United States Patent 9,061,059 (MODIFIED POLYNUCLEOTIDES FOR TREATING PROTEIN DEFICIENCY) - sequence listing, part 56

SEQ ID NO: 107651 - DNA, 702 bp, Artificial Sequence
  Description of Artificial Sequence: Synthetic coding sequence
atggccgccggcaccgccgtgggtgcctgggtactagtgcttagcctatggggcgcagtggtaggggcccagaacatcactgcaagaatcggcgaacccctcgtgcttaagtgcaagggtgccccaaagaagcccccccagcgactcgaatggaagttaaatactggtcgtacggaagcctggaaggtattaagtccgcaaggggggggtccttgggactccgtggctagggtgcttccaaatggaagcctgtttctgcccgctgtcggtatccaggatgaaggaatctttcgctgtcaggcaatgaacaggaatggtaaggaaacaaagagtaattaccgagtgagagtgtaccagatccctggaaagcccgaaatagtcgatagtgcttcggagctcacggccggcgtgcctaacaaagtcgtggaggagtcacgaaggtcacgaaaacggccttgcgagcaggaggtggggacctgtgtgagcgaaggaagttatcccgcagggactctctcatggcacttggacggcaagcctcttgtgcctaatgagaaaggcgtttctgtgaaggagcagactcggcgccaccccgaaacaggactgtttactctccagtcagaacttatggtgacacccgcccgcggaggcgacccaaggccaactttttcatgtagttttagccctggactgcctaggcattag

SEQ ID NO: 107652 - DNA, 402 bp, Artificial Sequence
  Description of Artificial Sequence: Synthetic coding sequence
atgaaagacggagtccccttgcccctgcccccatccccagtgctgatccttccggaaattggaccccaggatcaaggtacttattcttgcgtagcgacacacagttcccacggtccacaagagtcccgtgccgtcagcatcagcatcatcgagcctggcgaggagggccccaccgctggttcagtgggtggttctgggctgggtaccctcgctctagccttagggatcctggggggtctcgggacggccgcgcttctgatcggggtgattctgtggcagcggagacagcgtagaggggaagagcggaaagcccctgagaatcaagaggaggaagaagaaagggctgagctgaatcagagcgaggagccggaggcaggggaatccagcactggcggcccatag

SEQ ID NO: 107653 - DNA, 366 bp, Artificial Sequence
  Description of Artificial Sequence: Synthetic coding sequence
atggctgcaggaacagctgtaggcgcatgggtgctggtgctgagcctttggggcgccgttgtgggagctcagaatatcactgcccgcataggcgaacccctggtgctcaagtgtaaaggggctccgaaaaaacccccacagcgccttgagtggaaactcaatacaggaagaactgaagcatggaaggtgctgagtcctcagggaggcggcccatgggattccgtcgctagggttctgccaaatggaagcctgttcctgcccgcggtgggcattcaagatgagggaatctttcgctgtcaggccatgaataggaatggcaaggaaaccaaatcaaactggtggtggtctcaaaaggttgagcagtag

SEQ ID NO: 107654 - DNA, 1029 bp, Artificial Sequence
  Description of Artificial Sequence: Synthetic coding sequence
atggcagcgggtactgccgtgggcgcatgggtgcttgtcctttccttgtggggcgccgtggtgggggctcagaacataactgcaaggataggcgagccactggtgctgaaatgtaaaggcgccccgaagaagccaccccaacgattagagtggaagctgggagggggaccttgggatagcgtggcgagggtgttgccaaatgggtccctgtttctgccagctgttggcattcaggacgagggaatctttcgatgtcaagccatgaaccggaacggtaaagaaactaaatcaaactatcgcgtgcgagtttaccagatcccagggaagcccgaaatagttgacagcgctagcgagctgaccgccggagtgcctaataaggttgggacttgtgtgtctgagggcagttatccagccgggaccctgagctggcacttggacggcaagcctctggtaccaaatgagaaaggagtatccgtaaaggaacagacccgccgacaccctgagacaggtttgtttaccttacagtccgaactgatggtaaccccagctaggggcggagaccctagacccaccttcagttgctccttttcaccagggttgcctagacatagggctctccgaacagccccgatccagcctcgcgtctgggaaccagtgccccttgaggaggtacaattggttgtcgagcccgagggcggagcagtggccccagggggcaccgtgaccctgacttgtgaggtacccgctcagccctcaccccagatacactggatgaaggatgtttcggatttagaacgcggggctggccgcactagacgcgggggtgctaactgccggctctgcgggaggataagagcaggcaactcgagcccggggcctggagatcccggtagacccggcgatagccgacccgcccactgggggcacttggtagcaaaggccgcaactccaaggaggggcgaagagggcccccggaaacccggcggccgggggggcgcatgccgtactgaaagtgtggggggcacttag

SEQ ID NO: 107655 - DNA, 885 bp, Artificial Sequence
  Description of Artificial Sequence: Synthetic coding sequence
atgaacagaaacggaaaggagactaagtccaattaccgcgtccgggtatatcagatcccaggaaaacctgagatcgtcgattcagcgtcggagctgaccgcgggagtcccaaacaaagtaggaacctgcgtttcagaaggctcataccccgccggtacactgagctggcatttggacggcaagcctctggtccccaatgagaaaggggtaagtgtgaaagaacaaactaggcgacaccctgagactggccttttcaccctacagagcgaactgatggtgacccccgcacgaggaggggatcctaggccaacatttagctgttctttctccccaggactgccccggcatcgcgccctgcgtaccgccccaattcagccaagggtgtgggagcctgtacccctggaagaggtccagctggtcgttgaacctgaagggggagctgtggcacctggcggtacagtcacacttacatgtgaggtgccagcccaaccaagcccgcagattcattggatgaaagacggagtaccattgcctctcccaccatccccagtgcttatccttcctgagattggcccacaggatcaagggacctatagctgtgtggccactcattcaagccatgggccccaggagagcagggctgtatcaatcagcataatcgggtcggttgggggcagcggccttggcaccctagctttggccttagggattctcggagggctcggcacagctgccttgctcattggggttatcctgtggcagaggcgacagcggcgcggagaggagcgcaaagctcccgagaatcaagaagaggaggaggagcgtgctgagctcaaccagtcagaagaaccggaggctggagaatcaagtaccggcggaccttag

SEQ ID NO: 107656 - DNA, 1308 bp, Artificial Sequence
  Description of Artificial Sequence: Synthetic coding sequence
atgggggcaggcgaacgggtgcaggcccccccgagagctgaggctaccgctggccggggtgctgatagagcccggacgttggagggcagcaggatggcagctgggacagccgtcggcgcctgggtgctcgttttaagcctttggggggctgtcgtcggggcccagaatatcaccgcccgcattggtgagccactggtgcttaagtgtaaaggcgcccccaagaagcccccccagaggctggagtggaagctaaatacaggacgaactgaagcttggaaggtgctgtcccctcaggggggagggccatgggactctgttgccagggtgctgcctaatggttctctgtttcttcctgccgtggggattcaggacgaaggcatctttagatgccaggcaatgaaccgcaacggaaaggagacaaagtctaactatcgcgtgagggtgtatcaaattcctgggaaacctgaaattgtggatagcgctagcgagctgaccgctggcgtgccaaataaggtggggacttgtgtgagtgaaggctcatacccagcgggaaccttgagttggcatctggacgggaagccccttgtccctaatgaaaagggtgtctcagttaaggagcaaactcgcaggcatcctgaaacggggctttttactttgcagtcagagctgatggtaactcctgctcgcggtggtgaccctcgtcctaccttcagctgtagtttctctcctggcctgcccaggcatcgagctctcagaaccgccccgattcaaccacgcgtgtgggaacctgtgcccctggaggaggtgcagcttgtggttgagcccgagggcggagctgtggccccaggcgggaccgtgacactcacatgtgaagttcccgcgcagcctagcccccagatccattggatgaaggacggcgtacccctcccacttcccccctcccccgtcttgatccttcctgagattggacctcaagaccaaggtacttatagttgtgttgctactcattcttcacacgggcctcaggagtcacgagcagtctcgatttcaatcatcgaacccggcgaggagggcccgaccgcgggatcagtaggtgggtctggtctgggcacactggccttggccctcggcattctgggaggtctaggcacggctgcgctgctgattggggtaatcttatggcaaaggcgccagcgacgtggagaggagcggaaggcccctgaaaatcaggaggaagaagaggagagagcagaacttaaccagtcagaggaaccggaagcaggggaaagtagcactggggggccttag

SEQ ID NO: 107657 - DNA, 1215 bp, Artificial Sequence
  Description of Artificial Sequence: Synthetic coding sequence
atggccgccggaaccgccgtcggcgcttgggtcctggttttgagcctctggggagccgtggttggtgcccagaacatcacagcacggatcggcgagccccttgttcttaaatgcaaaggcgccccaaagaaacctccacagcgcctagagtggaagctgaatacaggcaggaccgaggcttggaaggtcctgtccccgcagggcgggggaccgtgggactcagtcgcaagggtgctgcccaacggatcactgttcttgcccgcggtgggcatacaagacgagggcatctttcgctgccaggccatgaaccgcaatggcaaggaaaccaagtcaaattaccgcgtacgggtctatcagatccctggtaagccagaaatcgtggactccgcaagtgaactaacagccggcgttccgaataaagtcggtacttgcgttagcgaaggctcctatcctgcggggaccctgagttggcacctcgacggtaaaccattagtcccgaacgaaaaaggcgtatcagtaaaagagcaaaccagaagacaccccgagacaggtctatttaccctacagagcgaactcatggtgacacccgcgagaggcggcgaccctcgaccaacattctcctgctcttttagtccagggctgcctaggcatcgtgccctgcggacagctcccattcagcctcgcgtctgggagccagtgccccttgaggaagtgcagttggttgtggaacccgaggggggcgccgtcgccccaggtggtactgtgaccttgacctgcgaggtcccagctcagccctccccgcaaatacattggatgaaagacggggtgcctctgcctttgcccccttccccagtccttattctgccagagattgggcctcaggatcagggcacatatagttgtgtcgctacccactctagccacggccctcaggagtcaagagcagtgtcaatttccatcatcgagcccggagaggaggggccaactgccggcagtgttggtggctcgggtttggggacgctggcacttgcactcggcatcctggggggactggggactgcggctcttctgatcggtgtaatcctgtggcagcgacgacagcgccgcggggaagagcggaaagctcccgagaaccaagaagaagaggaggaacgggccgagctgaatcaatcggaggagccagaagccggggagagctctactggggggccctag

SEQ ID NO: 107658 - DNA, 1044 bp, Artificial Sequence
  Description of Artificial Sequence: Synthetic coding sequence
atggccgccggcactgccgtcggcgcctgggtcttggtactgtccctgtggggagctgttgtcggggctcagaacattacagcgcgtattggggaaccactggttctgaagtgcaagggagcccctaagaagcccccacaaagactcgaatggaagctgaataccggcaggacggaggcttggaaggttctgtccccccagggcggcggcccatgggattctgtggccagagtgctcccaaacggctctttgttcttacctgccgtgggtatacaggacgagggcatcttccgttgccaggccatgaacaggaatggcaaggagacaaagtcaaactatcgcgttagggtgtatcagattcccggcaagccggaaatcgttgactccgcatccgagcttacagccggtgtcccaaacaaggtaggcacctgcgtctctgaaggctcatatcccgccggcactctaagctggcaccttgatggcaaacctctggtgcccaacgagaagggggtgtctgtgaaagagcagacgaggcgtcatccggagactggcctgttcacacttcaatccgaactcatggtgacaccggccaggggcggggatccccgccccacgttcagctgctccttctcgccgggcctgcctaggcatcgcgccctaaggacagctcctatccagccacgcgtgtgggagcctgtaccactggaagaagtccagctggtagtcgagcccgagggcggcgccgtcgcccctgggggcaccgtcaccctgacatgcgaagtgcccgcgcagccatctcctcagatccactggatgaaagacggtgtgccattgcctctcccgccctctccggtgttgatcctgcccgaaatagggccacaagaccaagggacatacagctgcgtggcgacccactcctcgcacggcccacaggagtctcgcgcagtgtccatttcaattattgagccaggtgaggagggaccgaccgccggggaagggttcgataaagtgcgtgaagctgaagatagccctcagcacatgtag

SEQ ID NO: 107659 - DNA, 1029 bp, Artificial Sequence
  Description of Artificial Sequence: Synthetic coding sequence
atggctgcagggaccgccgttggagcctgggtgcttgtcttgtcactctggggagcagtcgtgggggcacagaatatcaccgcccgaatcggggaaccactcgtcctgaaatgtaagggggcacccaaaaaacccccacaacgactcgaatggaaactgggtggcggaccatgggactcagtggccagagtcctgcctaatggatcactcttcctgccagccgtcggcatccaggatgaaggcatcttccgatgccaagccatgaacaggaacggaaaggagaccaagtccaactatcgcgttcgcgtctaccagattcccgggaaaccagaaatcgtagactcagcttccgagcttacagcaggagtccccaacaaagttgggacgtgcgttagtgaaggctcttacccagcagggaccctgagttggcatctggacggcaagccactggtaccgaacgaaaaaggggtgtctgtgaaggagcagactcggcgccacccggagaccgggctctttactcttcagtccgagctcatggtgacgcctgccagaggaggcgatccacggcctaccttcagctgcagtttttcccctggactccctcgacatcgtgcactgcggacagcgcccattcaaccacgagtatgggagccggttcctctggaagaagttcaactcgtcgtagagcccgagggaggagctgttgcccctggcggcactgtgacactaacgtgtgaagtgcccgcacagccaagtccacagattcattggatgaaggatgtcagcgatctggaacgaggcgctggccgcaccaggcggggcggcgccaactgcagattgtgcggacgaatacgggccggcaacagcagtcctggacctggcgatcccgggaggcctggtgattcccgcccggcgcattggggtcacctggttgcaaaggcggccacccctagacgcggcgaggaggggcctaggaagcccggtggtcgcggcggtgcatgtaggacagagtccgtgggtggcacctag

SEQ ID NO: 107660 - DNA, 1029 bp, Artificial Sequence
  Description of Artificial Sequence: Synthetic coding sequence
atggccgctgggactgccgtgggggcctgggtgttggtactgagcctctggggtgccgtggttggagcccagaacataacagcgaggataggtgaaccattggtactaaaatgcaaaggagcccccaaaaaaccacctcaacggctggaatggaagcttggtgggggaccctgggattccgtagccagagttctgccgaatgggtccctgttcttacccgccgtcggtattcaggacgagggtatattccgctgtcaggcaatgaatcgcaatgggaaagagacaaaatccaattaccgagtgcgggtgtatcaaatcccaggcaaaccggagattgtcgactccgccagcgagcttacagccggcgtgcctaacaaggtgggaacatgtgtttcagagggctcttatcccgccgggactctgtcctggcacctggacggaaagccccttgttcccaatgaaaagggagtgagcgtcaaagagcaaacccgtcggcacccagagaccggcttatttacacttcagagcgaactaatggttactcctgctcggggtggggaccctcgccccaccttcagttgtagctttagtccaggattgccgcgacaccgagctctgcggactgcccctattcagccgcgggtctgggaaccagtgcccctcgaagaggtccagcttgttgtagagcccgagggcggggccgtcgctccgggcggaacggttacgctaacatgcgaagtgcccgctcagccctctccacagatccactggatgaaggatgtgtctgacctcgagcgcggtgctggcagaacaaggcgaggcggcgcaaattgccggctttgtgggaggatcagggccggtaattccagtcctggaccaggcgatcctggtcgacccggagactcaagaccagcccactggggccatttagtggccaaagccgccacacctcgtcgtggcgaagagggtcccagaaagcccgggggaagggggggagcatgtcgcacagaaagcgtgggaggcacatag

SEQ ID NO: 107661 - DNA, 702 bp, Artificial Sequence
  Description of Artificial Sequence: Synthetic coding sequence
atggctgcaggtacagcggtgggagcttgggtgctggttctgagcttgtggggagctgtggtcggtgctcaaaacataacggctcgcataggagaacccctggtactcaaatgcaagggcgctccaaagaaaccccctcagagacttgagtggaaacttaatacaggaagaacggaggcctggaaagtcctctccccacagggaggcggcccttgggactccgtggcccgcgttctgccaaactctagtctttttctacctgctgtggggatccaggacgaaggcatcttcagatgtcaagcaatgaatagaaacggcaaagaaacgaaatccaactacagggtacgggtttatcagattccgggcaagccagagatcgtggactccgcgtctgaactgacagcaggagtgcccaacaaagtggtggaagagagccggcgttcgcggaagcgcccttgcgaacaggaggtcggcacctgcgtgtctgaaggctcatatcccgccggtaccttaagctggcacctggatggtaagcctctggtgccgaatgagaagggcgtcagtgtgaaggagcagactcgaaggcaccccgagaccggactttttactctccaatcagagttgatggtgacacccgcacgcggtggggaccctcggccaacgttttcctgctccttttcacccgggctcccacgtcattag

SEQ ID NO: 107662 - DNA, 705 bp, Artificial Sequence
  Description of Artificial Sequence: Synthetic coding sequence
atggccgcagggactgctgtaggggcttgggttttggttttgagcctctggggagcagtggtgggggctcagaatatcactgcgaggatcggagagcctctcgtgttgaaatgcaaaggcgctcctaagaagcccccgcaaagacttgagtggaaactcaataccgggaggaccgaggcctggaaggtgctgagcccccagggcggagggccatgggattctgttgcaagagtgctgccgaacggcagcctgttcttgccagcagtaggaattcaagatgaaggaatttttagatgtcaggcaatgaatcggaacgggaaggagaccaaaagtaactaccggtcactccgtacctttaccattactgcatctgactggatttttccgccatccgaaatacccgggaagcctgaaattgttgatagtgcctccgagctgacagctggggtgcccaacaaggttggcacatgtgtatccgaaggaagctacccagcgggaaccctgagttggcacctggatgggaagcctttagtgcctaatgaaaagggagtgtccgtcaaggagcagactcgccgccatccagagacaggtctgttcactctgcaatcggaactgatggtaactcctgcacggggaggcgatcctaggcccaccttctcatgctcatttagccctgggttaccacgccaccgagctctgcgctag

SEQ ID NO: 107663 - DNA, 705 bp, Artificial Sequence
  Description of Artificial Sequence: Synthetic coding sequence
atggccgctgggacggccgtgggggcttgggtgctcgtcctgtcactttggggtgccgttgtcggggcacagaatattacagccaggataggcgagccgctggtgctgaagtgcaagggcgccccgaagaagccaccccaacgtctggagtggaagctgaatacaggaagaacggaagcctggaaggtcctgtccccacagggcggggggccctgggacagcgtggcccgcgttttacccaacgggtcactgtttctgccagcagtaggaatccaagatgaaggcattttcagatgtcaggctatgaataggaatggaaaggagacaaagagcaactaccgcagcctgcgaaccttcaccatcacggcctccgactggattttccccccctccgaaatccccggaaaaccagagatcgtcgattccgcatctgagcttaccgcaggcgttccaaataaggtggggacttgcgtatctgaaggatcgtacccggcaggaactctgtcctggcacctcgacggtaagcccctcgtgcctaatgaaaagggagtttcagtgaaggaacaaaccaggagacatcccgaaactggcttgttcaccctgcagtctgaactcatggtgactcccgcacgaggaggcgaccccaggccgacgttctcctgttccttctcacctggactccctagacatagagctctccggtag

SEQ ID NO: 107664 - DNA, 702 bp, Artificial Sequence
  Description of Artificial Sequence: Synthetic coding sequence
atggctgctgggaccgcggtgggggcttgggtcttagtcctatctctgtggggcgccgtcgtcggtgcacagaacatcacggcacgcataggcgagcctctggtcctgaaatgtaagggggctcccaagaaacctccccagcgcctggagtggaagcttaacacaggaagaaccgaggcctggaaagtactttctccgcagggggggggtccatgggattctgtcgctagggtgctaccgaatggctctctgttcctgcctgccgtagggatccaggatgagggcattttccgctgccaggccatgaatagaaatgggaaagagactaaaagcaactatagggtcagggtgtaccagatacctgggaagcctgaaatcgtggactctgcctcagagctcacggctggagtccctaataaagtcgtggaggagtccaggcgcagcagaaaaagaccctgcgagcaggaggtgggcacctgcgtctcggaaggtagttatccagcggggactctctcttggcatctggatggtaagccactagtaccaaatgagaaaggggtcagcgtcaaggagcagacacggagacatcccgagacagggctcttcacattacaaagtgaattaatggttaccccggctcgcggaggtgacccaagacccacattctcctgttcattctctcctgggctgccccgccactag

SEQ ID NO: 107665 - DNA, 1215 bp, Artificial Sequence
  Description of Artificial Sequence: Synthetic coding sequence
atggccgctggcaccgcagtcggcgcctgggtactggtactcagcctatggggcgcggtggtgggcgcccagaacataacagctagaataggtgaacccctggtcctgaagtgcaaaggcgcaccgaagaaaccacctcagaggctggaatggaaactgaataccggcaggaccgaggcctggaaagtgctaagtcctcagggcggaggaccctgggatagtgtcgctcgcgtcctcccgaattcatcgctctttctgcctgctgtcggaatacaggacgaagggatttttaggtgtcaggccatgaaccgcaacggtaaagaaaccaaatctaactacagggtccgcgtctatcagatacctgggaaacccgaaatcgtagattccgcgtctgaattaaccgccggagtgcccaacaaggtaggtacgtgcgtgtcagagggatcctaccctgcagggacactctcttggcacctcgatggcaagccactggtgccaaacgaaaaaggcgttagtgttaaagagcagactcgcaggcaccccgaaacagggctgtttaccctacagtcagagctgatggtgacccccgcccgcgggggagatcctaggccgacgtttagttgctccttctcccccggcctccccaggcaccgcgccctaagaacggctcctatccagcctcgcgtgtgggagccagttcctctcgaggaagtgcagctcgttgtggaaccagagggcggggcagtggcgcccggcggcacggtgacactgacctgcgaggtgcccgcccagcctagtcctcaaatccactggatgaaagacggagtgccgttaccactgccaccctctcccgtgctgattctgcccgagatcggtccccaggatcaagggacttattcctgtgtagccacccactctagtcatggaccccaggagagccgagctgtgtccatctctatcatcgaacctggcgaggaagggccgaccgccgggtctgtcggcggcagcgggcttggtactttggcactggcccttggcattctcggcggactggggacagccgcgctgctgatcggggttattctatggcaaagacggcaacgacggggagaggagcgtaaagccccagaaaaccaggaggaggaggaggagagagccgagctcaatcagtctgaagaacccgaagccggagagtcctccactggcggcccatag

SEQ ID NO: 107666 - DNA, 1044 bp, Artificial Sequence
  Description of Artificial Sequence: Synthetic coding sequence
atggccgccggcaccgctgtaggtgcttgggtcttagtactcagcctgtggggagcggtggtgggcgcacaaaatattactgcccggataggagagcctctcgtccttaaatgcaaaggcgccccaaagaagccaccacagcgactggaatggaagcttaatacagggagaacagaggcctggaaggtcctgagcccacaaggtggtggaccctgggactccgtggcccgcgttctcccgaacgggtcgttgtttctcccagccgtgggtattcaggatgaaggcatatttcgctgccaagctatgaaccgtaatgggaaagaaacaaagtcgaattacagggtaagagtgtaccaaatccccggaaagccggagatagttgatagcgcctcagaactgactgctggggtgcctaataaggtagggacttgcgtgagcgagggctcttatcctgcagggactctgtcttggcaccttgatgggaagccattagtcccaaacgagaaaggagtctcagtaaaggagcagactaggaggcaccctgaaacaggactctttaccctacagtctgaattaatggtgaccccggctcggggaggagaccctcggcctactttctcatgttcgttttctcccggtcttcccagacatcgtgcattgcgcactgcaccgattcaaccaagggtgtgggagccagttcctcttgaggaagtccagctggtcgtcgagcccgagggcggggctgtcgctcccgggggcactgtcacgctgacttgtgaggtgccagcccagcctagcccccagatacactggatgaaagatggcgtccctctcccgcttccccccagccccgttctgattctgccggaaatcggcccacaggaccaaggaacctatagctgcgtcgcgacgcattctagccacgggcctcaggagtcgcgagcagtaagtatttcgatcattgaacccggcgaggaagggccaacagccggcgagggcttcgataaagtacgcgaggcagaggactcaccccagcacatgtag

SEQ ID NO: 107667 - DNA, 702 bp, Artificial Sequence
  Description of Artificial Sequence: Synthetic coding sequence
atggcggccggcaccgcagtgggtgcgtgggtgctggtgcttagcttgtggggagccgtcgtgggcgcccagaacataacagctcgcatcggcgaacccctggtgcttaagtgcaagggtgctcccaagaagccgccccaacggctagagtggaagctgaatacgggccggacggaagcgtggaaagtactctctccacaaggtggggggccttgggacagcgtggccagagtgctacccaacggctcactgtttctgcccgccgtgggtatccaagatgagggcattttccgatgccaagcaatgaatagaaacgggaaggaaactaaaagtaattaccgcgttcgtgtctatcaaattcctgggaagcctgagatcgtggacagcgcatcagaactgacagcaggagtgccaaacaaggtggtagaggagtcaaggcggtctagaaagagaccatgcgagcaggaagtgggcacctgcgtgtccgaggggtcctatcctgctggcaccctttcttggcacctcgatggaaagcccctggtgccgaatgaaaagggcgttagcgtgaaagagcagacacgtaggcaccccgagacaggtctattcaccctgcagtctgagcttatggttactcccgccagaggtggggacccaaggcccactttctcttgttccttttcccccggcttaccccgccattag

SEQ ID NO: 107668 - DNA, 1215 bp, Artificial Sequence
  Description of Artificial Sequence: Synthetic coding sequence
atggccgccggcacagctgtgggcgcctgggtactagtcctatctctttggggtgcagttgtgggagcacagaacattacggccagaatcggagagccccttgtcttgaagtgtaagggggcgccgaagaagccccctcagaggctcgagtggaaactcaatacaggccgtactgaggcctggaaagtcctgtctccccaggggggagggccttgggactccgtagcacgcgtactaccaaatggatccttgtttttaccagcagtaggtatacaggacgagggaatcttccggtgtcaggccatgaatcgcaacgggaaggagacaaagtccaattacagagtaagggtgtatcagatcccagggaagccagagatcgtcgactcagcttccgagctgaccgcgggggttccaaataaggtggggacctgcgtgtcagagggcagttaccctgcaggtactttgagctggcacctggatggtaagcccctcgttcccaatgaaaaaggggttagcgtgaaagagcagactagacgccaccccgaaaccggcctgttcacactacagtctgagctgatggtgaccccggcccgcggaggcgatccccgtccaaccttcagctgttcatttagcccaggattgcctaggcacagagccttacgaacagccccaatccagcctcgcgtctgggagcccgtccccctggaggaggtgcagcttgtcgtggagcctgagggcggcgccgtcgccccaggcggaaccgtgactctcacctgtgaggtccctgcccagccctctccccagatacattggatgaaagatggagtgccactccctctgccccccagtcctgttttaattctaccagaaataggaccccaggaccagggcacttattcatgcgtggcaacccactcaagtcacggtcctcaggaaagtcgcgccgtgtctatctctatcattgagcctggggaggagggacccacggctggatctgtggggggtagcggcctggggaccctcgctctggccctgggaatcctgggaggtctcggtacggcagccctgctgataggtgtgatcctctggcagagacgtcagcgccgcggtgaagagcgaaaggcgcctgaaaaccaggaggaggaggaggaaagggccgaattgaatcagtctgaagaaccggaagctggcgaatcatcaactggcgggccttag

SEQ ID NO: 107669 - DNA, 705 bp, Artificial Sequence
  Description of Artificial Sequence: Synthetic coding sequence
atggctgccggcactgcagtgggggcgtgggtacttgtgttaagcctatggggcgccgtggtgggggcgcagaatattaccgctagaattggagagccattagtgcttaaatgtaagggggcccccaaaaaaccccctcagcgccttgagtggaaactcaataccggccggaccgaagcctggaaagttttatccccacaaggaggcggaccttgggacagtgtggccagggtccttccaaacagctcactgtttctccccgctgtcggcatccaggatgagggcatttttcggtgccaggcaatgaatcgtaatggaaaagaaaccaaatcgaactatcggtccctgagaactttcaccattacagcatctgactggattttcccaccgtctgagatccccgggaagccagaaattgtggattcagccagtgagctaaccgcaggagtcccaaataaggtcggaacttgtgtatccgaaggatcataccctgctggcaccctgtcgtggcatttagatggaaaacctctggttcctaatgaaaagggggtgtcggtcaaagagcaaactcgcaggcaccccgaaacagggctatttacactgcagtcagagctgatggtgacccccgcccgggggggtgaccctcgacctacattctcctgcagcttctcaccagggcttccccggcacagggctctgagatag

SEQ ID NO: 107670 - DNA, 1092 bp, Artificial Sequence
  Description of Artificial Sequence: Synthetic coding sequence
atggctgctgggaccgcagtgggcgcttgggtgctcgtgcttagcctctggggggcagttgttggcgcacagaatatcacagcccgcataggagagcctcttgtgctcaagtgtaagggcgcacctaagaaacccccacagcggctggagtggaagcttaacactggcagaactgaggcctggaaggtcctctcacctcagggcgggggtccctgggacagcgttgcgcgcgtgctgcccaatggcagcctgttcctgccagcagtgggcatacaggatgaaggcattttcagatgtcaggctatgaatagaaacggcaaggaaactaaatcgaattatagggtcagggtctaccaaatccccggcaaaccagagatcgtcgactccgcttctgaattgactgctggtgttcccaataaagtggttgaagaaagtcgtaggtctcgcaaaaggccctgcgagcaggaggtggggacatgcgtgagtgagggttcctacccggccggaaccttgtcctggcacctagatggcaagccactcgtccctaatgaaaaaggtgtttccgtgaaagagcagactcgtcgacacccagaaaccggccttttcactctccagtccgagttaatggtgacccctgcacggggcggcgacccccggccgaccttctcctgctcctttagcccagggcttcctcggcatagagctttgcgcaccgcccctattcagccacgggtgtgggagcctgttccattggaggaagtgcaactcgttgttgaaccagagggtggcgccgtcgcgcctggcggtaccgtgacgttaacatgtgaagtgcccgcccagccaagcccccagatccactggatgaaagacggcgtaccattgcctttacctccaagtcccgtacttatcttaccagaaattggcccacaggatcaggggacttactcgtgcgttgccactcactctagtcacgggccccaagagtcccgagctgtgtccatcagcataatcgagccaggcgaagaggggcccacggccggagagggcttcgacaaagttcgcgaggctgaggactcccctcagcacatgtag

SEQ ID NO: 107671 - DNA, 1029 bp, Artificial Sequence
  Description of Artificial Sequence: Synthetic coding sequence
atggccgccgggaccgcagtgggcgcatgggttctagtactgagcctgtggggagccgtagttggcgcacaaaacattacagcacgcatcggtgagccgttagttctcaagtgtaaaggcgccccaaagaaaccacctcagaggttagagtggaagctgggtggcgggccttgggactcagtggctagagtcttgcctaacggtagcctgtttctgcccgccgtaggcattcaggatgagggcattttccgttgccaggctatgaaccgtaatggaaaggagaccaaaagcaactatagggtgagggtctaccaaattcctggaaagccagaaattgtcgatagcgcatctgaactgaccgccggggtgcctaacaaggtcggcacgtgcgtttcggaaggtagttaccccgcaggcaccctctcttggcatctagatggcaagccactggtgccaaacgagaagggggtatcggtcaaagaacaaacaagacgccatcctgaaacagggctcttcacgctgcagagcgagctcatggtgacccccgccagaggtggagatcctcgccctaccttcagttgttctttttctcctggccttccaagacaccgtgctctcaggaccgccccaattcagccgcgcgtttgggagccagtgccgctggaggaggtccagctcgtggtggagcccgaggggggcgctgtggcccccgggggaacagtcactctgacttgcgaagttccagctcagccaagccctcagatccattggatgaaagacgtgagcgatctagaaagaggcgccggacggacacgtcgcgggggggctaattgtagactctgcggtcgcatcagggctggcaattccagtcccgggcctggagaccctggaagaccaggtgacagccgccctgcacattgggggcacctcgtcgccaaggcagctactcctcgaaggggggaagagggcccccgtaaacctggcggccgaggcggggcatgccgcacagagtccgtcggtggcacttag

SEQ ID NO: 107672 - DNA, 702 bp, Artificial Sequence
  Description of Artificial Sequence: Synthetic coding sequence
atggccgcaggtaccgccgtcggagcatgggtcttagtgctcagcctctggggggcggtcgtgggtgctcagaacattaccgctagaatcggggaacctctggtgctaaagtgcaagggggcacctaagaaacccccccaacggcttgagtggaaattgaatacggggcgaaccgaggcttggaaggtgttaagcccccagggcgggggcccttgggacagcgtcgctcgcgtactccctaacgggagtctgtttctgcccgccgtgggtattcaggacgaggggatcttccgatgccaggctatgaacaggaacgggaaggagacaaagtcaaattaccgagtgagagtgtaccagatacccgggaagcccgagatcgtagacagtgcctcagagttaacggccggagtgccaaacaaggtggttgaggaatctcgaaggagtcggaaacggccctgcgagcaagaggtgggaacgtgtgtgagcgagggatcttatcctgccggcacactttcctggcacctggacgggaagccactcgtgccaaatgagaagggagtgtctgtcaaagaacagactagacgacatccagagaccggacttttcaccctgcagagcgagttgatggttacacctgccagggggggtgacccaagaccaaccttctcttgttcattctcaccagggctgccgcgccactag

SEQ ID NO: 107673 - DNA, 1029 bp, Artificial Sequence
  Description of Artificial Sequence: Synthetic coding sequence
atggctgcaggcacagctgtaggagcatgggtgttggtcttgtccctgtggggagcagtcgtgggtgcccaaaatatcaccgctagaatcggcgagcctctggttctaaagtgcaagggagcgcctaagaagccgcctcagcgtttggagtggaaactgggaggtggcccctgggactccgtcgcacgggtgttacctaacggaagcctctttctcccggccgtcggcatccaggacgaagggattttcagatgccaggcgatgaaccgtaatgggaaggaaacaaaatctaactacagggttagggtctaccagatacccggcaagcctgaaattgttgattccgcatccgagctgaccgccggcgtgccaaacaaagtggggacgtgtgtctcagagggaagctatcctgctgggaccctgtcctggcatctggacggaaagcccctcgtccccaacgagaagggtgtgtctgtaaaggaacagacccggcggcacccagagaccggcctttttacactccaatccgaattgatggtcactccagcaagaggtggcgacccaaggcccactttcagctgttctttctccccaggcctgcctaggcatcgcgcactgcgcacagcacccatccaacctagagtttgggaacccgtgcctttagaagaagttcaactggtggtagaacctgagggcggtgctgttgcccccggcggcaccgttacattgacatgcgaggtgccagcccagccgtctccccagatccattggatgaaagacgtgtccgatttggaacggggggcgggcagaactaggcgcggtggagcaaattgccgcctctgcggccgtatccgtgccggaaactcctctcctggccctggagatcccggacggcctggggattccaggcctgctcattggggtcatttggtggctaaggctgccaccccgcggcgcggagaagagggcccccgcaaacccggcggccgcgggggcgcctgtcgaacagaaagcgtcggtggaacctag

SEQ ID NO: 107674 - DNA, 705 bp, Artificial Sequence
  Description of Artificial Sequence: Synthetic coding sequence
atggctgcgggcaccgccgtcggcgcctgggtgctggtactatccctgtggggcgccgtagtcggcgcccagaatataaccgctcgaataggcgagcccctcgttctaaaatgcaagggtgcacctaaaaagcctccacagcgtctggagtggaaattgaatactggccgtactgaagcatggaaggtcctctcccctcaaggaggtggaccctgggacagcgtcgcgagagtcctgccaaatggttctctctttctgcctgccgtgggaatccaagacgagggaattttccgctgtcaagctatgaatcgaaacggcaaagagacaaaaagcaactacaggtcgctgcgcactttcactattaccgccagcgattggatatttccgccctcagagatacctggaaagcctgagatcgtagactcagcaagcgagcttacggctggcgtcccaaataaagtaggtacttgcgtcagcgaggggtcttacccagcaggcactctctcgtggcacctggatgggaaaccgctggtcccgaacgagaaaggcgtgtccgtgaaggagcagacacggcggcatcctgagaccggattattcaccctgcaatcagagttaatggtcactccagccagggggggcgatcctcggccaaccttctcatgctcatttagtcctggcctcccgagacaccgggctttaagatag

SEQ ID NO: 107675 - DNA, 1215 bp, Artificial Sequence
  Description of Artificial Sequence: Synthetic coding sequence
atggccgccggaacagcagtgggggcctgggtactcgtcctttcactgtggggggccgtggtgggtgcccagaatataacagctagaatcggtgaaccactcgttttaaagtgcaaaggcgcgccgaagaaacccccacaacggctggagtggaagctgaacactggacgcaccgaggcctggaaggtgctctcccctcagggtgggggtccatgggacagcgtggccagagttcttcctaatggaagccttttcctacccgccgttggtatccaggatgaggggatatttcgttgccaagcaatgaataggaacgggaaagagaccaagagtaattatcgggtgcgagtgtaccagattcccgggaagccggaaatcgtggactccgctagtgagctcacagccggcgtccccaataaggtcggcacctgcgtgagcgaaggttcctatcccgccggaaccctgagttggcacctcgacgggaagccgctcgtgcccaatgagaagggcgtgtccgtgaaagagcagacacgaaggcatcctgaaacagggctctttactttacaatccgagctgatggtgacccctgcacgcgggggagatccccggcctacattttcatgctctttcagccccggcctgcccagacacagagcactaagaaccgcgccgatacagcctcgggtgtgggaacccgtccccctagaggaggttcagcttgttgttgaacctgaaggtggcgcggttgcaccgggagggacagtgaccttgacttgtgaggttcccgctcagccttcgcctcagatccactggatgaaagatggtgtgccacttcctcttcccccctcccccgtgctcatcctgcccgagattggtccccaggatcagggcacctactcatgtgtcgctacacactctagtcacggcccccaggaaagtagggctgtgtctatcagcatcatcgaacctggggaggaggggcctacggccggcagcgtgggtggaagcggtcttggtacattagccttggctttggggattctgggcggcctggggaccgcagctctgctgatcggcgtgatcctttggcaacgccgtcagagacgcggggaggagcgcaaggcccccgaaaaccaggaggaggaggaggagcgagccgagctaaaccaaagcgaagagccagaggccggcgagagctcaacaggagggccctag

SEQ ID NO: 107676 - DNA, 1029 bp, Artificial Sequence
  Description of Artificial Sequence: Synthetic coding sequence
atggccgctggaacagccgttggagcttgggtcctggttctgtccctttggggagccgtggttggagctcagaacattacagcaagaataggagaaccactggtgctgaaatgcaagggagcccccaagaagcctccacagcggcttgagtggaaacttggcggcggtccctgggatagtgttgctagggttctcccaaatagcagcctgtttcttcccgctgtggggatacaggatgaggggatctttcgttgccaagccatgaataggaatggcaaggaaacaaagtcaaactaccgggttcgggtgtatcagatccccggcaagccagaaatcgtggattccgcatcagaactcacagcgggagtccccaataaggtaggaacttgtgtttcggaaggttcatatccagccggtacattaagttggcacctagatgggaagccattagtgcctaatgagaagggtgtgagcgtcaaggaacagacgaggcggcaccctgaaactggactattcaccctacagtcagaactgatggtgacaccggccaggggtggagaccccaggcctacattttcttgctctttttcgcccgggctccctagacatagggcattgcgcactgctccaatccagcctcgagtttgggagccggtcccacttgaggaagtgcagctagtggtagagcccgaggggggagctgttgcgccgggcggtacggtgactctcacgtgtgaggttcctgctcagcctagcccacagatccattggatgaaggacgtctcggacttggagcgaggcgcaggtagaacgcgccggggcggagccaactgtcgcttgtgtggacggattagggccggaaattcatctcccggacccggcgaccccggtcgccctggggatagccgtcccgcgcattggggacatctagtggcaaaggctgcgactccccgccggggagaagaaggacctcggaaacccggaggcagaggaggagcatgcaggacagaatccgtgggcggcacctag

SEQ ID NO: 107677 - DNA, 1044 bp, Artificial Sequence
  Description of Artificial Sequence: Synthetic coding sequence
atggccgccggaacggctgtaggagcttgggtgcttgttctttctttatggggcgcagtggtaggcgcccagaatattactgctagaataggtgagcctttggtcttgaagtgtaagggcgcccccaagaagcctccccaacgcctggagtggaagctgaatactggcagaacagaagcttggaaagtgctttccccccagggaggtggtccttgggatagcgttgccagagtgctccccaatggatccttatttttgcctgctgtgggaatccaggatgaaggtatctttaggtgtcaggcgatgaaccgtaatggcaaagagaccaagtcaaactaccgcgtaagggtttaccagatccccggaaagcctgaaatcgtcgattccgcctcagaacttaccgccggagtgcctaacaaggtaggcacctgcgtcagcgagggctcatatcccgccgggactctgtcttggcacctggatggaaagccccttgttccaaatgaaaaaggggtgagtgtcaaagaacagacccgacggcaccctgagacagggctcttcactctccaatccgagctgatggtcacaccggcccgcggaggggaccctaggccaacattcagctgttctttcagccccggactgcctaggcatagagcgctccggaccgccccaatccagcctcgcgtgtgggagcccgtgcccctggaggaagtgcaactggtcgtcgagcctgagggcggcgctgtagccccaggtggaaccgtgactcttacatgtgaggtgcccgcacagccgtcgccacagattcattggatgaaggatggcgtgccactcccattgcctccaagcccagttcttattttacctgagataggtccacaggaccagggcacttactcctgtgtcgctacacatagcagtcacggaccacaggaatctcgtgctgttagtatatcgatcatcgagccaggcgaagagggccccactgctggggaggggtttgataaggttcgagaggccgaagattctcctcagcacatgtag

SEQ ID NO: 107678 - DNA, 705 bp, Artificial Sequence
  Description of Artificial Sequence: Synthetic coding sequence
atggcagcaggcaccgcggtaggggcatgggtgcttgtcctttccttgtggggggctgtggttggagcgcagaatattaccgcgcgcattggcgagccactggtgctgaaatgtaagggcgcccctaagaaacctcctcagcggttggaatggaaactgaacactgggcggaccgaggcctggaaagtgctctctccacagggcggagggccctgggactccgtggctcgcgtcttacccaatgggagtcttttcttgcccgctgtgggcatccaggatgaggggattttccgctgtcaggcgatgaatcgtaacggtaaggagaccaaatctaattataggtcccttcggactttcaccattactgcttcagattggatatttccaccttctgagatccctggaaaacccgagattgtcgactcggcttccgagctgaccgctggcgttcctaacaaagtgggaacatgtgttagcgagggatcatacccagccggcacactctcctggcatctggacgggaaacctcttgttcctaacgagaagggagtatcggtgaaagagcagactcggagacatccagaaacaggcctgtttactttgcagtccgaactcatggtgacgcccgctcggggtggcgatcccagacccacattctcttgctccttttcaccgggactgccacgccaccgtgcattgcgatag

SEQ ID NO: 107679 - DNA, 1215 bp, Artificial Sequence
  Description of Artificial Sequence: Synthetic coding sequence
atggccgcggggacggctgtcggggcatgggttttggtcctcagcctgtggggggcagtagtgggcgcccagaacatcaccgcccgcatcggcgagccgttggtcctgaagtgcaagggagccccaaagaagccaccacagcggttggaatggaaactgaacacaggcaggaccgaggcctggaaagtgttaagtccacagggggggggaccctgggactctgtggccagagtgctgcccaacggttctttgttcctcccggcagttgggattcaggatgagggcatcttccggtgccaagccatgaatagaaatggcaaagaaaccaagagtaactaccgcgttcgtgtttaccagattccgggtaagcccgagatagtagattccgcaagtgagttaacagccggagtacctaacaaggtgggcacatgcgtctccgaaggaagctatccagcaggcaccttaagttggcatctcgacggcaaacctctggtccctaatgagaagggcgtttccgtcaaagagcagaccaggcgtcatcccgaaacggggctgtttacattgcagagtgagctcatggtcacccctgcacgcggtggagacccacggcctacgttctcgtgcagtttcagtcccgggttgcctaggcatagggccctgcggaccgcacctattcagccaagggtctgggagcctgtacctctcgaggaggtgcagttagtcgtggagcccgaaggcggggcagtcgctcccgggggaacggtcactttaacttgtgaagtgccagcacagccttccccacagatccattggatgaaggacggcgtcccattgccactgccaccgtcacctgtgctaattctgcctgaaatcggacctcaggatcaaggcacttacagttgtgtggccacacactcgtcccacgggccccaggagtcccgcgccgtctccatctccattattgaaccaggcgaagagggccccaccgccggaagcgtcgggggctctggcctcggtacactggcattagctctaggcatccttggcggtctgggcactgctgcgctgttgattggtgtcatcctgtggcagcggaggcagagacgaggagaggagagaaaagctcctgagaatcaggaagaggaagaggagcgggccgagctgaatcagagcgaggaacccgaggccggggaatctagcaccgggggaccttag

SEQ ID NO: 107680 - DNA, 1044 bp, Artificial Sequence
  Description of Artificial Sequence: Synthetic coding sequence
atggccgctgggactgctgtcggtgcctgggtgttggtgctctcattatggggggcagtcgtcggcgcgcagaacatcaccgcaaggatcggggaaccactggtgctgaaatgtaagggcgcaccgaagaagccaccacagcgcctcgaatggaagctgaataccggacgcaccgaagcttggaaggtgttgtcaccgcaaggcggcggtccctgggactcagttgcaagagtcctcccgaatagctccttgtttctacctgcagtgggaatccaggatgagggcatcttccgctgtcaggctatgaacagaaacggtaaagagactaaaagcaactaccgggtgagggtgtatcagatccccggaaaaccggagatcgtggattcagcctcagagctgactgccggggtgcccaacaaggttggaacctgtgtgtcagagggaagttaccccgccggaaccctctcttggcatcttgacgggaaacctctagtgcctaatgaaaagggcgtgagcgttaaggagcagacccgtcgccatccagagaccgggttgttcacactccagtctgagcttatggtaaccccagcccgagggggcgatccacgtcctaccttctcgtgctcattcagccctggcctccctagacaccgtgccctgaggactgcacccatccagccacgtgtgtgggagccggtccctctagaagaggtacagctggtcgtggaacccgagggcggggctgtggcccccggcggtaccgttactttgacatgcgaggtgcccgcacagccttccccacagattcactggatgaaagacggcgtgcctttaccgctaccgcccagccctgtcttgatactgcccgaaatcggtccccaggatcagggtacctactcatgcgtcgccacccatagtagtcacggcccacaggagtcgcgtgccgtttctatcagcattattgagccaggcgaggagggccctactgctggtgaggggttcgataaggtacgggaagctgaagacagtcctcagcacatgtag

SEQ ID NO: 107681 - DNA, 702 bp, Artificial Sequence
  Description of Artificial Sequence: Synthetic coding sequence
atggctgcaggcaccgcagtgggagcgtgggtgctggtcctgtccttgtggggggctgtcgtcggcgcgcagaatattactgcacggatcggcgagcctctggtcttaaaatgtaagggggccccaaaaaagcctccccagcgcctcgaatggaagctcaacacaggcagaaccgaggcctggaaggtgttgtcccctcaggggggaggtccatgggattcagtagcccgtgttttgcccaacggcagcctctttctgcctgccgtgggcatccaggatgagggaattttccggtgccaggcaatgaacaggaacgggaaggaaacaaaatcaaattatcgggttcgggtgtatcagattccgggaaagccagaaatcgtggactctgcatcagaactgaccgcgggcgtccctaataaggtggttgaggagagtagacgcagtcgcaaacgtccttgcgaacaggaagtagggacatgtgttagtgaagggtcttaccccgcagggaccctgtcctggcacctcgatggcaaaccattggtgccaaatgaaaagggcgttagtgtcaaggaacagacacgacgacatccagagacgggtctgtttacactccaatccgaactgatggtcaccccagctcggggcggagatccaaggcccactttctcttgtagcttttccccaggactgccacgacattag

SEQ ID NO: 107682 - DNA, 1044 bp, Artificial Sequence
  Description of Artificial Sequence: Synthetic coding sequence
atggctgccggcactgctgtgggcgcctgggtgctggtgctgtccctgtggggagccgtggtgggcgcccagaacattacggcacgtatcggggaaccactcgtcctcaaatgtaagggagcgcccaaaaagcctcctcaacggctcgagtggaaactgaacaccggacgcactgaagcctggaaggtactatctccccagggcgggggtccttgggattcagtggcacgggtcttaccgaacggcagcctgttcctgccagctgtgggcattcaggatgaggggatctttcgctgtcaggctatgaataggaacggtaaggaaaccaagagtaactatcgtgtcagagtgtatcagatcccaggtaagccagaaattgttgactcagcatccgaattgaccgccggggtacccaacaaagtcgggacctgtgttagcgagggatcataccctgccgggaccctttcttggcaccttgatggaaagcctctcgtgcccaatgaaaagggcgtgtctgttaaggagcagacacggagacatcccgaaactgggctgtttactctgcaaagtgaattgatggtgacacccgccaggggaggagacccaaggccgacgtttagctgctcattcagccctggactgcctagacacagggccttgcggaccgctcccatccagccccgcgtctgggaacccgttcctcttgaagaggttcagctggtggtggagccagaggggggggctgttgccccaggaggcacagtcacactcacgtgcgaggttcctgcacagccatccccccaaattcactggatgaaggatggcgttcctctccctctcccaccttcccccgtgttaatccttcctgagatcgggccacaggaccagggcacatactcttgcgtcgctacccactcctcacatggcccccaggaatcccgtgccgttagcattagcataatcgagcctggggaggaaggtcctactgcaggggaaggatttgataaggtacgggaggcagaagacagtccccagcacatgtag

SEQ ID NO: 107683 - DNA, 705 bp, Artificial Sequence
  Description of Artificial Sequence: Synthetic coding sequence
atggcagctggtacggctgtgggcgcatgggtgctggtgttgtctctatggggcgccgttgttggcgcccagaatatcacagcgcgaattggagaaccattggtgctgaagtgcaaaggcgctccaaagaaacccccacaaaggctcgaatggaaactcaacacaggccggaccgaggcctggaaggtactttcacctcaggggggtggaccctgggactccgtggcacgagtgttacccaacggtagtctctttctgccggcagtgggcatccaggatgagggcatatttagatgccaggctatgaatcgcaatgggaaggaaacgaaatcgaactatcggagtctgcgcacctttacgatcactgcaagtgactggatattccccccctcagagattcccggaaaacctgaaatcgtcgatagcgcatcggagttgacagccggggtgcccaataaggtgggcacatgtgttagcgaggggagctacccagcaggaaccctgtcttggcatctcgatggtaagcctctcgttccgaacgagaaaggcgtatcagtgaaggaacaaactcgacgccatcccgaaactggcttgtttactctacagtcagaacttatggtgactcctgctcgggggggcgatccaaggccgactttctcttgtagctttagccccggactacctaggcatcgggccctcaggtag

SEQ ID NO: 107684 - DNA, 1215 bp, Artificial Sequence
  Description of Artificial Sequence: Synthetic coding sequence
atggctgccgggactgccgtgggggcatgggtgctggtgctgagtctctggggcgctgtcgtaggggcccaaaatattacagcaagaattggggaacccctggtgctgaagtgcaagggtgccccaaaaaaacccccacagcggcttgagtggaaactgaatactggcagaacagaagcctggaaagtcctctcaccacaggggggcggcccctgggacagtgtggcaagggtactgccgaacggcagcctctttctgcccgccgtgggcatccaggacgagggaatattccggtgccaagcaatgaaccgcaatggaaaggaaaccaagtcgaactaccgggttcgcgtgtatcagatcccaggcaagccagaaatcgtggactcggcctccgaactgactgctggagtaccgaataaggtcggtacttgtgtaagtgagggaagctatcccgcaggaactctgtcttggcacttggacggcaagccccttgttccaaacgagaaaggcgtcagtgtgaaagagcagacccgacgccaccctgagactggcctattcacactgcaatccgaactgatggtcacccctgcccgcggcggcgaccctcgccccaccttttcttgttctttcagtccaggcctgcctaggcatagggctctccgtaccgctcctatacagcctagagtgtgggagccggtcccattggaagaggtgcagctcgtggttgaacctgagggcggagccgtcgcacctggcggcactgtgacactgacctgtgaggtgcctgcccaaccgagcccccaaattcattggatgaaggacggggttccactcccactgcccccatcgcccgtacttatccttcccgaaattggcccacaggaccagggaacttacagctgcgttgcaacacactcctctcatggaccccaggaaagtcgagcagtgtctataagtattatcgagcctggagaagaaggccctaccgctgggtccgtgggtggtagcggcttggggactcttgccctggccctggggattctgggcggcctgggcaccgccgccctgctgatcggggtaatcctgtggcagcggcgccagcgccgcggggaggaacgtaaagcaccagagaaccaagaagaggaagaagaaagggccgagcttaaccagagcgaggagcccgaggcgggcgagtcttccactggaggtccttag

SEQ ID NO: 107685 - DNA, 387 bp, Artificial Sequence
  Description of Artificial Sequence: Synthetic coding sequence
atggctgctggcactgccgtcggtgcgtgggtgcttgtgctgtccctttggggggctgtcgtcggcgcccagaatataaccgcacggatcggggaacccctggttcttaagtgtaaaggggcaccaaaaaagcccccacagagactggaatggaagctcaacacagggcggacggaggcctggaaagtgctgagcccacagggaggaggtccatgggatagtgttgcacgggtgctccccaatgggagcctgtttctgcctgcagtgggtatccaggatgagggcatctttcggtgccaggcgatgaacagaaatggaaaagagacaaagtctaattatagggtgcgcgtgtaccagttcgagaacctccacaattatagcttgtag

SEQ ID NO: 107686 - DNA, 462 bp, Artificial Sequence
  Description of Artificial Sequence: Synthetic coding sequence
atggcagccggaacggccgtcggagcatgggtcttggtgctgagcctgtggggagccgtggtgggggcacagaatatcaccgcaaggatcggagaacctctggtcctgaaatgcaaaggggcccctaagaaacctccgcaacgcctggaatggaaactgaacaccggcagaaccgaagcctggaaagtcctgtccccccaggggggcgggccttgggactctgtcgcacgagttctgccaaacggcagcctgttcctgccagcagtaggaatccaagatgagggcatcctcggcggccttggaacagcagccctgctgatcggcgtgatactctggcagaggcgtcaaagaaggggcgaggagaggaaggctcctgaaaatcaggaagaagaggaggaacgtgccgagctgaatcagtcggaggaacccgaggcaggggagtcatccacgggcggcccttag

SEQ ID NO: 107687 - DNA, 885 bp, Artificial Sequence
  Description of Artificial Sequence: Synthetic coding sequence
atgaatcgcaacggtaaagaaactaaatcaaactacagggtacgcgtctatcagattcctgggaagcctgagatcgtagactccgcatccgaacttacagctggggtgccaaacaaagtgggcacctgtgtcagtgagggatcctatcctgccggaactctctcatggcatctcgatggcaaaccattagttccaaacgaaaaaggtgtatccgtgaaggagcagactcgaaggcaccccgagacaggcctgtttaccctgcagtctgagctcatggtcactccagcccgggggggggatccacggcccacattcagctgttctttcagtcccggcctaccccgccatcgggccctgagaacagctccaattcagccaagggtatgggaaccagtgccactggaggaggtacagcttgtggtggaaccggagggcggtgcagtcgctcctggaggtacagtaactctgacctgcgaagttcccgcccagccctcaccccaaattcactggatgaaggatggggttcctctccccttgccgccgagcccagtcctaatcctccccgagattgggcctcaggaccagggtacatatagctgtgtggcaacacatagctcacatgggccgcaggaaagccgggcagtttctatcagtattataggatccgtgggcggatctggtctgggcacactggctttagccttgggaatccttggggggctcgggaccgccgctttgctgattggcgtcatcctctggcagcgaaggcaaagaagaggtgaggaacgcaaagcacccgagaaccaagaagaagaagaggagagagccgagcttaaccaatccgaggaaccagaggctggggagagttcgacaggaggcccttag

SEQ ID NO: 107688 - DNA, 885 bp, Artificial Sequence
  Description of Artificial Sequence: Synthetic coding sequence
atgaacagaaacgggaaggagaccaagtccaactatcgcgtgagagtgtaccagatccccggcaaaccagaaatcgtggactctgctagtgagctaacagccggcgtgcccaataaggtcggcacatgcgtgtccgagggaagctatcccgccggcacactttcctggcatctggatgggaaacccctagtgccaaacgaaaaaggcgtgtccgtgaaagagcagacccgacggcatcccgagactggcctctttaccctgcaatctgaactaatggtaacaccagcccgcggcggtgacccaagacctaccttctcttgttcttttagtcccgggctgccaaggcacagagccctgcggaccgcccccattcaaccaagggtttgggaacccgtgcctcttgaggaggtgcagcttgtagtcgaacctgaaggaggtgcggtcgccccggggggaactgtgacacttacctgcgaggttccggcccaaccttcaccccagattcactggatgaaagacggcgtgcctctgccactgcctcctagcccagttctgatcctgccagagataggcccgcaggaccaaggaacatacagctgtgtagctactcattcgtcccatggtccgcaggaatctagagccgtctcaataagtattatcgggtctgtgggggggtccgggctgggcacccttgctctggccctcggtatccttgggggtcttgggacagcggctctcctgatcggagtcatcctctggcaacggcgccagcgaaggggagaagaaaggaaggcccctgaaaatcaggaagaagaagaggaaagagctgaactgaatcaatccgaggaacccgaagccggggaaagcagtactggcggtccctag

SEQ ID NO: 107689 - DNA, 366 bp, Artificial Sequence
  Description of Artificial Sequence: Synthetic coding sequence
atggccgccgggactgctgtgggggcatgggtgctggtgctatccctctggggcgctgtggtgggtgcccagaatattacagcgcgcattggagaaccactagttttgaaatgtaaaggcgcccccaagaaacccccgcagcggctagagtggaagctgaacaccggaagaacagaggcctggaaagtgctgagccctcaggggggcgggccatgggactcggtcgcaagagtcctgccaaatggaagcctgttcctgcccgcagtggggatccaggatgagggcatttttcgttgccaggccatgaacaggaatggtaaggaaaccaagagtaattggtggtggtcgcagaaagtggaacaatag

SEQ ID NO: 107690 - DNA, 1308 bp, Artificial Sequence
  Description of Artificial Sequence: Synthetic coding sequence
atgggtgccggagaacgggtgcaagctcccccacgggcggaggctacggctggacgcggggccgacagggctcgtactctggaagggagcaggatggctgccggcaccgctgtgggcgcctgggtgctggtgctttctctttggggagccgtggtgggtgcacagaacataaccgcaaggatcggcgaaccactggttttaaaatgcaagggagccccgaagaaacccccccagaggctggaatggaagctgaataccgggcgcaccgaggcttggaaagttctgtccccccagggaggcggaccctgggactccgtggcaagggtgctgccaaacggctctctgttcctgccagccgtaggcattcaagacgaggggattttcaggtgtcaggcaatgaatcgtaatggaaaggagaccaaaagcaactatcgagtgagggtataccagatcccgggaaaacccgaaattgtcgattccgcttccgagctcacagcgggcgtcccaaacaaagtcgggacatgcgtgagcgaggggtcataccccgccggcacactttcgtggcaccttgatgggaagcccctggtccctaatgagaaaggagtatccgtgaaggagcagacccgcaggcatcctgagacagggctctttactctgcaatccgagctaatggtcactcctgctagggggggcgacccgcgcccaacattctcctgttccttttcccctggactgcctagacacagagccctgagaaccgctccaatccaaccccgagtttgggagccagtcccccttgaggaggttcagctcgtcgtcgagcccgagggcggagcggtggcccccggagggaccgtcacgctcacttgcgaggtacccgcacagccatcaccgcagatccactggatgaaggacggagtccctctccccctccccccttctcccgtgctgatcctgccagaaattggccctcaggaccaaggcacctactcatgcgtggcaacccactcatcacacggcccccaggaatctcgggctgttagtatcagcattattgaacccggagaggaggggcctacagccggctcagtgggaggatctggacttggaaccctcgcactcgcacttggtatcctcggcggtcttggaactgctgccctccttatcggagtgattttatggcagcgccgccaaaggagaggtgaggagagaaaagcccccgagaaccaggaggaggaagaggagagggccgagctgaatcaatccgaggaacccgaagccggggagagttctaccggagggccttag

SEQ ID NO: 107691 - DNA, 1092 bp, Artificial Sequence
  Description of Artificial Sequence: Synthetic coding sequence
atggcagccggcaccgccgtaggggcatgggtcttggttctgtctctgtggggcgcagtagtgggcgctcagaatatcaccgcccgcatcggagaacctcttgtccttaagtgtaagggagcccccaaaaaacccccgcaacgtttggaatggaaattgaacaccggacgtaccgaggcctggaaggtgctaagcccccagggtggagggccatgggactcagtcgctcgagtacttccaaatggatcactctttctgcccgccgtcggcattcaggatgaggggatctttcgctgccaagcaatgaacagaaatggcaaagaaacaaagagcaactatagagtgcgggtctaccagattccgggtaaaccagagattgttgacagtgccagcgagttaaccgctggagttcccaataaagtggtcgaagaatctaggcggtccaggaaacgtccatgcgagcaggaggtcggcacctgcgtcagcgagggaagctaccccgccggaactctgtcctggcatctggatggcaagccactcgtccccaacgaaaagggtgtatcagtgaaggagcagacacggcgacatccggagaccgggttatttaccctacagagtgagctgatggttaccccagcccgcggtggcgatccaagacctactttctcgtgctctttcagccctggtctgccccgtcaccgtgccctgcgtactgctccaatccagcctagagtctgggagccagtgccactggaagaagtccagttagtagttgaacccgagggcggggctgtggcgcctggcggaactgtcaccctgacctgcgaagttccggcacagccttcgccccagatccattggatgaaggacggtgtgccactgccattaccaccttctccagtcttgattctgccagaaattgggccccaagatcagggaacttatagctgcgtggctacgcactcaagtcatggaccccaagagtctcgcgccgtgagcatcagcataatagagcctggagaagagggcccaacagccggcgagggatttgataaggtgcgggaagccgaggactccccgcagcatatgtag

SEQ ID NO: 107692 - DNA, 402 bp, Artificial Sequence
  Description of Artificial Sequence: Synthetic coding sequence
atgaaagacggggtaccgctgcctctgcccccatctccggttctcattctcccggaaataggtccgcaggatcagggcacgtatagctgcgtggctacacactcttcccacgggccgcaggagtcccgggcagtgtccatatctatcatcgaaccaggggaggaaggccctacggccggcagtgtggggggctcaggactgggcaccctggctctagcactgggcatcctcggcggattggggacagcagccttgctgatcggtgttatcctgtggcaaaggcggcagcgtaggggagaggaacgtaaggcccctgaaaatcaggaggaggaagaggagcgagctgagcttaaccagagcgaagagccagaagctggagagtccagcactggagggccatag

SEQ ID NO: 107693 - DNA, 387 bp, Artificial Sequence
  Description of Artificial Sequence: Synthetic coding sequence
atggctgctggaaccgctgtcggagcctgggtgctggtgttgagcctatggggggccgttgtgggggctcagaatataacagcacgcatcggggaacccttggtcctgaagtgtaaaggagcccctaagaagcctccacagaggctagagtggaaacttaacactggacggacagaggcgtggaaggtgctgagtcctcagggaggcggaccttgggattcagtggcaagagtgctccctaactcctccttatttttgcccgccgtgggaattcaagatgagggaattttcaggtgccaagccatgaaccgaaatggaaaggagactaagtcgaactatcgcgtgcgagtctaccagtttgagaacctccataattattcgttatag

SEQ ID NO: 107694 - DNA, 462 bp, Artificial Sequence
  Description of Artificial Sequence: Synthetic coding sequence
atggcagccgggaccgcagtgggagcttgggtgctggtgttatccctttggggagcggtcgtgggggcccaaaatatcaccgctagaataggcgaacctctggtcctgaaatgcaagggagctcccaaaaagccgccacagaggctggagtggaaactgaataccggacggaccgaagcatggaaagtcctcagtcctcagggtggcggaccttgggatagcgtggccagagtgctgcctaatggttcattgttcctgcccgccgtgggaattcaggacgaggggatcctgggaggattaggcaccgccgctcttctgatcggcgtgattttatggcaacgcaggcagagacgtggcgaagaacggaaagctcctgagaaccaagaagaagaagaggagcgcgccgaacttaatcagtcagaggaaccggaggcaggagaaagttcaactgggggcccgtag

SEQ ID NO: 107695 - DNA, 1308 bp, Artificial Sequence
  Description of Artificial Sequence: Synthetic coding sequence
atgggcgctggtgagagagttcaagctccgccaagagccgaggccaccgccggccgaggggccgatcgtgccagaaccctggagggctcacgcatggccgctggaacggccgtaggagcctgggtactcgtgttatcattgtggggggcggttgtgggtgcccagaatatcacagcccgaataggggagcctctcgtgctaaaatgcaaaggtgcaccgaaaaagccgccacagcggcttgagtggaaacttaataccggcagaacggaggcttggaaagtgctgtcaccccagggggggggaccttgggactccgttgcccgggtgctgcctaatggcagtctattcctccccgcggtaggtattcaggatgagggcatattccggtgccaggccatgaaccgtaacggtaaggagacaaagagtaactatcgagtgagagtttatcaaatcccagggaaacccgaaattgtggatagcgcgtctgagctaaccgcgggcgtcccaaacaaagtggggacgtgtgtttcagagggaagctatcccgcaggaactctcagctggcacttagatggtaaacctcttgtgcccaatgagaagggagtcagtgttaaggagcagactcgtcggcacccagagactggactgttcaccctccagtcagagctgatggtcaccccagcccgtggcggagacccgcgccctactttttcctgctcttttagcccaggccttcctcggcatcgcgctttgaggacagcccctattcaaccccgcgtctgggagcctgtccccttagaagaagtacagctggtcgtcgagccggagggcggcgctgttgcccccggcggaacagtgacgctgacatgtgaggtgcctgcccagcccagtcctcagattcattggatgaaggatggcgttccactgcccctgcccccttcacccgttcttatacttcctgagataggccctcaggatcagggtacctattcttgcgtggccactcattcctcccacggacctcaggaaagtcgggccgtcagcatctctattatagagcctggtgaggagggtccaactgctggatccgtgggcggaagcggcctgggaactctcgccctcgctcttggtattctggggggtcttgggactgcggcccttcttataggggtcatattatggcaaagacggcaacggcggggtgaagagcgcaaggccccagagaaccaagaggaagaggaagagcgcgccgagctcaaccaatctgaggaacctgaagcgggcgagagtagtaccgggggcccatag

SEQ ID NO: 107696 - DNA, 366 bp, Artificial Sequence
  Description of Artificial Sequence: Synthetic coding sequence
atggcagctggtaccgcggttggggcctgggtccttgtgctatccctctggggagctgtggtgggagcgcagaacatcacagcaagaatcggggagcccttggtcctgaagtgtaaaggggcaccgaagaagcctcctcaaagacttgagtggaaactgaacacgggaaggacggaggcgtggaaggtgctctcgcctcagggcggtgggccatgggattccgtggcccgcgtgttacccaatggcagcttgtttctgccagccgtggggatacaggacgaggggatcttccgctgtcaagcgatgaaccgcaacgggaaggaaactaaatcgaactggtggtggtcccaaaaggttgagcaatag

SEQ ID NO: 107697 - DNA, 387 bp, Artificial Sequence
  Description of Artificial Sequence: Synthetic coding sequence
atggccgcaggaactgccgtgggcgcatgggtgctggtgctctccctgtggggagctgtggtcggggctcagaatattacagcacgcattggagagcctctggtgcttaagtgtaagggggcccctaagaaacccccacagaggctagagtggaagctgaacaccggccggaccgaggcctggaaagtcctgagtccccagggtgggggcccctgggacagtgtagcacgggtcctgcccaatggttctctgttcctccctgccgtgggaatacaggatgaggggatattcaggtgccaagccatgaaccggaatgggaaggagacaaaatccaactaccgtgttagagtgtaccagttcgagaacctccacaattacagtctgtag

SEQ ID NO: 107698 - DNA, 885 bp, Artificial Sequence
  Description of Artificial Sequence: Synthetic coding sequence
atgaaccgcaacggtaaagagaccaaaagtaattaccgagtacgtgtgtatcagatccccggcaagccggagatcgtcgactctgctagtgaactcacggccggtgtccccaacaaagttggtacctgcgtatccgaaggaagttaccccgcagggactttaagctggcaccttgatggaaagcccctggtgccaaatgagaaaggagtgtctgtgaaggagcagacacgtcgacacccagaaactgggctgttcacccttcaatcagaactaatggtgacgcccgcaagaggcggtgacccccgtcctaccttctcctgttcattcagtcccggcctgcctaggcatcgggctctaaggacggctcctatccagcccagagtgtgggaacccgtccctctcgaggaggttcagctcgttgtggaaccggagggcggtgccgttgccccagggggcaccgtgacactcacctgtgaggttcccgcccagccaagcccacagatacactggatgaaggatggcgttcccctcccacttccacccagcccggtcctcattttacccgaaatcggccctcaggaccaggggacctattcctgtgtggctacacattcgtcccatggaccacaggaaagccgtgcagtctccatctccatcatcggttccgtcggcggaagtggtctagggacgctagcactggccctgggtattctgggaggcctggggacggccgcactgctaatcggtgtgatcctctggcagcgcaggcagcgtagaggtgaggaaaggaaggcccccgagaaccaggaagaggaggaagaaagggccgagctaaaccagagtgaggaacccgaggcaggtgaaagcagcacaggcggcccatag

SEQ ID NO: 107699 - DNA, 366 bp, Artificial Sequence
  Description of Artificial Sequence: Synthetic coding sequence
atggctgcaggtactgctgtgggagcatgggttctggttcttagcctctggggcgccgttgtcggggcacaaaatatcactgctaggattggagagcctctagtgttgaagtgcaagggtgcacctaaaaagcccccacagcgcctcgaatggaaattgaacacaggtagaacagaggcatggaaagtactgtcaccccagggaggcggaccgtgggattctgtagcacgagtccttcctaacagctccctcttcctcccggccgtgggcatccaagacgagggtatctttcgttgtcaggcaatgaatcgaaacggcaaagagacaaagagtaactggtggtggagtcaaaaagttgaacaatag

SEQ ID NO: 107700 - DNA, 462 bp, Artificial Sequence
  Description of Artificial Sequence: Synthetic coding sequence
atggcggcagggacggccgtgggggcatgggtcctagttctcagcctttggggcgccgtcgtcggcgcccagaacattacagctcgcatcggcgagcctttagtcctgaagtgcaaaggtgctcctaaaaagccgccccagcgactggaatggaagctgaacaccgggcgaacagaggcgtggaaagtgcttagccctcagggggggggtccctgggactcagtagcccgggtgcttccgaatggatctctgttcctccccgctgtggggattcaagacgaaggaatcctcgggggcctgggaacggctgccttactgattggagtaattctgtggcagcgacggcagaggcgtggtgaggagcgcaaagctcccgagaatcaggaagaggaggaagagcgggccgagttgaatcagagcgaagagcccgaggcaggagaaagttcaacaggggggccttag

SEQ ID NO: 107701 - DNA, 1308 bp, Artificial Sequence
  Description of Artificial Sequence: Synthetic coding sequence
atgggggctggagagcgcgtccaggcacccccgcgtgcggaagccaccgctggccggggcgccgaccgggcacgtaccctagaagggagcagaatggccgcaggcaccgctgtgggcgcgtgggtactcgtcctgtcactgtggggcgccgtagtcggagcgcaaaacataaccgccagaattggcgaacccctggtgctaaaatgtaaaggggcaccgaagaaacctccgcagcgtctggaatggaagctcaacaccggcaggacggaagcctggaaagtcttgtccccccaggggggaggtccgtgggactctgttgccagggttctgcctaacggttcgctgttcttgccagcggtcggaatccaagacgaggggatttttaggtgtcaggcaatgaataggaatggaaaggaaactaagagtaactacagggtgcgggtctatcagatccccgggaagcccgaaattgtggactccgcctcggaactgaccgccggtgtcccgaataaagtgggaacctgtgtctccgagggtagttatccagcgggcacccttagctggcatctggatgggaagccactggtccccaatgaaaaaggtgtttccgttaaggagcagactcgaaggcacccagagaccggactctttacactgcagagcgagctcatggtcacgcccgcccgcggtggggaccctagacctacattcagttgtagcttttcacctggcctccctcgccacagagccctcagaaccgcacctatacagccgagagtctgggaaccggtccccttagaagaggtgcagttggtggtggagcccgagggcggtgccgttgctcctggcggaactgttaccttgacatgcgaggtaccagcacagccatctccccagatccactggatgaaggacggagtaccactgcccctgcccccttcccctgtactgatcctgccagaaatcggtcctcaggatcagggaacgtattcttgtgtagccacccattcgtcccacggtccacaggaatctcgagcagtatctatcagcataatcgaaccgggcgaagaggggccaacggccggaagcgttgggggatcggggctggggaccctggctctggcgttgggcatcttgggagggctgggcaccgcagcattacttataggcgtgatactgtggcagcggaggcagagacgaggagaggaacggaaggccccagagaaccaggaggaagaagaagaaagagccgagcttaatcagagcgaggagcccgaagccggcgagtcatcaactggcggtccttag

SEQ ID NO: 107702 - DNA, 366 bp, Artificial Sequence
  Description of Artificial Sequence: Synthetic coding sequence
atggctgcgggcactgccgtgggcgcgtgggtgctcgtactgtccctgtggggcgctgttgttggtgcgcagaacattactgcccgcataggcgaacccctggtgttgaagtgcaaaggagcaccaaagaaacctccccagaggctggagtggaaactcaatacaggcaggactgaagcctggaaagtactatccccgcagggcggaggcccctgggatagcgttgctagggttctacccaacggaagcttatttcttcctgctgtcggaatccaggacgagggtatctttaggtgccaggctatgaacaggaatggaaaggagacaaaaagcaattggtggtggtcacagaaggtggaacagtag

SEQ ID NO: 107703 - DNA, 402 bp, Artificial Sequence
  Description of Artificial Sequence: Synthetic coding sequence
atgaaggatggggtccctctcccactgcctcctagtcctgtcttaattcttccagagattggtccccaggatcagggcacctattcgtgtgtagcaactcactcctctcacggcccgcaggagagtagagccgtgagcattagcatcattgagccaggggaggaaggacccactgctgggtccgtgggcggtagtggcttggggaccttggccttggccctgggaatcctcgggggactggggactgccgccctgctcatcggggttattctgtggcagcggagacagaggcgtggagaggaacgtaaagcccccgagaaccaggaagaggaagaggagcgtgccgagttgaatcagagcgaagagccagaagcaggtgagtcttctactggcggaccatag

SEQ ID NO: 107704 - DNA, 885 bp, Artificial Sequence
  Description of Artificial Sequence: Synthetic coding sequence
atgaaccggaacgggaaagagaccaaatcgaactaccgtgtcagagtttaccaaattcctggtaaaccggaaatagtggactctgcctccgaactgactgcgggcgtgccaaataaagtgggcacttgcgttagcgaaggatcctaccctgcaggcactctatcttggcatcttgatggtaagccactggtgcccaatgaaaagggagtgagtgtgaaggaacagacacggcgtcatccagagaccggcctgtttacgttacagtccgaactaatggttactcctgcgaggggaggggacccacggcctaccttcagctgctccttcagtcctggtctgccgcggcatcgcgcattgagaaccgccccaattcaacccagggtttgggaaccggtgcctctcgaagaagttcagctagttgtggagcccgagggcggggcggtagccccaggtgggactgtgactctgacgtgtgaggtgccggcccaaccatctccccagattcactggatgaaggatggcgtgcccttaccgctccctcccagccccgtcctcatcctgccagaaatcgggccccaggaccagggaacatactcatgcgtggccacgcacagcagtcacggtccacaagagtctagagctgtgagcatctccatcataggctcagtcggggggagtggcctgggcacacttgcgcttgcacttggcattctcggggggttgggcaccgctgctctcttgatcggcgtgatcctgtggcagcgccggcagcgaagaggcgaagaacgaaaagcgcctgagaatcaagaagaggaggaggagagggccgaacttaatcagagtgaggaacctgaagccggggagtcaagtacaggtggaccatag

SEQ ID NO: 107705 - DNA, 402 bp, Artificial Sequence
  Description of Artificial Sequence: Synthetic coding sequence
atgaaggacggggttccgttgcctctgccaccttcccccgtgctgatcctgcctgagatcggcccacaggatcagggaacgtacagctgtgtggccactcattcatcccatggccctcaggagagccgggctgtgagtatttccatcatcgaaccaggagaagaaggaccgacagccggaagtgtgggcgggtcagggctgggtaccctcgccctcgctcttggcattttaggagggctgggcacggccgcactgctcattggggtcattctgtggcagcggagacagcggaggggtgaggaaaggaaggccccagagaaccaagaagaggaagaggaacgggcagagctcaaccagagtgaagagcctgaggctggagagagttcaactggcggcccctag

SEQ ID NO: 107706 - DNA, 1092 bp, Artificial Sequence
  Description of Artificial Sequence: Synthetic coding sequence
atggctgcgggcacagccgtcggcgcctgggtgttggtcttgtctctgtggggagccgtggtcggggcccagaacatcaccgcacgaattggggagccgctcgtcctaaagtgcaagggggcgcccaagaagccaccgcaaagactggaatggaaattgaacactgggcggactgaggcctggaaagttcttagtcctcaaggtggcggtccatgggactcagtggcaagggtgttaccaaatgggtccctttttcttcctgcagtcggcatccaggacgagggaatcttccgttgccaagctatgaacagaaacggtaaagagaccaagagcaactaccgagttcgggtgtatcagatccccggaaagcctgagattgtggactctgctagcgaacttaccgctggggtgccaaataaggtggtcgaggagagtcggcgctcccgtaaacgaccgtgtgagcaagaagtgggcacctgcgttagtgaaggcagttatcctgcaggaactctaagctggcatcttgacgggaaacccctggtcccgaatgagaaaggcgtgagcgttaaggaacagacccgccggcaccctgagactggtctgtttacactacagtcggagctaatggttacaccagcccgaggaggagatccgcgacccaccttctcttgcagtttttcacccggcctcccaagacatagagccctcagaaccgcgcctatacagccccgggtgtgggaaccagtcccactggaggaagtccagctagtcgtagaaccagaaggcggcgcagtggcaccaggagggaccgtgaccctaacctgcgaggtaccagcccagccctcacctcagattcactggatgaaggacggggtgcctctacctctgccgccctcacccgttttgatcctccctgagataggcccacaggaccaaggaacttactcatgtgtggctacacactcttcccacgggccccaagagtctagagctgtgagcatttcaatcattgagcctggggaggaaggtcccactgccggcgaaggatttgacaaggttagggaggcagaagacagccctcagcatatgtag

SEQ ID NO: 107707 - DNA, 1308 bp, Artificial Sequence
  Description of Artificial Sequence: Synthetic coding sequence
atgggggcaggcgaaagagtccaggcacctcctcgtgcagaagcaacagcaggtcgaggggctgaccgcgcccggaccttggaggggtcgcgtatggccgcagggacagctgtgggggcttgggtattggtgctctctctgtggggcgccgtggtcggggcccagaacatcacagcccggattggcgaaccgttggttctgaagtgtaagggcgcacccaaaaagcctcctcagcgcttggaatggaagttgaacactggacggacggaagcctggaaagtactgtccccgcagggaggaggtccatgggacagcgttgccagagtgctacctaactcttccctcttcttgccagctgtgggaatccaggacgaaggcatatttaggtgtcaagcgatgaaccggaacgggaaggaaactaaatctaactaccgagttcgtgtgtaccagataccagggaagcctgagatcgtggacagcgccagtgagctgacagccggcgtcccaaataaggtcggaacgtgcgtgtccgagggaagctacccagccggcacgctcagctggcacctggacgggaagcctctggtaccaaacgagaagggcgttagcgtgaaggagcagacccggcgacatcccgagacaggtctgtttaccctacagagtgagctgatggtcacacctgcacggggaggagaccccaggccaacgttcagctgttccttttcccctggcctaccacgacaccgcgccctgaggacggctcctatacagccgagagtctgggagcctgtgcccctggaggaagtgcagcttgtcgttgaacctgaagggggtgctgtcgctcccggcgggaccgtcacccttacatgcgaggtcccagcacagcctagtccacagattcactggatgaaagacggagtcccgctgcctctgccacctagtccagtccttattctgcccgaaatcggcccacaggatcagggtacttactcctgcgttgcaacgcatagcagtcacggtcctcaagagtcacgggccgtgagtatatctattatagaaccaggagaagaggggcctactgctggaagtgtgggaggtagcggattaggtactttggcgctcgcgctgggaatcctggggggcttgggaacagccgcactcctgattggcgttattctgtggcaacgtcgccagcgacggggtgaggagcggaaggccccagagaaccaggaggaagaagaagagcgcgcagagctgaatcaatcagaagaaccagaggctggtgagagtagtaccggtggtccatag

SEQ ID NO: 107708 - DNA, 387 bp, Artificial Sequence
  Description of Artificial Sequence: Synthetic coding sequence
atggccgccgggactgcagtaggcgcctgggtgctcgtgctctccctgtggggtgctgtggtgggtgctcagaacatcacagccagaataggggagccccttgtgctgaaatgcaaaggtgctcctaaaaaacctccacagagactggagtggaaacttaacaccggtcggaccgaggcctggaaggtcttgagcccacaagggggcggaccttgggattccgtggcacgagtattaccaaacggttctctgttcctccctgcagtcggcatccaggacgaaggtatctttagatgtcaagccatgaaccgcaacggtaaagaaaccaaatcaaattaccgggtgagggtctatcagtttgaaaatctgcataactacagtctctag

SEQ ID NO: 107709 - DNA, 462 bp, Artificial Sequence
  Description of Artificial Sequence: Synthetic coding sequence
atggcagctggcaccgctgtcggagcctgggtcctcgtactttctctttggggtgccgtggtcggtgcccagaacataactgcccgcatcggtgaacctctggtgctcaagtgtaaaggtgccccaaagaagcctccgcaacgcctggaatggaagctgaacacagggcggactgaggcctggaaagtcctatccccacaagggggcggcccatgggatagtgttgcgagggtgctgccaaacgggagcctgttccttcccgccgttgggattcaggacgagggaatactggggggtctgggcaccgctgctctgttgatcggggtcatcttgtggcagaggaggcaaaggcgaggagaggagagaaaggctcctgagaaccaggaggaggaggaagagcgggccgagctgaatcagtcggaggagccagaggccggagaatccagcactggcgggccttag

SEQ ID NO: 107710 - DNA, 1092 bp, Artificial Sequence
  Description of Artificial Sequence: Synthetic coding sequence
atggccgcgggaacagccgtcggagcctgggtcctggtgctgtccctttggggcgcagtcgtcggggcccaaaatataactgcccgtattggagaacccctggtccttaagtgtaaaggcgccccaaaaaaacccccacaaaggcttgaatggaagctaaacaccggaagaacagaagcctggaaggttctctctccccaaggcgggggaccctgggatagtgtagcacgggtcctcccaaacggcagcctctttctaccagctgttggaatccaggacgagggtatctttaggtgccaggctatgaatcgcaacggtaaggagaccaaaagcaactatagggtacgggtttatcagatccctgggaaaccagagatagtggattcggcgtcagaattaaccgcaggtgtaccaaataaggtagtggaggaaagtcgccgcagtcgtaagcggccttgcgagcaggaagtcggcacatgtgtctcagaagggtcctatcctgcaggcacactgagttggcacctggatggaaaacctctcgtccccaacgagaagggggtgtccgtcaaggagcagacaagaagacaccctgagaccgggctgttcactctccagtctgagctgatggtgacgcccgcgcggggaggcgacccacgtccaacattttcatgtagcttctctccgggactgcccagacatcgggctctgcgaaccgctcctatacagcccagggtgtgggaaccagttcctctggaggaggttcaacttgtcgtggagcctgagggcggcgccgttgcccctgggggtaccgtgacactgacttgcgaagtgccggcacaaccaagccctcagattcactggatgaaggatggagtgccactgcctctgcccccctccccagttctaatccttcctgagatcgggcctcaggatcaggggacctacagttgcgtggcgacccattccagccacgggcctcaggagagccgcgccgtctcgattagcatcatagagccaggggaagagggacccaccgcaggcgaggggttcgacaaagtgagagaagccgaggactcgccacaacacatgtag

SEQ ID NO: 107711 - DNA, 366 bp, Artificial Sequence
  Description of Artificial Sequence: Synthetic coding sequence
atggccgcaggaactgccgtgggggcatgggtactcgtcctttccctgtggggcgccgtagttggagcacaaaacatcacagccagaatcggcgagccgctggtcctcaagtgcaagggagctccgaaaaagcccccacagcggttagagtggaaactgaatacgggacggactgaagcatggaaagtactgagtccacaggggggaggtccatgggacagtgtggctcgagtgcttcccaatgggagcctttttctgccagcagtcggaatccaggatgaaggcatctttaggtgtcaagctatgaaccgaaatggcaaggagacaaagtccaattggtggtggagccagaaagtcgagcagtag

SEQ ID NO: 107712 - DNA, 402 bp, Artificial Sequence
  Description of Artificial Sequence: Synthetic coding sequence
atgaaggacggcgtccccctcccattgcctccttctcctgttctcattctgcccgagatcggaccgcaagatcagggaacttattcatgtgtggccacacatagctctcatggtccacaggagtctcgagctgtgagtatctccatcatcgaacccggagaggaaggcccaaccgcgggatccgtcggtggcagcggccttggcactctcgccttagccctgggaattctgggagggcttgggaccgctgccctcttaatcggtgtcatcctgtggcagagacgccaacgaaggggcgaagagcgcaaggcacctgaaaatcaggaggaagaagaggaacgagcggagttaaatcagtctgaggagcccgaagcgggggagagttcaaccgggggcccatag

SEQ ID NO: 107713 - DNA, 387 bp, Artificial Sequence
  Description of Artificial Sequence: Synthetic coding sequence
atggctgcaggtaccgccgtaggcgcctgggttcttgtcctgtctctgtggggagccgtggtcggcgcacagaatattaccgcacggatcggagaaccactggtcttaaagtgtaaaggggcacccaaaaagccaccccagagactggagtggaagctgaacaccgggaggactgaggcgtggaaggtactgtctcctcaaggcgggggcccatgggactctgtcgctcgcgttctccccaacggttccctgtttttacctgctgtcggcattcaggatgagggcatatttaggtgccaggctatgaaccgaaacggtaaagaaacaaagtcgaattaccgcgtcagagtgtaccagttcgagaaccttcataattactctttatag

SEQ ID NO: 107714 - DNA, 1092 bp, Artificial Sequence
  Description of Artificial Sequence: Synthetic coding sequence
atggccgctggcaccgctgtgggtgcttgggtgctggtcctcagcctctggggggcggtggtaggagcacagaatatcaccgccaggattggagaaccactagtgctcaaatgtaaaggggcacctaaaaaacccccacagagactggaatggaagctcaataccggcagaacagaagcctggaaagtcctgtccccccagggaggaggcccctgggactccgtggcccgggtgttgcctaatggcagtctcttcttgccagcagtggggatacaggacgagggaatttttcgttgtcaagccatgaaccgcaatgggaaggagacaaaatccaactacagggtgagagtctaccagatccctggaaagccagaaattgtggattcagcgagcgaacttaccgcgggagtgcccaacaaggtcgtcgaggaatctcgacgttcccgaaagcgcccgtgcgagcaggaggtgggcacatgcgtgtctgagggttcataccctgccgggaccctaagctggcaccttgacgggaagccactggtgccaaatgagaaaggcgttagcgtaaaagaacagaccagaaggcaccccgagacaggtctgttcactttgcaatccgagctcatggttacccccgctaggggtggtgatcctcgccctaccttttcttgcagcttctcacccgggttgccacgtcacagagctctcagaactgctccgatccagccaagagtttgggagcccgtacctcttgaggaggtgcagctggtcgtggagcccgagggaggagctgtggcccccggagggactgtgacgttgacctgtgaagtgccagcccagcccagccctcaaatccattggatgaaggatggtgttccgctgcctctgcccccgtctccagtgttaatcctccctgaaatagggcctcaagaccaggggacttattcttgtgtcgccacccattcctcgcacggccctcaggagtcccgagccgtgtccatttccattatcgaaccaggagaggagggacccacagccggcgagggctttgataaggtgcgggaagccgaagactccccgcaacatatgtag

SEQ ID NO: 107715 - DNA, 1308 bp, Artificial Sequence
  Description of Artificial Sequence: Synthetic coding sequence
atgggagccggggagagggtacaggcaccaccacgggcggaggcaacggcaggaagaggggccgacagggcacgcaccttggaagggtctcgcatggccgcgggaacagctgtgggcgcgtgggttctggtgctctcgctgtggggcgcagtcgttggagcccagaatatcaccgccaggatcggtgaacctttagtgttaaagtgcaagggagcaccaaaaaagcccccgcagcgcctggaatggaaactcaataccgggcgcaccgaggcctggaaagtgctctccccgcaaggcgggggaccttgggactcagtggcccgcgttctgcccaacggctctctgttcctgcctgccgtcgggatccaggacgagggtatcttccggtgtcaggcaatgaatcgaaatggcaaagaaacaaaaagcaattacagggtgcgcgtctaccagatacctggcaagcctgaaattgtggactcagcctcggagctcactgccggtgtgcccaacaaagtcggcacctgcgtgtctgaaggatcttatccagcggggaccctaagctggcatctggacgggaaaccccttgtgccaaacgaaaaaggggtgagcgtcaaagagcaaaccagacggcaccccgagaccgggctgtttactctacagagtgagctgatggtgactcctgcacgtggcggtgacccaaggcctacattttcctgtagcttctcccctggactgcctcggcatcgcgccttacgaaccgctcctattcagccaagggtgtgggagcccgtccctctcgaggaggtccaactcgtggtggagcctgaaggaggcgccgtagcaccaggaggtactgtgaccctcacgtgcgaggtcccggcccaacccagtccgcagattcattggatgaaagacggtgttccactgcctctgccaccctctccagtcttaattctgcccgagattggcccgcaggaccagggaacatatagttgcgtcgccacacattccagtcacggtcctcaggaatctcgagccgtgtctatttctattatagaacccggggaggaggggccgacggccggcagcgtcggtgggagtggacttggcacactcgccctggccttaggaattttggggggtctgggaaccgccgcccttttgataggagttatcctttggcagaggcggcagcgccgtggcgaggagcgaaaggctcctgagaaccaagaggaagaagaagagcgtgccgagctcaaccagagtgaagaacctgaggctggcgagagctcgacaggcggtccatag

SEQ ID NO: 107716 - DNA, 462 bp, Artificial Sequence
  Description of Artificial Sequence: Synthetic coding sequence
atggccgccggaacagccgtcggggcttgggttttggtgctcagtctgtggggagctgtggtcggcgctcagaacataaccgcccggattggagagcccctggtcctcaagtgcaagggggcacctaagaagccacctcaaaggctggagtggaagctgaatacggggagaaccgaggcctggaaagtattgtccccacagggaggaggtccatgggattctgttgcccgagtgctccccaattcctccctattcttgcccgctgtcggcatacaggacgaaggtattctgggtggcctcggcactgccgcgttgttaattggtgttatcttgtggcagcgacgccagcggaggggagaggaacggaaagctccagaaaaccaggaggaggaggaagagcgcgctgaactgaatcagtccgaggagcccgaggctggcgagtcatccactggcggaccttag

SEQ ID NO: 107717 - DNA, 402 bp, Artificial Sequence
  Description of Artificial Sequence: Synthetic coding sequence
atgaaagatggagtcccgttaccactgccgccttcccccgtgctgattctccccgaaatcggacctcaggaccagggtacgtatagctgcgtggcaactcactcgtcccacggaccgcaagagagccgcgccgtgtcaatcagcataattgagccaggggaggagggtcccacggccggatcagtaggcggctccggtctgggaacattggcactggcccttggaatccttggcggcctggggacagctgcactactcataggggtcatcttatggcagcggaggcagaggcggggggaggaaaggaaagcacccgagaaccaagaggaagaagaggagcgcgctgaactcaatcagagcgaagagccagaggccggcgagagctcaactggtggcccgtag

SEQ ID NO: 107718 - DNA, 885 bp, Artificial Sequence
  Description of Artificial Sequence: Synthetic coding sequence
atgaatcggaatggcaaagagaccaaatcgaattatcgcgtcagagtctaccagattcccggaaagccagagatcgtagattctgccagcgagctgactgccggcgtgcctaacaaagtgggcacctgcgtctctgagggctcatacccagcgggtaccctctcctggcacctagatggcaagccactggtaccaaacgaaaaaggcgtgtctgttaaagaacagactcggagacaccccgagaccggtctctttacacttcagagtgagctgatggtgactccagcacggggaggcgacccccgacccactttcagttgcagcttctctcccgggctgcccaggcacagggcattgaggactgcacctatccagccccgagtctgggagcctgtccccctggaggaagtacagctggttgtcgagccggaaggcggcgctgtggccccagggggaaccgtgacccttacatgcgaggtgccagcacagccatcacctcagatccattggatgaaggatggagtgccactccccctccctccttctccggttcttatacttccagagattggtccccaagaccaggggacttactcttgtgtcgccacccattctagtcatggacctcaggaatcacgcgctgtctctatctctatcattggaagcgtcggcggttccggactgggaactctggctctagctctcggaattctaggaggacttgggactgctgcgctgctaattggcgtgatcttatggcagcggcgccaacgccgtggggaagaaaggaaagcacccgagaatcaggaggaagaggaggaacgagctgagctaaatcagtcagaggagccggaggcaggcgagagctcaacaggcggaccgtag

SEQ ID NO: 107719 - DNA, 1092 bp, Artificial Sequence
  Description of Artificial Sequence: Synthetic coding sequence
atggctgccggcacagccgttggcgcttgggtgcttgtgctgtcactgtggggtgccgttgtgggcgctcagaacatcacagcgagaataggcgaaccgctagtgctgaaatgtaagggggccccgaaaaaaccaccccaacgtctcgagtggaagctcaatacaggacgcacagaggcctggaaggtgctgtctccccagggagggggcccatgggatagtgtcgctcgagtcttacctaacagctctttgttcctgcctgccgtaggaattcaggatgagggcatctttcgctgccaggctatgaacaggaacggcaaagaaacgaagtccaactatcgggtgcgcgtctatcagattcctgggaaacctgagatcgtggacagcgccagcgagctcaccgctggtgttcctaacaaggtggtcgaagaaagccggaggagccggaaacgtccctgcgagcaggaggtgggcacatgcgtgagcgaaggttcctacccggctggcaccctgagctggcatctcgacggcaagcctctggtgcctaacgagaaaggtgtatctgtgaaggagcagactaggagacatcccgagacaggcctattcactttacagtccgaactgatggtcacccctgctagaggaggtgacccacgacccactttcagctgctcgtttagtccgggtctgccccgccaccgggcgcttagaacagctcctatacagcctcgcgtctgggaacccgtccccctggaagaggtccaactggtggtagaaccggagggcggggccgtcgccccaggtgggaccgttaccttgacttgcgaggtccctgctcaacccagccctcagattcattggatgaaggatggcgtgcctctgcctctacccccttcccctgtcctgatcctccccgagatcggtccacaagaccagggcacatactcttgcgttgccacccactcttcccatggccctcaggagtccagggccgtttccatctccatcattgaaccgggagaggaaggtcccactgctggagaaggttttgataaagtaagagaggcagaggacagtcctcaacacatgtag

SEQ ID NO: 107720 - DNA, 462 bp, Artificial Sequence
  Description of Artificial Sequence: Synthetic coding sequence
atggctgcgggaaccgccgtgggcgcgtgggtactggtgctctcattatggggcgccgtggtaggtgcccagaatattacggctcggatcggcgagcctctggtgttaaaatgcaagggggctcctaagaaaccacctcaacggctggaatggaaattgaacaccgggcgtaccgaggcctggaaggtgctttcgccccagggtggcggaccatgggatagtgtggcacgagtgttacctaacggtagcctgtttttgccagccgtcgggattcaagacgagggcattctgggagggctgggtaccgcggccctattaataggggtaatactctggcagcggcgccagcgacgcggtgaggagagaaaagcacccgagaaccaggaagaggaggaggagagggcagagctgaaccagagtgaggagcccgaggcaggtgagagtagcactggtggtccctag

SEQ ID NO: 107721 - DNA, 387 bp, Artificial Sequence
  Description of Artificial Sequence: Synthetic coding sequence
atggccgccgggaccgctgtgggagcctgggtcttggtgttgtccctgtggggagctgttgtgggggctcagaacatcacagctagaattggagagccactggtgctgaagtgcaagggggctcccaaaaagcctccacaaagactggagtggaagctgaacaccggccgaactgaggcttggaaggtactgtccccacagggaggcggcccatgggacagtgtcgcccgggtcttaccaaatggctcactttttctgcccgccgtgggcatccaagatgaggggattttcaggtgtcaagccatgaaccgcaacggaaaagagaccaagagtaattatcgagtacgagtgtaccagtttgaaaacctccacaattatagcctgtag

SEQ ID NO: 107722 - DNA, 2460 bp, Artificial Sequence
  Description of Artificial Sequence: Synthetic coding sequence
atgcctcttacatcagcattccgggccgtggacaatgaccctggaattatcgtgtggaggatcgagaaaatggagctggccctggtgccagttagcgcgcatggcaacttctacgagggtgactgttacgtaatcctaagcaccaggcgcgtcgcctctctcttgtcccaggacatacacttttggatagggaaggactcatcccaggacgaacagtcctgtgcggccatatacactacccagctggacgattacctcggaggtagccctgtgcagcacagggaggtccagtaccacgagagcgacacctttcgcggatactttaaacagggaattatttataagcagggcggggtggccagtggtatgaaacacgtggaaacaaacacatacgacgttaagcgacttctccatgtgaagggcaagaggaatatccgtgctacagaggtggagatgagctgggattcctttaacagaggcgacgtcttcctgctcgatctggggaaggtgattattcagtggaatggccctgagtcaaattctggcgagagactgaaggccatgctgctggctaaggacattcgggacagagagcgaggcggccgggcgaagatcggagtgatcgaaggggataaggaagctgcaagtccagaactgatgaaggtgctgcaggacactctgggacgcaggtctatcataaagcctaccgtgcctgacgagatcatagaccagaagcagaaatcaacaatcatgttgtatcatattagcgattccgcaggccagctcgctgtgactgaagtagctacacgccccctggtacaggatctgctgaatcacgacgactgttacatcctagatcagagtggcactaagatctacgtgtggaaggggaaaggagcgacaaaagcagagaaacaggccgctatgtccaaagccttgggtttcatcaagatgaaatcttatccttcttcgacgaatgtagagaccgttaatgatggcgcagagtccgccatgtttaaacagctctttcagaagtggagcgttaaggatcagacaatgggactcgggaaaactttcagcattgggaaaatagccaaagtgttccaggacaagtttgacgtgacactgctgcacaccaaacccgaggtcgcggcacaagaacggatggtggatgacgggaacggtaaagtagaggtttggaggatcgaaaacctggagctcgtcccagtagagtatcagtggtacggctttttctatggcggagattgttacttagtgctgtacacctatgaagtgaatggcaaacctcaccatatactgtacatctggcaaggccgacatgcatctcaagacgagctcgccgccagtgcctaccaagccgtagaggtggaccgtcaatttgatggggccgccgtgcaggtcagggtgcggatggggaccgaaccacgtcacttcatggcaatctttaagggcaagctggtcatcttcgagggaggcacctcgagaaaaggtaacgcagaaccggaccccccggtacggctcttccagatccatggcaatgataagagcaatacaaaggcagttgaggttcctgcctttgcatcatcacttaactcaaacgatgtttttcttctgagaacacaggcggaacactacctgtggtatggtaagggatccagcggagatgaacgggccatggcgaaagagctggctagcctactgtgcgacgggagcgagaacacggtcgcggaaggtcaagaacctgccgagttttgggatttgctcggtggaaagaccccatacgcgaatgacaaacggctgcagcaggagatactggacgtgcagagcaggctgttcgagtgctccaataaaaccggacagttcgtggtcactgaaatcactgatttcacacaggatgatttgaacccaacggacgttatgcttcttgatacctgggatcaagtgttcctgtggataggcgctgaggccaacgctactgagaaagagtctgcactcgcaactgcccagcaatatttgcatactcacccttcagggagggatcccgatactccaatactaatcattaagcagggttttgaaccccccatctttaccggttggttcctggcctgggatcctaatatctggtcagcagggaaaacctacgagcagcttaaagaagaactaggcgacgccgcagccatcatgaggatcaccgctgacatgaagaacgctacactcagtcttaactctaatgactccgagccgaagtattatcctatagccgtgctgctcaagaaccagaatcaggagttaccagaggacgtcaatcccgcaaaaaaagaaaactacctttcagagcaagactttgtgagcgtctttggtattacacgaggccagtttgccgcactccccgggtggaaacagctgcagatgaagaaggaaaaaggcctgttttag

SEQ ID NO: 107723 - DNA, 2439 bp, Artificial Sequence
  Description of Artificial Sequence: Synthetic coding sequence
atgagttctaccggtcatcctggatcctataaaatctggggtgagaagatggaattggcgctggtccctgtctcagcacacggcaatttctacgagggtgactgttatgtgatcctcagtacccgccgggtggccagtttgcttagccaggatattcacttctggatcggtaaagactcctcacaagacgagcagtcgtgcgcagctatttacactacgcaattggatgactatctgggcggatctccagtgcagcacagagaagtgcagtatcacgaaagcgacacctttaggggatacttcaagcagggcattatctacaaacagggtggagttgccagcgggatgaagcacgtagaaaccaacacctatgacgtaaaacgcttgcttcacgttaagggaaagcgcaatatccgggcaacagaggttgagatgtcctgggactcattcaacagaggagatgtattcctcctcgacctcggaaaagtcattatccagtggaacggcccagaatctaactcaggcgaacggctcaaagctatgcttttggccaaggacattcgggaccgcgaaaggggtggcagggccaagatcggcgtcatcgaaggggacaaggaggccgctagcccggagctgatgaaggtcctacaggacactctgggacggcggagcataatcaagccgactgtaccagacgaaataattgaccagaaacagaagtcaaccatcatgctataccacatatccgacagcgccggacagctggctgtgactgaagtggcaacccgcccccttgtccaggatttattaaatcacgacgactgttatatcctcgatcagagcggaacgaaaatttatgtgtggaaaggaaaaggtgcaactaaagccgaaaagcaggccgcaatgagcaaagcccttggcttcatcaaaatgaagagctacccctcatccactaacgttgaaaccgtgaacgatggagccgaaagtgccatgtttaagcagctatttcagaagtggagtgttaaggaccaaaccatgggcttgggtaagacatttagtatcggaaaaatcgccaaggttttccaggacaaatttgatgtcacacttcttcacaccaagcccgaggtcgccgcccaggaacggatggtggacgatggaaacgggaaggtggaagtgtggagaatcgagaatttggagttagtgccggtcgagtatcagtggtacgggtttttttatgggggtgactgttacttagtcctgtacacctatgaagttaatggaaagccacaccacatattgtacatctggcaaggccgacacgcctctcaagacgagctggctgcttccgcctaccaggcagtggaagtggacagacagttcgacggcgctgccgtgcaggttagggtccgtatggggacggagcctcgtcattttatggctatcttcaaggggaagctggttatttttgaaggaggtacctctagaaagggcaacgctgagccagaccctccagttaggctctttcagatccacgggaatgataagagtaatacaaaggccgtggaagtacccgcattcgcgagtagcctcaattcgaacgacgtcttcctactccgcacgcaagccgagcactatctgtggtacggcaaggggtcttccggagatgaacgggcaatggctaaagaactggccagtcttctgtgcgacggttcggagaataccgttgccgaggggcaagagcctgcagaattttgggatctgttgggcgggaaaacaccctatgcgaacgacaagcggctgcagcaagaaattcttgacgtgcagtcgcggctatttgagtgttcaaataaaaccggccagtttgttgtgactgagatcacagactttacacaagatgatcttaatccgactgacgtgatgttgctggatacttgggatcaagttttcttgtggataggtgcagaggctaatgctacggaaaaagagtccgcgctagccacagcccagcaatacctccacacacatccatctggccgcgacccagacacaccaattttgattataaaacaaggtttcgaaccccccatctttactggatggtttctcgcctgggaccctaatatctggtccgccgggaagacttatgaacagcttaaggaagagctgggagatgccgctgctatcatgcgcataacagccgacatgaaaaacgcgaccctttcccttaatagcaatgatagtgagcctaagtactaccctatagccgtcctcctaaagaatcagaaccaggagttgccagaggacgtgaaccctgcaaagaaggagaattacttgagtgagcaggactttgtctccgtgttcggcatcacaagaggccaatttgccgctttacctggctggaagcaactccagatgaaaaaggaaaagggcttgttttag

SEQ ID NO: 107724 - DNA, 474 bp, Artificial Sequence
  Description of Artificial Sequence: Synthetic coding sequence
atgccgctcacatctgctttcagggccgtagataatgatccgggaatcattgtttggcgaattgagaaaatggaactcgcacttgtgcctgtgtccgcccatggcaacttttacgaaggcgattgctacgtgatcctgtctacccgcagagtcgctagcctgctttcccaagacattcacttttggataggcaaggacagctctcaggatgagcaaagttgcgctgccatttataccacccagctggatgattacctgggcggctctcctgtgcaacacagggaggttcaataccatgagtcggatacattcaggggatatttcaagcagggcatcatctacaagcaaggaggtgtcgccagcggaatgaaacatgtggaaactaatacatacgatgtcaaacgtctgctccacgtgaaagggaagagaaacatccgcgccacagaagttgagatgtcttgggactccttttag

SEQ ID NO: 107725 - DNA, 2859 bp, Artificial Sequence
  Description of Artificial Sequence: Synthetic coding sequence
atgaaatttaagaggcgccatcaggcttttccaagcttctttaaaatgaaagtcagcctgcccagcgacccgagttgcgtggaggagatccttcgggaaagccagcacttgaccccaggcttcactttgcagaagtggaacgaccccacaacccgggccagtacaaaaagtgtttcctttaagtctatgttagaggacgatctcaaactgtcgtcagacgaggatgatctggaaccagtcaagactttaacaacgcagtgtaccgcaaccgagctgtatcaggcagtggaaaaagctaagcccaggaacaaccccgttaacccccccttggccactccccagcccccaccggccgtacaggcctccgggggctcaggatcatcaagcgaaagcgaatcttccagcgagagtgacagcgatacagagtctagcacaaccgactcggagagtaatgaggctccccgagttgctacaccagaaccagaacctccctctaccaacaagtggcagttggacaagtggctgaacaaggtaacatcccagaacaaatctttcatttgcggccagaatgagacgccgatggaaacaatttctctgccccctcctataatacagccaatggaggttcagatgaaagttaagaccaatgccagccaagtaccggcagagcccaaggaacggccactgctctcactgatcagggagaaggcccgccccagacccactcaaaagatcccagagaccaaggcactcaagcacaaactgtcgacgacctccgaaaccgtgtctcagcgcacaattggaaagaaacagccgaagaaggtggaaaagaacaccagcaccgacgagttcacatggcccaagccaaatataacgagtagcaccccaaaagagaaagaaagcgtagagctgcatgatccccctcgtggccgaaacaaagcaaccgcgcataaacccgcacctaggaaggaaccaagacctaatatccctctggcaccagagaaaaagaagtacaggggacctggaaaaatcgttccgaaaagcagggagttcatcgagaccgattcgtccacatccgacagcaacaccgaccaagaagagacattgcagattaaggtactccccccatgcatcatttctggtggtaacaccgctaagtcaaaggagatctgcggagcaagcctgactttatccactcttatgtcctcgagcggctctaataataatttaagtatttcaaacgaagagcccaccttcagccccatccccgtgatgcagacggagatcctgtcgcccctgcgagatcatgagaacctcaaaaatctatgggtgaagatcgatctggacctactaagtagagtgcccggccattcctcactgcacgcagccccagccaaacccgatcacaaggaaactgctacaaaaccaaaaaggcaaactgccgtcactgctgtggaaaagcctgccccaaaaggaaaacgcaagcataagcctatcgaggtggccgagaagattcccgagaagaaacagcggctcgaagaggcaacgaccatttgcctcttgccaccttgtatatcccctgccccgcctcataaacctccaaacacgcgtgaaaacaacagcagtagaagagccaaccggcgcaaagaggagaagctctttcccccccccctttcccccttaccagaagaccccccccgcaggcgcaatgtttccggtaacaatggcccttttgggcaggataaaaacatcgcgatgacggggcagataacaagtaccaagccgaaacggactgaaggaaaattttgtgcgactttcaaaggtatcagcgtcaacgagggtgatacacccaagaaagcttcctctgcaacaatcactgtcacaaatacagccatcgccacagctacggtaacagctacagcaatagttactactacagtcaccgcaacagctacagcgacagctaccacaactacgactacaactacaatcagtacaatcacatcgacaattactacaggcttgatggattcttcccatcttgaaatgacttcttgggccgctctgcctctgctaagcagctccagcaccaatgtgcgccggcccaagctgactttcgatgattccgttcataacgccgattattacatgcaggaagccaagaagctgaagcataaggcagacgctctgttcgaaaagttcggcaaggcggtgaattatgctgacgctgccctgagtttcactgagtgcggcaatgcaatggagagagatcccctggaggcgaagtccccctatactatgtattcagagaccgttgaactactgcgctatgcaatgcgcctcaagaatttcgcatcacctttggccagcgacggtgataaaaaattagccgttttgtgctacagatgtctctctctcctgtacttgcggatgtttaaacttaagaaagatcacgccatgaaatacagtcggtccctcatggagtactttaaacagaatgctagcaaggtcgcccagatcccttcaccatgggtatccaacgggaagaataccccttcaccagtgtccctgaacaacgtgagtcccataaatgcaatgggcaattgtaataatgggccagtcactattccacagcgcatccaccatatggcagcctctcatgtaaacatcacgagcaatgttctccgaggctacgaacattgggacatggcagacaaactgacaagagagaacaaggaattttttggcgaccttgacacattaatggggcccctcacccagcatagctcgatgacaaacctggtgagatatgtgagacagggcttgtgctggttgaggattgatgcccacttgctctag

SEQ ID NO: 107726 - DNA, 3837 bp, Artificial Sequence
  Description of Artificial Sequence: Synthetic coding sequence
atggacctctttgacttctttagggattgggatctggagcagcaatgtcattacgagcaggacagatcggctctcaagaagagagaatgggagcgccgcaaccaagaggtgcaacaggaggatgaccttttttctagcggctttgacttgttcggagagccatataaaaccaacaaaggcgatgctctagcgaatagggtccagaacactcttggaaattacgatgaaatgaaaaacctgctcaccaatcatagtaatcaaaaccacttagtgggtatccccaaaaattccgttcctcagaacccaaataacaagaatgaaccttcatttttcccagagcagaagaatcgcatcatcccaccccaccaggacaatacacacccttctgcccccatgccaccaccatcggtcgtgattctcaatagcactctgattcactccaatcggaaaagcaagcccgagtggtctagagattcacataatccctcaaccgtattagcatcacaagcaagcggccagccaaataagatgcagaccctaacacaggaccaatcgcaggccaagctggaagacttctttgtctatcctgccgagcagccccagatcggggaggtggaagaatcaaatccatctgccaaggaagattcaaacccaaattcgtctggcgaagacgccttcaaagagatctttcaatcaaacagcccagaggagtcagagtttgccgtgcaggctcctggatcacccctggttgcttcttcactgctggcaccttccagcggactcagtgtgcagaatttcccaccgggcctatattgtaagaccagcatgggccagcagaaaccaaccgcatacgtaagaccgatggacggtcaggaccaggcccccgatatctcccctaccctcaaacccagtatcgagttcgaaaattcgtttggaaatttaagcttcggaactctgttagatgggaaaccctcagctgcgtctagcaaaacaaaacttcccaaattcactatcctgcagacaagtgaggtaagcctcccgagcgatccctcatgtgtcgaggagattttgagggagagtcagcacttgacacccgggttcactctgcagaaatggaatgaccctacgaccagggcttctaccaaatctgtaagctttaaatcaatgcttgaagatgatctaaaactttcgtctgatgaggatgacctggaaccagtcaagactctgacgacccagtgcactgcgaccgagctgtatcaggctgtggagaaagctaaaccacgcaataatcccgtgaacccgcctttggctacgccccagccccctcctgctgtccaggcaagtgggggctcagggtcctcttctgaatccgaatcaagcagcgagagcgactcggacacagagtctagcaccaccgattctgaatcgaacgaggccccccgcgtggccacccctgagcccgagccgccctccacaaacaagtggcagctggacaagtggttgaataaggtaacttcccagaacaaaagctttatctgcggacagaatgagacccctatggagacaattagcctcccacccccaatcatacaacctatggaggtccagatgaaggtgaagacaaatgcaagtcaggtgcccgctgagcctaaggagagacctcttttgtctctgataagagaaaaagccagacctcgaccaacacagaagatccctgagactaaagctctcaaacataaactcagcaccacgagcgagacggtttctcagcggacaattggcaagaaacaacccaaaaaggtcgagaaaaatacttcaaccgatgagttcacttggcccaaacctaatatcacaagtagtacaccaaaggaaaaagagtctgtggaactgcatgacccgccccgcggaagaaacaaggccactgcacacaaacctgcaccgagaaaggagccacgccccaatattccactggccccagagaagaaaaagtaccggggcccaggtaaaatcgtgccaaagtccagagagttcatcgaaacggactcaagcactagcgattcaaacacggaccaggaagaaacacttcaaataaaggtcctgcccccctgcatcataagtgggggaaatactgctaagagtaaagaaatttgcggtgctagtctgacactgagcactctgatgagctcctccgggagtaataataacctgagcatctccaacgaagaaccaaccttctcccctatcccagtaatgcagacggaaattttgagccctctgcgggaccacgaaaacctgaaaaacctctgggttaaaatagatctggatctcctgtcaagggtgccagggcacagtagtctccacgctgctcctgccaaaccagatcataaggagacagcaacaaagcctaagcgccagacggctgtgacagccgttgaaaagccagcacctaaaggaaagcggaagcataaacccattgaagttgccgaaaaaatcccagagaaaaagcagcgcctggaggaagccaccacaatctgtctcttaccgccatgcataagtcccgccccacctcataaaccgcccaatacaagagagaacaactcctcccgccgagccaacagacgtaaggaggagaagctctttccacctcccctcagccctctccctgaggacccccctagacgcaggaacgtgtccggcaacaatgggccgtttggccaggacaaaaatattgctatgactggccaaataacttccacaaagcccaaacgcacggagggcaaattctgtgcaacctttaaaggcatctctgttaacgagggcgacacacccaagaaggctagcagcgctaccatcaccgttaccaataccgccatagccacagccacagttaccgccacagccatcgttaccactacagtgacagctacggctaccgcaacagccactaccactactactaccacgactatttctacgataacctctacaattactaccggcctgatggacagttcccaccttgagatgacatcctgggccgctctgcccctgctaagttcgtcatccacgaatgtccggcgtccgaagctgaccttcgatgattcggtgcacaatgccgactactacatgcaggaagctaaaaaactgaaacacaaagccgacgctctcttcgaaaagtttgggaaagccgtaaattatgccgacgctgccctctcctttaccgagtgtggcaacgctatggagagggaccccctggaagccaaatccccctacaccatgtattcagaaaccgtagaactcttacgctatgccatgcgcctgaagaattttgctagccccctggcatcggatggtgataaaaagcttgcagttctctgctatagatgtctgagcctgctgtacctgcgaatgttcaagctgaaaaaggaccatgcaatgaaatatagccgtagcctgatggagtacttcaagcagaatgctagtaaggtggctcaaattccttccccttgggtatctaatggaaagaacacaccttcaccggtctcattaaacaacgtgagtccgataaacgccatggggaactgcaacaacggccctgtgacgatcccacagagaatccaccacatggcggcatctcatgtgaatatcacttcgaatgttcttcgagggtatgagcactgggatatggcggataagctgacacgtgaaaacaaggagttttttggagacctggataccttgatggggccgctgacccagcactcctctatgaccaatctggtccggtatgtcagacagggactgtgctggctgcgcatcgacgcgcacttactgtag

SEQ ID NO: 107727 - DNA, 3831 bp, Artificial Sequence
  Description of Artificial Sequence: Synthetic coding sequence
atggatctttttgacttcttccgggattgggatctggagcagcagtgtcactatgagcaggacagatctgctctgaaaaagcgagaatgggagaggcggaatcaggaggttcagcaggaagatgatctttttagtagtggttttgacttattcggtgaaccatacaagacaaacaaaggcgatgccctggcaaaccgggtccagaacaccctcggcaactatgacgagatgaagaatctgctcacaaaccattcaaatcaaaatcacctggttggtatcccaaaaaatagcgtgccacaaaaccccaataataaaaatgaaccaagcttctttcctgagcagaaaaacaggataatccctccacaccaggacaacacccatcccagtgcaccaatgccacccccctctgtagttatcctcaacagtaccctaattcactccaatcgcaagtctaaacctgagtggagtagggacagccacaacccgtcgactgtgctcgccagccaagcctccggccagccaaataaaatgcagacgctcacacaggatcagagccaggccaaactggaggacttcttcgtctatcccgcggagcagccgcagatcggagaggttgaagaatcgaatcctagcgcgaaggaggacagcaaccctaatagctccggcgaggatgcctttaaggaaatcttccagtcgaattcccctgaggaatctgagttcgccgtgcaggctccagggagtcccctggttgcctcctcccttctcgccccctcatccggcctgtctgtacagaattttccccctgggctgtattgcaaaacctccatgggacaacaaaagccaaccgcatacgtgaggccgatggacggacaggatcaggcgccggatatctctccaaccctaaaaccctccatcgagttcgaaaattcattcgggaatctctccttcggcactctgctcgacgggaaaccatccgctgcctcctcgaagactaagctccccaaattcactattttacagacatccgaggtgagtctcccttccgacccaagctgtgtggaggagattctgcgcgaatcacagcatctgacaccaggattcactctgcagaagtggaacgaccctactactcgcgcaagtacaaagtccgtgtcgtttaagagcatgttggaggatgacctaaagttgtcatctgatgaggatgatttggaaccagtcaaaaccctgaccacacagtgcaccgcaacggaactgtaccaggctgtcgaaaaagccaagccacgtaacaatcctgtgaaccccccactggcgaccccacagccaccacccgccgtgcaagcttcaggaggatcaggaagcagctctgagagcgagtctagcagcgagagcgactccgatactgagagctccacaacagactctgaatctaatgaagcaccccgggtggctacacccgaacccgagccaccgagcaccaacaaatggcagcttgataagtggctcaacaaagtgacttcccagaataaatcgtttatctgtgggcagaatgagacccctatggaaaccatttcattacctccacccatcatccagcccatggaggttcaaatgaaggttaaaactaacgcctcacaggtccctgccgaacccaaggagcgcccactgctgtcactaatccgggagaaggcacggcccagacctacccagaaaattcccgaaaccaaagcactcaaacacaagctctccactacatcggagaccgtctctcagcgaacaatcggcaagaagcagcccaaaaaagtggagaagaacacgtctactgacgaatttacgtggcctaaaccaaatataacaagtagtacccccaaggagaaagaaagcgtcgagctccacgatcctccaagagggagaaacaaagcaactgcccacaaaccagcccctagaaaggagcctcggcccaatatccccctggcaccggagaaaaagaaatataggggtcccggcaaaatcgtgcctaaatctagagaatttatcgaaacagactcatccacatcagactccaacacagaccaggaggaaactctgcaaattaaagtgctgccaccctgcatcattagcgggggcaatactgccaaatctaaagaaatctgtggcgcatcattaaccttgtccacgctgatgtccagctctggctccaacaacaatctaagtatcagtaacgaggaacccacattctcccctatccctgtaatgcaaactgaaatactgagtcccctgcgagaccacgagaatctgaagaatctatgggtaaagatagatctcgacttgctgtcccgggtgcccgggcatagctccctccacgctgccccagccaagccggatcacaaggagaccgccaccaaacctaaacgccagacagctgtgaccgcagtggagaaacccgcaccaaagggcaaacggaagcacaaaccaatagaggttgccgaaaaaatacctgagaagaaacagagactggaggaggcgacgacaatctgtctcctcccgccctgcatatccccagctcctccacataagccaccaaacacacgggagaacaactcaagccgcagagccaacagaaggaaggaagaaaaactttttccccctcctctgagccctctccccgaggatccccctaggagaagaaatgtgagcggcaacaacgggccttttggtcaggacaaaaacatcgcaatgacagggcagataacatcaaccaaacccaagcgcacggagggaaagttttgtgctacgttcaagggaatatctgagggagacaccccaaaaaaagcgtccagtgctaccatcacggttacgaacaccgccatcgccacagcgacggtaaccgcgactgctattgtaactacaaccgtgacagctacggcgaccgccacagccaccactactacaacgacaacaaccatctcaaccatcaccagcaccatcactactggtctgatggattcatcccaccttgagatgaccagctgggctgcacttcccctcctgagttcctcctccactaatgtccgccgccccaaactgacatttgacgattccgtccacaatgctgattattacatgcaggaggccaagaagcttaagcataaggccgacgctcttttcgaaaagtttggaaaagctgtcaactatgccgacgctgccctgagctttaccgagtgtggaaacgccatggagagggatcccctagaggccaaaagtccatacacaatgtacagcgagaccgttgaattacttagatatgccatgcgcctcaagaatttcgcaagcccgctggctagcgacggagacaagaagttagcagtactctgctacagatgcctgtccctgctctaccttcgtatgtttaagctgaagaaggatcacgctatgaagtatagtaggtcactaatggagtactttaaacaaaacgcctccaaagtggcgcagattccatccccatgggtctccaacggaaagaacacacctagtcccgtttctttgaacaatgtctctccaatcaacgccatgggaaactgtaataacggacccgtgactatcccacagcggatccaccacatggcagcctctcacgtcaacatcacttcaaatgtgctgagaggatacgaacactgggacatggcagacaaactgacccgggagaacaaggaattctttggagatctcgacacactgatgggaccacttactcagcactccagtatgacaaacctcgtacgatacgttcgtcagggactgtgctggcttagaatcgatgcccacctgctgtag

SEQ ID NO: 107728 - DNA, 1284 bp, Artificial Sequence
  Description of Artificial Sequence: Synthetic coding sequence
atggacctgtttgacttctttcgcgactgggacctggaacagcagtgccactatgaacaggataggtcagccctgaagaaaagagagtgggaacgccgcaatcaggaggtccagcaggaggatgacttgttttctagtggattcgacttgttcggagaaccttacaagaccaataagggagatgcactggcaaatagagtgcaaaatactctgggtaattacgacgaaatgaagaacctgttgacaaaccacagtaaccaaaatcacctggtaggaatcccaaaaaattcagtgccacaaaatcctaataacaagaatgagccttcatttttccccgaacaaaaaaaccgaattattcccccacaccaggataatacacacccatctgccccaatgccgccgccctcagtggtgattctgaactccaccctgatccattctaatcggaaatccaagcccgaatggtccagagactcacacaacccatccaccgtcctggccagccaggcgagtggccagcctaataaaatgcagactcttacacaagatcagtcccaggccaaactggaggattttttcgtatacccggccgagcagccccagattggcgaggtcgaggaatccaacccatcagccaaagaagattccaatcccaatagctcaggagaagacgcttttaaagaaatatttcagtccaattccccagaggaatcagagtttgctgtgcaggcgccagggtctcccctggtggcaagcagcctgctagccccctcatcagggctcagcgttcagaatttccctccgggcctgtactgtaagacctcaatgggtcagcagaaaccaaccgcctacgttaggcccatggacggacaggatcaggcgccagatattagccccactctgaagccgtccatagaattcgaaaactcttttggcaaccttagtttcgggactctgctggatggcaagccttccgccgcctccagtaaaaccaaactcccgaaatttaccatcctgcagacctctgaggtatcactaccctccgatccgagttgtgtcgaggagattcttcgtgaatctcagcacttaactcctgggtttactctgcagaaatggaatgatcccacaacccgggcctcgacaaaaatgctggaggacgacctgaagttgtcctccgatgaggatgatctggagccagtcaagaccttgactactcagtgcacagcgactgaattgtaccaggcagtcgagaaagccaaaccaaggaacaaccccgtcaaatag

SEQ ID NO: 107729 - DNA, 3936 bp, Artificial Sequence
  Description of Artificial Sequence: Synthetic coding sequence
atggacttattcgacttcttccgggattgggatctggagcaacagtgtcattatgaacaggatcgctccgcactgaagaagagagagtgggagagacgaaaccaggaagtgcagcaggaggacgatctgttctctagcgggttcgatctgtttggcgaaccgtacaaggttgccgaatataccaacaagggtgatgcccttgcaaacagagtccagaacacactaggaaattacgacgaaatgaaaaatctacttacaaaccactcaaaccagaatcacctagtaggcattcccaagaactctgtaccacaaaatccaaacaacaagaatgaaccctcattttttccagagcagaagaatcgcattattcctcctcaccaagataatacccatccttcagccccaatgcccccacctagcgtggtgattttaaatagcacactgattcatagcaatcgaaagtctaaacccgagtggtcccgggactcccacaaccccagcactgtgctagcatctcaggcttcagggcagccaaataagatgcagactcttactcaggaccagtcacaggcaaagttggaagacttttttgtgtatcccgccgaacaacctcagataggtgaagtggaggaatctaacccttcagcaaaggaagatagcaatcctaatagcagtggcgaggatgcgtttaaggaaatctttcagagcaatagcccagaggagtccgagtttgctgtccaggctcccggttcccccctggtcgccagtagcctgctcgctccttcttctggcctttctgtgcagaatttcccaccagggttgtattgtaaaacaagcatggggcagcaaaaacccacagcgtacgtgaggcccatggacggacaggaccaggcgcccgatatttctccgacgctaaaacccagcatcgagtttgaaaactccttcggcaatctgtcctttggcactctcctggatggaaagccttcagctgccagtagtaaaaccaagcttccaaaatttactatcctgcagacttctgaagtcagcctgcccagcgacccctcgtgcgtagaggaaatccttagagaaatgacccactcttggcctaccccactcaccagtatgcatacagcaggccattctgaacaatcaacttttagcattccgggacaggagagccaacacttgacccctggctttactcttcagaagtggaacgatccgacaactagagctagtacgaaatcagtttcctttaaaagtatgctggaggatgatctcaagctgagtagcgacgaggacgacctcgaaccagtgaagactcttacaacccaatgtaccgccacggaactgtatcaggcagtcgagaaggctaaaccacggaacaaccccgtgaatcctcccttagcaacaccccagccccctccggcagttcaggccagtggaggaagcggcagttcgtccgagagcgaatcttcatccgagtctgacagcgatactgagagttctaccaccgacagtgaaagcaatgaagctccaagagtggctacaccagagccagaaccccccagcaccaataagtggcagttagataaatggctgaataaggttacaagccaaaataagtcgttcatatgcggtcagaatgagactccaatggaaacgatcagtctcccgcctccaatcatccagcctatggaagtacaaatgaaggttaaaacaaatgccagccaagtccctgctgagcctaaagagagacccctgctttcgctgatccgtgaaaaagcacgccctcgcccaacccagaagatcccagaaaccaaggcactcaagcacaagctctccactacctccgagacagtgtcccaacggaccattgggaaaaagcagccaaaaaaagtggaaaaaaacactagtaccgatgagtttacatggcctaagcctaatatcactagtagtacccctaaagagaaagagtctgtggaattacacgacccgccacgtggtaggaacaaagcaaccgctcataaaccggcacctagaaaggagcctcgaccaaatatccccctggcaccggagaaaaagaaatacagaggcccaggaaagattgtgcccaaatctcgagagttcatagagactgactctagtactagcgacagcaacaccgaccaggaggagactctgcagatcaaagtgctgcctccttgtattatctccgggggcaatacggcaaagagtaaagagatctgtggagcaagcctgactttatctacgttaatgtcaagtagtggatccaataacaatttgagtattagtaacgaggaacctacatttagtcccattccagtgatgcagactgagatcttgtcccccctgagggaccacgagaatcttaagaacttatgggtcaaaatagacttggacctgctgagccgtgtccccggtcactcttcattacatgctgcccctgctaagcctgatcacaaggaaacggccaccaaacctaagcgccagacagctgtaactgcagtggagaagcctgctcccaaaggcaaacgtaaacataagcccatcgaggtcgccgagaagataccagaaaaaaagcagcgcctggaggaggccacaactatatgtcttttgccgccttgcattagtcctgcacccccacacaagcctccaaatacacgcgagaataattcttcacgccgggccaaccgaaggaaggaagagaagcttttcccgccccccctcagccccttacccgaggacccccccaggaggcgtaacgtttcagggaacaatggaccctttggtcaggataaaaatatcgcaatgacaggccagatcacatcaacaaagccaaagcggactgagggaaaattctgcgcaacctttaaaggcatttccgtcaacgaaggtgacactcctaagaaggcatcaagtgccactattacagtaaccaatactgctattgccacggccactgtgacagccaccgccatcgtgaccacaaccgtgactgcgaccgccacagcaaccgctactaccacgactacgaccacgactatcagcaccatcaccagcactataacgactgggctgatggactccagccacctggagatgacaagttgggcagcgttgcccctgctttctagctccagtactaacgtcaggagacctaagctcaccttcgacgacagcgtgcacaacgctgactactacatgcaggaggctaagaagctgaagcacaaagcagatgcactttttgaaaaattcggcaaggccgtcaactatgccgacgccgctctgtcctttactgagtgcggtaatgcaatggagcgggaccccttagaagcgaagtctccttacaccatgtattcagagactgtggaactgcttcgctacgctatgagattgaaaaactttgccagtcctctggcctctgacggggataagaaacttgccgtgctttgttacagatgtttaagcctgctgtatcttagaatgtttaaacttaaaaaagatcatgcaatgaagtattccaggagcctcatggagtacttcaagcagaacgcttcaaaggtcgcccagataccttctccttgggtcagtaatgggaagaatactccaagtcctgtctcgttgaataatgtgtcaccaataaacgcaatggggaattgcaataacgggcctgttacaatcccacagcggatccaccacatggccgctagtcatgtcaacatcacctccaatgtcctgcggggctatgagcattgggatatggccgacaagcttacacgggagaacaaagagttctttggggacctcgacacattgatgggacccctcactcagcacagctcaatgactaatctcgtgaggtacgtacgccaaggactatgttggctgaggattgatgcccatcttctctag

SEQ ID NO: 107730 - DNA, 1410 bp, Artificial Sequence
  Description of Artificial Sequence: Synthetic coding sequence
atgtccgccctcacacctccaacagatatgccaacaccgacaacagataaaatcacacaggccgcaatggagaccatttacctgtgtaaatttagggtgtccatggatggcgagtggctatgtcttagggagctagatgatatctccctgacgccagatcccgagcccactcacgaggatcccaattacttgatggccaacgaacgcatgaacctgatgaacatggcgaaactgtccatcaaaggcctgatcgaatcagctctcaatctaggaagaaccttagactccgattacgctccactccaacagttctttgtagtgatggagcactgtctgaagcacggcctcaaagccaaaaagacctttctggggcagaacaaaagcttttggggtcccctggagctggtggaaaaactggtgcctgaggctgccgaaataaccgcttccgtcaaggacctacccgggctgaaaacccctgtcggaaggggccgggcatggctgcgtctggctctaatgcagaagaagctcagcgagtatatgaaggctctgatcaataagaaggaattactgtcagaattttacgaacctaacgcgctcatgatggaggaggagggggccattattgcgggcttgttggtgggacttaacgtgatcgacgcaaacttttgcatgaagggggaagacctcgactcccaggtgggcgttattgacttttccatgtatctcaaggacggaaattcctccaagggcaccgaaggggatggacagatcaccgccatccttgaccaaaagaattacgttgaagagctgaatcgtcacctgaacgccaccgtgaataatctgcaggctaaggttgacgctctcgagaaatccaacactaagttgaccgaggaactagccgtcgcaaataatcgcattatcacactccaggaggagatggaacgggtgaaggaagaaagttcctacattttagaatctaacagaaagggaccaaaacaggaccgaactgcagaaggccaagcactctccgaggctaggaaacatctgaaggaagagacccagttgcgcctggacgtagagaaagagctcgaaatgcagatttcaatgcggcaggagatggagctggcaatgaagatgctcgaaaaggatgtgtgcgagaaacaggacgcgctcgttagtctacgtcaacagttagatgaccttagagctctaaagcacgagctggctttcaaattgcagtcctccgacctcggtgttaaacagaagagtgagttaaacagcagactcgaggaaaaaaccaaccagatggctgccactataaagcagcttgaacaaagcgaaaaagatctggtcaagcaggctaagacactcaattctgcagccaataagctcatcccgaaacatcactag

SEQ ID NO: 107731 - DNA, 2394 bp, Artificial Sequence
  Description of Artificial Sequence: Synthetic coding sequence
atggcccacagatgcctgcggctgtggggccgaggtggctgttggcctaggggactccagcagttattagtgcccggcggggtggggccgggtgagcagccttgtcttcgcaccttgtatcgcttcgttaccacccaggcccgcgctagccgcaatagcctgcttaccgacataatagccgcttatcagaggttctgctctcgaccccctaagggctttgagaagtacttccccaatgggaaaaatggcaagaaggcctctgagccaaaggaggtcatgggagaaaagaaagagtcaaaacccgctgccaccactcggagttctggcggtggcggtggtgggggggggaaaagaggggggaagaaggatgattcccattggtggtctagattccagaagggagacatcccatgggacgacaaggacttccgcatgtttttcctctggacggccctcttctggggcggggtgatgttttacttgcttcttaagcgttccggtagagagattacatggaaggattttgtgaataactacctgtcaaaaggagtggtggaccgcctcgaggttgttaataaacggttcgtaagggtaacatttacgcctggtaagactcctgtcgacgggcagtacgtttggttcaacattggcagtgttgacacctttgagaggaatctggagacgctccagcaggaactggggatcgaaggggaaaatcgcgtgccagtcgtgtatattgccgaatcggacgggtcttttctgctgagcatgctgcccacggtgctgatcatcgcgtttctcctgtacactatccgcagaggccctgctgggatcgggcgtactggcaggggcatgggcggcctgttctcggtgggggaaacgacagctaaagtgcttaaggatgagatagacgtgaagtttaaggacgttgctggatgcgaagaagctaagctcgaaataatggagtttgtgaatttcctcaagaaccctaaacagtaccaagatttgggagcaaagatcccgaagggtgctattctaacagggcctcctgggaccgggaagaccctgttggccaaagccactgccggtgaggcgaatgtgccctttatcactgttagtggatcggagttcctggagatgtttgtgggagtgggacctgctagagtacgtgacctctttgcgctggcaaggaagaatgccccgtgcatcttatttatcgacgagatcgatgccgtcggcaggaagcggggccgtggcaattttggaggacaaagcgagcaggagaatactctgaatcagctgctggtggagatggacggctttaatactaccactaatgtggtgattctcgccggcactaaccggccggacatcctggacccagcccttctgcgaccgggccgtttcgaccgacagatcttcatcgggccaccagatatcaaaggccgcgcctccattttcaaggttcatctgcggcccctgaagctagattccacactggaaaaagataagctcgctcgtaaactggcaagtcttactccaggtttctctggagcagatgtggcgaacgtgtgtaacgaagccgcgctgatcgccgctcgacatctgtcagacagcattaaccaaaagcacttcgagcaagcaatcgagcgcgttatcggaggcctggagaaaaagacccaagttctccagcctgaggagaaaaagacagtcgcttaccacgaagccggacatgcagttgcaggttggtaccttgaacacgcagatccattactcaaggtgagcattatcccaagggggaaaggtctgggctatgctcaatatctgcccaaagaacaatacctctacaccaaagagcaactcctcgataggatgtgtatgacacttgggggtcgtgtctctgaagagattttcttcggcagaattactacaggggctcaggatgatctgcgcaaagtcacacagagtgcctatgcacagatcgtgcagtttggcatgaacgaaaaggtgggtcaaatctcatttgatttacctaggcagggagacatggtcctcgagaaaccctactcggaagctacggctcggttaattgatgatgaagttcggattctcattaacgatgcatacaaacgcaccgtagccttgctcacagagaaaaaggctgacgtggagaaggtggcattactcttgctagagaaagaggttctcgacaagaacgacatggtggagctgctcggacccagacccttcgccgagaaatccacatatgaggagttcgttgagggcaccgggtccctcgacgaggatacgagtttgcctgaaggcctgaaagattggaacaaagagcgggaaaaagaaaaggaagagccccccggagaaaaggtggccaactag

SEQ ID NO: 107732 - DNA, 2439 bp, Artificial Sequence
  Description of Artificial Sequence: Synthetic coding sequence
ggtgcaggcggtaggcgccgcagagttgaatctctgggctcaagtgtatcacggaggcgcgcctctcttccagggggactctccccgagccgcgctcgcttcccccggcccccagttgtcgcctgtccgaggctgcgcgagcagccatgcttgaggaccctgtacaggttcgtgactacccaggccagagcaagccgaaactcactcctgacggatataatcgcagcctaccagaggttctgctcccggcctccgaagggtttcgaaaagtacttccctaacgggaaaaacgggaaaaaggctagcgagcccaaggaggtgatgggggagaagaaagaatctaagccggccgccaccaccagaagcagcggggggggcggcggcggcggcggaaagcgaggaggaaagaaagacgacagtcattggtggtcccgcttccagaagggagatatcccttgggatgataaggattttaggatgtttttcctctggacagctcttttctggggcggtgtgatgttctatttgctacttaaacggtctggcagagaaattacctggaaagactttgtcaacaactacctgagtaagggagtcgtggatcgtctcgaggtcgtgaacaaacgttttgtgcgcgtgacctttacgcctggaaagaccccagttgacggccagtatgtctggttcaacattgggagcgtggacactttcgagaggaatttggaaacgctccagcaagaattgggcatcgaaggtgagaaccgggtgcctgtggtctacatcgccgagtccgacgggtccttccttctctccatgctgccaaccgtgctgataatcgctttccttctgtacactatacgtaggggacctgccggcattggcaggacaggtcgaggcatgggagggctcttcagcgtcggtgaaactaccgccaaagtactgaaggatgaaatcgatgtaaaattcaaggacgtcgcaggttgtgaggaggccaagttggagatcatggaattcgtgaatttcttaaaaaatcccaagcagtaccaagacctgggagcaaagattcccaagggcgcaatattaaccggcccacctggcacgggaaaaactctattagctaaagcaacggcaggggaggcaaacgtaccatttattactgtgagcggcagcgagtttcttgagatgtttgttggggttggacccgcaagagtccgggatctttttgccctggccaggaagaatgcaccctgtatcctgttcatcgacgaaatcgatgctgttgggagaaagcgtggtagaggcaacttcggtgggcagtcagaacaggagaacacgctcaatcagttattggttgagatggacggtttcaacacaacaacaaacgtagtgattttggcggggacaaaccgccctgatatcctcgatccagccttattgcgtccaggccgcttcgatcgacaaatattcatcggaccccctgacatcaaaggaagggcaagcatctttaaagtgcacctgcgccccctgaagctggatagcactctggagaaggataaactggccagaaaactagcttcactcacacccggcttcagtggagccgacgtcgctaatgtctgtaacgaggccgcccttatcgccgcaaggcacctttcagactctattaatcagaagcatttcgagcaagcgatcgagagggttatcggaggtcttgagaagaaaacgcaggtcctgcaaccagaagaaaaaaagacagtcgcatatcatgaggcgggtcatgccgtggcaggctggtatttggaacacgctgaccccctcctgaaggttagcatcatccctcgcggcaagggcttggggtatgctcaatatctgccaaaggagcagtacctgtacactaaagaacagctgctggatagaatgtgtatgacactgggcgggcgggtgtccgaggagatctttttcgggcggatcactacaggggctcaagacgacctgagaaaggttacccaatcagcttatgcacaaatcgtgcagttcggcatgaatgagaaggtgggacagatttctttcgacttgcctcgtcagggagacatggttcttgagaaaccatactccgaagctaccgcccgactcattgacgatgaggtccgcatattgattaatgatgcgtataagagaacagtggccctcttgaccgagaaaaaggcagacgttgagaaggtggctttgctgctgctcgagaaggaggtgttagataagaatgatatggtggaattgctgggtccaagaccatttgccgaaaagagtacctatgaagagttcgtcgaaggtacaggaagtctcgacgaagatacgtccctccccgaaggtctgaaagattggaataaggagcgtgaaaaagagaaggaggagcctcctggtgagaaggtggccaactag

SEQ ID NO: 107733 - DNA, 7251 bp, Artificial Sequence
  Description of Artificial Sequence: Synthetic coding sequence
atgacaacactcctctgggtgtttgttactctccgagtcatcactgctgcggtgaccgttgagacgtccgaccacgacaatagtctctcagtttccatcccacagccctcaccactgcgcgtgctgctgggcacctctttgacaatcccttgttatttcattgatcccatgcaccccgtgactaccgctccgtccacagcgcccctggccccaagaattaagtggagtcgggtgtcgaaggagaaggaagttgttctgttagtggccaccgagggcagggtgcgggttaactcagcgtatcaggacaaagttagcctgcctaattacccggccatcccaagtgacgccaccctcgaagttcagagcctccgtagcaatgactctggggtgtatcgctgcgaagtgatgcacgggattgaagattctgaagcgactctggaggtggtggtaaaagggattgtgttccattaccgggctatctctacaaggtacaccctggatttcgacagagcccagagggcctgccttcagaactccgcaattatcgcaactccagagcagcttcaagccgcttatgaagacggtttccaccaatgtgacgcaggctggctcgcagaccaaaccgtgcggtatccaattcatacaccccgcgaaggctgttacggagataaggatgagtttcccggagtcagaacttatggtatcagggacaccaatgaaacttacgatgtgtactgttttgctgaggagatggagggagaagtgttctatgccacatctccggagaagttcacatttcaggaagcggcaaacgaatgcagacgcctgggagctcgattagcaacaacagggcagctgtatctagcctggcaggccggaatggatatgtgctctgcaggttggctcgccgatagatccgtcaggtaccctattagcaaggctcgacccaactgcggcgggaatctgctcggagtgaggactgtgtacgtgcatgccaaccagacgggctatccagacccctcaagcaggtacgatgcaatctgctacacgggcgaggatttcgtggatataccagaaaattttttcggtgtcggcggggaggaggacataactgtacagacagtgacgtggccagacatggaactgcccctgcctaggaacataaccgagggggaggcccgtggttccgtgattctcaccgttaaacctattttcgaggtatctcccagtccactggaacctgaagagcctttcactttcgcacctgaaatcggtgctacagccttcgccgaagtggaaaacgagaccggagaagccacgaggccctggggctttcctacgcctgggctggggccagctaccgctttcactagcgaggacctagttgttcaggtgactgcagttcctggacagcctcatctccccggcggcgtggttttccactatcggcctggaccaacccggtacagtcttacattcgaagaagctcagcaggcatgcctgaggacgggagccgtgattgcctcacctgagcagttgcaggccgcttatgaggcaggctacgaacagtgcgatgctggctggctccgcgaccagaccgtcagatacccaatcgtctcccccagaacgccatgcgtcggagataaagattccagccccggtgttcgcacatatggcgttcgtccttcaaccgaaacttacgacgtttactgctttgtcgaccgattggagggagaggtcttttttgccacccggttggagcagttcaccttccaagaagcgttggaattttgcgaatcacacaatgctaccctggctaccactggccagctctacgcagcctggtctagagggctggataagtgctatgccgggtggctggctgacggcagtttgaggtatcccatcgtcacaccccgacctgcctgcggaggcgataagcccggggtgaggacagtctatctgtatccaaaccaaactggactgccagaccccctgtctcgccatcatgccttctgttttagggggatctccgccgttccttccccgggggaggaagagggcggaacccctacatccccaagtggtgtggaggaatggatagtcacacaggtggtgccgggggtggctgcggtgcctgtcgaggaagaaactacagctgtgccaagcggcgagaccactgctatcctagaatttacaaccgaacctgaaaatcagaccgagtgggagcctgcctacacacccgtgggcaccagcccgctgcccgggatcctgcctacttggccccctactggggccgcaaccgaggagtctacagagggtccgagcgccactgaagtcccatctgcctcggaggagccctcaccttctgaggtgcctttcccttctgaggaaccctcaccatccgaggaacctttcccctcagttaggcctttcccatccgtggaattatttccttccgaggaacctttcccctccaaggagccgtcaccatcagaagagccatcagcatccgaagagccttacacaccgtcccccccggtgccatcttggacagagctgccgtcctctggtgaggaatcaggggcccctgatgtgtccggcgacttcactggctctggggacgtgtccggacacttggacttcagcggccagctcagcggcgaccgcgcatctggattaccctccggggatctcgactcaagcggcctgactagtactgtcggatctgggctgccagttgagtcaggactgccctcgggcgacgaagagcggatcgaatggccatctacccctaccgtcggcgaactcccttcaggcgccgagatcctggaggggtcggccagcggcgtgggtgacctctcgggtctgccgagcggcgaagtgctggagacatctgcaagcggagtcggtgacctttcaggcctgccctccggagaagtgctagagactaccgcccctggcgtagaggacatatccggcctccctagtggggaggttttggagacaacagcccctggcgtagaagatatcagtggcttgccatccggcgaagtccttgaaaccacagcaccaggtgttgaagatatctctggactgccatccggagaggtgctcgaaacaacggcaccaggcgtggaggatatctccggcctgcccagcggtgaagtacttgagaccacagctcccggcgtcgaggatatcagcggactgccctctggagaagtgctcgagaccgcagctcccggagtggaggacatcagcgggctcccgtcaggtgaggtgctggagaccgctgccccaggggttgaagatatttccgggttgccaagtggagaagtattagaaacggccgcacccggcgtcgaagatatctctgggctcccgtcaggagaggtactggaaacagcagccccaggggtggaagacatcagcggattaccaagtggtgaggtgctggaaaccgccgctccaggcgtagaggatattagcggcctaccctcgggcgaggtgttagagaccgcggcaccgggggtcgaagatatatctgggcttccctctggggaggtgctggagaccgccgctcccggagtggaggacatctccgggctgccctctggcgaggtgctcgagaccgccgcaccgggtgttgaggacatctctggtctgccttctggagaggtactggaaacggctgctcccggcgtggaggatatcagtggattgcctagcggagaggtgcttgaaaccgccgcacctggcgtcgaggacatcagcggattaccgagcggcgaagtgctggagacggctgcaccaggagtcgaggatattagcggcttaccctccggggaggtgctcgaaacaactgcaccaggcgtcgaggaaattagtggcctacctagtggggaagtgctggagaccaccgctcccggggttgacgaaatctccggactaccctccggcgaggtcctggaaacgacagcccccggcgtggaggaaatctctggcctgccttctggcgaagtactggaaaccagtacttctgcggtcggcgatctgtctgggctgccgagcggaggagaggtgctggagatctccgtttccggggtggaggacatttcggggctcccctcgggggaggtcgttgagacctccgcctcaggaatcgaggatgtttctgaactcccttccggtgaggggctggagaccagtgcatcgggtgtggaggatctgtcccggttgcctagtggtgaagaggttctggaaatcagtgccagtggtttcggagacctgtccggcctgccctcgggcggtgaaggcctggaaacaagtgcatctgaggtgggaacagacttgtccggcctcccttcagggcgagagggcctggaaacgtcggccagtggggccgaggacctcagcggcctgccctcaggaaaggaggaccttgttggatctgcatccggcgatctggatcttgggaaattgccatcaggcaccttgggctcaggccaagccccggaaacaagcggcctcccttccgggttcagcggcgagtactctggcgtcgatctagggagcggaccaccttctggactgccagatttctctggcctcccctcagggtttcctactgtatcgttagtcgacagtacattagtggaggtcgtaactgcttctactgcctctgagctggagggtaggggcacaattgggattagtggcgctggtgagatctccggtcttccatccagtgagctggacatctcaggacgcgcatcagggctgccaagcggcaccgaactgtccggccaagcctctggctcccccgacgtatccggcgaaataccaggactttttggggtatccggtcagccctctggtttcccagatacatcgggcgagactagcggagtgactgaactcagcggcctgagctccggccagcctgggatcagcggagaagcttcaggcgtgctgtacgggacctctcagccttttgggatcactgatctgtctggcgagacctcaggagtacctgatctgagtgggcagccatctggcctcccaggcttttcgggcgctactagtggcgttccagatttagtgtccggcaccacatctggctctggggagagttcagggatcacattcgtcgatacttccctggttgaggtggcgcccactacttttaaggaggaagaaggattggggtctgtggagctgtccggcctcccttctggcgaagccgacttaagcgggaagagtggcatggtagatgtctccggacagttctccggtaccgtggacagttcaggtttcacgtcccagacaccagaatttagcggcctgccttcgggcatagcagaggtgtcaggtgaaagctcgcgagctgagatcggctcctcacttccctctggggcctattatggctcaggaactcccagctcgttccccacagtctcgctggtcgacagaactctcgtggagtccgtgacccaagcccccaccgcacaagaggctggggaagggccatccggcattcttgaactgagcggggcccacagcggcgcacctgatatgagtggtgagcacagtggcttcctggatttgtccggcctgcagtcgggtctgatcgagccatctggcgagccgcccggtacgccatacttttctggggatttcgcatccaccaccaatgtgtctggcgagagttcggtggccatggggactagcggggaagccagtggtctgccagaagtgaccctgataacaagcgaattcgttgaaggcgtaactgaaccaaccattagtcaagagttggggcaacgaccacccgtcacacacaccccccagctattcgagtcctccgggaaagtcagcaccgccggggacattagcggcgccactccagtgctcccaggatctggggtcgaagtcagctcagtgcccgaaagtagcagtgaaacttccgcgtaccccgaagcgggatttggtgccagcgctgcacccgaggcctcgcgcgaggatagtggaagtccggatctgtccgagacgacaagcgcatttcatgaggccaatctcgagaggtctagtggcctcggagtttccggatctactctgacattccaggagggagaggcttctgcggcacccgaagtgagcggcgagagcactaccacctcagacgtaggtacagaagcacctggactgccaagtgccacccccaccgcatccggggaccgaactgaaatttcaggtgatctatcgggacacacctcccagctgggcgtggtcatctccacatctatacctgaaagtgaatggacgcagcagacacagcgtccggccgagacacacctggaaatcgagtcctcctcattgctctacagtggcgaggagacccacaccgtggagaccgcaacttccccaactgatgcaagtatccctgcatctcccgagtggaagagggaaagcgagtctaccgctgctgcccctgcccgatcctgcgcagaggagccttgtggtgccggaacctgtaaggaaacagaaggacatgtcatatgcctctgtcctcccggttatactggggaacattgcaacatagatcaagaggtgtgcgaagaagggtggaataaataccaggggcattgctaccggcacttccccgatcgagagacatgggtcgatgctgaacgtcgttgcagggaacagcagtctcacttaagcagtatcgtgacacccgaagagcaggagttcgttaataataacgctcaggactatcaatggataggcctcaatgaccgaactattgaaggtgattttcgttggtctgatggccacccaatgcagttcgagaactggcgccccaaccagcccgataacttcttcgcggccggcgaggattgcgtggtgatgatctggcacgagaaaggggagtggaacgatgttccctgtaactatcatttgccattcacatgcaagaaagggactgttgcgtgtggagaaccacctgtcgtcgagcatgccagaacatttgggcagaaaaaagatcgatacgagatcaatagtctagttcggtaccagtgcacggaggggtttgtccagcgacacatgcccactatccgctgtcaaccatctggccattgggaagagcctcagatcacgtgtacagatcccacgacttataaacggcgtttgcagaaaagaagctctaggcatcccagaagatcccggcctagcactgcccattag

SEQ ID NO: 107734 - DNA, 7296 bp, Artificial Sequence
  Description of Artificial Sequence: Synthetic coding sequence
atgactacattgctgtgggtgtttgtaacactccgcgtgatcaccgctgccgttaccgttgaaacttctgaccatgacaacagcctgtcggtgagtattccacagcccagccccttgagggttctgctgggaactagtttgactattccttgctactttattgatccaatgcatcccgttacaacggcgccttctaccgcccctctagcccctagaatcaaatggtccagagtgagtaaggaaaaagaggtggtgctgcttgtggctactgaggggcgcgtgagggttaacagcgcttaccaggataaagtgtctctccccaattatccagccatcccgtcggatgcaactttagaggtgcaatctctgcgctcaaacgacagcggcgtatatcggtgtgaagtcatgcatggcattgaagactccgaggccaccctggaagtggttgttaaaggcatcgtatttcattacagggctatctccacaaggtacactctggacttcgatcgcgcccagagagcttgcctccaaaattcagctattatcgcaacacctgagcagctccaagctgcctatgaagacgggttccaccagtgtgatgccggctggcttgccgatcagaccgttcgctacccaatccatacgccccgcgaaggctgctatggcgacaaggacgagttcccaggcgtccgcacctacggcattagggatacaaacgagacctacgatgtttactgcttcgctgaggagatggaaggcgaagttttctatgccacctctccagaaaagttcacgttccaggaggcggcgaatgaatgcaggcgtctcggagccaggctcgcgacgacgggtcagctctacttggcctggcaagctggcatggacatgtgtagcgccgggtggctggccgatagatcagttcggtaccccattagcaaagcccgccccaactgtgggggcaacctgttaggcgtcagaacggtgtatgtgcatgccaaccagaccgggtacccggacccttcaagtcgatatgatgcaatctgttacaccggtgaggacttcgtcgacatcccagagaatttctttggggtaggcggcgaagaagatattactgtgcaaacggtgacttggccagatatggagctgcccttgccacgcaacattaccgaaggcgaggcccgaggatccgtgatcttgactgtgaaaccaattttcgaggtgagcccttcacctctggaacccgaggagccctttacattcgctcccgaaattggggctaccgctttcgctgaagtggagaacgaaacgggcgaagccacccgaccttggggatttcccacaccaggcctgggacctgcaactgcttttactagtgaagacctcgttgttcaggttacagctgttcctgggcagccgcacctgcccggaggtgtcgtgttccactatcgtcccgggcccacacgatactccctgacttttgaagaagctcagcaggcttgcctccgcacaggcgcggtcattgcatccccagaacagctgcaggccgcgtatgaagccggttatgagcagtgcgatgccggctggctacgagaccagactgttaggtacccgatagtgtcacctagaacaccatgtgtaggcgacaaggattctagccctggcgtcaggacatacggcgtgcgacccagcacagagacctacgacgtatactgcttcgttgacagactggaaggagaggtctttttcgctaccagacttgaacaattcacattccaggaagctcttgaattttgtgaatcccacaacgcgaccctggctaccaccggccagctatatgctgcttggtcaagagggcttgataaatgttacgctgggtggctggcggacggttcccttcgctatcctatcgtcactcctaggccagcatgcggaggggacaaaccgggtgtgcgtaccgtgtacctttatcctaaccagaccggactccccgatcctctgagcaggcaccacgcattttgtttcagaggcattagcgccgtcccttctccaggcgaggaagagggaggcacacccacctcgccgtctggagttgaggaatggatcgtaacccaagtcgtccccggagtggcagcggtcccagtggaggaggagacaaccgcagtgccgtccggggagacaacagccatcctggagttcacaaccgaacccgagaaccagacggaatgggaacctgcctacactcctgtcggaacaagcccactgcctggcatcctgcctacgtggccccctaccggggcagcaaccgaggagtcgacagagggcccttcagccactgaggtcccctcagcatcagaagagccaagcccttctgaagtgcctttcccctccgaggagcccagcccttctgaagagcccttccccagtgtaaggccgtttccttctgtggaattgttcccatctgaggagcccttcccctcaaaggaaccatctccctcagaggagcccagcgcgtccgaagaaccttatacacccagtcctcctgtccccagttggacagagctaccctcgagtggtgaagagagcggtgctcctgacgtatcaggcgacttcacaggatcaggagacgtctctggccatctcgacttctctggacaactgtccggcgatagggcctccggcctgccatctggtgacctcgatagcagcggtctaacatccactgtgggctctgggctccctgttgagagcggcctccccagcggagacgaagaaagaattgagtggcccagtacccccacagtcggcgaacttccttcaggagcagagatcctcgagggaagtgcttcaggcgtcggggacctcagcgggctccctagcggagaggtactggagacttcagccagtggagtgggggacctctctggcctgccatcaggggaggtccttgaaaccactgcgcccggcgtggaagatatcagcggtttaccatccggagaagtcttagagaccacagccccgggagtggaagatatttcggggcttccgagcggagaagtgctggaaactacggcgcccggggtggaggatatatctggactccccagcggggaggtgctcgagacaacagcccccggtgtggaggacatctccggcctacctagtggggaggtcctggagactactgctccgggtgtcgaggatatctcaggcctgcccagcggcgaggtgctggagaccacggcacccggcgtagaggacatcagcggactgcctagcggagaagtcttagagactgcagcccccggtgtggaggacatttctgggctcccttccggagaggttcttgagacagccgccccgggcgtcgaggacatcagcggactcccttcaggggaggtgctcgagaccgctgcgcctggcgtagaagatatctctggcctgccttctggtgaagtgctggaaacagccgctcccggagttgaggatatctccggcctgccttccggtgaagtgcttgagaccgccgcccccggcgtagaggacatatctggtctaccttcaggtgaggtgctagagaccgcagccccaggcgtagaagatatctccggtctgccttccggggaagtactggaaacagccgctcccggtgttgaagatatttcaggtcttccttctggtgaagtgctcgagactgccgcccctggcgtagaagacatcagcggactgccctccggggaagtactggaaaccgccgctccaggtgttgaggatatcagcggccttccttctggagaggtgctggagacagctgcgcctggagtggaggatatttccggactgccttctggcgaggtcttagagacagcagcccctggtgttgaggacatttctggtttgcccagtggggaggtcttggagactgccgccccgggggttgaagacatctctggactccccagtggagaagtgttggaaaccgcagcccccggtgtggaagacatttcagggttgcctagtggcgaggtattagaaacagctgctcccggggtcgaagatatcagcggtttgccttctggagaggtcctcgaaaccgccgccccaggtgtggaggacatatcagggctcccctcaggcgaagtactggaaaccgccgcccctggagtcgaggatattagcggacttccatccggagaggttctggaaactaccgcccccggagtggaggaaatttcagggcttccttccggcgaggtactcgagacaacggcacccggggtggacgagataagcggcctgccttccggtgaggtcctggagacgacagccccaggggttgaggaaataagtggtctgcctagcggggaagtcctggagacctccacgtccgccgtgggcgacttgtccgggctcccctctggcggagaggtcctagaaatttctgtgtctggagtcgaggacatctcaggactgccatctggagaggtagtggagactagcgcctccgggattgaggacgttagcgagttgcccagtggtgaaggactcgaaacttcagcgtctggcgtcgaagacttgtctagactcccctccggcgaagaagtgctggagatttctgcttctgggtttggcgatctgagcggtctgccgagcggcggcgaaggactcgagacttccgccagtgaagtgggtaccgatctcagcggcctcccttccggccgagaagggctggaaacctcagcttctggagcggaggacctttcaggccttccttcagggaaagaagatctcgtggggtccgccagcggagatctcgatctcggaaagctgcctagcggtacactgggaagcggacaggcccctgaaacctcaggactgccatctggattctcaggcgagtatagtggggttgatctaggatcaggtcccccgtcagggctccctgatttcagtgggttaccgagcggatttcccacagtgagtctcgttgatagcaccctggtcgaagttgttactgcatctactgccagcgagcttgagggtaggggaactattgggatcagtggggccggtgagatcagcgggctgcctagctcagaactggacatctccggaagagcaagcggtctgccctctggcactgagttatccggccaagcaagtggctctcctgatgtgagcggcgagatccctgggctatttggggttagtggccagccttctggcttccccgatacctctggtgaaacaagtggcgtcacagagttgtctgggcttagtagcggccagcctggaatatcaggggaagcctctggcgtgctatatgggacatcccagccattcggcataaccgatctgtcgggcgagacttccggggtccccgacctcagtggccagccatccggcttgcccggtttttctggggccacctctggcgttccagatctggtgtccggtactacctcaggaagcggtgaaagttctggcataacgtttgtcgatacttccttagtggaagtggccccaactacttttaaagaagaagaaggcctcggcagcgtggaattgagcggtctcccatcgggagaggccgacctgtctgggaagtccggcatggtcgatgtgtccggccagttctctggcaccgtggacagtagcgggttcactagccagaccccagagttctcaggtctgcctagtggcatcgccgaggtgagtggagagtctagtcgggccgagataggctcttccctgccttccggtgcatactatggatccgggactcctagcagtttcccaacggtaagccttgttgaccgcactttggtggaatctgttacccaagccccaactgcccaggaggccggcgaagggccaagcggaatcctcgagctttcgggcgcgcattcaggagcccccgacatgagcggtgagcatagcggttttctcgatttgtctgggctgcaatctggcctgatcgagccatctggcgagccgcctggcacaccttatttcagcggagatttcgcatccacgaccaacgtgtctggcgaatcaagcgtggcaatgggcacttccggcgaagcttctggattgccggaagtaacactgatcacaagtgagttcgtggagggtgtgaccgagccaaccatttcccaagagttgggccagcgccctccagtgacccacactccgcagttgttcgaaagttctggaaaggtttcgacagcaggggacatctctggcgctacccccgtgctccctggaagtggggtggaggtaagttctgtgcccgagagcagctctgaaacatcggcataccctgaagccggctttggtgcatctgccgcgcccgaggcatcaagagaagattctggctctcctgatttaagcgagactacttccgccttccacgaagccaacctggagagatcctcaggcttgggcgtatcaggttctactctgactttccaggagggggaagcatccgccgctccagaggtgtctggtgagagcacaactacatcagacgtgggcaccgaagcccccggcttgccttcagctaccccaacagcttccggcgaccgcacagaaatttccggggatttaagcggtcacacaagccagctcggagtggttatctcaacctccataccagagtccgaatggactcagcaaacacagcggcccgccgagacacatctggaaatagagtcatcttccctgttatactcaggagaggaaactcacaccgtggagaccgctacatcgccaactgatgcatctatacccgcaagcccagagtggaagcgggagagcgagtccactgccgcagaccaggaggtttgcgaagagggctggaataagtaccagggtcattgttatcggcacttcccggaccgcgagacttgggtcgatgctgagcgccggtgccgagagcaacaatcccatctttcatccatcgtcacacctgaggagcaggagttcgtgaacaataatgcgcaggattatcagtggattggactgaacgacagaacaatcgagggcgattttcgctggagtgacggccaccccatgcagttcgagaactggcgaccaaatcagcctgacaatttctttgcagccggggaagattgcgttgtgatgatctggcatgagaagggtgagtggaacgacgtcccatgcaactatcacctgcccttcacctgcaagaagggaacggctacaacatacaagcggaggctgcagaagaggtcctcccgccatccaagacgttccaggcctagtacagcccattag

SEQ ID NO: 107735 - DNA, 7593 bp, Artificial Sequence
  Description of Artificial Sequence: Synthetic coding sequence
atgacgactctcctgtgggtgtttgtcactctgcgtgtcatcacggcagcagtaaccgtggaaactagcgatcacgataattcattgagtgtgtccatccctcaaccatcccctctgcgagtgctactcggaacatcgttaaccattccctgttacttcattgatcccatgcatcctgttacaacagcccccagcactgcacctctcgctcctcgcatcaagtggagcagagtctccaaggagaaagaagtggtcctgctggtcgcaacagagggacgcgtgagagtgaatagtgcctatcaggacaaggtgtcgctcccaaattatcccgccatccccagcgatgccacactggaggtgcagtctctgaggagtaacgactctggcgtttacagatgtgaagtgatgcacggaatagaagatagtgaagccacgctcgaagtagtcgttaaagggatcgtgttccattatagggccatatcgacccgctacacactggacttcgaccgcgcccagagggcttgcctgcagaattcagccatcattgccaccccagagcagcttcaggccgcatacgaagacggttttcatcaatgtgatgccggctggctggctgatcagaccgtgaggtatcccattcacacacccagagagggttgctatggagacaaagacgagttcccaggggtacgtacctatggtatccgggataccaatgagacatatgacgtgtactgcttcgcagaggagatggaaggcgaggtgttctacgctacttcccctgaaaagtttaccttccaggaggctgcaaacgaatgtcggcgcctcggcgcccggctagcgacgaccggacagctatatctggcctggcaggcgggaatggacatgtgtagcgctggatggctcgccgaccgctcggtgcgctaccccatctcaaaagcccgacctaactgcggtggtaacttgctcggtgtaagaacagtttacgtgcacgctaaccagactggatatccggaccctagttcacgatatgacgcaatttgctataccggggaagactttgtggatatccctgaaaatttttttggtgtgggcggtgaggaggacatcacagtgcaaaccgttacctggccagacatggaactgcctctgccccggaatatcaccgagggcgaggcgcgcggtagtgtgattctgaccgttaaaccaatttttgaggtgtcacctagcccactcgagccggaggaaccgttcaccttcgcccccgagatcggcgcaaccgcttttgccgaagtggagaacgagaccggcgaggcaactagaccctgggggtttcccacacccggcttaggacctgccacagcctttacttcagaagatctagtcgtgcaggtcaccgcagtgccaggacagcctcatttaccaggcggggtggtgtttcactaccgccccggccccactcggtattctttgacattcgaggaggcacaacaggcctgtctccggactggagctgttatcgcctctccagaacagctgcaagcagcttacgaggccggttacgagcagtgcgacgccgggtggctccgcgaccaaaccgtgcgctacccaatcgtgtctccacgcactccttgtgttggggacaaagactcgtcacctggtgtccgcacctacggtgttcggccgagcacggagacctacgacgtgtactgttttgtcgacaggttagagggcgaggtgttcttcgcaactcggctagagcagttcacctttcaagaagcactcgaattctgtgaatcacataacgccacgctggccacaacgggccagctctacgccgcttggtcacgcggcctcgataaatgctacgcaggatggttggctgatgggagtctccgttaccctatcgttactcctcggccggcttgcggaggggataagcctggtgtgaggaccgtatacctctatcccaaccagaccggactgcccgatcctctgtctagacatcacgctttttgttttcgcggaatttccgccgttcctagtccaggcgaagaggagggagggacccctacgtccccctccggagtcgaggaatggattgtgacacaagtggtgcctggggtcgcagccgtgcctgtggaggaggagacgactgctgtcccctctggagaaactacagccatcttggaattcacgactgagccggagaaccagacagagtgggagcctgcttacaccccagtagggactagcccgcttccaggaattctgcccacctggcctcctactggggcagccaccgaggagtccacagagggcccgtccgctacagaggtgccctccgcatctgaagagccatcccccagtgaggttccttttccatctgaggaaccaagcccgtcagaggaaccatttccctccgtgcgcccattcccaagcgtggaactgtttccatcggaagagcctttcccatctaaggaaccaagcccaagtgaagagccaagtgcgtccgaggagccatataccccttctccccccgttcccagctggactgaacttccaagcagcggcgaggaatctggcgcaccagatgtcagtggggattttaccggcagcggcgatgtgtccggacatctggattttagtggccaattgtcaggggatcgtgcgagcggcttaccttctggcgatttggactcgtctgggttaacttcaaccgttgggagcggccttccagtcgaaagtggactgccgtcaggagacgaagagcgtatcgaatggccaagcactccaaccgtaggggaactaccatctggcgccgaaattctggagggatcagcctcaggtgttggggacttgtctggcctaccctcaggagaagtgctcgagacttctgcttcaggcgtgggagacttgtctgggctaccgtccggcgaagttttggagacaacagcccccggtgtggaggatatcagtggactgccttccggtgaggttttggagactaccgcacctggcgtcgaggacatctcaggcttgccttccggcgaagttctggagaccacagcacccggggtcgaagatatttccgggctccctagcggcgaagtcctggagaccactgcccccggcgtcgaagatatcagcggactgcctagcggggaggtgttagagactacagcaccaggggtggaagatatctcaggtttaccctccggtgaagtgttggaaacaacagctcccggcgtggaagacattagcggtctgccgtctggcgaagttctcgaaacagccgcaccaggcgtcgaagatatctcaggtctgcctagtggcgaggtactggagacagccgccccaggggtggaggatatttccggacttcccagcggagaagtcctggagacagcagcacctggagtggaagatatttctggccttccttcaggtgaggtgttagaaaccgcggccccaggagtggaggacatctcggggttaccatcaggcgaagttttagagaccgcagcacctggggtggaggacatcagtggtctaccctctggagaggtgctagaaaccgcagccccaggggttgaggatatctctggacttcccagtggcgaggtattggagacggccgctcccggagtggaggatatatccgggctcccctccggagaggtgttggaaaccgctgctcctggagtcgaggacatctccgggctcccctccggagaagtactggaaacagcagcacccggtgtcgaagacatctctggcctccccagcggcgaggtgctcgagacggcggctcctggcgtcgaggacatctctgggctaccgtccggagaggttctagagacggccgcacccggtgttgaagatatcagcggcctccctagcggcgaggtgctcgaaaccgcagcgcccggtgtggaggatattagcgggcttccatctggcgaggtgctggagacggctgcccctggggttgaggatatttcaggactgccctctggagaggtactggagactgctgcacctggtgtggaggacatttccggtctcccctccggtgaagttctggaaaccgcagcgccgggcgttgaggatatcagcggactccccagtggggaggtactggaaaccgcagcccccggtgtggaagacatctcgggccttcccagcggcgaggtgctggagactacagctccgggagttgaggagatctcgggcctccctagcggagaggtcctggagaccacagctcctggtgtcgacgagatctccggattaccaagcggcgaggtcctggagacaaccgctcccggcgtggaagagatcagtggcctcccttctggcgaggtactcgagaccagcacaagcgctgtaggcgatctaagtgggttgccatccggcggcgaggttctggagatctccgtcagcggagtggaggatatatccggcctcccttcaggtgaggttgtagagaccagtgcttctgggattgaggacgtcagcgaattacctagcggagaaggcttggagacctcagcctccggtgtggaggatctgagccgcctgcctagtggcgaagaggtgcttgaaatttccgcctctggcttcggcgacttgagtggcttgccaagcggcggagaaggccttgagacctcagctagtgaggtgggtacagatctgagcggactgccatcaggaagggagggactggagacaagcgcttccggagctgaggacttatccggacttccttcagggaaagaagatctggtgggctccgcttccggagacttggacctgggcaaattgccatctgggacacttgggagcggccaagcacctgaaacatctggcttgcctagcggcttcagcggagaatattccggagtggacctgggctccggtccaccctctggactgccagacttctctggactgccttcaggatttccaacagtgagcctggtcgactctaccttagtggaggtcgtgaccgccagcacagcctccgagcttgaaggtcgcgggactattggtatttctggggctggagagattagcggccttccttccagcgaactggacataagcggcagggcctcaggactgccatcagggacagagctctctgggcaggcctctggctcacctgatgtgtctggggaaatccccggattattcggagtgagtggtcaaccctctgggttccctgataccagtggtgaaacatcaggcgtcacagagctcagtgggttgtcatcgggccagcccgggatctcaggggaagcaagcggagtgctgtatgggacctcacagccatttggtattaccgatctgagtggcgaaacaagcggagttccagacctgagtggtcagccttctggtttgccaggcttcagcggagctacgtctggagttccagatctggtgagcgggacgacatccgggtcaggggagtcttctggcatcaccttcgtggatacatccctggttgaagtagctcccaccacattcaaagaagaggaaggactggggtccgtagagctgtctggcttaccttccggagaggctgatctgagtggcaagagtggaatggtcgacgtgagcgggcagttcagtggtacggtggacagctcgggcttcacctcccagacaccggagtttagcggccttccctcaggaattgccgaagtgtccggcgagtcatcccgcgcagagataggatccagcctgccctctggggcctattatggcagcggcaccccctcctccttcccaacggtgagcctggttgatcgaactctggttgagtccgtgacgcaggcgccaacagcacaggaagctggtgagggcccatccggcatactggagctgtcaggtgcccattctggagcccccgacatgtcaggggaacattctggcttcctcgatctttccggtcttcagagtggcctgatcgaaccttctggagagcctcccggtacaccctacttttctggagattttgcctccaccaccaatgtttccggcgaaagcagcgtcgccatgggcaccagtggggaggcgtccggcttgcctgaggttaccctgatcacaagcgaattcgttgagggcgtgacagaacccactattagccaagaactcggccagcgacctcctgtcacccataccccgcagctctttgagtcctcaggaaaagtgtccaccgccggggacatctcaggggccacacccgtactgccaggatcaggagttgaggtctcttcggtgccagagtccagcagcgaaacatccgcatatccggaagccgggtttggcgcaagcgccgcaccggaggcttccagagaagattcagggtctcctgacctgagcgaaaccaccagtgctttccatgaggctaaccttgaacgcagtagtggactcggcgtaagcgggtccaccctgacttttcaggagggggaagccagcgccgctcctgaagtctctggggagtccaccacaacctcagatgtgggaactgaggcaccgggattgccatctgccacgcctaccgcgtctggcgatcgtactgagatttctggagatctgtctggacatacttcacagctgggcgtggtgatctccactagcatcccagagagcgagtggacacaacaaacccagcgcccagccgaaacgcatttagagattgagtcgagctcactgctctactcaggcgaagaaacacacaccgtcgagacagcaacctcccccactgacgcctcaattccagctagtcccgagtggaagcgggagtcagaatccaccgcggctgctcccgctcgaagttgcgccgaggagccatgtggagctggtacttgcaaggaaaccgagggacacgtcatttgtctctgtcctcctggctataccggcgaacactgcaatattgatcaggaggtgtgcgaggaggggtggaacaagtaccagggtcactgttataggcatttcccggaccgtgagacatgggttgatgcggagcggcggtgccgcgagcaacagtcccatttgagttccattgtgaccccagaagagcaagagttcgttaataataacgctcaagactaccagtggattgggcttaatgaccgcacaattgaaggagattttcgatggagtgacggccaccccatgcagttcgagaactggcggcccaaccaaccagacaatttttttgcggcaggcgaggactgcgtcgttatgatttggcacgagaagggtgaatggaacgacgtgccctgcaactaccatttgccttttacctgtaaaaagggcacagtggcctgcggcgaaccccccgtagtcgagcacgccaggaccttcgggcagaagaaagataggtacgaaattaacagtcttgtacgttatcagtgcacagagggatttgttcaacggcacatgcccactattcgttgccagccttcagggcactgggaggagccccagatcacttgcacggaccccacaacttacaaacggcgtctccagaagagatcctctagacatccgaggcgtagtagaccctccaccgctcactag

SEQ ID NO: 107736 - DNA, 7479 bp, Artificial Sequence
  Description of Artificial Sequence: Synthetic coding sequence
atgaccacgctactttgggtgttcgtgaccctgagggtcattacagccgcggtgacagtggagacctctgaccacgacaactccttatcagtctcgattccgcagcctagccctttacgcgtgcttcttggcacctcattaactataccctgctattttattgatccaatgcaccctgtaactacggcgccgtctaccgctcccctggcccctaggatcaagtggagcagggtaagcaaagagaaagaggtggttttgctggtggccaccgagggccgggtccgcgtgaattctgcctatcaggacaaggtgtcacttccaaactacccagccatcccaagtgacgccacactggaggtccaaagcctacggtccaatgattccggcgtgtacaggtgtgaagtgatgcatgggattgaagattctgaggctacattggaggtcgtcgtgaaagggatcgtgtttcactatcgggcgatctccacccgctacaccctggacttcgaccgggcacaaagagcctgcctccagaactctgcaattatagcaacccctgaacagctgcaagcagcctatgaagacggattccaccagtgcgacgcgggctggttggcagatcaaaccgtaaggtatccaattcatacaccgcgtgagggatgctacggagacaaagacgagtttccaggcgtgagaacttatggcatacgggacacaaatgagacctacgacgtgtattgtttcgccgaggaaatggaaggtgaagtgttctatgctactagtcctgagaagttcactttccaggaggccgccaacgaatgtcgcagactcggagcacgcctcgccaccaccggtcagctgtacctagcctggcaggccggaatggacatgtgctccgctgggtggctggctgatcggtccgtgagatatccaattagcaaggctcggccaaactgcggtggtaacctgcttggagtaaggaccgtttacgtgcacgcaaatcaaactgggtacccagatccaagctcccgctacgacgcaatttgctacacaggggaggatttcgtggatattcccgagaatttcttcggcgtcgggggagaagaggacattacagtgcagaccgtcacctggcccgacatggaacttcctttaccaagaaacatcactgagggagaggctcgcgggtctgtgattctgactgtaaagcccattttcgaggttagcccatctcctcttgagcctgaggagcccttcaccttcgctccggaaatcggagccaccgctttcgcggaggtggaaaatgaaactggagaggccacccgcccgtgggggtttcccacacccggcctgggcccagccacagccttcacctccgaagacctagtggtgcaagttaccgctgttcccgggcagccacacttaccagggggagtggtttttcactaccggcccggccctactcggtacagcttgacttttgaagaggcgcagcaggcatgtttgaggaccggcgccgttatagcctccccggagcagctgcaagcagcctacgaagcaggctatgagcagtgtgacgctggctggcttcgagaccagaccgttcggtaccctatcgtttcacctagaaccccttgcgtcggtgacaaggatagtagtcctggagttcgcacatatggcgtgagacccagcactgagacttacgacgtgtattgcttcgttgacaggctggagggcgaagtgttcttcgcaactcgactggaacagttcaccttccaagaagccctggagttctgtgagtcccacaatgcaactctggcaacaactggtcagctctacgctgcatggtctcgcgggcttgataagtgctatgctggttggttagcagacggcagtttgaggtatccaatcgtgactcccaggcccgcttgcggaggcgataaaccgggcgtgaggacagtgtacctgtatcctaatcagacaggactcccggacccactgagtagacaccacgcattctgctttcggggcatcagcgctgtgccctcacctggagaagaggagggcggaactcccacgtcccctagtggagtggaagaatggatcgtcacccaagtggttcctggagttgccgctgtcccggtggaggaggagacaaccgcggttccatccggggaaaccacagcaattctggaattcactactgagccggaaaaccagaccgaatgggaacctgcctacacgcctgtgggaactagtcccttaccagggatcctcccaacctggccaccaactggagccgcaaccgaagagtcaacggaggggccttctgccaccgaggtgccttccgcttcagaggagcccagcccatccgaagtccctttccccagcgaggagccctccccctctgaagagcctttccctagcgtccgaccctttccttccgttgaattgttccccagcgaggaaccttttcctagtaaggaaccttctccatcggaagaaccaagtgcgtctgaggaaccctatacgccctctcccccagtaccaagctggacagagctgccttctagtggagaggagtccggcgcacccgacgttagtggcgacttcacaggtagcggagatgtatccggccacctggacttcagcggccaattatctggggacagagccagtggcctgccctccggcgaccttgactcaagcgggctgacttcaactgtcggcagtggcctccccgttgaaagtgggttgccctccggcgatgaagagcgtatcgaatggccaagcacgcctacagtcggggaactgccttccggggcagaaattctggaagggagcgcaagcggcgttggagacctgagtggacttccttccggggaagtcctggaaacctctgcctcgggagtgggcgacctctctgggctgccttcaggagaagtcctggagaccacagccccaggagtggaggacatttccggtttgccttccggggaggtactggagacaacagctccaggcgtggaggatatctctggtctcccttcaggggaggtgcttgaaactaccgctccaggcgtggaagatatctcaggccttccaagcggtgaggtcctggagaccaccgcaccaggcgtagaagatattagcgggctgcccagcggagaggtgctggagaccactgcaccaggtgtggaagacatttcaggactgccctccggagaagtgctggagactactgcccccggggttgaagacattagcggactacctagcggcgaagtgttagagaccgctgccccaggtgttgaggacatatccgggctaccctccggggaggtgcttgagaccgccgcgcccggtgtcgaggatattagcggcctgccaagcggggaggtgctggaaaccgcggcaccaggcgtcgaggatatctctgggctgcccagcggcgaggtgttggaaacagctgctcccggagtggaggacatcagcggactaccttctggcgaagtgctggaaacagccgcccctggtgttgaagacatctcgggactgcctagcggtgaggtcctggaaacggcagctccgggagtggaagacatttcaggcctaccgtctggagaggtgctcgaaacagctgctcctggggtggaagatatcagcgggttgccaagcggcgaagttctggaaaccgctgcgcctggagtcgaggatatcagtggtctgccgtctggcgaggttctggagacagccgccccaggggtcgaagatatatccggcctgcccagtggtgaagttttggagaccgccgcacccggcgttgaggatatcagcgggcttccaagtggagaagtgctggaaacggctgccccaggcgtggaagacatttctggactgccaagcggggaggtcctggagacagccgctcccggggttgaagacatttcgggccttccaagcggggaggtcctggagaccgccgcccccggcgttgaggacatctcaggattaccctctggagaagtgctcgagactgcagccccgggggtcgaagatatcagcgggctgccctctggagaagttctagaaacagcggcacctggtgtggaggacatctctggcttgcctagcggcgaagtcttagagactgctgcaccaggggtagaggacatcagcggcctgccgtccggagaggtactggagacaacggcccccggtgtggaggaaatctcgggtttgccgagcggggaggttctcgagacgactgcacctggagtcgacgaaatctccggtctcccctccggggaggtgctggaaacgactgcccctggagtggaagaaattagcggactgcccagcggagaagttttggagacttccacttccgccgttggcgacctgagcggtttgccctcaggaggggaggttttagaaattagcgtaagcggcgtggaagatattagtggcctgcctagtggagaggtcgtggaaacatcagcatcaggaattgaggacgtgagcgagttgccttccggcgaagggctcgagacatccgcgagcggcgtggaggatcttagccgacttcctagtggcgaggaagtcttggaaatcagtgcctctggatttggggacctatctggcctccctagcggcggcgagggcctcgagacatctgcctctgaggttggtaccgatctgagtggattaccaagcggaagggagggacttgaaacctccgcctccggcgcagaggacctgtcaggccttcctagcggcaaagaggatctggtcggctcagcttcaggtgatctcgacttggggaaactcccgagtgggacactggggtccgggcaggctccagagacttcgggcctaccctccggatttagtggagagtactcaggggtcgacctgggctcaggaccgccaagtggcctcccagatttcagtgggctcccttcggggtttcccactgtttcgctggtggattctactctggtggaggtggtcacagcatctacagcatcggagctggagggacgtggcaccatcgggatcagcggcgcgggggagatcagtggcttgccgtcaagtgaactcgacatttcaggacgggctagtggcctgccgtcagggaccgaactctctggccaggcaagcggatcacctgacgtgtcaggcgaaatcccaggtctgtttggagtgtcagggcagccatccggttttcccgacacatctggtgagaccagtggcgtgactgagctgtccggactgtcttctggtcaaccgggcattagtggcgaagcgagtggagtgctatatggaacgagccagccttttggtatcaccgacctgtccggcgaaacaagcggggtgcctgacttgagcgggcagccctccggcctaccaggtttcagcggtgccaccagtggtgtacctgatctagtcagtggcacaacaagtggcagcggcgaaagctctgggatcacattcgtggacacctcacttgtggaggtggctcccacaacctttaaggaggaagaaggtctcggttctgttgagctgtcaggcctccccagcggtgaggcggacctctctggcaagagtggcatggttgatgtatccggtcagttctccggcaccgtagattcttcaggctttacaagtcagacgccggagttttcagggctgccaagtggcattgccgaagtcagtggcgagtcgagcagagctgaaatcggatcttcactgcccagtggagcctactacggcagcgggacccctagttcttttcccacagtctccctagtcgatcggacattagtcgagtctgtaacacaagcgcccactgcccaggaagccggagagggaccgtcaggcatccttgagctgtcaggagcgcactccggagcccccgacatgtctggggagcactccggctttctcgatttgtccgggctgcagagcggactaatcgagccatccggcgaaccaccagggacgccctattttagcggggacttcgcttcgactaccaacgtgtccggtgagtctagtgtggcaatgggaaccagtggcgaggccagtgggctgccggaggtgacccttataacaagcgaattcgtcgagggcgtgactgaaccaactatctctcaggagttgggacagaggcctccggtgacacacacgcctcagctctttgaatcaagcggcaaggtgtcaactgcaggagacatttctggcgcgacaccagttctccccggctctggggtagaggtctcctctgttcctgagtcttcatctgaaaccagcgcctatccggaagctggattcggagcaagtgctgcccctgaagcctcaagagaggatagcggtagtcctgacctgagtgagacaacgtccgcattccacgaggctaatctcgaacgatcctccggactaggcgtgtctggctctacactgaccttccaggagggcgaggctagtgcagccccggaagtctctggggaatccacaacgaccagcgatgtgggtactgaggccccaggactcccatccgcaacccctaccgcaagtggtgacagaacagaaatctccggagacctcagtggccacacaagtcagttgggggtcgttatctccacgtccatacctgaatccgagtggacacagcaaacccagcgccctgctgaaacacatctagaaatcgaatcttcgagtctcctgtattctggcgaggaaactcacaccgtggagacagcaacatcccccaccgatgcttctatccccgcatcacccgagtggaaacgagaatcagaaagtactgcagcggatcaagaagtgtgcgaagagggctggaataagtaccagggacactgctacagacactttccagacagggaaacatgggtggatgcagaacggagatgtagggagcagcaaagtcacctgagcagtattgttacacccgaagaacaggaatttgtgaataataacgcccaagactaccagtggatcggtctgaacgatagaaccattgaaggtgatttccgatggtccgatggacatcctatgcagttcgagaattggcggcctaaccagcccgacaatttctttgcagccggggaggattgcgtggttatgatctggcatgagaaaggggaatggaacgacgtgccatgcaattaccacttgccattcacttgcaagaagggaactgtggcctgcggcgagcctccagtggtggaacacgctcgaacattcgggcagaagaaagatagatacgagatcaattccctggtgcggtatcaatgcactgaaggctttgttcagcgacatatgcctactattcggtgtcagccaagcggtcactgggaggagccacaaattacctgcacagacccaactacctataagagacggttacagaaacgatcctcgcgtcatccaagaaggtcccggccatccactgcgcactag

SEQ ID NO: 107737 - DNA, 7593 bp, Artificial Sequence
  Description of Artificial Sequence: Synthetic coding sequence
atgacgacgctgctgtgggtgttcgtaacactgagagtgattacagcagccgtaactgtcgaaacctctgatcacgataatagcctctctgtgtcaattccacagccatctcccttgagagttctgctcggcacatctctgactattccatgctactttatcgaccctatgcaccctgttacaacagcccccagcacagcgccacttgcacctcggataaagtggtctcgggtcagcaaagagaaggaagtggttctcctcgtggctaccgaaggccgagtccgcgtgaactctgcctaccaagataaggtgagccttccgaactacccagccattcccagtgacgcgacgctcgaagttcagtctctcaggagcaatgattctggcgtctacaggtgtgaagtcatgcatggtattgaggactccgaggctacattggaggtggtggtcaagggcatagtcttccattaccgggcaatttccacaagatatacactggattttgaccgagcccagcgagcctgtcttcagaatagcgccatcatcgccactccagaacagctgcaggcagcatacgaggacgggtttcaccagtgtgacgctggatggctggcagaccagaccgttaggtacccaatacacacccccagagaaggctgctatggggacaaggatgagtttcccggcgtccgaacttatggcataagagacacaaatgagacatacgacgtgtactgcttcgccgaggaaatggagggtgaagttttctacgctacatctccggagaagttcactttccaagaggcagccaatgaatgccgaagactcggagcccgcttagcgaccactggccagctataccttgcatggcaggctgggatggacatgtgttcagcagggtggctggctgacagaagtgttcggtatccaatatccaaagcccggcctaactgcggtgggaacttgctcggtgtgcggaccgtgtacgtccacgctaaccagacgggatatcctgacccgagttctcgctatgatgccatttgttacaccggggaggacttcgtggacatccctgagaacttttttggagtgggcggagaggaggatatcaccgtgcagaccgtcacatggcccgacatggagcttcctcttccgcgcaatattacggagggcgaggcacggggttcggtcatcttaacggttaaaccgatatttgaagtttccccctctccactggaaccggaggagcctttcacattcgcccccgagatcggagcgactgcattcgccgaagttgagaacgagacgggcgaggcaacccggccatggggctttccaacaccgggcctcggccccgccactgctttcacttcagaagatttggttgttcaggtcacagcggtgcctgggcagcctcacctccccgggggcgttgtattccactacaggccgggacccacgagatactctttgacctttgaggaggcacaacaggcgtgcctaaggaccggagcagttattgccagccccgaacagctgcaagccgcctatgaagctggatatgaacagtgtgacgcaggctggttacgtgatcagaccgttcgttacccaatagtctccccccgtaccccctgcgtgggcgataaagatagctcacctggcgtgcgtacctacggcgtgcgaccttctacagaaacatacgatgtttactgctttgtggacaggctagaaggtgaggtgttcttcgcaactaggctggagcagttcacgttccaagaagccttggagttctgcgagtcacataatgccacactcgcgaccacgggccagctgtatgctgcctggagccggggcttggataagtgttacgcgggctggcttgctgacggcagtctccgctaccctatagttacacctagacccgcatgtgggggagacaagccaggggttaggaccgtttacctctatccaaaccagacaggccttccagatcccctgagcaggcaccacgccttttgttttaggggaatttctgctgtgccaagccctggcgaagaggagggaggtacaccaacaagcccatccggtgtcgaggaatggatcgtgactcaggtggtcccaggagtagcggcggttccagtggaggaggaaaccaccgccgtaccaagtggtgagaccactgcaatcctcgaatttactactgagcctgagaaccagaccgaatgggagccagcctacaccccggtgggtacatctcccctgccgggcattctgccaacctggccgccaactggcgcagccaccgaagagtcaacagaaggaccctccgccacagaggtcccgtcagccagtgaagagccctccccgagcgaggtgccctttccctccgaggagccctcaccatcagaagaaccctttccttccgtgaggccattcccttccgtggagctttttccatcagaagagccttttcccagcaaagagccatcaccatctgaagaaccttccgccagcgaagaaccctatacacctagcccacccgtcccttcatggacggaactcccttcaagtggtgaggaaagcggagctcccgacgttagcggggatttcacaggatccggcgatgtgagcggtcacctggatttttcaggtcagctctccggagaccgtgcgtctggacttccgtctggggacttggactcctccggtctaaccagcactgttgggagcgggcttccggtggagagcggactcccttctggggacgaggagcgaatagaatggccttccacacccaccgttggagagctgcctagtggagccgagatcctcgaaggcagcgccagcggggttggagacctgagcggactcccttctggagaggtgttggaaactagcgcctccggcgtgggggacctgtccggtctgccaagtggggaggtgttagagaccaccgctcctggcgtagaggatattagcggactgcccagcggagaagtacttgaaacaacagcccctggggttgaagacatatccgggttgccatccggcgaggtgttagagaccaccgctccaggcgtagaggatatctccggactcccctctggtgaagtcctcgagacaacagccccgggagttgaagatattagtgggctcccttcaggggaggttctggagactacagctcccggagtggaagacatcagtgggctgcctagtggagaggtgctggagacaaccgcccctggagttgaggacatcagcggtctgccgagtggggaggttctggagaccgcagctcccggggtggaagacatttccggactgccttcgggggaagtgctggagactgccgctcccggagtagaggatatttcaggacttcctagtggggaggtgcttgagacggctgcacctggcgtggaggacatcagcgggctgccctcaggagaagtgcttgagacagcggcccctggggtggaggacatctcaggtctgcccagtggcgaagtacttgagacagctgcccctggagttgaggacatctccgggctgcccagcggagaggtgctggagactgccgctcctggggtggaagacatctcagggcttccatctggagaagtcctggaaacagcggcgcctggcgtggaggatatcagtgggctccccagcggcgaagtgctagaaaccgctgccccaggtgtggaggatatttccgggctgcctagcggcgaggtccttgagaccgcagctccaggggtagaagatattagtgggctacccagcggagaagttctagagaccgcagcccctggtgtggaggatatctctggcttgccttcaggtgaggttcttgagacagcagcccctggagtagaggacatttctggcctgccgagcggggaggtcctggaaaccgcagcaccaggagtggaggacatcagcggtttgccttcgggcgaagtcctggaaaccgccgcccccggcgtggaagatatttctggactaccttctggggaagtattggaaacagccgccccaggtgtcgaagacatatctgggctgccttccggggaggtacttgagactgccgcgccaggagtcgaagatatttcaggactgccatctggggaggtactggaaactgcggcccccggggtcgaagatatttccggcctccccagcggtgaggtgctcgaaacaaccgccccaggcgtggaagagatcagtggactccccagcggtgaagtgctggaaactacagcaccaggggtagatgaaattagcgggcttccctcaggagaagttttggagactaccgcacccggggtggaagagatcagtggtttgccgtccggcgaggtgctcgagacctctacttcggcggtaggagacctgtcgggcctgccgagcggcggggaggtattagaaatttccgtgtctggagtggaagatatcagcggactccctagcggagaggtcgtcgagacatccgcttctggcattgaagacgtttctgaactgccgagcggggagggtctggagacgtctgcatcgggagtggaggacctgtcacggctgccttccggggaggaggtgctggaaatctccgcctcaggatttggtgatctgagtggactccccagtggtggtgaaggtctcgagacatccgccagtgaagtgggcaccgacttaagcgggcttccctccgggagagagggtctggagacgtccgccagcggagccgaggacttaagcggtctcccttccggcaaggaagatctggtgggtagcgctagcggcgacctggacctcggtaaacttccaagcggcactctgggatccggtcaggcccctgagacttccggactccctagcggcttcagcggcgagtacagtggcgtggatctggggtccggaccccctagcggccttcctgacttctccgggcttccctctggatttcccacagtttcactcgtggactccactctcgtagaggtcgttaccgctagcaccgcaagcgaattggagggcaggggcacaattggcatcagcggggcgggcgagatctccggtctcccttccagcgagctagacattagcggcagggcgtccgggttgccatctggcactgaactgagcggacaggcctccggatcaccagatgtgtccggggaaatccccggccttttcggcgtgtccggacagcccagcggattccctgacacctccggcgaaacatccggcgttacagaactatccggattgtctagcggccagccaggcatctccggtgaggcgtctggagtgctgtatggcaccagtcaaccttttggcattacagatctgtcgggagaaacatctggcgtgcctgacctcagcggccagccctctgggctgccaggattttcaggcgctacatctggggtgccggacttggtgagcggtaccacctcgggctcaggcgagtcctccggtatcaccttcgtcgacacctccctggtggaagtcgctccaacgacttttaaagaagaagaaggcctgggcagtgtggagcttagcggcctccccagcggggaggccgacctgtctgggaagtccggcatggtggacgtaagtggccagttcagtggcactgtggacagttctgggtttacctcccagactcctgaattctcagggctcccatctggaatagctgaggtgtcaggagagtcatctagagctgaaattggctctagtctgccatccggcgcttactatggctctggcacaccctcctcgtttcctactgtgagcctcgtagataggacgctggtcgagagtgtaactcaggcaccaaccgcccaggaagccggcgagggtccttctgggattctcgagctctcaggagcccattcgggcgctccagacatgagcggggagcacagtggatttctggatctcagcgggttacagagtgggctcatcgagccttccggagagccccccggaactccatatttctctggagattttgcatcgaccactaacgtgagcggtgagagcagtgtcgccatgggcacctctggagaggccagtggcctgccggaagtgacactaataacctccgaatttgttgaaggagtgactgagcctactattagccaggagctgggtcagcgtcctcctgtaacacacacgccgcagctctttgagagtagcggcaaggtgagcaccgcgggagacatctcaggagccactccagtgctcccggggagtggcgtggaagtctcatccgttccagagtcgtcatcagaaacctcagcctatccagaggcgggcttcggcgctagtgctgcgccagaagcctcaagggaggacagcggttctcctgacctctctgagactacttctgcgtttcatgaggctaacttggaaaggagttctgggctcggcgtgtcagggagtactcttaccttccaggaaggtgaagcttccgccgctcccgaagtctcgggcgagagtactaccaccagcgatgtgggtaccgaggcccctgggctgccctctgctaccccgacagcctctggcgaccgcactgagatcagcggcgatcttagcggccatactagtcagttgggagtggtgattagcacctccattccggagagcgagtggacgcagcagacccagcgcccagccgagacacatctggaaatagagtctagctcactgctgtattcaggtgaagaaacgcacaccgtggaaacggctaccagtcctactgatgcttccataccagctagtccggaatggaaaagggaatccgaatcgaccgctgcggcaccagccaggtcctgtgcggaggagccctgcggagctggcacctgcaaagaaaccgaaggccacgtgatctgtttatgcccacccgggtatactggcgagcactgtaatatcgaccaggaggtatgtgaggagggatggaacaaataccaaggacattgttaccgccattttccagatagagagacttgggtcgacgctgaacgaagatgtagagagcaacagtcgcacctgtcttccatcgtaacccctgaggagcaggagtttgtgaacaacaatgctcaggactaccagtggatcgggctcaatgacagaacaattgagggcgatttcaggtggagcgacggacaccccatgcagttcgaaaattggcggcccaaccaacctgataacttcttcgccgcaggcgaagattgtgtggtgatgatctggcatgaaaaaggcgagtggaacgacgtgccatgtaattaccatctaccctttacctgcaagaaaggcacagtagcttgcggcgagccgccagtcgtggaacatgctcgcacctttggccagaaaaaggatcggtacgagatcaactcgcttgtccgctatcaatgcactgagggcttcgtgcagcgccacatgcctacaatccgatgccagccctccgggcactgggaggagcctcagattacctgtactgacccgacaacttataaaaggcggttgcagaagcggtctagtagacatccgcgtagaagccggccgagcaccgcacactag

SEQ ID NO: 107738 - DNA, 399 bp, Artificial Sequence
  Description of Artificial Sequence: Synthetic coding sequence
atgttgacagccgctgttctgagttgtgctctgctgctggccctcccggctacccgaggagctcagatgggcttggccccaatggaaggtatacgccggcctgaccaggccctgctgcccgaacttcctggcctcggcctgcgggccccactgaaaaaaacgacggctgaacaagcagaggaagatctgttacaggaggctcaggcactcgcagaggtattggatttacaggatcgggaacctagaagctcccgaagatgcgtgagactacatgagagttgcctcggacaacaagtgccctgctgtgacccttgcgccacttgttactgtagattctttaatgccttttgttactgccgcaagctgggcacggcaatgaatccttgttcccggacatag

SEQ ID NO: 107739 - DNA, 399 bp, Artificial Sequence
  Description of Artificial Sequence: Synthetic coding sequence
atggacgtcactcgcctgttacttgcaaccttgctcgtctttctgtgcttttttacagccaatagccatctgcctccagaagaaaagctccgggatgacagatctctgaggagtaacagctctgtgaacttactggatgttccatccgtctcgattgtggccctaaacaaaaagtccaaacagataggccgaaaagccgccgaaaaaaagcggtctagcaaaaaagaagcctccatgaagaaagtggttaggcctcggacgccattatcagcaccgtgtgttgctacccgcaacagctgtaaacctcctgcccccgcatgttgcgacccatgcgcttcatgtcagtgtaggttctttcgatcggcctgcagctgtagggtgctgagcctgaattgttag

SEQ ID NO: 107740 - DNA, 936 bp, Artificial Sequence
  Description of Artificial Sequence: Synthetic coding sequence
atggctctagaggtggtgtttctggctagggggccctccgggctgctcctctataatggacagaagaccgacggtaagggcgatttcgttagcctcgccctgcgcgacaggcgattggagttcaggtatgatctgggaaagggggccgctgtgatccgcagtcgggagcctgtgacgcttggcgcctggacacgggtgagcctagagcggaatggcaggaagggcgcactgcgcgtgggagacggaccgcgggttttgggagagtctcccaagagtcgaaaggtgccccataccgtcctgaatctcaaagagcctctctatgtcggcggagcccccgacttctcgaaactcgcccgagcagcggctgtgtcatctggctttgatggggcaatacagctggtgtccttgggcggtcggcaattgctgacccccgagcacgtgctgcgccaggtcgatgtaacatctttcgcgggtcatccatgtacaagagcttctggacatccatgcctgaacggtgcgagctgcgtcccacgggaggccgcctacgtgtgcctttgtcctggcggcttttctggcccacactgtgaaaagggtcttgtggagaagtctgccggagacgtggacacactcgcattcgacggtagaactttcgtggagtatcttaacgccgtaacggaaagtgagctcgcaaatgagatccctgtgcccgagacgctggactccggagccctgcacagtgagaaagctctgcagtcaaaccactttgaactgtccttaagaacggaggccactcaaggtttagtactttggagtggtaaggctaccgagcgagccgactacgtggcactggctattgtggatggacatctgcagttatcatacaatctgggctcccagcccgtggttctcagaagcacagtgcctgttaacacatag

SEQ ID NO: 107741 - DNA, 6138 bp, Artificial Sequence
  Description of Artificial Sequence: Synthetic coding sequence
atggccggtcgttcacaccccggacccctgagaccccttctgcctcttcttgtggtcgccgcttgtgtgctgcccggcgccgggggaacgtgccctgaacgcgccctggaacggcgggaagaggaggccaatgttgttctaaccggcacagtggaggagatattgaatgttgacccagtccaacatacatacagttgtaaagtgagggtctggaggtacctgaaaggcaaggaccttgtggcgcgtgagtccctgctcgacggtgggaataaggtggtgatcagtgggttcggcgaccctcttatctgcgataatcaggtgtcgacaggggataccaggatctttttcgtcaaccctgctccgccctacctgtggccagcacacaaaaacgagttgatgttgaactcctcacttatgcgtatcactttgcggaacctggaagaggtagagttctgcgtggaggacaagccaggcactcacttcactccagtccctcccacaccccctgatgcctgccgggggatgttgtgtgggttcggcgctgtatgcgaaccgaatgccgagggaccgggtagagcaagttgcgtgtgtaagaagagtccctgcccatctgtcgtagcccctgtttgcggtagcgacgctagtacctatagtaacgagtgtgagctgcagcgggcccagtgttctcagcagagacggattcgcctgttatcccgtgggccctgcggtagcagggatccatgcagtaatgtgacatgctcttttgggagcacttgcgcaaggtctgccgatggacttaccgcctcttgtctgtgtcccgccacctgccggggggcccccgaaggcacagtttgcggttcggatggcgccgactatcctggcgaatgccagctgctgcggagagcctgtgcccgccaggaaaatgtgttcaagaagtttgatgggccatgtgatccttgccaaggagccctcccagatccttctcgctcttgccgggttaatccacgcacgcgtcgacccgagatgctcctgcgccctgagtcttgcccagctagacaggctcccgtatgcggtgatgatggcgtgacctacgagaatgattgcgtgatggggcgatccggagccgcccggggtttgctcctgcagaaggtgcgttctgggcagtgtcaaggtcgtgaccagtgccccgagccctgtcggtttaatgctgtctgtttatctcgaagggggagacctaggtgcagttgcgatagagtaacatgtgatggcgcttaccgcccagtgtgtgcccaggatggccggacatatgactcagactgttggcggcaacaggcagagtgcaggcagcagcgcgcgatacctagcaagcatcaggggccttgtgaccaagctccctcgccttgcctgggcgtacagtgcgcatttggagctacttgcgccgtaaagaatggccaggctgcatgcgaatgcctccaggcatgctcttctctgtacgatccagtgtgcggtagtgacggcgtcacctatggtagcgcttgcgagctggaagcgacggcctgcaccctgggacgcgagatccaggtagcccgaaaaggcccctgcgaccggtgtgggcagtgtcggttcggagctttatgcgaagctgagacggggcgctgcgtttgcccctccgagtgcgtggcccttgcacaacccgtgtgtggttccgacggacacacatatcccagcgagtgcatgctgcacgtgcatgcttgcacacatcagatatcacttcacgtggctagtgctggaccatgcgaaacctgtggcgatgcagtatgtgcttttggcgccgtttgtagtgctggtcagtgcgtgtgtccccggtgtgaacaccctcctccagggcccgtgtgcgggagcgacggtgtcacctatggaagcgcttgtgagctgcgagaagccgcgtgcttacagcagacacagatcgaggaagcaagggctggcccttgtgaacaggccgaatgcggcagtggaggaagcggctccggcgaagatggggactgcgaacaggagctgtgccgccaaaggggcgggatctgggatgaggatagtgaagacggtccttgcgtatgtgatttttcgtgccaatctgtcccaggcagtcccgtttgtggatctgacggagtgacttattccaccgaatgcgagcttaagaaagcccgatgtgaatcccagcgcgggttgtacgttgcggctcagggagcctgtagagggcccacgttcgctcctctgcctccagtcgctcccctacattgtgcccaaactccctacggatgctgtcaagacaatattactgcagcaagaggtgtgggcctggccgggtgcccttcagcctgccagtgtaaccctcacggatcatatggtggcacctgcgaccccgccacagggcaatgctcctgtcggccaggagtgggagggttgaggtgcgaccgatgtgagcccggcttctggaatttccgtggaatcgtcaccgatggaaggagtggatgcaccccgtgcagttgcgatccacagggagctgtccgagatgactgtgagcagatgaccgggctttgttcttgtaagcccggggtcgcagggccaaagtgtggacagtgccccgatggtcgggccctgggtccagccggctgtgaagctgatgcctcagctcctgcgacatgcgctgagatgcggtgcgagttcggggctcgctgtgtggaagaatccgggtcagcgcactgcgtatgcccaatgctcacctgcccagaggctaacgctaccaaagtgtgcggttctgacggagttacttatggaaacgagtgtcaactgaaaacaattgcatgtcgccagggcctgcaaattagcatccagagcctcggaccatgccaagaggcagtggcaccttccactcaccctaccagcgctagcgttacagtgaccacaccgggtttattgctgtcacaggcgttacctgcaccaccaggtgcattacccctcgcaccttcctccacagctcatagccagaccacccctccgccatcctccagacccaggacaacagccagcgttcctcgcacaacagtgtggcccgtcctaaccgtgccccccactgcaccgtctcctgctccctcccttgtcgcgagcgcttttggagaatctggaagcaccgacggatcctcggacgaggaactttcaggggaccaggaagctagcggaggaggctctggcggtctggagccgcttgagggaagtagcgtggcaactccaggcccccctgtggagcgtgcgtcttgctacaactctgctctaggatgctgcagcgacgggaaaaccccatccctggatgctgagggatcaaattgccccgccaccaaggtttttcagggagtgctagagctggagggggtggaaggtcaggagctgttctacacccccgaaatggctgatcctaaaagtgagctgttcggagaaactgctaggagcattgagagcactctggacgatttgtttcgaaacagcgatgtgaagaaggatttccggagtgtgagacttagggaccttgggcctggaaagtctgtccgcgccatcgtggacgtgcacttcgacccaactacggcttttcgggcaccagatgtggctagggcattactgcgccagatacaggtttctcggcgcagatctctgggggtgcgcagaccgttgcaggagcacgtaaggttcatggatttcgactggtttcctgcgttcatcaccggggccacatctggagctattgctgccggcgcgacagccagggcaacgaccgctagccgtctcccttcctcagctgtgactcctcgggcgccacacccttcgcatacaagccaacccgtcgcaaaaacaaccgcggcccccaccactaggcgaccaccgactaccgcccccagtagggtacctggtaggagacctcctgcacctcagcagccacccaaaccatgtgactcgcagccttgttttcatggcggtacctgccaagactgggcccttggaggcggtttcacttgcagttgccctgccgggagaggcggagccgtgtgcgagaaagtgctcggcgcacccgtgcccgcgttcgaaggcaggtcttttctcgccttcccgaccctccgggcctaccacacactgaggttggctctggagttcagggccctcgagccgcaagggctgttattatacaatggtaatgccaggggtaaagactttttggccctagcactgttggatggaagagttcagctccgctttgatacgggatccggtccggcggtgctgaccagcgccgtgcctgtcgagccaggtcaatggcaccggcttgagctgtctaggcactggcggcgcggcaccttaagtgtggatggggaaactccagttctgggcgagtcccccagtggtacagacggccttaacctggacaccgatctgtttgtcgggggagtccccgaggaccaagctgccgtggcactggaacggactttcgttggcgccggtcttagagggtgcatccggctgctggatgtcaataaccagaggctggaactgggtatcgggccaggggcagctacaagggggtctggagttggggagtgcggtgaccacccctgcctgcctaatccatgtcatggaggggccccctgtcagaaccttgaggcaggcagattccactgccagtgtcctcctggacgtgtgggcccaacatgtgccgatgagaagtcgccttgtcagccgaacccctgtcacggtgccgccccttgcagggttctgcctgaagggggagcgcaatgtgaatgcccacttggtcgcgaaggaacattctgtcaaaccgcaagtggccaggacggaagcggaccctttctggcagatttcaacggctttagtcacctggagctccggggcctgcacacctttgccagggatctcggagagaagatggcactcgaggtcgttttccttgctagaggtccaagtggtctacttctgtacaatggtcagaagacagacggaaagggagatttcgtgtctcttgctttgagggatagaagattagaattcagatacgacttaggaaagggagcagccgtgatacgctcacgggaacctgtgacactcggcgcctggactagagtttccctagaaagaaatggtcgaaaaggagccttgcgagtcggcgatggccctcgggtcctgggggaatcgcccgtgcctcacacagtcctgaatttaaaggaacccctgtacgtcggtggtgcccctgatttttccaagcttgcacgtgccgcagcagtttctagcgggttcgacggagcaattcagctcgtgtccctgggaggtcggcagctcctgacgcccgagcatgtgctgcgtcaggttgacgtgacctctttcgccggacacccttgtaccagggcctcaggacacccatgtctgaatggggcctcttgcgtgccaagagaagcagcttacgtgtgtctctgtccgggcggatttagcgggcctcattgcgagaaaggactggtcgagaagagcgcgggcgatgtggacacgctcgcctttgacgggcggactttcgtcgagtacctgaatgcagtgactgaaagcgagaaagccctgcagtcaaaccactttgaactgtcactgaggaccgaagcaacccagggccttgtgctgtggagtggcaaggcgacagagagagccgactacgtggccctggctatcgtggacggtcacctccagctatcctacaatctcggtagccagccggtggttctgaggtccacagtgccagtgaacactaacagatggctgcgtgttgtggcacacagggaacagcgcgaagggtctctgcaggttgggaatgaggcccctgtcactggttcaagtcccctgggcgcgacccaactggacactgacggagcactgtggctggggggattgcctgaactgccggtgggccctgcgctgcccaaggcctatgggaccgggtttgtggggtgtctgagagacgtggtggtcggtaggcaccccctccacctcttggaggacgcggtaacaaagcccgagttgcggccttgtcctacgccatag

SEQ ID NO: 107742 - DNA, 816 bp, Artificial Sequence
  Description of Artificial Sequence: Synthetic coding sequence
tagcggtatgatcttggaaaaggtgccgctgtgatcagaagcagggagccggtcactctgggagcctggactcgcgtgtctctggagcgaaacggccgcaagggcgcgctccgtgtgggtgatgggccccgcgtgcttggtgaatcgcctaaatctcggaaggtaccccatactgtgttgaacctgaaagagcccctttacgtcggcggcgcccctgatttcagcaagctggccagggccgcggccgtttccagcggcttcgatggggcgattcagctggtttccctgggaggccggcagctgttaacaccggagcatgtcctgcggcaagtagacgttacaagtttcgcgggtcatccctgtacccgagcctcaggccatccatgtcttaacggggcctcctgcgtgccaagagaagccgcatacgtgtgcctctgccctggtggattctcggggcctcattgtgagaagggcctggtcgaaaagagtgccggagacgttgacactcttgcattcgatggccgcaccttcgtggagtaccttaatgccgttacagagtctgaattggccaacgagataccggtgcccgaaactcttgatagcggagctctgcactccgaaaaggctctccagtccaaccattttgagctctcccttagaacagaggcgactcaaggacttgtgttgtggagcggaaaagctactgagagagcggactatgtcgcccttgccatcgttgatggacatcttcagctgtcttataacctgggctcgcaaccggtcgtgttgcgctcaacggtgcccgtgaacacctag

SEQ ID NO: 107743 - DNA, 462 bp, Artificial Sequence
  Description of Artificial Sequence: Synthetic coding sequence
atggcacttgtgttcgtgtatgggactctcaagagaggccagcctaaccatcgcgtgctgagagatggcgcccatggaagcgctgccttcagagctcgcggacggacactggagccatacccgctggtgattgccggcgaacacaacattccttggttgttgcaccttcctggaagcggtcgattagtggagggcgaggtctatgccgtggatgagagaatgctgcgctttttggatgacttcgagagctgtccagccttatatcagaggaccgttctccgggtccagctcctggaggatcgcgcgcctggggccgaagagcctcctgctcccaccgccgtgcagtgttttgtttacagccgagccacatttccacccgagtgggcacagttgccccaccatgactcatacgattccgaaggacctcacggactgcgctacaacccaagggagaaccggtag

SEQ ID NO: 107744 - DNA, 462 bp, Artificial Sequence
  Description of Artificial Sequence: Synthetic coding sequence
atggccctggtcttcgtgtatggtacattgaagcggggccagcctaaccacagagtgctgagggacggagctcatgggtccgcagcctttcgagcacggggaaggactctcgaaccttatccccttgtcatcgctggcgagcacaatataccctggctcctgcacctcccagggtcaggaaggctggtggaaggagaggtttacgcagtggacgaaagaatgctgcggttcctagacgattttgagtcctgtccggcactctaccagagaacggtgctgcgcgtccagctgcttgaagatcgcgcccccggcgctgaggagccccctgccccaacggcagtgcaatgcttcgtatattcaagggccacatttccccccgaatgggcccagttacctcaccatgacagttacgacagcgaagggccccatggcttacgatacaacccccgtgaaaaccggtag

SEQ ID NO: 107745 - DNA, 879 bp, Artificial Sequence
  Description of Artificial Sequence: Synthetic coding sequence
atgaatcctttctggagtatgtctacctcatcagttagaaaacgaagcgagggggaagagaaaaccctgaccggggatgtcaaaaccagtcctccgagaacagcccctaagaaacaacttccgtcgatcccgaaaaacgcgcttcccatcacgaagcctactagtcccgcccccgctgctcagtctaccaacggcacacacgcctcatacggccctttctacctggaatatagcctcttagccgagttcacacttgtagtgaagcagaagctgccaggcgtctacgtacagccttcttaccggtcagccctcatgtggtttggcgtcatatttatccgccacggcttgtaccaggatggagtattcaaattcaccgtttatatccccgacaattaccccgacggagattgcccccgattagtctttgacatacccgtgtttcaccctctggttgacccaacctcaggggagctggatgtgaaacgcgcctttgccaagtggcgccggaatcacaatcacatttggcaggtgttgatgtatgccaggagagtgttttacaagattgacacagcttcacctcttaacccagaggccgctgtcctttacgaaaaggacatacaactgttcaagtctaaggtagttgattcagtcaaagtgtgtacggcacggttgtttgaccaaccaaaaatcgaggacccctacgccattagtttctcaccctggaacccttcggtccacgatgaagccagagaaaagatgctcacccagaagaaacctgaagaacagcacaataaatcggtgcacgtggctgggctgtcctgggtaaaaccaggttcagtgcagccgttcagcaaagaagaaaagaccgtcgctacttag

SEQ ID NO: 107746 - DNA, 879 bp, Artificial Sequence
  Description of Artificial Sequence: Synthetic coding sequence
atgaaccccttttggagcatgagcacgtcctctgttagaaaaagatccgagggtgaagagaagacactgaccggagatgtgaagacttcccctcccagaacagccccgaagaagcagctgccctcgatcccaaagaacgctctgccaatcactaagcctacttcccctgcccccgctgcccagtcaactaacgggacacatgcatcgtacggacccttttacttagaatactctctgctggctgaatttactctggtggtaaagcagaaattacctggcgtctatgtgcagccatcttacagatctgccttgatgtggttcggcgtgatttttatccggcatggcttataccaagatggtgtgtttaaatttaccgtgtatatccctgacaactatccagatggcgattgccctcggttggtgttcgacatccctgtgttccaccccctggtcgatcctacttcaggcgaacttgacgtgaagcgcgccttcgccaagtggagaaggaatcataaccacatctggcaggtgcttatgtacgcccgacgggttttttataaaatcgacaccgccagccccttgaatccggaagccgcggtcctgtatgagaaggacatccagctgtttaagtccaaggtggtggacagcgtgaaggtgtgtactgccaggctattcgaccagcctaagatcgaggatccttacgctatctctttctccccttggaacccatctgtgcatgacgaggctcgcgaaaagatgctaacgcaaaagaagccagaggagcagcacaataagtctgtacacgtcgccgggctctcatgggtgaagcccggtagcgttcagcccttcagtaaggaggagaaaacagtcgcgacatag

SEQ ID NO: 107747 - DNA, 1179 bp, Artificial Sequence
  Description of Artificial Sequence: Synthetic coding sequence
atggcgtcccacaaactgctcgtcaccccccctaaggcgctgttaaagccactgtcaatacctaaccaactcttgctcggaccgggtccatcgaacctgccacctcgaattatggccgccggcggtcttcagatgatcggctccatgtccaaggacatgtaccaaatcatggatgaaatcaaagaaggtattcaatacgtcttccagacccggaacccgctaacactggtcatctcaggatcagggcactgcgctctggaggctgcgctggttaatgtgctagagcccggcgacagtttcctggtcggggccaacgggatatggggccagcgcgctgtcgatatcggggagcggatcggggctagggtgcatcctatgactaaggatcctggcggtcattatactctgcaggaagtggaagaaggattagctcaacacaagcctgtgctgctctttctcactcatggtgaaagctccacaggcgtgctccagcctttagacgggtttggggaattgtgtcatagatacaagtgtttgctcctcgtcgacagcgtggcgagtctggggggaactccattgtacatggatcggcagggcatcgacatcctgtatagcggctcccagaaggctctgaatgcaccccccggtacctcactcatcagttttagcgacaaagcaaagaagaagatgtacagtcggaagaccaaaccgttttccttttacctcgacatcaagtggctggctaacttctggggctgtgatgaccaaccacgtatgtaccaccatactatccctgtgatctccctctactcccttagggagtctctggcactgatcgccgaacaaggcctggaaaattcttggagacagcaccgagaggccgcagcttacctccatggacgtctgcaggcactcggattgcaactctttgtgaaggacccggccctcaggctgccaacagtcactacagtggcagtacctgcgggatatgattggagagacatcgtttcttacgtgatcgatcactttgatatcgagattatgggagggcttgggccaagcacaggcaaagtgctgcgcatcgggctcctgggctgcaatgccacccgcgagaatgtagaccgggtcaccgaagctctccgcgccgccttacagcattgtccgaaaaagaaactatag

SEQ ID NO: 107748 - DNA, 3078 bp, Artificial Sequence
  Description of Artificial Sequence: Synthetic coding sequence
atggagccttttacgaatgatagattgcagttgcctaggaatatgatcgagaacagcatgtttgaagaagaacctgatgttgtagatcttgccaaggaaccctgcctgcatcctcttgagccagatgaggtcgagtatgaaccccggggctcacgcttgctcgtcagagggttgggagaacatgaaatggaagaggacgaggaggattacgagtcctccgccaagttgctagggatgagctttatgaaccggagcagtggcctacgaaactctgcaaccggttatcgacagtcccctgatggagcatgttccgtaccgtccgctcgcaccatggtcgtgtgcgcctttgtaatcgtcgtcgccgtgagcgtgatcatggtgatctatcttctgccccgatgcacatttacaaaggaaggatgtcacaagaaaaatcagagcattggcctgatccagcccttcgctactaacggaaagctattcccctgggcgcagattagattacccaccgcagtggtacccctgaggtatgaacttagcctccacccaaatctgactagcatgacttttcgcggcagtgttactattagcgtccaggccttgcaggttacatggaacattatcttgcactctactgggcacaatatttctcgggtgacctttatgtcagctgtgtcttctcaggagaagcaggctgaaatcttggaatacgcatatcatggccagatcgcgattgtggcccctgaggccctgcttgctggacacaactacactctcaagattgaatactccgcgaatatttcttccagttattacggcttctatggattttcctataccgatgagagcaatgagaagaagtactttgctgcaacccagttcgagcctttagctgcgaggagtgcctttccttgcttcgatgaaccagcatttaaggccacctttattatcaagattatccgcgatgaacagtatacagctttgtctaacatgcccaaaaagagctccgtggtgttggacgatggactcgttcaggacgaattcagcgaatctgtgaaaatgtcaacctacctggttgctttcattgtcggcgagatgaaaaatctgagtcaggacgtgaatggaactctggtatcaatttatgcggttcccgaaaagattggacaggtgcattatgccctggagaccaccgttaagctgctcgagttcttccaaaattatttcgaaatccagtaccccctcaagaagttggatctagtggctattccagactttgaagctggagccatggagaactggggtctgctcacattcagggaggaaactctgctctatgatagcaacacatcttctatggccgataggaagcttgtgacgaaaatcatagcccatgagctggctcatcagtggttcggaaatctggtgacgatgaagtggtggaacgatctgtggctgaatgaaggcttcgctacatttatggagtattttagcttagagaaaatcttcaaggagttatcttcctacgaagacttcctcgacgcccggtttaaaaccatgaaaaaggacagtcttaattctagccacccgatctctagtagcgtgcaatcttctgagcagattgaggaaatgttcgactccctctcttactttaaaggaagtagcctgctgctcatgctaaagacctatttgtccgaggacgtgttccagcatgcagtggtgctttatctccacaatcacagttatgcgtccattcagtctgacgacttatgggacagctttaatgaggttacgaatcagaccttagatgttaagagaatgatgaagacatggaccctccaaaagggcttccctctggtaactgttcagaagaagggcaaagaactatttattcagcaggagagattcttcctcaacatgaaacccgagattcagccttccgatacctcttatctgtggcacatacccctatcttatgtgactgagggcaggaactactcaaaataccagtccgttagcctgcttgataagaagtccggggtgatcaacctcactgaagaggtcctttgggtgaaagtaaacattaatatgaacgggtattacatcgtacattacgccgacgatgactgggaagcactgatccatcaactgaagatcaacccatacgtgttaagcgacaaggaccgtgctaacctgatcaataacatctttgaacttgccggcctgggtaaagtgcctcttaagcgcgcattcgacttgatcaattatctcggtaatgaaaatcataccgccccaatcactgaagctttgtttcaaaccgatctgatctacaatctcctcgaaaagttagggtacatggaccttgccagtcggcttgtaacgcgcgtcttcaaactcctccaaaatcagatccagcaacaaacatggaccgacgaaggcacgccctctatgcgggagctgaggtctgccctcctggagtttgcttgcactcataacctcggaaactgctccacgaccgcaatgaagctgttcgacgattggatggcctctaacggcactcagtccttaccgactgacgttatgacaaccgtcttcaaggtgggcgccaagactgacaagggatggagttttcttctcggcaaatatatctccatcgggagcgaggccgagaagaacaagatcctggaggcactggcttccagcgaagatgtgcgtaagctttactggctcatgaaatcatcattaaatggcgataattttaggactcagaaattatcctttattatcaggacagtgggtcgtcactttcctggccatcttctcgcctgggacttcgtgaaggagaactggaataagctcgttcagaagtttccactaggctcttacacgatccaaaatattgtggcagggtctacttatctgttttctaccaagactcatctgagtgaggtgcaggccttctttgaaaatcagtcagaggctacctttaggcttaggtgtgtccaggaggccttagaggtgatccagctgaatatccaatggatggagaaaaatctcaagtctctgacctggtggctctag

SEQ ID NO: 107749 - DNA, 2907 bp, Artificial Sequence
  Description of Artificial Sequence: Synthetic coding sequence
atggactcaactcttaccgcctctgagataaggcagaggttcatcgatttctttaaacgcaacgagcatacctatgtgcactccagcgccaccattcctttggatgacccgacgcttttgttcgccaacgccggcatgaatcagttcaagccgatcttcctgaacacaattgatccaagccacccaatggcaaagcttagccgggccgctaacacccagaaatgcatacgagcaggggggaagcataatgacctagacgacgtgggaaaagatgtgtaccatcacacgtttttcgaaatgttaggttcttggagtttcggcgattattttaaagagctggcttgcaaaatggctcttgagctgctgactcaggagtttgggatccctatagagcgcctgtacgtgacttatttcggaggagatgaagccgccggactggaggccgacctcgaatgcaaacagatctggcagaatctgggactggacgacactaaaatcctgcctggcaacatgaaggataacttttgggagatgggagatactggcccttgcggaccatgcagtgaaatccactatgacaggattgggggccgcgacgctgctcacctggtcaatcaagacgatcccaacgtgctagaaatctggaaccttgtgtttattcagtataaccgagaagccgatgggattctgaagccccttccaaaaaagagtatcgacaccggcatgggcctggagcggctggtttctgtgctgcagaacaaaatgtctaactacgacaccgacctgtttgtgccctattttgaggctatacagaagggtaccggggcccgcccatacactggcaaagtgggcgcagaggatgccgacgggatcgatatggcctaccgagttctggccgaccatgctaggactattactgtggcattggctgatgggggacgccccgacaatactggacgggggtatgttttaagaagaatcctgcggagagccgtgcgctacgcacacgaaaagttaaacgcttcccgtggcttttttgctacgctggtggacgtggtggtgcagagcctgggcgatgcgttccccgagctgaaaaaagaccctgacatggttaaagacattattaatgaggaagaagtgcagttcttgaagaccctgagcagaggacggcgcattctggacagaaagatccaatcgctgggggacagtaaaaccattccgggagatacagcctggctgttatatgacacatatgggttcccagtcgacttaacaggccttattgctgaggagaagggcctggtggtggacatggacggatttgaggaagagagaaagctcgcacaattgaaatcgcagggtaagggggccggcggagaggaccttatcatgttggacatttatgccatagaggaattgagagcaagaggtctggaggtaaccgatgatagccctaaatacaactaccacctggactcctcagggagttacgtctttgaaaataccgtcgcaaccgtaatggccctcagacgcgaaaagatgttcgtggaagaggtgtccacaggtcaggagtgcggggtcgtgctggacaaaacatgtttttacgccgagcagggcggacagatttacgatgagggttacctagtgaaagtggacgacagttcagaggataagacagagtttacggttaaaaacgcgcaggttcggggagggtacgttctacatattggcactatctacggagacctgaaagtcggcgaccaggtttggctttttatcgatgaacccaggcggcggccaataatgtcaaaccacactgcaacccatatactgaactttgccttgagaagcgtcctcggagaagccgaccagaagggttcacttgttgcgcctgatcgcttgagattcgacttcaccgctaagggagccatgtcgactcagcagatcaaaaaagccgaggaaatcgcgaatgaaatgatcgaagccgcaaaagccgtttatacacaggattgtccactcgctgccgcaaaggcaatccagggcctgagggccgtgtttgacgagacctatcccgatcccgtgcgcgtcgtttctattggagttccagtctccgagctcttggatgatccaagcggaccggctgggagcctgacttccgtcgagttttgtggaggaacccacttaagaaattccagccatgcgggcgccttcgttatcgtcaccgaggaagcaattgccaaaggaattagaaggattgtggccgttactggagcagaagcacaaaaggcactgcgcaaagcagaaagcctcaaaaaatgcctgagcgtcatggaggcaaaagtgaaggcgcaaactgcacccaacaaagatgtgcagagggagatcgcagatctgggcgaagccctcgccacggcagtgatcccccagtggcaaaaggatgagctcagagaaaccctgaagtcgctgaaaaaagttatggatgacttggacagagctagcaaggcggacgttcagaagcgtgtgctggaaaagaccaaacaattcatagactcaaatccaaaccagccgttggtcattcttgagatggagtctggggcgagtgccaaggcacttaacgaggccctgaagctgttcaagatgcactcccctcagacgtcggctatgctctttacagtggacaacgaagcagggaagatcacctgtctctgccaggtaccgcaaaatgcagccaatcggggccttaaggctagtgagtgggtacagcaagtttcaggcttgatggacggcaaggggggaggtaaagacgtcagtgcccaggccacaggaaaaaacgtcggttgtttacaggaggccctgcaactagcaacctccttcgcccaactccgactcggtgacgtgaagaactag

SEQ ID NO: 107750 - DNA, 2958 bp, Artificial Sequence
  Description of Artificial Sequence: Synthetic coding sequence
atggctgcgtcagtggcagctgccgcaagaaggctgcgtcgcgccattcgccggtccccagcctggagaggactttcacatagacctctgagttcagaaccacctgccgcaaaggccagcgctgttagggcagcattcctaaacttctttagggaccgccacggtcatcgactcgtcccatccgcctctgtgagaccaagaggagatccctcgcttctgtttgtgaacgccggtatgaatcagttcaagcctatctttctgggcacggttgacccaagatcagaaatggctggattcaggagagtcgctaattcacagaagtgtgtgagagcaggagggcatcacaacgacctggaggacgtgggcagagatctttctcaccacacatttttcgagatgctaggtaattgggcctttggtggagaatattttaaggaggaagcttgtaacatggcctgggaacttctgacgcaagtttatggtatcccagaagagcgactgtggatttcttactttgatggggaccctaaagcaggcttagatccggacctggagactagggacatctggctctctctcggagtgcctgcctctagagttctctcttttggtcctcaagaaaatttctgggagatgggggatacgggcccatgcgggccctgcaccgaaatccactacgatctggcagggggcgtcggcgcgcctcaacttgtggaactttggaatctcgtgttcatgcagcataatcgagaggctgacggaagtcttcagcccttaccacagcgccatgttgatacgggaatgggactcgagagactggtggcagtcctccagggcaagcactcaacctacgacacagatctgttcagtcccctcttgaatgcaatacagcaggggtgcagagccccaccctaccttgggagggttggcgtggcagacgaaggccggacggacacggcctacagggtcgtggcagatcatatcaggaccctatccgtgtgtatatcagatggcatctttcctggcatgtcagggccacccctagtcttaaggagaatcctgcgaagagcggtaagattctcaatggaaattctgaaggcccccccgggatttctggggtctttggtgcccgtggttgtggaaactctgggtgatgcctaccccgaactacaaaggaattccgctcagattgcgaacttagtttcagaggacgaagccgccttcctggccagtctggagcgggggaggagaattattgataggacgttacggaccctcggccctagcgatatgttccccgcggaagtggcctggtcactgtccctgtgcggcgatctcggtttgccactggacatggtagagctgatgctggaggagaagggcgtgcagctggattccgcagggcttgaaagacttgcccaggaggaggcacagcaccgcgcgcgacaggccgagccagttcagaagcaaggcctgtggcttgatgtacacgccctgggcgagctccagagacagggtgttccacctacagacgactcgccaaaatataactactctcttaggccttcaggctcgtacgagttcggcacctgtgaggcccaagtgctacaattatacactgaagacggtaccgctgtggctagcgtggggaaaggtcaaagatgtgggctcctgctggatcgcacgaacttttacgctgaacaaggaggccaggcttctgaccggggctatctcgtgagagctgggcaggaggacgttttattccccgttgcccgagcccaggtgtgtggggggttcatcttgcacgaagcagtggcccccgagtgcctgagactgggcgaccaggtgcagctgcacgtggatgaagcatggagactggggtgcatggcaaaacacaccgccacccacctgctgaactgggcccttcgacagacactggggccggggaccgaacagcagggatctcatcttaaccctgagcagctgaggctggatgtgacaacacagaccccccttacacctgagcagttgcgggccgtcgagaacacagttcaggaagctgtcgggcaagacgaggctgtttacatggaggaagttcccctcgccctgaccgcacaggttcctggcttaaggtcactggatgaggtgtaccccgaccccgtgcgcgtggtcagtgtcggcgtcccagtggcccacgctctggatcccgcctcacaagcagcactgcagacttctgtcgaattgtgttgtggcacacatttgctcaggaccggggctgtgggggatctggtaatcatcggtgaccgacaactgtcgaagggaactacccggctgctggctgtcactggtgagcaggcccaacaggccagggaattgggccagtccctcgcacaggaagtgaaggccgccactgagaggctttccctaggcagtagggatgttgctgaggcgctacgactatctaaggatatcggccgacttatagaggccgttgaaaccgctgttatgccacagtggcagaggagggaactacttgccaccgtcaaaatgctgcaacggagagcaaatacagcgattcgcaagctgcaaatgggccaggccgctaaaaaaacgcaggaactgctagaacggcatagtaaaggacccttaattgtggacaccgtgagcgccgaatcactctccgttttagtgaaggtggtccggcagctttgtgaacaagccccatcaacatccgtcctactgttaagcccccaacccatgggtaaggttttgtgcgcctgtcaggtcgcccagggcgcaatgcccacgttcactgcagaggcctgggcgttggccgtgtgttcgcatatggggggtaaagcttgggggagtagggttgtggcccaaggtaccggctctacaacggacttagaagccgcactgagcattgcccaaacctatgctttgagccagttatag

SEQ ID NO: 107751 - DNA, 1578 bp, Artificial Sequence
  Description of Artificial Sequence: Synthetic coding sequence
atggaattttgtgtggaggatagcaccgatgtgcatgtgctgattgaggaccatcgaatagttttctcttgcaagaacgccgacggagtcgaactgtacaatgagattgagttctatgctaaggtgaacagcaaagacagtcaggacaaacggagcagtcggagtattacatgctttgtgaggaaatggaaggagaaggtggcatggcctagactgacaaaagaagacatcaaacccgtttggctaagcgtggacttcgacaactggagggactgggaaggtgatgaggaaatggaactcgcccatgtcgagcactatgccgagctgctgaaaaaggtaagtacgaaacggcctcctcctgcaatggacgacttggatttcacgacgactgtcgtatcgtgctgccctgccgagctacaaacggaggggagcaacggaaaaaaggaggtgctcagcggtttccaggttgtgcttgaagacaccgtcctctttccagaaggcgggggacaacccgatgatcggggaacaatcaacgacatctctgtccttcgcgtgacgcggagaggagagcaggccgatcatttcacccagacaccacttgaccctggcagtcaggttttagtcagggtggactgggaacggcggtttgaccacatgcagcagcactcagggcaacacctcatcaccgccgtcgctgaccacctcttcaagctgaagactacttcctgggagctaggaaggttcagatctgccatcgaactggatactccgagtatgacagccgaacaggtagccgccattgagcaatcagtgaacgagaagatccgggaccgcttacctgtgaatgtccgggagctgtccctggacgatcctgaggtggagcaggtcagtgggaggggcctccccgatgatcatgcgggacccattcgcgtcgtaaacattgagggggtggacagtaacatgtgctgcggcactcacgtcagcaatttgtcagacctgcaagttataaaaatactcgggacggagaaagggaaaaagaatcggactaacctaatcttcctgagcgggaacagggtcctcaagtggatggagcggagccacggaacggagaaagcccttacagcactcctaaaatgcggggccgaagaccacgtggaagccgtgaaaaagctccagaattctaccaagatactgcagaagaataatctgaatctgttacgggatctcgccgtccacatagcccacagtctgcgcaattctcccgactggggaggagtggtcatccttcacagaaaagagggagatagcgagtttatgaatatcatagcaaacgaaattggtagtgaggagactcttctgttcctcaccgtcggagatgaaaagggcggcgggctgtttctgttagcaggtcctcccgcctctgtagaaactctgggaccccgggttgccgaagtcctggaaggcaagggagctgggaagaaggggaggttccaaggaaaagcaaccaagatgagtaggaggatggaagcccaagcactgctccaggactacatctccacccagtcggccaaagagtag

SEQ ID NO: 107752 - DNA, 1761 bp, Artificial Sequence
  Description of Artificial Sequence: Synthetic coding sequence
atgttttccctgccgttgaattgcagtcccgaccatatccgccgcggttcatgctggggcagaccccaagaccttaagatcgccgccccagcgtggaactctaaatgccatcccggagctggcgccgcaatggcaaggcagcacgcgcggacactgtggtacgaccgaccacggtacgtctttatggagttctgtgtggaagactctaccgatgtccacgtgttaatagaggatcaccgaattgtgtttagctgtaagaacgctgacggtgtggaactgtacaacgagattgaattttatgccaaggtcaatagcaaggattcacaagataagaggagtagtcgaagcatcacatgcttcgtgagaaagtggaaggagaaagtggcctggcctaggttgacaaaggaggacataaaaccagtctggctgagtgttgacttcgacaattggagagattgggagggcgatgaggaaatggagttagcccacgtggaacactatgccgagttgcttaagaaggtctctaccaagagacctccacctgccatggacgacctggactttactacaaccgtggtgagctgctgtcccgctgaacttcaaacagaaggtagcaatggaaagaaagaggtgctgtctggcttccaggtggtcctcgaagataccgttctgtttcccgagggcggggggcagccagatgaccgagggaccataaacgatatctctgtgttgagggtgacgcggcggggcgagcaggccgaccactttacccaaaccccgctcgatcctggatctcaggtgcttgtccgagtagactgggagcgtaggtttgatcatatgcagcagcattccggtcagcatctaattaccgctgtggccgaccatctattcaagttgaagactacctcatgggagttaggacggtttcgttccgccatcgagttagatactccatctatgaccgctgagcaggtcgcagccatcgaacagtccgtaaacgaaaagatccgggataggcttcccgtgaatgtacgagagcttagcctggacgaccccgaggtggaacaggtctctggcagaggtttgccagacgatcacgctggacctataagggtggtaaacatcgagggggtggactcaaacatgtgttgcgggacgcatgtgtcaaatctttcagatctgcaggttataaaaatcctaggaaccgaaaaggggaaaaaaaaccggacaaatcttatatttctgtctgggaatcgagtcctcaaatggatggaacgatcacacgggactgagaaggctctaactgccctgttaaagtgtggcgcagaagaccatgtggaagcagtcaaaaagctccagaactccacaaaaatcttgcagaagaataacttaaatttgttacgagatctggccgtgcacatcgcgcacagcctcaggaattctccagattggggaggtgtggtcattcttcatcgcaaggagggggactctgagtttatgaatatcatagcaaacgaaattggatccgaggaaacccttcttttcctgacagtcggagacgagaaagggggtggattgttcctgcttgccggtccgccggcatccgtggagactctgggtccccgggtggcggaggtgctggagggcaagggggcggggaagaaaggacgcttccagggcaaagccacaaaaatgtcccggagaatggaagcacaggccctgctgcaagattatatctcaactcaaagtgcaaaggagtag

SEQ ID NO: 107753 - DNA, 1761 bp, Artificial Sequence
  Description of Artificial Sequence: Synthetic coding sequence
atgttctctttgcccctaaattgctcaccagaccacatcaggcgcggcagctgctggggcaggccacaggacctgaagattgccgcacccgcctggaacagtaagtgtcacccaggcgccggcgccgccatggccaggcaacatgcccgtactctgtggtatgatagaccacgatacgtcttcatggaattctgcgtggaagactctactgatgtccacgtcctaattgaggatcatcggatcgtcttttcttgtaagaacgccgacggcgttgaactctacaatgagattgagttttacgcaaaagtcaattcaaaggattcgcaagacaagcggtcctcccgcagcataacctgcttcgtgcggaaatggaaggagaaagtggcgtggccccgcctgaccaaggaagacatcaaacccgtttggctatccgtcgacttcgacaattggcgggactgggaaggcgatgaagaaatggagttggctcatgtggagcactatgccgagctcctgaagaaggtgtcaacgaaacggccaccccccgccatggacgatttggatttcactactacagtggtgtcctgttgcccggccgaactccagactgaggggtccaacggtaagaaagaagtcttatctgggtttcaggttgttctggaagatacagtgctctttccagagggaggaggccagccagatgatcgcggtaccatcaatgacatcagcgtgctcagggtaactcgccggggtgaacaggccgaccacttcacacagacccctctggaccctggctctcaagtgttggttcgcgtggactgggaaagacgcttcgaccacatgcagcagcactcggggcagcacttgatcacagcagtggcagatcacctattcaaacttaagaccaccagctgggaacttggtaggttcagatctgccattgagctcgataccccatctatgacagccgagcaggtggcagccattgaacagagcgtaaacgagaaaatccgcgatcggctcccagtgaacgtgagggaattgtcgctggatgacccagaagtcgaacaagtgagtggtagagggctacccgatgaccacgcagggcccatccgagttgttaatatcgaaggggtcgactcgaatatgtgttgtggcacacatgtttctaatctgagcgacctgcaggtgatcaagatcctggggacagagaagggcaagaagaaccgcacaaatctgattttcctgtccggtaacagagtgctgaaatggatggagcgcagccacgggacagaaaaagcgttaaccgctctcctaaagtgtggcgccgaggatcatgtggaagccgtgaagaagctgcagaacagcacaaagattcttcagaagaacaacctaaatctgctccgggatctggccgttcacatcgcgcattccctgaggaattctcccgactggggtggcgtggtgatcttgcatcgaaaggaaggcgactctgaatttatgaatattattgcaaatgagatcggctcggaagagacgctgctgtttctgacagtgggggacgagaagggcggtggcctgtttttacttgccggacctcctgctagcgtggaaacgcttggcccccgcgttgctgaggtgttagaaggcaaaggagcgggtaagaaaggacgttttcaaggcaaagccacgaagatgtccaggcggatggaggctcaggccctgcttcaagactatattagtacgcaaagtgccaaagagtag

SEQ ID NO: 107754 - DNA, 1239 bp, Artificial Sequence
  Description of Artificial Sequence: Synthetic coding sequence
atggcattttggtgtcagagagatagttacgcccgagagtttaccaccacagtcgtatcctgttgtcctgcagagctgcagacagaaggaagcaacgggaagaaggaggtgctgtccggatttcaggtggttctggaggatacagtccttttccctgaagggggaggacagcccgacgacagaggtaccataaatgacatttcagttctgcgggtgacaagacggggagaacaggccgatcattttacccagacgccactggacccaggaagtcaagtgcttgtcagagtggactgggaaagacgtttcgatcacatgcaacagcattctgggcaacatctgatcacggctgtggccgaccacttgttcaaactcaaaactaccagttgggaactcggaaggtttcgttctgctattgagctagacacacccagtatgactgcagagcaggtcgccgccattgagcagagcgtgaacgaaaaaatacgcgatcggcttccggtgaacgtgcgtgaactctccctggatgatccggaagttgagcaggtgtccggtcggggcttgccagacgatcacgccggcccgatccgcgtcgtgaatatcgagggggtagatagtaatatgtgctgcgggactcacgtcagcaacctctctgatttgcaggtgataaagatacttggaacagaaaagggtaaaaagaaccgaacaaacctcatatttctatctggcaacagagttttgaagtggatggagaggtcacatggaaccgagaaggcactaacagcactcctcaagtgcggggctgaagaccatgtagaggccgtgaagaaactccagaacagtacaaaaatactgcaaaaaaacaacttgaatctcttacgggacctcgccgtgcacatcgcccactctctcagaaattctcccgactggggcggcgttgtgatattgcacagaaaggagggggacagcgaattcatgaacatcatcgccaatgagatcggcagcgaagagactctgcttttcctcaccgtgggcgatgaaaaagggggcggcctgtttctgctggccggccccccagcatccgtggagactctcggcccccgagtggcagaagtgttagagggtaaaggtgccgggaagaaagggagattccaagggaaggcaacaaaaatgagccgtcgtatggaagctcaggctctactgcaggattatattagcacacagagcgcaaaggaatag

SEQ ID NO: 107755 - DNA, 501 bp, Artificial Sequence
  Description of Artificial Sequence: Synthetic coding sequence
atgttttctctaccgttaaattgttctcccgaccatattagacgaggttcctgctggggacgtccacaggaccttaagattgctgcccccgcttggaactccaaatgtcaccccggcgcgggcgcagcgatggccagacaacacgcgcgtacgctatggtatgatcgaccgcgatacgtgttcatggaattttgcgtcgaagactccacagatgtccacgtgctcattgaagaccaccgcatcgttttctcctgcaagaacgctgacggggtggagctttacaacgagattgaattctatgccaaggtaaacagtaagcctgtatggcttagcgtggatttcgacaattggcgtgattgggagggtgacgaggagatggaactcgctcatgtggagcactacgcggagctgcttaagaaagtgagcacaaagcggccgccccctgctatggacgatctggacgatgatagcgattcagccgacgatgccacctctaattag

SEQ ID NO: 107756 - DNA, 399 bp, Artificial Sequence
  Description of Artificial Sequence: Synthetic coding sequence
atggaattttgtgtagaggacagcactgatgtacacgtgcttattgaggatcaccggatcgtcttctcatgtaaaaatgcggacggtgtggaactttataacgagattgaattctacgcaaaagttaactccaaggactcccaggacaaaagaagttcccgctctatcacgtgcttcgtgcggaagtggaaagagaaagttgcatggcctagactaacaaaggaggacatcaagcctgtatggctgtcagtggactttgataactggagagattgggagggcgacgaagagatggagctggcccatgtcgagcattacgccgagcttctgaagaaagtgtcaactaagagacctcccccagcaatggacgacctcgactttacaacgacagtggtgtag

SEQ ID NO: 107757 - DNA, 1830 bp, Artificial Sequence
  Description of Artificial Sequence: Synthetic coding sequence
atgaagtgggtgacattcatctccttgttgttcttattttcctctgcatattccaggggcgtcttcagacgggacgctcataagtccgaggtggcccatcggttcaaagatttgggcgaagagaactttaaagctctggtactgatcgctttcgcacagtatctacaacagtgcccctttgaagatcacgtgaaactggtaaatgaggtcacagaattcgccaagacgtgtgttgcagacgagtccgcagaaaactgtgacaaaagcctccacaccttattcggagacaagctctgtaccgtggcaacacttagagaaacgtatggagagatggccgactgctgtgcaaagcaggaaccagagagaaatgagtgcttcttacagcacaaggatgacaaccccaacctgccccgcctcgtcaggccagaagtggacgtcatgtgcactgcgttccacgataacgaggaaacctttctcaagaaatatttgtatgaaatagcccggcgccatccctatttttacgcccctgaattgctgttttttgccaaacgctataaagccgcttttacagagtgttgccaagcagctgacaaagccgcttgtctcttaccgaagcttgatgagctgcgggatgagggtaaggcgtcgagcgcaaaacaacgtctcaagtgtgcctctctccagaaatttggtgaacgggccttcaaggcatgggccgtcgcacggttatcccaaagatttcccaaggctgaattcgccgaagtttccaaattggttaccgatttgacgaaagtgcacactgagtgctgccatggcgacctgctggaatgcgcggacgaccgggcagatttggccaaatacatctgcgagaaccaagactctatcagtagcaaactaaaagagtgctgcgaaaaacccttgctggagaagagtcactgtatcgctgaagtggagaatgacgagatgcccgctgatttgccgtctctggccgctgacttcgtggagtcaaaagacgtgtgtaaaaattatgccgaagcaaaggacgtttttctgggcatgtttctgtacgaatatgcccggagacatcccgactattccgttgtcctcctcctgcggctagcaaaaacatatgagactacgctagaaaagtgctgcgctgctgccgatcctcacgagtgttacgctaaggtgtttgatgaatttaagcctctggtggaagagcctcagaatttaattaagcagaactgcgaattgttcgagcaattaggggagtataaatttcagaatgcgttgctggtgaggtataccaagaaggttccacaagtctcgactcccacccttgtcgaggtgagcagaaacctgggcaaagtggggagtaaatgctgcaagcatccagaagcgaaacgaatgccttgtgcagaggactatttaagtgtggtgctaaaccaactttgcgtgctgcacgagaagacccccgtcagcgatcgggtcaccaaatgttgcaccgaatcccttgtcaacaggagaccctgtttcagtgccctggaagtggatgagacttacgttcctaaggagttcaatgcggagacattcacctttcacgcagacatctgcacattgagcgaaaaagagcgccaaattaaaaagcagactgctttggtggagcttgtgaaacacaaacctaaagccactaaagaacagctgaaggccgtgatggacgatttcgccgcctttgtcgaaaaatgctgcaaggccgacgataaagagacgtgtttcgccgaggagggtaaaaaactggtcgcagcatcccaggccgccttgggactctag

SEQ ID NO: 107758 - DNA, 1191 bp, Artificial Sequence
  Description of Artificial Sequence: Synthetic coding sequence
atgaagtgggtgacattcatttccctgctattcctattttcttctgcctactctcggggggtttttcgcagggacgctcataagtccgaagttgcacaccggttcaaggatctgggggaagaaaacttcaaggccctagtactgattgcttttgctcagtatctgcagcaatgccctttcgaagaccacgttaaactggtaaatgaagttaccgagttcgccaagacttgcgtggcagacgagagcgcagagaactgtgacaaatctctgcataccttatttggtgacaagctgtgcaccgttgccacgcttagggaaacgtacggagaaatggcggattgctgcgccaagcaggagcctgagcgaaatgaatgcttcctgcaacacaaagatgacaacccgaatcttcctagactagtgagacccgaagtcgacgttatgtgtaccgccttccatgataatgaagaaactttcttaaagaagtacctgtacgagaccactctggagaagtgctgcgctgccgctgacccccatgagtgctatgccaaagtattcgacgaattcaagcctctggtagaggagccccaaaatcttattaaacaaaattgtgaactgttcgaacaacttggggaatataaatttcagaacgccctcctggtgcggtataccaagaaggtgcctcaggttagcacgcccacattggtcgaagtctctaggaatttaggcaaggtgggtagcaaatgctgcaagcatccagaggccaagcggatgccgtgtgccgaagattacttatctgtggttcttaatcagctgtgtgtcctccacgagaagacccccgtgtctgacagggtcacaaaatgttgcaccgagtctcttgtgaataggaggccatgttttagcgcgctggaggttgacgaaacctatgttcctaaagagttcaacgctgagacgttcacgtttcacgcggacatttgcactctttccgaaaaggaacgccagatcaagaagcagactgcactggtcgagctcgtgaagcacaaaccaaaggctactaaggagcagctgaaagcagtaatggatgacttcgctgcctttgttgaaaagtgctgcaaggctgatgataaagagacttgcttcgcagaggagggaaagaaactcgtggccgcatctcaggccgcgctgggtttgtag

SEQ ID NO: 107759 - DNA, 1254 bp, Artificial Sequence
  Description of Artificial Sequence: Synthetic coding sequence
atgaaatgggtcacgttcatttctctactctttctattttcaagcgcttactcaaggggcgtatttcgtcgcgacgcgcataagagcgaggtggcccaccggtttaaagatctaggagaggagaactttaaagctctcgcggtggcacgcctgtctcagcggttcccaaaggccgagttcgccgaggtctccaagctggtgactgacttaactaaggtgcacactgagtgctgccacggggacttactcgaatgcgccgacgaccgggccgatttggcaaaatatatctgcgagaatcaggacagtatctcttcgaagcttaaagaatgctgcgagaagcctctgcttgagaaaagccactgtatcgccgaagtcgaaaatgacgaaatgccggccgatctgccttccctggcggctgatttcgtcgagtcaaaagatgtatgcaagaattacgccgaagctaaggacgtgtttctgggcatgttcctttacgagtacgcccgtagacatcccgactattctgtggtacttctcttgcggcttgccaagacctacgaaactacacttgagaagtgctgcgccgccgcggatccccacgaatgctacgctaaagtatttgacgaattcaaaccactcgtggaggagccacagaacctgatcaaacaaaattgtgagctattcgagcagcttggggagtacaagttccaaaacgccttactcgtacggtataccaagaaggttccgcaagtgtcgacacccacgctggtggaagtttccagaaatctgggcaaagttggatccaaatgctgtaaacaccctgaagcaaagcgaatgccctgcgccgaggattacctctctgtggtgttgaaccagctgtgcgtgcttcacgaaaagacacctgtgtccgacagggtgacaaagtgctgcactgagtctttggtgaaccgacgcccgtgtttctccgctttagaagtcgatgaaacctatgtcccgaaagaattcaatgctgagacatttacctttcacgccgacatatgcactctgtcagagaaagagagacaaattaagaagcagaccgccctggtggagcttgtgaaacacaagcctaaggccactaaggagcagttgaaggcagtcatggatgactttgcggctttcgtagagaagtgctgcaaggccgatgacaaagaaacatgctttgccgaagagggcaagaagttggtggccgccagccaagccgcactgggcctgtag

SEQ ID NO: 107760 - DNA, 1857 bp, Artificial Sequence
  Description of Artificial Sequence: Synthetic coding sequence
atgaaatgggtgacattcataagtctgctgttcctgttctccagcgcctactcccggggcgtctttagacgcgacgcgcttttcctcttcttcttcccttgtccagataagtctgaggtggcccacaggttcaaggatttgggagaggagaatttcaaggcacttgtgctgatcgcctttgcacagtatctccagcagtgtcctttcgaagaccacgtgaaacttgtcaacgaggtgacagagtttgcgaagacatgcgtagctgacgaaagtgctgagaattgcgataaatccctgcacactttgtttggcgacaagctatgtaccgtagctacgctccgcgagacgtacggagagatggcagactgttgcgcgaaacaggaacccgagagaaatgaatgtttcctgcaacacaaggacgataacccaaatttaccccgtctagtgcgcccagaagttgatgtgatgtgcactgccttccacgacaatgaagaaacatttctgaagaagtacctctatgaaatagcgcgaagacatccctacttctatgcgcctgagctgctgttcttcgctaaacgatacaaagcggcctttacagaatgttgtcaggccgccgataaagccgcctgtctgctgcccaaacttgacgagttgagagatgagggcaaagccagctctgccaagcagcggctgaaatgtgcttcactgcagaaattcggagagcgggctttcaaggcctgggccgttgccagactttctcagagatttcccaaagctgagtttgcggaggtctctaaactggtgacagatctgacgaaggtgcacaccgagtgttgccatggtgacctgttagagtgcgctgacgatagggccgacctggccaaatatatctgtgagaaccaggattcgatatcatccaaacttaaggaatgctgtgagaagcccctgctggagaaaagtcactgtattgctgaagtagaaaacgatgaaatgcccgcggacctcccgtctctcgctgctgattttgtagagagtaaagacgtttgtaagaactacgccgaggccaaagacgtattcctgggtatgtttttgtacgagtacgcacggagacaccccgactactccgtggtcctcctactgcgcctagcaaagacatatgaaacaaccctggaaaaatgctgtgccgccgcagaccctcatgagtgttacgccaaagtgtttgatgagtttaaacccctggtcgaggagccacagaacttaattaaacagaactgcgagctatttgagcaactgggtgagtataaatttcaaaatgctcttctggttagatatacaaagaaggtgccccaggtgagtaccccaactctggtagaggtgagccggaacctaggaaaggtcggctctaagtgctgcaagcaccctgaggcaaagagaatgccatgtgccgaagactacctctctgtggtgctgaaccagctttgtgtcctgcacgagaaaacccccgtgtcagatcgtgtaactaagtgctgtaccgaatcattggtgaatagacggccctgcttttcagccttggaagtcgacgagacctacgtccccaaggagtttaatgctgaaacatttacgttccacgccgacatctgcacattgtctgagaaagagagacagattaaaaaacagaccgcactggtggagctcgtgaaacacaaacctaaggcaactaaagaacagctgaaggccgttatggacgactttgccgcgttcgtagaaaaatgctgcaaagcagacgataaggaaacctgctttgccgaagagggtaagaagttggtggccgcgagccaggccgccctgggcctctag

SEQ ID NO: 107761 - DNA, 1161 bp, Artificial Sequence
  Description of Artificial Sequence: Synthetic coding sequence
atgtttgctgaaattcagatccaggacaaggatagaatgggtactgcaggaaaggtgattaaatgcaaagctgcagtgttgtgggaacagaaacagcccttttcaatcgaagagatcgaagtggcacccccaaagaccaaagaagtgagaatcaagatattagcaaccgggatctgtcggacagatgatcacgtgatcaaaggaacaatggtgagcaagtttccggtgattgtgggacatgaagctacagggattgtcgagagtatcggcgagggcgtgactactgtaaaaccaggcgacaaggtcattcccctgtttctaccccaatgccgtgagtgcaatgcctgtcggaacccggacgggaatctgtgcatccgctccgacattactggccggggagtcctcgcggatggcactactcgatttacatgtaagggcaagcctgtacaccacttcatgaatacctccacattcactgagtataccgtagttgacgaaagttcggtggcaaagatagacgacgctgcgccccctgagaaggtgtgtctgatcggttgcggcttcagcactggttatggcgccgccgtgaagaccggcaaggtgaaacctgggtccacttgcgttgttttcggattaggtggtgtggggctaagtgtcattatgggctgtaaatccgccggggcttctcgtatcatagggatcgatctgaataaggataaattcgagaaagcgatggctgttggagcgactgagtgtatcagtcccaaggattccaccaagccaatctctgaagtcctgtctgagatgaccggaaataacgtcggctacacctttgaggttatcggtcacctggagactatgatcgacgctttggcatcatgtcacatgaactacggaacttcggtggtcgtgggcgtaccacctagcgctaagatgctgacctatgaccccatgctgttgtttaccgggcgaacttggaaagggtgtgtctttggcgggctaaagtcccgggatgacgttcctaagctggttaccgaattcctcgccaagaagttcgacctggatcaactgattacacatgttttgccgtttaaaaagattagtgagggttttgagctcctgaactctgggcagagcattaggaccgttctaacattttag

SEQ ID NO: 107762 - DNA, 1128 bp, Artificial Sequence
  Description of Artificial Sequence: Synthetic coding sequence
atgtccacagctggtaaggtgattaaatgcaaagctgccgttttgtgggaagtgaaaaagccttttagcatcgaagacgtggaagtggctcccccgaaagcttacgaggtgaggattaaaatggtggcggtgggcatctgtcacacagatgaccacgtggttagcggtaacctcgttaccccactccccgtgattttgggccacgaggccgcaggcatagtcgaaagcgtgggcgagggcgtgaccacagtgaaacccggcgacaaggtgatcccactttttaccccccagtgcggaaaatgccgggtgtgtaagaatccggaaagtaactattgcttgaagaatgatctggggaaccctagagggacactgcaagatggaacgaggcgttttacatgtagaggtaagcctattcatcattttctggggactagcaccttttcgcaatatacagtggttgacgagaatgccgtggctaaaatagacgccgcatcccccctcgagaaagtgtgtctgataggttgcgggttctcaacagggtatggatctgccgtcaacgtggccaaggtcacccccgggagtacctgcgctgtatttggcctgggcggagtggggctgtctgcagttatgggctgtaaagctgctggtgcagcgagaatcatcgctgtcgacatcaataaagacaaattcgcaaaagccaaggagctgggagccactgaatgtatcaacccgcaagactataagaagccaattcaagaggtactgaaggagatgaccgatggtggggtggatttttcctttgaggtgattggtcgattggacacgatgatggcgtcattattatgttgtcatgaggcctgcggcacaagcgttatcgtcggagttccccctgcttcgcaaaatctttcaattaaccccatgctgcttttgaccgggcgtacgtggaagggcgccgtgtatgggggctttaagagcaaggaagggatcccgaagctggtagcagattttatggcaaagaagttctccctcgatgctctaattactcatgttctgcccttcgagaagattaatgagggctttgacctcttgcactccggaaagtctattagaaccgtgcttactttctag

SEQ ID NO: 107763 - DNA, 1008 bp, Artificial Sequence
  Description of Artificial Sequence: Synthetic coding sequence
atggtggcagtggggatctgccataccgacgatcatgtggtcagcgggaatctggttacacctcttcccgtcatcctgggacatgaggcagccggtatcgtggagtcagttggggaaggtgttaccacagttaaacccggggacaaagtgattccgttgtttacccctcagtgtggaaaatgccgtgtctgtaagaatcctgagagcaactattgtctcaagaatgatctaggaaatcctcgcggcacactgcaggacggcacacgtaggtttacttgccggggtaaaccgattcatcactttctgggaacctctactttttcacagtacaccgtggtggatgaaaatgctgtcgctaagattgatgccgcttctccactcgaaaaggtgtgtctaatcggatgtgggttttctaccggctacggctcagcagtgaacgtcgccaaggttacgccagggtctacctgcgcagtgtttggcctggggggagtcggtctgtctgccgtaatgggctgcaaagctgcaggcgctgcgaggatcatcgccgtcgacatcaataaggacaagtttgccaaggcaaaagagctgggggcaacagaatgtattaatccacaggattacaagaagcctattcaggaggtgctgaaggaaatgaccgatggaggtgtggatttctcttttgaggtcattgggagactagacaccatgatggcctcacttctatgttgccatgaggcctgcggaaccagcgtgattgttggcgtgccccccgcttcccagaatctgtcaatcaaccccatgctgctattaacgggacgcacttggaagggggctgtgtacggcggtttcaagagtaaggagggaattccaaagctcgtcgccgacttcatggccaagaagttttctctggatgctctgatcactcacgtgcttccgtttgagaagattaatgaaggtttcgatctactgcacagcggcaaatcaattagaactgttctcacgttttag

SEQ ID NO: 107764 - DNA, 1089 bp, Artificial Sequence
  Description of Artificial Sequence: Synthetic coding sequence
atgtcgaccgccggcaaggtgatcaagtgtaaggctgccgtgctctgggaagttaagaagccattttcaattgaagacgtagaagtggctccgccgaaggcttacgaggtaaggatcaagatggtcgctgtagggatttgccacaccgacgaccacgtcgtgtccgggaacctggtgaccccactccctgtcatcctcggacacgaagctgccggcattgtggagagtgtcggtgaaggcgtcaccaccgttaaacctggcgacaaagtcataccactctttactcctcaatgcggcaagtgccgagtgtgcaaaaaccctgaaagtaactactgcttgaaaaatgacctgggaaatccgcgtggcaagcccatccatcacttcttggggacctcaacgttctctcagtatacagtagtcgacgaaaacgccgtggctaagatcgacgccgcctccccactggagaaagtgtgcctcattggttgcggcttttcaactggatacgggtccgccgtgaacgtcgccaaagttactcccggatccacttgtgcagtgttcggcctaggcggagttggcctgagcgccgtgatgggatgcaaagccgctggcgctgcgcgaatcatcgccgtcgatatcaataaagataaatttgctaaggctaaagagctgggtgctaccgagtgtattaacccccaggattacaagaagccgattcaagaggtgttgaaagaaatgacggatggtggagtggatttttctttcgaagtgattggacggctggacacaatgatggccagcctactatgctgtcatgaagcatgcgggaccagcgtaattgttggagtaccaccggcctcccagaacctgtccatcaacccaatgctgttgctgactggtagaacctggaagggagcagtttacggaggttttaaaagcaaagaggggatacctaagcttgttgcagattttatggctaagaagtttagcctcgatgctctgatcacccatgttctgccgttcgagaagatcaacgagggctttgacttgctccacagtggaaaatccatcaggaccgtcctcaccttctag

SEQ ID NO: 107765 - DNA, 1143 bp, Artificial Sequence
  Description of Artificial Sequence: Synthetic coding sequence
atggggaccaagggaaaggtcatcaagtgtaaggcagctatcgcttgggaggccggcaagcctttatgcatcgaggaggtggaagtcgcaccgcctaaggcccatgaagtgcgtatccaaatcatcgctacgagtctttgccacaccgacgctacagtgatagattccaagttcgagggcctggctttccccgtcattgtggggcatgaagccgcagggatagtagaaagtattggaccaggggtaactaatgttaagccgggggacaaggtgatcccgctgtacgcccctctgtgtagaaaatgtaaattctgtctttctcccttgaccaacctttgtggaaaaatttccaacctgaaaagccccgcttccgatcagcagttgatggaggataaaaccagccggtttacgtgtaaaggtaaacctgtgtatcatttctttggcactagcacgttttcccagtataccgtggtttcggatatcaaccttgccaagatcgacgatgatgctaatctggaaagagtgtgcctcctgggctgtgggttttccaccgggtatggcgccgctattaacaatgctaaagttactcccggatcaacgtgcgctgtttttggccttggcggagtgggcctctctgcggtcatggggtgcaaagcggcaggcgcctctaggatcatcggaattgacatcaatagtgagaagtttgtgaaggccaaagcgctcggagcaaccgattgtctgaaccctcgtgatctccataaaccaatccaggaggtcattattgagctgacgaagggaggggtcgactttgccttagactgcgctggaggatccgagaccatgaaggcggccctggattgcacaacagccgggtgggggagctgcaccttcataggcgtcgccgcaggctccaaggggctgacaatttttcctgaagaacttataatcgggcgaaccattaatggtaccttcttcggtggctggaagtctgtggatagtatacccaagctcgtgactgattacaagaataagaaattcaacctcgatgcgttggtgacacacaccctgccatttgataagatcagcgaagcctttgacctcatgaaccaggggaagagtgtccggacaattctgatcttctag

SEQ ID NO: 107766 - DNA, 1200 bp, Artificial Sequence
  Description of Artificial Sequence: Synthetic coding sequence
atgttagtgaggggcccgcatttcgagttgcagaggtgcaagacacatctgttctcatcaaattatttaacacaggttatcaaatgcaaggccgccatagcctgggaggcaggtaagcccctttgcattgaagaagtggaagtggccccccctaaggcccatgaagtgcgcatccagattatagctaccagcctctgccacactgacgccactgtgatagatagcaagttcgagggcctggcattcccggttatcgtggggcatgaggccgccggcattgtggaaagcataggccccggtgtcactaacgtgaaacctggtgacaaagtaatcccgctgtatgcacctctgtgcagaaaatgcaagttctgcctgtctcctctgactaacctatgtggaaaaatttccaacctcaagagtcccgctagcgaccaacagttaatggaagacaaaactagcaggtttacctgtaagggaaaaccagtctatcatttttttgggacgtcgacctttagccagtacaccgtcgtgagtgatattaatttagcgaagatagacgacgacgcaaatctcgaacgagtttgtctgctgggttgtggcttttccaccgggtacggggctgcaataaacaatgccaaggttactcctggttcgacctgcgccgtcttcgggctggggggagtgggactatcagccgtgatgggttgtaaagcagccggcgcgtcaaggattattggcatcgacataaactccgaaaagttcgtcaaggccaaagcgctgggggccacggactgcctgaacccgcgtgatctccataaacccattcaggaggttattatagagctaacaaaaggaggcgtggattttgccctcgattgtgctggggggtccgagacaatgaaggccgcgttagactgtacaacagcaggctggggctcttgcactttcatcggcgttgcggctgggagtaagggcctgacgatctttccagaggagctgataattggccgaactatcaacggtacattctttgggggatggaagtccgtggatagtatcccaaaactggtcactgattataagaataaaaagtttaatttagatgcactagtgacacacacgctaccctttgataagattagcgaggcttttgacctgatgaaccagggaaagtcggtgagaacaattctgattttctag

SEQ ID NO: 107767 - DNA, 1125 bp, Artificial Sequence
  Description of Artificial Sequence: Synthetic coding sequence
atggcaaacgaagtgattaagtgcaaggccgcagtggcctgggaagctggtaagcctttatctatcgaagaaattgaggtggcaccaccgaaggcccacgaggtgcgcattaagatcattgcgaccgcagtatgtcatactgacgcctacaccctctccggagccgaccctgaaggctgctttcctgttatcttgggtcacgaaggagccgggatcgtggagagcgtcggcgaaggagtcaccaagcttaaagcaggggatacagtaatccccctctatatcccccagtgcggtgagtgtaaattctgcttaaatccgaaaaccaacttgtgccagaaaatccgagttacccagggtaaagggctcatgcccgacgggacgtctcggttcacctgtaaggggaagacgatcctccactacatggggaccagtacattctccgagtataccgtggtcgcggacatcagcgtagccaagattgacccattagcgcctctggataaggtctgtttgcttggttgcggcatctctaccggctacggggctgcagtgaatacagccaaactagaaccgggctcagtctgcgctgtcttcggcctgggtggagtcggcctggcggttatcatgggatgcaaggtggccggagcctcgcgaatcatcggagttgatattaacaaagataagtttgctcgggctaaggaatttggggctacggagtgcattaatccgcaggacttttcaaaacccatccaggaggtgttgattgagatgaccgacggtggggtggactactcattcgaatgtatcggtaacgtcaaagtcatgagggccgctctggaagcctgtcataaaggttggggcgtaagcgtagtagtgggtgtggcagcctctggcgaagagatcgcgactaggccgtttcagctcgtcacgggacggacctggaagggcacagcctttggaggctggaaatcagttgagtccgtccccaaactggtctccgaatatatgtccaaaaaaatcaaagtggacgaatttgtgactcataatctctcctttgacgagataaacaaggcattcgaactgatgcattctgggaaatcaatccgcactgttgtgaagatctag

SEQ ID NO: 107768 - DNA, 1107 bp, Artificial Sequence
  Description of Artificial Sequence: Synthetic coding sequence
atgtgtaccaccggccaggtgatccgatgcaaagctgcaattctctggaaacccggtgcccccttttccatcgaggaggtagaagttgcccctccgaaagcaaaagaagtacgtatcaaggtagttgccacgggcctctgtgggaccgaaatgaaggtcctcggaagtaagcatctggacctgctgtaccccactatcctgggtcacgaaggggccggtattgtggagtctataggtgaaggagtctcgacagtgaaacccggtgacaaagttatcacgctgttcctccctcagtgtggggaatgcacaagttgcctgaattccgagggaaatttttgtattcagtttaaacagtccaaaacccaattgatgtccgatgggacctcacgtttcacctgcaaaggaaagtccatctatcattttggaaacacaagcaccttttgcgaatacaccgtgatcaaagagatttcagttgctaaaattgacgctgttgcgcctctggagaaagtgtgcttgatctcctgtggctttagtacaggctttggcgctgccatcaataccgcgaaggtgactccgggcagtacttgtgctgtgtttggcctgggaggggtaggtctgtccgtggttatggggtgtaaggcagccggagctgctcggattataggggtcgacgtgaacaaagagaagttcaagaaggctcaggaacttggcgccacagagtgtctgaaccctcaagatctgaaaaaacccatccaggaggtgctattcgatatgactgacgccgggattgatttttgcttcgaggccatcggcaacctggacgttctggccgccgccctagctagttgcaacgaatcctacggtgtgtgcgtcgtggttggcgtcctccccgctagtgtgcagctgaaaattagcggtcagctgtttttctccggccgcagcctgaaggggtcggtgttcggagggtggaaatccaggcaacacatcccgaaactagtggcagactacatggcggagaagctgaatcttgatcccctcatcacacatactctaaatttggataagataaacgaagctgtggaattaatgaaaaccgggaagtggtag

SEQ ID NO: 107769 - DNA, 1128 bp, Artificial Sequence
  Description of Artificial Sequence: Synthetic coding sequence
atgtgtactaccggacaagtgatacggtgcaaagctgctatcctgtggaaaccgggcgcccccttcagcatcgaggaggtggaagtggctccgccaaaggccaaagaggtccgcatcaaggtggtggcaactggtctctgcggtaccgaaatgaaagtccttggtagcaagcacctcgatctgctttaccctaccatcctggggcacgaaggggctgggattgtggagagcattggggagggagtgtccacggtgaagccaggcgacaaggtcattactctcttcctgccacaatgcggggagtgcaccagttgtctaaacagtgagggaaacttctgcatccagtttaagcaaagcaaaacccagctcatgtctgatggaacctcacgctttacctgcaaaggaaaaagcatctaccacttcggaaatacctcaactttctgcgaatataccgtcatcaaggagatttctgttgccaaaatcgatgccgtggcccctctggagaaagtgtgtctaattagttgcggctttagtaccggatttggcgccgcgatcaatactgctaaggtgaccccgggctccacctgtgcagtgttcggcttaggtggcgtgggactcagcgtggtaatgggttgcaaggcagccggagccgcgcgcatcataggtgtggatgtaaataaagaaaagttcaaaaaggcccaagaattgggagctaccgaatgccttaacccgcaggacctgaagaaaccaattcaggaggtgctatttgatatgaccgatgcaggaatcgacttttgctttgaggccataggtaacctggatgttctggctgctgcccttgccagctgcaacgagagctatggagtgtgtgttgtggtgggcgtcctgcctgcaagtgtgcagttgaagattagcggacagctctttttctctggtagatccttgaagggtagtgtgttcggcgggtggaagagcaggcagcacattccgaaactggttgctgattatatggcagagaaactcaaccttgaccccttaataacccacacactgaatctggacaagattaatgaggctgtggagcttatgaaaactggcaaatgtatccgctgtatcctccttctgtag

SEQ ID NO: 107770 - DNA, 501 bp, Artificial Sequence
  Description of Artificial Sequence: Synthetic coding sequence
atgggctgcaaggcggctggagctgcccggataatcggtgtggatgttaacaaagaaaaatttaaaaaagcgcaggagttgggagccaccgagtgcctgaacccgcaggatctcaagaaaccaattcaagaagttctgttcgacatgacggacgctggtatagatttctgctttgaggccattggcaacctcgacgtgcttgccgcagcactagcaagctgtaacgaatcatacggggtgtgtgtcgtagttggcgtccttcccgctagcgtgcagctgaagatcagcgggcagctgttcttctcaggacggagtcttaaaggatcagtcttcggtggctggaaaagcagacaacacataccaaaattagttgctgattacatggccgaaaagcttaaccttgatcctctgattactcatacgctgaacctagacaagataaatgaggctgtagaactgatgaagaccgggaagtgcatcagatgtattctgctgttgtag

SEQ ID NO: 107771 - DNA, 1068 bp, Artificial Sequence
  Description of Artificial Sequence: Synthetic coding sequence
atggaaccagagaagcagactgaaatctctgagtttttcctgcaaggcctgtccgagaaaccggaacaccagacactgctgttcacaatgtttctgtccacatacctggtgacaattatcggcaatgcactgattattctcgccatcattaccgattcacaccttcacactcccatgtacttctttcttttcaatctgtctttggtggacaccctcttgtctagcaccaccgtaccaaaaatgctcgctaacattcaggctcagagcagggccattcctttcgtggggtgccttacccagatgtacgcgtttcacctgtttggcacaatggacagttttctcctggccgtcatggcaatagatcgctttgtggctatagtgcatccccagagatacctcgtactgatgtgctccccagtctgcggactcctactaggagccagttggatgataactaacctgcaatccctgattcacacctgcctgatggcacagcttactttttgcgccggaagtgaaatcagccatttcttctgcgacttgatgcccctgttgaaactgagcggtagcgacacgcacactaatgagctggtcatcttcgccttcggcatcgtcgtaggtacttcacccttctcttgcattctgctctcgtacataagaatattctggactgtgtttaagattccatctacccgcggcaagtggaaggccttcagcacatgcgggctccacctcactgtggtgagccttagctatggcacgattttcgcagtgtatttgcagcctacaagcccatcaagcagtcagaaagacaaggcggcagcattaatgtgtggcgtcttcatccccatgctaaatccattcatctacagtataagaaataaagacatgaaggccgctctgggaaagcttatcggcaaagtcgccgtcccatgtccccgccccgaacagctgctggatgtgtaccacgttccaggctcattactggcagctcgcgatacagagatgcatcccatcccctaccccggcggggtccagagcctggccggaaaccgagacatggaatag

SEQ ID NO: 107772 - DNA, 1125 bp, Artificial Sequence
  Description of Artificial Sequence: Synthetic coding sequence
atggggacggctggaaaagtcattaaatgcaaggctgccgtgctgtgggagcagaaacagccgttcagcatagaggagatcgaagtcgcaccgccaaaaactaaagaagttaggataaagatcttggcgacgggcatatgtcgcactgacgatcacgtgattaaggggactatggtaagcaagttcccagtgattgtcgggcatgaagctacaggaattgtggagtccattggggagggggtaaccactgtgaagccaggtgacaaggtcatcccgctcttccttccgcaatgtcgggagtgcaacgcatgccgtaaccccgacggaaatctatgtattcgcagcgacatcacagggaggggcgtgctggccgacgggacaacccggttcacttgcaagggcaagcctgtgcaccattttatgaacactagtaccttcacggaatataccgtagtcgacgagagcagcgtggcaaaaatcgacgacgccgctccacctgaaaaggtttgtctgatcgggtgcggcttcagcacaggttatggggcggccgtgaagaccggaaaggtaaagcccggctccacctgtgtggtctttggactgggcggcgtgggattgtccgtgattatgggctgcaagtccgccggcgcatctaggattattggaattgacttgaacaaagataagttcgagaaggccatggcagttggagctacggaatgcatcagccctaaggattccacaaagccgatctcagaagtactgtccgagatgactggtaataacgtgggatacaccttcgaggtgatcgggcatcttgaaaccatgattgacgcccttgcttcatgccatatgaattacggcacgtccgttgtcgttggggtaccgccaagtgccaagatgcttacctatgacccaatgctgctgttcacagggcgaacatggaaagggtgtgtgtttggcggccttaaaagcagggacgatgtgcctaagcttgtgaccgagttcttagcaaaaaaatttgatctggatcaactgattactcacgtgctcccatttaaaaaaatcagtgaaggctttgagctgctgaactctgggcagagcatccggaccgtcttgacattctag

SEQ ID NO: 107773 - DNA, 1185 bp, Artificial Sequence
  Description of Artificial Sequence: Synthetic coding sequence
atgaagtgtctcgtctcacgccacaccgtaagggagaccctagacatggtgttccaaaggatgtctgtggaggctggggtaatcaaatgtaaggcagccgtactgtgggagcagaaacaaccgtttagtattgaggagatcgaggtcgccccccctaaaaccaaggaggtgaggattaagattctggccaccggcatctgtagaactgatgaccatgtgattaaaggtacaatggtgtccaagtttcccgtgatcgtcggccacgaagccaccggcatcgtggaatccatcggggagggggtgaccaccgtgaagcctggtgataaggtaatccctctcttccttccccagtgccgagagtgcaacgcctgtagaaatccagatggcaacctttgcattcggtctgatatcacagggcggggtgtcctggcggatggtactacccgctttacctgcaaagggaagcctgtgcatcattttatgaatacaagcacctttacggaatatacagtcgtggacgagagttctgtggctaaaatcgatgatgccgctccacctgaaaaagtttgccttattggctgcggtttctcaactgggtacggggcagcagttaaaactggcaaggtgaagcctgggtctacctgtgtcgtattcgggcttgggggtgtggggctgtccgtaatcatgggatgcaaaagtgcaggggcgtcccgaattatcggtattgatctgaacaaggacaagttcgagaaagcaatggctgtgggcgccacagagtgtatctctcctaaagactctaccaagccaatttccgaggtactcagcgagatgaccgggaataacgtggggtatacatttgaagtgatcgggcacctggagaccatgatcgatgcactggccagctgccacatgaactacggaactagcgttgtagtgggcgttcctccgtccgctaagatgttgacttatgatccaatgctactcttcacagggagaacatggaagggctgcgtgttcggtggccttaagtctcgggacgatgttccaaaactggtgaccgaatttctcgccaaaaagttcgatctggatcagctgattacacacgttttacctttcaagaagatatctgaaggattcgagttactgaactccgggcagtcaatccgaaccgtgctgactttttag

SEQ ID NO: 107774 - DNA, 954 bp, Artificial Sequence
  Description of Artificial Sequence: Synthetic coding sequence
atggtcagcaagttccctgtaattgtagggcacgaagccacaggaattgtggagtccatcggggagggcgtcaccaccgtgaaaccgggggacaaagtaatccctctgttcctgccacagtgtcgagagtgtaacgcatgtagaaacccagatggaaatctgtgtattaggagtgacatcaccggaagaggcgtgctggctgacggtacaacaaggtttacttgtaaggggaagccggtacaccacttcatgaatactagtacctttaccgaatacaccgtcgtggacgaatcgagcgtcgccaaaatcgacgacgccgctccacctgaaaaagtatgcctcatcggttgcggcttctctaccgggtacggagccgctgtgaagactggcaaagttaaacccggcagcacatgtgttgtgttcggcctgggtggcgtcggtctttccgtaatcatgggctgtaaatccgctggcgcttctcgcattattggcattgatcttaacaaggacaaatttgagaaggctatggctgtcggagcaacggagtgtatctcccccaaggattctaccaagcctatctcagaagtactgtcagaaatgaccgggaataatgtgggttatactttcgaagtgataggtcatctcgagactatgattgatgctctggcctcatgccatatgaactatgggacgtcggtcgttgtgggtgtcccgcctagcgctaagatgctgacatatgacccgatgctgctgttcaccggtcgcacttggaaaggctgcgtgttcggtggtctgaagtccagggacgatgtgccaaaactcgtaaccgagttcctcgccaagaaattcgatctggaccagctcattactcatgttttgccctttaagaagatcagtgaaggcttcgaactgctcaactcaggccagagcatccggaccgttctgacattttag

SEQ ID NO: 107775 - DNA, 912 bp, Artificial Sequence
  Description of Artificial Sequence: Synthetic coding sequence
atggctgctgctgcacgtgcaagagtggcctacttgttacgacagttacagcgagccgcatgccaatgcccaacgcacagccacacatactcccaagccccaggcctctccccctctggaaagaccacagactacgctttcgagatggccgtgagcaatatacgctatggggcagccgtcacaaaagaagtgggaatggaccttaaaaatatgggcgctaagaatgtgtgtcttatgacggacaagaatctgagcaagttacctccggtgcaagttgccatggactcactggtgaagaatggcattcccttcacagtgtacgataatgttagggtcgagccgacagatagcagtttcatggaggcaatagaattcgctcaaaaaggcgcgttcgatgcctatgtagcggtcggtggtggatccacgatggacacttgtaaggccgccaacttgtacgctagcagtccacacagcgactttctggattatgtcagtgcccctatcgggaagggaaagcccgtgtccgttcctctgaagccactaatcgcggtgcctactacctcgggaacgggttctgagactactggcgtagcgatattcgattacgaacatttgaaggtgaagataggtattacctcaagagccattaagccaactttgggactgattgacccgttacacacccttcatatgcccgcccgagttgtcgctaactcaggttttgatgtcctgtgtcatgcactcgagagctataccacactgccttatcatctgcgcagtccttgtccatccaaccccataacgagaccagcctatcaaggttcaaatcccatttcagacatttgggcaattcatgcactcaggatcgttgcgaaatatctcaagcgcgctgtaaactccacggacaagtag

SEQ ID NO: 107776 - DNA, 1404 bp, Artificial Sequence
  Description of Artificial Sequence: Synthetic coding sequence
atggccgccgccgcgcgagcacgggtggcctacctgctgagacagctgcaacgagccgcgtgtcagtgtccgactcactcccacacttatagccaagcccccggcttaagtcctagtggaaagaccaccgactatgcatttgaaatggccgtgagtaacattcgctatggtgccgccgtgaccaaggaggtcggtatggacctgaagaatatgggcgccaaaaacgtgtgcctaatgacagacaagaacctctcgaaactgccaccggtgcaagtggctatggacagcctcgttaaaaacggcattccatttaccgtttacgataacgttcgcgtcgaacccacagattcgagctttatggaggcaattgagtttgctcagaaaggagccttcgacgcctatgtggcagtgggggggggttctacaatggatacctgtaaagccgctaacttatatgcatctagtccacacagcgactttttggactacgtctccgctcccatcggcaaagggaaacctgtttccgtgccgttgaaacctctgattgctgtacctacaacctccggcaccggatcagaaacaaccggcgttgctattttcgactacgaacacttgaaggttaagattgggataacctcccgcgcgataaaacctacgcttggactcatagatcccctccacacgctccacatgccggcccgcgtagttgcgaacagtggctttgatgtcctgtgccacgctctggaatcatataccactctcccctatcatctgagatccccttgcccaagtaacccaataacccgccccgcgtatcagggctctaacccaatttcggacatatgggctatccacgctttgcgcattgtcgcaaaatacctcaagagagctgtgcggaatcccgatgacctcgaggccaggtcgcacatgcacctagcaagtgcattcgccggcattggctttggcaatgctggtgtgcatttatgtcacggcatgtcttatcccatctccggcttggtgaagatgtacaaagcaaaggattataacgtggatcatcccctggtgcctcacggcctgagcgtcgtactcaccagcccagcggtgtttacttttaccgctcagatgtttcctgagagacacttggaaatggcggagattctaggcgcagacactaggactgctcgcatccaggacgccggcctggtgctggccgatacgctcagaaaattcctatttgacctagatgtcgacgatgggctagctgcggtcggctacagcaaggccgacattcctgccttggtgaaaggcacactcccacaggagagagttactaaactcgccccctgcccgcagagtgaagaggacctggccgccttattcgaagcttctatgaaattgtactag

SEQ ID NO: 107777 - DNA, 2406 bp, Artificial Sequence
  Description of Artificial Sequence: Synthetic coding sequence
atgaagatagccgtgattggccagtctctgttcgggcaagaggtctactgccatctgagaaaggaggggcacgaagtggtcggcgtgttcaccgtacctgacaaggacggtaaagccgatcctctagggttggaggccgaaaaggatggggtgcccgtattcaaatatagccgctggcgggccaaaggtcaagctcttcctgatgtggtcgcaaaataccaggccctgggggccgagctgaacgtattgccattctgcagccagttcatccccatggagatcatctccgccccccgccacggcagcattatataccacccatcattactgccacgccatcggggagcaagtgcgattcataattggattaggggaaatgacaaggtccctggggcgtggaccgaggcttgcgagcagaagcttaccttctttaactctaccctgaacactagtgggctagtgcccgagggagacgccctccccatccctggtgctcacaggcccggagtagttaccaaggcggggctgattctctttggcaacgacgataaaatgctccttgtgaagaacatacaactggaagatggtaagatgattctcgcaagcaatttcttcaaaggagccgcctcaagcgtccttgaactgacagaggcagaactggtgaccgccgaggctgtcaggtcggtttggcaacggattctgcctaaagttttagaggtggaggactccaccgacttcttcaagtccggcgctgcttctgtagatgtggtccgcttagtggaggaggtgaaggagctgtgcgacggactagagctggagaacgaggacgtctatatggcatccacgttcggggatttcatacaactattagttagaaagttgcggggcgacgacgaagaaggagagtgctctattgattatgtggaaatggctgtgaacaagcgcacagtgaggatgccacaccaactcttcattggcggcgagttcgtcgacgcagaaggggctaaaacatcagaaactatcaaccccacggacggcagcgtgatatgtcaggtgtctctggctcaggtcacggacgtggacaaggcagtggccgccgccaaagatgccttcgagaatgggcgctggggcaagatcagtgccagggacagaggccggctgatgtatcgcctcgctgatcttatggaacagcatcaggaagagttggccacaattgaggcgttagacgcaggggccgtgtataccctggctctgaaaacccacgttggaatgagcatccagacattccgctactttgcagggtggtgcgataaaatacaggggagtactattccgataaatcaagcaagacccaatcgtaacctcaccctcacccgcaaggagcccgtcggggtgtgtgggataatcatcccctggaattatccactgatgatgctgtcctggaagaccgcagcctgtctggctgctggtaataccgtggtcatcaaacccgcacaggtgacacctttgacagccctgaaatttgccgagctgaccctgaaagctggtatccccaagggtgtggttaacgttttaccaggctccggctctcttgtgggccagcgcctgtcagaccaccccgacgttagaaaaattggctttacaggctccacagaggttgggaagcatatcatgaagagctgtgcaatatctaacgtcaagaaagtatctctggagctcggcggtaagagccccctgataattttcgcagattgtgatctgaacaaagccgtgcagatggggatgtcatctgtgttcttcaacaaaggggaaaactgtattgcggccggccgcctgttcgtggaagacagcatccacgacgaatttgtgcgtagggtcgtggaggaagtaaggaagatgaaggttgggaaccctcttgacagggacaccgaccacggaccacaaaatcaccacgctcaccttgtcaaactcatggagtattgccagcacggtgttaaagagggcgcaactctcgtttgcggtggaaaccaggtgcctcgaccaggcttcttcttcgaaccgacggtgttcactgacgtggaggaccatatgttcattgcaaaagaagagagtttcggaccggtcatgataatctcccggttcgcggatggagacctggacgcggtcctctcacgtgccaatgccacagaattcggactggcctcaggagtgttcactcgagatatcaacaaagccctgtacgtgtcagataaactccaagccggaactgttttcgtgaacacgtacaacaagactgacgtagcagccccttttggcggctttaaacaaagcggtttcgggaaggacttgggtgaggcagcgctcaacgaatatctgagggtaaaaaccgttacgtttgagtattag

SEQ ID NO: 107778 - DNA, 1506 bp, Artificial Sequence
  Description of Artificial Sequence: Synthetic coding sequence
atgtcaagctccgggacacctgacctgcctgttttgctcaccgacctgaaaatccagtataccaagatttttataaacaatgaatggcatgactcggtctcagggaaaaaatttcctgtgtttaaccctgccacggaagaggaactttgtcaggtggaagagggtgacaaagaggatgtagataaagccgtgaaagctgctcggcaagcttttcagatagggtcaccttggcgtacgatggacgcctcagagcgcggcaggctcctttacaaactggccgatctgatcgaacgggaccgcctgctgctggctacaatggagtcaatgaacggcggcaaactctatagcaacgcttacctgaatgatctggctggatgcattaagacccttcggtattgtgccggctgggctgacaagattcaaggaagaacgattcctatcgacggaaacttcttcacctacacccgacacgaacccattggagtgtgcggccagatcatcccttggaatttccctcttgtgatgcttatttggaagatcggacctgccctttcgtgcggaaacactgtggtggtgaaaccagcagagcaaaccccgttaaccgcactgcacgttgcttctttgattaaagaggccggctttccaccaggtgtggtgaacatagttcccgggtatggccccacagctggagcagctattagctctcatatggacatcgataaagtggccttcaccggctccactgaagtcggtaaattaatcaaagaagccgctggaaagtctaaccttaaacgcgtgaccctcgagttaggaggtaaatctccttgcatcgtcttagctgacgccgacctggataatgccgtggaattcgcacaccatggcgttttctatcatcagggccagtgttgtatcgccgcgtcccggattttcgtcgaggagagtatctatgacgaattcgtgcggcggtctgtcgagagggcgaagaaatacatcctggggaatccactcacacccggagtgacccaagggccccaaattgataaagaacaatatgacaagattctggacctgatcgagtctggtaagaaggagggggccaagcttgagtgtggaggcggtccttgggggaacaagggatattttgtgcagcctaccgtgttctctaacgtgacagatgagatgagaatcgccaaggaggaaatatttggacccgtgcaacaaattatgaaattcaaatccctggatgatgtcattaaaagagccaataataccttttacggtctgtcagcaggtgtgttcacaaaagacatagataaagccattaccatcagctccgccctgcaggcaggaacggtttgggttaactgttacggggtcgtgagcgcacagtgccctttcggcggattcaaaatgagcgggaatggccgggaactgggtgagtacggtttccacgaatacacagaggtgaaaacagttaccgtgaaaatatctcagaagaattcctag

SEQ ID NO: 107779 - DNA, 693 bp, Artificial Sequence
  Description of Artificial Sequence: Synthetic coding sequence
atgagtagcagcggcacacccgatctcccagtgttgttgactgatttaaagattcagtatacaaagatcttcataaacaatgagtggcacgacagtgtgagtggcaagaagtttcccgtatttaacccggctactgaagaggagctgtgccaggtggaggagggtgataaggaggatgtcgataaggcagtaaaggctgctcgccaagccttccagatcggctctccttggaggaccatggacgcgtctgaaagaggaaggttgctttacaaattagccgatctaattgagcgcgacaggctgctgttggccactatggagtcaatgaatggtgggaaactgtactccaatgcctatctgaacgacctggctggctgtataaaaacactccgctactgcgcaggttgggccgataagatccaggggcgaacgatccccatagacggtaactttttcacctacactcgtcacgagcccatcggagtgtgcggccaaatcattccttggaactttccgctggtcatgctgatttggaagattggcccagcgctgagctgcggcaacacagttgtggtgaagcctgctgaacagacccccctgaccgccctgcatgtggcatcactgatcaaggaggccgggttcccgccaggtgttgtgaatatcgtacctggatatggagcctcagtggtttag

SEQ ID NO: 107780 - DNA, 717 bp, Artificial Sequence
  Description of Artificial Sequence: Synthetic coding sequence
atgtcctcaagcggcacaccagaccttcctgtcctgctgactgacctgaagatccagtatacaaaaattttcattaataacgagtggcacgacagtgtatccgggaagaagtttccagtgttcaatcctgccacggaggaggaactgtgtcaggtggaagagggggacaaggaggacgtggacaaggccgtgaaggcagcaagacaggcattccagattgggagtccatggcggacaatggatgcatcagaaagggggagactcctgtataaactcgccgatctcattgaacgggaccgattgctgttggccactatggagagtatgaatgggggcaagctctatagtaacgcctatcttaatgacctggcagggtgcattaaaaccttaagatactgtgcaggatgggcagataagatccagggaaggacgatccctatcgatggcaatttctttacatacacaagacacgagcccatcggcgtgtgcggccagattattccgtggaatttccccctcgtgatgctcatctggaagatcggccctgctctcagctgtgggaacacagtggtcgtgaagcccgcagagcagactcctctgactgccttgcatgtggcgagcttaattaaggaggccggctttcctcccggagtggtcaatatagttcccggttacggaccaacagccggagcagcaatcagctctcatatggactag

SEQ ID NO: 107781 - DNA, 990 bp, Artificial Sequence
  Description of Artificial Sequence: Synthetic coding sequence
atcgctgaaccagtgacatgtgtaccgggggcagaaagcgagatgagctcctctggcactccagacctgcctgtgctactcactgacctcaagatacagtacacgaagatctttattaacaatgaatggcatgacagcgtgtccggaaaaaagttcccagtgttcaacccagctactgaagaagagctctgccaggtggaagagggcgacaaagaggacgttgataaggcggtgaaggcagcacgacaggcctttcagatcgggtcaccatggcgaacaatggatgcttctgagcgtgggagactactatataagctggccgaccttatcgagcgggataggctgcttctggccacaatggagtccatgaacggcggcaaactctattccaacgcatatctgaacgacttggccggatgtatcaaaaccctgcgatactgtgctggatgggccgataagatccaggggcgcaccattcctattgacggcaatttctttacctatacccgccatgagcccatcggggtttgcggccagataattccttggaactttcctctcgttatgttgatttggaagatcggacccgctctgtcctgtggtaatacagtggtggtgaaaccggcagagcaaaccccacttaccgccctgcatgtggcctctctgatcaaagaggctggcttccccccaggcgtcgtcaacattgtgccaggttatgggcctaccgcaggcgcagctatatcgagccacatggacatcgataaagttgcctttaccgggagcaccgaggtcgggaagcttatcaaggaagccgctgggaaatcaaatctcaagcgggttaccctagagctagggggtaaatctccctgcatcgtcctagctgacgccgatctggacaatgcagtcgagtttgcacaccacggagtattctatcatcagggccagtgttgtatcgctgcgagcaggttttgtggcaggattaatctgtag

SEQ ID NO: 107782 - DNA, 612 bp, Artificial Sequence
  Description of Artificial Sequence: Synthetic coding sequence
atgagtagcagtggaaccccagatctccctgtgctccttaccgatctcaagatccaatatacaaagattttcataaataacgagtggcatgattccgtgtcaggaaagaagttccctgtgttcaaccccgcaaccgaagaagaactctgccaggtggaggagggcgacaaagaagacgtcgataaggccgttaaagccgcgaggcaggcgtttcagattgggtccccctggcgtacaatggatgcgagcgaacgcggccgtctgttgtacaagctcgcagacttgatagagcgggaccggttgttgttagccacaatggagagcatgaacggcggtaagctgtattctaatgcttacttgaacgatctggccggttgtatcaagacactcagatattgtgccgggtgggccgacaaaatccaggggcggaccattccaattgatggcaatttctttacgtatactaggcacgagcccattggcgtctgcggccagatcattccctggaactttcctcttgtcatgctgatatggaaaatcggccctgctctgtcttgtggcaacacagtggtagtcaaaccagccgagcagactccgctcacagcgctctag

SEQ ID NO: 107783 - DNA, 1557 bp, Artificial Sequence
  Description of Artificial Sequence: Synthetic coding sequence
atgaccagctcaaaaatcgagatgcctggagaggtcaaggctgaccctgcggccctaatggcaagcctacacctcctgccctctccaacacccaacctggaaatcaagtacacgaagatttttataaataatgaatggcaaaactctgagagcggtcgcgttttcccagtgtacaatcctgctaccggcgagcaagtttgtgaagttcaagaggccgacaaagctgacatcgacaaagctgttcaggccgccagattggccttttccctgggttccgtgtggaggcggatggacgcctcggaaaggggccgccttcttgataagctggctgatttagtggaaagggacagggctgtcctggcaaccatggagtctctcaatgggggaaagccttttctgcaagccttctacgtcgacctccagggcgtgatcaagacatttagatactacgctggctgggccgacaagattcatggcatgaccattcccgtggatggagactattttacctttacacgtcacgaaccaatcggggtttgtggtcagattatcccatggaacttccccctccttatgttcgcttggaaaatcgcccccgctttatgctgcggcaatacagtggtaattaaacccgctgagcaaacacccctttccgctctttatatgggggctttgatcaaagaggctggattcccaccgggagttatcaacatcctgcccgggtatggccccacagcaggagctgccatcgcatcccacattggaatcgataaaatagcttttacaggctcaactgaagtcggaaagctgatccaggaagcagctgggcgcagcaatttgaagagggtcaccctcgaactggggggtaagtcacccaacatcatatttgctgatgccgatcttgactacgctgtcgagcaagcccaccagggagtattttttaatcagggccaatgctgcactgccggcagccggatctttgtggaggagtccatttatgaagagttcgtgaggcggagcgtggagcgtgctaaaaggagagttgttggatcgcccttcgaccccaccaccgaacaagggcctcagatcgataagaaacaatataacaagattctggaactaatccagagcggcgtcgcggagggcgccaaattagagtgtgggggcaaggggctcgggcggaaaggattctttatagaacccaccgtgttctctaacgtgacagacgacatgagaatcgcaaaggaagagatctttgggccagtacaggagatccttaggtttaaaactatggacgaagtcatagaacgggcaaataactcagatttcggcttggtggctgccgtgtttaccaacgacatcaacaaagcattgaccgtgtcttcggctatgcaggctgggaccgtttggataaattgttacaacgctttgaatgctcagtcccccttcggaggattcaaaatgtccggcaatggccgcgaaatgggagaatttgggttgcgcgagtacagcgaggttaaaactgtgaccgtgaagatcccgcaaaagaactcttag

SEQ ID NO: 107784 - DNA, 1443 bp, Artificial Sequence
  Description of Artificial Sequence: Synthetic coding sequence
atgacctctagtaagatcgagatgcccggcgaggtgaaagctgatcctgctgcattgatggcctccctgcacctcttgcctagtccgacccccaacctggaaataaagtataccaagatcttcatcaacaatgaatggcaaaattctgagtccggtagagtgttccctgtctacaatccagccacaggagagcaagtttgtgaagtccaagaggccgataaagcagacattgataaggctgtgcaggccgccagactggccttttctctgggttccgtgtggcgccggatggacgctagcgaacggggacgtctactcgacaaattagctgatcttgtggagcgggatagggccgtgctggcaaccatggagtccctgaatggtgggaagccattcttgcaggcgttctacgtcgacctccagggcgtgatcaagacattccgatactatgccggatgggccgataaaatccacggcatgacaattccggtggatggtgactatttcacatttactcgtcatgaacctatcggcgtgtgcggtcagatcattccgtggaattttcctttgctgatgtttgcttggaaaatcgcaccagcactgtgttgcggaaatactgtggtgataaaaccggccgaacagacccctctctcggccctgtatatgggcgccctgattaaagaagtgggcaaactaatccaggaagccgccgggcgatctaatctgaagcgcgtgacactggaactcggaggaaagagtccaaatattatatttgctgatgctgacctagattatgcagtggagcaggcccaccaaggggtcttcttcaaccagggtcagtgttgcacggccggcagccgcatcttcgtcgaggagtcaatctatgaagaatttgtcagacggtcagtcgagagagcaaagaggcgtgtggtcgggtctcccttcgatccgacgaccgaacagggcccccagattgacaaaaagcagtataacaagattctcgagctgatccaaagcggcgtcgcagaaggtgccaaactggaatgcgggggcaaggggctggggcgcaaaggcttctttatcgaacccacggtgtttagcaacgttaccgatgacatgagaatcgcaaaagaagagatattcggccctgtgcaggaaatacttaggttcaagacgatggacgaagtgatcgagcgggccaataacagcgattttggactggtggccgccgtgtttactaacgacatcaacaaggccctcactgtatcatccgcaatgcaagcgggcacggtatggattaattgctacaatgctttgaacgctcagtccccgttcggcggctttaaaatgtccggaaacggccgggaaatgggcgagttcgggctacgcgaatactccgaggtgaagacagtgacagtcaagatcccccagaagaactcttag

SEQ ID NO: 107785 - DNA, 1494 bp, Artificial Sequence
  Description of Artificial Sequence: Synthetic coding sequence
atgaagaaccaatgcgagaccgtctggctgaagtcgcccatcaagttgaagctgatattcataaacaatgaatggcagaacagcgagagcggcagggtcttccccgtttacaatccggccactggggagcaggtgtgtgaagttcaagaggctgacaaggccgatattgacaaggctgttcaagctgcccggttagctttttcgctgggaagcgtctggcggcggatggatgccagcgagaggggtagactgctggacaagctggcggatcttgtggaacgggacagggctgtgcttgccacaatggaatccttgaacggtggaaagcccttccttcaggcgttttatgtcgacctacagggagtaattaaaactttcagatattatgccggctgggccgacaagattcatgggatgacaattccggtagatggtgactacttcacgtttacacgacacgagcccattggagtgtgcggtcagattatcccatggaactttcccctgcttatgtttgcttggaagatcgcaccagcactctgctgcgggaatacagttgtaatcaaaccagcagagcagacacccctctcagccctgtacatgggagctctcatcaaggaagctggattccccccaggtgtaatcaacatactccctggctacgggcctactgctggcgcggcaattgccagccatatcggcattgataaaatagcattcacaggctcaaccgaagtggggaagctcattcaggaggccgcagggaggagcaacttgaaacgcgttaccctcgagttgggcggaaagtccccaaacattatattcgccgacgccgatctggactacgccgttgagcaggctcaccagggcgtttttttcaatcaaggacagtgctgtactgctggttcccgcatttttgtggaggaatccatctacgaggaattcgttaggcgctccgttgagcgcgccaaaaggagggtggtgggcagccctttcgatcccactacagagcaggggccacaaattgataagaaacagtacaacaagattttggagcttatccagtcaggcgttgcggaaggagcgaagctcgagtgtggtggaaagggactaggtcgcaaaggtttctttatcgaaccaaccgtgttctctaacgtcaccgatgatatgcgaatcgccaaggaggagatctttgggcctgtccaagagattcttagattcaagaccatggatgaggtgatagaaagggctaataactctgacttcgggttggttgcagctgtgttcactaacgatattaacaaggcccttacagtctcatccgccatgcaggctgggacagtgtggatcaattgctacaatgcgttaaatgcacagagcccttttggcggcttcaagatgtcgggcaatggccgggagatgggcgagtttggccttcgcgagtattccgaggttaaaaccgtgacagtcaaaattcctcaaaaaaattcctag

SEQ ID NO: 107786 - DNA, 1470 bp, Artificial Sequence
  Description of Artificial Sequence: Synthetic coding sequence
atgaagggcaagaattgcaatgatgtaaagatattcatcaataatgagtggcaaaattccgagagcgggagggtatttcccgtttataatccagcgaccggtgagcaggtatgcgaggtgcaggaagcagacaaggcggacatagacaaagccgttcaggcagccaggctggcgtttagcctcggctctgtatggagacggatggatgcatctgaaaggggaaggcttttggataagcttgctgacctggtcgaaagggatagggctgtgctggccaccatggaaagtcttaacggcggtaaaccttttctgcaagccttttatgtcgatctacagggtgtaataaaaacttttcgctactacgccggatgggcagacaaaatccacgggatgactatcccagtggatggcgattacttcacatttacaagacacgagcccattggagtctgtgggcagatcatcccatggaacttcccactgctcatgttcgcatggaaaattgcgcccgcgctgtgttgcggcaacaccgtggtgatcaagccagccgaacaaacacccctgagtgcgttgtacatgggagcccttattaaggaagccgggttcccccctggtgttatcaacattctaccaggatatggccccacagcaggggctgcaatcgccagccacattggtattgataagattgcatttacaggtagcacagaagtgggaaaactaatccaggaggcagcagggcgctcaaacctgaagcgggttacattagaactgggcggaaagagcccaaacatcattttcgctgacgcagatcttgactacgccgtagaacaggcgcatcagggagttttcttcaaccagggccagtgctgtactgccgggagcaggatttttgtcgaagaaagtatctatgaggagtttgtgagacgcagcgtggaaagagctaagcggagggttgttgggagtccctttgacccgaccacagaacagggccctcaaatagataagaagcagtacaataagatactggagctaattcagtctggagttgctgagggtgctaagctggaatgcggagggaagggccttgggagaaaaggtttctttatcgaacctaccgtgttctctaatgttactgatgacatgagaatcgccaaggaagaaatctttggtcctgtgcaggaaatcctccgctttaagaccatggacgaagtcatcgagcgggctaataacagtgacttcgggcttgtggctgctgtctttactaatgacattaacaaggccctgacggttagttcagccatgcaggccggtactgtgtggattaattgttacaacgccctcaacgcccagtcgccattcggcggattcaaaatgtccggcaacggaagagaaatgggcgaattcggcctgcgcgaatacagcgaggttaaaaccgtgactgtcaagatacctcagaaaaatagctag

SEQ ID NO: 107787 - DNA, 30 bp, Artificial Sequence
  Description of Artificial Sequence: Synthetic coding sequence
atggatgcctccgaacgtgggcgactgtag

SEQ ID NO: 107788 - DNA, 1470 bp, Artificial Sequence
  Description of Artificial Sequence: Synthetic coding sequence
atgaagggcaggaattggaaaactacaaagattttcattaacaatgaatggcagaattccgagtcagggcgcgtgtttcccgtgtacaatccagccacaggggagcaggtctgcgaggtgcaggaggcagacaaggccgacatcgataaggctgtacaggctgccaggctcgcctttagcctgggcagcgtgtggcggcggatggatgccagtgagcgaggtcgactgttggataagttggcagatcttgtcgagcgagaccgcgcagtacttgccactatggaaagcctcaacggggggaagccattcctccaggctttttacgtggatctgcagggcgtaataaagactttccgctactacgccggctgggcggacaagatacacggaatgaccatccctgtagacggcgattattttacgtttacacggcacgagcctatcggcgtgtgcggacagataattccttggaatttccccttactgatgttcgcctggaagatcgcacctgccctgtgttgcggcaacacggtggtaatcaaacctgctgagcaaacccccctgtcagcgctgtatatgggcgccctgatcaaagaagctgggttccccccaggggtgatcaacatactgcctggatacggtccaactgcaggagccgctattgcatcccatattggcattgacaagattgctttcaccgggagtaccgaggtagggaagctcattcaggaagctgctggccggagcaatctgaagagggtgacacttgaactggggggaaagtcccccaatataatttttgcagatgcggacctagattatgcagtggaacaggcccaccagggagtgttttttaaccagggccaatgttgtactgctggttctaggatctttgtcgaagagagcatctacgaggaatttgtgcgaagatcagtcgaacgcgctaagagaagagtggtaggaagcccattcgaccccactacagagcagggaccccagatcgacaaaaaacagtacaacaagattcttgaactaatccaaagtggagttgctgagggcgcaaagctggagtgcgggggcaaaggtctgggccgcaagggattctttattgagccaaccgtattctcaaacgttacggatgatatgagaatcgcgaaagaggaaatatttggccccgtgcaagagatcctgcgcttcaagaccatggatgaagtcattgaacgtgccaataattcagactttggactcgttgcagctgtgttcaccaatgacattaataaggctctgactgtaagtagtgcgatgcaggcaggcaccgtctggatcaattgttataatgccctaaacgcacaaagcccctttggcgggttcaaaatgtctgggaacgggcgagagatgggggagtttgggctgagagagtatagtgaggtgaaaacggtaacagtcaagatcccccagaagaattcgtag

SEQ ID NO: 107789 - DNA, 78 bp, Artificial Sequence
  Description of Artificial Sequence: Synthetic coding sequence
atggacgcctctgagaggggccgtttgctggataagctcgccgaccttgtagagagggatagagctgtcctcgcctag

SEQ ID NO: 107790 - DNA, 1269 bp, Artificial Sequence
  Description of Artificial Sequence: Synthetic coding sequence
atggatgccagtgagaggggcagactgttagacaagctcgccgatctggttgaacgggacagggccgttctggcaaccatggagtccttaaatggcgggaagccttttttgcaggcgttctatgtagacttgcagggtgtaatcaaaacatttaggtattatgcagggtgggccgataagattcacggtatgacaatacccgtagacggcgattactttacatttactagacacgagcccattggagtgtgcggccagatcatcccatggaacttcccactcctgatgttcgcttggaaaatagcgccagcattatgctgcggcaatactgttgtcatcaagccggcagaacagacgcctctttctgcactgtacatgggtgctctgatcaaggaggctggatttcctcccggggtcattaatattctgcccggatatggtcccaccgccggggcagcaatcgcatctcatatcggaattgacaagattgcttttacagggtccaccgaggtcgggaaactgatacaagaagccgcaggaaggagcaacttaaaaagggtgactttagaactgggcggaaaaagtcctaacattatatttgcagacgcagacttagattacgctgtggagcaagcccatcaaggcgtgttcttcaaccagggccagtgttgcactgccggcagtagaatctttgtcgaagagagcatttacgaggagttcgtgcggagatcagttgaacgtgccaagcggagggtggtgggaagcccatttgaccctaccaccgagcagggaccccagattgacaaaaagcagtataacaaaatacttgaactaatccagtccggggttgccgagggggcaaagctcgaatgcggtggaaagggactgggtcggaagggattcttcatcgaaccgaccgtcttttctaatgtgaccgacgatatgcggattgctaaagaagaaatctttgggcctgttcaggagatccttcgctttaaaaccatggatgaagtgatcgagagagcaaataatagcgatttcggcttggtggccgccgtgtttaccaatgacatcaataaagctttgacagtgtcctctgctatgcaggcaggcaccgtttggatcaactgttataacgccctgaacgcccagtctcccttcggtgggtttaagatgtcaggcaacggcagggaaatgggcgagttcggcctgcgcgagtatagcgaggtgaagacagtgactgtcaagatccctcaaaaaaatagctag

SEQ ID NO: 107791 - DNA, 258 bp, Artificial Sequence
  Description of Artificial Sequence: Synthetic coding sequence
atggatgccagcgaacgcggacgcttgcttgacaagctagccgacctggtcgaacgcgaccgggcggtgctggccacaatggagtccctgaacggcggaaaaccttttctccaagctttctatgtggacctccagggtgttatcaagacatttcggtattacgccggatgggctgacaagatacatggaatgacgatccctgtggacggagactattttactttcactcggcacgagcccataggggtctgtggatag

SEQ ID NO: 107792 - DNA, 1539 bp, Artificial Sequence
  Description of Artificial Sequence: Synthetic coding sequence
atggcaaccgcaaacggagcggtcgagaatggtcagcccgaccgcaaaccacccgccctgcctcgcccaataagaaacctagaagtgaagtttactaagatctttataaataacgaatggcatgaatctaagtctggcaagaagtttgcgacatgcaacccctccaccagggagcaaatctgtgaggtcgaggaaggcgataaacccgatgtcgataaggctgttgaagcggctcaagttgcttttcaaagaggaagcccatggcggagactcgatgcgctgtctagggggcggctgctgcatcagctcgccgacctagtggagagggaccgcgcaaccctggcagcgctggaaaccatggataccgggaagccctttttacatgccttttttattgacctggagggctgcattcgaaccctgcgttacttcgccgggtgggctgataagatccagggaaagactatccccaccgacgataatgtcgtctgttttacccgacatgagcctataggcgtgtgcggagctatcactccttggaactttccgttgctgatgctggtctggaagctggcccccgcactctgttgcggaaatactatggtgctaaagcccgctgagcagacgccgctcacagcactctatctggggagcttgattaaagaagctggttttccaccaggcgtagttaacatagtgccaggctttggccccaccgttggagccgctatttctagccatccacagatcaacaaaattgcttttaccggcagtaccgaggtggggaagctcgtgaaggaggccgcttcaaggtcgaatcttaaaagggtgacactagagttgggcgggaagaacccttgtatagtctgcgccgatgctgatttggatctggctgtcgaatgcgcacatcagggcgtgttcttcaatcagggtcagtgctgcaccgcggcatctagagtgttcgtggaagagcaagtgtattccgagtttgtgcgacgatcagtggaatatgccaaaaaaagacctgttggtgatcccttcgatgtgaagacagagcagggtccacaaatcgatcagaagcaattcgataagatacttgaattgatcgagtcagggaaaaaggaaggcgccaagctagagtgcggtggtagcgctatggaagataaaggactcttcatcaagcctaccgtttttagcgaggtaactgataatatgcgcattgccaaggaagaaatctttggtccagtgcagcccattctcaagttcaagtctatcgaggaggtgatcaagagggctaactccacagactatgggctcaccgccgccgtatttaccaagaatctggataaggcgctgaaactggccagtgcgctggaatcgggaaccgtgtggattaactgttacaacgcactgtacgctcaagcacccttcggcgggttcaaaatgtctggcaacggccgggagctcggcgaatacgcactggccgaatatactgaggtcaaaacagtgactatcaaactgggcgacaaaaatccctag

SEQ ID NO: 107793 - DNA, 456 bp, Artificial Sequence
  Description of Artificial Sequence: Synthetic coding sequence
atggctactgctaacggagctgtcgagaacggacagcccgacagaaagcccccggctcttccccgaccaatccggaatctcgaggtcaagtttacaaaaatatttattaacaatgagtggcacgagagtaagtccggaaagaagtttgctacctgcaacccaagtactcgggaacaaatctgtgaagtggaagagggggataaacctgatgtggataaggctgtggaggcagctcaggtcgcttttcagcgcggctcaccttggcggcgattggacgccttaagtcgcggacggctactgcatcaattggctgacctggttgaaagggatcgagccacccttgccgctctagagactatggacacaggcaaaccctttctgcacgcctttttcattgacctcgaaggatgcatcagaactctacggctgataaagtcttcctctacgaagtcgtag

SEQ ID NO: 107794 - DNA, 1554 bp, Artificial Sequence
  Description of Artificial Sequence: Synthetic coding sequence
atgctgcggtttttggcacccaggctgctttcactgcaggggaggaccgcgcgttattccagcgccgcagcattgccatcccccattctgaatccagatattccatataaccaattatttattaacaatgaatggcaggacgcggttagtaagaaaacctttcccaccgtaaatcctaccacaggcgaggtgattggtcacgtggccgagggagacagggctgatgtcgatagagctgtaaaggccgccagggaggcttttcgcctgggtagtccatggagacgcatggacgcctctgagcgaggcaggctgctgaatcgcctggccgatctggttgaacgtgatagagtgtacctcgcttccttggagacgcttgataatgggaagccgtttcaggagtcgtacgctctggacctagacgaggtcattaaagtttaccgatatttcgctggatgggcagacaagtggcatggaaagacgattcccatggacggccagcacttttgttttacccgacacgagccggtcggagtctgtggccaaattattccctggaactttccactagtaatgcaagggtggaagctggcgcccgccctggccacaggaaacactgtagtcatgaaagtcgccgaacagacccccttatcggctctgtatctggccagtctgattaaggaagccggctttccacctggagttgtcaatattattactggttatgggcccaccgctggcgccgccatagctcagcatgtggacgtcgataaggtggcatttactggctccaccgaagttgggcacctgatccagaaagcggccggagacagtaatttgaaaagggtaacccttgaactagggggaaaatcaccttctatagtcctcgccgacgccgatatggagcacgccgtggagcagtgtcacgaggctctattttttaacatgggacagtgttgctgcgcagggtctcgcaccttcgtggaagagagcatttataacgagttcttggaacgtacggtggaaaaggccaaacagcgcaaggtcggtaacccatttgaattggacacacagcagggaccacaggttgataaagaacagtttgaacgggtcctgggatatatccagctcgggcaaaaggagggcgcaaagctcctctgcggaggcgagcgcttcggcgaacggggcttctttatcaaaccaacggtgtttgggggcgtgcaggacgacatgcgtatagccaaggaggaaatcttcggtcccgtccagcccctgttcaaattcaagaagatcgaggaggtcgtcgagagggccaacaacacaagatatgggctggctgcggccgtgtttacaagggatctggataaagccatgtatttcacccaagccctccaggcgggcaccgtgtgggtgaacacctataacatcgttacttgtcataccccctttggtgggttcaaagaatccggaaacgggcgggagctgggcgaggacgggctgaaagcctataccgaagtcaagacggtgacaataaaggtgccacagaagaactcatag

SEQ ID NO: 107795 - DNA, 657 bp, Artificial Sequence
  Description of Artificial Sequence: Synthetic coding sequence
atggagcatgcagtcgagcaatgtcatgaggccctgttctttaacatgggtcaatgctgctgtgccggctcacgaacattcgtggaggagagcatttataatgaattcctggaacgaacagtagaaaaggctaaacagcgaaaagtggggaatccctttgaattggatacacagcagggccctcaggtagacaaagaacagtttgagagagtcctcggatatatccagctaggtcagaaagaaggggccaaactcctctgcggcggggagcgattcggcgaaagggggttcttcatcaaacctacggtctttggaggggtgcaggatgacatgcgaatcgccaaggaagagatcttcggaccagtgcagccccttttcaagttcaagaagatcgaggaggttgttgagcgagcgaacaatactagatatggtctggccgccgctgtgtttacacgggacttggataaagccatgtattttacacaggcactgcaggctggaaccgtgtgggtgaacacttataacattgtcacctgccatacacccttcggcggctttaaggagtctgggaatggccgagagctcggggaggacggcctgaaagcttatacagaagtcaaaacagtgactattaaggtgcctcagaaaaattcttag

SEQ ID NO: 107796 - DNA, 2739 bp, Artificial Sequence
  Description of Artificial Sequence: Synthetic coding sequence
atggcaggccctagcaacccccccgccactatgaaaatagcagtgattggccaaagcctttttggacaggaggtgtattgccacctacgtaaggaggggcacgaggttgtcggtgtattcacggttccggacaaagatgggaaggcagatcctttgggcctggaggcagagaaggacggcgtgcctgtattcaaatattcccgctggcgcgctaaaggacaggctctaccagacgttgtggctaagtaccaagccttgggtgctgaattgaatgtgcttcccttctgctctcagtttatacccatggaaattatctctgcccctagacatggcagcataatctaccacccctctctcctgccgcggcacaggggcgcttcagctattaattggaccttgatccacggcgataagaagggtggcttctctatcttctgggccgacgatgggttggacactggagacttgctgttgcagaaagagtgcgaggttctccctgacgacacagtcagcacactatacaatcggtttctgtttcctgaaggaattaagggtatggtccaggctgtccgcctcattgcagaagggaaggccccgcggctacctcagccagaagagggggccacatacgaggggattcaaaagaaggaaacagccaagattaattgggatcagccagctgaagctatacacaattggatccgaggcaacgacaaggtccccggcgcatggacagaggcatgcgagcagaaactgacatttttcaactctacactgaacacatcggggttggtgcccgagggggacgcactccctatcccaggagcacaccgccctggcgtggtgactaaggcaggtctaatattattcggtaatgatgataaaatgttactggtgaagaatatccagctggaagatgggaaaatgatccttgcctctaacttcttcaagggtgccgccagtagcgtgctggaattaacagaggcggagctcgtcactgcagaggccgttagaagcgtgtggcagcgtattctgcccaaagtgctggaggttgaagattcgacagatttcttcaagtccggggctgcgtccgtagatgtagtgagattggtggaagaggttaaggaattgtgtgatgggctcgaattggagaatgaggacgtgtacatggcttcaactttcggggacttcattcagctgctagtcagaaagctaaggggcgacgatgaggaaggggagtgcagcatcgactacgtcgagatggcagtaaataaacggacagtccgaatgccacatcagttgtttataggtggggagttcgttgatgcggaaggcgccaaaacctccgagactattaaccctacagatgggtcggttatttgccaagtctctctggcacaggtaacggacgtagacaaggcggtggccgcggctaaggatgcattcgagaatggacgatggggtaagatctctgctagggaccgtggccgcttgatgtacagattggccgatctaatggaacagcatcaggaagaactggctaccattgaagcattagacgctggggccgtgtacacactcgccttgaagactcacgttggaatgtccatccagacattccggtattttgcaggatggtgtgataaaatacagggtagcacaatcccaataaatcaagcccggcccaatcgcaatctcacccttacaagaaaagagcccgtcggggtttgcggcatcattataccttggaactatccacttatgatgctatcctggaagacagcagcctgtctcgccgctgggaacacagtagtcataaaacccgcacaggtcacccctctaaccgcattaaagttcgctgaactcacacttaaggccggaatcccaaagggagtcgtgaatgttctgcctggtagcggaagcctggtagggcagcggctgtctgatcatcccgacgtacgaaaaatcggatttaccggctctactgaagtcgggaagcatatcatgaagtcctgtgctatttctaacgtgaaaaaagttagcctggagctgggggggaagtcaccactgattatctttgccgattgcgatctcaacaaggcggtgcaaatgggaatgtcgagcgttttttttaacaaaggtgagaattgcatcgccgcgggacgcctcttcgtagaggactctatacacgacgagttcgtaagaagagttgttgaagaagttcggaaaatgaaggttggtaatcccctagaccgggacaccgaccacggaccccagaaccatcacgcacacttggtcaagctgatggagtattgccagcacggcgtgaaggagggggccaccctggtgtgcggggggaaccaggtgccaagacctggattcttctttgaacctactgtttttacggacgttgaagatcacatgttcatagcgaaggaggagagcttcggaccagtgatgatcatttcaagattcgcagacggcgacctggacgctgtgttgagtagggctaatgctaccgaatttgggttggcatctggcgtttttacacgcgacatcaataaagcactgtacgtatctgacaagctgcaggccggcaccgttttcgtgaatacgtacaataagactgacgtggctgctcccttcggcggtttcaaacaatctgggtttgggaaggatttaggcgaggccgcgttaaatgagtacctcagagtcaagacagtgaccttcgaatattag

SEQ ID NO: 107797 - DNA, 1518 bp, Artificial Sequence
  Description of Artificial Sequence: Synthetic coding sequence
atgaaaatcgcagtcatcggtcaatccctctttggccaggaagtatactgtcatctgcgcaaggagggccacgaggtggtgggagtcttcacagtgcctgacaaggatggtaaagcggatcctctgggtcttgaggctgagaaggacggtgtcccagtgtttaagtattcccgctggcgggccaaaggccaggcccttcccgatgtcgtcgccaagtaccaggctctgggcgctgaactgaacgtactgcccttttgctcacagttcatccctatggagatcatttctgcccccagacacggctcgattatttaccacccctcattacttccaagacataggggcgcgtcagctatcaattggacattgattcatggagataaaaagggcggtttttccatcttctgggccgacgacggtctggacactggcgacctgctactccagaaagagtgcgaagtgctcccagatgacacggtcagcacactgtataaccgttttctgtttcccgaaggcatcaagggtatggtgcaggccgtgagactaatcgcagagggaaaggcacctaggctgccccagcccgaggagggagcgacttacgaaggcatccagaagaaggaaacagcaaagattaactgggatcaaccagcagaggcaatacacaactggattcgcggtaacgacaaggtccccggcgcatggaccgaagcttgtgaacaaaagcttacattttttaattcaacccttaacacgagtggattggtgcccgagggggatgctctgcctatacctggggcccatcgccccggtgttgtgaccaaggctgggctaatcctgtttggcaacgatgataagatgctgcttgtgaagaatattcagttggaggacggaaaaatgatactcgcgtctaacttttttaagggagctgcatcctccgttctcgagctcacagaagctgagctggtaacggcagaggccgttagaagtgtttggcagagaatcctccccaaggtactggaggtggaggattccacggattttttcaagagcggcgcagcctctgtggatgtggtgagactcgtcgaggaagtgaaggagctctgcgacggcctagaacttgaaaatgaggacgtttatatggccagtacgtttggagacttcatccagctgctggtacgcaaacttagaggtgatgacgaagagggtgaatgttcaatagactatgttgaaatggcggtgaataagcgtacggtgcggatgccacaccagctgtttatcggcggggagtttgtagacgctgagggcgctaaaactagcgagacaatcaaccctacagatggatcggtgatctgtcaggtgtcgttggcacaggtgacagacgttgataaggccgtcgccgctgcaaaagatgcattcgaaaatggcagatggggcaaaatctcagcaagggatagagggcgtctcatgtatagagcgcctcctagccccagcacccgtccagatcctaccgccacgtag

SEQ ID NO: 107798 - DNA, 2709 bp, Artificial Sequence
  Description of Artificial Sequence: Synthetic coding sequence
atgaagatcgccgtgattggccagtccctgtttggccaggaagtgtactgtcacttgcgcaaggaaggacatgaagtggtgggcgtgtttactgttccggataaggatggtaaggctgacccactgggtctcgaggcagagaaggatggcgtccccgtattcaaatactccagatggcgagcgaagggtcaggcactgcccgacgttgtggctaaataccaggcattgggtgccgaacttaatgtactgcccttctgctcacagttcataccaatggaaattatatcagctccaagacatggctccataatttatcatccttccctgctccctcgccaccgaggcgccagcgctattaattggactctgatccacggggacaaaaagggcggattcagtatcttctgggctgacgatggactagacacaggggaccttcttttgcagaaggagtgcgaagtgcttccagatgatactgtaagcacactctataatcgatttttattcccagaaggcattaaagggatggttcaggccgttcgcttaatcgcggaaggaaaagctccccggctccctcaacccgaagaaggagctacctatgaaggcattcaaaagaaggaaaccgcaaagattaactgggatcagccggccgaagcaattcacaactggatcagagggaacgacaaggtgccgggcgcctggacagaagcctgcgagcagaaactgaccttcttcaactcgaccttaaacacctcggggttggttcccgaaggtgatgccttacctattcctggagcccatcgtcccggtgtggtgacaaaggccggactgattctgtttggcaacgacgataagatgcttctcgtgaagaatattcagctcgaggacgggaaaatgatcctggcaagcaattttttcaagggcgccgctagctctgtgctggaactaacagaggccgagctggttactgccgaggcagtgcgatccgtttggcaacgaatcctgcctaaagttctagaggtggaggactctaccgatttctttaagagcggggcggcctcagtggacgttgttcgattagtggaagaggtaaaggagctttgcgatggcctcgagcttgaaaatgaagacgtgtacatggcatctaccttcggtgacttcattcagctgcttgtccgaaagttacggggtgatgatgaagaaggggagtgcagcatcgactacgtcgagatggctgtcaataaaagaacagtgagaatgccacatcaactgttcatcggcggggagttcgttgatgccgaaggtgcaaaaacctctgaaacaatcaacccaacagacggatccgtgatctgccaggttagcctagcacaggtgactgatgtggataaggctgttgccgcggcgaaagatgcattcgaaaatgggagatggggaaagataagtgccagagatcgcgggagactaatgtaccggctggcagatcttatggagcagcaccaagaagagctggccactatcgaggccctcgacgcgggagccgtgtatacactcgctttgaagactcacgtgggcatgagcatccagacatttcgctattttgccggatggtgtgataaaatacagggcagcactatccccattaatcaggctagaccgaacaggaacctgacactgacgcgaaaagagcctgtgggcgtctgcgggattattatcccatggaactacccactcatgatgctgtcatggaaaaccgccgcatgcctggctgctggaaataccgtcgtgatcaagcctgctcaggtgacacccctgacggctctgaaattcgccgaactcactctgaaggccggaattcccaaaggagtagtgaatgtactccctgggagcgggtcactggtgggccagcggctgagtgatcaccccgacgttcgaaagatcggcttcacgggaagcaccgaagtgggtaaacatattatgaagagctgcgccatctccaacgtgaagaaggtgagcttggaattgggcggcaagtcacccctcatcatttttgccgattgcgatctgaacaaggcggtgcagatgggaatgagcagtgtgtttttcaacaagggcgagaactgtatcgccgccggcagactttttgtagaagattcaatccatgacgaatttgtaagacgggttgtggaagaagtgagaaaaatgaaagtcgggaatcctctggaccgtgatactgatcacgggccccagaatcaccacgcccacctagtcaaattgatggagtactgccaacacggtgtaaaggaaggagcgacgctggtttgcggcggaaaccaagtcccgcggccagggttcttcttcgaaccaactgtctttacagacgtggaggaccatatgtttatagctaaagaagaaagcttcgggcccgtgatgatcatcagcagattcgctgatggagacttggatgccgttctgagcagagctaacgcgaccgaattcggactggctagcggagtattcacaagagacattaataaagcactctatgtaagcgataaactgcaggcaggtacggtgtttgtcaacacatataacaaaacagacgtggccgcaccattcggaggattcaagcagagcggtttcggcaaggatctgggagaggcagcactcaacgagtaccttcgagtgaaaaccgtcacattcgagtactag

SEQ ID NO: 107799 - DNA, 483 bp, Artificial Sequence
  Description of Artificial Sequence: Synthetic coding sequence
atggttcaggccgtgcggcttattgccgaaggcaaagcaccgaggctacctcagccagaggaaggggccacctacgagggtatccagaagaaagagactgctaaaatcaattgggaccagcccgcagaggctatccataattggataagaggtaacgacaaggtccccggtgcctggactgaggcttgcgagcagaaactgaccttctttaattccaccctgaatacaagtggactcgtcccagagggcgacgccctacctattcctggcgcccatagacccggagtagtgacaaaggccggattgattttgttcggtaacgacgataaaatggtacgcgccagactctgggtcacttgtctcctgaaggccacgcatgcccctgtgctgggccttaggccgcatagaaagacccttggctccagcggagaaaacggaaaaaatcagacccaggagggtaccctgaccttgatttgtccctag

SEQ ID NO: 107800 - DNA, 507 bp, Artificial Sequence
  Description of Artificial Sequence: Synthetic coding sequence
atgaagatagccgttataggccagagtctgtttggtcaggaggtctactgccatctgaggaaagagggccatgaggtcgttggtgtatttaccgtccctgacaaggacggtaaggccgatcctctgggcctggaagccgagaaagacggtgtacccgtatttaaatatagcagatggcgcgcaaaaggacaagccttgccagatgtggttgccaagtaccaggccctcggagccgaactgaacgtcctgccattttgttcacaattcattcctatggagataatttcagccccgcgccatggctctattatataccatccttccctcctgccacgtcacaggggcgctagtgctatcaactggaccctcattcatggggacaagaagggaggatttagcatcttctgggccgacgacggactggacacgggagacctgctcctgcagaaggagtgtgaggtccttcccgacgacacagtgtcaactctgtacaacagattcctgtag

SEQ ID NO: 107801 - DNA, 2709 bp, Artificial Sequence
  Description of Artificial Sequence: Synthetic coding sequence
atgaagatagccgtgattggacagagcctgttcggacaggaagtgtattgccatctgcgtaaggagggccacgaggttgttggggtgtttaccgtgcctgacaaggacgggaaggcagacccactcggcttggaagctgagaaagacggcgtccccgtgttcaaatatagcagatggcgcgctaagggtcaagccttgccggacgttgttgccaaatatcaggctctgggcgctgagctcaacgtcctgcccttttgctcccaattcattcccatggaaatcatctctgctcctcgacatggatcaatcatatatcacccttcactcctgccacgacaccggggcgccagtgccattaactggacgctgatccacggagacaagaaaggcggcttcagcatcttctgggccgatgacgggttggatacaggggatctgttgctgcagaaagaatgcgaggtcctccctgacgataccgtctcaactctgtacaatcgatttctgttccctgaggggataaaggggatggttcaggcagtaagattgatagctgagggcaaggccccgagacttcctcaacccgaggagggggccacttatgaggggattcaaaaaaaagagacagcaaagataaactgggatcagccagccgaagcgatccataactggattagaggcaacgataaagtgcctggagcatggacggaggcctgtgagcaaaagctcacctttttcaactccacattaaatacctcaggcctggtacctgaaggcgatgccttgcctattccaggcgctcatagacccggggttgtgacaaaagccggcttgatattgttcggtaacgacgataagatgctcctggtcaaaaacattcagctggaggatgggaaaatgatcctggcatcaaatttcttcaaaggggccgcatcttctgtgctggaactcacagaggctgagttggtcactgctgaggcggttagatcagtttggcagcggatcctgccaaaagtcctggaagtggaggattctaccgatttttttaagtccggagccgcttccgtcgacgtggttaggctggttgaggaagtaaaggagctttgcgacggactggagctcgagaacgaggatgtatatatggcttcgacattcggtgattttatccaactcctggtgaggaaattgagaggagatgacgaggaaggggagtgctccatcgattacgtagaaatggcagtgaacaagaggaccgtaagaatgccccaccagctgttcatcggcggggagttcgtggacgccgagggcgccaagaccagtgaaactatcaacccaacagatggatcagtcatctgccaggtctcacttgcccaagtcactgatgtcgacaaggccgttgccgccgcaaaggacgcgttcgaaaatggccgatggggaaaaatcagcgccagggatcgcgggaggctgatgtaccgccttgcagacctcatggagcaacatcaggaagagcttgcaaccattgaggcactcgacgccggagccgtgtatactctggctctgaaaacacatgtaggaatgagtatccaaacattccgctactttgctgggtggtgtgataaaatccagggctcaacaatacctataaatcaggcgcgccctaatcgaaatcttactctgaccagaaaggaaccagtgggggtctgcggcataatcatcccatggaattaccccctcatgatgttatcttggaagacggccgcatgtctcgccgcgggaaatacagttgttatcaagcccgcccaagttactccactgaccgccctgaaatttgcagagctgacccttaaagctggcatccctaaaggcgtcgttaatgtgctgccaggcagtggttcgctagtcgggcagcggctcagtgaccaccccgatgtccgaaagatcggattcactggttctacagaagtggggaagcacatcatgaagtcatgtgctatttcaaatgttaaaaaagtgtccctggaattgggcggcaaatctcctctaatcatattcgccgattgcgacttgaataaagcagtgcagatggggatgagctcagttttttttaataagggtgagaattgtatcgccgccggccgactgtttgtagaggatagcattcacgatgaatttgtgcgaagggtggtggaggaagtgaggaaaatgaaggtcggcaacccgcttgatcgcgacaccgatcacggcccacagaatcatcatgcacacctggtgaaactgatggaatattgtcagcatggagtcaaagagggcgccacactggtatgtgggggtaaccaggttccacggccagggttcttctttgaacctacagtcttcaccgatgtggaggatcatatgttcatagccaaggaggaaagcttcggccccgttatgatcatctctagattcgcagatggggacctggatgccgttctgagtagagccaatgccaccgagttcgggctcgccagtggggtctttacaagggacattaacaaggcactgtacgttagcgacaaactccaggccgggaccgtctttgtgaacacatataacaaaacagacgtggccgccccttttggcggcttcaagcaaagcgggttcggcaaagacctgggggaagctgcactgaatgaatacctgcgggtcaagacggtgacatttgagtattag

SEQ ID NO: 107802 - DNA, 474 bp, Artificial Sequence
  Description of Artificial Sequence: Synthetic coding sequence
atgaaaatagcagtaatcgggcagagcctgttcggccaggaagtgtattgtcacctgcggaaggagggccacgaagtcgtgggagtgtttacagtaccggacaaggacgggaaagctgatcctctggggctggaggctgagaaagacggagtccccgtattcaaatactccaggtggagggccaaagggcaggccctacctgacgtagttgcaaaataccaggcccttggggccgagctcaatgtgctcccgttctgcagtcagtttatacccatggaaattatcagcgcgccaagacacggaagcattatataccaccctagtctgctgcctaggcatcgcggagcatccgccattaattggaccctcatacatggagataagaaagggggtttctcgatcttctgggcagacgatgggctggacaccggggatctcctgctgcagaaagagtgtgaggtcttgccggactag

SEQ ID NO: 107803 - DNA, 534 bp, Artificial Sequence
  Description of Artificial Sequence: Synthetic coding sequence
atgaagattgccgtcatcggacaatccctcttcggtcaggaggtctattgccatctcagaaaggagggccatgaggtggtgggagtattcacagtccccgataaggatgggaaagccgaccctttgggcctggaagctgagaaggacggagtccccgtgttcaaatattcacgatggcgcgcaaaaggccaggccctgcccgacgttgtggccaagtaccaggctctgggtgcagaactgaatgttctacccttctgtagtcaattcatcccaatggaaatcatctccgcaccacggcatgggtccatcatttaccacccttctctgctccctagacaccgtggcgcatccgcaatcaactggacacttatccatggggacaagaaggggggattctctatattctgggccgacgacggacttgacaccggtgacctcctactgcaaaaggaatgcgaagttctgcccgatgacacagtatctaccctgtataaccgcttcctgttcccggagggaattaagggaatggtctag

SEQ ID NO: 107804 - DNA, 303 bp, Artificial Sequence
  Description of Artificial Sequence: Synthetic coding sequence
atgaaaatcgccgtgattggtcagtccctctttggacaggaagtctattgccacctgaggaaagagggccacgaggtggtgggggtttttacggtcccagacaaggatggaaaagctgatccactagggctagaagccgagaaggatggagtgccggttttcaaatactcccggtggcgggctaagggccaggcattgccagacgtcgtggcaaagtaccaggccttaggtgccgaactgaacgtgctgccattctgcagccaatttattcctatggaaataattagcgcaccccggcactag

SEQ ID NO: 107805 - DNA, 2409 bp, Artificial Sequence
  Description of Artificial Sequence: Synthetic coding sequence
atggccgcaactcgggctggaccccgggcccgcgagattttcacttccttggagtatggacccgttcccgagagccatgcctgcgcactagcgtggctcgatacccaggataggtgcctgggccactacgtgaacggaaagtggcttaagccagaacatagaaacagtgtgccctgccaggaccccatcaccggggagaatcttgcttcatgcttacaggctcaggcggaagacgtcgctgccgccgttgaagccgccagaatggctttcaaaggctggtcagcccatcctggcgttgtcagggctcagcacttgacacgcctcgcagaagtaatccagaagcaccagcggctgctgtggacccttgaatctttagtgacgggccgagccgtgcgggaggttcgggacggggatgtccagttggcgcagcagctgctccactaccacgccatccaggcaagcacacaggaagaagctttggccgggtgggagccgatgggtgttattggtctcatccttccccctacttttagctttctagagatgatgtggagaatttgccctgccctggccgtggggtgcaccgtcgtggcactggttcccccagcctcgccagcgccccttctgttggcccaattggctggggagttggggccttttcctggtatactaaatgtcttaagcggacccgcgagtctggtgccaatcctcgccagtcagcccggtatcaggaaagtggccttctgcggcgcccctgaggaagggagagctcttcggcggtcccttgctggcgaatgcgctgagctggggctcgctctgggcacagaatcactgctccttttgaccgacactgccgacgttgactccgccgtggagggcgtggttgatgcagcgtggtcagatcggggcccgggcgggcttagacttttgatccaggaatcagtgtgggatgaagccatgaggaggctgcaggaacgtatgggtcggctgcgctcaggacggggtctagacggggccgtggatatgggcgctcgcggcgcagcagcctgtgacctagttcaacggttcgttcgggaagcccagtcccagggtgctcaggtcttccaggccggggatgtgcctagcgaaagaccattttatccacctactcttgtgagcaatctccctccagccagcccttgcgcccaggtggaggttccttggcccgttgtcgtagctagtcccttcaggaccgccaaagaggctctgcttgtggccaacggcacaccccgcggggggtcagcaagtgtctggtctgagcgattaggtcaagctttggagttaggttacgggttgcaggtcgggacagtttggattaacgcccacgggctgcgggatccttctgtccccactggcggttgtaaagaatctggctgttcctggcatggcgggcccgacgggctgtatgaatatctgcgaccctccggcacacctgctcgtttgtcttgcctgagcaaaaatctgaactacgacaccttcgggctcgccgttccttccaccctccctgcaggcccagaaattggacctagccccgcaccaccctatggtctgtttgtgggagggcgtttccaggcgcccggggccagaagctcgcggccaattagagattcttcaggtaatctgcatggctacgttgcagaaggcggggcaaaggacattcgcggagccgtggaggcggctcaccaggcattcccagggtgggccggccagtcacctggagcacgggccgccctgttgtgggctctggcagcagccctggaacgccgcaagtccacgctcgctagcaggctggagcggcaaggggctgagctgaaggctgctgaagctgaagttgaactcagtgctagacggctcagagcgtggggggctagagtacaagcccaaggccatacacttcaggtggcggggctgagaggccccgtgctgcgcttgcgagagcctctaggagtattagcagtcgtgtgccctgacgagtggccgttgttagcctttgtgtccctgctcgccccggctttggcctatggcaacaccgtggtcatggtgcctagcgccgcttgtccgcttctcgctttagaagtgtgtcaagacatggccaccgtcttccccgccggcctggcaaatgtcgtgactggagacagggatcacctcactcggtgtttagcactccaccaggatgttcaggcaatgtggtatttcgggagtgcccagggatcccaattcgtggagtgggcttccgccggaaatctgaagcccgtatgggcaagtagaggatgtccccgcgcatgggaccaggaggcagagggcgcagggcccgagctgggcctgagagtcgcccgcactaaggccctttggttgcctatgggcgattag

SEQ ID NO: 107806 - DNA, 1914 bp, Artificial Sequence
  Description of Artificial Sequence: Synthetic coding sequence
atgggggtaattgggctgatactgcctccgacattttcttttcttgaaatgatgtggaggatctgcccagctcttgcagtaggatgtaccgtggtggccctcgtgccaccagcatcccccgcacctcttctgttggcgcaattggctggggagctggggccattccccgggattctgaatgttctgagcggcccagcttctcttgtgccaatattggcttctcagcccggcataaggaaggtggcgttctgcggcgcacctgaggagggccgggcattgcggaggagtctggcaggcgaatgtgcggagttgggcttggccttgggtacagaaagcttactccttcttacagacaccgcagatgtcgactccgcggtggagggggtggtggacgctgcctggagtgacagaggcccaggtggactgcgcctgctcattcaggaaagtgtgtgggacgaggccatgagaaggttgcaggagcgcatgggtcgcctccgctcaggtcgcggcttggacggggctgttgacatgggcgctcggggagccgccgcatgcgacctggtgcaaagattcgtgcgcgaggctcagtcacagggcgcccaggtgttccaggccggtgatgtcccaagcgagcgcccgttttacccaccaacactggtgagtaaccttcctcctgcatcaccctgtgcccaagtcgaggtgccttggccagtggtggtcgcaagcccttttcgtaccgctaaggaagccctcctggtggccaatggcaccccaagaggtggcagcgcatctgtttggtcagaaagactgggccaagcactggaacttgggtacggactccaagtggggactgtctggataaatgcccacggcctaagagatccttccgtgccgacaggcggttgcaaagaatctgggtgttcctggcatgggggcccagatggactgtatgagtacttgcgcccaagtggcactcctgcccgtctcagttgtctgagcaaaaaccttaactacgacacgttcggactagccgttcccagcacactgccagcaggacctgaaataggacccagtccggccccgccttacgggctctttgttggcggccgattccaagcaccaggagctaggagcagccgacccataagagatagcagcggcaacctacatggctacgtggcggaggggggagcaaaagacattagaggtgctgtagaagctgcacaccaggcctttccaggctgggctgggcagtcacctggggcaagagccgccctgctttgggctttagctgccgccttggaacggcgaaaatctacactggcctctagattggagcgccagggagctgagctcaaggctgccgaagccgaagtcgagctcagcgcccggagacttagagcatggggtgctcgagtgcaggctcagggccacacattgcaggttgcgggactccgcgggccggtcttacgtctcagggagcctctgggcgtacttgcagtggtgtgtccagatgagtggcctttgctcgcatttgtctctttgttggctccagccttggcctacggcaacaccgtcgtgatggtaccctctgccgcctgcccgctccttgcactggaagtgtgccaggacatggcaacggtcttccccgccggtttggcaaatgtcgtgaccggggacagagatcatcttacaaggtgcctggccctccaccaagacgttcaagcaatgtggtacttcggttctgctcagggatcgcagttcgtcgagtgggcatctgcaggaaaccttaaaccagtgtgggcttctaggggatgcccacgggcatgggaccaggaggcggagggggctgggccagagctgggactccgcgtcgctcgaaccaaggctttgtggctgccaatgggagattag

SEQ ID NO: 107807 - DNA, 2256 bp, Artificial Sequence
  Description of Artificial Sequence: Synthetic coding sequence
atggcagccaccagggctggtccacgcgctcgcgaaatcttcacgtcgcttgagtatggacctgttccagagtcacatgcctgtgccctcgcttggttggacacacaggaccggtgtctagggcactacgtcaacggaaaatggttgaagccagagcacagaaacagcgtcccatgccaggatcctattaccggcgagaacctggcttcttgtctgcaggcccaagcagaggatgtagctgccgcagttgaagctgcgaggatggcgttcaaggggtggagcgctcacccgggggtggtgcgggctcagcacttgacgaggctggcggaggtgatccagaagcatcagcggctgttatggacactcgagtcacttgtgactgggagggcagtacgcgaagtccgcgacggagatgtgcagttggcccagcagctcttgcattaccacgcaattcaggccagcactcaagaagaggcgctggcagggtgggaaccaatgggcgtcatcgggctgattttgccacctacattttcgttcctcgagatgatgtggcggatctgtcctgccctcgctgtaggctgcacagtcgtcgctcttgtgccacccgcaagccccgctcctctcctgttggcccagctagccggcgagctggggccttttcctgggatactgaacgtgttgagcggaccagcctcccttgtgcccatcctcgcatcacagcccgggatccgtaaagtggctttttgtggcgcacccgagggcggcctgaggctgctgatacaggaatctgtctgggatgaggctatgaggaggttgcaggagcggatgggacgtctgcgatccggtcgcgggctggacggcgctgtagatatgggtgccaggggtgccgccgcatgtgacctcgttcagcggtttgtgcgtgaggcccagtcccagggtgcccaggtcttccaagctggagacgtaccaagtgagcgccctttttatccaccgacgctcgtgtctaacttgccacccgcttctccttgtgcacaggttgaggtgccgtggcccgttgtggtagcgagcccattccgaactgccaaagaagccttgttagtcgcgaatggtacgccgcggggcggtagcgcaagcgtttggtccgagagactcggccaggcgctcgagctgggatatggtcttcaagtgggaacagtgtggattaatgctcatggtctgcgagatccttcagtgccaaccggcgggtgtaaagagtcaggatgctcttggcacggggggccggatggcctctatgagtatctcaggcccagcgggacccctgcacgactttcctgcctgtcaaaaaatttgaactacgacaccttcggactggctgtgccgtcaactctccccgccggccctgagattggccccagccccgcccctccctatggactgttcgtcggagggcgttttcaggcccctggcgcccggtcttcacgccccatacgcgactcctcaggtaatttacacggatatgtggcagagggaggtgctaaggatataaggggagcggtagaggctgctcaccaggcctttcctggctgggctggccaatcccctggcgcgagagctgctttgctctgggctttggcggctgcattggaacgccgaaaatccaccctggcgtctagactggaacgccaaggcgccgaactaaaggctgcagaagcagaagtggaactctcagcccggaggctgcgagcctggggggcacgggtgcaggcccaaggtcacaccctgcaggtggcaggtctgcgtggtccagtgctgaggctgcgcgagccactgggcgtgcttgcagtagtttgtcctgatgaatggcctcttctcgccttcgttagtctcctggccccggctctggcctatggcaacacagtcgtaatggtccccagcgcggcgtgccccctgctggccctggaggtctgccaagacatggccaccgtctttcctgcagggctggccaacgtggtgaccggcgacagagaccatctgaccaggtgcctggcactgcaccaggacgtccaggccatgtggtacttcggatcagcccagggttcccaattcgtggaatgggcaagcgctggcaacctgaaaccagtgtgggccagccggggttgtccacgagcgtgggatcaggaagccgagggcgcaggcccggagctggggctccgagtggcaagaaccaaggcgctgtggttgcccatgggggactag

SEQ ID NO: 107808 - DNA, 1920 bp, Artificial Sequence
  Description of Artificial Sequence: Synthetic coding sequence
atgagaaccggagtgatcggtctcatattacctcccacctttagtttcttggagatgatgtggcgcatctgccctgccctggcagtcggctgcactgtcgtcgccctggtgccccctgctagcccagcccccctgctactggctcagctcgccggggagctcggcccattcccaggcatcctaaatgtcctgagcggcccagcttcgttggttcctatccttgcctcacagcccggaattaggaaggtcgccttctgcggcgccccagaagagggccgtgccctgcggcggtctctggcgggagagtgcgccgagttggggctcgccctcggcaccgaaagcctcctcttactcaccgacacagctgatgtggattctgcagtggagggggttgttgacgcggcttggtcggaccgcgggcccggaggcctgcgactgcttatccaggaaagcgtgtgggatgaggcgatgcgcagattgcaggagcggatgggccgtttaagatctggccggggcctagatggggccgttgatatgggcgccaggggcgctgccgcttgcgacttggttcagcggttcgttcgagaagctcagagtcagggggcccaggtgttccaggcaggggacgtgccgtcggaacgtcctttctacccccccacattagtatcaaatttacctcctgcgagcccatgcgctcaggtagaggttccgtggcccgttgtcgtggcgtcccccttccgcaccgcaaaggaggctctgctggtcgcgaatggcaccccaagaggtggcagtgcctctgtctggtctgagcggttagggcaggcacttgagctcggctatgggctccaggtgggaacagtatggataaacgctcatgggttgcgcgatccctcggtgccaaccgggggatgtaaagagtcaggctgttcgtggcacggaggcccggacggtctctacgaatacctccgcccctctggtacacccgctagactgagttgcctgagcaaaaatctgaactacgacactttcggattagccgtgccctctactttgccagctggacctgagatcggcccttcgccagcgcccccatacggattgttcgttggcggccgattccaggctcctggtgcccggagttcgcgaccaatccgggatagctctgggaatctgcacggctatgtggccgagggcggagctaaggatatcaggggtgccgtggaagcagcacaccaagcattccctggttgggctggccagtctccaggcgcccgcgctgccctgctctgggcccttgccgctgccctggagagaaggaagtccaccctggctagtaggctcgagagacagggcgccgagttaaaagcagccgaggcagaggtggagctcagcgctaggcgcctaagggcctggggagcgcgggtccaggcacaggggcataccctgcaggttgctggactgcgcgggccagtcttaaggcttagagaaccactcggcgtcctggcagtggtgtgtccggacgaatggcccctcttggcgtttgtgagcctccttgcccccgctctcgcttacggaaatactgttgtgatggttccaagcgcggcttgccctctgctcgcgctggaggtgtgtcaggacatggctacggtgtttccagctggcctggccaacgtcgtaaccggagacagggatcacttaacccggtgtctggccctccatcaggacgtgcaggccatgtggtactttggctccgctcagggcagccaatttgtggagtgggcaagcgctggaaatctgaagccagtatgggcatcacggggttgtcctcgcgcatgggaccaggaggccgagggggccggccctgagctggggctgcgagttgctaggaccaaggccctctggctgccaatgggcgactag

SEQ ID NO: 107809 - DNA, 2382 bp, Artificial Sequence
  Description of Artificial Sequence: Synthetic coding sequence
atgttatcacaagtataccggtgtggcttccagcccttcaaccagcacttgctgccctgggtgaagtgtaccactgttttcaggtcacactgcattcagcctagcgtgatcagacacgtccgcagctggtctaatatcccgtttattaccgtgcccctcagccgcacacacgggaagtcctttgctcatagaagtgaattgaagcacgctaagaggatcgtagtgaaacttggatccgccgttgtgacacggggcgacgagtgtgggcttgccctcggccgcttggcgtcaatcgtggagcaggtgtcagttttgcagaaccagggaagagagatgatgctagttaccagcggcgctgtcgcatttgggaagcaaagactgagacacgaaatcctgctaagccaatccgtgagacaagctctccattccgggcaaaatcaactaaaggagatggcgataccggttttagaggccagagcttgcgccgctgcagggcagtctgggttgatggcactctatgaggctatgtttacccagtatagtatatgcgcagcccagatacttgtgactaacctcgacttccacgacgagcagaaacgtcgcaacctgaacggcactctacatgagctgttacggatgaatatcgttccgatcgtcaacacgaacgatgccgtggtcccgcctgcggagccgaacagtgatctccagggtgtcatcagtgttaaggacaatgactcactcgcagcacgcctcgctgtcgagatgaagaccgatttattgatagtgctgtctgatgttgagggattgtttgactccccccccgggtcagacgacgccaaactcattgacatcttctatcctggagaccagcaaagcgtcaccttcgggacgaaatctcgagtgggaatggggggaatggaagcaaaggtaaaagcagccttgtgggctctgcaaggcgggacttctgtagttatcgccaatggcacacatcccaaagtcagtggacatgtgataacagatatagtggaaggtaagaaagtcggcacattcttctccgaagtgaaacctgccggacctacagtggagcaacagggcgaaatggcgcggtccgggggacggatgctggctactttggaacccgaacagagagctgagattattcaccacttggcagatctgctcaccgaccagcgtgatgaaattctgctggccaacaagaaagatttagaggaagctgagggaaggcttgcagccccactcctgaagcgtctgagcctgtcaaccagtaaattgaactctctggctattggcctaagacagatcgccgcctcctctcaggattccgttggccgcgttctcagacggacccgaatagccaagaatttggagctagagcaggtaaccgtccctatcggagttctgctggtgatctttgagagccgcccagattgcttgccacaagtcgccgcactggctattgcaagcgggaatggcctgctgttgaagggaggaaaggaggccgcccactctaatcggatattacatcttctgacccaagaggccctgtctatccacggcgtgaaggaggccgtgcagttggtcaacacccgagaagaagtggaggatctttgcagacttgacaagatgatcgacctcattataccaaggggttcatcccagttggtacgggatatacagaaagccgctaaaggcatcccggttatgggtcactctgagggcatatgccacatgtacgtggactctgaagcctctgtagacaaggtgacaagactggtgcgggactcaaagtgcgagtaccctgctgcctgcaacgcattggaaacgctgctgatccaccgcgatctcctgcggactcccttgttcgaccagattattgacatgttaagagttgagcaggttaaaatccatgccggtccgaagtttgcctcatatctgactttttcaccaagcgaggtcaagtctctgaggacagagtacggcgacctggagctgtgcatagaggtggtggacaatgtgcaggacgcaattgatcacattcataagtacggaagctctcacacagatgtcatcgtcactgaagacgagaacaccgcggagttcttcctgcagcatgtggatagtgcctgtgttttttggaatgccagcaccagattctctgacggctatcgttttgggctgggggcagaggtaggaatcagtacatcgaggatccatgcgagggggcccgtgggcctggaaggtctgcttaccactaaatggttgctgagaggtaaggaccacgtcgtgtcggattttagcgagcacgggtccctgaaatatctgcacgagaatctacccataccacagcgtaacactaactag

SEQ ID NO: 107810 - DNA, 2388 bp, Artificial Sequence
  Description of Artificial Sequence: Synthetic coding sequence
atgctctctcaagtgtaccggtgcggatttcagccctttaatcagcacctgctgccatgggttaaatgtactacagtgtttcgcagccactgtatacaaccctctgtgattcggcatgtccgcagttggtccaatatcccgtttatcacagtcccactgtcaaggacgcatggaaagtcatttgcccatcgatccgagctcaaacatgcaaaacgcattgtggtgaagttgggaagtgctgttgtgacccgtggggatgaatgtgggctggcactcgggcggcttgcttctatcgtggagcaggtgtcagtcctgcagaaccagggacgcgaaatgatgcttgtgacgagcggtgccgtcgcattcggcaagcagagactgcgccacgagattttgctctcccagtctgtgagacaggcattacattccggccagaaccagttgaaggaaatggcaatcccagttctggaggcgagagcgtgcgccgccgccggccagtccgggctgatggccctgtacgaggctatgttcacacaatattccatctgtgcggcgcagattttggtgactaacctggactttcatgacgaacagaagcgtaggaacctcaatgggacattgcatgaactgttgaggatgaacattgttccaattgtcaatactaatgatgcggtcgtcccgcctgcagagcctaattctgacctgcagggagtgaacgtgatcagtgttaaagataatgattccctggccgctaggcttgccgttgagatgaagaccgacctcctcattgtgctgtctgacgtggagggactgttcgatagtcccccgggatctgacgatgcgaagctgatcgatatcttttaccctggcgatcagcagtccgtgaccttcggaacgaaatctcgcgtcggcatgggcggcatggaggcaaaagtgaaggctgctctctgggctttacaaggtggtacctccgtcgttattgcgaatggcacccatcctaaagtgagtggccacgtcattacagacatcgttgagggcaaaaaggtcgggacctttttttcggaggtgaaaccggcagggcctacagtggaacagcagggagaaatggctagatctgggggcaggatgctcgctaccttggaacctgagcagcgggcagagatcatccaccacctagcagatttactgactgaccaacgagacgagatcttactagccaacaagaaagatctggaagaggccgagggcagactggctgcacctctactgaaacgtctgtcactctcgacctccaaactaaattctttggccataggtctgagacaaatcgccgcctcttctcaggactctgtgggcagggtgttacgtcggacccggattgccaaaaacctcgagttggaacaggtgacagtccctattggggtgcttctggtgatttttgagtctcggccagactgcctgccacaggttgctgcattggcaattgcctccggcaacggattgttgctgaagggtggaaaggaggcagcccacagcaatagaattctgcacctcctgactcaggaggctctctcaattcacggcgttaaggaggcagtacagctcgttaacacaagggaagaagtggaagatttatgtcgactcgacaagatgattgatcttattatcccccgtgggtcttcccagttagtcagggatattcagaaggctgcaaagggcattcccgtgatgggacactcggagggtatctgccacatgtacgtggactcagaagctagcgtggataaggtgactcgcttagttcgcgacagcaaatgcgagtatccagctgcctgtaacgcactggagacgctgctcatccatagggatcttctgcgcaccccactgttcgatcaaatcatcgatatgcttagagttgagcaggtcaaaatacacgctgggcctaaatttgcaagctacctaacattctctccttccgaggtgaagtccctgagaacagagtacggcgacctggagttgtgcattgaagtcgtcgacaatgtccaggatgccattgaccacatacacaaatatggaagttctcacactgatgtcatcgtgactgaggacgagaacactgccgagttttttcttcagcatgtggattccgcatgcgtgttttggaacgcttccaccagatttagcgatggataccgcttcggcctcggtgccgaagtgggcatctccaccagtcgcatccacgctagaggtcccgtggggctggaggggctgctgaccaccaaatggctcctgaggggcaaagatcatgtcgtgagcgacttcagcgagcacggatctcttaaatatttgcacgagaatctacctattccacagcgcaacaccaactag

SEQ ID NO: 107811 - DNA, 1554 bp, Artificial Sequence
  Description of Artificial Sequence: Synthetic coding sequence
atgttgcgcgcagcagcccggtttggcccccgcctgggtcggcgacttctgtctgcagcagcgacccaggccgttcccgctccaaatcagcaacctgaggttttctgcaatcaaatctttatcaacaacgaatggcacgatgccgtttcaaggaagacattcccaacggtcaatccttccactggcgaggtcatttgtcaagtcgcagaaggggacaaagaagatgtggataaggctgtaaaggcagctcgtgctgcttttcagctggggtctccatggcgcagaatggacgcctcgcaccggggtcgcctgctcaaccgactcgcggacctcatagagagggaccgcacataccttgccgccctggagacactggataacggtaaaccctatgttatctcctacctcgttgacctcgacatggtcttgaaatgtctgcgttactatgcaggctgggctgacaaataccatggaaagactattcccattgacggggatttcttctcttatacccgccacgagcccgtaggggtttgtggccagatcattccctggaacttcccactgttgatgcaagcgtggaagctgggcccagcactggccaccggtaatgttgttgtcatgaaagtggctgagcaaactcctctgacagccttgtacgtggccaacctcatcaaagaagccggtttcccccccggagtcgttaacatagtcccaggttttggacctaccgccggtgccgccattgcaagccatgaggacgtcgataaggtcgcattcactggctccacggagattggacgcgtaattcaagtcgcagcgggttcctctaacctgaaacgtgtcaccttggagttgggaggcaagagtcccaacataatcatgagtgatgcagacatggactgggcagtggagcaggcccatttcgcactttttttcaaccagggtcagtgttgttgtgccggatctcggactttcgttcaggaggatatttatgatgagttcgtagagcgtagtgttgcccgcgcaaagtccagagttgtaggtaatccattcgactctaaaacagagcaaggcccacaggtcgatgaaacccagttcaagaagatactgggatacatcaataccggcaagcaggagggtgccaagcttttgtgtggcggcggaattgccgccgacagaggctattttatacagcccactgttttcggcgatgtccaggatgggatgactatcgccaaggaagagatatttggacctgtgatgcaaatcttgaaatttaaaaccatcgaggaggtggtggggagagcgaataattccacctacggactagccgcagcagtgttcacaaaggacctggacaaggcaaattacttgagccaggccttgcaggcgggcactgtgtgggtaaactgctatgacgtttttggagcccagtccccattcggtggttataagatgtctggcagcggcagagagctcggcgagtacggtctgcaggcctacaccgaggtcaagacagtgacagtaaaagttcctcaaaagaattcttag

SEQ ID NO: 107812 - DNA, 1413 bp, Artificial Sequence
  Description of Artificial Sequence: Synthetic coding sequence
atgctgagagccgcggcccgcttcgggcccaggctgggccgccgcctgctaagtgccgcagccacacaggctgtcccggctcccaaccagcagcctgaagtattctgcaaccagatcttcataaataacgagtggcatgatgcagtttctagaaaaacctttcccactgtcaatccatccactggcgaggttatatgtcaggttgccgagggggacaaagccctggaaaccctggacaatggtaagccctatgtgattagttacctcgttgacctggatatggtgcttaagtgtctacgctattacgccggctgggcagataagtaccacggtaaaacaattcctattgacggcgatttcttttcctatacgcggcacgagcctgtgggggtgtgcggccagatcatcccatggaacttcccactgctgatgcaggcctggaaactgggtccggcactggctacaggaaatgttgtggtaatgaaagttgcggaacagacccccctcaccgcgctctatgtcgccaatctgatcaaggaggctgggtttccccccggggtggtgaacatagtcccgggctttgggcccacggcgggcgctgccatagcgagccacgaagatgtcgacaaggtggcgtttacaggctccaccgagattggaagggtcattcaggtcgccgcagggagctccaacttgaaacgagtgactctcgaattaggcggaaaaagccctaatatcatcatgtcggatgccgacatggactgggcagttgagcaggcgcattttgcgttattcttcaaccagggccagtgttgctgcgccgggtcccggacctttgtacaggaagatatctatgacgagttcgtcgaacgatccgttgccagggccaagtctcgcgttgttggtaacccattcgacagtaaaaccgagcagggtcctcaggtggatgaaacgcagtttaagaagattttgggctacatcaatacaggcaagcaggagggggcaaaattgctgtgtggcggtggaatcgccgctgaccggggttactttatacaacccactgtatttggagacgtccaagatggtatgacaatcgccaaggaagagatcttcggtccggtcatgcagatacttaagtttaagaccatcgaggaggtggtggggcgagcaaacaactccacctacggtctggccgccgccgtcttcaccaaggacctggacaaagcaaactatctgagccaggccctccaggctggcactgtgtgggtcaattgctacgatgttttcggggcccagtccccatttggggggtataaaatgtctggtagtggtcgggaacttggggaatatggactccaggcctacaccgaggtgaagacggtgaccgtcaaggtgccccagaagaattcttag

SEQ ID NO: 107813 - DNA, 1989 bp, Artificial Sequence
  Description of Artificial Sequence: Synthetic coding sequence
atgagaggagcgggcccatccccaaggcaaagccctcggactctgcggccagatcctgggccggcaatgagtttctttcggagaaaagtcaagggtaaagaacaggaaaaaactagtgacgtgaaatccataaaagcttccatttcagttcatagcccacaaaaatctaccaaaaaccatgcgctgttagaggccgccggaccttcacatgttgctattaatgccatttctgccaatatggattcgttctctagtagtcggactgctacactgaaaaaacagccaagccatatggaagccgcccactttggcgacctcggccggtcgtgcctggattatcagacccaggaaaccaaatcaagcctatcgaagacgcttgagcaggtcctacatgatacaatcgttctgccgtacttcatccagttcatggaacttcgacgaatggaacatctggtgaaattctggcttgaggctgagtcttttcatagcactacatggagccgcatcagggcacactccttgaacactgttaagcagtcttcgctcgccgaaccagtgtccccatcgaagaagcacgagacaacagcctccttcctaactgactctctggataagaggctcgaggattccggatcagcacagctctttatgactcactctgaggggatcgacctgaacaatcggaccaattctacgcaaaaccatctgctgctctcccaagaatgtgactccgcccattctcttcgattggaaatggcacgagcagggactcatcaggtgtctatggagacacaggagtcctcctctacactgaccgttgcctctaggaattcccctgccagcccgctcaaagagctctctggaaagctgatgaagtccatcgagcaagacgcagtaaatacgtttactaagtacatctcccctgacgcagctaaacctatacctatcaccgaggccatgaggaatgatattatcgctaggatctgcggcgaggatgggcaggtggaccccaattgtttcgtcctggctcagagcattgtgttctcggccatggagcaggagcacttcagcgaattcctgcggagccaccacttctgtaagtatcaaattgaggtgctgacatcgggcaccgtatatctcgctgatattctcttctgcgagtctgcgctgttctattttagtgagtatatggagaaggaagatgccgtgaatattttgcagttctggctagccgccgacaactttcagtctcagctagccgctaagaaaggacagtacgatggccaggaggctcaaaatgacgccatgatcctatacgacaaatacttcagtctacaggcaacacaccccctcggttttgacgatgtggtaagactggaaatcgaatccaacatctgtagagaaggggggcctttacccaattgttttaccactccactgcgacaggcgtggaccaccatggagaaagtgtttctccctggctttctctcctctaacctttattacaagtaccttaatgacctcatccactccgtccgcggcgacgagtttcttggcgggaacgtttctttgaccgccccgggcagcgtgggacccccagatgaatcgcacccaggcagctccgactccagtgcctctcagagctccgtaaagaaagcatctatcaagattttgaagaattttgacgaagccattatagtggacgccgcttcgttggaccctgagtcgttataccagcgaacttatgcaggcaaaatgaccttcggaagggtgagcgacctaggtcagttcattcgagaaagtgaacctgagccggatgtccggaagtcaaagggctcaatgttctcacaggccatgaagaaatgggtccagggcaacactgacgaggcacaagaggaactcgcctggaagatagctaagatgatagtgtcagatatcatgcagcaggcacagtatgaccagcccctggaaaagagcacaaaactctag

SEQ ID NO: 107814 - DNA, 1536 bp, Artificial Sequence
  Description of Artificial Sequence: Synthetic coding sequence
gaggtgcaacggactcctcacccgacttttgaatactttttcttcctaagtcggaagttgccaggacaggaactgcaagggctgaacgggcgggaggcaggcagtctgaatacctctccactgggctcttgccgctcccgaagtccctcctacagggaaaggctgtgtcagcggagacacgaacaggaccagagagggcgcgaggccaggcctcgccgcctccagggccgcacccgcccgttgcaatttcgtatacagcagctagaagctctgcagcgcctcatccaagaacaggaacaggagttagttggagcgctggcagccgatcttcacaaaaacgagtggaacgcttactacgaggaagtggtttacgtgctggaggaaatcgagtatatgatccagaaacttcctgaatgggccgccgacgaacctgtcgagaaaacacctcaaacgcagcaagatgaactgtacattcacagtgaaccattgggagtcgtgctcgtgataggtacctggaactatccattcaatctgactattcagcccatggttggcgctatcgcagctggcaacagcgtagtcctgaagccctccgagctttcagagaacatggcgtctttgctcgctacaattatacctcagtatctcgacaaagatctgtatccggtaatcaatggaggggtgccagaaaccactgagctgttgaaggagcgattcgatcacattctgtatacaggctccacgggagtggggaagattattatgactgcggccgcgaagcatctgacgcccgtgaccctggagttgggcggtaagagcccctgctacgtggataagaattgtgatctcgatgttgcttgtcgacggatagcgtggggcaagtttatgaactctgggcagacatgtgtcgcccctgattatatcttgtgcgacccgtccatccaaaaccaaatagtcgaaaagctgaagaagtctctcaaggagttttacggggaagatgctaaaaaatctagggattacggtcgaatcattagtgctcgacactttcagcgcgttatggggctcattgaaggccaaaaagtggcctatggcgggaccggcgatgccgccactcgatatattgctcctacgatactgaccgacgtggaccctcagagccctgtaatgcaagaggaaattttcgggcccgtcttgcctatagtctgtgtacggagtctggaagaagcaatccagtttattaatcagcgcgagaagccgttggccttgtacatgttcagtagtaacgacaaagtgattaagaaaatgattgctgagacctcgtctggtggtgtggcagctaatgacgtcatagtgcatattacccttcactctttgcctttcggcggagtgggcaactctggaatggggagctaccacggaaagaagtccttcgaaaccttttctcataggaggtcctgcttagtgaggcctctgatgaatgacgagggattgaaggtgcgctaccctccctccccagctaagatgactcagcactag

SEQ ID NO: 107815 - DNA, 1170 bp, Artificial Sequence
  Description of Artificial Sequence: Synthetic coding sequence
atgtctaaaatatccgaggctgttaagcgggccagggcagcctttagctctggtagaacacggcctcttcagttccgcattcagcagttagaagcactgcaacgtctgatacaagagcaggagcaggagcttgtgggcgccctggcggccgacctccacaaaaatgagtggaatgcctattacgaggaggtggtgtatgtgctcgaggagatcgagtatatgatacagaagctgcctgaatgggccgcagatgagcccgtagaaaagacacctcaaactcaacaagatgagctctacattcattctgaacctcttggagttgtgctagtcattggtacgtggaactatccgtttaacctcacaattcaacccatggtgggagccatagccgcaggcaattctgtggtgctgaagccatcagagctaagcgaaaacatggcatctcttctggccacaattattccacagtacctggataaggacctttatcctgtaatcaacggtggtgtgcctgaaaccactgagctgctaaaggaaagatttgatcacatcttgtacacaggatcgaccggagtggggaagatcatcatgactgctgccgccaagcacctgacccctgtgaccttggagttaggagggaagtctccatgttacgtcgacaaaaattgtgacctggacgtggcatgcaggaggatcgcgtggggcaaatttatgaactccggccagacttgcgtcgccccggactacattctgtgcgatccatccatccaaaaccagatcgttgaaaagttgaagaaaagtctcaaagaaatattcggacccgtccttcctatcgtatgtgtcaggtccctggaggaggctatacagtttatcaaccaacgtgaaaagccactggctctgtacatgttctccagtaatgacaaggtcatcaagaaaatgatagcagagacctctagtggcggggtcgccgctaatgatgtaattgtacatattaccctgcacagtttacctttcgggggagttggcaattctgggatgggttcatatcatggaaaaaaaagttttgagaccttttctcatcgtcgttcctgtctggtgagacccctaatgaatgatgagggactgaaagtgcgttatcccccaagcccagcaaagatgacccagcactag

SEQ ID NO: 107816 - DNA, 693 bp, Artificial Sequence
  Description of Artificial Sequence: Synthetic coding sequence
atgagcaagatcagtgaggccgtaaagcgagctcgtgctgcatttagcagcggccggacgcggccattgcagttcaggatccagcagctcgaagctctgcagaggttaatacaagaacaggagcaggaactcgtcggggctctggccgcggacctgcataagaacgagtggaatgcctactacgaagaggtggtgtacgtcctggaagaaattgaatacatgatccaaaagctgcccgagtgggctgccgatgaacccgttgagaagacacctcagactcaacaggacgagctgtatatacactccgagcccctgggcgtcgtgctggtgattggcacctggaactatccattcaaccttacgatccagccaatggtcggcgctatagctgccgggaattcagtcgtcctgaagccatcagagctttctgagaacatggcctctcttctggccacaatcatcccacagtatcttgacaaggatctgtaccctgtgataaatggcggtgtcccagaaaccacagagctgctgaaggagcggtttgatcacatcttgtatacaggatccacgggtgttggcaagatcattatgaccgctgccgccaaacacctgacacccgtcacactcgagcttggcggaaaaagtccttgttacgtggataaaaactgcgatctggatgtggcctgtaggtag

SEQ ID NO: 107817 - DNA, 1119 bp, Artificial Sequence
  Description of Artificial Sequence: Synthetic coding sequence
atgagtaagatctccgaagccgtgaaacgagccagggctgccttctcgagcgggagaaccaggccgctgcagtttagaatccagcagcttgaggctttgcaacggttgattcaggaacaagagcaggagctggtcggagccctggccgctgacctgcataagaacgagtggaacgcctactatgaggaggtggtgtacgtgctcgaggagattgagtacatgattcagaaattgcccgagtgggccgccgatgagccggttgaaaaaacgccccaaacacagcaggatgaactgtacattcatagtgagcctctgggggtcgttctggtgatcggcacctggaattatcctttcaatctgactatccaaccaatggttggcgccattgctgccgggaatagtgtagtacttaaaccgagtgagctcagcgagaatatggcctctctgctggcaactattattcctcaatacctggacaaagacttatatccagtgatcaatgggggggtgccagagactactgagttgctaaaagaaaggtttgatcacatcttgtacactggaagtaccggcgtgggaaaaatcattatgaccgctgcagcaaaacatctcactcctgttacgttggagttggggggcaaatctccctgttatgtggacaaaaattgtgacttagacgtggcctgcaggcgcatagcatgggggaaatttatgaacagcggacagacatgcgttgcccccgattacattctctgcgacccctccatccagaaccagatcgtcgaaaaactgaagaaatcactcaaagaattttatggtgaagacgcgaagaagagccgcgactacggcaggattataagtgcccgccacttccagagggtcatggggttgatcgaaggccaaaaagtagcttatggtggcactggcgacgccgccacacggtatatagcacctacgatccttaccgatgtagatccacaatccccggtcatgcaggaggagatcttcggccctgtgttgcccatcgtctgtgttaggtccctggaagaagctattcagttcatcaaccagcgcgaaaagcccctggctttgtatatgttcagctcaaatgataaatag

SEQ ID NO: 107818 - DNA, 1362 bp, Artificial Sequence
  Description of Artificial Sequence: Synthetic coding sequence
atgtcaaagatctctgaggctgtcaaacgagcccgcgcggcatttagtagtggtcggacgagaccattgcagtttcgaatccaacaactggaggccctccagcgcttgatacaagagcaagagcaggagctggtaggcgcactggcagcggacctgcacaagaacgagtggaatgcctattatgaggaagtggtgtacgtgttggaggagattgagtatatgatccagaaactgccagaatgggccgcagatgagcccgtagagaagaccccacaaacccagcaggatgagctatatatccattccgaaccattgggcgtcgtgttagtaatcggtacctggaattacccttttaatctgacaatccagcccatggtaggggctatcgcagctggcaatagtgtggttttgaagccttcggagttgtcagagaatatggccagcctgttggctaccattatcccacagtatctggataaagacctgtatccagttattaacgggggtgtacccgagacaaccgagctcctcaaggaacggtttgaccacattctctatacgggctccacaggggtggggaagatcatcatgactgcggccgctaaacatcttactccagtgacactagagctgggtggcaagagtccctgctacgtggacaagaattgcgatctagatgtcgcatgtaggcggatcgcctggggcaaattcatgaatagcggccagacgtgtgtggcacccgattatatcctgtgcgatcctagtatccagaatcaaatcgtagagaaattgaagaaatccctgaaggaattctacggcgaggatgcgaagaagtctcgggactacgggcgaatcatctccgccaggcactttcagcgtgtgatgggcctgatcgagggacaaaaggtggcatacgggggtacaggcgatgcagctactcggtacattgcacctaccatcctcacagacgtcgatccgcaatccccggtgatgcaagaggagattttcgggcctgtgctgcctattgtgtgtgttcgctccctcgaagaggctatccagttcatcaatcagcgcgagaagcctctggccctgtatatgttcagttctaacgacaaagtaataaaaaaaatgatcgccgagacctctagcggaggggtagccgcaaacgatgtgattgtccatataactctgcattccctcccctttgggggtgtcggaaatagcggcatgggaagctaccacgggaaaaagtcctttgaaacattttcgcacagacgcagctgtctggtgagaccactgatgaatgacgaaggtttaaaggtgagatacccaccgtctccagctaagatgactcagcattag

SEQ ID NO: 107819 - DNA, 1362 bp, Artificial Sequence
  Description of Artificial Sequence: Synthetic coding sequence
atgtccaagattagcgaggcggtgaaacgcgcccgcgcggcattcagtagcggccggactcgccctctgcagtttcgcatccagcagctcgaggccttgcaacgactcatacaagaacaagaacaagaactcgtgggagcgctggcagcagacctacataagaatgaatggaacgcttactacgaagaagtagtttatgtgcttgaggagattgagtatatgatccaaaagcttccagagtgggcggcagacgaacctgtcgagaagacccctcagactcagcaggatgagttgtacattcattccgagccattgggggtagtcctggttatcgggacatggaactacccatttaacctgacgatccagccgatggtgggtgccattgccgcgggcaactcagtcgtccttaagccctccgaactgtctgagaatatggcatccctgctggccaccattataccccagtacctggataaagatctataccctgttatcaacggcggtgtccctgaaactaccgagctgcttaaggagaggttcgatcacatcttgtatacaggatcaacgggcgtcgggaaaattattatgacggctgccgctaaacacctaacacctgttacattagagctcggaggaaagtccccatgctacgttgacaaaaactgcgacctcgacgtggcctgccgtcgaattgcttggggtaagttcatgaactccggccagacctgcgttgcccctgactacatcctttgcgatccatcgatccagaatcagatagtggagaaactaaaaaaaagtctgaaggaattttatggggaggacgccaaaaaatcccgcgactacggtcgaataatctccgcccgacactttcaacgggtcatggggctaatcgagggccagaaagtggcctatggcgggacaggtgatgccgctacacgctatatcgcccctaccatcctcacagatgttgatcctcagtcccccgtgatgcaggaggagatatttggtccagtcttgcccatagtgtgcgttcggtctttggaggaagctattcagttcataaaccagcgggaaaagccacttgccctgtacatgttcagttctaatgacaaagtcattaaaaagatgatcgcggagacttcctccgggggtgtcgcggccaacgacgtgattgtacatatcacactccactcccttcctttcggaggggtggggaactcagggatgggaagctatcacggaaagaagtcattcgagacattctcgcaccggcgcagctgtcttgtgagacctctcatgaacgatgaaggcctcaaagtacgatatccaccatcccccgcgaagatgacccagcactag

SEQ ID NO: 107820 - DNA, 1203 bp, Artificial Sequence
  Description of Artificial Sequence: Synthetic coding sequence
atgatccagaagttacccgaatgggcagcagatgagcctgttgaaaagacacctcagacacaacaggacgaactgtacatccacagcgagccacttggcgtggtgctagtgatcggtacatggaactaccctttcaacttgacgattcagccgatggtaggcgcaatagctgccggcaacagtgttgtactgaagccaagcgaactgtccgagaatatggcgtctctactagcaacaatcatccctcagtaccttgataaagacctctaccccgtcattaatggcggtgtccccgagacaaccgaactcctaaaggagcggttcgatcacattttgtatactggaagtacaggggttggcaagatcattatgacagccgcagcaaagcacctaacacctgtgaccttggagctcggaggcaagagcccctgctatgtcgacaagaattgtgacttggacgtggcgtgtcgcagaatcgcctggggtaagttcatgaattctgggcagacgtgtgtcgcgccagactatattctgtgcgacccatctatccaaaaccaaattgtggagaagcttaagaaatctcttaaggagttctatggggaggacgccaaaaagtctcgggattatgggcgcataatcagcgctcgccattttcagcgggtgatgggtttaatcgaaggacagaaagtagcgtacggagggacaggcgatgctgctactagatacattgcaccaaccatcttaactgatgtggatccccagagccctgttatgcaggaagagatcttcgggccagtactaccaatcgtttgcgtgaggagcctcgaagaggctattcagtttattaatcagagagagaaaccactcgcactctatatgttcagcagtaacgacaaagtgatcaaaaaaatgatcgcagaaacatcaagtggaggtgtggccgcaaatgacgtaattgtgcacataacactccacagtttgccttttggcggtgtcggcaactctggcatgggcagttaccacggaaaaaagagttttgagactttcagtcacagacggtcctgcctggtgcggcctctgatgaacgatgaggggctaaaggtgcggtatcccccctcccccgccaaaatgacccagcattggctttcttggccctgggaaaaccggtcttgttccccttcccctgctcccctgctctgttag

SEQ ID NO: 107821 - DNA, 1458 bp, Artificial Sequence
  Description of Artificial Sequence: Synthetic coding sequence
atggaactggaggtgagaagagtccgacaggcgttcctttccggccgcagcagacccctgcgctttcgacttcagcagctggaagccctccgaaggatggtgcaggagagggagaaggacatcctcaccgctatagctgcagatctttgcaaatctgaatttaatgtgtattcacaagaagtgatcacagttttgggggagatcgacttcatgctcgaaaacttgcccgagtgggtgacagcgaaaccagtgaaaaagaacgtgctcaccatgttagatgaggcatacatccagccccagccactgggggtggttctgatcattggagcctggaactatcctttcgtgcttactattcaaccgcttatcggtgccattgccgccggaaatgctgttataattaagccctctgagctttcggagaatacagccaagatcctggccaagttgttaccacagtaccttgaccaggatctttatatcgtgatcaacggaggggtggaggagaccactgagcttctaaaacagcggtttgaccacatcttctataccgggaacactgctgtgggcaagatcgttatggaagccgccgctaagcaccttacccccgttactctggagctcggaggaaaatcaccttgttatattgataaagactgtgaccttgacattgtctgcaggcgtatcacttgggggaaatatatgaattgtggccagacgtgcatcgcccctgactacatcctgtgtgaggccagcctccagaatcagattgtgtggaagatcaaggaaacagtgaaggagttttatggtgaaaatatcaaagagtcccccgactatgagaggatcatcaacctgaggcattttaaacggatcctgtctttactggaaggacaaaaaatagcatttggcggcgagacggacgaagcgacccgatatatcgctccaacagtgctgacagatgttgatcccaagacaaaggttatgcaagaggagatcttcggccctatcctgcccattgtacccgtgaagaatgtagatgaagcgatcaattttataaacgagcgggaaaaaccccttgccctctatgtgttcagccataatcacaaactgataaagcggatgattgacgagacgtccagcggcggcgttactggcaacgatgtaattatgcactttaccctgaactcctttccttttggcggcgttggttcctcaggaatgggtgcctatcacggcaaacactctttcgacacctttagccaccaacgcccttgtctactgaaaagcctaaagagagaaggggctaacaaactcaggtacccacctaatagccagtcaaaagtggactggggcaagttcttcctactgaaaagatttaacaaagaaaagttgggcctgctgttactgacattcctaggcatcgtcgcagcagtgctcgtgaaggcagaatactactag

SEQ ID NO: 107822 - DNA, 1527 bp, Artificial Sequence
  Description of Artificial Sequence: Synthetic coding sequence
atggaacttgaagtccgacgagttcggcaagccttcctgtccggcagatctagaccccttaggttccgcttacagcaactggaggccctgcgcagaatggttcaggagcgggagaaagacattctcacggcgattgccgccgacctgtgcaaatcggagtttaacgtgtactctcaggaggtgattactgtcttaggcgagattgacttcatgcttgagaacttgccagaatgggttacagccaagcccgttaaaaagaatgtgctcacaatgctcgatgaagcctatattcaaccccagcccctcggagtggtgctgatcataggggcttggaactaccccttcgttctgacgattcagccactcatcggcgccatcgctgctggcaatgccgtgataattaagcctagtgaactcagtgagaatactgccaagatcttggccaagctgctcccccagtacctggatcaggacctctatatcgtgatcaacggtggagtggaggaaacaaccgagcttctcaagcagcgctttgaccacattttttacacaggaaatacggctgtagggaagatagtcatggaggctgctgctaagcatttgacaccagtcacactggaattgggaggcaaatcaccttgctacattgacaaagattgcgacctcgacattgtctgccgaagaattacatggggaaagtacatgaactgtggtcaaacctgcatcgcccccgattacatcctgtgcgaggcctccctgcagaaccagattgtgtggaagattaaagagaccgtgaaagagttttatggggaaaatatcaaagagagccctgattacgagagaataatcaacctgaggcacttcaagcggatcctctcactgctggagggacagaagatcgccttcgggggggaaacagatgaagcaacacgctacatagcacccactgttctaacggatgtggacccaaagactaaggtcatgcaggaggagatatttggcccgatactgcctatagttccagttaagaacgtggacgaggctattaatttcatcaacgagcgcgaaaagcccctcgctctatatgtgttttcgcataaccataaactcattaaaagaatgattgacgaaaccagctctggaggagtgactgggaacgatgtcattatgcatttcactctcaatagcttccctttcgggggagtcgggtcttctggcatgggcgcatatcacgggaagcattcattcgacactttctcccaccagcgtccttgtctgctgaagagcttgaaacgtgaaggagccaacaaactgcgatatccccctaatagccagagtaaagtagattgggggaagttttttctcctgaagagattcaacaaggaaaaacttggtctgctcctgttaactttcctgggcatagtggctgccgtgttagtgaagaaatatcaagcagtgctcaggagaaaagctctgctgatcttcctcgtggtgcaccgtctccgctggtcaagtaaacaaagatag

SEQ ID NO: 107823 - DNA, 1458 bp, Artificial Sequence
  Description of Artificial Sequence: Synthetic coding sequence
atggagttggaagtccggagagtccgccaggcattcctgtcaggtcgatcaaggccgttacgcttcaggctgcagcagttggaagcacttcgaaggatggtccaggagcgggagaaggatatcctgacagctatagcggccgacctctgtaagtccgagttcaacgtgtattcccaagaagtgattaccgtgctgggggaaatcgattttatgctcgaaaacctgcccgagtgggtgaccgccaaaccggtcaagaaaaatgtcttaaccatgctggacgaagcctatattcagccccagcccctcggcgtggtgctcattattggcgcttggaattacccattcgtcctgacaatccaacccctgatcggagcgatagccgcggggaacgcagttataatcaaaccgtccgagctgtcggaaaatacggccaagattctcgctaaactgcttcctcagtacctggaccaagacctctacattgtcattaacgggggggtggaggagaccactgagctgcttaaacagcggttcgatcacattttttatactggaaatactgccgtgggtaaaatagtcatggaagcagctgccaagcacctgacacccgttacactagaactgggtgggaaaagcccatgttacatcgataaggattgtgatctggacatcgtttgcaggagaatcacatggggtaaatatatgaattgcggacagacatgcatcgccccggattacatcctgtgcgaggcgtctctacagaatcaaatcgtgtggaagattaaagagacagtgaaggaattttatggggaaaacatcaaagaatcccctgattacgaacggatcattaaccttagacatttcaagcgcatcctatctcttctggagggtcaaaaaattgcgttcgggggagaaacagacgaagccacacgctacatcgcacccactgttttgaccgatgtagaccctaagacaaaggtgatgcaagaggaaatctttgggccaatcctgccaatcgtgccggtcaaaaacgtcgacgaagctattaactttattaacgagcgggagaaacccctggccctgtatgtttttagtcacaatcataaactcattaagcggatgattgatgaaacctccagcggaggtgtgaccgggaatgatgtgatcatgcattttaccctgaactcctttccctttgggggagttggatcatcgggcatgggagcttatcacgggaagcattctttcgacacattcagccaccagagaccgtgcttactaaaatcacttaagcgtgaaggagcgaacaaactgaggtacccccccaatagtcagtctaaggttgattggggtaagtttttcctcctgaagcgattcaacaaggaaaagctgggcctgctgctactaacttttttaggcatcgtcgccgccgtcctggtcaaggccgagtattattag

SEQ ID NO: 107824 - DNA, 501 bp, Artificial Sequence
  Description of Artificial Sequence: Synthetic coding sequence
atggagctagaggtaaggcgggtccggcaggcctttctcagtggaaggagcagacctctgcgcttcaggctgcagcaattggaagccctgcgaagaatggttcaggagcgagaaaaagacatccttacagctattgccgccgacctctgcaagtccgagtttaacgtgtactcccaagaggtgattactgtgctcggcgagattgacttcatgttggagaatttgccagaatgggtgaccgccaagccagtcaagaaaaacgtcctcaccatgctggatgaagcctacatccaaccccagccgctaggggttgtgttgattataggggcttggaactacccatttgtgctaacaattcaaccgctaatcggcgccattgctgcagggaacgccgtgatcattaagccgtctgaactttccgagaatacggctaagatcctggcaaagctactaccacagtacctggaccaagacctatacatagttatcaacggagggtag

SEQ ID NO: 107825 - DNA, 1158 bp, Artificial Sequence
  Description of Artificial Sequence: Synthetic coding sequence
atgaaagacgaacccaggagcaccaatttattcatgaagctggatagcgtgtttatctggaaggagccttttggactcgtcttgataatcgccccctggaattaccctcttaatctgacactggtgctgctggtaggagccctcgcggctggctcttgtgtggttctcaaaccatccgagatcagccaggggactgagaaggtactggcagaggtgctcccacagtatctcgatcaaagctgcttcgccgtcgtgctagggggcccacaggagactggccagctcctagagcacaagctggattacatcttctttacagggtcaccacgcgtcggaaagatcgtaatgacagctgctacaaagcatttaacaccagtgacactcgagttaggaggaaagaacccttgttatgtggatgacaattgtgatcctcaaaccgtggcgaacagggtggcgtggttttgctactttaatgccggccagacatgcgtggccccagactacgttctgtgttcacctgagatgcaggagcgattgctcccagctctgcagagcacaataactcgattctacggcgacgacccccagtcaagtcccaatttgggacatatcatcaaccagaagcagttccaaagactccgcgccctgctggggtgtagtcgggtggccatcggcgggcagagcaacgagagcgatcgatacattgcccccaccgtgctggtggatgtccaggaaaccgagcccgtgatgcaggaagagatttttggtccaattcttcccatcgtgaatgtgcaaagcgtcgatgaagctattaaattcatcaaccgacaagagaaacctctcgcgctgtacgctttctctaactcaagtcaggtcgttaaccaaatgctagaaaggactagcagcgggtcatttggcgggaatgagggatttacttatatcagcctcctttcagtaccgttcggaggcgtcggtcacagcggtatgggaagatatcatgggaagtttacgttcgataccttttctcatcaccgaacctgcctgcttgctccttcaggtctggagaagctaaaagagattcactaccccccctacaccgactggaatcaacagctcttaagatgggggatgggctcccagtcgtgtactctgctgtag

SEQ ID NO: 107826 - DNA, 447 bp, Artificial Sequence
  Description of Artificial Sequence: Synthetic coding sequence
atgaaggacgagcctcgaagcaccaacttgtttatgaagcttgattcagtcttcatttggaaggaacctttcggcctcgtgctgattattgccccatggaactaccctctcaatctgacactcgtcttactggtcggcgctttagcagcagggtcctgtgtggtactaaagccaagtgagatctcgcaaggcacagagaaggtcctcgctgaggtcttgccacagtacctcgaccaatcctgctttgccgtcgtcctcggcggaccacaagaaaccgggcaactgctggagcataagctcgactacatcttcttcacaggatccccccgggtcggcaaaatcgtgatgactgcagccacaaagcatctcacgcccgtgaccctggagctagggggcaagaacccgtgctatgtggacgacaattgtgatccccagacagtggcgtag

SEQ ID NO: 107827 - DNA, 288 bp, Artificial Sequence
  Description of Artificial Sequence: Synthetic coding sequence
atgaaagatgaacctagatcgacaaatctctttatgaaattggactccgtatttatttggaaagagccgttcggactggtgctgatcattgccccctggaactacccactgaacctgaccctagtattgctggtgggggctctggctgccggcagctgcgtggtgttaaagccaagcgaaatctcacagggcactgaaaaagtcctggcagaggtactaccgcagtatttggaccagtcatgtttcgctgttgtactgggcggtcctcaggagaccgggcagctttag

SEQ ID NO: 107828 - DNA, 1158 bp, Artificial Sequence
  Description of Artificial Sequence: Synthetic coding sequence
atgaaagatgaaccccgcagtaccaacctttttatgaagctggacagcgtctttatttggaaggagcccttcggactggtgctcataatagccccatggaactacccactgaacttgacattagtgctattggtgggcgctctcgccgctggaagttgcgtggtactgaagccgtccgagatttcccagggaactgaaaaggtgcttgccgaagtgctgcctcagtacttggatcagtcttgtttcgctgtcgtgctgggcgggccgcaggagaccggccagctgcttgagcataaattggattacatatttttcaccggtagtcctagggtaggcaaaatcgttatgaccgccgctacaaaacacctcactcccgtcacactggagctaggtggtaaaaacccgtgctacgtggatgataactgcgatccccagaccgtagccaaccgcgtcgcatggttctgctacttcaacgccggccagacgtgcgtggctccagattacgttctgtgctctccagaaatgcaggagcggttgctgcccgcactgcaatcaacaattacgcggttttacggggacgacccccagtcgagcccaaatcttggccatattatcaatcagaagcagtttcagcgcctaagggcgctgctgggatgctcgcgggtggcaattggtggtcagtctaacgaatccgatagatacatcgcccccaccgttttggtggacgtacaggagacggaaccagtaatgcaagaggaaattttcggtccaatcctgccaatcgtgaatgtgcagtctgttgacgaagccataaaatttatcaacagacaggaaaagccactggcattgtacgccttttccaacagtagccaggtggtgaatcagatgctggagaggaccagttcaggatcatttggcggtaacgaaggattcacctatatttcactactaagtgtgccttttgggggcgtcggccattctggtatgggcagatatcacggcaaatttacattcgacacattcagtcaccaccgaacttgcctccttgccccgtcaggacttgaaaaattgaaggagatccactatcctccgtacacagattggaaccaacaactgctgcgatgggggatgggctcccagtcttgcactctgttgtag

SEQ ID NO: 107829 - DNA, 1692 bp, Artificial Sequence
  Description of Artificial Sequence: Synthetic coding sequence
atgttgctaccagcgcccgcactccgaagggcattgctctcacggccgtggaccggtgcgggtctgcggtggaagcatacttcttctctgaaggtggctaatgagccagtgttagccttcacccaggggagtccagaacgcgacgctctccagaaagccctgaaagacttgaaaggaaggatggaggcaattccctgcgtggtgggcgatgaggaggtgtggacatccgacgttcaataccaggtgagccctttcaaccacggccataaagtggcgaaattctgttacgccgacaagtccctgctgaacaaagctatcgaagcagcactcgcagcccgcaaagaatgggacctgaagcccatcgccgatcgagcgcagatattcctcaaggcagcagacatgctgtcaggcccccgccgtgcagaaatactggccaaaacaatggttggccaagggaagaccgttatacaagcagaaattgatgccgcagcggaactcatagatttcttcagattcaatgcaaaatatgccgtggagctggagggccaacagcccattagcgtgcccccttctaccaactccaccgtttatagaggcttggagggattcgtggccgccatctcgccattcaacttcaccgctattggtggcaatctggccggcgctccagcactgatgggcaacgtcgtactgtggaagccctcagacaccgccatgcttgcatcgtacgccgtttaccgcattttgagggaagcagggttgccgccgaatataatacagtttgtgcccgcagatggacctctttttggagatacagttacatcttctgagcacctttgcggaattaattttaccggctcagtgcccacgtttaaacatttatggaaacaggtggcccagaacctcgatcgatttcacacattcccacggctggccggtgagtgtggaggaaagaacttccattttgtgcaccggagcgctgacgtcgaaagtgtggtgagcgggactctgcggagcgcattcgagtacggggggcagaagtgtagtgcctgttcgcgcctgtacgtgcctcattctttgtggccccagatcaagggccgtctgctagaggagcattctcgtattaaagtgggagaccccgctgaggactttggaaccttctttagtgctgtgattgatgctaaaagctttgccaggattaagaagtggctggagcatgctaggagtagccctagtctgactatcctggctggcggaaaatgcgatgatagcgtcggatacttcgtggaaccgtgtatcgtggagtcaaaggacccccaagaaccaattatgaaggaagagatctttggtcctgtgctgtctgtatacgtctacccggacgataaatataaagagacactgcaactcgtagactcaactacatcctatggattgaccggggccgtctttagccaggacaaggacgtggtacaggaggctacaaaagtcctgcgcaacgcagctggcaatttttacataaacgacaaatccacaggctcaatagttgggcagcagccattcgggggggcacgggctagcgggaccaatgacaaacccggaggacctcactacattctgaggtggacttctccccaggtcatcaaggaaacacataaacctctgggcgattggtcctacgcctacatgcagtag

SEQ ID NO: 107830 - DNA, 588 bp, Artificial Sequence
  Description of Artificial Sequence: Synthetic coding sequence
atggaggctataccgtgcgtggttggagacgaagaggtttggacgagtgatgtacagtaccaggtcagccccttcaatcatggccacaaggtggctaaattctgttacgccgataagtcactcctgaataaggcgatcgaagctgccctggcggctcgtaaggagtgggacctgaagcccattgccgatcgtgcccagatttttctaaaagccgctgacatgctctccggtcctcgccgggcagagatacttgccaaaactatggtgggtcagggcaagaccgtcatacaggctgagattgatgcggccgcagaattaatcgatttctttcgcttcaacgctaaatatgccgtggagctggaaggacagcagccaatcagtgtgcccccttcaaccaacagcactgtttataggggccttgagggattcgtggccgctattagcccattcaattttaccgctattggtggtaacctggccggggctccagcccttatgctgcgtgagggggtggtgacactgcctttatgccagatgacaaaattgaggcacaccgctgtgacatatcttgcaagactctccgactag

SEQ ID NO: 107831 - DNA, 633 bp, Artificial Sequence
  Description of Artificial Sequence: Synthetic coding sequence
atgttgctgccagcacctgccctacgcagagcacttctgtctaggccatggaccggggccggtcttcgctggaagcacacctcatccctcaaagtagccaacgaaccggttctggcctttacccaggggtcgcccgagcgagatgcgctgcagaaggctttgaaggatctcaaaggaaggatggaggcgatcccttgcgtcgtcggggatgaagaagtgtggacaagcgatgtgcaataccaagtgtcatcccttttgaataaggcaattgaggcggccctagccgcccgcaaggaatgggaccttaagccaatagcagacagagcgcagatatttctgaaggctgcagacatgctgagcggacctcgccgcgccgaaatcctcgccaagaccatggtgggacaggggaaaacagtgatccaagcagaaatcgacgccgcagctgaattgatcgacttctttcggtttaatgcaaagtacgccgtggaattagagggacaacagccaattagtgtgccaccaagcaccaacagtacagtgtacagaggtcttgagggtttcgtagcggcaatatctccattcaacttcactgccatcggcggtaacctcgccggggcaccagcgctgatgtag

SEQ ID NO: 107832 - DNA, 1692 bp, Artificial Sequence
  Description of Artificial Sequence: Synthetic coding sequence
atgttgttaccggcaccagcgctgcgccgtgcgctcctttccaggccatggacgggcgccggccttaggtggaaacatacctcctcattgaaggtagcaaacgagccggtgttagcatttacacaaggcagccccgagcgtgacgctctccaaaaagctttaaaagatctgaaaggtaggatggaggccattccctgcgtagttggcgacgaggaggtgtggacatcagatgtccagtatcaggtaagccccttcaaccacgggcacaaagttgctaaattttgctacgctgataagtcactgctgaataaagccattgaagctgccctggctgcccgtaaagagtgggacttgaagccaattgccgatcgagcgcagattttcctcaaggccgccgacatgctctcagggccccggcgggcggagatactcgccaagacaatggtaggccagggcaagacagtgattcaggccgaaatcgacgccgccgcagaactgatagatttctttaggtttaacgccaaatatgccgttgagctggagggccagcagcctatatcagtgcctccctcaacgaattccacagtgtacagaggcctggaaggattcgtcgctgccatcagcccattcaattttacagccatcggggggaacctggccggagctccggccctgatgggcaacgtggtactgtggaagccctcagacacagctatgctcgcctcctatgcagtctatcgtatcctgcgcgaggctggccttcccccgaatattatacagtttgtgccagctgacggcccactgttcggtgacacagtgacatcatcagagcatctgtgcggcataaatttcaccggaagcgtaccaacatttaaacacctgtggaagcaagtggcccagaatcttgaccgattccatacatttcccaggcttgccggtgaatgcgggggaaagaactttcacttcgtgcatcggtccgccgacgtggagagcgtcgtgtcaggcactctgagaagtgcctttgagtacggtggacagaagtgctcagcttgcagccggctctatgtgccgcactctctctggcctcaaatcaaaggccgtctcctggaagagcacagccgcatcaaggtgggagacccagccgaagactttggcacctttttctccgccgtcatagatgctaaatcattcgcgagaattaaaaagtggctggagcacgcaaggtcatctccctctctgaccattctggctggcggcaaatgcgacgatagtgttggctactttgtggaaccatgtattgttgagagcaaggacccccaagaaccgattatgaaagaggaaatcttcggacccgtcctcagtgtctacgtgtaccctgatgacaagtacaaagaaactctccaactggttgattccaccacttcatacggattgaccggcgccgttttctcacaggataaggatgtcgtccaggaagctaccaaagtgctcagaaatgccgctggaaatttttatatcaatgacaaaagcactggcagcatcgtgggtcagcagccttttggcggagctagagcctcgggcacaaatgataaaccaggcggtccacattatatcctgagatggacttcgccccaggtgattaaggagacacataagccgctgggggattggagttacgcgtatatgcagtag

SEQ ID NO: 107833 - DNA, 645 bp, Artificial Sequence
  Description of Artificial Sequence: Synthetic coding sequence
atgcttcttccggctcctgctcttcgccgcgctctgctttccagaccctggaccggagcaggcttaagatggaagcacacaagctcacttaaggtggccaatgagccggtgctagcattcactcagggaagccccgagagggacgcgctccagaaggctctgaaggatcttaaaggaagaatggaggccatcccgtgcgtggtgggcgatgaagaggtctggacatcagacgtgcagtaccaggtgtctagcctcctgaacaaggctattgaggccgccctcgctgcgaggaaggaatgggacctgaaacccattgccgaccgcgcccagatctttctcaaggccgcagatatgctgagcgggcctcggagagcagaaattctcgccaagacaatggtcggacaaggtaaaacggtcatccaggctgagattgacgctgctgcggaactcatcgatttcttccgtttcaatgccaaatacgcagtggaactcgaaggccagcagccgatctccgtcccaccctctacaaattcgacagtctacagggggttggaaggcttcgtggctgccatatccccttttaactttactgccattggaggaaatctcgcaggtgcccccgcactcatggttcggtgtgggtag

SEQ ID NO: 107834 - DNA, 462 bp, Artificial Sequence
  Description of Artificial Sequence: Synthetic coding sequence
aacaaggcaattgaggcggccctagcggcccgaaaagagtgggacttgaaaccaatcgctgatcgggcgcaaatcttcttaaaggcagctgacatgttgagtggacccaggcgcgcggagattctggccaaaacaatggtcggccaaggtaagacggtgattcaggcggaaatagacgctgctgctgaacttatcgacttcttccggtttaatgcaaagtacgcagtggagcttgaggggcagcagcctatttccgttccaccttccacgaattcaacagtttaccgggggcttgagggcttcgttgccgcaatatcaccctttaacttcacagccatcggcggaaacttggccggcgctccagccctgatgctccgcgaaggagttgtcaccttgcctctgtgccaaatgactaagttacggcacaccgccgttacatatctcgcacgcctgtcagattag

SEQ ID NO: 107835 - DNA, 1512 bp, Artificial Sequence
  Description of Artificial Sequence: Synthetic coding sequence
atggaggctatcccatgtgttgtaggtgatgaggaagtttggacatctgacgtgcagtatcaggtctcccccttcaatcacggccacaaagttgcaaagttttgttacgccgataaaagccttctgaacaaggccatagaagccgccctggctgccaggaaagagtgggacttgaagcctatcgccgaccgagctcagatattcctgaaagctgccgacatgttgagcggcccacggagagccgagattctggccaagaccatggtgggtcaggggaaaactgtgatccaggctgaaattgatgccgcggccgagctaatcgatttctttcggtttaacgctaagtatgccgtggaactggagggccagcagcccatctctgtaccaccaagcaccaactctaccgtgtatagaggactggaggggtttgtggccgctatctcgccctttaactttaccgcaattggcggaaacttagctggggcacctgccttaatgggaaacgtggtcctatggaagccatctgacactgctatgctggcatcttacgcggtctatagaatactgagggaggctggcctgccaccaaatattatacagtttgttcccgccgatggccccttgttcggggatactgtaacttcaagtgaacatctgtgcggaattaacttcaccgggtccgtgcccacattcaagcacctgtggaagcaagtcgcacagaatttggatcgattccacacatttccgagactggccggcgagtgcgggggcaaaaatttccatttcgtccacagatcggccgatgtcgaatccgttgtgtctgggaccctcagatccgcctttgagtacggaggccagaagtgttccgcttgctccaggctatacgtgccgcactcactttggcctcagataaaagggagattgctcgaagaacattctcgaattaaagtgggtgaccccgccgaagactttggtactttcttcagcgcagtaattgatgcaaaatcattcgctcgaatcaagaaatggctggagcacgcacggagctcgcctagtctgactattctcgccggaggaaaatgcgacgacagtgttggctatttcgtcgaaccctgcatcgtggaaagtaaggatccgcaagagcctataatgaaggaggagatcttcggacccgttctctccgtttacgtataccctgacgacaaatacaaggaaacacttcagctggtggactcaacaacctcttatgggctgactggcgcggtattctcgcaggacaaagacgttgtacaagaggccaccaaggtactgcgaaatgctgctggcaatttttacattaatgacaaaagcactgggagcatcgttggacaacaaccttttggtggcgcccgcgcatccgggaccaacgataagcctgggggtccccattatatccttcgttggaccagcccccaagtgattaaggagactcataagcctctgggcgattggtcgtatgcttacatgcagtag

SEQ ID NO: 107836 - DNA, 1539 bp, Artificial Sequence
  Description of Artificial Sequence: Synthetic coding sequence
atgctgttgccagcccccgccctgcgcagggctctgctcagcagaccgtggaccggagccggtttgcggtggaaacacacttcctccttgaaagtggctaacgagcccgtcctcgcgtttacccaggggagccccgaacgcgacgccttgcaaaaagccctgaaggacctcaaagggcgcatggaagccataccttgcgttgtgggcgacgaggaagtgtggacttcggacgtgcagtatcaggtaagcccgttcaaccacgggcataaggtcgccaaattctgctacgccgacaaaagcttactgaacaaagccattgaagcggctctggcagcgcgcaaggagtgggacttgaagcccatagctgacagggcccagatttttctgaaagcagccgacatgctgtcaggaccgcggcgcgccgagatcctcgcgaagacaatggtgggccaaggtaagactgtgatccaggctgagatagacgctgccgccgagctgatcgacttcttccgatttaacgctaaatacgccgtggagctggagggccaacagcctataagtgtgcctccgtctactaacagcacagtgtacaggggattggagggttttgtcgcagccataagtccttttaacttcaccgcaatcggcgggaacctagctggagcccccgcgctgatgggtaatgtggtgctttggaagccctcggacactgctatgctggccagctacgccgtgtaccgcatcttaagggaggccgggctacctccgaatataattcaatttgtgccagcagacggccccctgtttggggatactgtgactagctctgaacacctatgtggcatcaacttcaccgggtcagtgccaaccttcaaacacctgtggaaacaggtggctcagaacctggataggttccatacctttccgcgcctggcaggtgagtgcggcggaaagaatttccattttgtccatagaagtgcagacgttgagagcgtcgtcagcggcactctgcgctccgccttcgagtacggaggtcagaagtgctcggcttgttccaggctctacgtaccccactcgctctggcctcagattaagggacggctcctagaagagcatagtcgcatcaaggtcggagaccccgcagaggactttggtactttcttttccgccgtgattgatgcaaaggaaatttttggacccgtgctctcagtgtatgtttacccagacgacaaatacaaagagaccctccagttggtcgatagcacaacgtcatacggactgaccggagccgtattttcccaggacaaagacgttgtgcaagaagcaacaaaggtcttgcggaatgcagccgggaatttctacataaacgacaaatcaaccggcagcattgtgggtcagcagccctttgggggggcccgggcgtcaggaactaacgacaagccaggcgggccccactacatcttgcgatggaccagtccccaggtcatcaaagagacacataaacccctgggcgactggagctacgcttatatgcagtag

SEQ ID NO: 107837 - DNA, 1647 bp, Artificial Sequence
  Description of Artificial Sequence: Synthetic coding sequence
atggctacatgcatttggctgagatcctgcggtgcccggcgcctcgggtcaacattccccgggtgtcgactacgaccgagagcaggtggacttgtccctgcctcgggacctgcccctggtcccgctcaactgagatgttatgctggacgcctggccggactgagcgccgccctactgcgtacggattcattcgtgggtgggcggtggttgcccgccgcagccactttcccagttcaagatccagcctctggagcagcactgggtatggtggccgactgcggcgtccgggaagcaagagccgcagtccgggccgcctacgaggcgttttgtcgctggagggaagtatccgctaaagagcggagctcgctgctgcgcaagtggtataatctgatgattcaaaacaaggatgatctggcaagaatcattaccgctgaatcgggaaagccccttaaagaggctcatggtgagatcctttactccgctttcttcctagagtggttcagcgaagaggccagacgcgtgtatggtgatattatccacacccctgccaaagacaggcgcgccctggtgctgaagcagcctatcggcgtcgcagcggtgattacaccctggaattttccttccgcgatgattacccggaaggttggtgcggccctcgcagccgggtgcactgtcgtggtgaaacctgccgaagacactcctttttccgcgttggccctagcagaggttaaccaaggattcctgttggacctcgacccccttttacttgcctcccaggctggcataccttccggagtgtacaatgtaataccctgtagtcggaagaatgcaaaagaagtgggcgaggccatatgcaccgatcctctcgtcagtaaaatttcgtttacaggctcaacaacgactggaaaaattctgctgcatcatgccgcaaactctgttaagcgggttagtatggagctggggggcttagccccctttattgtgtttgactctgccaacgttgaccaagctgtggctggcgctatggcatccaagttccgaaatactggccagacatgcgtctgcagcaatcaattcttggtgcagcgaggcatccatgatgctttcgtgaaagcatttgccgaagctatgaagaagaatctgcgagtgggaaacggcttcgaggaggggaccacacagggccctctgattaatgagaaggcggttgagaaagtagagaagcaagttaacgacgccgtctccaagggggcgacagtcgtcacaggggggaaacgccatcaactaggcaagaacttctttgagcctaccttgctctgcaacgtgactcaggatatgttatgtacacacgaagaaacttttggtcctctcgccccagttatcaaattcgatacagaagaggaagcaatagccatagctaacgcagcggatgttggactggccggatatttttactcccaggaccctgcacagatctggcgcgtagccgagcagcttgaggttggtatggtgggtgttaatgagggactgatcagttcagtcgagtgccctttcgggggagtgaaacaaagcggcctggggagagagggttcaaagtacggaatcgatgagtacttggaactgaaatatgtatgttatggaggattgtag

SEQ ID NO: 107838 - DNA, 1608 bp, Artificial Sequence
  Description of Artificial Sequence: Synthetic coding sequence
atggcaacctgcatatggctccgatcctgtggagcacgaaggctcggctcaacctttcctggctgtcgtctaagaccgagagccggggggcttgtgcctgcaagtgggccggccccggggcctgcacagctcagatgctatgctggcagactggcagggctcagcgctgcccttctgaggacagatagcttcgtgggtggacgctggctccctgctgcagccacatttccagtccaggatcctgcctccggtgcagcactggggatggtggccgattgcggagttcgggaagctagggcagcagttcgggccgcctatgaagctttctgccgttggcgcgaagtgtccgctaaggaaagatcatctctgctgagaaaatggtacaatttgatgatccaaaataaagatgatctggctcggatcatcaccgccgagagcgggaagccgctgaaagaagctcacggggaaatcctgtacagtgctttctttcttgagtggttcagcgaagaggcaaggagggtgtatggtgatattatccacaccccagccaaggatcggagggcactcgtcctgaagcagccaatcggggtcgccgccgttatcaccccgtggaacttccccagcgcaatgatcacgcggaaagttggggccgccttggcagccggctgcacagtggtggtgaagccagcagaggatacaccattttctgcactcgctctggcggaattggcctctcaagctgggataccatctggagtctacaacgtgatcccatgctcgcggaagaatgccaaagaggtcggagaggctatttgcacagacccgttggtatctaagatctccttcactggaagcactaccacagggaagattctgcttcaccatgcagcaaacagcgtgaagagagtgtccatggagcttggtggtctggccccctttatcgtgttcgatagtgctaacgtggaccaggctgtcgccggcgccatggccagtaagttccggaacacaggacagacctgtgtgtgctctaaccagttcctggtgcagaggggcatccatgatgctttcgttaaggccttcgctgaggccatgaaaaaaaatcttcgggtgggtaacggatttgaagaaggcaccacacagggacccctcatcaacgaaaaggcagtcgagaaggtagagaagcaagttaatgacgcagtttcgaagggggctactgttgtcaccggcggcaagaggcatcagctggggaaaaacttttttgaacccacactcctctgcaatgtcacccaagacatgctgtgtacgcacgaagagaccttcggtcccttggcccccgtgattaagtttgatacagaggaagaggccatcgctatcgctaatgctgccgatgtggggctagccgggtacttctattcacaggatcctgcccaaatttggcgagtagcggagcagctcgaagtcgggatggtaggcgtcaatgagggactgatcagtagcgtggaatgtcccttcgggggagtcaagcagtccggcttgggccgggaaggatcgaagtatggcattgatgagtatcttgagctgaaatatgtttgctacggaggcctctag

SEQ ID NO: 107839 - DNA, 1344 bp, Artificial Sequence
  Description of Artificial Sequence: Synthetic coding sequence
atggtggcggattgcggggtcagggaagcgagagccgctgtgcgggcagcctatgaagcattttgtagatggagagaggtttccgccaaggagcgaagctccctcctcaggaagtggtacaacctcatgattcagaataaggacgatctggcaaggataattactgctgagtcagggaaacctttaaaagaagcccacggcgaaattctgtacagtgcctttttcctcgagtggttctccgaggaagcccgcagagtgtatggcgatattatccacactcccgcaaaagatcggagagcactggtcctgaaacagccaatcggggttgcagccgtcattaccccctggaactttccatcggccatgattactaggaaagtcggggctgctctggctgccggttgcacagtggtggttaagccggcagaggacacacccttctcagcgttggccctcgcagagctggctagtcaggcgggcataccatccggcgtgtacaacgttataccatgctccagaaaaaatgccaaggaggtgggggaggcaatctgcactgacccactagtatcgaagatttcctttacggggtctaccactaccgggaaaatactcctacatcatgccgctaatagtgtgaagcgggtctctatggaactcggtggcttagctcctttcattgtgtttgatagtgcaaacgtagaccaagccgtcgcgggtgcgatggccagtaaatttagaaatactggacaaacctgcgtgtgtagtaaccagttcctggtgcagcgagggatccacgacgcctttgtaaaagcatttgcagaagccatgaagaagaatctgcgagttggcaacggtttcgaggaggggactacacaagggcctctgattaatgagaaggccgtggagaaggtagaaaaacaggtgaacgacgctgtcagcaagggcgctaccgtagtgactggcgggaagagacaccagctggggaagaacttctttgagcccactttgctctgcaatgtcacgcaagacatgctttgcacgcacgaagagacattcgggccccttgcgcccgtgataaagttcgacacggaggaggaggctattgccattgctaacgcagcagacgtcggcttggcgggctacttctatagtcaggaccctgcccagatttggcgagttgccgagcaactggaagttggtatggtgggggtaaatgagggcctgatttccagtgtggaatgcccgttcggtggggtaaagcaaagtggactcggcagggagggaagcaagtatggtattgatgagtacctggaactcaaatacgtctgttacggagggttgtag

SEQ ID NO: 107840 - DNA, 1608 bp, Artificial Sequence
  Description of Artificial Sequence: Synthetic coding sequence
atggccgctctcctcgcagctgcagcagtcagagcacgaattctccaggtatctagtaaagtgaaaagttctcccacttggtactccgcctcctctttcagctctagtgttcccaccgtgaagttgtttattggaggcaaattcgtagagagcaagtccgacaagtggatcgacatccacaatcccgctacgaatgaagttattggccgcgtgccacaggcgacaaaggctgaaatggatgccgccattgcttcttgcaaacgcgctttccccgcctgggccgatacgtccgtactcagtcggcagcaggttctgctccggtaccagcagctcattaaagaaaacctgaaggagattgcaaagctgattactctggagcaaggtaaaacactggcagacgctgagggagacgtgtttagggggctacaggtggtagaacatgcctgctcagtgacgtcactgatgatgggcgaaaccatgcctagtattactaaagatatggacctctatagctataggctgccactaggagtgtgtgccggcatcgcgccgtttaattttccggcaatgattcccctttggatgttccctatggctatggtctgcgggaacaccttcctgatgaagccctcagagcgcgtgcccggtgccactatgcttctcgccaagctgcttcaagattctggtgcgccagatggcacactgaatatcatccatggacagcacgaagccgtaaactttatttgcgaccacccagacattaaggccatttcttttgtgggctctaacaaggcaggagaatatatctttgaaaggggaagcagacacggcaaaagggtacaggcgaatatgggagccaagaaccacggggttgtgatgccagatgctaataaagaaaatactctgaatcagctcgtcggggctgccttcggagcagcagggcagcgctgcatggctctctctaccgcagtgttagtaggcgaggccaaaaagtggcttccggaactagtagaacatgcaaaaaatctccgcgtcaatgctggagatcaacccggcgccgacctcggcccgcttatcacaccacaggctaaggaacgagtatgcaaccttatcgacagcgggacgaaagagggggcctctatcctgctcgatggcaggaagattaaggtgaaggggtatgagaacggtaatttcgttggccctacaatcatttctaacgtaaagcccaatatgacctgttacaaagaggagatttttgggcctgtgctggtcgtgcttgagaccgaaacactggacgaagcaatccaaatcgtgaataacaacccttacggcaatggcaccgccatattcacgaccaacggcgctaccgctcgtaagtatgcccatcttgtcgacgtgggacaggtgggcgtcaacgtaccaatccccgtgccacttccaatgtttagttttaccggcagccggagctcgtttcggggggacacaaacttttacggcaagcaggggatccaattctacacccaactgaagacaatcacgagccagtggaaggaggaagatgccactctctcatctcccgcagtggttatgccgacaatgggcagatag

SEQ ID NO: 107841 - DNA, 1620 bp, Artificial Sequence
  Description of Artificial Sequence: Synthetic coding sequence
atgtggcgattgcctcgtgccttgtgcgtccacgctgcaaaaaccagcaagctgtctggcccctggtccaggccagccgcgttcatgagcactctgctgattaatcagccgcagtatgcctggctgaaagagctggggctgagggaagaaaatgaaggcgtgtataatggaagctggggcggccgaggcgaagtaatcaccacctactgcccagcaaacaacgagcccatcgcccgggttaggcaggcctctgttgcagactacgaggaaactgtcaagaaggctcgcgaagcctggaagatctgggccgatattccagcgccgaagaggggcgagattgttcgccagatcggcgatgctctgagggagaagattcaagtgctcggatcactggtcagcctggagatggggaagatcctggtagagggagtcggcgaggtgcaggaatacgtggacatctgcgattacgccgttggactgtctcgtatgattggcgggcccatcctccccagcgagcgcagcggccatgcccttatcgagcagtggaaccctgtgggcctcgtcggcatcataaccgctttcaactttccagttgcggtctatgggtggaacaacgctatcgcaatgatttgcggtaatgtgtgtctatggaagggcgcccccaccacctcactgattagcgtggccgtaacgaaaatcatcgcgaaagtactcgaggataataagcttcccggagcaatttgtagtctaacctgtggtggggctgacataggcaccgctatggccaaggacgagcgtgtgaatctcttgtctttcacaggatctactcaggtggggaagcaggttgggttgatggtacaggagagattcggtaggtccctcctggaactcggtggaaataatgccatcatagcctttgaggacgctgatcttagcctggtcgtgccatcagcactgttcgccgccgtgggtactgctggacagcggtgtaccaccgcccgccgcctctttatacacgagtcgatccacgatgaagttgtgaacaggttgaaaaaagcttacgctcagattagagtggggaacccgtgggaccctaatgtgctgtacggacccctgcacactaagcaggctgtcagtatgtttttgggtgcagtcgaggaggctaaaaaggagggagggacagtggtgtacggaggtaaggtcatggatcgacccggcaattacgtggagccgactattgtgactgggcttggtcacgatgcgtcaatcgctcatactgagacttttgccccgattctctatgttttcaagttcaagaatgaagaggaggtctttgcgtggaataacgaagtgaaacaagggctttctagttccattttcacaaaagacttgggtagaatctttaggtggctcggtccaaagggaagcgattgcggaattgtaaacgtcaacattcccacctctggcgcggaaatcggcggagccttcggcggggaaaagcataccggagggggaagagaaagcggaagtgacgcctggaaacagtacatgaggcgctccacatgcactataaattattctaaagatctccctctcgcacagggcataaagtttcagtag

SEQ ID NO: 107842 - DNA, 1044 bp, Artificial Sequence
  Description of Artificial Sequence: Synthetic coding sequence
atgtggagactgccccgcgcattatgtgtacatgccgccaaaacatctaagctctctggcccttggagccggcctgctgcattcatgagtacctctctgatatctgttgcggtgactaagataattgctaaagtgctagaagacaataagctccccggagccatctgctccctcacatgcggcggtgctgatattggcaccgctatggccaaagacgagcgcgtgaatctgctgagcttcacaggctcgactcaggtgggcaagcaggttgggctcatggtccaggagcgtttcggtagatctttgttagagctgggcggcaataacgctattattgcatttgaggatgctgacttgtccctagtggtcccgtcagcactcttcgccgccgtgggcacagcaggccagagatgcacaacagctcggcggctatttattcacgaatccattcatgatgaagtcgtaaatcgcttgaagaaagcctatgctcagattcgggtgggaaacccatgggacccaaatgttctctatggccctctccacaccaagcaagccgtctcgatgttcctcggggccgtggaagaggctaaaaaagagggtggtacggtcgtctacggcggtaaagtcatggaccgcccaggtaactacgtggagcccactattgttactggtctggggcacgatgccagcatcgcgcatacagagacattcgccccaattctgtacgtcttcaagtttaagaacgaagaagaggtcttcgcttggaacaacgaggtcaagcagggccttagctcgtcgatttttacaaaagacctaggccgaatttttcgatggctcggcccaaaggggagcgactgcggaatcgtgaatgttaacattccaactagcggcgctgagataggcggggcgtttggcggtgaaaagcataccggaggcggtcgggagtccggctctgatgcctggaagcaatatatgagacggtctacttgtaccattaattattccaaagacctgccgttggctcaggggattaaattccagtag

SEQ ID NO: 107843 - DNA, 1509 bp, Artificial Sequence
  Description of Artificial Sequence: Synthetic coding sequence
atgggctccccaggtcgtggagctgggctgtatttttccagttcgcagggcttggggctcatcccgtccccgggactgagcatgtggaggctgccccgagccttgtgcgttcacgctgcaaagactagcaaactgtccgggccttggagccgtcccgccgcatttatgtcaacgcttctgatcaaccagccccaatatgcttggctcaaggaactggggctcagggaggaaaatgagggagtctataacggatcttggggcggaaggggggaggttataactacctactgtcctgccaacaatgagcctatcgctagagtacgacaagctagcgtggcagactacgaggagaccgttaagaaggccagggaggcctggaagatttgggctgacatccctgctcctaagagaggagaaatagttcggcagattggagatgccctcagggaaaaaattcaggtcttaggtagtctagtctcactggaaatgggaaagattcttgtggaaggcgtgggcgaagtgcaagagtacgttgacatatgcgattacgcagtcggcctgagccggatgatcggcgggcccatactcccaagcgagagatcaggtcatgccctaattgagcaatggaacccagtggggctggtcggtatcatcacagccttcaacttccccgtagctgtctacggctggaacaacgctatcgccatgatttgcggtaacgtgtgcctgtggaaaggggcgccaaccacttcattgatcagcgtcgccgtaactaagatcattgccaaggtgctggaggacaacaagttaccaggggctatctgttcccttacatgcggcggcgcggacataggcactgcaatggctaaagacgaaagagtaaacctgctttcatttaccggttccacacaggtgggcaagcaggtaggcctcatggtgcaggagagatttggccggtctctgctggagctaggaggcaacaatgccatcattgcgttcgaagacgcagatctttctctggtggtgccttctgctctcttcgcagccgtgggaaccgccgggcagagatgcacaacagctcggcgtctcgtgatggatagaccggggaactatgtggaacccacgatagtgaccggtttaggtcacgacgcgtcaatcgcgcataccgaaaccttcgcacctatactgtacgtgtttaagttcaaaaacgaagaggaagttttcgcctggaataacgaggtgaagcagggcttaagcagcagcatattcacaaaggacctgggcaggatctttcggtggctgggtcctaagggctccgactgtggaatcgtgaacgtcaacattccaaccagtggggcagagatagggggcgccttcggaggcgagaagcataccggaggtggcagagagtccgggtcggacgcctggaaacaatacatgcgtcgaagtacatgcactatcaactacagcaaggaccttcccttggctcagggtataaaatttcagtag

SEQ ID NO: 107844 - DNA, 1314 bp, Artificial Sequence
  Description of Artificial Sequence: Synthetic coding sequence
atggcgggaaccaacgccctgctgatgctggagaactttatagacggaaagtttctgccatgctcatcctacatcgacagctatgacccttcaactggcgaggtttactgccgcgtgcccaacagcgggaaggacgagatcgaggcagctgtcaaggcagcgagggaggccttcccttcctggtcttcccgctctccgcaagagcgatcacgtgtgttaaaccaagtggccgacctgctggagcaatctttggaggagtttgctcaggctgagtcaaaggaccaaggaaaaacacttgctctcgctaggactatggacatcccgcgatctgtgcagaacttccgattcttcgcaagctcttctttgcaccatacaagcgagtgcacacagatggaccatctcgggtgtatgcattatacagtgagggctcccgtcggtgttggggtcccacctggggttgtaaacatcgtgttcggtactggcccgcgagtgggagaggcactggttagccaccccgaagtccccttaatctcctttactgggtcacagccaactgcggagaggattacgcaattgagcgcaccccactgtaagaagctgtctctggagcttggcggaaaaaatcccgctatcatatttgaagacgctaacctggatgaatgcattccggccacagtccggtcatcatttgctaaccagggggaaatctgcttatgcacgtcacgcatcttcgtgcaaaaaagtatttacagcgagtttttgaagcgttttgttgaggcaactagaaagtggaaggtgggaattcctagcgaccctctcgtgtctattggtgcattgatcagcaaggcccacctggagaaggtaagatcttatgtgaaacgagcactagccgaaggtgcccagatctggtgtggagagggggtcgacaagttgtctctacctgcaaggaaccaggccggctattttatgttgcccactgtgatcactgacatcaaagacgaatcttgctgcatgaccgaggaaattttcggtcctgtgacgtgcgtcgtcccattcgatagtgaggaagaggtgatagagcgagctaacaatgtcaaatacggactagctgccaccgtgtggagttctaacgtcggacgtgtgcatcgtgtggccaagaagctgcaaagcggtctggtttggacaaactgctggttaatccgcgagttaaatctccccttcggagggatgaagtcaagcgggattggtcgagagggagccaaggacagttacgatttttttaccgaaatcaaaaccattaccgtaaagcactag

SEQ ID NO: 107845 - DNA, 1464 bp, Artificial Sequence
  Description of Artificial Sequence: Synthetic coding sequence
atggccggaactaatgccctgctgatgttggagaatttcatagatggaaaattcctcccttgtagctcttatatcgattcctacgatccctccacaggtgaagtgtactgtcgagtgcccaacagcggtaaagatgagattgaggcggccgttaaggctgctcgggaggctttcccatcatggtcttcacgatcacctcaggagagatcaagggtgctgaaccaagtagcggacctcctggagcagtctctcgaggagttcgctcaagcagaatcaaaagatcagggcaaaaccctggctctggccaggacaatggacatcccccgtagtgttcagaattttagattcttcgcctcaagcagcctgcatcacacgtctgagtgcacccaaatggatcatcttggatgtatgcattataccgtgcgagcacctgtcggagtggccggattgatttcgccttggaacctcccactatacctgctgacttggaagattgcccccgccatggccgcaggcaatactgtgatcgccaagccatcagagttgacttctgttacagcctggatgctgtgcaaactcctcgataaggccggggtacctcctggagtggtgaacattgtcttcgggacaggcccacgcgtgggcgaagcgctagtgtcacacccggaagtgccgctcatctctttcactggaagccagccaacagccgaaagaatcacgcagctgtctgccccccattgcaagaaactgagcctggaactgggtggtaaaaatcctgccatcatatttgaagacgcaaacttagacgaatgcatcccagccacagtccgctcttcctttgccaatcagggagagatctgtctctgtaccagtaggattttcgtgcagaaatctatctattctgagtttttgaagagatttgtggaggcaactcgaaagtggaaggtaggaatacccagtgacccacttgttagcattggagcccttataagcaaggcgcacctggagaaagttcggtcctacgttaaacgggccttggcagaaggtgcccagatctggtgcggcgaaggcgtggataagttaagcctgcctgccaggaatcaggccggatacttcatgctgcctacagttataacagatatcaaggatgagagctgctgtatgactgaggagatttttgggcccgtcacctgtgtggtccccttcgactcggaagaagaggtgatcgagcgagcaaacaatgttaagtacggacttgctgctacggtctggtcctcaaacgtgggcagagttcaccgcgttgctaaaaaattgcagagcggccttgtttggactaattgttggcttatccgagagctcaacttgccatttgggggtatgaagagtagcggcatcggacgggaaggggctaaggactcatatgacttcttcaccgagattaagaccataaccgtaaagcattag

SEQ ID NO: 107846 - DNA, 1302 bp, Artificial Sequence
  Description of Artificial Sequence: Synthetic coding sequence
atggctggaaccaacgcactgctgatgttagaaaatttcatcgacggcaaattcctgccgtgctccagctacattgactcatatgaccccagcacaggtgaagtctactgccgagttcccaattctggaaaagatgaaattgaggcagcagtgaaggcggctagagaagcctttcccagctggtcctctcggagcccacaggaaagatctcgagttctgaatcaggtggctgatctgctggagcaatccctggaagagtttgcacaggcagagtccaaggatcagggaaagacactggcactggcccgtacaatggacatcccacgatccgttcaaaattttcggttctttgcctcgagctcgctgcatcacaccagtgagtgcacacagatggaccatcttggctgtatgcactacacagtacgcgcccccgtcggggtagctggcctgatttccccttggaacctgcctctctacctcctcacgtggaaaatcgcgcctgcaatggccgcaggtaacacagtgattgctaagcctagcgaactgacaagtgtcacagcctggatgctttgtaaactgctcgataaggcaggggtgccccctggggtggttaatatcgtctttgggacaggccctagagtgggggaggccctcgtgtcccacccagaggtgcctctgatttctttcacaggctcgcaaccaacagcagagcgaatcacccagctgtctgccccccactgtaaaaaactgtccctggaacttggcggaaaaaatccggctatcatcttcgaggatgccaatctggatgaatgtatacctgccactgtacggagctcgtttgctaaccaggtgcgctcttacgttaaaagagccctggctgagggagctcagatttggtgcggggagggcgtagacaagctgtcattacccgcaagaaatcaggccgggtacttcatgctcccgaccgtcattacggatattaaggacgagagctgttgcatgactgaggaaattttcggtccggtgacctgcgtggtgccgtttgattctgaagaagaagtgatcgagcgcgcaaacaacgtcaagtatgggttggctgcaacagtctggagtagtaatgtcggccgagtgcatcgcgtcgccaaaaagctccagagtgggctcgtctggactaactgctggcttatccgagaactcaacctgccattcggggggatgaaatctagtgggatcggccgagagggggccaaagattcttacgatttcttcactgaaattaagaccatcacagtgaagcactag

SEQ ID NO: 107847 - DNA, 1557 bp, Artificial Sequence
  Description of Artificial Sequence: Synthetic coding sequence
atgtttctacgggccgggttagctgcgctgagcccattgctgcggagcttgcggccatctccagtcgccgcgatgtctacggggaccttcgtggtgtcacagccccttaattatagaggaggcgctagagtggagccggcagacgcctccgggactgagaaggcgttcgagcccgctacagggcgggtgatcgcaacgttcacatgcagtggggaaaaggaagttaacctggcggttcagaatgcgaaagccgcttttaaaatttggtcccagaagtccggtatggagagatgcaggattctgttggaggccgccagaatcataagggagcgcgaggatgagatcgcaacaatggagtgtataaacaacggtaagagcatttttgaggcacggcttgatattgatatttcctggcagtgcctggagtattacgctggtttggctgcatcgatggccggcgagcatatccagctaccagggggcagttttggctacactcgccgggagccattaggggtttgtgtgggaatcggcgcttggaactatccatttcaaattgccagttggaagagcgccccggcactagcctgtggaaatgctatggtgtttaagccttccccgttcactccagtaagcgcactccttctggctgaaatttattctgaagcaggcgtgccacctggactctttaacgttgttcaaggcggagccgccaccggtcagtttctatgtcaacatccagacgtggctaaggtgtcatttaccggcagtgttccaaccgggatgaagattatggagatgtccgctaagggaatcaagccagtcactttggagctgggcgggaaatcccccctaataatttttagcgattgcgatatgaacaatgcggttaagggggcacttatggccaatttcttgactcaggggcaggtgtgctgcaacggtactagagtgtttgtccaaaaggagatcttggataagtttaccgaggaggtcgtgaaacagacacagcgcatcaaaatcggtgacccattgctcgaagatacaaggatgggacccctgataaacaggccccatttggagagggtgctcggcttcgtaaaagttgcaaaggaacaaggagccaaagttctttgcgggggggatatctatgtgccagaagaccccaagcttaaggacggctactacatgagaccctgtgtcctcactaactgtagagatgatatgacctgcgtgaaggaggagatatttggtcctgttatgtccatcctatcgttcgacactgaagcagaggtattggaacgggccaacgatacgacattcgggctggctgccggtgtttttacaagggatatccagcgtgctcacagggtggttgcagaattgcaggccggtacttgtttcattaacaattacaatgtgtcacccgttgagctccctttcggcggatacaagaagagcggattcggaagagagaatgggagagttacaatcgagtattatagccaactgaagactgtttgcgtcgagatgggcgacgtggagagcgcgttctag

SEQ ID NO: 107848 - DNA, 1275 bp, Artificial Sequence
  Description of Artificial Sequence: Synthetic coding sequence
atggaaagatgtagaatcctgctggaagctgctcggataatcagggagcgcgaggacgagatcgcgacgatggagtgtattaataacgggaagagtatctttgaagcacggttggacatcgacatatcatggcaatgtctggagtattacgcgggcctggccgctagcatggccggcgaacatatacagcttccaggcggaagcttcggctacacccggagagagccattgggagtgtgcgtaggcataggtgcctggaactaccctttccagatcgcaagctggaagtccgccccggctctggcttgcggaaacgctatggtcttcaaaccctcccccttcactcctgtgtctgccctgcttctcgccgaaatctattccgaagctggcgtccctcctgggttattcaacgtggtgcaggggggcgcagccacaggtcagtttctttgtcagcatccagacgtagccaaagtgagctttactgggtccgtccctaccggaatgaaaatcatggagatgtctgcaaagggaatcaagccagtgacattagaactgggaggcaagagccccttgatcatttttagtgactgcgacatgaacaatgctgttaagggcgctctcatggctaacttcctgacccagggccaagtttgttgcaacggcaccagggtcttcgtccagaaggagatcctcgacaagttcactgaggaggtagttaagcagactcaacggattaaaataggcgatcctctgctagaggacacacgaatgggaccactcatcaatcgtccccaccttgagcgtgtactgggcttcgtcaaggttgctaaggaacagggggcgaaagtgttgtgcggaggtgacatttacgtgcccgaggatccaaaactaaaggacggttactacatgagaccctgcgtgcttaccaactgccgcgacgatatgacctgtgtgaaggaggagatcttcggccccgtgatgtctatcctctcttttgatactgaggccgaggtgctggagagagctaatgacaccacttttggtctggccgccggtgtgttcacccgtgatatacaaagggcccatagagtcgtggcagaactccaggccggtacctgctttataaacaattataacgtgtcaccagtagagctgcctttcgggggctataagaagagcggcttcggacgagagaacggtcgtgtaaccatcgagtattactcccagctgaagacagtgtgcgtcgagatgggcgacgtggagagtgccttttag

SEQ ID NO: 107849 - DNA, 4017 bp, Artificial Sequence
  Description of Artificial Sequence: Synthetic coding sequence
atggacagggctagcgagctcctgttttatgtcaacggcaggaaggtgatagagaagaatgtggacccagaaaccatgctcctgccatacttacgtaagaaactccgcctgacagggacaaagtacgggtgcggcggaggcggatgcggcgcatgcaccgtcatgatctcgcggtataatccaatcactaagcggattcgtcaccatcccgctaacgcctgccttatccccatatgctccctctatggggccgccgtgactaccgtcgaggggattggatctacccacactcggatccatcctgtgcaggaaaggatcgcaaagtgccacggtactcagtgtgggttctgcactccaggaatggtgatgtctatctatacactgttgcgtaatcatcccgagccaacattggatcaacttactgacgcccttgggggcaatttgtgccggtgtaccggctaccggcccataattgacgcatgcaaaactttttgcaagactagcggctgctgccagtccaaggaaaatggcgtttgctgcctggaccagggcatcaacggtcttccggagtttgaggaagggagtaagacatcccctaaattattcgccgaagaagagttcctgcctttggaccccactcaggaactgatcttccctccggagcttatgattatggccgaaaagcagagtcagcgtacccgcgtttttggttctgagaggatgatgtggttctcacctgtcaccctgaaagaactgctcgagtttaagtttaaatatccccaggccccagtcatcatgggcaatacaagtgtgggcccagaagtcaaattcaaaggtgtgttccacccggtgatcatatcccccgatcgcatagaagagctcagcgttgtaaatcatgcatacaatgggctgaccttaggcgctggattatcattagcgcaggttaaggacatcctggctgatgtagttcagaaactgcctgaggagaagacccagatgtaccacgcgttgctgaagcacttggggactctagccggctcccagattagaaatatggcatccctgggtggtcatatcattagtaggcatcctgacagcgaccttaatcccattctcgcagtgggcaattgcacactcaacctgctgtccaaggaagggaagagacagatcccactgaacgaacagtttttgagtaaatgtccaaatgctgatctaaagcctcaagagatcctcgtttcagtgaacattccttactctcggaagtgggagttcgtgtcagcctttagacaggcgcagcgccaagaaaatgcactggccattgtcaacagcggtatgagggtcttcttcggagaaggggacggcatcatcagggagttgtgcattagttatggaggagtcggccccgcaacaatctgtgcgaagaactcttgtcagaagcttatcggccgccactggaacgagcagatgctcgacatcgcctgtcggctgatactcaatgaggtgtctctcctcggatccgctccggggggcaaggttgaattcaaacgtaccttgatcatttcatttctcttcaagttttatctggaagtttcacaaatcttgaagaagatggaccctgtgcattacccttcccttgccgataagtacgagtccgcactagaggaccttcacagtaagcatcactgttccactcttaagtaccaaaacattggccccaagcagcaccctgaagacccgattggacatcccatcatgcatctctcaggcgtgaaacacgcgaccggcgaagccatctattgtgatgatatgcccctcgtggaccaggaattgtttctgactttcgtcacgagttcccgggctcacgctaagatcgtgtccatcgatctgagcgaagccttgagtatgccaggcgtggtcgatataatgaccgccgagcatctgtcggacgtgaactctttttgcttttttacagaggctgagaaattccttgcaacggataaggtattctgtgtcggacagctagtttgcgccgtcctggccgatagcgaggttcaggctaaaagggcagcaaaacgtgttaagatcgtgtaccaagacctcgagcccctcattctaacgattgaagaatccattcaacacaactcgtctttcaagccggagcgaaagctggagtacggcaatgtcgacgaagcgttcaaggttgttgaccagattctggaaggagagatccacatgggtggccaagagcatttttatatggagacacaaagcatgctcgttgtaccgaagggagaagaccaggagatggatgtttatgtttctacacagtttccaaagtacatccaggacattgtcgcttcaaccttgaagcttcccgctaataaagtcatgtgtcacgtgcgccgcgtgggcggagcatttggggggaaagttctgaaaactggaatcatcgcggccgtcacagcgttcgcagccaataagcatggccgggcggttcgctgtgtgctggaacgaggcgaagacatgcttatcaccggcggtcgacacccctacctcgggaaatacaaggcaggatttatgaacgacggtcgtattctcgcgctggacatggagcactatagcaatgcaggggcgagcctggacgagagtttgttcgtgatcgaaatgggcctgcttaaaatggataacgcttataaattccccaacttgaggtgtcgcgggtgggcttgtcgcaccaatctgccatctaatacagcatttcggggtttcggatttccccaggccgccctgatcacggaaagttgtatcacagaggtggcggccaaatgcggactttccccagagaaggtccgcattataaatatgtataaggaaattgaccagacaccgtataaacaagagatcaatgcaaaaaatctcatccaatgctggagggagtgcatggccatgagctcttattccctccggaaggttgctgtggaaaagttcaacgccgagaattactggaagaagaagggactggcaatggtgcccctcaagtttcctgtgggccttggctctcgtgccgcagggcaagccgccgccctagtgcacatctatttagacggcagcgtgctcgtgacgcatggtggcatcgaaatgggtcaaggcgttcacactaagatgattcaagtcgtgtcacgggagctccgaatgcctatgagtaacgtccatttgcgcggtacctctactgagacggtccccaacgcaaatatatcaggaggtagtgtggtggctgatctcaatgggctggccgtgaaggatgcatgtcaaaccctgctgaagcggttggaaccgatcatcagcaaaaatccgaaagggacatggaaagactgggctcaaacagcttttgatgaatcaatcaacttatcagccgtagggtacttccggggctatgaatccgatatgaactgggaaaagggtgaaggccaaccatttgaatactttgtatacggtgctgcttgtagcgaggtggagattgactgcttgactggcgatcataagaacattaggaccgacattgtcatggacgtaggatgcagcatcaaccctgctatcgacatcggtcagattgagggagcctttatccagggcatgggtctatacaccatagaagagctgaactatagtccacaaggtatcctgcatacacgcggaccggaccagtacaagatccccgctatctgcgatatgcccacggaactgcatatagctttgctgccgcccagtcagaactctaacacactttattcatccaaagggctgggggaatccggagtgtttctgggatgctctgtgttcttcgcaatccatgatgctgtgagcgccgccaggcaggaaagagggctgcatgggccgctcactctgaactctcctttgacccccgaaaaaattcgcatggcgtgtgaagacaaatttactaaaatgataccccgcgatgaacctggtagctacgtaccatggaatgtgccaatctag

SEQ ID NO: 107850 - DNA, 456 bp, Artificial Sequence
  Description of Artificial Sequence: Synthetic coding sequence
atgctcctcccgtatctgcgtaaaaagctgagacttactgggactaaatatggttgcggggggggcggctgcggcgcttgcacagtgatgatcagccgatataatcccatcactaaaagaattcgccaccatcctgcgaatgcctgcctgatcccgatttgctccctttacggcgctgccgtcacgaccgtcgaggggatcggtagtacgcatacccggatccaccccgtacaggaaaggatagctaagtgtcacggtacgcagtgtggattctgtaccccgggaatggtcatgtccatttatactcttctccgcaaccaccccgagcccacgctggatcagttgactgacgctcttgggggcaacctctgtaggtgcaccgggtaccggccgatcattgacgcctgtaaaactttctgtaagactagcggctgttgtcaaagtaaggaaaattag

SEQ ID NO: 107851 - DNA, 858 bp, Artificial Sequence
  Description of Artificial Sequence: Synthetic coding sequence
atggacttatcagcagctagtcacagaattcctcttagtgacggaaattcgatcccgatcatcgggctgggaacatattctgagcctaagtcaacacctaagggagcgtgcgcaaccagtgtcaaggttgctatagatacagggtatcggcacattgatggcgcctacatttatcaaaacgaacacgaagttggagaagccattcgtgaaaagatagctgagggaaaagtgcgccgggaggacattttctattgcggaaagctgtgggcaacaaatcacgtgcccgagatggtccggcctacattagagagaacactgcgtgtgctccagctcgattacgttgatctgtatatcatcgaggtgcctatggccttcaagccaggcgacgaaatctatccccgagatgagaatggcaaatggctgtatcacaaatccaatctctgtgccacttgggaagtcgagtgccacccgtattttactcagcctaaactgctcaaattctgccaacagcacgatattgtgatcaccgcttattctcccctcggtacttctcgtaaccccatctgggtgaacgtgtccagccctccccttctgaaggatgccttactgaactcattgggcaagcggtataataagacagccgcacagatcgtgctgcggtttaacatccagaggggcgtcgtggtgatccccaagtcattcaacctggaacgaatcaaggagaatttccaaatttttgatttctctctaacagaggaggaaatgaaggatatcgaggccctgaataagaatgtcaggtttgtggagctgctaatgtggcgcgaccatccggagtacccattccacgacgagtactag

SEQ ID NO: 107852 - DNA, 873 bp, Artificial Sequence
  Description of Artificial Sequence: Synthetic coding sequence
atggatttgagcgcagcctcccacaggattcccctcagcgacggaaatagcatccccattatcggtttgggcacctacagcgaaccgaagagtacccctaaaggagcgtgtgccaccagcgtcaaggtcgctatcgatactgggtaccgtcacatcgacggcgcatacatctaccagaacgaacacgaagttggcgaggccattcgggagaaaatcgctgagggcaaagtgcgccgcgaggacatattctattgtgggaaactatgggccaccaatcatgttcctgagatggtgcggcccactctggagcggactctgagagtgctgcaattagactacgttgacctgtatattatcgaagtacctatggcctttaaacccggagatgagatctaccccagagacgagaatggcaagtggctgtatcacaagagcaacctttgcgctacctgggaagccatggaagcttgtaaggatgccggtctggtcaaaagcctgggcgtttcaaacttcaacagacggcagcttgaactcatactgaataagcctggtcttaagcataagccagtaagtaatcaagtcgagtgtcatccgtacttcacacaacctaaactgttaaagttttgtcagcagcacgacatcgttatcaccgcctacagcccgctagggacatccaggaaccctatttgggtgaatgtgtcttccccacctctgttgaaggacgccttgttgaatagcctagggaagcggtataataaaacagctgcccagattgtcctgaggttcaatattcagcgcggggtcgtagtgattcctaaatctttcaaccttgagcggatcaaagagaactttcaggtggcacggtccagttag

SEQ ID NO: 107853 - DNA, 978 bp, Artificial Sequence
  Description of Artificial Sequence: Synthetic coding sequence
atggccgctagctgcgtgctgctgcacaccggccagaaaatgcccttgattgggctggggacctggaaatcagagcccggccaggtgaaggcagcagtcaagtacgccctaagcgtgggatacaggcatattgattgcgctgccatttatggaaatgagccagagattggagaggcccttaaggaggatgtgggtcctggtaaggccgtccctcgggaggagttatttgtgacctcaaaactctggaataccaagcaccacccagaagacgtggaacccgccctgcggaagacactcgccgacttacagcttgagtatttggatctttacttgatgcactggccttatgcttttgagaggggagacaacccctttccaaagaacgccgatggaacaatctgttatgattcaacacactacaaagagacatggaaagcactagaggctctcgtcgcgaaagggctcgtccaggctctcggtttgagtaatttcaactcccgacaaatcgatgatattctgtcagttgcgtccgtgaggcctgccgtactgcaagtcgaatgtcatccatatctggcccagaacgagctaatcgcacattgtcaagcacgagggctggaggttacagcctattcccccctaggtagctccgaccgggcttggcgcgaccccgacgagcccgtgctactcgaggagcctgtggtgcttgcactcgccgaaaaatacggaaggagtcccgcccagatcttgcttcgttggcaggttcagcgaaaggtgatctgcattcccaaatcaatcacgccatcccggatcctgcagaatatcaaggttttcgacttcacattcagtccagaggagatgaagcagctgaacgcccttaacaaaaactggagatatattgtgcctatgctgaccgtcgacggcaagcgggttccgcgggatgccgggcatccattgtatcccttcaatgatccatattag

SEQ ID NO: 107854 - DNA, 978 bp, Artificial Sequence
  Description of Artificial Sequence: Synthetic coding sequence
atggccgcttcttgcgtgttgttgcacaccgggcagaaaatgccactgatcggcttgggtacctggaagagcgagccaggccaagtaaaggcggctgtgaaatatgccctctccgtcggttatcgccacatagattgcgctgccatctacgggaacgagcccgagatcggcgaggcccttaaggaagatgtcgggcccggaaaagcagtccctcgggaggagctgtttgtgacttcaaagctgtggaataccaagcaccaccccgaagatgtggagccggccctgcgaaagactcttgctgatctgcagcttgaatatctcgatctgtatcttatgcattggccttacgcgtttgagagaggggacaatccatttcctaagaacgccgacggaacaatctgttacgattctacccattacaaggagacctggaaggcactggaggctctggtcgctaagggtctggtgcaagctctcggcctatcaaattttaactctagacagatcgatgacatcctgtccgtggctagcgtccgcccggcggttctccaggtggaatgtcacccatatcttgcccagaatgagctgatagcccactgccaagcacgtggactcgaggtcacagcctacagcccgttggggagctcagatagggcatggagagatcccgatgagcccgtccttctcgaagagccagtggttctggcactcgccgagaaatacggacgcagccctgcgcagatcctgctcaggtggcaggttcaacgcaaagtgatctgtattccgaagtcaataactccaagtcgcatccttcagaatatcaaagtttttgattttactttcagtccggaggagatgaaacaattgaacgctctaaataagaattggcgctacatagtaccaatgctgactgtggatggcaaacgagttccccgcgatgctggccatcccctttatccctttaatgatccttactag

SEQ ID NO: 107855 - DNA, 444 bp, Artificial Sequence
  Description of Artificial Sequence: Synthetic coding sequence
atggccgctagttgcgtcctattacacacaggacagaagatgcccctgatcggtttaggtacatggaaaagtgagccaggtcaagttaaagctgctgtaaaatatgccctgtcagtggggtataggcatatagactgtgccgcaatctatggcaacgagcccgaaataggcgaagccctgaaggaggacgttgggccaggaaaggccgtacctcgggaggaactttttgttacatccaagctgtggaacacaaaacatcatccggaggatgttgaacccgccctgagaaaaacgctggccgacctccagctggaataccttgacttatacctgatgcactggccctacgccttcgaacgaggtgacaaccccttccctaaaaacgcagatggcacaatttgttacgatagcactcactataaagaaacctggaaggctctttag

SEQ ID NO: 107856 - DNA, 951 bp, Artificial Sequence
  Description of Artificial Sequence: Synthetic coding sequence
atggccagtaggctgctcctgaacaacggagcaaagatgccaattctgggcctgggaacttggaaaagtcctccaggtcaggtgacggaggccgtgaaggttgccatcgacgtcggatatcgccatattgattgcgctcacgtgtaccaaaacgagaatgaagtaggagtcgccatacaggaaaagttgagggagcaggtcgttaagagggaagaactctttatcgtttctaagctgtggtgtacataccacgaaaaaggactagtgaaaggtgcttgtcagaaaactttaagtgacctgaaattggactacctggacctgtacctcatccactggcccactggattcaagcccggaaaagagttctttccacttgatgaatccggcaatgtcgtaccttccgacacgaatatcctcgacacgtgggctgctatggaggagcttgtcgacgaggggctcgtcaaagccattggtataagtaattttaaccatcttcaggtcgaaatgatactcaataagcccggactgaaatacaaacctgccgtcaaccaaatcgagtgtcatccttacctgactcaagaaaagctcattcagtactgccagtctaaaggcatcgtggttaccgcctattcgcctttgggttctccagaccgtccttgggctaagcctgaagacccatctcttctggaagaccctcgaattaaagccatcgcagctaaacataataagacaactgcgcaggtgcttattcgttttcccatgcagagaaacctcgtggttataccaaaatcagtcactcccgaaaggatcgccgagaacttcaaggtcttcgacttcgagctaagctcccaggacatgacaacgctcctgagctataaccggaattggagagtctgcgccctgctctcttgtacctcacacaaagactacccttttcacgaagagttctag

SEQ ID NO: 107857 - DNA, 618 bp, Artificial Sequence
  Description of Artificial Sequence: Synthetic coding sequence
atgggtgttgtgtcgctattcttgtgcatcgttgagcagatctttacgagctccaagaaaatacagttcaggggtatattcatggctaaggtaccaaaatctaaagcgctcgaggccacaaagctggccattgaggcagggttcagacacattgactcagctcacttatataacaacgaggagcaggtaggcctcgcaatccgttccaaaattgcggatggttcagtcaagcgcgaggatattttttatactagtaaattgtggtgtaatagccataggccggaactggtgcgccccgccttggaacggagcctcaagaatctgcagctggattacgttgatctgtatctgattcacttccctgtgtctgtgaagcccggagaggaggtaataccgaaagacgaaaacggaaaaatcctgttcgatacggtggacctgtgtgcaacatgggaggctgtggaaaaatgcaaagatgccggattggcaaaatctattggagtgagtaactttaacagacggcagctggagatgatactcaataagcccggcctgaaatacaaaccagtttgtaatcaacctcgagacaacagcatattctccttgtccccagactggtag

SEQ ID NO: 107858 - DNA, 972 bp, Artificial Sequence
  Description of Artificial Sequence: Synthetic coding sequence
atggattctaaataccagtgtgtgaagctgaacgatggacactttatgcctgtcctcggtttcggtacctacgctcctgcagaagtacctaaatctaaagccctagaagccacgaaactggccatcgaggctggctttagacacattgactccgcgcacctgtacaacaacgaggagcaggttggactagcaattcggtctaaaatagccgacggatctgtcaaacgggaagacatcttttatacttccaagctgtggtgtaacagtcaccgaccggaactggtgcgtcccgccttagaacggtcactgaaaaacctgcaactcgactacgtagacctgtacctgatacacttccctgtcagcgtgaagccaggagaagaggtgatcccgaaagacgaaaacggcaagatactgtttgacacggtcgacctatgcgcaacctgggaagccgtcgagaagtgtaaagatgctggtctagccaagtccatcggcgtttcgaacttcaacaggcgccaattggaaatgatattaaataagcctggtctcaagtataagcctgtgtgcaatcaagtggaatgccacccttactttaaccagcgcaagctgctggacttttgtaaatctaaggacatcgtgctggtcgcctatagtgctctcggctcacatagagaggagccttgggtggaccccaattccccagttctgctcgaggaccctgttctttgcgccctcgcgaaaaagcataaaaggaccccagctctgattgctctgcgatatcagcttcagcgcggggtggtcgtgctagcaaagagctacaatgaacagcggatccgacagaacgtgcaggtctttgaattccagctaacatccgaggagatgaaagcaatagatggactcaatcgcaatgtaagatacttgactctcgacatctttgcagggcccccaaactatccattcagcgacgagtactag

SEQ ID NO: 107859 - DNA, 972 bp, Artificial Sequence
  Description of Artificial Sequence: Synthetic coding sequence
atggattccaaataccagtgtgtgaaattaaacgatggccacttcatgccagtcctcggctttggcacctacgctccagcagaagtgcctaagtcaaaggcgctggaagccaccaagttggcaatcgaggccggtttcagacacatcgactccgcccatctttacaacaatgaggaacaggtcggcctcgcaatcaggtctaagatagccgacggctccgtgaaaagagaagacatattctatacatctaaactgtggtgcaattcacaccgccccgaactcgttaggccagctctggaaaggagtttgaaaaatctgcaattagattatgtggatctttatctcattcactttccagtcagcgtgaaacctggggaggaggtcatccctaaagatgaaaatggaaagattctgtttgatactgttgatctgtgcgcgacttgggaagccgtggaaaagtgcaaagacgcaggcctcgccaaatctataggagtgtctaattttaataggcgccagctggagatgatcctcaacaaacccgggttgaaatataaaccagtgtgtaatcaggtagagtgccatccctacttcaatcagcggaagttactcgacttttgcaagtcaaaagacatcgtcctggtggcctattccgccctgggcagtcacagggaagagccatgggtggatcctaactcaccagtcttgctcgaggaccctgtcttgtgtgccctcgcaaaaaagcataaacgcactcccgctttaatcgctctaaggtatcagctgcagaggggggtggtcgttctagccaagagttacaacgaacagcgtatccggcagaatgtgcaggtatttgagtttcaactgacatcagaagaaatgaaagccatcgacgggctgaacagaaatgtgaggtacctgacccttgacatttttgccggaccacctaactaccccttcagcgacgaatactag

SEQ ID NO: 107860 - DNA, 747 bp, Artificial Sequence
  Description of Artificial Sequence: Synthetic coding sequence
taatctaagtaccagtgcgttaagctaaacgatgggcacttcatgcctgtcctgggcttcggcacctacgcacccgccgaagtcggtctggcaattcgcagcaagattgcagatggctctgtcaagagagaagatatcttttacacttctaaactgtggtgtaactctcaccggcccgagctcgttcggcccgcactagaaaggtccctcaagaacctccaattggactacgttgatctctacctgattcattttcctgttagcgttaaacctggtgaagaagttatccctaaggacgagaatgggaaaattctgttcgacacggtcgacctgtgcgcaacatgggaggcagtagagaagtgcaaggacgctggcttggctaaatccattggggtttctaattttaatcgaagacagctagagatgatcctcaacaaacctggcctgaagtacaagcccgtgtgcaaccaggtggagtgtcacccctattttaaccagaggaagcttctggatttctgcaaatccaaagacatagtgctggtcgcctacagtgccctcgggagtcatagagaggagccctgggttgaccccaattcccctgtcctgctggaggaccccgtgctatgcgctttggctaaaaaacataagaggacacctgccctcattgcattacgatatcagctgcagagaggcgtcgtcgtcctggccaaatcctacaatgaacagcgaatccggcaaaacgtatag

SEQ ID NO: 107861 - DNA, 972 bp, Artificial Sequence
  Description of Artificial Sequence: Synthetic coding sequence
atggatagcaaataccaatgtgttaaactgaacgacgggcacttcatgccagttcttggctttggtacatacgcgcccgctgaggtaccaaagtccaaagctctggaggcggtaaagcttgctatagaggccggattccatcacatcgattctgcacatgtgtacaacaacgaagagcaggtgggcctagccatccgtagcaagattgctgacggaagcgtgaaacgggaagacatattctacactagcaagttgtggtccaatagtcacaggccagaactggtccgcccagccctcgaacgctctctgaaaaacttgcagctggactatgtggacttgtaccttatccactttcctgttagcgtgaagcctggggaggaggtaataccaaaagatgagaatggtaagatcctgtttgataccgtcgatctgtgtgccacatgggaagcaatggagaagtgcaaggatgcaggactggctaagagcataggagtttctaacttcaaccacagactcctcgagatgattttgaacaaacccggcttaaaatataagccggtgtgcaatcaggtggagtgccacccttatttcaatcagcgaaagttactggatttctgcaaaagcaaagacatcgtccttgtcgcatattccgccctcgggtctcaccgtgaggagccctgggttgacccaaacagccccgtactgctggaggatcctgtcctgtgcgctttggccaagaagcataagagaacacccgcactgatcgcccttcgctaccagttacagaggggggtggttgtcctggccaagagctacaatgaacagcggatcagacagaacgtgcaggtctttgagttccagctgacaagtgaggaaatgaaggctattgatggcctcaatagaaatgtgcgttatctcactcttgacatcttcgctgggccaccaaactaccctttctcagatgagtactag

SEQ ID NO: 107862 - DNA, 972 bp, Artificial Sequence
  Description of Artificial Sequence: Synthetic coding sequence
atggattcgaagtaccagtgtgttaaactgaatgacggtcatttcatgccagtgctgggcttcgggacctacgcccccgcggaggtgcccaaatccaaggcacttgaagccgtgaaactcgccatcgaagccggattccatcacattgattccgctcatgtttataataatgaggagcaagttggtctggcaattcgctcaaagatcgcggatggttcagtcaaacgggaagacatcttctatacaagtaaactttggagcaatagccatagaccagagctggtgcggcccgcactggaacgatctcttaagaatttgcagctagattacgtggacctgtacttgatccacttccctgtgtcggtgaaacctggggaggaggttatccccaaggacgaaaatggaaagattctgtttgacaccgtggacttgtgtgctacatgggaggcaatggaaaagtgcaaagacgccggcttagccaaatctatcggggtctctaatttcaaccatcggctgctggaaatgatcctcaataagcccggattgaaatataaacctgtgtgtaatcaggtggaatgccacccttatttcaaccaaagaaagctgctcgatttttgtaaatccaaggatatagtcctggttgcatacagtgcactgggctcccatcgcgaggaaccctgggtggatcccaattctccagttttgctcgaggacccggtactatgcgccctcgctaagaagcacaaaaggacccctgccctcatcgccctcaggtaccagctgcaacgcggagtggtggttctggcgaaatcctacaatgaacagaggattaggcagaatgttcaggtgtttgagttccagctgacttctgaggagatgaaagctatcgacggccttaacagaaacgtccggtacttgaccctggatatctttgccggccctccaaattacccgttctcggacgagtattag

SEQ ID NO: 107863 - DNA, 894 bp, Artificial Sequence
  Description of Artificial Sequence: Synthetic coding sequence
atggacagtaaatatcagtgtgtcaagctgaatgatggccacttcatgccagtgctgggttttggcacgtatgcacctgccgaggtacctaaatcaaaggcccttgaagctgttaagctggccattgaggctgggttccaccacattgattctgcacacgtgtacaataacgaggaacaagtcgggttagcaatcaggagtaagattgctgacggcagcgtaaagcgagaagacatattttacacttccaaactgtggagcaactctcaccgacctgaactcgtccggcctgccctcgagagatctttgaaaaatctacagctggattatgtcgacctatacctgatccattttcctgtatcagtgaaggccatggaaaagtgcaaagatgccggactagccaaatctataggtgtctccaattttaaccaccgactcctggagatgatcctgaataagcccggactcaagtacaagcctgtctgtaatcaagtggagtgtcatccgtatttcaaccaaaggaagctgctggatttctgtaaatcgaaggatatagtgctggttgcctactcagcactgggatcgcatcgagaggagccctgggtggaccccaactcacctgtgctactggaggatcccgtcctgtgcgcgctggcaaaaaagcacaagcgaaccccagcactcatcgccctcaggtaccaattgcagcgtggggtggtggttctggctaaatcatacaacgaacagcgcattcgacagaatgtccaggtctttgagttccagctgacctccgaggaaatgaaagccattgatggccttaataggaacgtgaggtatctgacattggacatcttcgccgggccccctaattaccccttttccgacgaatactag

SEQ ID NO: 107864 - DNA, 420 bp, Artificial Sequence
  Description of Artificial Sequence: Synthetic coding sequence
atggatagcaaatatcagtgcgtcaaattaaatgacggacactttatgcccgtcctaggcttcgggacatatgctcccgccgaagtgcctaagtctaaagcactcgaagctgtaaagttggcaatcgaagccggcttccatcatattgacagtgctcacgtctataacaacgaggaacaggtaggcctagcaatcaggtccaagattgctgatggctcagttaagcgtgaggatatcttctacactagtaagctgtggagcaatagccaccgtcccgagttggtgaggccagcactcgagagaagcctgaagaacctgcagctggattacgtggatctctacttgatccactttccagtgagcgtaaaagaagacatcggcatcttgacttggaaaaaatctccaaaacacaacagctag

SEQ ID NO: 107865 - DNA, 972 bp, Artificial Sequence
  Description of Artificial Sequence: Synthetic coding sequence
atggattccaaacaccaatgcgtgaaacttaatgatggccactttatgccggtgctgggcttcggaacctatgcccctccagaggttcctcgctcaaaagcgctagaagtgacaaaactggctattgaagctggatttcgccacatcgattcagcacatctctacaacaatgaggagcaggtaggcctcgcgataaggtcaaagatcgcagacgggagcgtgaaacgagaagatattttctacacctcaaagctgtggagcacatttcatagacctgagttggtccgccccgccctcgaaaactcgctgaagaaagctcagctggactatgtcgacttatatttaatccattcacctatgtccttaaaacccggcgaggaactgtctccgactgacgagaacggcaaagtcatttttgatatcgtggatctgtgtaccacgtgggaagcaatggaaaaatgtaaggatgctgggctggctaagtccataggggtgtctaactttaataggaggcagctcgaaatgattctcaacaagccgggattaaaatacaagcccgtctgtaatcaggtcgaatgccatccatacttcaacagatccaaattactagatttttgcaaaagcaaggacattgtgttagtggcttattcagcgttgggaagccaaagagataaaagatgggtggatcccaattctccagtgttgctggaggacccagtgctgtgtgcacttgcaaaaaaacataaaaggacgcccgcactcatagctctgagataccagctacagcgcggcgtcgtggtcctggcgaagtcatacaatgaacagaggattcgccaaaatgtacaagtgtttgaattccagctcaccgcagaagatatgaaagcgatagacggcttggatagaaatctccattatttcaattcagactctttcgcttcccatcctaattacccgtattccgatgagtattag

SEQ ID NO: 107866 - DNA, 615 bp, Artificial Sequence
  Description of Artificial Sequence: Synthetic coding sequence
atgtccttaaaacctggcgaagagctgagtcctacagatgagaatggcaaagtaatcttcgacattgtggacctctgcacaacctgggaagcaatggaaaagtgcaaagatgcgggtctcgccaagagcatcggggtgagtaacttcaaccgccggcagcttgagatgattttaaataagcctgggctcaagtacaagcccgtgtgcaaccaggtggaatgccacccatacttcaatcgcagcaaattgctggacttctgcaagtctaaggacatcgtgcttgtcgcttattcagcgctcggctcccagcgggacaagcgttgggtggatcctaatagccccgtgctcctcgaggatcccgtactgtgcgcccttgctaagaaacataagagaacccccgctctgatagctctgcggtaccagctacaaagaggtgtggttgtcttggccaaaagttacaatgagcagaggatcaggcagaatgttcaggtgtttgaattccagctgactgcggaagatatgaaggcaatcgacgggctggaccgtaatctccactattttaactctgacagctttgcatcgcaccctaactatccttacagcgacgagtactag

SEQ ID NO: 107867 - DNA, 972 bp, Artificial Sequence
  Description of Artificial Sequence: Synthetic coding sequence
atggaccctaaataccaaagggtagaactgaatgatggacacttcatgccagttctcgggtttgggacctacgcccctcccgaggtccctcgaaaccgcgccgtagaggtcactaagctggccatcgaagccggcttccggcacattgacagtgcctacctctataacaacgaggagcaagtaggcctcgcaataagatccaaaatcgcagacggctctgtgaagcgtgaagatatcttctacactagcaagttgtggtgtacattcttccagccgcagatggtccagcccgcattggagagctctctgaagaagctgcagttagattacgtggatctctatctgctccatttcccgatggcgttgaagcccggagagacaccactgccaaaagatgagaacggaaaggtgatcttcgatacagtagatctgtctgcaacatgggaggttatggagaagtgcaaggatgcgggcctcgccaagtcaataggggtatctaactttaactgccggcagctggaaatgattctcaacaagccaggactgaagtacaagcctgtgtgcaatcaagtggagtgccatccctacctgaaccagtccaaactgctggatttctgcaaaagcaaggatatagtgttagtcgcacactctgcactcggaacacagcgacacaaattgtgggtggatcccaactcccctgtgttgctggaagatcccgtgctttgtgctcttgctaagaagcacaaacaaacgcccgccctgatagctctgaggtatcagctgcagcggggagttgtggtcctggccaagtcatacaatgagcagcgcatcagagaaaatattcaggttttcgaatttcagctgacatctgaggacatgaaagtgctcgacggactgaatcgcaattatcggtatgtagttatggactttcttatggaccatccggactacccattctccgatgagtactag

SEQ ID NO: 107868 - DNA, 972 bp, Artificial Sequence
  Description of Artificial Sequence: Synthetic coding sequence
atggatcctaaataccaacgcgtggagttgaacgacggacatttcatgcccgttctcggcttcggtacttacgcaccccccgaagtcccccggaatagggccgtggaggttacgaagctggctattgaggccggatttcgccatatcgattctgcctacctctacaataacgaggagcaggttggtctggctattcgtagcaagatcgccgatggatctgtgaaacgagaagacatcttctacacctccaagctgtggtgcactttcttccagccacagatggtacagccagccctggagtcttctctgaagaagctgcagctggactacgtggacctgtatctgctccatttccctatggctctgaagccaggcgaaacgccgctacccaaagatgagaacggaaaagtgatattcgatacggtagacctgagtgctacttgggaagtgatggaaaaatgtaaagacgcaggattggctaagtcaattggggtgagtaacttcaactgtcgccagttagaaatgatcttgaacaaaccaggactgaagtataagcccgtctgtaaccaagtcgagtgtcatccttatctcaatcaaagcaagctcctggacttttgcaagagcaaagatatagtactcgtcgcccactccgcattggggacacagcgtcacaaactgtgggtggaccccaatagtcctgtcttactcgaggatccagtgttgtgcgcccttgccaagaaacacaaacagactcctgcccttattgccctgcgctaccaactgcagcggggagtggtggtgttggccaagagctataacgaacagagaatccgggagaacatccaggtcttcgagttccagctgacatccgaggatatgaaagtactcgacggactcaaccgtaactatcgctacgtagtaatggattttctaatggatcacccagactatcccttttcagacgagtattag

SEQ ID NO: 107869 - DNA, 381 bp, Artificial Sequence
  Description of Artificial Sequence: Synthetic coding sequence
atggatcccaaataccagcgggtcgagctgaatgacggtcactttatgcctgtgctcggctttggcacctacgcaccacccgaggtccctagaaatcgtgcagttgaggttaccaagctggccattgaagcggggtttcggcacatcgactccgcatacctgtacaacaatgaggaacaggttgggctcgctatccgctccaagatcgccgatggctccgtgaaacgtgaggacattttctatacgagcaagctctggtgcacctttttccagccccagatggtgcaaccagctttagaaagtagtctcaagaagctccagctggattatgtggatctgtacttgctgcattttcctatggctctgaaaagtacaacctag

SEQ ID NO: 107870 - DNA, 981 bp, Artificial Sequence
  Description of Artificial Sequence: Synthetic coding sequence
atggacctaagcgcagcaagccataggatccctttgtctgacggaaactccatccccatcatcggactgggcacatactcggagcctaagtccacacccaagggtgcttgcgccacatccgtgaaagtggcgattgacacgggttacagacacatagacggcgcatacatctaccagaacgagcatgaggtgggtgaagcaatccgcgagaagatcgcagaaggaaaggtgcggcgggaagacatcttctattgtgggaagctttgggctactaatcacgtgcccgaaatggttcggccaaccctcgagagaacactgcgtgtactgcagttggattacgtggatttgtacattatagaagtgcccatggccttcaagccaggcgacgaaatctaccctagagacgagaatggtaagtggctgtatcacaaatcaaatttgtgcgcaacctgggaggcaatggaagcctgcaaagacgctggcttggttaaatccctcggagtatcgaacttcaatcgcaggcaacttgagcttattttgaacaagcccggcttgaagcacaagccagtaagcaatcaggtcgaatgccatccttacttcacacagcctaaactgctgaagttctgtcagcagcatgacatcgtgataactgcctattctccactgggcacctcacgcaaccccatttgggtaaacgttagcagtccacctctcctgaaggatgccctcctaaatagcctgggaaagaggtataacaaaaccgccgcccagatagtgctccgttttaacatccaacgcggtgtggtggtcattccaaagtctttcaacttggagaggatcaaggaaaatttccagattttcgatttcagtttgactgaggaggagatgaaggatatcgaggcactcaacaaaaacgttagatttgttgagctactgatgtggcgtgaccaccctgaatacccctttcacgacgagtactag

SEQ ID NO: 107871 - DNA, 441 bp, Artificial Sequence
  Description of Artificial Sequence: Synthetic coding sequence
atggcatttaagccgggtgatgaaatctatcccagggatgagaacggcaagtggctataccacaagagtaatctttgcgccacttgggaagccatggaagcctgcaaggacgctgggcttgtcaagtctcttggtgtaagcaactttaacaggcgccagctggagctgatcttaaataagcctggcctcaaacataaacccgtgagtaaccaggtcgagtgtcacccctactttacccagccaaagctgctgaagttctgccaacagcacgacatcgtgattacagcctattcgccactggggacctcacgcaatcccatatggcgacagctccataagctggccctcttggacctgccaatcctcagggtcacattgcactccgttcataccctgcactccgagaaactggtaacgggcgaccttcagtgtcctgggtag

SEQ ID NO: 107872 - DNA, 672 bp, Artificial Sequence
  Description of Artificial Sequence: Synthetic coding sequence
atggcgcacagattccctgctttgacgcaggagcaaaaaaaagattcccagggaaagctcttccggaacatcctaaaagagaaagggattgtcgttggtatcaagctggatcagggcggagcccctttagccgggaccaacaaagagacaacaatccaggggctcgatggcctgtctgagcggtgtgcccagtataagaaggacggtgttgacttcgggaaatggcgcgccgtgctgcgcattgcggatcagtgccccagctccctggcaatccaggaaaacgccaacgccttggctaggtatgcatctatatgccagcagaatggtcttgtaccaattgtggaaccagaagtcataccagatggcgatcatgatctggagcactgtcagtacgtaactgaaaaagtgttggcagctgtgtataaagcgctcaacgaccaccacgtctacctggagggcacactgctgaaacctaatatggttaccgccggtcatgcctgtaccaagaagtacacaccagagcaggtcgccatggctaccgttaccgctttgcacagaacagtccccgccgctgtccctggtatctgcttcttatcagggggcatgtcagaagaagacgcaacactgaacctgaacgccattcccacacgcgtgcaatgtccgcccgcgtag

SEQ ID NO: 107873 - DNA, 1095 bp, Artificial Sequence
  Description of Artificial Sequence: Synthetic coding sequence
atggcccaccggtttccagcattgactcaggagcaaaaaaaagaattgtcggaaatcgcccagtccatagttgccaatgggaaggggattctcgcagccgacgaaagcgtcggcacaatgggaaatcggctccagcgcattaaagttgagaacacagaagagaatagaaggcagtttagagagatattgttttcagtggattcaagtattaatcagtcaattggcggtgtcattctcttccatgaaaccctgtaccagaaggattcccagggcaagctgtttaggaatatattaaaagagaaggggattgtagtgggtattaaactagaccagggaggtgcaccactggcaggcaccaataaagagacgactatccaagggctagacgggctgtccgaaagatgtgcacaatataagaaagacggcgtggatttcggcaagtggagagccgtcctacggatcgcagatcaatgtcccagttcgcttgctatccaggaaaacgcaaacgctctggcacgctacgccagcatctgtcagcagaacggtttagtgcctattgtagaacctgaggtgatccccgacggagatcacgacctggaacactgccagtacgtgaccgaaaaagtgttggccgccgtttataaggcactgaacgatcaccatgtttacctggaaggcacccttctgaaacccaatatggttacagctggacacgcttgtaccaagaagtatacccccgagcaggtggcgatggctacggtgaccgccttgcacaggaccgtgcctgcggcggtgcccggcatttgtttcttatccggcggaatgtctgaagaggatgccacactgaatctgaatgccatcaatctgtgccccctgcccaagccttggaaactgtcattctcatacgggcgcgctctgcaggcatccgcgttggccgcctggggcggcaaggccgctaacaaggaggcaacgcaggaagcattcatgaagcgggctatggccaattgtcaagccgccaaggggcagtacgtacacactgggagctcaggcgcggcttcaactcaatcattgtttactgcctgttatacatactag

SEQ ID NO: 107874 - DNA, 951 bp, Artificial Sequence
  Description of Artificial Sequence: Synthetic coding sequence
atggctcaccgatttccggccttaacacaagagcaaaaaaaggagttgtcagagatagcccagagtatagtcgccaatggcaaggggatattggctgctgacgagagcgtgggaactatgggcaatcgcttgcagagaatcaaggtggagaacacagaggaaaatcggagacaattccgggagatcctgttcagtgtcgactcttcgattaaccagtcaatcggtggagtgattctgttccacgagaccctttaccaaaaggatagccagggaaagttattccggaatatcttgaaggaaaaaggtatcgtcgtgggcattaagctcgatcaagggggggcaccgctcgccggaaccaacaaagagaccaccattcagggactcgatggcctaagcgaacgctgtgctcagtacaagaaggacggtgtggattttggcaagtggcgcgctgtccttcgcatcgctgaccaatgccctagcagcctggcaatccaagagaatgccaacgccttggcccgctatgcctcgatctgtcagcagaacgggcttgtacccatcgtggagccagaggtcattcccgatggcgatcacgatctcgagcactgtcagtacgtgactgaaaaggtcctggctgcagtatacaaagcactgaacgatcaccacgtctatctcgagggaacactgctcaagcctaatatggttacagcgggacacgcatgcaccaaaaagtatactcccgaacaggttgcgatggcaacggttactgcgctccacagaactgttcccgccgctgtcccaggaatctgtttcctctccgggggtatgagtgaagaggatgctacactcaacctcaatgctattaacttatgccccctcccaaaaccctggaaactatcctttagcggtgtggcccgcctacaaactcgtcgacagcccaggcggctgctttag

SEQ ID NO: 107875 - DNA, 1947 bp, Artificial Sequence
  Description of Artificial Sequence: Synthetic coding sequence
atggtatccctgccccctccacagtcagacgtaaccttaccagggccaactaggcttgaaggagagcggcagggagacctgatgcaagcacctgggctgccaggttcacctgctccccagtccaagcacgccggattctcatgctcctcgtttgtgagtgatggaccccccgaaagaactccttcactgcctcctcactctcctcggatagcctcacctggtcctgagcaggtgcaggggcactgtcctgctggtccaggcccgggaccatttcggctgtctcctagtgataaatatcctgggtttggcttcgaagaagccgccgcatctagcccaggccggtttctcaagggtagccacgccccgtttcacccgtacaaacgccccttccacgaagacgtttttccagaagccgaaaccactctggctctgaaagggcattcatttaagacccccggacctctcgaagcctttgaggaaattcccgtggatgtggccgaagccgaggcatttctgccaggcttctccgctgaggcctggtgcaacggcctgccgtatccctctcaggaacacggaccacaggtcctgggcagcgaggtaaaagtaaagccacctgtccttgagtccggagccggaatgttttgctatcagcccccattgcaacacatgtactgctcctctcagccgccatttcaccaatatagccctggcggcggcagctacccaataccatatctggggtcatctcattatcagtatcagcgaatggccccacaagcatcaacagatggccaccagcccctgttcccaaagcccatctattcatattcaatcctaattttcatggcacttaaaaactctaagaccggaagtctgccagtgtccgagatctacaacttcatgacagagcacttcccttacttcaaaactgctccggatgggtggaagaactccgttcgacacaacttgtctctgaataagtgctttgaaaaagtggaaaacaagagcggatcttccagcaggaaaggctgcctgtgggctcttaatcctgctaagattgataaaatgcaggaagaattacaaaagtggaaaaggaaagatcctattgcggtgaggaaatctatggccaaacctgaagagttggactcactgataggcgataagagggagaaactcggctcaccactgttaggatgtccccctcccggtttatccggaagcggtccgatccggcctctggcacctcctgccggcctttccccccccctccatagcctccacccggcaccgggcccaatcccaggcaaaaaccccctgcaggatcttttgatgggccacacccccagttgctatggacagacttaccttcatctgtcacccggcctcgcacccccagggcctccgcaaccactattcccccagcctgatgggcatttggagttgcgtgcccaacccggcactccacaggactctccgcttcccgctcatactcccccatctcattcagctaagctactagcggagccctcaccagcacggacgatgcacgacactctgctgcccgacggcgatcttggtacagacctggatgctatcaatcctagtttgactgacttcgactttcagggaaacctctgggagcaactcaaagacgattccttagccctggaccccttggtgctggtgacctccagcccaacctcaagcagcatgcctcccccacagcctcctccacactgcttcccccccggaccatgtctgacagagactggatcgggcgcgggagatctggcagctcctggcagcggtgggagcggagccctcggcgacttgcatcttaccaccctttactccgcgtttatggagctcgaacccacccccccaaccgcaccggcgggtccatcagtatacttaagcccttcctctaaaccagtagccctggcttag

SEQ ID NO: 107876 - DNA, 1095 bp, Artificial Sequence
  Description of Artificial Sequence: Synthetic coding sequence
atgccccactcttatcctgctctttccgcagagcaaaaaaaggaactgagtgacattgctctaagaattgtggccccaggaaagggaatcttagcagctgacgaatcagtgggtagtatggcaaagaggctctcccagatcggagtggaaaacacggaggaaaaccggagactgtaccgccaggtcctattttcagcagacgatcgagtgaagaagtgcatcggaggggtaatcttcttccatgaaaccctatatcagaaggacgataacggcgttccgttcgtgcgcacaattcaggataagggcattgtagtaggaattaaagtcgacaaaggcgtcgtgccacttgcgggaactgatggtgagaccaccacccagggcctggacggcctgtctgagaggtgtgctcagtacaaaaaggatggggccgacttcgccaagtggagatgtgtgctgaagatcagcgagaggaccccctctgcccttgcgattcttgaaaatgccaatgtgctcgctcggtatgcctccatctgccagcagaatgggatcgtgcccatcgtagagcccgaaatcttgccagacggcgaccacgacctgaagaggtgccaatatgtcactgaaaaggtgttggcagcagtttacaaggccctgtccgaccaccatgtgtatctcgagggaacactactcaaaccaaacatggttacgcccggccatgcatgccccatcaagtacacccctgaggagattgccatggcaacagtcaccgcgctcagaagaacggtccccccagctgtccctggcgttacgtttctttcagggggacagtctgaagaagaggcctctttcaaccttaacgcaatcaatcgatgtccgctgccaagaccttgggcactgaccttttcttacggacgagcactgcaggcctctgctctaaatgcctggcgggggcagcgtgacaacgccggtgctgctactgaggagtttataaaaagggccgaggtgaacggtcttgctgcacagggcaagtacgagggttctggtgaagatgggggcgcagctgcccagtctctgtacattgcaaatcatgcatactag

SEQ ID NO: 107877 - DNA, 450 bp, Artificial Sequence
  Description of Artificial Sequence: Synthetic coding sequence
atgccccactcttaccctgcactgtccgctgagcagaagaaagagctgagtgatattgccttacgaatcgtcgccccaggaaaaggaattctggctgccgacgagagtgtcgggtctatggcgaagagactgagtcaaataggggtggagaatactgaggaaaatcggcgactgtacagacaggtcttgttttccgctgatgacagagttaagaagtgcattggtggagttattttcttccacgagacactgtaccagaaggacgacaatggggtgcccttcgtacgtacaatccaggacaaaggaattgtcgtggggatcaaagtggataagggggtagtgccactcgcaggtacagatggagaaacgaccacccagggcttagatggattgagcgaacgatgtgcccaatacaagaaagatggcgcagattttgccaagtggcgctag

SEQ ID NO: 107878 - DNA, 795 bp, Artificial Sequence
  Description of Artificial Sequence: Synthetic coding sequence
atgccctctatctttgcttaccaatcctctgaggtcgactggtgcgaaagcaactttcagtactcagagctggttgctgagttttataacaccttctctaacatcccattctttatctttggccccctcatgatgctcctgatgcacccatacgcacaaaaaaggagcaggtatatttacgtggtgtgggtattgtttatgataatcggtttgttctctatgtattttcacatgacgctgtcttttctgggtcagctgcttgacgagattgctattctgtggctactggggtctggctactccatttggatgcccaggtgctactttccatccttcctgggcggaaacagaagtcagttcatcagactggtctttatcactaccgtggtaagcacactgctgtctttcttgcggccgactgtgaatgcctatgctttgaacagcattgcactgcacatcttgtacatagtatgccaggagtatcggaaaacatctaataaggaactgagacatctgatcgaggtcagtgtcgttctgtgggctgtagcccttacaagttggattagcgacagactgttgtgtagtttctggcagaggattcacttcttttacctgcattccatatggcacgtgctgatttcaatcacattcccctacgggatggtcactatggctctggtagacgccaactatgaaatgccgggggagacgttgaaagtgagatactggccgcgtgactcctggccagtgggactgccatacgtggagatcagaggggatgacaaggattgttag

SEQ ID NO: 107879 - DNA, 828 bp, Artificial Sequence
  Description of Artificial Sequence: Synthetic coding sequence
atgggcgctccgcactggtgggaccaattacaggccggatcatcagaagtggactggtgcgaagataattatactatcgttccagcaatagccgagttttataacacgatcagtaatgtcctttttttcatcctgcctcccatttgcatgtgtctgtttcgccagtacgccacctgcttcaatagcgggatttatctgatttggaccctcctggtcgttgtgggcatcggatccgtgtacttccacgccactcttagttttctagggcagatgctggacgagcttgctgtgctttgggttttgatgtgcgccctagcaatgtggtttccccggagatacttacctaagatttttagaaatgatcgcggtaggttcaaagtggttgtttccgtcttaagtgccgtaactacatgtttggcttttgttaagcctgctattaataacatctcattgatgaccttaggcgtgccgtgcaccgcactgctgatagcagagctgaagcgctgtgataatatgcgggtgttcaagctgggcttgtttagcgggctgtggtggaccctggccctgttttgttggatttctgaccgcgctttttgtgaattactttcttcttttaactttccatatctgcactgcatgtggcacattctcatttgtttggcagcgtacctcggttgtgtgtgctttgcctatttcgacgctgcatctgagatccccgaacaaggccccgtaattaagttttggccgaatgaaaagtgggccttcatcggagtcccctatgtctctctgctctgtgccaacaagaagtcttctgtcaagattacatag

SEQ ID NO: 107880 - DNA, 423 bp, Artificial Sequence
  Description of Artificial Sequence: Synthetic coding sequence
atgtgtcttttcaggcagtacgcaacctgtttcaatagcggcatttaccttatttggacactcctcgtcgtagtagggattggctccgtgtacttccatgctacgttgtcctttctgggccagatgttggatgagttagcagtgctatgggtgctcatgtgcgctctggctatgtggtttccgagacgatatctgccgaaaatttttcgtaacgataggggtagatttaaagtggtggtgtccgtgttatcggccgtgacaacttgcctggcgttcgtgaagccagctatcaacaacatatcattaatgaccctcggcgtcccgtgcacggctctcctcatcgcagaacttaagcgccacgagcgcaatcagagacgcaggcaccggaaaggcggacaacagggggggggagataaggtctag

SEQ ID NO: 107881 - DNA, 1587 bp, Artificial Sequence
  Description of Artificial Sequence: Synthetic coding sequence
atgcaaggcccttgggtactcctccttcttggactgcgattgcagctgtcactcggtgttatccccgcagaggaagaaaatcccgcattctggaacagacaggccgcagaggccttggatgcagctaaaaagctgcagccaattcagaaggtggcaaaaaacctgatcctcttcctcggtgatgggctgggcgtgccgaccgttaccgcaacaaggatcttaaagggccagaagaatggtaaactcggcccagaaactcctctggccatggatcgctttccttatctggcactgagcaagacgtataatgtggaccgacaggtgcctgattctgccgccacggcaacggcttatttgtgcggagtgaaagctaacttccagacaatcgggctctctgcagccgcgaggttcaaccaatgcaatacaacccgcggcaacgaggtcattagcgtgatgaaccgggccaagcaagccgggaaatcagtgggagtggttaccacaacccgcgtccaacatgctagtccagcaggaacatatgcccacaccgtcaatcggaactggtactccgacgctgatatgccggcatcagcaaggcaggaagggtgtcaagacatagctacgcagcttatcagcaatatggacattgacgtgatcctgggcgggggacggaagtacatgttccccatgggcacccccgaccctgagtacccagccgacgcctctcaaaatgggattagacttgatggcaagaatctagttcaggagtggctagctaaacatcagggtgcctggtacgtatggaataggacagaactgatgcaggcgagcctggatcagagtgttactcatctcatgggactgtttgaacctggagataccaaatatgaaattcaccgcgaccccaccctcgacccttccctcatggagatgacagaggccgccctccgcctcctcagccgcaatcctcggggattttacctttttgttgagggcggacgcatagatcatggacaccacgaaggggtggcttatcaagcactgaccgaggccgtgatgtttgacgatgccattgagcgtgccggacagctgacgagtgaagaagacacactgaccttggtgactgctgaccattcccacgtgttcagctttggaggctacacccttaggggaagctcaatttttgggctggctccgagcaaggcacaggatagcaaagcctatacatcaatcctgtacggtaatgggcccgggtacgtgtttaatagcggggtcaggcctgacgttaacgaatccgagagcggcagccccgactatcagcagcaagctgcagtgcctctttcttccgagacccatggaggagaggatgtggcggtgttcgcccgtggcccccaggcccacctagtgcacggggttcaggagcagtcattcgtggcccatgtgatggccttcgctgcctgtttagagccgtacacagcgtgtgatctggcgcctccagcgtgtacaacagatgctgcccatcccgttgctgcatctctccctcttttggctggaaccctgcttttgctgggcgcctccgccgcaccgtag

SEQ ID NO: 107882 - DNA, 513 bp, Artificial Sequence
  Description of Artificial Sequence: Synthetic coding sequence
atggaccgcgccatcggtcaggctggttcactgactagctctgaggacaccctgaccgtcgtgaccgctgaccatagtcatgtattcacttttgggggatacacacccaggggaaactccatctttggacttgctccgatgctgagcgataccgataagaagccatttaccgcgatcctgtatgggaacggccccggatacaaggtcgtggggggcgaacgcgaaaatgtgagcatggttgattatgcacacaataattatcaggcacagtccgccgtcccgctccggcacgagactcatggcggagaggacgtggccgtgttctcaaagggaccaatggcccacttgctccacggagtgcatgagcagaactatgtgccccacgtgatggcatacgcggcttgcattggcgcgaatctgggtcattgcgctcctgcctcgtccgctggaagtctcgctgccgggcccctgctacttgcgctagcgctgtatcccctcagcgttctcttttag

SEQ ID NO: 107883 - DNA, 513 bp, Artificial Sequence
  Description of Artificial Sequence: Synthetic coding sequence
atggatcgcgccattggtcaggctgggtcacttacaagctccgaggacacgctgacagtggtcacggcggatcactcacacgtgtttacgtttggcggctacacccccaggggcaacagtattttcggtctcgctcccatgttatctgacaccgataagaaaccctttactgcaatcttatacggaaatggtccgggttacaaggtagtcggaggcgaaagagagaacgtaagcatggtggattatgcccacaataactaccaagcacagtctgctgtccctctgcggcacgagactcatggaggggaggatgttgctgtgttctctaaaggaccaatggctcatcttttgcatggggtccacgaacaaaactatgtccctcacgtaatggcttatgccgcatgcatcggtgctaacctcggccactgcgccccggcaagcagtgctgggagtctcgccgctggacccctcctcctggccctcgccctgtatccactcagcgtgctcttctag

SEQ ID NO: 107884 - DNA, 1575 bp, Artificial Sequence
  Description of Artificial Sequence: Synthetic coding sequence
atgatttcaccattcctcgtcctcgctattgggacctgtctgacgaacagtcttgtcccagaaaaagaaaaagacccaaagtactggcgcgatcaagcccaggagacccttaaatacgccttagaactccagaagctgaacactaatgtggctaaaaacgttataatgttcctgggagacggaatgggcgtcagtactgtgactgctgctcgtatccttaaagggcagctccatcacaatcctggcgaggagacaagactcgaaatggacaagttccccttcgtggctctgtcaaaaacctacaataccaacgcccaagtcccagactccgctggcactgccactgcttacctttgcggagtgaaagctaacgagggaacagtgggcgtgagcgccgccacggaacgatcgagatgcaatacaacccaggggaacgaggtaacctctattctgcggtgggcaaaggacgcaggtaagtccgtgggtatcgtgaccacaactagggtaaatcatgccaccccaagcgccgcttacgctcattccgcagatagggactggtacagcgataatgaaatgccacctgaagcactgtcccaaggatgcaaagatattgcgtaccagctcatgcacaatattcgcgatattgacgtcatcatggggggtggacggaaatacatgtatccaaagaacaagacagacgttgagtatgaaagcgatgaaaaggctcggggaacaagacttgacggcttagatctcgtcgatacctggaagtctttcaagccccgttataagcacagccactttatctggaatagaactgaactgctgacgttagatccccacaacgtggactaccttctggggctgtttgagcccggcgatatgcagtatgagctgaatcgtaataatgtaacagacccaagtctgtcagagatggtcgtggtggcaattcagatccttcgtaagaatccgaagggcttttttctcctggtggagggtgggcggattgaccacgggcaccacgaaggaaaggctaagcaggccttgcacgaagccgttgagatggatcgggcaatcggccaagcgggcagcctgacctcctccgaagacacactaaccgtagtaacagccgaccactcgcatgtatttacttttggtggttacaccccaaggggtaactctatctttggactcgctcccatgctctcagacaccgataagaagcccttcaccgctatactgtacgggaatggtccaggctacaaagtcgtgggcggggaacgtgaaaacgtttctatggtggactacgcacacaacaactaccaggcccaatcagccgtgcccctgagacacgaaacacatggtggggaagacgtggccgtgttcagcaaggggcctatggcgcatttactgcacggggtgcacgagcagaattacgtcccacacgtcatggcttacgcagcttgcatcggcgccaatctcggccactgcgcccccgcaagtagcgccggcagcttagccgcagggcccctgctgttggcactagccctgtaccccctttccgtacttttctag

SEQ ID NO: 107885 - DNA, 1575 bp, Artificial Sequence
  Description of Artificial Sequence: Synthetic coding sequence
atgatttcgcctttcctcgtgctggccattggcacatgccttaccaatagcctcgtgcccgaaaaagaaaaggatccgaaatattggagagatcaggctcaagaaacattaaagtacgcactggaattacagaagttgaacacaaatgtggccaagaatgtaattatgtttttgggagacggaatgggagtgtcgactgtaacagccgctcgaatcctgaagggccagctccaccacaatccaggggaagagactcggctagagatggacaaattcccctttgtggccctgagtaaaacatacaataccaatgctcaggtaccggattctgccgggaccgccacagcttatctttgtggagtgaaagcgaacgaaggcaccgtgggagtttcagctgcaaccgagagatcaaggtgtaatacaacgcaaggtaatgaggtgacctccattttgagatgggccaaggacgcaggtaaaagtgtgggcatcgttacaacaacccgcgttaaccacgccactcccagtgctgcttatgcccatagtgccgacagggattggtattcggacaatgaaatgcctcctgaagctctgagccagggttgtaaggatatcgcctaccagctcatgcataacattagggacattgatgtaattatgggaggtggcagaaaatatatgtatcctaagaataagacagacgtggagtatgagagtgatgagaaagcacgtgggactcggctcgatggacttgacctggtagatacctggaaatcttttaaaccaaggtacaagcactcccactttatctggaaccgaactgaactgctaacactggatccacataatgtggattatttgctgggactgttcgaacccggcgacatgcaatacgagcttaatagaaacaatgtgacagacccttcgctgtctgaaatggttgttgttgccatacagatcctgcggaaaaaccctaaggggttcttcctgcttgtggaaggaggacgcatcgaccacggacatcacgaggggaaggccaaacaggccctgcacgaagcagttgagatggatcgcgccattggacaagccggttccttgacctcctccgaagacacactgactgtggttaccgccgatcattcacacgtcttcacatttggcggctacacccctcggggcaacagtatttttgggctggctcctatgctgagcgacacggataaaaaacctttcacagccatcctttacgggaacgggcccggatataaggtggtcggaggcgaacgtgagaacgtttcaatggtagattacgcccacaataactaccaagcccagtctgctgtgcctttgcgccatgaaactcacggcggtgaggatgtggcggtgttcagtaaaggccctatggctcacttactacatggggtgcacgagcagaattacgtgccgcacgtgatggcctacgcggcttgcattggcgccaacttagggcactgcgctcctgcctcgagcgccggatcattggcagcaggtcccctgctgcttgctcttgccttatatccactgagcgtgctcttttag

SEQ ID NO: 107886 - DNA, 1575 bp, Artificial Sequence
  Description of Artificial Sequence: Synthetic coding sequence
atgatcagcccatttctggtgctcgccatagggacctgcctcacaaatagtttggtgcccgagaaagaaaaagatccgaaatattggagggatcaagctcaggagactctcaaatacgctctcgagcttcaaaaactcaataccaacgtggcgaagaatgtgatcatgttccttggagatggtatgggggtgtcaactgtcaccgccgccagaattctgaaagggcagttgcaccacaaccccggggaggagaccaggttggaaatggacaagttcccatttgtagccctgagtaagacatataatacaaacgcccaggttcctgattccgctgggactgcgactgcctatctgtgcggcgttaaagctaatgaaggaacggtgggagtcagtgccgcaactgagcgaagcagatgcaacaccacccagggaaacgaggtcacatcaattcttaggtgggccaaggatgctggtaagtcagtcgggattgtgacgacaacacgggtgaaccatgctacgccttccgccgcgtacgcccattcagccgatagggactggtacagcgacaacgagatgccaccggaagctttgtcacaggggtgcaaggacatcgcgtaccagctgatgcacaacattagggacatcgacgtgattatgggcgggggcaggaagtacatgtatcctaagaacaaaaccgacgtggagtacgaatctgatgagaaagcaaggggtactcgcctcgacgggcttgatcttgtcgatacttggaaatctttcaaaccccggtacaagcattcccattttatttggaatagaacagagctcctgaccctcgatccacacaacgtggattatcttctgggtctgttcgagcctggagacatgcagtatgaacttaaccgcaataacgtgactgacccctcattatccgagatggtagtggttgccattcaaatcttacgcaaaaatcccaaaggattctttttgctggttgagggcggacggatcgaccacggccaccacgaaggcaaagctaagcaggctcttcacgaagccgtagaaatggatagagctatcggtcaggccggctctctgaccagtagcgaagacactctgacagtcgtcactgcagaccactcccacgtttttacatttggaggttacactcccagaggcaactcaatttttggcctggctcccatgttgagtgataccgataagaaaccctttaccgctattctgtatggaaacggcccgggttataaggtcgttggcggcgagagagagaatgtttcaatggtggattacgcccacaacaactatcaagcacagagtgccgttccactgcgacacgaaacccacgggggggaggacgttgctgtgttcagtaaaggacctatggctcacctattacatggcgtgcacgaacagaattacgtcccgcatgtcatggcatatgctgcctgtatcggtgctaatctaggacattgtgctccagcttcctccgctggaagtctggcagccgggcctctgcttctggccctcgctctgtatcctttgtctgttctcttttag

SEQ ID NO: 107887 - DNA, 1344 bp, Artificial Sequence
  Description of Artificial Sequence: Synthetic coding sequence
atgccttggtcctttcgcagctcaacgccaacctggctacgaatgagctcctgctcatgggagatgacatacaataccaacgcccaggtccccgatagtgccgggaccgctacagcatacctatgtggagtgaaggcaaacgaaggcacagtcggtgtgtcagccgccactgaaagatcccgctgcaacactacgcaaggcaacgaggttacttctatactgaggtgggccaaagacgctggaaagtccgtcggtattgtgacaactacccgagttaatcacgctactccgagcgctgcgtatgcacatagcgctgatagagattggtattcagataatgagatgccccccgaggccctctcacagggatgcaaggacattgcataccagcttatgcacaatattcgggacattgacgtgattatgggagggggcaggaagtatatgtatccaaaaaacaagaccgatgtagagtacgagagtgatgaaaaggcacgtggaaccaggttagacggcctggacttagttgacacttggaagagctttaaaccacgttacaagcactcccattttatctggaacagaactgagcttctcacactggatcctcataatgttgactacctcctgggtctgtttgagccaggagacatgcagtacgagctaaacagaaacaatgtcacggatcccagcctgtccgagatggtggtggttgccatccaaattttacggaaaaatccgaagggattcttcctgcttgtagaaggtggaagaatcgatcatggccaccatgagggtaaagctaagcaggccctgcatgaagctgtggaaatggatcgggctatcggccaggcgggttcattgaccagctcagaagataccctcaccgtggtcaccgccgatcactcgcacgtctttaccttcggaggctacactccgagaggcaattctattttcggactggcccccatgctgtccgacacggacaaaaagcctttcacagcaatcttgtacggcaacggtcctggctataaggtggtgggtggcgagagggagaacgtcagcatggtggattacgcgcacaataattaccaggcccagtccgctgtgcctctgcggcatgaaacccacggaggggaggatgttgcagttttttcaaagggccctatggcccatttgctgcacggggttcatgagcaaaattatgtgccacatgtcatggcttatgctgcctgtatcggggccaatctgggccactgcgcccccgcctcttcggctggatctctggcagccggcccgcttcttctcgccctcgcactgtacccactgtcagtccttttctag

SEQ ID NO: 107888 - DNA, 1410 bp, Artificial Sequence
  Description of Artificial Sequence: Synthetic coding sequence
atgttccttggtgacggaatgggagtctctacagttacagccgctcgtatattaaagggccaactccaccataatccaggcgaggagacccgactggagatggataagtttcctttcgttgcactgagtaaaacctataacacaaatgcacaggtccctgacagcgccgggacggctactgcttatctatgcggcgtgaaggcaaacgaaggaaccgtcggcgtgtcagctgctacagaaaggagccgctgcaatactacccaggggaatgaagtgacttcaattttaagatgggccaaggacgctggcaaatccgttggaatcgtgaccacgactcgagtgaaccacgcaacgccttcagcggcctatgcacacagcgctgaccgcgattggtattctgataacgagatgccacccgaggctttgtcccagggctgcaaggacatcgcctaccagctgatgcacaacatccgagacatcgatgtcattatggggggaggacggaagtacatgtacccaaagaataagactgatgtggagtacgaatcagatgagaaagcccgcggaacgaggttggatggactggatctggttgacacttggaaaagtttcaaacctcgctacaagcactctcatttcatatggaatagaaccgaactactgacgttggacccccataacgtagattatctgctgggactctttgaacctggggacatgcagtacgaactgaataggaacaatgtgaccgacccctcactgtctgagatggttgtggttgcaattcagatcctgcgcaagaacccaaaagggttcttcctgctggttgaaggcggtcggatcgaccatggacaccacgaaggaaaggcaaagcaggccctccatgaagccgttgagatggatagagctatcgggcaggcaggtagcctcacgagcagtgaggatactttgacagtggtgacggccgaccactcacacgtgttcacctttggtggttacacccctagaggtaatagcatcttcggccttgcccccatgctatctgataccgacaagaagccgtttacagccatcctgtatggcaatggccccggctataaggtagttggcggggagcgggaaaatgtctctatggtggattacgctcataacaactatcaagctcaaagcgccgttcccttgcggcatgagactcacggaggagaagatgttgcggtgtttagcaagggaccgatggcacacctgctgcatggcgtgcacgagcagaactatgtgccacatgtgatggcctatgccgcctgtattggcgcaaatctgggtcactgtgcccctgcttcctcagcaggcagcctcgccgccggccccctgctgctggctctggcgctgtatcctctgtccgtcctgttttag

SEQ ID NO: 107889 - DNA, 1608 bp, Artificial Sequence
  Description of Artificial Sequence: Synthetic coding sequence
atgctgggtccttgtatgctcttgttacttctgctgctaggcctgaggctgcagctgtcccttggtataatacctgtcgaggaggaaaaccccgacttctggaacagagaggccgccgaggctctcggggcggccaagaagttgcagccggctcagaccgccgccaaaaatctgatcatcttcttgggcgatggcatgggagtgtcaaccgtcaccgccgcgaggatcctcaagggccagaaaaaagataaattagggccagagatccccctggcaatggacagattcccttatgtggccttgtccaagacgtataatgtggataaacacgttccagactcaggagctaccgctaccgcctacttatgtggagtgaagggaaactttcagactatcgggctcagcgcagctgcccgtttcaaccagtgtaataccacaagagggaacgaggttattagcgttatgaaccgcgcaaaaaaagccgggaagagtgttggtgtggtcactaccactcgagtgcagcacgcgtctcccgcaggaacctatgcacacaccgtaaaccgaaattggtacagcgacgcggatgtaccggcctccgctaggcaagaaggatgtcaggacatcgctactcaactgatctctaatatggacatagatgtaatactggggggcggtcgaaaatatatgtttcggatgggcaccccagatcccgaatacccagacgattatagtcagggcggcacaaggcttgacggaaaaaatctggtccaggagtggctggccaagcgccagggagctaggtacgtgtggaacagaactgaactaatgcaggctagcctggaccccagtgttacacacctaatggggctgttcgagcccggagacatgaagtatgaaatacaccgcgacagcacactggacccgtctctgatggagatgacagaagctgcgcttagactcctctcacgaaatccgcgtggattttttctgtttgtggaggggggaagaatagaccatgggcatcacgagtcccgagcttaccgcgcccttaccgagactatcatgttcgatgatgccatcgaacgggcagggcaacttacttctgaagaggacactttatcattagtcacagctgaccactcccatgtgttctcattcggcggctatccacttaggggctcctctatcttcggtctcgcacctgggaaagccagggacagaaaggcatacaccgtcctgttatacgggaatggccctggctacgtgctgaaagatggggcccggcccgacgtgacagaaagcgagagtgggtcccctgaataccgacaacagagcgcagtgccactggacgaagagacccacgctggtgaggacgtggcagtattcgctagaggcccccaagcgcacctggtacacggcgtgcaggagcagacctttattgcccacgtgatggccttcgccgcctgcctcgagccatatacagcttgcgatcttgcccctccagccgggacaactgatgcggcccaccccggtcggagcgtcgtgcctgctctcttaccgttactcgctggaacattacttcttttggaaacggctaccgccccctag

SEQ ID NO: 107890 - DNA, 1599 bp, Artificial Sequence
  Description of Artificial Sequence: Synthetic coding sequence
atgcagggaccctgggttctcctgctgttaggacttcggctacaactgtcactgggaataatccccgttgaggaggagaacccagatttctggaatagacaggctgcagaggcactcggcgcagccaagaagcttcagcctgcacagacagccgccaaaaacctgataatcttccttggcgatggcatgggagtctcaacagtcaccgccgcccgtatactgaaaggtcagaagaaggataaactaggtccagagacatttttggcgatggaccgatttccatatgtcgctctcagcaagacttactcagtggacaaacatgttcccgactccggagccaccgcaacagcctatctgtgcggcgtgaaagggaacttccagaccatcggcttgtccgctgcagcaagattcaaccagtgtaataccactcgagggaatgaggtgatttcggtaatgaatagggccaaaaaggccggaaagtccgtcggggtagtcactactacgcgcgtgcaacacgcctcaccggcgggagcttacgcacatacggtcaacaggaattggtactcagatgctgatgttcccgcatcagctaggcaggaggggtgccaggatatcgcaacacagctaatttctaacatggacattgacgtgattctgggagggggacgcaaatatatgttccccatgggcacccccgaccctgagtaccccgatgattactctcagggcggcaccagactggacggtaagaatctcgttcaggaatggctggctaagcatcaaggtgccagatacgtttggaatcggacggaactcctgcaggcaagtctggacccgtccgttacacatcttatgggcctgttcgaaccaggggacatgaaatacgagatacaccgcgatagcacactggacccttccctcatggaaatgacagaggccgccctgctgctgctgtctaggaaccctcgcggattttttctgtttgtggagggtggcagaatcgatcacggtcatcatgagtctagggcttaccgcgctctgacagaaaccatcatgtttgatgatgcgatcgagagggcagggcagctgacttccgaggaggacaccctgtctctggtgactgcggatcattcgcatgttttttcctttggcgggtatcccctcagaggctctagcatcttcggcctcgctcccggaaaggctagagaccgcaaggcatatactgttttgctttatggcaatgggccaggatacgtcctgaaagatggtgctaggccagacgttacggagagtgaaagtggctcccctgagtacaggcaacagagcgccgtgcccctggacggtgaaacccacgcaggggaggacgtcgctgtctttgcaagaggtccacaggctcacctagtccacggcgttcaagagcaaactttcattgcacacgtgatggcctttgccgcctgccttgaaccatacaccgcatgtgatctcgcccctagggctggcaccacagacgccgcccatcccggaccctctgttgtgcctgcattgttgccgttgcttgctgggacacttctgctgcttggtaccgccaccgccccctag

SEQ ID NO: 107891 - DNA, 474 bp, Artificial Sequence
  Description of Artificial Sequence: Synthetic coding sequence
atggacagatttctcgtgaagggggcacaggggggtctcctgcgcaaacaggaagaacaggaacccaccggggaagaacctgccgtgcttgggggagacaaggagtcaacaagaaagagaccgagacgtgaagcacctgggaacggtggacacagcgccggaccatcttggcggcatattagggccgagggtcttgattgctcatacaccgttctgtttggcaaagcagaggctgatgaaatcttccaggaactggaaaaggaggttgagtactttactggcattaaaatggccgtcaccaccagtggctctacggagatgatgaaggagaattggcctctcggcgcccccctgcccctgagccctagcgtgccagcggagactcttagttcaggtattcgaataccagtgggaaaggccccacctggcggctggcgatggtcaggttgtagatggccaacgggcgcctactag

SEQ ID NO: 107892 - DNA, 2958 bp, Artificial Sequence
  Description of Artificial Sequence: Synthetic coding sequence
atgatacgccatgctggtgcgcctgcgcggggggatcctacaggcccagtgccagtcgttggcaagggggaggaggaggaggaggaagatgggatgcgcctgtgcctccctgccaacccaaaaaattgtctcccccaccggcgaggcatttccatcctggagaaattgatcaagacatgccctgtgtggctgcagctttccctgggccaggctgaggtggcccgcatactccatagagttgttgcgggaatgtttctggtgcgacgcgatagctcttccaagcaattagtgctttgcgtgcattttccctccttgaatgaatcttctgcagaggtcttagaatacacaataaaagaggaaaagtccattctatacttggaaggtagcgcactagtgttcgaggacattttccgactgatcgcattttattgtgtgtctagggatttgttaccgtttacactgcgactccctcaagcaatcctggaagcgtcgtcattcactgatcttgaaacgatagcaaatctcggtttgggcttttgggacagtagcctcaacccaccacaggagcggggcaaacccgcagagccaccccgcgaccgagccccaggcttccctctggtttcttctctgaggcccacagcacacgacgcaaactgcgcatgcgaaattgaactttccgtcggcaacgaccgattatggtttgtgaatcccatattcatcgaggattgttcttctgccctcccaaccgaccaaccccctctgggaaattgcccagcaagaccccttcccccgactagtgatgcaacctcccctacttcgcgttgggctcccaggaggccgcctccacccccgcccgtgctccccctgcagccttgcagtccagcccagccaccagtcctgcccgctcttgcccctgccccagcgtgtcctttgcccacaagccctccagtgccagcccctcatgtgacaccacatgcgcctgggcccccggatcatcctaaccagcctcctatgatgacatgtgaaagactgccctgtcctaccgcagggctcgggccactgagagaagaagccatgaagcccggggccgccagtagccccctccagcaggtacctgcccctcccttgccagcgaagaaaaacctccctaccgcccccccaaggcggcgcgtctcagaacgtgtctcccttgaggaccagtcaccagggatggcagccgagggagaccaactatccctcccaccacagggcactagcgatggccccgaagacacacccagggaaagcacagagcaagggcaagatacagaggtcaaggcttccgatccccactcgatgcccgaactccctaggactgccaagcaaccgcccgtgccaccaccgaggaaaaaaaggatctctagacagctcgctagcacactacccgctcctcttgagaatgcggaactgtgcacccaagcgatggccctggagactcctacaccgggaccaccacgggaaggtcagtcccccgcttcacaggctggtacccagcaccctcctgcccaggcgacagctcatagccagtcaagcccagagtttaagggaagtttggccagcctctccgattccctgggagtgagcgtgatggctacagaccaagactcctactctaccagtagtaccgaggaagagctggagcagttctccagcccgtccgttaaaaaaaaaccgagtatgattctgggcaaggcaagacaccgtctcagctttgcatcattctcatccatgttccatgccttcctgagtaacaacagaaagttgtacaagaaggtggtggaactggcacaagataaagggtcctattttggatccctcgtgcaagactataaggtgtattccctggaaatgatggcacgacagacctcaagcactgaaatgttgcaagagattcgcactatgatgacccaacttaagtcatatcttttgcaatccaccgaattaaaagcgttagtggaccccgctctccatagtgaggaagaactcgaggccatcgtggaaagcgctctgtataagtgcgtcttgaaaccactgaaagaggccataaactcctgtctacaccagatccattctaaagatggctccctgcagcagctgaaggaaaaccagctcgtgatcctcgcaactactaccaccgacctgggagtcaccacctccgtgccagaggttccaatgatggagaagatcctccagaagtttacttctatgcacaaagcgtatagtccagagaaaaaaatctctattcttctcaagacatgcaaactgatatacgactccatggcactcggaaaccccggtaagccatatggggccgacgacttcttacccgtcctgatgtacgtgttggctaggagcaatctgaccgaaatgctgttgaatgtcgagtatatgatggaactgatggaccccgcacttcagttaggcgaaggctcatactaccttactacgacctacggagcattagagcatattaaaagttacgataaaatcacagtcacaagacagttgtcagttgaggtccaagactctattcatagatgggaacgacgccgtacgctgaacaaggccagggcatctcgctctagcgtgcaggacttcatctgtgtgagctacttggaacccgagcaacaggcccggacccttgcttctcgcgctgacacccaggcccaggccctttgcgcgcagtgtgccgagaaatttgccgtggagcgacctcaagcccacaggctcttcgtcctggtggacgggcgctgctttcaacttgctgacgacgctctgcctcattgcataaagggatatctgctgagaagcgagccaaaaagagactttcatttcgtctatagacccttagacggaggcggcgggggtgggggcgggtccccgccttgtctggttgtcagagagcccaacttcctttag

SEQ ID NO: 107893 - DNA, 786 bp, Artificial Sequence
  Description of Artificial Sequence: Synthetic coding sequence
atggacaggttcctggtaaaaggagcccaggggggactcttaagaaagcaagaagaacaagagcccaccggggaggaacccgccgtgctcgggggggataaagaatccactagaaagcgtccccggcgcgaggcccccggcaacggaggccatagtgccgggccaagttggaggcacattcgagcggagggacttgattgcagctatacggtgttatttggaaaggcggaggcagacgaaattttccaggaactggagaaagaggtcgagtactttacgggcgcactggcccgggtgcaggtcttcgggaaatggcattcagtcccgcggaagcaagctacatacggggatgcaggcctgacctacacgtttagtggtcttacgttatctcccaagccctggatccccgtcttagaacggatacgcgaccatgtgtccggtgtaacgggccagaccttcaacttcgtcttaatcaaccgctacaaagacgggtgcgatcacattggcgagcacagggacgatgagcgagagctggcacccgggagtccaatcgcttcagtcagttttggtgcctgccgcgacttcgttttcagacataaggattctcgtggtaaatcgccaagcagaagggtcgccgtggtgcgcctcccactggcccatggctctcttctgatgatgaatcaccccaccaatacgcactggtatcactccctgccagtacgtaagaaagtccttgctcccagagtgaatctaacattcagaaaaatcctcctgaccaaaaaatag

SEQ ID NO: 107894 - DNA, 786 bp, Artificial Sequence
  Description of Artificial Sequence: Synthetic coding sequence
atggaccgcttcctcgtgaagggcgcacaggggggactgctccgcaagcaggaggagcaggagcctactggggaagaacccgctgtgttgggaggagataaagagtcgacacgcaaacggccacggcgcgaagctcccggcaacggcggccacagcgcaggcccctcttggagacacattagagccgaaggacttgattgctcttataccgtgctattcgggaaagcggaagcggacgagatattccaggagctagagaaggaggtggagtattttacaggggctctcgcccgagttcaggtctttggtaagtggcatagcgttccacggaaacaggccacatacggggatgccggtctgacgtacactttctctggcctcacactatcccctaagccatggataccggtgctggagcgcattagagaccatgtgagcggagttacgggacagaccttcaactttgtgttgatcaacaggtacaaggacggttgtgatcatatcggcgaacaccgagacgacgagcgcgaactggcccccggcagcccaatcgcctctgtgagttttggcgcatgtcgcgactttgtgttcaggcacaaggattcacgcggtaagtccccctcgagacgcgtcgccgtggtccgtttgccgctagcccatggcagcctgcttatgatgaatcacccgaccaatactcactggtaccactcactcccagttagaaagaaagtgctggcaccccgagtcaatctgacttttcgcaaaatccttttaaccaaaaaatag

SEQ ID NO: 107895 - DNA, 786 bp, Artificial Sequence
  Description of Artificial Sequence: Synthetic coding sequence
atggatcgtttcctggtcaagggcgcccaaggcggcctactgcggaagcaagaagagcaggagcctaccggggaggaacccgccgtcttgggtggagacaaggaaagcactagaaagcggcctagacgcgaggcgcctggcaacggagggcattccgctggcccgtcttggaggcatatccgagccgaggggctcgactgcagctacactgtgctctttggaaaggcagaagcagacgaaatttttcaagagttggaaaaagaggtcgagtactttacaggggctctcgcacgggtccaggtgttcgggaagtggcacagtgtcccccgcaagcaggctacctacggagacgccggccttacctacactttctccggccttaccctttccccgaagccttggatacctgttttagagcggatccgggaccatgtgagcggggtgacggggcagacattcaatttcgttcttatcaaccggtacaaagacgggtgcgaccacataggcgaacaccgagacgatgagagggagttggcccccggctcccccatcgcctcggttagtttcggagcctgccgggatttcgtcttccgccataaagatagcagaggcaaatcgcccagccggcgtgtcgctgttgtacggcttcccctcgcccacgggtccctactgatgatgaatcatcctacaaatacacactggtatcactcattgccagtccggaagaaagtcctggcccctcgagtaaacctgacattccggaagatcttactaactaagaagtag

SEQ ID NO: 107896 - DNA, 453 bp, Artificial Sequence
  Description of Artificial Sequence: Synthetic coding sequence
atggataggtttctggtgaagggcgcccagggcggtttattgcgcaaacaggaggagcaggaaccaacaggagaagagccagccgtgctgggaggagacaaagagtctaccagaaaacgccctagacgcgaagcgcctggaaatggtgggcactccgctggcccaagctggcgtcatatcagggccgaaggactcgactgttcttacaccgtgctgttcggaaaggccgaggctgatgaaatcttccaagagctggagaaggaagtggagtacttcaccggcgcgcttgccagggtacaggtcttcggcaaatggcattcagtgccacggaaacaggccacgtacggagacgccgggctcacatacactttttctggactgactctatctcctaagccttggatccctgtcctggagaggatccgggatcatgtgagtggggtgaccggctag

SEQ ID NO: 107897 - DNA, 366 bp, Artificial Sequence
  Description of Artificial Sequence: Synthetic coding sequence
atggacaggtttcttgtgaagggagcccagggaggcctgctaagaaagcaggaagagcaggaacccaccggagaggagcccgcggtgcttggcggcgataaggagagcacacgcaaaaggccccgtcgcgaagcccctggtaatggcggacactccgctggccctagctggaggcacatcagggctgagggtctagactgctcttacactgtactctttggaaaggccgaggctgacgagatctttcaggagttggaaaaagaagtcgaatatttcacgggggcactggctagagtccaggtcttcggaaagtggcactcagttccaagaaaacaggctacctacggggacgccggtctaacttag

SEQ ID NO: 107898 - DNA, 483 bp, Artificial Sequence
  Description of Artificial Sequence: Synthetic coding sequence
atggatcggttcttagtgaaaggcgcacagggcgggctgctgagaaaacaggaagagcaggaacccacaggagaagagccagctgtacttggaggcgacaaggaatctacccgcaaacggccccggcgcgaagcccctggaaacggtggtcacagtgccgggccatcttggcgccatatccgcgccgagggacttgattgcagttacaccgttctttttggaaaagccgaagccgacgagatttttcaggaactcgagaaagaagtagaatacttcaccggcgcccttgcacgcgtgcaggttttcggaaagtggcattcagtcccccgaaaacaggccacgtacggagatgccgggctaacatatacattctccgggttgactctcagccctaagccatggatccccgtcctggaaagaatcagagatcatgtatcaggtgtgaccggccagaccttcaacttcgtattgatcaaccggtag

SEQ ID NO: 107899 - DNA, 861 bp, Artificial Sequence
  Description of Artificial Sequence: Synthetic coding sequence
atggaggagaaaagacgtagggcccgagtacagggcgcttgggccgcccccgtcaagtctcaagcgatcgcccagcccgctaccaccgccaagtctcacctccatcagaaacctggccaaacctggaagaacaaagaacaccacctgtccgaccgggagtttgtctttaaggagccacagcaggtggtgaggcgggctccagaaccacgagtcattgacagagaaggagtctacgagattagcctttcccctaccggcgtgtctcgggtttgtctgtaccccggattcgtggatgtgaaggaagccgactggattctggagcagctttgtcaagatgtgccctggaaacagaggactggaatcagggaagatattacttaccagcagccacgcttaaccgcctggtatggcgaactgccctatacttattcaaggattaccatggagcccaatccacactggcatcccgtcctgagaactctgaaaaatcggatcgaagaaaacactgggcacacgttcaacagccttctgtgtaacctgtaccggaacgaaaaagatagcgtagactggcactccgatgatgagcccagtctgggaagatgtcccatcattgctagcctctcatttggtgccacccggacctttgagatgcgaaagaagcccccgcctgaagaaaacggcgactacacgtatgtcgaaagagtgaaaatcccactggaccacggcacgctgctgatcatggagggtgcgacacaggccgattggcagcatcgagtccccaaggaataccactctagggagccgagagtgaatctaactttccgcactgtgtatcccgaccctcggggggccccgtggtag

SEQ ID NO: 107900 - DNA, 513 bp, Artificial Sequence
  Description of Artificial Sequence: Synthetic coding sequence
atggaagagaagagaagacgagcacgggttcagggagcctgggcagcacctgtgaagtctcaggccatagcccagccagccacaaccgctaagtctcacctgcatcagaaacccggccagacatggaagaacaaggagcaccacctgtcagaccgcgaatttgtgttcaaagaaccccagcaagtagttagacgagcccctgaaccgagggtcattgaagaaggcgtgtacgagataagcctgtcacctacaggtgtgtcccgagtttgcttatatccggggttcgtagacgttaaagaggctgactggatattagaacagttgtgccaggatgtgccctggaagcagcggaccggcatcagagaggatagcatccttcagctcacctttaaaaagtccgcacctgtgtctggaaccgctaccgctccccagtcttgttggtatgaacggcccagtcctccccacatacctgggcctgctatacttaccaggacgcggctttgggcgccctag

SEQ ID NO: 107901 - DNA, 183 bp, Artificial Sequence
  Description of Artificial Sequence: Synthetic coding sequence
atggaagagaaaagacgccgtgctcgggtgcagggtgcgtgggctgcacccgtcaaatcccaagccatcgctcaaccagctacgacggcgaagtcccatctgcaccagaaacccggacagacatggaagaataaggaacatcatctttccgatcgcgagttcgtcttcaaagagccgcagtag

SEQ ID NO: 107902 - DNA, 909 bp, Artificial Sequence
  Description of Artificial Sequence: Synthetic coding sequence
atggccgctgctgcggcagagaccccggaagtgcttcgcgaatgtggttgcaagggcatcaggacctgtctcatatgtgagcgccagagaggaagcgaccctccttgggagctgccacctgccaagacctaccggtttatatattgtagcgatactgggtgggcggtcggcacagaagagtcagacttcgaaggctgggccttcccattccccggcgtcatgctgatcgaggatttcgtcactcgcgaagaggaagcagagttggtgcgcctgatggatcgggatccctggaaattaagccagtcaggacggaggaaacaggactatggacctaaagtcaatttcaggaagcagaaattgaagactgaggggttctgtgggctaccatctttctcccgcgaggtcgtgagaaggatgggactctaccccggactggaaggattcagacccgtcgaacaatgcaaccttgactattgtccagaaagaggatccgcaatcgatcctcacctggacgacgcctggctgtggggggaacggctggtcagcctgaatctcctatcgcccacagtgttgtctatgtgcagggaggccccaggatccctgctcctctgcagcgcaccctccgcggctccagaggctctggttgacagcgtcatcgccccctcccgcagtgtactgtgtcaggaggtagaggtcgctatacccctgcccgcacgcagcctgctagtactgaccggagccgctcggcaccagtggaaacacgctatccaccgtcgtcacattgaagcgcgacgagtatgcgtcacattccgggagctgtccgcagagttcggccccggtgggagacaacaggagctgggccaggagctcctcaggatagctctgtcatttcagggtagaccagtatag

SEQ ID NO: 107903 - DNA, 1377 bp, Artificial Sequence
  Description of Artificial Sequence: Synthetic coding sequence
atggctgcggctagcgggtatacggatctgcgcgagaagctgaaaagtatgacgagcagagataactataaggccggatcacgagaggcggccgccgcagccgcagctgcagttgccgccgctgccgccgccgccgcagccgccgaaccctatcctgtgagtggagccaagaggaagtatcaggaagattcagatcccgagcgcagcgattacgaggagcaacagctccaaaaggaggaagaggcccgcaaagtaaaatccggtattcggcagatgcgcctattcagccaagacgaatgcgccaaaattgaagctcggatcgacgaggtcgtcagccgggctgaaaaaggactgtacaatgaacacaccgtcgacagggccccactcagaaacaaatacttctttggggaaggatatacatacggagcccaacttcaaaaaaggggaccaggccaggaaagattgtaccccccaggagatgtggatgaaatccccgaatgggtgcatcaactggtgattcagaaacttgttgagcatcgggttatcccagaagggtttgtgaattcagcggtaataaacgattatcagccaggaggatgcattgttagccacgtagatccgattcacatcttcgagaggccaattgtgagtgtcagttttttttcggactctgctctgtgcttcggctgcaaatttcagtttaagcctatccgggtgagcgaacccgtactgagtctaccagttcggcgaggctccgtgacggtgttgtcgggatatgcagctgatgagattacacattgcatcaggccccaggatattaaggagaggcgggcagtgatcatactgcgcaagacccggctggatgctcctcgtctggagacgaagtccctatctagttcagtgcttcctcccagctacgctagcgatcggcttagcggaaacaaccgagaccctgccctgaaacctaaaaggtcgcacagaaaagccgacccagatgccgcgcatcggcctcggatcctcgaaatggataaggaggaaaataggcggtctgtgctgctgcccacgcaccgccggcgcgggagctttagctccgaaaattattggaggaaatcatacgaatcctcagaagactgctctgaagcggctggctccccgggcaattctggttcctccctgcggtcttgcccttcattttgctttgagggcttcgtttttgtgcattggggggtctttgttttctgcttcctgttttttctgattctatacatcttcccctggttctgttgtctgcttggccttaagaatagaatagggcaggatcttgggagtcacatcctggggatcccccccgggtggaaagggtgctggcaccagtag

SEQ ID NO: 107904 - DNA, 1185 bp, Artificial Sequence
  Description of Artificial Sequence: Synthetic coding sequence
atggcggctgcatccgggtataccgatttacgcgagaaactaaaaagcatgacatcccgcgataattataaggcaggcagtcgggaagcagccgcggcagccgcagcagcggtggctgctgccgcggccgccgcagctgccgccgagccatatcccgtatctggggccaagcgaaaatatcaagaagatagtgaccctgagcgctccgactatgaggagcaacagctgcagaaggaagaggaagcaagaaaggtaaagagcggtattcgccagatgagactgttcagccaggatgaatgcgcaaagattgaggcccgtattgacgaagtagtgtctcgcgccgagaaaggtttatataacgagcacacggttgacagggcaccacttcgaaacaaatacttttttggcgaaggatatacatacggggctcagctgcagaaacgcggccccggacaggagcgactgtatcctcccggcgatgtggatgagattcccgagtgggtacatcagctggtcattcagaaactagtcgaacaccgcgtaatccccgaaggatttgtaaattctgctgtcatcaatgattatcagccggggggctgcatcgtgtcgcacgttgacccaattcatatctttgaaagaccaatcgtttctgtctctttctttagcgacagcgccctctgtttcggatgcaagttccagttcaaacccattcgggtgagcgagcccgtgctgtcactccctgtgcgtcgcggatccgtcactgtacttagtggctatgccgcagacgaaatcacccactgcatcagaccacaggatattaaggaacgtagagccgtaataattctgagaaaaactaggttagacgccccacgcctggaaacaaagtctctgagctctagcgtgcttccaccttcctacgcttcagacagactctccgggaataacagggaccccgctttaaaacccaaaaggtcccatcgaaaggctgaccccgacgcggcccacaggccaagaatcctagaaatggataaggaggaaaaccggagatctgtgctgctaccaactcataggagacggggaagctttagttctgaaaactattggcgtaaatcctacgagagtagcgaggactgtagcgaggctgcgggatcccccgctcgcaaggtgaaaatgagaagacattag

SEQ ID NO: 107905 - DNA, 1152 bp, Artificial Sequence
  Description of Artificial Sequence: Synthetic coding sequence
atgaggaggtgcaggcgtccatgtcctgccggacgcggtgaaggagggggcggtcggtccccagcggccgctgctgccgtcgccgcggccgccgcagccgccgcggctgcagagccatacccagtatcaggtgccaagagaaaatatcaagaggactcagatcctgagcggagcgattacgaggaacagcagctccagaaagaagaagaggccagaaaggtaaaatcaggaatccgccagatgagacttttttctcaagatgagtgtgcaaagatcgaggctcggattgatgaggtggtttcccgcgctgaaaagggcctgtataatgagcacacagtcgatcgagcgccactgaggaacaagtacttttttggcgaaggctatacgtacggagctcagcttcagaagcggggccctggtcaggaacgtttgtacccacctggggatgtggacgagataccagagtgggtccatcagttggtgatccaaaaacttgtggagcatcgcgtgataccagagggatttgttaattcagcagtcataaacgattaccagcccggtggctgtatagtatcccacgtggatccgattcatatcttcgaacgcccgattgtctccgtttccttcttttcagactcggctctctgctttgggtgtaaatttcagtttaagccaatcagagtttctgagcccgtgctcagtcttccagtgagaagagggagtgtgaccgttctgtctggctatgctgccgatgaaatcacacactgtatcagaccacaggacatcaaagagcgccgcgctgtaattattctccgcaaaacacgccttgacgccccaagacttgagacgaagtcactgtcctcgtcagtgctgccgccttcttatgcgtctgaccgcctgagcgggaataaccgggacccggccctgaaaccaaagaggtcccatagaaaagctgaccctgacgcggcccaccgccccaggattcttgagatggacaaggaagaaaaccgacgatcggtgttgttacctactcacaggcgccggggcagcttctcctccgagaactactggcggaagtcctatgaatcttctgaagattgctcagaggcagctgggtcccccgcacgaaaggtcaagatgcggcggcattag

SEQ ID NO: 107906 - DNA, 717 bp, Artificial Sequence
  Description of Artificial Sequence: Synthetic coding sequence
atggaggagcaggatgcccgggtgcctgcgctcgaaccatttcgggtagagcaagcacctccagtgatctactacgttcccgatttcatttcgaaagaggaggaggaatatctgttgcggcaggtgttcaacgctcccaagcccaaatggacccaactatcggggcggaaactgcagaattggggcggactacctcacccccgtgggatggtgccagagcggcttccaccatggctgcagagatacgttgacaaagtctccaacctgagtctgtttggggggttaccagccaaccacgtcctggtgaaccagtatctccccggggagggcattatgccgcatgaggacgggcctctgtattaccccacagtctcaactataagcttgggctcccacacggtgctggatttttacgagccacgtcggcctgaggacgatgatcctactgagcagccgcggcctccgccaagacccacgactagcctgttactcgagccgaggtctctgctggttttaagagggcctgcgtacacacgcttgctccacgggattgccgcagcccgggtcgatgccctggatgctgcgtcttctcccccaaacgctgctgcatgccccagtgcccgacctggcgcttgcctcgtgaggggaacccgcgtgtctctgactattaggagagtcccccgcgttcttcgggccggtctgctgctgggtaaatag

SEQ ID NO: 107907 - DNA, 801 bp, Artificial Sequence
  Description of Artificial Sequence: Synthetic coding sequence
atggccggccgcggcatgggtatgctgaatctggaaatcggaggtgacgcaggcgggcggatcggttgtaaagaattggtactgatggaagaacaggacgctcgcgtgcccgctcttgagcccttccgagtcgagcaggctccccccgtaatctattatgtaccagactttataagtaaggaagaagaggaatatcttttacgccaggtgtttaatgctccgaagccaaagtggacccagctcagcgggcggaaactgcagaactggggcgggctgcctcaccctcgcggaatggtacccgaacgactgccaccgtggctgcagaggtatgtggacaaggtttccaacctgtccctattcggtggactgcccgccaatcatgtgttggtcaaccaatacctccctggggagggcataatgccccacgaggatgggcctttgtactatccaacagtatctacaatcagtctgggctcccacacggtcctcgacttctatgagccacgcagaccagaggatgatgatcctacggagcagcctcgcccccctcccagacccacaaccagcctgctgctagaaccacggtccctgctggtgcttagaggaccggcgtatacacgactcctacatggcatagccgcagcacgagtcgacgcactcgacgctgcttcaagcccccctaacgcagcagcctgccccagcgcgaggcccggcgcctgcctggtgagaggtacccgagtctcccttacaatcaggcgcgtgcctcgagttctgagagctgggttgcttctaggaaagtag

SEQ ID NO: 107908 - DNA, 717 bp, Artificial Sequence
  Description of Artificial Sequence: Synthetic coding sequence
atggaagaacaggatgccagggtgccagcactggagccttttagggtggaacaagcccctcctgtcatttactacgtcccggacttcatctcgaaagaggaggaggaatacctgttgagacaagtgtttaatgcaccaaagccaaagtggacacaattatctgggcggaagttgcagaattggggcgggctccctcatccgcgcggtatggtgcccgaacgcctccccccctggttacagaggtatgtcgacaaagttagcaacctttccttatttggagggctaccggccaaccatgtgcttgtgaaccaatacttgccaggagaggggatcatgccacacgaggacgggcctttgtattaccccacagtcagcacgatttccctgggctcgcatactgtcctggatttctacgagccgcggagaccggaggacgacgatcccacagaacagcctcggcctccccctcggccaacaactagcctcctgctggagccgaggtcactgctggttttgcgaggcccagcatacacaaggttgctgcacggaatcgccgccgcgcgcgtggatgctctggacgccgcctcatcacccccaaatgctgcagcctgcccctcagcaagaccaggagcttgtcttgtgcgcgggaccagggtatctctgaccatccgtcgcgtgccccgcgttttaagagccgggctgctgctggggaagtag

SEQ ID NO: 107909 - DNA, 666 bp, Artificial Sequence
  Description of Artificial Sequence: Synthetic coding sequence
atggcggggacggggctccttgctctccgtacgctgcccggacctagttgggtcaggggcagcgggccttcagtattgtcaagactgcaggatgccgcggtcgtccgtcctggcttcctgtcaaccgccgaggaagaaaccctttctagagagttggaacccgagctgcgacgcagaaggtatgaatacgaccattgggatgctgctattcacggtttccgggagaccgagaagagtaggtggtcagaagcatctagggccattctgcagagagtgcaggcggctgcttttggccccggtcaaacgctgctttcatctgtccatgtactggaccttgaggccagaggctatatcaaaccccatgtcgatagtatcaaattttgtggcgccaccattgccgggttgagcctgctaagtccttcggtgatgaggctggtccacacacaggagccgggagagtggctcgagctgttgcttgagcccgggtctttgtatattttgagaggcagcgctcgctatgattttagccacgaaatcctccgagatgaggaatcattttttggcgagcggcgaattccccggggccggaggatatctgtcatttgcagaagcctccctgagggaatgggccccggtgagagcgggcaacctccccctgcctgctag

SEQ ID NO: 107910 - DNA, 1995 bp, Artificial Sequence
  Description of Artificial Sequence: Synthetic coding sequence
atggattctaatcaccagtcaaactataagctcagtaaaaccgaaaaaaaatttttacgcaaacagatcaaagccaagcacacgctcctgagacacgaaggaatcgagacggtctcttatgccacacagagcctggtcgtggccaacggcggcttgggcaatggggtatctcgcaatcagttgctccccgtgttagagaagtgtggcctagtggacgcgctgctaatgcccccaaacaagccttacagttttgcccgatatcgcactacggaagaatctaagcgagcatacgtgacccttaatggaaaagaagtggtggatgatctggggcagaaaattacactgtacttaaactttgtggaaaaggtccaatggaaagagctgaggccacaggctcttccgcctggtctgatggttgtggaagagataattagctcagaggaagagaaaatgttgcttgagtccgtggactggacggaagacaccgacaaccaaaacagtcagaaaagcctcaagcaccggagggtgaagcattttggatatgaatttcattacgagaataacaacgtagacaaggacaaacccctcagcggcggtctgccagatatatgcgaaagctttctggagaaatggctccgtaagggctatatcaagcacaagcccgatcagatgaccatcaatcagtacgagcccggacagggaatcccagcacacatcgatacccatagtgcgttcgaagatgagattgtcagtctgtccttaggtagcgagattgtgatggacttcaaacaccccgatggtatcgccgtgccagtcatgctgccaaggaggtctctattggttatgacaggagaaagtagatacctatggactcacggaattacgtgcaggaagttcgataccgtgcaggcatctgagagtctcaagtcagggatcattaccagcgatgtcggagacctcaccctgagtaagagaggactgcggacgagctttactttcagaaaggtgcggcagacaccctgtaattgtagctaccccctggtgtgcgactcacaaagaaaggagacaccaccgagcttccccgagagtgataaggaagcctccaggttagagcaggaatacgttcatcaagtgtacgaggagatcgcgggacacttctcctcaacgagacacacaccctggccccacatcgtggagttcctgaaggctctgccctcaggctccatcgtggcggacattggttgtggtaacggcaaatatttggggataaacaaagagctctatatgattggttgcgatcggagccagaacctggtggacatctgtcgcgagcgtcaattccaggccttcgtctgtgatgcactggcggttcctgtccggagtgggtcttgtgacgcttgcatttcaatagcggtcattcaccacttcgctactgccgagcggcgcgtcgccgcattgcaggaaatcgtccggctccttcgccctggcggcaaagcactgatctacgtatgggctatggagcaggagtataataaacaaaagtccaagtatctccggggtaacagaaatagccagggcaaaaaggaggaaatgaactccgacacttccgtgcagagatctctagtagaacagatgcgcgacatgggcagcagggatagtgcctcaagtgtaccgagaatcaacgatagccaggaaggtggatgcaacagccggcaggtttccaacagcaagctgcccgtccatgtcaatcgcacttccttctactcgcaagatgtgctagtgccatggcacttgaaggggaacccagacaaggggaaacctgttgagccctttgggcctatcggctcacaggatccttcaccagtgttccaccggtattatcacgtgttccgagagggcgagctggaaggagcatgtcgcacggttagcgatgtcagaatcctgcagagctattacgaccagggaaattggtgtgtgatcctccaaaaagcctag

SEQ ID NO: 107911 - DNA, 2004 bp, Artificial Sequence
  Description of Artificial Sequence: Synthetic coding sequence
atgtttgccatggacagcaaccaccagagcaattacaagttaagcaagaccgagaagaaatttctcaggaaacagattaaggctaaacatacgcttctaaggcacgagggtatcgaaacagtgagttatgcaactcagagtctcgtcgtggcaaacggggggctgggcaatggcgtgtctcggaatcagctgctccctgtgcttgagaagtgcgggcttgtggacgccctactgatgccccctaataagccttattccttcgcaagataccgcaccactgaagaaagtaaaagggcctatgtcactctgaatggaaaggaggtcgtcgacgatctgggccagaaaataacactgtacttgaatttcgttgagaaagtacagtggaaagagttgagaccgcaggccttgccacccggtctcatggttgtggaagagataattagttccgaagaagaaaagatgctgttggagagtgttgactggaccgaagataccgataaccagaactcgcaaaaaagtttgaagcaccgtagagtcaagcatttcggctacgaattccattatgagaataacaacgtcgacaaagataagcctctgtcagggggcctgcctgatatttgcgagtctttcctggagaagtggctgcgtaaaggttatatcaaacataagcctgatcagatgaccatcaaccagtatgagccaggccagggcattcccgcccacatcgatacccacagtgccttcgaagatgaaatagttagcctctcactcgggtccgaaatcgtcatggactttaagcatcctgatggaatcgccgttcccgtcatgctgccgcgccgaagtttgttggtgatgacaggcgagtcgcgttacttgtggactcatgggattacctgtaggaaattcgatacggtgcaagcctccgaatcactgaagtctggaattatcacgagcgatgtgggcgacctgacccttagcaaaaggggtctccgcacatccttcacattccgtaaagttaggcagacgccatgcaactgttcatatccgttggtatgtgacagccagaggaaggaaacaccacccagctttccagagtccgacaaagaagcttcgaggctcgaacaggaatatgtccatcaggtgtacgaggaaattgcaggacatttttcctcaactcggcatacgccctggccccacatcgtggaatttctgaaggctttgccgtccggctccattgtggctgatattgggtgcggcaatgggaaatacctcggtatcaacaaggagttatacatgattggttgcgatcgctctcaaaatttggtcgatatatgtcgcgagcggcaatttcaggccttcgtgtgcgatgccctcgcagtgcctgttcgatccggcagctgtgatgcttgcatctctatcgccgtgatccatcatttcgccacggcagaaagaagggtcgccgcactgcaggaaatcgttcggttgctacggccagggggcaaagcactgatttatgtgtgggccatggagcaggaatataataaacagaagtctaagtacctgagagggaatagaaattctcagggcaagaaagaagagatgaattctgacacatccgttcaacggtcgctggtagaacagatgcgcgatatggggagccgggactcggcttcgtctgtccccaggattaatgactcccaggaaggcggctgtaacagccgacaggtaagcaacagcaagttacctgtacacgtgaatagaacgtccttttattcccaggacgtgctcgtgccctggcatttaaaggggaaccctgacaaggggaagcccgtcgagcccttcggaccgattgggtcccaggatccctcccccgttttccataggtactatcacgtttttcgagaaggcgaattagaaggtgcatgtagaactgttagtgacgtgagaatcctccaatcatactacgaccagggcaactggtgtgtaattctccaaaaggcgtag

SEQ ID NO: 107912 - DNA, 1995 bp, Artificial Sequence
  Description of Artificial Sequence: Synthetic coding sequence
atggactctaatcaccagagcaattataagttgtctaaaactgaaaagaagtttttgagaaaacagatcaaagccaagcatacattgctgcgtcacgagggtatcgaaactgtgtcctatgccacccagtccctggtggtcgcaaatggggggcttgggaatggtgtcagccgcaatcagttgttgcctgtcctggaaaaatgcgggctggttgacgctctcctgatgcccccgaataagccctatagctttgctcggtaccgcacaactgaagagagtaaacgagcctacgtgaccttgaatggtaaggaggttgtcgacgatctcgggcaaaagatcaccctctatcttaactttgtcgaaaaggtgcagtggaaagagctccgcccgcaggccttgccccctgggctgatggtagtggaggagataatctcctccgaggaagagaaaatgttactggaatcggttgattggaccgaggacactgacaaccagaattcacaaaagtctttaaagcaccgtcgcgtgaaacactttggttacgagttccactatgagaacaataatgttgacaaggacaagcccctgtcaggcgggcttcctgacatctgcgagagcttccttgaaaagtggttgagaaagggatatattaagcataagccagatcagatgacaattaaccagtacgagcccggccaggggattccagcacatattgatacacactcagcctttgaagacgagatcgtctccctgtccttgggctccgagatcgtgatggattttaaacatccagacggcatcgccgtcccggtgatgctgccgcggaggtctctcttggtcatgacaggggaaagccgttatctatggacacacggaatcacctgccgtaagtttgacaccgttcaggcctccgagtctctcaaaagtgggatcatcacaagtgacgttggcgacctgacactcagcaaacggggtctcagaaccagcttcacattccggaaagtgagacagaccccttgcaactgctcctaccctctcgtctgtgactcccaacggaaggagacacctcctagcttccccgagtccgacaaggaagccagccggttggaacaagaatatgtgcatcaggtctatgaagaaatcgctggccacttcagctccacccgccataccccgtggccccacattgtggagttcctgaaggcgctcccgtccgggtctattgtggccgacatcgggtgcggcaatgggaagtacctgggaatcaacaaggaactgtacatgatcggttgtgatcgatcccagaacctggtcgatatctgccgggagagacagttccaggcgttcgtgtgcgatgctctagcagttcccgtgcggtctggctcctgcgacgcctgcatttctatagcggtgatacaccacttcgccactgcagagcgcagggtggccgctctgcaggagattgtgcggctcttgagaccaggaggcaaggccctgatttacgtgtgggccatggagcaggagtacaataagcagaagagcaagtacctgaggggcaatcggaactcacagggtaaaaaggaagaaatgaattcagacacctcggtgcagcgcagtctcgttgaacagatgcgggatatggggtcccgggacagcgccagcagcgtgcctcgcatcaatgattctcaggaagggggatgcaatagccgccaagttagtaattccaaactgcccgtgcatgtcaaccggaccagcttttacagccaggacgttttagtcccttggcatctgaagggcaaccccgataaaggcaaacccgtcgagccttttggaccaattggtagccaggacccaagcccggtgttccatagatactatcacgtttttcgagaaggggaattagaaggcgcctgtcgcactgtctccgatgtccggatcctgcagagctactatgaccaggggaactggtgcgtgattttacagaaggcctag

SEQ ID NO: 107913 - DNA, 675 bp, Artificial Sequence
  Description of Artificial Sequence: Synthetic coding sequence
atggattctaatcaccagtctaattataagctcagcaagactgaaaaaaaatttttacgtaaacagattaaggctaaacacacactgcttcgtcacgagggtattgagactgtgagctacgcaacccagtcccttgtcgtggccaacgggggacttggcaacggagtgtctcgcaaccagctcctgccagtacttgagaaatgcggtcttgttgatgcattacttatgcctcccaacaaaccgtatagtttcgcccgctacagaaccacagaagaatccaaacgtgcatacgtcaccctcaacggaaaggaggtggtggacgacctgggacagaaaatcacattgtacctaaactttgtcgagaaggtgcagtggaaagagttgcggccccaagcattaccgcccggacttatggtggttgaggagattatcagcagcgaagaggagaaaatgctcctcgaatctgttgactggaccgaagatactgataatcagaatagtcaaaaaagcctgaagcaccgccgggtgaagcatttcgggtacgagtttcattacgaaaacaacaacgttgataaagataaacctctctcaggtggtcttcctgatatctgcgagtcatttttagaaaagtggctgaggaaagctgagaaaaacctggaggtaggcatacactag

SEQ ID NO: 107914 - DNA, 1338 bp, Artificial Sequence
  Description of Artificial Sequence: Synthetic coding sequence
atgaagaatcccgaggctcaacaagacgtcagcgtgtcccagggctttcgcatgctcttttataccatgaagccctccgagacgtctttccagacactcgaggaggtccccgattacgttaagaaggcaacaccattctttatcagtttgatgcttctggagctggtagtcagttggattttgaaagggaaacctcccgggcgtctcgatgatgccctcacctccatctctgctggcgtgcttagtcggctaccatcccttttctttaggtcaatagagctgaccagctatatatatatttgggaaaattacaggctgtttaacttaccctgggattcgccatggacttggtattctgccttccttggggtagatttcggctactactggtttcataggatggcccacgaggtcaacattatgtgggcgggccatcagacacaccactctagtgaagattacaacctgtcaactgcgttacggcagtcagtgctgcagatatacactagctggattttttacagtccactcgctttgttcatacccccgagcgtgtacgcggtgcatctccaatttaatttgttataccagttttggattcatactgaggtgatcaataacctgggaccattggagttaatcctcaacacaccatcacaccaccgagtacatcacgggaggaataggtactgcatagacaaaaactacgcaggggtactgatcatatgggacaagatattcggcacctttgaagctgagaatgagaaggtcgtttacggactgacacatcccatcaacacatttgagcccattaaggtccaattccatcatctgttcagcatttggactacattctgggccacgcctgggttttttaacaagtttagcgtgattttcaagggaccaggctggggacccggaaaaccaaggctgggcttgagtgaggagattcccgaagtgacaggcaaggaagtgcctttctctagcagctctagtcaactgctcaagatatatactgtcgtgcaatttgccctgatgctggccttttatgaagagaccttcgctgataccgccgcgctctctcaggtgacactcctgctgagggtctgctttatcatactgaccctaacaagtattggattcctcttagaccagcgccctaaagccgctatcatggagacccttaggtgcttgatgtttcttatgctgtaccgattcgggcacctcaagcctctggtgcctagtctgtccagcgcgttcgagattgtgttctccatctgtattgcattctggggagttcgcagcatgaaacagctgactagccacccttggaaatag

SEQ ID NO: 107915 - DNA, 1977 bp, Artificial Sequence
  Description of Artificial Sequence: Synthetic coding sequence
atggcagaagcagccgcggccgccggcggaacaggactgggtgccggcgcatcctatggaagcgccgcggatagagatcgcgatcccgaccctgatagggccggacgacgcctgcgggtcctgtctggtcacttgttgggccgaccaagagaggctctgtctaccaatgagtgcaaggctcggcgagctgcgagcgccgctacggctgcaccgacagctacccccgccgcacaggagtctggaactattccaaaaaagagacaagaagttatgaaatggaacggatggggctataacgattccaagttcattttcaataaaaaagggcagattgaattgaccgggaaaagatatccactgtctggaatgggactcccgacctttaaagagtggatccagaacaccttaggagttaatgtcgaacataagactacatccaaggctagtctgaatccgtctgatacacctccctccgttgtcaatgaagattttctgcacgatctgaaagagaccaatatctcgtacagccaagaagcggacgacagggtctttagggcacatggccactgtctgcatgagatattcttgttgcgggaaggtatgtttgaacggatcccagacatcgtactttggcctacctgccatgatgatgtcgtgaagatcgttaatcttgcctgcaagtataacctctgtattatccccataggcggtgggacatccgtgtcatacggactcatgtgtcccgccgatgaaactagaactatcatcagtctggacacttcccagatgaatcggatactttgggtggatgagaataacctaactgcccacgtcgaagcaggtatcactgggcaagaactggagagacagctcaaagaaagcggctactgtaccggacacgaacctgatagcctggagttttctacagtcggcggctgggtctcgacgagagcctctggaatgaaaaaaaacatctacggcaatatagaagatctcgtggtgcatatcaagatggtgactccacgcggtatcatcgaaaagtcttgtcagggaccacgaatgtcaacagggcctgatatccatcatttcatcatgggttccgagggtactctgggagtgattactgaggcaactatcaagatcagacccgttcctgagtaccagaaatatggctcggtcgctttcccgaactttgaacaaggggtcgcttgtctgcgggagatagcgaagcagcgatgcgccccagcatctattcgcctgatggataataagcagttccagtttggccatgcactgaaaccacaggtgtcgtcgatttttaccagctttctggatgggctcaaaaagttctacatcaccaagttcaagggcttcgatccgaaccagctatccgtagcgacgctgctcttcgagggtgatagggaaaaggtgttacaacacgagaagcaggtctatgatatcgctgctaagttcggcgggttggccgctggcgaagacaacggtcagcggggttatctactgacatacgtgattgcatatatacgtgatttggctttggagtattatgtgttgggagagagcttcgagacgtccgcaccttgggaccgcgtcgtcgatctgtgtagaaacgtgaaggaaagaattactcgggagtgcaaagaaaagggcgtacaatttgcaccattcagcacttgccgggtgacccagacatacgatgccggagcctgcatttacttttacttcgcctttaactacaggggaatatccgatcctcttacagtcttcgaacagacagaggccgcagccagagaggagattcttgccaacggggggagtctgagccaccaccacggcgtgggaaaactgagaaagcagtggttgaaagaatccatttcggatgtcggctttggcatgttgaaatcggtgaaggagtatgtagacccgaataacattttcgggaacaggaatcttctctag

SEQ ID NO: 107916 - DNA, 966 bp, Artificial Sequence
  Description of Artificial Sequence: Synthetic coding sequence
atggatccaaagtacccgtggagcaagtgcggccataaaacgacctccaaagctagtttgaatccctccgatacgccgccatccgtcgtcaatgaggactttttgcacgacctgaaagagaccaatatctcgtattcacaggaagccgacgaccgggttttcagggcgcatgggcattgtcttcatgaaatattcctgttgagagaaggaatgtttgagaggatccccgatatcgttttatggcctacatgtcacgacgacgttgtaaagatcgtgaatttggcctgtaagtacaacctatgcatcatccccattggggggggtactagcgtgtcctatggcctgatgtgccccgccgacgagaccagaacaatcatctctctagacaccagtcaaatgaataggatcctttgggtcgacgagaacaacctgacagcacacgtagaggctggaatcaccggccaggagctggagcgacagctcaaggagagtggttattgcaccggacatgagccagacagcctcgagttctctactgtggggggttgggtgtctactagggccagcggaatgaaaaagaacatctatgggaacatcgaagatttagtagtccacataaaaatggttaccccgcgaggaatcatcgaaaaatcttgtcagggtccccgaatgtctacagggccagatatacatcacttcatcatgggctcagagggcactctgggagtgattaccgaggctacaatcaaaatacgccctgtgccagaataccagaaatacggttccgttgcctttcccaactttgaacagggcgtggcatgtttaagggaaattgcaaaacagcgatgtgcacctgcttccatccgcctgatggataataaacagtttcagtttgggcatgcactgaaaccccaggtcagctcgattttcacatcctttctggatggcctcaaaaagttctactag

SEQ ID NO: 107917 - DNA, 1176 bp, Artificial Sequence
  Description of Artificial Sequence: Synthetic coding sequence
atggatatggcaagcgaatccgtcgggggaaaaattctgttcgccaccgacgattttttcgcaccggccgaaaatctgataaagagcgactcaccctgcttcaaagagcacgaatacactgaattcggaaagtggatggatggctgggagactcgcaggaagaggatccctggccacgattggtgtgtgttgcgactgggcatacagggtgtgatccgtggtttcgatgttgacgtgtcatattttacgggggattacgctcctcgagtgtccattcaggcagcgaatttggaggaagataaactgcccgaaattccagaaaggggtaccaggacaggagcagccgccactcccgaggaattcgaggctatagcagagctgaaaagtgacgattggagctacctggtccctatgactgaactgaaaccaggcaaccccgcttctgggcataactactttttggtcaattctcagcagcggtggacccatattcgccttaatatttttcccgacggaggtatagcacgactgcgagtgtttggcacgggacagaaggactggaccgccacagaccctaaggagccagccgatctggtggcgattgcttttggaggggtatgcgttgggttttctaatgctaaatttggtcaccccaataatataataggagttgggggtgcaaagagtatggccgatggatgggaaaccgccagaagacttgacagacccccaatccttgagaatgatgaaaacgggatactgctcgtgcctggctgtgagtgggcagtattccggctggctcaccctggcgttatcacgcgtattgagattgacacaaagtatttcgaaggaaatgcacccgatagctgtaaagtggacggctgtattctgactacacaggaggaggaggccgtcattcgtcagaagtggatcttacctgcacacaaatggaagcccttgttacctgtgaccaaactgtctccaaaccagtctcatctgtttgattctctaacacttgagctgcaggatgtaattacccacgcacgactaaccatcgtgcccgatggaggcgtcagccgcctgaggttgcggggttttccttcctcgatatgtcttctccgtccgagagaaaaaccaatgttaaaattctccgtgtcttttaaggccaacccttag

SEQ ID NO: 107918 - DNA, 486 bp, Artificial Sequence
  Description of Artificial Sequence: Synthetic coding sequence
ggacgcaaggcctcagagaagaccgggggtcgggaaggcgagcctgccgatcgaggcctgcaactaggtgggaaagccttcggacttctcaaagcacaacaggaagaaaggcttgacgagataaacaagcaatttctggacgatcctaaatattcttcagacgaggacttgcctagtaaactggaggggtttaaagaaaaatatatggagttcgacctaaatggaaacggcgatatcgacatcatgtcgctgaaaagaatgcttgaaaaactgggagtgccaaaaacacacctggagctgaagaagctcatcggcgaggtctctagtgggtcaggagagacttttagctaccccgattttttgcgcatgatgttgggcaaacgatccgcaatcctgaagatgatactcatgtatgaggaaaaggcccgggagaaagagaagccaaccggacccccagcgaaaaaagccattagcgagctgccatag

SEQ ID NO: 107919 - DNA, 282 bp, Artificial Sequence
  Description of Artificial Sequence: Synthetic coding sequence
atggaattcgacttgaacgggaacggagacattgacattatgtctctcaaacgtatgctcgagaagttgggcgtgcctaagacacacctggagttaaagaagttaatcggggaggtgtcaagcggatcaggagagacattcagctatccggatttcttacggatgatgctggggaaacgttcagccatcttgaagatgatactgatgtatgaggaaaaagcccgtgagaaggagaaacctacaggtccacctgcgaagaaagctatctctgagctaccatag

SEQ ID NO: 107920 - DNA, 444 bp, Artificial Sequence
  Description of Artificial Sequence: Synthetic coding sequence
atgtcacaaactagagacctccaggggggcaaggcatttgggctgctgaaagctcagcaggaagaacgactggacgaaataaacaagcagtttctggacgacccgaagtattcttcggatgaggacctcccttccaaactggagggtttcaaagaaaaatacatggagtttgacctgaatggaaacggtgacatcgatatcatgagcctgaaacgcatgcttgagaagctgggggtgcccaagacgcatctggaacttaaaaaactgatcggtgaagtgtcgagcggatcaggcgagaccttctcttatcccgattttctgaggatgatgcttggcaagagatcggctatcctgaaaatgattctgatgtatgaggagaaggctcgcgaaaaggagaaacctaccggaccccccgcaaagaaagcaatcagtgagttaccctag

SEQ ID NO: 107921 - DNA, 282 bp, Artificial Sequence
  Description of Artificial Sequence: Synthetic coding sequence
atggaatttgacctaaatggcaatggagacatcgatataatgtctctcaagcgtatgctggaaaagctgggggttccaaaaacgcacctggaactgaaaaagctgattggagaggtgagttctggaagcggcgaaacatttagctatccagacttcttgaggatgatgctcggcaaaaggagcgccatcctcaagatgatcctgatgtacgaagagaaggcaagagagaaagagaaacccaccgggcccccagccaagaaggccatctctgaactcccctag

SEQ ID NO: 107922 - DNA, 444 bp, Artificial Sequence
  Description of Artificial Sequence: Synthetic coding sequence
atgtctcagaccagagatctccagggcggcaaggccttcgggctgctgaaggctcagcaggaggagagactagacgaaatcaataaacagttcttggacgacccaaaatattcctccgacgaggaccttccaagcaagttggaagggtttaaggagaaatacatggaatttgatttaaatggcaatggggacatcgacatcatgagcctcaagaggatgctggagaagctcggcgttcccaaaactcacttagaactcaagaagctgatcggggaagtgtcatcagggtcaggggagacgttctcctatcctgactttcttcggatgatgctgggaaaaaggagtgccattttaaagatgatcctgatgtacgaggagaaggcccgagagaaggagaaaccgaccggaccacctgccaagaaggctatatctgagctaccttag

SEQ ID NO: 107923 - DNA, 486 bp, Artificial Sequence
  Description of Artificial Sequence: Synthetic coding sequence
ggtcggaaagcaagtgaaaagacaggaggaagggaaggggaacccgctgataggggccttcaattgggcgggaaggcttttggactgctgaaggctcagcaggaagagcgcctggatgagatcaacaaacaattcctggacgatccaaaatacagctctgacgaagacctaccctctaaattggaagggttcaaagagaagtatatggaatttgacttaaatggcaacggggatatcgatatcatgtccctcaagcgtatgctcgaaaaactcggtgttcccaaaacccatctcgagttaaagaagttgatcggggaggtgtcgtctggaagcggagagacatttagctatccagatttcctgagaatgatgctgggcaagaggagcgctattctgaagatgattctgatgtatgaggagaaagcgagagaaaaggaaaaacctactgggccacccgctaagaaggcaataagtgaactgccctag

SEQ ID NO: 107924 - DNA, 444 bp, Artificial Sequence
  Description of Artificial Sequence: Synthetic coding sequence
atgagccagacccgtgacctgcaggggggtaaggcattcgggctcttgaaagctcagcaggaagagagactggacgaaattaacaaacagttcctcgacgatccaaagtattcttctgacgaagatttaccaagtaagctggagggatttaaggaaaagtatatggagttcgatttgaatggaaacggggacattgatataatgtctctcaaacgaatgctcgaaaagcttggcgtgcctaagacacacctggagttaaaaaagctgattggagaggtgagctctgggagcggagagacattttcatatcccgactttcttaggatgatgctggggaaaaggagtgccattctgaagatgatcctcatgtacgaagagaaggcaagagaaaaggagaagccaaccgggccgcctgcgaagaaagcaatctctgaactgccctag

SEQ ID NO: 107925 - DNA, 444 bp, Artificial Sequence
  Description of Artificial Sequence: Synthetic coding sequence
atgtctcaaacgcgagacttacagggaggcaaggcattcggcctcctgaaagctcaacaggaagagagactggacgaaatcaataagcagtttttggatgaccccaaatacagctctgacgaagacctcccctctaaactagaagggtttaaagagaagtatatggaattcgatctgaacgggaatggcgacatagatataatgtccctcaaacggatgctggaaaaattgggagtacctaagacacatctggagctgaagaagctgatcggagaagtgtcctcggggagcggcgagacattttcataccccgacttcctacgcatgatgctcggcaagcgaagcgccatcctcaagatgatcctgatgtacgaggagaaggctagagaaaaggagaaaccaaccggacccccagcgaagaaggctatttccgagctgccatag

SEQ ID NO: 107926 - DNA, 282 bp, Artificial Sequence
  Description of Artificial Sequence: Synthetic coding sequence
atggaattcgatttgaatggcaacggtgatattgatataatgagcctcaaacggatgcttgaaaagctaggtgtccctaagacccatctcgagcttaaaaagctgatcggcgaagtgtcttcagggtctggggagacattcagctaccccgatttccttcggatgatgctgggtaagcgcagcgctatcctgaagatgattctcatgtatgaagaaaaggcccgggagaaggagaagcctacaggaccccctgcgaagaaggctatctctgagctcccatag

SEQ ID NO: 107927 - DNA, 282 bp, Artificial Sequence
  Description of Artificial Sequence: Synthetic coding sequence
atggagttcgacttgaatggaaatggagatattgacatcatgagtctcaaaagaatgctggaaaagctgggagtgccaaagacccacctcgaattaaagaaattaatcggggaggtgtcatcagggtccggcgagacattcagctaccctgacttcctcagaatgatgctgggcaaaagatcggctatactgaagatgatcctgatgtacgaagagaaagcacgcgagaaagagaaacccactggcccccctgccaaaaaggctatcagtgagcttccatag

SEQ ID NO: 107928 - DNA, 486 bp, Artificial Sequence
  Description of Artificial Sequence: Synthetic coding sequence
ggacgaaaggcctccgagaaaaccgggggcagagaaggggaaccggccgaccggggtctgcagctaggagggaaagcttttggactgttaaaagcacaacaggaagagcgtttggatgagatcaataaacagttccttgacgatccaaaatacagtagcgatgaggatctgccgtctaagctggaggggtttaaagagaagtatatggagttcgatctgaatggcaacggggacattgacatcatgtcgttgaagcgcatgttagagaaactgggtgtgcccaagacccaccttgagttgaagaagcttatcggcgaagtttcatccggaagcggtgaaaccttttcctaccctgactttcttaggatgatgctgggaaagcgatccgcaatacttaaaatgatccttatgtacgaagaaaaagctcgcgagaaagagaagcccacgggtcctcccgccaagaaagccatatccgagctcccatag

SEQ ID NO: 107929 - DNA, 282 bp, Artificial Sequence
  Description of Artificial Sequence: Synthetic coding sequence
atggaattcgacttgaatggcaatggcgacatcgatatcatgagcctgaagcgtatgttggaaaaactcggcgttcccaagacccatttggagctgaaaaagttaattggagaagtgtctagcggctctggggagacctttagctacccagacttcttgcggatgatgttgggtaagcggtccgcaatactgaagatgattttgatgtacgaagagaaggctcgcgagaaggaaaaaccaactggtcctcccgccaaaaaggccatttccgagctgccctag

SEQ ID NO: 107930 - DNA, 282 bp, Artificial Sequence
  Description of Artificial Sequence: Synthetic coding sequence
atggaattcgacctgaacggaaatggggacatcgacattatgtcactgaagcgcatgcttgagaagctcggtgttcctaaaactcatctcgagctcaagaaactgatcggtgaagttagttctggttctggtgaaacgtttagctatccagacttcctgcgcatgatgcttggtaaaaggtctgctatcttgaaaatgattctgatgtatgaagaaaaggcccgcgagaaggagaagccaacagggcctcccgccaaaaaggccattagtgagttgccttag

SEQ ID NO: 107931 - DNA, 444 bp, Artificial Sequence
  Description of Artificial Sequence: Synthetic coding sequence
atgtcacagactagagacctgcagggaggcaaggctttcggtctcctcaaggctcagcaagaggaaagactagacgaaataaacaaacaattcctggatgatcccaagtattcctcggatgaagacctgcccagtaagttagagggcttcaaagagaaatacatggagtttgatcttaacggtaacggcgacatcgacatcatgagtttgaagcgcatgttggaaaaacttggagtacccaagactcacctggaattgaagaagctgatcggggaagtttctagcgggtctggcgagacattttcttatccggactttctgcgcatgatgctgggtaaacgctccgcaatcctaaagatgatcctgatgtatgaagaaaaagcacgcgaaaaggagaagccgaccgggcctcctgcaaaaaaggccatatcggagttaccgtag

SEQ ID NO: 107932 - DNA, 486 bp, Artificial Sequence
  Description of Artificial Sequence: Synthetic coding sequence
ggtcgtaaggcgagcgagaaaactgggggtcgagaaggggagcccgctgaccgaggcctgcagcttggcggaaaggcatttggcttgttaaaggcacagcaggaggagcgactcgacgagataaataagcaattcctggatgatccgaaatattctagtgacgaggacctgccgagtaaactggaggggtttaaggaaaagtacatggagttcgacctcaacggtaatggggacattgacatcatgtccttgaagcggatgctagagaaactcggagtaccaaagacgcacttggaactgaaaaagttaatcggggaagtcagttctgggtctggcgaaacgttctcctaccccgattttctacggatgatgttgggcaagcggagcgccatccttaagatgatactgatgtacgaggaaaaggcccgggaaaaagaaaaacctactggcccccctgcaaagaaagctattagtgaactgccttag

SEQ ID NO: 107933 - DNA, 444 bp, Artificial Sequence
  Description of Artificial Sequence: Synthetic coding sequence
atgtcacagactcgtgatctgcagggcggcaaagctttcggcctgcttaaggcccagcaggaggagcgacttgacgaaattaataaacagtttttggacgatcctaaatactcttcagatgaggatttgccttctaagctggagggcttcaaagagaagtacatggaattcgacctaaacggcaacggggatattgacataatgagcctgaagagaatgcttgaaaagctgggagtccctaagactcatctcgaattaaagaaattaattggcgaggtgtcttctggttctggtgagacattttcttaccccgactttctgcggatgatgctcggaaagcgttccgccattctgaagatgatcctgatgtatgaagaaaaagcccgggaaaaagaaaaaccaactggacctccagccaaaaaagctatctctgagctgccttag

SEQ ID NO: 107934 - DNA, 486 bp, Artificial Sequence
  Description of Artificial Sequence: Synthetic coding sequence
ggtaggaaggccagtgagaaaacgggtggaagggagggtgagccagcagatcgcggactgcagctgggcgggaaggcattcgggctcttaaaggcacaacaagaggaaaggctggatgagattaacaagcagtttttggatgaccccaaatatagttctgacgaggatttaccctctaaactggagggcttcaaggaaaaatacatggagtttgacctgaacgggaatggggacatcgatattatgtcccttaagcggatgctggagaaactaggtgtgccgaagacccacctggagctcaagaaattaatcggcgaggtgtcttcgggcagtggtgaaacattctcatatccagatttcctccgaatgatgcttggcaaaaggagcgccatcctgaaaatgattctgatgtatgaagagaaggctcgagagaaggaaaagcccaccggcccccccgcaaagaaagccatcagcgagttgccatag

SEQ ID NO: 107935 - DNA, 486 bp, Artificial Sequence
  Description of Artificial Sequence: Synthetic coding sequence
ggccggaaagcctccgagaaaaccggcggccgtgagggggaaccggctgataggggtttgcagctgggagggaaggctttcggactgctgaaggcacagcaagaagagcgtttggacgagatcaataaacaatttctagatgaccccaaatatagctccgacgaggacctgccctccaaactggaggggttcaaagaaaagtacatggaattcgacctgaatggcaatggagatatcgatatcatgtctcttaaaaggatgcttgaaaaactcggcgtccctaagacacacctggagctgaagaagctaattggtgaagtgagcagtgggtccggtgagacattctcctatcctgacttcctccgtatgatgctgggtaagcgttccgccattcttaagatgatactcatgtacgaggagaaggcaagggagaaagaaaagccaactggcccgccagcaaaaaaagctatctcagaattgccctag

SEQ ID NO: 107936 - DNA, 282 bp, Artificial Sequence
  Description of Artificial Sequence: Synthetic coding sequence
atggagttcgatctgaacggcaatggtgacatagacattatgagcttaaagagaatgcttgagaaactcggcgtgccaaagactcacttggaacttaagaagctcatcggagaagtgagttctggatcgggggagaccttttcctaccctgatttcttgcgaatgatgctcggtaagcggtcggccattctgaagatgatcctcatgtacgaggagaaggcccgcgagaaagagaagccaaccggtcccccggccaaaaaagcaatttctgagctcccctag

SEQ ID NO: 107937 - DNA, 1062 bp, Artificial Sequence
  Description of Artificial Sequence: Synthetic coding sequence
atgagcaaaccccctgatttgttgctgcggcttctgaggggtgcaccaaggcagagggtttgcaccctgttcatcatcggtttcaaatttaccttctttgtatcaatcatgatttactggcacgtggtaggtgagcctaaggagaaaggccagctgtacaacctgccagctgaaattccttgtccgacactgacaccacctacaccccccagtcatggccccaccccaggcaacattttttttttagaaactagcgaccgcaccaacccaaacttcctgttcatgtgttccgtggagtcagccgcccggacccatcctgaatcccacgtgctagttctgatgaagggcctacccgggggcaacgctagcctgccgcgccacctggggattagtctcttgtcctgtttccctaacgtccagatgctccccctcgaccttagggagctgttccgagacacacctttggccgactggtatgcagccgtgcaggggcggtgggagccatatcttctccctgttctgagcgatgcttctcgaatcgctcttatgtggaagttcggtggcatttacctggacaccgatttcatcgtgttgaagaacctcagaaacctaaccaatgtgctaggcacgcagagtcggtatgtactgaacggcgcttttcttgctttcgaaagacgacatgagtttatggcgctgtgtatgcgggattttgtggaccattataacggttggatttggggtcatcagggacctcagcttttgacaagggtcttcaagaagtggtgcagcatccgaagtcttgctgaatcacgtgcatgcagaggggtgaccactctcccacctgaagcattttatccgataccatggcaggattggaagaagtacttcgaggatattaacccagaagagctcccaagactgttatcggcaacgtatgctgtccatgtttggaacaaaaagagccaaggcactcgtttcgaggcgacaagtcgggcacttctggcacagctgcatgctcggtattgccctacgacccatgaagccatgaaaatgtacctttag

SEQ ID NO: 107938 - DNA, 1062 bp, Artificial Sequence
  Description of Artificial Sequence: Synthetic coding sequence
atgagtaagccacccgacttgctgcttagactgctccggggcgcgccccggcagcgggtgtgtactctgttcatcattggattcaaattcacttttttcgtctcaatcatgatttattggcatgtggtcggcgaaccaaaggagaaggggcagctgtataacctcccagccgaaatcccatgccccacattgactccccccacgccgccctctcacggtccaactcccggcaacatcttctttctggaaacaagtgaccggacgaatcctaattttttgttcatgtgcagcgtagaaagcgcagctagaacccaccccgaaagccatgttctggtgcttatgaaagggctgccaggcgggaacgcaagtctcccacgacacttaggcatcagcctgctgtcatgctttccgaacgtgcagatgctgccactggacctcagagagcttttccgcgacaccccactcgcagactggtatgccgcggttcaggggcggtgggagccatacttactgcccgtgctatccgatgctagccgaatagccctgatgtggaaattcggggggatttacctggatacagacttcattgtgctgaagaatctgaggaatctgaccaatgtcctggggacacagtccagatacgtcctaaacggcgctttcttggctttcgaaaggcgacatgaattcatggcattatgtatgcgtgactttgtagaccactataatggctggatttggggccaccaaggccctcagctacttacacgcgtgtttaaaaagtggtgctccataaggtctctggcagaatcacgcgcctgccgcggagtcacaacactgcctccagaggcattttatcctattccatggcaagactggaagaaatatttcgaagacataaaccctgaagagctgcccaggctgctcagcgctacttatgcagttcacgtttggaacaagaagagccagggcacgagattcgaggcgacatcccgagcactgctagctcaactgcacgcccgttactgcccgactacccacgaggctatgaagatgtacctgtag

SEQ ID NO: 107939 - DNA, 1062 bp, Artificial Sequence
  Description of Artificial Sequence: Synthetic coding sequence
atgagcaagccccctgatcttttactgcggttgctgaggggagctccccggcagagggtctgcaccctgtttattatcggtttcaaattcacgtttttcgtgtctattatgatatactggcacgtagtgggggagcctaaggagaaaggacagttgtacaacctccccgccgaaatcccttgtccaacactcaccccccccactcctcccagccacggacctacccccgggaacatcttcttcttggagaccagcgaccggacaaaccccaacttcttgtttatgtgttccgtggagtctgccgcccgcactcacccggaaagccacgtgctggtccttatgaaaggcctgccaggtggtaacgcgagcctcccacgacacttgggaatcagtctgctgtcatgtttccctaacgtccagatgctgccccttgatctcagagagctgtttagagacaccccactggcagactggtatgcggctgtacagggacggtgggagccgtacctccttccagtgttaagtgacgcgagccgcattgcacttatgtggaagttcggcggaatctacctcgacactgacttcattgtactgaagaatctgcggaacttaacaaacgttctgggcacacagtcgaggtatgttctgaacggtgcttttctcgctttcgagcgtcgtcacgaattcatggccctctgcatgcgtgatttcgttgaccactacaacggttggatctggggtcaccagggcccgcagctcttaacaagggtatttaaaaaatggtgtagcatcagatcgctggccgaatcacgggcctgcagaggggtcacgacactcccccctgaggccttctatcctattccctggcaggactggaaaaagtactttgaagatattaatccggaggagctgccccgactgctgtccgccacctacgccgtgcacgtgtggaacaaaaaatcacagggaacacggttcgaagcaacatcccgcgccctgcttgctcagctgcacgctcgatattgccccaccacgcatgaagccatgaagatgtacttatag

SEQ ID NO: 107940 - DNA, 1311 bp, Artificial Sequence
  Description of Artificial Sequence: Synthetic coding sequence
atgagtaaaccccctgacttactgttacggcttctccgcggagccccaagacaaagagtgtgtactctctttattatcgggtttaagttcacgttttttgtgagtattatgatctattggcacgtggtcggagaaccaaaagagaagggacagctgtacaatctcccagctgaaatcccttgtccaaccctgacccctcccacaccaccatctcatggccctacgcccggtaatatcttctttctggagaccagcgacagaactaatcctaactttctgttcatgtgcagcgtggagtcagccgcccgaactcatcccgagagtcacgttctggtgcttatgaaaggactacctggcgggaacgcatctctgccccggcatcttggtatctctctcctttcatgcttccccaacgtccaaatgttgcccctggatctgcgcgagctgttccgcgacacgccactcgctgattggtatgcagccgtccagggccggtgggaaccatacttgctaccagtgctgagcgatgcttcacgaattgctctgatgtggaaattcggagggatttatttggacaccgactttatagtactgaagaatctacgtaacctgaccaatgttctggggacccagtcacggtatgtactaaatggcgctttcctcgcctttgagcggcggcacgaattcatggccctgtgtatgcgcgactttgtagaccattataacggctggatctggggccaccagggaccccagctccttacacgcgtgtttaaaaagtggtgcagcattcgatcccttgccgaaagcagagcctgtagaggagtgactaccctgcctcctgaggccttttatcccattccctggcaggactggaaaaaatacttcgaggatattaatccagaggagctcccacgactcctatccgctacctatgcagtgcatgtctggaacaagaagagccagggaaccgcagggcctgctgcttgtccactcctcccccacgacgccagaggacatgagaacgtcttagtgaggggtccgcctggccacctgcctaacctcctacttatggggcactgggccgcgctaccaggtgaggccaggttgcgggctcgggagagagaagcgagagcagccaccgggttacggcaggccgttgaggagctgtgggagcaggcgcaatgggaagcggtggacacaccacgcaccgtgagctgcttagaggctggactcacccatggggctattgccagcgggggaaggagtgtgagcgctcccggcctgttagacaatcgacaggaggggtag

SEQ ID NO: 107941 - DNA, 309 bp, Artificial Sequence
  Description of Artificial Sequence: Synthetic coding sequence
atggctcttctgaaggctaacaaggatctcatctctgccggactgaaagagttcagtgtcctgcttaaccagcaggtatttaacgacccgctggttagcgaagaagacatggttacagtggtcgaggactggatgaatttctacatcaactactatcgacagcaggtgacgggggagccccaggagcgcgataaggctctgcaggagctgcgtcaggaattaaatacccttgctaacccttttctcgccaagtaccgggactttctgaagtcacacgaacttccttcccacccccccccatcatcctag

SEQ ID NO: 107942 - DNA, 1488 bp, Artificial Sequence
  Description of Artificial Sequence: Synthetic coding sequence
atgagcatgctggtggtgtttctgctgttgtggggggttacgtggggccctgtcaccgaggccgcaattttctacgagactcaacctagcctgtgggcagagtcagaatccctcctaaagcccctagcaaatgttacactaacctgtcaagcccacctggaaacgcctgattttcagcttttcaagaacggcgttgcacaggaacccgtgcatctcgatagcccagcaatcaagcaccagtttctccttactggcgacacacaagggaggtatagatgccggtctgggctgtcaacaggatggacccaactgtcgaaactgctggagctcaccgggcccaaatccctgcctgctccgtggctgtccatggcccctgtctcgtggatcaccccgggcctgaaaacaacggccgtctgcagaggcgtgctgaggggcgtcacttttttgctgcggcgcgagggcgaccacgaatttctcgaagtccccgaagcccaggaagatgtggaggcaacctttccggtccatcagccaggtaactacagctgctcttaccgaacagatggagaaggtgccttatcagagccatcggccactgtgactatcgaagagctcgctgcacccccgcctcctgtgctcatgcaccacggtgagtcatcacaagtgcttcaccctggaaataaggtaacgttaacgtgcgtggcaccactttccggcgtggacttccagctcagaagaggggaaaaggaattgctggtgcctaggtctagtacgagcccagacaggattttcttccatctcaacgccgttgctctgggcgatgggggtcactatacttgcaggtacagactacatgacaaccagaacggatggagtggagattccgctcccgtggaactgattctctccgatgagacactgccagcaccggagttttctccggagccagaatccggtcgcgcgttacgtttaagatgcctggcccctctggagggagcccgctttgctctagtgcgcgaggataggggcggcagaagagtccataggtttcagagtccagcaggcaccgaggcccttttcgagctgcataacatttcagttgccgatagcgccaactattcatgcgtatacgtggatctgaaacctccgttcggaggctcagcaccctcagagcgattagagcttcatgtggatggacctcctccacggcctcagttaagagccacttggtctggagcagtcttggctggtcgggatgccgtgctgagatgtgagggccctattcctgacgtgaccttcgaactcctgagggaaggcgagactaaggccgtgaagaccgtgcgcactccgggggccgctgccaacctggaactgatatttgtggggccgcagcatgcaggaaactatcgctgccggtataggtcatgggtgcctcacacttttgagagtgagctgtccgaccccgtcgaactgttggtggcagagtcatag

SEQ ID NO: 107943 - DNA, 1059 bp, Artificial Sequence
  Description of Artificial Sequence: Synthetic coding sequence
atgcggtctctgggtgcactgttgttactgctgtcggcctgtctggcagtgtcggccggcccagtccccacaccacctgataacatacaggttcaggagaattttaatatatcacggatatatggcaaatggtacaatttagcaataggcagcacatgtccatggcttaaaaagataatggatagaatgacggtgagtaccctcgtgctgggggagggtgctactgaggccgaaattagcatgacaagcacacggtggcgaaaaggagtgtgcgaggagaccagcggagcgtacgagaagacagacactgatggcaaatttctttatcataagtctaagtggaatattaccatggaatcctacgtcgttcacactaattacgacgagtatgcaatattccttacaaaaaagttcagccgccaccacggccctaccattaccgctaaattgtacgggcgggcaccacaattgagggaaactttgcttcaagattttcgagtcgttgcacagggagtgggaattccagaagactctatctttaccatggccgacagaggcgaatgcgtgccgggcgaacaggagccagaacctatcttaattccacgcgtgagacgggcggtcctgcctcaggaggaggaaggaagcggtggcggccagctcgtgacagaggtaaccaaaaaggaggatagttgtcagctcgggtattcagctggcccttgtatgggaatgacttcacgctatttttataacgggacctccatggcgtgcgagacgtttcagtacggagggtgcatgggtaacgggaacaattttgttaccgaaaaagagtgcctccaaacatgtcgcacggtagccgcgtgcaatctgcccatagtgagaggcccctgccgggcttttattcaattgtgggccttcgacgcggtaaagggtaaatgcgttctctttccttatgggggttgtcagggaaatgggaataaattctactccgaaaaggagtgtagagagtactgtggagtgccaggtgacggagatgaggaactgctgcgtttcagcaattag

SEQ ID NO: 107944 - DNA, 813 bp, Artificial Sequence
  Description of Artificial Sequence: Synthetic coding sequence
atggaccgaatgactgtgagtactttagtgcttggagagggcgccactgaagcggagatttccatgactagtaccaggtggcgaaaaggagtttgtgaagaaacgtccggggcctacgagaaaacagatacagacgggaagtttttgtatcacaaatctaagtggaacatcactatggagagctatgtagtacacactaactacgatgaatatgcgatttttttaacaaaaaaattctccagacatcacggccctaccattactgcaaagctgtacggtcgagccccacagttaagagagaccctattgcaagactttcgggtagtggctcagggggtcgggattccagaggattctatattcacgatggctgaccggggtgagtgtgtccctggcgagcaagaacccgaaccgatactgattccacgcgtcagacgcgctgtcctgccccaggaagaggaaggtagcggcggaggccagctggtgaccgaagtcacgaagaaggaagacagctgccagctggggtatagcgccggcccatgcatggggatgacgagcaggtacttctataacggcacgagcatggcctgtgagaccttccagtacgggggatgcatgggtaatggcaacaactttgtgaccgagaaagaatgtttgcaaacgtgtcggactgtgggagagtgcggctctccccctctgtgtgcgctgcatccccaggatccagtccccccagtcaatcacttgcgcattgagaaggtagccaatcgagggcactctagcgggcgcacaccgggaggtttcctgaagtcctag

SEQ ID NO: 107945 - DNA, 897 bp, Artificial Sequence
  Description of Artificial Sequence: Synthetic coding sequence
atggtaaggatggtccccgtgctgctgtccctcctgctcctattaggtccggctgtgccccaggagaaccaggatggccggtacagcctcacttacatttatacgggactgtcaaaacacgtggaagacgtgcccgccttccaggcgctgggttcattaaacgatctccagttctttagatacaatagtaaagatagaaagtctcagccaatgggattgtggcgccaggtggaagggatggaagactggaaacaggatagtcaactccagaaagcacgggaggacatcttcatggaaaccttgaaagatatcgtggagtattacaatgactcgaacggaagtcatgtgctgcaaggcagatttggttgcgagatcgaaaacaaccgctcttccggcgccttctggaaatactactacgatggcaaagactacatcgaatttaataaggaaatacctgcctgggtcccgttcgatccagccgcgcagattaccaaacagaagtgggaggctgagccggtttatgtccagcgggctaaggcgtaccttgaagaggaatgtcccgcaaccttgcggaagtacttgaagtactcaaagaatatcttagatagacaggatcccccgagcgtcgtagttacatcacaccaagcaccaggcgaaaaaaagaaattaaaatgcctcgcatatgacttctaccccggcaagatcgacgtccactggaccagggctggagaagttcaagaacctgagcttcgaggcgacgtgctacacaacggcaacggaacttaccagagctgggtggtggtggccgtgcccccacaggacaccgccccttactcgtgccacgttcaacactcctccctggcacagcctctggtcgttccatgggaggcatcctag

SEQ ID NO: 107946 - DNA, 1104 bp, Artificial Sequence
  Description of Artificial Sequence: Synthetic coding sequence
atgaagtccctggtgctcctgctctgcttggcccaactgtgggggtgtcactccgccccccacggcccaggactcatttatagacaacccaattgtgacgacccagagacggaagaagctgcgctggtggccatagactacatcaaccagaacttaccttggggttataagcatactttgaaccaaattgatgaagtgaaggtctggcctcagcaaccctcaggggaactattcgaaatcgaaatagacaccctcgaaacaacctgtcacgtcctcgatcccacccccgtcgcgagatgttcagttcgtcagctgaaggagcacgccgtcgaaggcgattgtgacttccagctcctgaagcttgacgggaaattcagcgtcgtttatgccaaatgcgacagctctcccgactcagctgaggacgtgcggaaggtatgtcaagattgtcccctgttggccccgctcaacgacacaagggtcgtgcatgctgccaaggcagcccttgctgcattcaacgcccagaataatggatccaacttccagctggaagagattagtcgagctcagctcgtccccctcccgccgtccacctacgtggaattcaccgtgtcaggcactgactgtgtggctaaggaggcaacggaagccgcaaagtgcaacctgctcgccgaaaagcaatacgggttttgtaaggcaactctgtctgaaaagctcggcggggctgaagtggcggtcacctgcatggtatttcagactcaaccagtgtcatctcagccgcaacccgaaggtgccaacgaagccgtgccaaccccagtagttgatcctgacgctccacctagccctcccctgggcgcgcctgggctccccccagcgggcagtccgcctgattcacacgtcctgcttgccgcccccccaggccaccagctgcacagggcccattatgacctgagacacactttcatgggcgtcgtctctctgggaagcccttccggggaagtctcgcatccacgaaaaaccagaaccgtggtgcaacctagcgtgggggctgctgctggacccgtggtgccaccttgcccagggcgcattcggcattttaaggtctag

SEQ ID NO: 107947 - DNA, 1302 bp, Artificial Sequence
  Description of Artificial Sequence: Synthetic coding sequence
atgtttgctgggtgctttttttttctgcttaatcagtctcgtaatcaccctgtgtccctttgtaacagttccggaagactccaacagattaataaagcacatcacccaccgtgggtgtatctgagccagcagtcaacttgggttggccccgaagcgtccaatcacctccacgcttgccaagggctcagtggcgctgctatgaagtcgcttgtgctgcttttgtgcctagcacagctctggggatgtcactccgctccccacggaccagggcttatatacaggcagcccaactgcgatgaccctgagacggaggaagccgcactggtggccattgattatattaaccagaatctcccatggggatataaacacacgcttaaccagatcgatgaagttaaagtgtggcctcagcaacctagcggagaactgttcgagatcgagatagacacccttgagactacatgccacgttcttgacccaactcctgtggccaggtgcagtgtgaggcagctgaaggagcacgccgtcgaaggagattgcgattttcagctgctgaagctggatgggaaattcagcgtggtatatgctaagtgcgattcctctcctgatagtgcagaggatgtgagaaaagtgtgccaggattgccctctgctggcacccctcaatgacacgagagtagtgcatgctgccaaagcagcgttagcagctttcaatgctcaaaacaatggaagtaatttccaactggaagagatctctcgtgctcagctagtgcccctgcccccatctacatatgtggagtttaccgtgtctggtactgattgtgttgcaaaggaagcgacagaagccgctaaatgcaatttgctggcagagaaacagtacggattttgtaaggctactctcagcgaaaagctggggggggcagaggtggccgtgacgtgtatggttttccagacgcagccagtgagtagccaaccacaaccagagggagcaaacgaagccgtccccactcccgtcgtcgatccggacgctcccccttctccacccctgggagcgcccggtttgccacccgcagggagccctcctgattcccatgttctcttagccgcccccccaggccatcaactgcatagagcccactacgacctgcgtcacacgttcatgggcgttgtgtcattggggtctccatctggagaggtgagtcaccctaggaaaaccagaacagtagtccagccaagtgttggggcggcggccggacccgtggtgcctccgtgtcctggccgcatcaggcatttcaaggtttag

SEQ ID NO: 107948 - DNA, 4425 bp, Artificial Sequence
  Description of Artificial Sequence: Synthetic coding sequence
atggggaaaaacaaactgttgcatcccagtttggtgcttttgttgctcgttttacttcccacagatgcttccgtatctggcaagcctcagtacatggtacttgtgccatctctacttcatactgagactaccgaaaaagggtgcgtgctgttgagctatttaaatgagacggtgaccgtgagcgcctccctcgaaagcgtgaggggaaacaggagcctgttcactgatctggaggctgaaaatgatgtgctccattgtgtggctttcgccgtcccaaagtcaagcagcaatgaggaagtcatgttccttacagtccaggtgaagggacccacacaagaatttaagaagcggaccacggttatggtgaagaatgaagactccctcgtgttcgtgcagaccgataaaagcatttacaagcctggccaaacggtcaagtttagggtcgtttctatggacgaaaacttccatccacttaacgaactgattccccttgtatatatacaggacccaaagggtaatcgtatagcccagtggcaatcgttccagctggaaggtgggctaaagcagtttagctttccactttcgtccgagccgttccaggggtcgtacaaagtagtggtccaaaaaaagtcaggggggcgcaccgaacacccattcactgtagaagagttcgtcctaccgaaattcgaggtgcaggtaactgtccctaagatcattactatccttgaggaagagatgaatgtcagtgtgtgcggattgtacacctatgggaaaccggtgcccggccatgtcactgtgtccatttgccgtaagtatagcgacgcctccgactgccacggtgaggactctcaggcgttctgtgaaaagttttctgggcagctaaattctcatgggtgcttctatcagcaggtgaaaacaaaggtgttccaattgaagcgcaaagagtatgaaatgaaactgcacaccgaggcccagattcaagaagaaggtacggtggttgaactgaccggtcgacagtctagtgaaatcacacgaaccatcactaaactctctttcgtgaaagtggatagtcatttcagacagggcatccccttctttggacaggtccgcctcgtggacggaaagggggtgccaatccctaacaaagttatatttatacgagggaatgaggctaattactactctaatgccaccacagacgagcacgggctggtccagttttccatcaacacgacaaacgtgatggggacctctcttacagtgagagtaaattataaagacagaagcccatgctatggataccagtgggtgtctgaggagcatgaggaggctcaccacacagcgtacctggttttctcgccctctaaatcattcgtgcatctggaacctatgtcccacgagctaccatgcggacacacccaaacagttcaggcccattacatattaaacggcggcacactgctgggtctcaagaaactcagtttttactatcttattatggccaaagggggcattgtgcgaactgggactcatgggttactcgtcaagcaagaggatatgaagggacacttctctatctctatccccgttaaatctgacattgctccggtggctaggctgcttatctacgcagtgcttcctacaggcgatgtaattggcgattcagcaaagtacgacgtggaaaattgcttggctaacaaagtcgacctctccttttccccatcacagtctctccccgcatcgcacgcgcatttgcgagtgacggctgcaccccagtccgtttgtgcactgagagccgttgatcaatcagtcctgcttatgaagcctgatgccgagctgtcggcctcctcggtttataatttgctacctgaaaaagacctcacaggatttccaggccctctcaacgatcaggataacgaagattgcataaatcgccataacgtgtatattaatgggattacatacacacccgtctcaagtacgaatgaaaaggacatgtattcctttcttgaggacatgggcttgaaggcattcactaactcaaaaattcggaaacccaagatgtgtccccaacttcaacaatatgagatgcatgggccggagggcctgcgggtcgggttttatgaaagtgatgttatgggaagaggacacgcccgactggtgcacgttgaagaacctcacacagagaccgtccggaagtactttcctgaaacctggatatgggatctcgtagtggtgaactcagccggggtcgctgaagtaggtgtgaccgtgccagataccattactgagtggaaagccggggcgttttgcctgtcggaggatgccgggcttggcatcagtagcactgcatcactgcgcgcatttcagcctttttttgtcgagctgaccatgccctattctgtgattcgcggcgaagctttcacccttaaagcaactgtgctcaactatctccctaagtgtatccgcgtgtccgtgcagctcgaagctagtcctgctttcctagccgtacctgtggagaaagaacaggccccgcactgtatttgcgcaaacgggcgccaaacagtcagctgggccgttactccaaaatcgctgggtaacgttaactttactgtctctgctgaggccctggagagccaggagttgtgtggcaccgaagtgcctagcgttcccgagcatggtcgtaaggacacggtaataaagcctttactagtcgaaccagaaggccttgagaaagaaacaactttcaattctctgctgtgtccttccggcggggaggtgtcggaagaactttcattgaaactgcctcctaacgtagtggaagaaagtgccagggccagtgttagcgtgctgggagacatactcggcagtgccatgcaaaatacccagaatcttcttcagatgccttacggatgtggggagcagaacatggtgctttttgctcccaacatctacgtactggactacctgaacgaaactcagcagttaacacctgagattaaaagtaaagctatcggatatctaaataccggttaccagaggcagctgaactacaaacattacgatggaagctactctacttttggggagcggtatggccgcaatcaaggaaatacatggctgacagccttcgtcctgaagacatttgcacaggcacgagcttacatctttatagacgaagctcacataacacaggcactgatttggctgtctcagcgtcagaaggataatggatgctttagatcttcagggagcctgctgaacaacgcaattaaagggggcgtcgaggacgaggtgaccctgagcgcctatattacaattgcactgctggagatacctctgaccgtaactcacccagtagtgaggaatgctcttttttgccttgaaagcgcctggaagacagcccaggaaggcgaccatggatcccatgtttataccaaagccctgctggcctatgcattcgctctggcgggcaatcaggacaagcgcaaggaggtgctgaagagtttgaacgaggaagcagtaaaaaaggacaactctgtccactgggagaggccgcaaaagccaaaagctcccgtgggccacttctacgaaccacaggcgccatcggctgaagtggaaatgacttcctacgttctcctggcttatctaacagctcagcctgcgcctacctcagaggacttgacttccgccacgaatatcgtgaaatggattacaaagcagcagaacgcacagggcggcttctcttctacacaagataccgttgttgcgcttcatgcgctatccaaatacggagctgccacctttaccagaacgggcaaggctgcacaggtcacgatccagagcagcgggactttcagcagcaagtttcaggtcgataataacaaccggctgctgttgcagcaagtctccttgcccgagctgcccggcgagtactctatgaaagttaccggagaagggtgcgtgtaccttcaaaccagtctgaagtataacattctgcccgaaaaggaagagttcccttttgctctgggggttcaaactcttccccaaacttgcgacgagccgaaggcccataccagctttcaaatctccctgtctgttagttatacgggcagccgctccgctagcaacatggccatcgtcgacgtaaagatggtcagtggattcatccctcttaaaccgacggtgaagatgctggagaggtctaaccacgtttcacgcaccgaggtgtcctctaaccacgtccttatctacctggacaaagtatctaatcagaccctttccctgttcttcacagtactccaggatgtccccgtgagggatttgaaacccgcaatcgtaaaggtgtacgactactacgaaaccgatgagtttgccatagccgaatacaacgccccatgcagcaaggatctgggcaacgcttag

SEQ ID NO: 107949 - DNA, 507 bp, Artificial Sequence
  Description of Artificial Sequence: Synthetic coding sequence
atgggcaagaacaagctcctacatccttcactggtcctgttgttgcttgtactgctccccaccgacgcaagcgtctccggtaaaccccaatatatggtgcttgtacccagccttttgcacacggaaacaacagaaaaaggatgtgtgctcctgagctacttgaacgaaacagttaccgtgagtgccagcctggagagcgtgcgagggaatagatccctcttcactgacttggaggcggaaaacgacgtgttacactgtgtggcatttgcagttcccaagagtagctcaaatgaagaggtgatgttcctaacagtgcaagtgaagggaccgacgcaggaattcaagaagcgcacgacagttatggtgaaaaacgaagatagcctcgtgttcgttcagactgacaagtcgatttataagccgggtcagactgtgaaattccgcgtagtgagtatggacgagaattttcatcctctaaatgagctcatccccctggtatacatccagtag

SEQ ID NO: 107950 - DNA, 4470 bp, Artificial Sequence
  Description of Artificial Sequence: Synthetic coding sequence
cgagtgcagtacgtatgcagcccgccagccccctccttctgcaatatgggcaaaaacaaattgctgcatccgagtcttgtgctgctactgctggttctgctgcccactgatgcaagtgtttccgggaagccccagtacatggtgcttgtgccctcactgcttcatactgaaactaccgagaaaggatgtgttttgctatcctatcttaacgagacagtgactgtctcagctagccttgagagtgtcagaggaaaccggtctcttttcacagacctggaagcagaaaacgacgtccttcactgcgtcgcttttgcggtgccaaaaagtagctctaacgaggaagttatgttcctgactgtccaagtgaagggccccacccaggagttcaaaaagcgcacgactgttatggtgaagaacgaggactccctggtttttgtccagaccgacaaaagtatatataaacctggacagactgtgaagttccgcgtcgtcagcatggacgagaattttcacccactcaatgaattaatcccactggtgtacatccaggaccctaagggtaaccgaatcgcccagtggcagagctttcagctggagggaggtctgaaacagttctccttccccttatcttcggagcccttccagggctcttataaggtggtggtccagaagaaaagtgggggccgaaccgaacaccccttcacggttgaggagtttgtgctgccaaagttcgaagtacaagtgacggtgccaaaaatcataacgattctagaggaagagatgaacgtgagtgtatgtggattgtatacatatggaaaacctgtgccaggccacgtaacagtgtctatttgcagaaagtattccgatgcctccgattgccacggtgaggactcacaggccttctgcgaaaaattcagcggccagcttaacagtcatgggtgtttttaccagcaagtgaagacaaaggttttccagctgaagaggaaggaatatgaaatgaaactgcataccgaggcacagatccaggaggaaggtactgtagtcgagttaacggggcggcagtcttcggagattaccagaacaattactaaactcagttttgtgaaggtggatagccacttccggcaaggcatccctttcttcgggcaggtccggctagtggacgggaagggcgtccctattcctaataaggtcatcttcattcgcggaaacgaagcgaattactacagtaatgccaccaccgatgagcacggcctggtgcagttctcaattaatacaaccaacgtcatgggtaccagcctgacagtgagggtaaattacaaggatcggtccccatgctatggttaccagtgggtgtcggaggaacatgaagaagcccaccacacggcttaccttgtattttcaccttccaagtctttcgtgcacctcgaaccgatgtcccatgagcttccttgcgggcacacacaaactgtgcaggcccactatatcttgaacggtgggaccctgctgggcctcaaaaagctctctttttactacctaataatggcgaagggtggcatagtcagaactggtacgcacgggctgcttgtgaaacaagaggacatgaaggggcacttttccatctctattcctgtgaagtcggacatagcacctgtggctcggctgcttatatatgccgttctccctacaggtgatgtcatcggtgattccgccaaatacgacgtcgaaaattgtttagcaaataaggtggaccttagcttctccccctcacagtctctgcctgcttcccatgcacacctccgcgtgaccgccgctccacagtcagtgtgtgcactgcgagccgttgaccagagcgtgttgctgatgaagcccgacgctgagctgagcgcatcttcagtgtataatcttctccctgaaaaggatcttaccggattccctggacctctcaacgatcaggacaacgaggattgtatcaaccgtcacaacgtctatatcaacggcattacctacacgccagtgagttccaccaatgaaaaggatatgtacagcttcctcgaagatatggggctaaaagcttttactaattccaaaatacgcaaaccaaaaatgtgtccccagttacagcaatacgaaatgcatggcccagagggtctgagagtaggcttttacgaaagcgacgtaatgggacggggccacgcccgcctcgtacatgttgaagagccccatacagagaccgtgaggaagtattttccggagacctggatctgggatttggtggtcgttaacagcgccggagtggccgaggtaggagtcacagttcctgatactattacagagtggaaagccggagcattctgtctgagcgaggatgcggggctcggcatttcatccactgcttctctccgagctttccagcctttctttgtggagcttacgatgccttattcagtcatccgtggagaggcatttaccctgaaagctacagtgctgaattatctgcctaagtgcattagagttagtgttcaattggaagcatcaccagccttcctggccgtaccggtggaaaaggagcaagcccctcactgcatctgtgcaaacggccggcaaacagtgtcctgggctgtgacccccaagagcctcggcaacgtgaacttcacagtgtcagctgaagccctggaatcccaggagctgtgtgggacagaagtgccttctgttcccgaacacggccgtaaagatacagtgatcaagcctctgctcgtcgagccggaaggcctggaaaaagaaactacttttaacagccttctttgccctagtgggggtgaagtttctgaagagctctcgcttaagctaccgcctaatgtagtcgaggagtccgctagggcatccgtgtccgtgctgggggacattcttgggtcagccatgcagaatacccagaacctccttcagatgccctacggttgcggcgaacagaatatggtgctgtttgcccccaatatttacgtgcttgactatctgaacgagactcagcagttgacaccggaaatcaagtccaaggctattggctatctaaataccggctaccagcgacagctcaattacaaacactatgacggcagctactcaacctttggagaacgatacggacgcaaccaaggcaatacttggctcaccgcgttcgtgttaaagacattcgcacaggctcgagcttatattttcattgacgaagcgcacattacacaagcgctgatctggctcagccagagacagaaggacaacgggtgcttcagaagctctggctcgctgcttaacaatgctattaaaggaggggtcgaggacgaagtcactttgtccgcatatattaccatcgccttactggagattcctctcaccgtaacccaccccgtagtgagaaacgctctgttctgcctcgaatccgcctggaagaccgctcaggagggcgaccatggtagtcatgtgtacaccaaggcccttctcgcctatgcatttgccctggcgggaaaccaagacaaacggaaggaggttctaaagtccctgaatgaagaggcggttaaaaaggataattccgttcattgggaaaggcctcagaagccaaaagctcctgtaggacacttctacgagccccaggctccttccgctgaggtagagatgacctcttatgtgctactggcgtacctgaccgcacaacccgcaccaaccagtgaagacttgaccagcgccaccaacatcgtgaagtggatcactaagcagcaaaacgcccaaggagggttttcctcaactcaggatacagtagtggccctgcacgctctttctaagtatggtgcggcgactttcacgcgaacaggcaaagctgcgcaggttacaattcaatccagtggaacgttctcgtcaaaatttcaggtcgacaacaacaacaggttgctgcttcagcaggtgtctctgccagaactgcctggggaatactccatgaaagtaacgggtgaaggctgtgtatatttacagacttctctaaaatataatatcttgccggagaaagaggaattcccatttgcccttggggtccaaacactccctcagacatgtgacgagcctaaagcccacacctcctttcagatttcactcagcgtctcttacacggggagtcggagcgcctcgaacatggcgatcgtagacgtgaagatggtcagcgggtttatccctcttaaaccgaccgtcaaaatgctggagcgctctaatcacgttagtagaacagaagttagttctaaccacgtgctgatatacctggacaaggttagcaatcagactctcagtctgttctttactgttctccaggatgtgcccgtgagagatttaaaaccagccatcgtgaaggtgtacgactactacgaaaccgatgagtttgcaatagctgaatataacgccccatgttcaaaagatttggggaacgcttag

SEQ ID NO: 107951 - DNA, 4365 bp, Artificial Sequence
  Description of Artificial Sequence: Synthetic coding sequence
atgtgggcccagctgttgctcggaatgctggccctgagccccgcaatcgccgaagaactacccaactatctcgtaactctaccggcaagactgaatttcccaagcgtgcagaaggtgtgtctggatttgtcccccggctattcggacgttaagttcaccgtaaccctcgagacaaaggataagactcaaaagttgttggagtactccggcctgaaaaagaggcacctgcattgtatttcctttttagtgccaccacccgcagggggcacagaggaggtggccacaataagagtgagtggagtgggaaataatatcagcttcgaggagaagaagaaggtcctgattcagagacaggggaacggtaccttcgtgcagacagacaagcctttatacactcctgggcagcaggtgtattttaggatcgtgacaatggacagtaacttcgttcccgtcaatgacaaatacagtatggttgaactacaggaccccaactcgaacagaattgctcagtggctcgaggttgttccagaacagggcatcgttgatctaagcttccagctggccccggaggctatgctagggacctatacagtcgccgtggctgagggaaaaaccttcgggacattctcagtggaggagtacgtgttgcccaagtttaaggtggaggtggtcgagccgaaggaattatccacagtccaggaatcctttcttgtaaagatctgctgccggtacacatacggtaagcccatgctgggggccgtgcaggtaagcgtttgccagaaagccaacacctattggtatagagaagtggagcgcgagcagttacctgataagtgccgaaacttatcgggccagactgataagaccggctgcttctccgcccctgtcgacatggctaccttcgatcttattggttatgcgtacagccatcaaatcaatatagttgccactgtggtcgaagaaggaactggcgtggaggctaatgctacccagaatatctacatcagcccacagatggggtccatgacatttgaagatacttctaacttttatcaccccaatttccccttttcaggcaagattagggtgcgtggccacgacgatagcttcttgaaaaatcatctcgtgtttctggttatctacggcacgaacggaacattcaaccaaacacttgtcaccgacaacaacggtctcgccccctttactcttgagacctccgggtggaacggcactgatgtgtcactggagggaaagttccagatggaagatctggtttataatcctgaacaggtgcccaggtattaccaaaacgcttatctccatctgcgccccttttacagcactacacgctcgtttctgggcatccaccggttgaacggccccttgaagtgtggtcaaccccaggaggtccttgtggattactacattgatcctgcggacgcctctcccgatcaagagatcagcttctcatactatctgatcgggaaaggctccctggttatggaaggacagaaacacctaaactcaaaaaagaaaggtctgaaagccagcttctctctgagcctaacatttacatcacgattagcacctgatcccagcttagtaatctatgcaatcttcccgtccggtggcgtcgtggccgacaagattcagttctcagttgagatgtgcttcgataaccaagtctccctcggctttagccctagtcagcagcttcccggggcagaggtggagcttcaattgcaggccgcaccgggcagtctgtgcgctctgcgagcagtggacgagtccgtacttcttcttagaccggaccgggaactaagtaacaggtccgtgtacgggatgttcccgttctggtatggccactacccataccaagtggctgaatatgaccagtgtcctgtttccgggccttgggattttccacaacctcttatagaccctatgccccagggccacagttcccagcgctcaataatttggcggcccagcttcagtgaggggacagacttgttttctttctttagggacgtaggcctgaaaatcctgagtaatgctaaaatcaagaagcctgttgattgtagtcaccgtagcccggaatacagcacagccatgggagccggcggcggacaccctgaggccttcgaatccagcacacctctccaccaggccgaagactcccaggtgcgccagtactttccggaaacctggctctgggatcttttccccattggcaatagtgggaaagaagctgtgcatgtcactgttccggatgctataactgagtggaaggccatgtctttttgtacctcccagagccgggggttcggcttgagccccacagtgggtctcacggccttcaaaccatttttcgttgatttgacactgccatacagcgttgtcaggggcgagagttttcgattgactgccaccatattcaattatcttaaggactgtatccgcgtgcagactgacctggccaagagccacgaataccagctggagtcctgggccgatagccaaacctcttcttgtctgtgcgcagatgacgctaagacccaccactggaatataactgctgtgaaactgggccatattaacttcactatttctactaaaattttggactccaacgaaccctgtggaggacaaaaaggatttgttccccagaagggaagatccgacaccctgatcaagcccgtacttgtcaaaccagaaggagtgcttgtagaaaaaacacactcatctctgctctgccctaaaggcaaagtagcatccgagagcgttagccttgagctcccggtggatattgttccggacagtacaaaggcctacgtaacagtcctcggtgacattatggggacagcactgcagaaccttgacgggttggtacaaatgccttccggctgtggcgagcaaaacatggtattatttgcaccaatcatctacgttttacagtacttggaaaaagctggacttctcactgaggaaatcaggtctcgcgcggtcggattcctggaaattggctaccaaaaggaactgatgtacaagcatagcaacggtagctactcagccttcggcgagcgggatggcaacgggaacacatggctgacagcgttcgtgaccaagtgctttggccaggctcagaagtttattttcatcgatcctaagaacattcaggacgccctaaagtggatggcaggcaatcagttgccttccggttgctacgccaacgtaggcaacctcctgcataccgccatgaagggaggagtggacgacgaagtaagcctcaccgcttatgtgacagccgccttattagaaatgggaaaggacgttgatgacccgatggtgtcccaaggactgcggtgtttgaagaattctgccaccagtacaactaacctgtatactcaagccctgctagcctatatctttagcctggcgggcgagatggacatcaggaacatactactcaaacagttagatcaacaggccattatcagtggagagagcatttattggtctcagaaacctacgcccagcagtaacgcctctccatggagcgaaccagcagccgtggacgtggaactgacggcctatgcattgctggcccagctaaccaagccaagcttaacacagaaagagatagccaaagccacgtctatagtggcttggctggccaagcagcacaacgcttacgggggcttctcatctacacaggatacagtggtcgcgctacaggccctggcgaaatacgccacaacagcctacatgccatcagaggagattaatctggtcgttaagtctacggagaacttccaaagaaccttcaacatccaatccgttaacagactggtgttccagcaggacacattgcccaacgtgcccgggatgtacactctggaagcgagcggccaaggatgcgtctatgtgcagacagtgctgcgctacaacatcttaccccctacaaacatgaagaccttctccttgagtgtcgagatcggcaaggcaaggtgcgagcaacctactagtcccagaagccttaccctgactatacatacgtcatatgtaggatctcgaagttccagcaatatggccattgtggaggtgaaaatgttatccgggtttagccccatggaaggcacgaaccagttgctcctccagcagccactcgtgaaaaaggtggagtttggaacagatactcttaacatttacctagatgaactgattaaaaatacccagacctatactttcacgattagccaaagcgtgctagtcacgaacctcaagcccgccaccattaaggtgtacgattactatctgcccgacgagcaggccacaatccaatactccgatccctgtgaatag

SEQ ID NO: 107952 - DNA, 4365 bp, Artificial Sequence
  Description of Artificial Sequence: Synthetic coding sequence
atgtgggcgcagcttttgttaggaatgttagctttatctccggctattgccgaggagttgccaaattatctggtgacactcccggcccgacttaattttccttccgttcagaaggtgtgtctggacctgtcaccagggtacagcgacgtcaaatttacagtgactctcgagacaaaagataagacccagaaactgctggagtactctggcctcaaaaagcggcacctgcactgtatcagttttttggtgcctcccccagccggcggcaccgaggaagtggccaccattagggtgtctggcgtgggcaataacattagcttcgaggaaaaaaagaaagtattgatccagcgccagggaaatgggactttcgttcagacggacaagccgttgtacacaccaggacaacaggtgtatttccgtatcgtcacgatggacagtaacttcgtacccgtcaatgacaaagtgtcatgggaagaaggccaggatcccaatagtaacagaatcgcccagtggctggaggtggtaccagaacagggcattgtcgacctgagcttccagctcgcacccgaagctatgctcggcacctatacagtggcggtggccgaggggaagaccttcggaactttctcagttgaggagtatgttctgcccaagttcaaagtcgaggtcgtagagccaaaggaactaagcacagtgcaagagtcatttctcgttaaaatctgttgtcggtacacttacggcaagccgatgctcggagctgttcaagtgagcgtgtgtcaaaaagccaatacctattggtatcgggaggtggagagggagcaactccccgacaagtgcaggaacctgtccgggcagaccgataaaacaggctgtttctccgctcccgtggatatggctaccttcgatctcattggatacgcctacagccaccaaataaacattgtcgctaccgtggtcgaagaaggaactggggttgaggcaaatgccactcagaatatatatatcagccctcagatgggcagtatgacttttgaagataccagcaacttttatcatcccaattttcccttctccgggaaaattagagttcgcggccacgacgacagcttcctgaaaaaccatctggtgtttttggtgatttacggcacaaatggtacattcaatcagacgctggttactgataacaacggactggctcctttcacactcgaaacgtccggctggaatggcaccgatgtgtccctagagggcaaatttcaaatggaggacttagtctataatcctgagcaggtcccacgctattaccagaatgcctacctccacttgcgccctttctattccacaacgcgaagttttctaggaattcacaggttaaatggaccactgaagtgtgggcaaccccaggaagtgcttgtggactactatattgaccccgccgacgcgtctcccgatcaggagatctcattctcgtactatctgattggcaagggctccctcgttatggagggccagaaacatttgaattctaagaaaaaaggactgaaggcctcattttccctgtcattgaccttcacatcgcggctagccccagatcccagccttgtgatctacgctatctttccaagcggtggcgtggtggctgataaaattcagtttagtgtggagatgtgcttcgataatcaggtcagcttgggtttctccccctcacagcagcttccgggcgctgaggttgagctgcagttacaagccgcaccagggtccttatgcgccctgagagcagttgacgagagcgttctgctgcttcgccccgatagggaattgtcgaacaggagcgtgtacggcatgttcccattctggtatggacattacccctaccaggtcgctgaatacgaccagtgcccagtcagcggcccgtgggatttcccgcagccactgattgatcccatgcctcagggacacagctcgcagaggagcattatttggcgtccgtccttttcagagggcacggatctattcagcttcttcagagatgtcggcctcaagattctgtccaacgccaagatcaaaaagcctgtggattgctctcaccggtctcctgagtactcaacagccatgggggccgggggaggtcacccagaggcctttgagtcaagcacacccctgcaccaggccgaggactcccaggtgcggcagtacttcccagaaacctggctgtgggatttgttcccaatcggaaacagtggcaaggaggcagtacatgtaacagtaccagacgcgattacagagtggaaggctatgtcattctgcaccagccagagtagaggcttcgggctttccccaacggtaggattgaccgcgttcaagcccttctttgtagatctgacgctgccatacagtgtggtgcgaggtgagagttttaggctgacggccacaatatttaattatctgaaggactgtatacgcgttcagacagatcttgccaaatcccatgaataccagttagaatcttgggcagactcacagaccagctcttgtctgtgtgccgacgacgccaaaacccaccattggaatatcacagcagtcaagctcggccacatcaacttcactatcagcactaagatactggactctaatgagccatgcggaggccagaagggattcgtgccacaaaagggcaggagtgacaccttgattaaacctgtgctggtcaaaccagagggagtactggtcgagaaaactcacagctccctcctgtgccccaagggtaaggtggccagcgaatcagtgtctctggaactgccagtagacatcgtgcctgacagcacaaaagcatacgtcaccgtcttaggggatattatgggcacagccttacagaacttagacgggcttgttcaaatgccctctggttgcggcgaacagaatatggtcttgtttgcccccataatttatgttttacagtatcttgaaaaagctgggctgttaacagaggagatccggtcccgcgctgtgggctttcttgagatcggatatcagaaagagctaatgtataagcatagcaacgggagctactctgcttttggagaacgggatggaaatggaaatacatggctgactgcattcgtaactaagtgctttggccaggctcagaagtttatttttatcgacccaaagaatattcaggatgcactgaaatggatggctgggaaccagctgccctccgggtgctacgctaacgtgggcaatcttctgcacactgccatgaagggcggggtggatgatgaggtgagtctcaccgcttacgtaacggccgcattactggagatggggaaggatgtcgacgaccctatggtctcccaaggcctccgatgtcttaaaaacagcgctacctcaactactaatctctacacccaagcccttctcgcctatatcttcagcctggctggggaaatggacatcagaaacattctattaaaacagcttgaccagcaggccatcatttctggggagagcatctactggagccaaaaaccaaccccttctagcaacgcctccccatggtctgaacccgccgccgtcgacgttgagctcactgcgtacgccctgctggcccagctgactaagcctagcctaacacagaaggagattgccaaagcaacctccatcgtggcctggctggctaaacaacataacgcttacgggggtttcagcagcacccaggatactgttgtggccttgcaagcactcgcaaagtacgccactacagcatatatgccctctgaggaaataaacttagtcgtcaaatcaactgaaaactttcaaaggacctttaatattcagtcagtgaatcggctcgtctttcagcaggatactctccccaacgtacctggcatgtatacattggaagctagcggacagggatgcgtctacgtgcagactgtgctgaggtacaatatcctgcctcctaccaacatgaagacattctccttatccgttgagatcggcaaggcaaggtgtgaacaacccacaagccctcgtagcttaacgctgacaattcatacttcatacgttggatcaagatccagcagcaacatggcaatcgttgaagttaaaatgttaagtgggttctctcccatggagggcacaaaccagctgctcctccagcagccactcgtgaagaaggtcgaatttggcacggatactcttaatatttatctcgatgaactgataaaaaatacccagacatacacatttaccattagccagtccgtactcgttactaatctgaagcccgcgaccatcaaagtctatgactactatttgccggacgagcaggccacaatccagtatagcgatccctgcgaatag

SEQ ID NO: 107953 - DNA, 3015 bp, Artificial Sequence
  Description of Artificial Sequence: Synthetic coding sequence
tcctttctcggtatccataggttgaacggcccattaaaatgtggacagccgcaagaggtcctggtcgattactatatagacccggccgatgcctcgcccgatcaggagattagcttttcctactatcttattgggaagggtagccttgttatggaagggcagaagcatctgaattccaagaagaagggactcaaggccagttttagtctctctctcacattcacaagccggttagcacctgaccccagcctggtgatttatgcaatcttcccaagcggaggagtggtggcagacaaaatacagttttcggtcgaaatgtgttttgataaccaggtctcactgggattttctccaagccagcagctccctggggcagaggtcgaattacaactgcaagccgcacctggctccttgtgtgccctgcgagccgttgatgaaagcgttctgttgttgcggcctgaccgagagctgtccaaccgctctgtgtacgggatgtttccgttctggtacggacattacccgtaccaggtggcagagtatgatcagtgcccggtgtctggaccatgggatttcccccagccactgatcgatcccatgccacaaggccattccagccaacgttccattatttggcgccccagcttcagcgagggcacagatcttttctcttttttcagagacgtaggcctgaaaatcctcagcaacgcgaaaatcaaaaagccagtagactgctcccatcgctctcccgaatattcaacagcaatgggggccgggggggggcatccagaggcattcgaatcttctacgcctctgcaccaagctgaagatagtcaggtgcgacaatatttcccagagacttggctttgggatctgttcccgattggaaacagcggcaaggaagctgtccacgtcactgttccagacgctatcacagaatggaaagccatgtcattctgcacctcgcagagccggggttttggattgtcccccacagtgggcctgaccgctttcaagcccttctttgtggatctgacactgccctattctgtcgtgcgtggcgaatctttccgcctgactgccactatttttaattaccttaaagattgtatcagagttcagaccgatctggccaagagtcatgagtaccagctcgagtcctgggccgactcacaaacatcatcctgtctttgtgccgatgacgccaagacccatcactggaacattaccgcagttaaactaggccatataaatttcactatttcaacaaagattctggattctaacgagccttgtgggggacaaaagggttttgtcccccagaaaggccgatcagacaccctgatcaagcctgtattggtgaaacccgagggcgtgcttgtggagaaaacacattcttccttgctatgccccaaaggcaaggtagcttcagagagcgtgagccttgagctccctgtcgacatcgttccagactccactaaagcctatgtgaccgtactgggggacatcatgggcacggcgctgcagaacctggacggactcgtgcagatgccaagtgggtgcggcgaacagaacatggtccttttcgcacctatcatctatgttttgcaatatctcgagaaggccggcctgctcaccgaagaaatccggtcacgggccgtgggattccttgagatcggataccagaaagaactgatgtacaagcatagtaacgggtcttactcagcctttggtgagagggatggcaacggaaacacatggctaactgcctttgtaacaaagtgttttggccaagcccagaagttcatttttatcgatcccaagaacatccaggatgcccttaaatggatggcagggaaccagctgcccagcggatgctacgccaacgtgggcaatctgctgcatacagcaatgaagggaggggtggacgatgaagtctctttgaccgcctacgtaaccgctgccctgctggaaatgggtaaggatgtggacgacccgatggtgagtcagggtctgcgttgtctgaagaatagtgctaccagcacaactaacttatatacccaggcactcctggcctacatctttagtctagccggcgagatggacatccgtaacattctcctaaagcaattagaccagcaggccattatttcaggggaaagtatctattggagtcagaagccaacgcccagctcgaacgcttcaccgtggtccgaacctgcagctgtggatgtggaattaacagcctatgcgctgctcgcccagctgaccaaaccgtctctgactcagaaagaaatcgcaaaagccacctctattgttgcatggctggccaaacaacacaatgcctacggagggttctcctctactcaggatacggtcgtggctcttcaagccctcgcgaagtacgcaaccacagcctacatgccatctgaggagatcaaccttgtggttaagagcacagagaactttcagaggacatttaacatccagtcggtaaacagactcgtattccagcaggacacactccccaacgtaccaggaatgtataccttggaggcttcaggccaagggtgcgtttatgtccagaccgtgttacgatataacattctgccacctactaatatgaagactttcagtctgtctgtggaaattggcaaagcccggtgcgagcaaccaaccagtcctagaagccttactttgaccatccatacttcctatgtgggatcccgaagcagctctaatatggctatagttgaagttaagatgctttcgggtttctccccaatggaaggaactaatcagctcctgctgcagcagccgctcgtgaagaaggtcgaatttggtactgatacattaaatatctacctggacgagctgatcaagaatacacaaacttacacatttacaatctctcagtctgtgttggtcacgaacctgaagcctgcaaccattaaggtttatgactactatctgcctgatgagcaggcaactattcaatattcggacccctgcgaatag

SEQ ID NO: 107954 - DNA, 1830 bp, Artificial Sequence
  Description of Artificial Sequence: Synthetic coding sequence
atgaagtgggtggagtccatctttctcattttcttgttaaacttcactgagtctcggactctacatagaaacgagtacggtattgctagtatactggattcctatcagtgtacagctgaaatctccttagcagatctcgcaacgatattctttgcccagttcgtgcaggaagccacttataaggaagtttccaagatggtaaaagacgctctcacagccattgagaaaccgacaggagatgaacagtctagtggctgtctagagaatcagctgcccgctttcctagaagaactgtgccacgaaaaggaaattctcgaaaagtatggccattccgactgttgttctcagtcagaggaggggcggcataactgctttctcgctcataagaagccaacacctgccagcataccactcttccaggtgccggaacctgtcacatcatgtgaggcgtatgaggaggacagagaaacatttatgaacaaatttatttatgagatcgcaagacgccacccctttctttacgcccccaccatcctgctgtgggctgcccggtacgataagatcattcccagctgctgcaaagccgaaaacgcagtcgagtgcttccagacaaaggcagccacagtaacaaaggaactccgggaaagctcccttttgaaccagcatgcatgtgccgttatgaagaatttcggaaccaggacttttcaagccattacagtgaccaaactctcccagaagttcaccaaggtcaacttcacagagattcagaaactggtgcttgacgtggcccacgtgcacgagcattgctgtagaggcgacgtccttgactgtctgcaagacggcgagaaaattatgagctacatttgctcacagcaggacacgttatccaacaaaattaccgaatgctgcaaacttaccaccctagagcgtgggcaatgtatcatccatgccgagaacgacgagaaacccgaagggcttagccctaatctcaacagatttctgggggaccgggattttaaccagttcagttcaggcgagaaaaacatcttcttggcctcattcgtgcacgagtattcacggaggcacccacagttagcggtgtccgtgatcctgcgggttgcaaaggggtatcaggaattactagaaaagtgttttcagacggaaaacccccttgagtgccaagataagggagaagaagagctgcagaagtacatccaggaatcacaggcactggccaagagatcctgtggactcttccagaagctgggggaatattacctgcagaatgcttttttggtggcctatacaaaaaaggcaccacagctaacaagtagcgaactcatggccattacgaggaaaatggcagcaactgctgctacatgttgccagcttagcgaagacaagctcctggcctgtggggagggcgcagccgatataatcataggacatttatgcattcgccacgagatgacacccgtcaacccaggcgtgggtcagtgttgtacctcctcctacgcaaacaggcggccctgttttagttctctggttgtggacgaaacctatgtgccacccgcgttctccgacgacaagtttatcttccataaggatctgtgtcaggctcagggggtggcccttcagacgatgaagcaagaattcctgatcaacctagtgaaacaaaagccgcaaatcacggaggagcagctagaagccgtgatagcagatttttccggcctgctcgagaagtgctgtcaaggccaagagcaagaagtatgcttcgccgaagagggtcagaagctgatcagtaagactcgagctgcccttggagtgtag

SEQ ID NO: 107955 - DNA, 3735 bp, Artificial Sequence
  Description of Artificial Sequence: Synthetic coding sequence
atgaacaatcaaaaggtcgttgctgtgcttctgcaggagtgcaaacaagtgttggatcagttgctcctggaagcacctgacgtgtcggaagaggacaagagcgaggaccagcggtgtcgtgcactactgccgagtgagttgaggactctaattcaggaagccaaggaaatgaagtggccctttgtgcccgagaaatggcagtataaacaggctgtcggccccgaagacaaaacgaaccttaaagatgtgatcggagccggcctgcagcagctgctggcctcacttagagcttcaatcctggcccgagactgcgcagctgcagctgcaatagttttccttgtcgatcggtttctgtatgggttggacgtgtccggcaaattgctgcaggtagccaaggggctacataagctgcaacccgctacacctattgcaccccaggttgtcatccggcaggcacgaatctctgtgaattctggaaagttacttaaggcagagtatatcctgagcagcctaatcagtaataacggcgctacaggcacctggctgtaccgaaatgaatctgacaaggtgctggtccaaagcgtgtgcatacagattcgcggtcagattctgcagaaactgggtatgtggtatgaggccgcagagctgatttgggcttccattgtgggctacctggctctgccgcaacccgataaaaaaggattaagtacgtccctggggattctcgcagatatctttgtgtcaatgagcaagaatgattatgaaaagtttaagaacaatccacaaataaacctttccttactgaaagagttcgaccatcacctactctccgcagccgaagcatgtaagttagccgctgctttctcggcctatactcctctttttgtgctgactgcagtgaacattcgagggacgtgcctgctcagctactcctcttccaacgactgcccccccgaactgaagaatctgcacctatgtgaagccaaagaagcctttgagatcggcctcctcacaaagagggatgatgagccagtgacaggcaaacaggagctgcacagctttgttaaggcagcattcggactgaccaccgttcacagacggctccatggcgagacaggcacagtgcacgccgcgtcacagctgtgcaaagaagcaatgggaaagctctacaatttttctacctccagtcggtcacaagacagggaagctctttcccaggaagtgatgagcgtgattgcccaggtgaaggagcaccttcaggtgcaatccttttccaatgtggatgatcggtcgtacgtacctgaatcattcgagtgtaggctggacaagctcatattgcatggacagggggattttcagaagatcctggatacatactcacagcatcataccagcgtttgtgaagtgtttgaaagtgactgcggtaacaacaagaacgagcagaaggacgccaaaaccggggtgtgcatcacagcccttaagaccgaaatcaaaaatattgacactgtgtccaccactcaggagaagccccactgtcagcgtgacacgggaatcagttcctcactgatgggcaaaaacgtccagagagagcttcggagggggggcagaaggaactggactcatagcgatgctttcagggtgtctttagaccaggatgtggagacagagactgagccgagcgattactcaaacggcgagggcgccgttttcaataagagtctgagtggctctcagacttcttcagcttggagtaatctcagcggtttcagtagctccgctagctgggaggaggtcaattaccatgttgatgataggtctgcccggaaagagccgggcaaggagcatctcgtcgatacacaatgtagcaccgctctgtccgaggaactagagaatgatcgtgagggacgagctatgcatagtttgcatagtcagctgcacgacctcagtctgcaggagccaaataacgataacttagaacctagccagaaccagccccaacagcagatgccccttacccccttttccccccacaatacccctgggatctttctggcaccgggggccggcctacttgagggcgcgcctgagggcatacaagaggttcggaatatggggcccagaaacacgtccgcccattctcggccaagctatcggtctgcctcctggtcctcagactcaggcagaccaaagaacatgggaacccatccttctgttcagaaagaggaagccttcgaaattattgtggagttccccgagacaaactgtgacgtaaaggaccggcagggtaaggagcagggcgaggagatatccgagcgcggagctggacctactttcaaagcctccccctcgtgggtagatcccgagggcgaaacagctgagtccactgaagatgcaccactggatttccaccgtgttctgcataactcactcggtaatattagtatgctgccttgtagcagcttcactcccaactggcccgttcagaatcccgactctagaaagtctgggggcccagtcgcggagcagggtatcgatcccgatgcatcgactgtggacgaggaagggcagctcctcgattcaatggatgtgccatgtacaaacggccacggttctcacagactttgtattctcagacagccacctggccaacgagctgagacccccaattccagtgtatccggaaatattctgttcccagtgttgagcgaggattgcactaccaccgaggagggtaaccagcctgggaatatgcttaactgttcacaaaactcctcatcaagttcggtatggtggttgaaatcaccggcattttcctccggctcctcagaaggagacagcccatggagctatcttaatagttctggaagttcatgggtcagcctgccagggaagatgcgcaaggagatacttgaagcgcgaacccttcaaccagacgactttgagaaactactggcaggtgtccggcacgactggctgtttcagaggctcgagaacacaggagtgttcaagccatcccagctgcatcgtgctcactcggccttgcttctcaaatactccaaaaagtccgagctttggacagcacaggaaactatagtctatctcggagactacttgacagtcaagaagaaggggaggcagagaaatgctttttgggtccaccacttgcaccaggaagaaattctagggcggtatgtagggaaagactataaagagcagaagggactctggcaccactttacagatgtggaaaggcagatgaccgcgcagcattatgtaactgaatttaacaaacggctgtatgagcagaatattccgacacagattttttacataccctccactattctcctgatcctcgaagataagacgatcaagggatgtatatccgttgagccatacattttaggggaattcgtgaagctcagcaataacaccaaggtggttaagacggaatataaggcaacagaatacgggctggcctacgggcatttcagttacgagttctcgaaccaccgggatgttgtggtggatctacagggatgggtaacaggcaacggtaaaggattaatttatctaactgaccctcaaattcactccgtggatcagaaggtgttcacaactaactttgggaagcggggcatattctactttttcaataatcagcatgtcgaatgcaacgaaatatgtcaccgattaagcctcacacgcccctctatggagaagccgtgtacgtag

SEQ ID NO: 107956 - DNA, 429 bp, Artificial Sequence
  Description of Artificial Sequence: Synthetic coding sequence
atgaacaatcagaaggtcgtcgcggttttgctccaagagtgcaaggcgctgcttccttccgagctgcgcacgctgatccaagaagccaaggagatgaagtggccattcgtcccagagaagtggcagtacaagcaggctgtagggccggaggataaaaccaatttgaaagacgtgatcggagccgggttgcaacagctgctagctagccttcgggcctcaattctggcaagagattgtgcagctgcagcagccatcgtgtttctggttgacaggtttctctatgggctggatgtgtcaggcaagctgcttcaggttgccaaggggctccataaattacaacctgccacccccattgctccacaggtggtgattcgacaggcacgtatatcagtaaacagcggttctcaccctgcaaagcatagcatgtag

SEQ ID NO: 107957 - DNA, 3735 bp, Artificial Sequence
  Description of Artificial Sequence: Synthetic coding sequence
atgaataatcagaaagttgtggcagttctgctgcaggaatgcaagcaggtgctggaccaacttctgctggaggctcctgatgtgtctgaagaggataagtcggaagaccagagatgccgggccctgctcccaagcgaactccgtacactgattcaagaagcaaaggaaatgaagtggccttttgtcccagagaagtggcagtataaacaagctgtaggccccgaggataaaaccaatctgaaggacgtcataggagccggactgcagcaattgctggcatctctgcgggcctccatactggcgagggactgtgccgctgcggcggcaatcgtgtttttagtcgatcgtttcctctatggtcttgatgtgtccgggaagctgcttcaagtggcaaaaggattacacaaactgcagccggccactcctattgctcctcaggttgtgatccgccaagctcggatctcagttaatagcggaaaactgctcaaagcagagtatatcctgagttccctcatttccaataatggcgccaccgggacatggttgtatcgtaacgaaagcgataaagtgctggtgcagtcagtttgcatccagattcgaggacagattctgcagaagctggggatgtggtatgaagcagccgaactcatctgggccagcatagtggggtacttggcactaccacaacccgataaaaagggcctgtcaacatctcttggtattctggcagatatctttgtctcaatgagcaagaacgactacgagaagtttaaaaacaacccccagatcaacctgtctctgttgaaggaatttgaccatcacctgctgtccgcagctgaagcatgtaaactggccgctgccttctccgcctatactccactattcgtgctgactgcggtgaatataagaggtacatgtctgctgtcttactcctcatccaatgattgcccccccgaactgaagaacctgcatctctgcgaggccaaggaagccttcgagatcggtctgctaactaagagagatgacgagcccgtgaccgggaagcaggagttgcactctttcgttaaagccgcattcggacttactacagttcaccgccggctacacggcgagaccgggacggtgcatgcagcgtcccagttatgcaaggaagcaatgggaaaactgtacaactttagcacaagctcccggtctcaggaccgggaggcgctgtcccaggaggtgatgtctgtgatagcccaggtgaaagaacatctacaggtacagtctttttctaacgtggatgatcgttcctacgtgccggaaagcttcgagtgccgcctggacaagcttatactgcacggccaaggagatttccagaaaattctggatacgtactctcagcaccacacatcagtgtgtgaagtcttcgagtctgattgtggcaataacaagaacgagcagaaagacgctaaaacgggagtgtgcattactgcactgaaaaccgaaatcaagaacatcgacactgtgtctaccacacaggagaagccccattgccaacgcgacaccggaatatcttcaagcttgatgggcaagaatgtgcaacgcgaacttagaaggggaggacggaggaactggacccactcagacgcctttagagtatctctggaccaggatgtggaaaccgaaaccgagccatcggattacagcaatggagagggcgccgtctttaataagtccctgagtggatcacagacttcgagtgcctggtcaaatcttagcggattcagctctagcgctagctgggaggaagttaattaccatgtagacgacagaagtgcccggaaagagcctggcaaagaacacctggtggatactcaatgctcgacagccttgtcagaggaactggagaatgatagagagggcagagctatgcactctctacattcacagctccacgatctaagcttgcaggaacctaataatgataacctggaaccctctcaaaatcaaccgcagcaacaaatgccgctcacccccttttcaccacacaacactccgggaattttcttagctccaggtgccggtctgctggagggcgccccagaaggcattcaagaggtgagaaacatgggaccgcgaaatacctccgcccattcacgtccctcttataggagcgccagctggtcatccgacagcggtaggcctaagaacatggggacacacccgtcggtccagaaagaagaggctttcgagatcattgtggaatttccggagaccaattgcgacgttaaagaccggcagggcaaggagcagggcgaagaaatttccgaaaggggagccggtccgaccttcaaggcctccccatcttgggttgaccccgagggcgaaacagccgagtctaccgaagatgcccccctcgactttcatagggttttgcacaacagcctgggtaacatttctatgctcccctgctctagctttaccccgaattggcccgttcaaaatccggactcgaggaagtccggagggcctgttgcagaacagggaatcgaccccgatgctagcacagtggacgaagagggacagttattagattcgatggacgtgccttgtacaaatggacatggtagccaccgcctgtgcatcctcagacagcccccaggccaaagagccgagacaccaaactcctcagtgtccgggaacatcctgttccccgtcctgtcggaagactgtactaccacagaggagggcaatcagcccggcaacatgcttaactgttcccagaacagcagttctagtagtgtatggtggctgaagtcccccgcctttagttccggttcatccgagggcgattccccttggagttacctgaactcttcaggttcttcatgggtaagcttacccgggaagatgcggaaggaaattttggaggcgcgtacgctgcaaccagatgactttgagaagttgctggcaggagtgcggcacgactggttgttccagcggctcgaaaataccggagtttttaaaccttcccagttgcatcgagctcacagtgcgttactgctgaagtattcaaaaaaaagtgaattatggactgcccaagaaacaattgtgtacctgggagactatttgaccgtgaagaagaaggggcggcaacggaatgccttttgggtccaccatctgcatcaggaggagattttgggccgctacgtcgggaaagattataaagaacaaaagggtctgtggcaccattttacagatgtagaacgacagatgaccgcccaacactacgtgacggaattcaacaagaggctctatgagcagaacatccccacccagatcttttatatcccctcgactatcctattgattctcgaggacaagaccatcaagggctgcatcagcgtagaaccatacattctgggcgagttcgttaagttgtctaacaacaccaaggtcgtcaaaaccgagtacaaggccacagagtatggtttagcctatggccatttttcttacgagttctccaatcaccgagacgtggtggtggatttacagggatgggttacaggcaatggaaaaggtctgatctaccttacggacccccagatccattctgtggatcagaaggtgttcacgaccaactttggaaagcgagggattttctatttctttaataaccagcatgtcgagtgcaatgaaatctgtcatcgtcttagtctcaccagacctagtatggaaaaaccctgcacttag

SEQ ID NO: 107958 - DNA, 3501 bp, Artificial Sequence
  Description of Artificial Sequence: Synthetic coding sequence
atgtgcagaaagcgaaccagggcccggacatcggctgcggaagccagcttacgggcctcaattttggcaagagactgtgcagctgctgctgccatagttttcctggtcgatcgatttctgtatggcctggatgtctcaggcaagctgctgcaggttgcaaaaggattgcacaagctccagccagctactccgattgccccgcaagttgtgattcggcaggcacgaattagcgtgaatagcggaaagctgctgaaggccgagtacattttgagtagtctgataagcaacaatggcgctacgggcacttggctctatcgcaacgaaagcgataaagtactggtccagagcgtgtgcattcagatcagagggcaaatcctgcagaagctcgggatgtggtacgaggctgcggaattgatatgggcctccatagtcggttacctggcactgcctcagcctgacaaaaaaggtctgtctacatctctgggaatcctcgccgacattttcgtatccatgagcaagaacgattatgaaaaatttaaaaacaaccctcagattaacctgagtctgttgaaggagtttgaccaccacctgctatccgcggctgaggcctgcaagctcgctgctgctttcagcgcctacacacctttgttcgtgctcacagccgtaaatatcaggggcacctgcttgctgtcatattcatcatctaatgattgtccaccagagcttaagaatcttcacctatgcgaggccaaagaggctttcgagattggacttttgacaaagagagacgacgagcctgtcaccgggaagcaagaattgcatagtttcgtgaaggctgcttttggactgactaccgtccatcgccgccttcatggcgagaccggtaccgtccatgctgcctctcagctgtgcaaagaggcaatgggcaaactctacaattttagcacatccagccggagtcaggatagggaagcactctcacaggaggttatgagtgttatcgcacaggtcaaggaacacttgcaagttcagtcgttctcgaatgtagacgatcgttcttatgtaccagaatctttcgagtgccgcctcgacaagcttattctgcatggccagggggatttccagaaaatacttgatacgtattctcagcaccatacgagcgtgtgcgaagtgttcgaatctgactgcggcaacaacaagaacgaacaaaaggatgccaaaacaggggtttgtatcacagccctcaaaacagagattaagaatatagacacggttagtacaacacaggaaaaaccgcactgccagcgggataccgggatcagttcatctctgatgggcaaaaacgtgcaacgggagctccggaggggggggcggcgaaattggactcactccgacgccttccgggtgtcactcgaccaggacgtggaaaccgagactgaaccgagtgattactctaatggcgagggcgcagtcttcaacaagtcccttagcgggtcacagacgtcttccgcttggagcaatttatctggattctccagcagtgcatcatgggaagaagtcaattaccacgttgacgaccggtccgctaggaaggagccaggcaaagagcacctggtcgacacgcagtgttctacggccctcagcgaagaactcgagaacgatcgggaggggagggcaatgcattccctgcactcgcagctgcacgacctctccttacaggagccaaataacgacaatttggagccttcacagaatcagcctcaacagcagatgccacttaccccattctccccgcacaacaccccaggtatcttcttggcaccaggggcgggcctgcttgagggtgcacccgagggaatccaggaggtgaggaatatgggccctcgcaatactagcgcccactccagaccatcctatagatccgcatcctggagtagtgattctggcaggccaaagaacatgggaacgcaccccagcgtgcaaaaggaggaggcatttgaaatcattgtggagtttccagagacaaattgcgatgtgaaggataggcaagggaaggagcagggcgaagaaataagcgaacgcggggccgggcccaccttcaaagccagcccgtcttgggttgatccagagggagagaccgcagaaagcacggaagacgctcccctggattttcatagagttctgcacaattctcttggaaatatcagtatgctgccgtgcagtagctttacgccaaattggcccgtgcagaatccagattctcgaaagtccggcggaccagtagccgagcagggcatcgaccccgatgcaagcacagtggacgaagagggccagctgctcgattctatggacgtgccctgtaccaacggccatggatcccatcgactgtgcatcttgcggcagcccccaggccaaagagcggaaacacctaactctagcgtgagtggaaacatattgtttcccgtcctgtccgaagactgtactaccacagaagaagggaaccagcctggtaacatgcttaactgcagccagaactcatcctctagtagcgtgtggtggctgaagagtccagctttttcaagtggcagttccgaaggtgactccccatggtcttacttaaacagttcagggtccagttgggtttcccttccaggcaaaatgcgcaaggaaatccttgaagcccggacgcttcaacccgacgactttgaaaagctgctggcaggagtgaggcacgactggctttttcagcggcttgaaaatacgggcgtttttaagccgtcgcagctgcaccgcgctcacagtgccctgctactgaaatactctaagaagtccgagctttggacggcccaggaaacgatcgtctacctgggcgactacttgacagtgaagaaaaaaggaaggcagagaaacgccttctgggttcatcaccttcatcaggaagagatcctcggcagatacgtggggaaggactacaaagaacagaaggggctctggcatcactttactgatgtggagcggcagatgaccgcacagcactatgtgactgaattcaacaaaagattatacgagcagaacatccccacacagatattttacatacccagcacaatcttactgatcttggaagacaaaaccataaaaggatgtatctctgtcgagccctacattctcggcgagtttgtcaaattgagcaataacacaaaagtcgtgaagaccgagtacaaagcaaccgagtacgggttggcctatggccacttttcttacgaattctccaaccacagagacgtcgttgttgatctgcaggggtgggtgaccggcaatggtaagggacttatttacctcactgatccacaaattcactctgtcgaccagaaggtgttcacaactaacttcggaaaacgaggaatcttctatttcttcaacaatcagcacgttgaatgcaacgaaatctgccaccggctaagtcttacaaggccctctatggagaaaccctgcacatag

SEQ ID NO: 107959 - DNA, 1149 bp, Artificial Sequence
  Description of Artificial Sequence: Synthetic coding sequence
atggcattgcagggaatctcagtagtggagctgtcaggattggctccaggtcccttttgcgccatggtgctggcagatttcggtgccagggtcgtcagagtggatcgccccggaagtagatacgacgtttcccggctgggtcgtgggaaacgatcccttgtgttggatctcaagcagccgcgtggcgcggccgtccttagacgcttgtgtaaaagaagcgatgtgttgctagagccatttcggcgtggagtgatggagaagctgcaactgggccctgagatattgcagcgagagaacccaagattaatttatgccagactgtccggatttgggcaaagcggctccttctgcagactggcgggacacgacatcaattatctagcactgtcaggggtgctaagcaaaatcggaaggtctggggagaatccctacgcacccctaaatctgctggctgatttcgccggcggggggctcatgtgcgccctgggcatcataatggcactgtttgatcgtaccaggaccggaaagggacaggtgatcgatgccaatatggtcgaaggcactgcttatttatcttcattcctctggaagacccagaagctgtcattgtgggaggctccccgaggccagaacatgctggacggcggcgcgcctttttacactacatataggacagctgacggggaattcatggcagtgggtgcaatcgaaccacagttctacgaactgctaatcaaaggcttgggcctgaaatctgacgaactccccaaccagatgagcatggatgattggcccgagatgaaaaagaagtttgccgacgtcttcgccgaaaaaaccaaggcagagtggtgccaaattttcgacggtacagatgcctgtgtgactccagttctcacgttcgaagaggtggtccaccatgaccacaacaaagagagggggtccttcatcacctctgaagaacaggacgtctctcctcgcccagctccacttctcctcaacacaccggccattcccagcttcaagcgcgacccattcatcggtgaacacacggaagagattctcgaggagtttggcttctcccgggaggagatctaccagttaaacagtgacaagattattgagagtaacaaggtcaaggcgagcttgtag

SEQ ID NO: 107960 - DNA, 597 bp, Artificial Sequence
  Description of Artificial Sequence: Synthetic coding sequence
atggccttacaggggatctccgttgtggaactgagtggactggctccgggtcccttctgtgcgatggtgctcgccgactttggcgcccgtgtggtgcgggtagacaggcccgggtcccggtatgacgtatctagacttggccgcggtaagagaagcctcgtcctggacttaaagcagccacgcggggccgctgtgcttcggcggctttgtaaacggtccgatgtcctgctggaacctttcaggcggggcgtcatggagaaactgcagttgggtcctgaaatcctgcagcgcgaaaaccctaggctgatctatgcaaggctcagcgggtttggacagagcggttccttctgtcggcttgccggacacgacatcaattatttagccctgtctggtggaaggaattcaatcttcaagttttttagcgtagagaatagtgaaatagagtccgtcgggagtacctctagaacagagcatgttggttggtggagcaccttcctatatgacctccaggatagtaggtgggggatccacgggtgttggagcaacagaacgcccgtcctgcgggcggccgatcaaagaacatggacaaaagtgtag

SEQ ID NO: 107961 - DNA, 690 bp, Artificial Sequence
  Description of Artificial Sequence: Synthetic coding sequence
atggcccttcaagggatatccgtagtggaactgagtggcctcgcaccggggcctttctgcgctatggtactggccgactttggagctcgggtagtgcgcgttgaccgccccggctctcgatatgatgtgtcaagactgggaagggggaagagatcattggttctggacttgaaacaaccccggggcgccgccgtactgcgacgcttgtgtaagcgctctgatgtactactcgagccgttccgacgtggcgtcatggagaagcttcagcttggtcccgaaatacttcaacgcgaaaacccccgtctgatctacgcgcgcttatccgggtttggccagtccggaagcttttgtcgactggctggtcacgatatcaactatcttgccctcagtgggggccgcaacagcatatttaagtttttttccgtggagaacagcgaaattgaatcagttggtagcaccagcaggacagaacacgtgggatggtggtccacctttctgtacgacctgcaggactctcgctggggaatccacgggtgctggtccaacaggacccctgtgttgcgcgcagcagatcagcgcagcttgatcccatattttaacctatatctgcagtttctcaatatttccatgcagaacttgttcaaggttcatacccttttacgaccttgctacttcctgggccaaaagtag

SEQ ID NO: 107962 - DNA, 1185 bp, Artificial Sequence
  Description of Artificial Sequence: Synthetic coding sequence
atggccctgcaaggtatctccgtggtggaactttctggactcgctcctgggccattttgcgccatggttctggctgacttcggggccagagttgtacgtgtggaccgtcccggttctcggtatgatgtgagccgcctaggcaggggtaagcgcagcttagttttggacctcaaacagccacgaggggctgccgtcctacgaaggttgtgcaagcgcagtgatgttttattggagccattcaggcgaggcgtgatggaaaagctccagctagggcccgaaattctgcaaagagaaaatccgaggttaatttacgctcgcttgtccggctttgggcaaagcgggtcgttttgtagactcgccgggcacgacattaattatctggcactctctggcgtcctgtccaaaatcggtagatcaggcgagaatccctacgccccactgaacttgctggcagactttgcgggaggcggccttatgtgcgctctcggcatcataatggcgctgttcgaccgaactaggacgggaaaagggcaggtcattgatgccaatatggtcgaaggcacggcatatctcagctcttttctctggaaaacacagaaactgagcctgtgggaagcccctagagggcagaatatgctggacgggggagcgcctttctacactacttaccgcaccgcggatggagagttcatggctgtgggcgccatcgagccccagttttatgagctactaattaagggcttgggactaaaatccgacgaactgcccaatcagatgtcaatggacgattggcccgaaatgaagaaaaagttcgctgacgtgttcgccgaaaagacaaaagccgaatggtgtcaaatctttgatgggaccgatgcctgcgtgacgcctgtactgacttttgaggaggtggtccatcatgatcacaacaaggagcgcgggtcttttatcacttccgaggagcaggatgtctccccacgccctgcccccttgctgctaaatacccctgccattccgtcttttaagcgggatccctttatcggcgagcataccgaagagattcttgaagagtttggtttcagcagagaggagatttaccaacttaattccgacaagatcatcgaatctaacaaagccggctctaaattttggatactgtatccaactcactccaacattcaaaaatag

SEQ ID NO: 107963 - DNA, 1002 bp, Artificial Sequence
  Description of Artificial Sequence: Synthetic coding sequence
atggccgccggctgctgtggagtaaagaagcagaaactgagcagttccccaccttcaggttccggcggaggcggcggtgcttctagctccagccattgcagcggagagtcccaatgtcgggcaggcgagctcggactgggcggcgcagggaccaggttgaacggcctcggcgggctgacaggcggcggatccggtagcgggtgcacactgagccctccccagggctgtggcggggggggcggcggtatcgccctgagtcccccgccctcctgcggcgtaggaactctcctgagcacccccgccgcagccaccagttcaagcccatcatcaagctctgcagcctctagtagctcccccggcagcaggaaaatggttgtgtctgccgagatgtgctgtttttgttttgacgtgctctactgccacttatatggctaccagcagcctaggacaccgcgcttcaccaatgagccttatcccctattcgttacgtggaagatcggtcgagataagcggctccggggttgtattgggacattcagtgcaatgaatttacactctgggcttcgcgaatatacactcaccagtgctctcaaagactctcgttttccacccatgactagggacgaacttccacgactgttttgcagtgtcagtctgttgaccaacttcgaggacgtctgcgactacttggattgggaagtgggcgtgcatggtatccggatcgagtttatcaacgagaaaggatcgaaaagaaccgcgacctacctccccgaagttgcaaaggagcagggctgggaccacatccagaccatcgactcactgttgcgcaagggtggctacaaggcccccattaccaatgagtttagaaaaacaataaagttaacccggtatcgaagtgaaaaaatgacgctgagctatgctgagtatctcgcgcaccggcagcaccatcatttccagaatggtatcggccacccgcttcctccatacaaccactactcttag

SEQ ID NO: 107964 - DNA, 633 bp, Artificial Sequence
  Description of Artificial Sequence: Synthetic coding sequence
atggtagtatccgcagaaatgtgctgcttctgttttgacgttctctattgtcatctgtacggataccaacagcctaggactccccgcttcacgaatgagccgtacccgttgtttgtcacttggaagatcggccgagacaaaaggctgaggggttgtattggaacctttagcgcaatgaatttacactctggattgcgcgagtataccctgacctcggctcttaaagactcacgtttccctccgatgactcgcgatgaactgcctaggctgttttgcagcgtgagtttgcttacaaatttcgaagacgtctgtgactacctagattgggaagtaggcgtccacggaatccgaatcgagtttataaacgaaaagggctccaagaggaccgctacctacctccctgaggttgcaaaagaacagggctgggatcacattcagacaattgacagcctgctccgcaagggggggtataaggctcctataacaaatgaattccgcaagacaattaaactaacccggtatcgaagtgaaaaaatgaccctttcttacgcagagtatctggcgcacaggcagcaccatcactttcagaatggtataggccaccctctgcctccgtataatcattactcctag

SEQ ID NO: 107965 - DNA, 891 bp, Artificial Sequence
  Description of Artificial Sequence: Synthetic coding sequence
atggccgccggctgctgtggggtgaagaaacagaaactaagttcttcaccaccctcaggttctggtggaggaggaggggcttcttccagtagccattgcagtggcgaatcccagtgcagagcgggcgaacttggcctcggcggagctggaaccaggctgaacggactcggagggctgaccggcggcggatcaggcagtgggtgcactctgagcccaccccaaggatgcggcgggggtggaggggggatagctctgagcccgccgccgagctgtggggtgggcactctcttatccaccccggccgccgccacttctagctctccatcgtcatctagtgcggccagcagtagttctcctggatcaagaaagatggttgtgagcgcagaaatgtgttgcttctgtttcgatgtgctctattgccacctgtacggctaccagcagcctcggacacccaggtttacaaatgaaccttacgctctgaaagacagcaggttccccccaatgacgagggacgaactacctaggctgttctgctccgttagcctgctgactaacttcgaagacgtttgtgattacttggattgggaggttggggtgcatggcattcggattgaattcataaacgaaaaaggaagtaaaaggaccgccacctacctcccagaggtcgccaaagaacaaggatgggatcatatccagactattgactccttgctccgaaagggtggctataaagcacccatcacaaatgagttcaggaaaacaatcaagctgacaagatacagatccgagaagatgactctgtcgtacgccgagtacctcgcgcataggcaacatcatcacttccaaaacgggatcgggcacccattgcccccgtacaatcactatagctag

SEQ ID NO: 107966 - DNA, 2862 bp, Artificial Sequence
  Description of Artificial Sequence: Synthetic coding sequence
atgtgcaatcctgaggaggcagctctcttgaggcttgaagaggttttttctgctacgctggcccacgtcaattcactagtgttacagccgctcctcccagctgcgcctgatccctcggatccttgggggcgcgagtgcctgcggctgcttcagcagctgcacaaatcatctcaacagctgtgggaagtgactgaagagagcttacacagcctgcaagaacggctgaggtaccctgatagcaccggcttagaatccctgttgttactccgcggcgcagaccgcgtgctgcaagcccacatcgaatatattgagagttatacgagctgtatggtcgtccaagcattccagaaagcagctaaaaggcgctctgaatattggcgggggcaaaggaaagccctgaggcagttgttgagcggagtctcatcggaggggtccgttggggcgtctctgggccaggctctgcaccagcccttggctcaccacgttcagcagtatgtgttattactgctgagcctgggagatacaattggcgagcaccaccccacccgcgagttagtggttaacgcggtcaccctgtttggcaatctgcaatcctttatgaaacaagaactggatcaggcggtcgccacacaggctctttggcacacactcaggggtagactgcgggatgtactgtgtacccctgcccaccggcttcttcaggatagccaagacgtaccagtcacagtggctccgctccgcgcggagcgcgtgctattgtttgatgacgcgttggttcttctgcagggtcataatgtgcatacattcgacctcaaactcgtgtgggtggatccgggacaggacggctgcacctttcatctactgacccccgaggaggagttttctttctgcgccaaagacagccaggggcaggctgtgtggcaatggaaagtcacctgggccgtacaccaggcacttcacggcaagaaggattttccggtgttgggggcgggacttgagccctcccagcctcctgactgcaggtgtgccgagtacacttttcaggcagaggggcgactatgtcaggctacatacgagggcgagtggtgtcgcgggcgaccacacggcaaggggaccctgaaatggcctgacggcagaaaccacgtgggcaacttctgtcaaggcttggaacatggctttggaatccgcctccttccacaggcaagcgaggataagtttgactgttacaaatgccattggagagaaggatccatgtgcggatacggaatctgtgagtattcaacggacgaggtctacaagggatatttccaagagggactgcggcacggttttggcgtactggaatctgggcctcaggctcctcagcctttcagatatacgggacattgggaaagggggcagcgcagcggctatggtattgaggaagacggcgatcggggagagaggtacataggaatgtggcaggccggccagcgccacgggccgggagtgatggttacacaggccggcgtgtgttatcagggcacattccaggccgacaaaactgttgggcctggcatcttgctgtctgaggatgattctctgtatgagggcacgttcacccgtgacctgacattgatgggcaaagggaaggtgacttttccaaacgggttcactctggagggttcattcggttccggtgcaggtcgaggcctgcacacacagggggtcctggacactgctgccctgccacctgatccttcctcaacatgcaagagacagttgggcgtcggcgctttccctgtggaaagcagatggcagggggtttattcaccattccgagacttcgtctgcgctggttgccctcgtgacctgcaggaggctctgcttggcttcgacgtgcagagtagtagagaactacgaagatctcaggactacctcagttgtgaacggactcatccagaagatagtgtcggatccatggaggatatactcgaagagctgctgcagcacagggaaccgaaggccctgcagctgtatctcagaaaggccctctctaattctctgcatcccctgggaaaactgttgcgtaccttgatgttgacattccaggctacctacgccggtgttggtgcaaataagcatttgcaggagctggctcaagaggaggttaaacagcacgcccaggagttgtgggccgcataccgaggactgctgcgggtcgccttagaacgcaagggtcaggctctggaagaggacgaagatacagagacgcgggacctccaggtgcacgggctggtcttgccccttatgttgccctccttttactctgagctgttcacgctctatctgcttctacacgagagagaggacagcttttatagtcaaggcatcgccaatcttagcctctttcctgacacacagttactggagtttttagatgtccagaaacatttatggcctttgaaagacttaacactgacatctaaccaacggtattcactggtgcgggataaatgtttcctgtctgcaactgagtgtctgcaaaagattatgaccaccgtggacccgcgagaaaaattggaagtgctggaacgaacatatggggaaatcgagggaacggtttcaagagtgttggggagggagtacaaactgcccatggatgaccttctccctttattgatatatgtcgtgtccagagcaaggattcagcacctgggcgcagagatacatctgattcgggacatgatggatccaaatcacaccgggggcctgtatgactttctgctgacggcgctggaatcctgctacgagcacattcagaaggaagatatgaggctccatcgcctgcccggccattggcactccagggagctgtggtag

SEQ ID NO: 107967 - DNA, 903 bp, Artificial Sequence
  Description of Artificial Sequence: Synthetic coding sequence
atggaagacatcctggaagagctgctgcagcaccgcgagcccaaggcactgcaactttaccttcgaaaggcactctccaatagtcttcaccccctgggtaagctgctccggacactcatgctgacctttcaggcaacttacgccggagttggagccaacaagcatttacaggagcttgcccaagaagaagtgaagcaacacgcccaggaactatgggcggcataccggggactgctaagggtcgccctggaaaggaaggggcaggctctggaggaagacgaggataccgagactcgagatctacaagtccacggtctcgtgcttccactgatgcttcctagcttctacagcgaattgtttactctctacctgctgctgcacgaacgagaggacagcttctattcacaggggatcgccaatctttctctctttccagatactcagctcctggaattccttgatgtgcagaaacacctgtggccgttaaaagatctcacactgacaagcaatcaacgatatagcttagtgagagataaatgttttcttagtgcaaccgagtgcctccaaaaaattatgaccacggtggatccaagagagaaactagaggtcttagaacggacatatggcgaaattgaaggaactgtaagccgcgttctgggacgggaatataagcttccaatggatgatcttctccccctcctgatttatgtcgtatcgcgcgctaggatccagcatctgggagcagaaattcacctgatccgtgatatgatggaccctaatcacaccggcggcctttatgactttctgctgactgccttggaatcctgttacgagcacattcagaaagaggacatgcgcctgcaccgccttccgggccactggcactcacgcgagctttggtag

SEQ ID NO: 107968 - DNA, 2862 bp, Artificial Sequence
  Description of Artificial Sequence: Synthetic coding sequence
atgtgtaaccctgaagaagctgctttgctacgactcgaggaggtcttctccgccactctggctcatgttaactcgcttgtccttcagcccctcttgcctgcggccccggacccctcagacccctggggccgggagtgtttgcgcctgctccaacagctgcataaatctagccagcaactgtgggaggtcacagaagagagtctccattctctgcaggagcgcctgcggtatcctgactctacgggactggagagcctgctgttactgcggggagccgatcgggtgctccaggcccacatagagtacatcgagagctatacatcctgtatggtggttcaagctttccaaaaggcagcgaaacgtcgctcagaatattggcgagggcagaggaaagcccttcggcaattgctctcaggcgtaagctccgaaggttccgtgggcgcatcattggggcaggcactgcaccaacctttggcccaccacgtgcagcagtatgttctgctgctgctcagcctgggagacaccattggtgagcaccatccaacaagagagcttgtcgtgaacgcagttacgttgtttggaaatctgcagtcatttatgaagcaggagctggaccaggccgtggcaactcaggcgttgtggcacaccctgaggggtcgcctaagagatgtgctctgtacacctgctcacaggctgctgcaggatagccaggacgtgcccgtcacggtggctccattgagagccgagcgcgtgcttctctttgatgacgctctagtgctgctccagggacacaacgtccacacatttgacctcaagctggtttgggtcgaccctggacaagatgggtgtacctttcacctcctgacgcccgaagaagagttttccttttgcgctaaagacagtcaaggccaggcggtgtggcaatggaaggtgacctgggctgttcatcaggcccttcatggaaagaaggattttcctgtgctgggagcaggattggagccctcacagcctcctgactgcagatgtgctgaatatacttttcaggccgagggacggctgtgtcaggccacatatgaaggcgaatggtgtcgagggcgcccacacggcaagggaactttgaaatggcccgacgggagaaaccatgtgggtaacttctgccaggggctagagcatgggttcggaattagattgctgccccaagcctctgaagataagttcgactgttacaaatgccactggagagagggctccatgtgtggatatggtatttgtgaatattccaccgacgaagtttataagggctacttccaagaaggccttcgccacgggttcggagtcctcgaatcaggccctcaggccccgcagccattccgctatacaggacactgggagcgcggtcagagatccggctacgggattgaggaagacggagaccgcggggaacgttacataggaatgtggcaggcaggacagagacacggccctggcgtcatggttacacaggccggggtgtgttatcagggaactttccaggccgataagactgtgggtcccggaatcctgctcagcgaagacgactccctgtatgagggaacctttactcgggacctgacactgatggggaaaggaaaggtgacctttcccaacgggttcacattggaagggtctttcgggtccggagcagggaggggactgcacacccagggagtgctcgacacggctgctctcccaccggatccttcttccacctgtaagaggcagctgggtgtaggcgcatttccggtagaatcccggtggcagggagtgtactctcctttccgggactttgtgtgtgctgggtgtcccagggacctgcaggaagctctcctgggttttgacgtgcagagcagcagggagctgcggaggtcacaggattatctgagctgcgaaagaacccacccagaagattcagtggggtcaatggaagacatcctagaggagttgcttcagcacagagagccgaaggctcttcagctgtatttgcgaaaggccctgagtaactccctgcaccccttaggaaagctattgcgaacccttatgctgacctttcaagcaacttatgcgggggtgggagctaataagcacctacaggaactggcacaggaggaggtcaaacagcacgctcaagagctttgggcggcctaccgtgggctgcttcgtgtggccttggaacgtaagggccaggcattggaggaggatgaggataccgagaccagggacctccaagtgcatggtctggtgttgcccctgatgttaccatctttctattccgaattgtttactttataccttctcctacacgagagggaagatagtttttactcccaaggaattgctaacttatctttgttccctgacacccaacttctcgaattcctagacgtacaaaagcacctctggcccctgaaagatttaaccctgactagcaatcagcgctatagtctcgtgcgtgacaaatgcttcttgagcgctactgagtgtcttcagaaaataatgacaaccgtcgatcctcgggagaagctggaggtgctagagaggacctacggtgaaattgaggggaccgtgagccgggtgttgggtagagaatataagctgcccatggacgacctcctgcctctgctgatttacgtagtgagtcgcgctcgcatccagcatctcggcgcagaaattcacttgatccgtgatatgatggaccccaaccatactggtggcctgtacgactttctgttaacggccctagagtcttgctacgagcacatccagaaggaagacatgaggctccatagacttccgggacactggcatagcagagaactatggtag

SEQ ID NO: 107969 - DNA, 12504 bp, Artificial Sequence
  Description of Artificial Sequence: Synthetic coding sequence
atggagcccgaggatttgccatggcctggggaattggaagaggaggaggaggaagaagaagaagaggaggaagaagaagaggaagctgcagcagcagccgccgccaatgtcgatgacgtggtggtggtggaagaagtcgaggaggaagccggtcgtgaactggatagtgattcccactacggtccacaacaccttgagagcatcgatgatgaagaggacgaggaagctaaagcctggctacaggcacaccctggcagaatcttgccgccattaagcccaccacagcacaggtatagcgagggcgagcgcacttctctggaaaagattgtaccgctaacttgccacgtgtggcagcagattgtgtaccagggtaatagtaggacacagatttctgacacgaatgtggtctgtctcgagacgactgctcaacggggatccggagacgaccaaaagacagaatcgtggcactgcctaccccaggagatggatagttcacagacactcgatactagtcaaactcggtttaatgtccgaaccgaagacaccgaagtgacagacttcccaagcttagaggaaggtattctaacacagtcggagaatcaggtaaaggaacctaacagggatctgttttgctccccgttactggtcattcaggattcttttgcctctcccgacctgcctctgttgacctgcttaacacaagatcaagagttcgcccccgacagcctgtttcatcagagcgagctctccttcgccccccttcgcgggatacccgataaaagcgaagataccgagtggagcagtcgcccaagtgaagtgagcgaggcgctgtttcaggccacagcagaggtcgcctctgatcttgcatccagtagatttagcgtctctcagcatccactcattggctcgacagccgtcggatctcagtgcccttttctcccttctgaacaggggaacaacgaagaaacaatctcctcagttgacgagctcaagatccctaaagactgcgaccgatacgatgacctatgctcctacatgtcatggaagacaagaaaggacacccagtggcctgagaacaatttagctgacaaggatcaggtcagtgtggcgacctcttttgacatcaccgacgaaaatattgctaccaaaagaagcgaccactttgacgccgctagaagttacgggcagtattggactcaggaagattcaagcaaacaggcagaaacatatcttacaaaaggactgcagggcaaggtggaatcagacgtgattaccctcgacggcctaaatgagaacgccgtggtttgcagcgaacgcgtggcagaactccagaggaaaccgactcgcgagagcgaatatcattcctctgatctgcggatgctgcggatgtctcccgacaccgtccccaaggccccaaagcacctgaaagctggagatacctccaaaggcgggatagccaaagtaactcaatcaaatctaaagagcgggattacaacgacacccgttgatagcgacatcgggtcacacctgagtctctccctggaggatctttcccagctggccgtctctagtctggaaaccacaaccggccagcacacagatacactcaaccagaagacattagctgacacccacctgaccgaagagactctcaaggttacggctattccagagccggcagaccagaaaaccgccactcctaccgtgctcagctcttctcacagtcacagaggcaaaccatctatcttctaccagcaagggttgccagatagccacctcactgaggaagcactcaaagtgtccgcagcgccgggtttggccgaccagactaccggtatgagtactttgacttcaacatcatattctcaccgcgagaaaccagggaccttctaccagcaggagctgcccgaatcgaatctgacggaagaaccattagaggtttctgccgcccccggccctgttgaacagaaaaccggaatccctaccgtttcaagtacctctcactcacatgtcgaggatctgttgttcttctatcgccagaccctgcccgacggtcatctcactgatcaggcccttaaagtgtcagccgtctccggccctgccgatcaaaaaacgggcaccgccactgtgttatccaccccgcactcccacagggagaagccaggcatattctatcagcaagaatttgcagactcacatcagacagaagagacactgacaaaggtgtctgcgacaccgggccctgctgatcagaagactgaaatcccagctgttcaaagttccagctattcacagagggagaagccttctattctatatccccaggatctggccgattctcacttgcctgaggaaggcctgaaggtctctgcagtcgccggtcctgccgaccagaagaccgggctgcccacggtgccaagttccgcctattcacatcgagagaaacttcttgtcttttatcagcaggccttgctggactctcatctccccgaagaagccctgaaagtgtctgcggtgagcgggcctgcagatggcaagaccgggacccctgccgtcacatcgacctcctcagcatcaagtagcctcggcgagaaacctagtgcattttaccagcagacgttgcctaatagccatctgaccgaagaggctttgaaggtttccatcgtgcctggacctggcgatcagaaaacagggattccttctgcaccatcttccttctactcacaccgggaaaaacccatcattttcagccagcagactttaccagatttcttgttccctgaggaggcgctgaaggtatccgccgtgtcagtgttggctgcccagaagacaggcacacctacagtatctagtaattcacattcgcactcggagaagagtagcgtattttaccagcaagaattgccagattccgatcttcctagagaatccctcaagatgtccgccattcccggtcttactgatcagaagaccgtaccgacaccaacagtcccgagtggatctttcagtcatagagaaaagccctctattttttatcaacaagagtggccggactcctacgcgacagagaaggctttaaaggtatctacaggaccgggaccagcggatcagaaaaccgagattcccgccgtgcagtcatcttcataccctcaacgcgaaaagccttccgttttatacccccaagtcctctctgacagccacctccccgaagaaagcctgaaagttagtgcctttcccggacccgccgatcagatgaccgatacccccgctgtgccttccaccttctacagccagcgtgagaaaccaggtattttttatcaacagaccctgccagagtcgcacctgcctaaggaggcccttaagatctcagttgctcctggactggccgatcagaagaccggcacacctactgttaccagtacgtcgtacagccagcatcgagagaaaccttctatttttcaccagcaggcactgccaggcacgcatatacccgaggaggcacaaaaagtttccgccgtgaccggtcccggaaatcagaagacatggatccctagagtattgtcaaccttctacagtcagcgcgagaaacccggtatcttctaccaacagacactgcctggaagtcatattcctgaggaggcccagaaagtctcacccgtgctgggacccgcggaccagaagacaggcaccccaacacctacgtctgcttcttattcacacacggagaaacctggaattttttaccagcaagtcctcccagataaccatcccactgaagaagctcttaagatcagtgtagcaagcgagcctgtggaccagactacaggtacacccgcagtgacatcaacctcttattcacaatatagagaaaaacccagcatcttttatcagcaaagcttgccctcatcgcatctgacggaggaggcgaagaatgtgtctgccgttccaggccccgccgatcagaaaacagtgattcccattttgccgtccaccttttactcccatacagagaaaccaggagtcttttaccagcaagtgctgccacactcacatcctacagaggaagctctcaagatcagcgtcgcctccgagcccgttgatcaaacaacaggcaccccaaccgtcactagcactagctattcacagcatacagaaaagccctcaatcttctatcagcagtccctgcctggttcccatttgacagaagaagcaaaaaacgtgagtgcagtccctgggcccggagaccggaagacagggatccctaccctgccctccacgttctacagtcacactgaaaagcctgggagcttttaccaacaagtattaccacattcgcacttgccagaagaagcactggaagttagtgtggcacctgggccagttgaccaaaccattggaactcccaccgtgacctcgcccagttcaagctttggtgagaagcccatcgtgatctacaaacaggccttccctgaggggcatctgcctgaggaaagcttgaaggtttcagttgcacccgggcctgtcgggcagaccaccggggccccaaccattacctctcccagttactcacaacacagagctaaatctggttcattctatcaactggccttgctcggctctcaaattccagaagaggctctgagagtatcatccgcccctggtcctgccgatcagacaactggcattcccactatcacctccacttcctattcctttggagagaagccaatcgtgaactacaagcaggcttttcccgacggacacctccccgaggaagcactgaaagtgagtatcgtgtccgggcccaccgagaaaaaaacagacattcccgccggcccgttgggctcctctgcactcggagagaagcccattactttttataggcaagctttgcttgatagcccactcaataaagaagtggtcaaggtctctgccgcaccaggcccggccgaccagaaaacagaaacactccccgtgcacagtacctcctatagtaatagaggcaagcctgtgatcttctatcagcagactttgtcagattctcaccttccagaagaagcgctgaaagtccccccagttccagggcccgatgcccagaagaccgagacccccagtgtaagcagcagcctctatagttaccgggagaaacctatcgttttctaccagcaggccctgcctgattcagaactgactcaagaggcactgaaggtctctgcagtcccacaaccagccgaccaaaaaacgggcctttctacggtgacttcttctttctactcacatacggaaaaacccaacatctcttatcaacaggagctccctgactcacatttgaccgaagaggcccttaaagtgagcaacgtccccgggccagctgatcagaagaccggagtgtcaactgtcaccagtacgagttattctcatcgcgaaaagccaatcgtttcttatcagcgagaactgcctcacttcaccgaggccgggttaaagatcctgagagttccagggcccgccgaccaaaaaaccggaattaacatacttccatccaacagctaccctcaacgcgagcattctgtcatctcatatgaacaggagctgccggatctgacagaggtcaccctcaaggcaatcggcgtcccaggcccagcggatcagaagacaggcatccaaatagcctcatcaagctcatactccaatagggaaaaggcctccatctttcaccagcaggaactacccgatgtaacagaggaagccctgaatgtttttgtagtaccaggacagggagaccggaagacagagattccaacagtcccattgtcctattactccagacgggagaaaccgtctgtaatttcccaacaggagcttcccgactcgcatctgactgaagaggctctgaaggtgtctcctgtgtcgatccccgctgaacagaagaccggcatccccatcggcctcagttcatcttactctcatagccataaagagaagctgaagatttcaacagtgcacatccccgatgatcagaagacggaatttcccgcagccactctctctagctatagccagattgaaaaacctaaaatctcaacggtaatcggacctaatgatcaaaaaaccccatcacagaccgccttccattcatcctattcccagaccgttaaacctaatatcctgttccagcagcagctaccggaccgggatcagtccaagggtattctcaagatctctgccgtgccagaactgacagacgtaaacactggcaaaccagtgagtctgtctagttcctatttccacagggagaaaagtaacatctttagcccccaggagttaccaggctctcatgtgacagaggacgttctgaaggtcagtacgattcccgggcccgccggtcagaagaccgtgctgcccacagccctcccgtcctctttcagccatcgcgagaagcccgacattttttaccagaaggatctgcctgaccgccatctgacagaggacgcactgaagatatctagtgctctggggcaggctgaccaaatcacaggtctacagaccgttcctagcgggacgtattcacacggcgagaaccataaattggtcagcgaacacgttcagcgcttaattgacaatttaaactcttccgattcttcagttagctctaacaacgtgcttttgaactcacaagcagatgacagggtggtaattaacaagccagaaagcgccgggtttcgtgacgtcggctcagaggagattcaggacgccgaaaatagcgccaagactctgaaagagataagaaccctgctcatggaggccgagaatatggcacttaaaagatgtaactttcccgcccccctagccaggtttcgggatatcagcgacatctcattcatacaatcaaaaaaggtcgtttgcttcaaggaaccctcctccaccggagtgtccaacggtgatttactgcatagacagcctttcaccgaagaatcccccagtagtaggtgtattcagaaagatatcgggacccaaacgaaccttaaatgccgccgtggaatcgagaactgggaatttatcagttctaccactgtgagatcccctctgcaagaagccgaatccaaagtgtcaatggctctcgaggagacactgagacagtaccaggctgcaaagtcagtgatgagatccgaaccggagggatgctcaggaacgataggtaataagattattatccccatgatgaccgttattaagtcagattcaagctctgacgcaagtgatgggaatggctcctgctcatgggattcaaatctgcctgaatctttagaatccgtgtctgatgtgctgctgaacttttttccttacgtcagtccaaagacctcaataaccgactcccgggaggaggaaggggtgagcgagagtgaggacggaggcggcagttcagtggacagcctcgctgcccatgtgaagaacctgttgcagtgtgagagttcactcaaccacgccaaagaaattctgcgaaacgccgaagaggaggagagccgagtgcgcgcacatgcttggaatatgaagttcaacctggcccatgactgcggatacagcatctctgaacttaacgaggacgatagaaggaaggtggaggagataaaggcagagttgtttggacacgggaggacaacagacctaagtaaaggactgcaatctcctcgagggatggggtgtaagcccgaggccgtgtgttcacacataattattgaatctcacgagaaggggtgtttccgcaccctgacatcagaacatccacagctcgataggcacccatgcgcatttcggtccgctggtcctagtgaaatgacacgagggcgccaaaacccttcttcttgtcgagcaaagcacgtgaatctcagcgcgtcactggaccagaataatagtcattttaaggtatggaattctctccagttaaaatcacatagccccttccagaactttatcccagacgaattcaaaatttccaagggtctgagaatgcccttcgatgaaaagatggatccttggctgtctgaactcgtcgaacctgccttcgtccctccaaaagaagtggacttccacagttcctcacaaatgccttcaccagagcctatgaaaaagtttaccactagtattaccttcagctcccatcgccatagtaaatgcattagcaattcttcagtggtgaaggtaggcgtgacggagggcagccaatgcacgggtgcatctgtgggggtattcaattctcattttaccgaagagcaaaatcccccccgagatcttaaacagaagacttcgagcccatcctcatttaagatgcattcgaatagccaggacaaggaagttaccatactggcagagggcaggaggcagtcccagaaactgcccgtggacttcgagaggtccttccaggaagaaaagccactagaaaggagcgacttcacaggttcccattccgaaccctctaccagagcaaactgttccaactttaaagaaatccaaataagtgataatcatacgttgatctctatgggcagaccatcatctaccttaggcgtcaaccgctcgagttctaggctcggtgtaaaggaaaaaaacgtgacaatcactccagatcttccatcatgtatttttctggaacagcgcgaattatttgagcagagtaaagctcccagagctgacgaccacgtgcgtaaacaccattctccatcaccacagcaccaggactacgttgcgccagatttaccgagctgcatcttcttggagcaacgggagctctttgaacagtgcaaggcaccatatgtagaccatcagatgcgagagaatcactcaccattaccacagggacaagacagcatagcgagcgacttaccgtcgccaataagcctagagcaatgtcagagcaaggctccaggcgtcgacgatcagatgaataagcaccacttccccctgccccaaggacaggattgcgtggtcgaaaagaacaaccagcataagcccaagtcacacatcagcaacattaatgtcgaggcgaagttcaacacagtcgttagtcagagtgccccaaatcactgtactctggccgctagcgcttctacacctcccagcaaccgcaaagccttgtcctgtgtccacattacactttgccccaagacctcctctaagctcgacagcggaactctggatgaaagattccattcactggatgccgcatccaaggctagaatgaattctgagttcaactttgatctccatactgtgtcgtcccggagcctagagcctacctcaaagctgctgaccagcaagccagtggcccaggaccaggagtctcttggcttcctcggacctaagtcctcactcgactttcaagtagtgcagcctagcttgcctgacagtaatactattacgcaggatctgaagaccataccctctcaaaattcccagattgtcacgtcacggcaaattcaggttaacatctcagactttgagggtcactccaaccctgagggcacccccgtatttgccgatcggctccctgagaaaatgaagacaccactctcagctttcagcgaaaaactgtccagcgatgcagtgacacagataactacagagtcgccagagaagaccctattctctagtgaaatctttatcaacgctgaggacaggggccacgaaatcatcgagcccggaaaccagaagttaaggaaggcccccgtgaaatttgccagttcatcatctgtgcagcaagtgacatttagcaggggtactgatgggcagccactgctcttgccttataagccctcgggctcgacaaaaatgtattacgtcccccagctaagacagatccccccatctcctgactccaagagcgatacgactgtcgagtcaagtcactcgggctctaatgatgcaatagctccagatttcccagcacaggttttgggtactagagatgatgacctgtccgccacagtcaatataaagcacaaggaaggcatttactcgaagcgagttgtcaccaaggcctcgcttcctgtgggcgagaagccattgcagaatgagaacgccgatgcaagtgtgcaagtactgatcactggggacgagaacctctcagacaaaaaacagcaggagatccatagcactagagctgtgactgaggcggctcaggctaaagagaaagagtcgctgcagaaagataccgccgactctagtgcggcagcagcagcggagcattctgcccaggtgggagatcctgagatgaagaatcttcctgataccaaagccataacgcaaaaggaagaaattcaccggaagaagacagtgcccgaggaggcctggcctaataataaagagagtctccagattaatattgaagagtctgagtgccacagcgaatttgaaaatacaacacgctctgtcttccgctctgcaaaattctatatccaccatcccgtccacctaccaagcgatcaggatatatgtcatgaaagtctgggcaagtctgtatttatgcgccactcatggaaggatttttttcagcatcaccccgacaagcaccgcgaacacatgtgccttcccctgccataccagaacatggacaagacaaagaccgattacactaggatcaaatcactgagtatcaacgtgaaccttggcaacaaggaggttatggacaccacgaaatcacaggtgcgggattatcctaaacacaatggtcaaatcagtgatccgcaacgtgaccagaaagtgactccagagcaaacaactcagcatactgtgagcttaaatgagctgtggaacaaataccgtgagcgccaaagacagcaaagacaacctgaactaggggaccggaaagaactgtccttagttgacagacttgaccgcctggccaagattctgcagaatcctatcacccactctctgcaagtttctgagagtacccacgatgattcccgtggcgaaagaagtgtaaaagagtggagcggcagacaacagcaaagaaataagctgcagaagaagaaaaggttcaagagcctcgaaaagagccacaagaataccggagagcttaaaaaaagcaaggtgctgtctcatcacagggcaggtcggagcaatcagatcaagattgaacagattaagttcgacaagtatattctgtccaagcagcctggattcaactacatctccaacactagttctgactgtcgtccatcagaagaatcagaattgttgacagacaccaccacaaatatcttaagtgggacaacaagtacagtggagagcgatatcttgacgcagacggatcgcgaggttgcattacatgaaagatcaagtagcgtgtcgacgatcgatacagcccggctgatccaagctttcggccatgaaagagtgtgccttagccctcggcggataaagttgtatagcagtattaccaaccaacaaaggaggtacttggagaagcggtccaaacattcgaagaaggtgctcaatacgggtcaccctctggtcacatccgagcacactcgtcgaagacacatccaggtggcaaatcacgttattagttcggattccatttcttcttcggcctccagtttcttgtccagcaactccacattttgtaataaacagaacgtgcacatgctcaataaggggatccaggcagggaaccttgaaatcgttaatggagccaaaaagcatacccgtgatgtgggtataacattcccaacaccaagttcaagcgaggctaagctcgaagaaaacagcgacgtgacaagctggtcagaagagaaaagagaagagaagatgctgtttacagggtaccctgaagaccggaagctcaaaaagaacaagaaaaattcgcacgagggagtttcctggttcgtacccgtggagaacgtggaaagccgatcgaaaaaggagaatgtgccgaacacttgtggtcctgggatcagctggttcgagccaattaccaagacccgcccttggcgcgagccacttcgcgaacagaattgccaggggcagcacctggacggaagaggctatcttgccggaccgggacgcgaagctggccgggacctccttcggccttttgtgcgcgccacattgcaagagtctttgcaatttcacagacccgattttatctccagaagcggagaacggatcaagagacttaaacttatcgttcaagagcggaagctgcagtctatgctccagacagagcgagatgctctattcaacatagatcgggagcgccagggtcatcagaacagaatgtgtccgttgcctaaaagagtatttttggctatccaaaagaacaaaccgatctctaaaaaagagatgatccaacgatcaaaacggatctatgaacagctgccggaggttcagaaaaagcgggaagaggaaaaacgcaaatcagaatataagtcctaccgattgcgcgcacaactttacaagaaacgcgttaccaatcaattgctcgggcgcaaagttccctgggattag

SEQ ID NO: 107970 - DNA, 7686 bp, Artificial Sequence
  Description of Artificial Sequence: Synthetic coding sequence
atggaacccgaggatctgccctggcccggcgaattggaagaagaggaagaggaagaagaagaggaggaggaggaagaggaagaggccgctgctgcggccgcggccaacgtcgatgacgtggtggtggtggaggaggtggaagaggaagccggtagagagctcgacagtgatagccactacggacctcagcacctggagtctattgacgatgaggaagacgaagaagcgaaagcctggctgcaggcccatccagggagaattcttccacctctgtcaccgcctcaacacaggtattctgaaggtgagcgaaccagtctggagaagatcgtcccactcacatgccatgtgtggcaacagattgtgtatcagggaaactctagaacccagatctcagacacaaatgtcgtgtgcctcgaaacaacagcccagagaggtagcggcgacgaccagaaaaccgaatcttggcactgcctcccacaagagatggactcctcacagaccctggatacgagccagaccagatttaatgtgcgcaccgaagacactgaagtgactgatttcccctccttagaagaggggatccttacccagtccgaaaaccaggtcaaggagcctaaccgcgatctgttctgtagtcctttattagttatccaggattctttcgcgtcaccagacctcccccttctgacatgtctgacgcaagaccaggagttcgcgcctgactccttgttccatcaatccgagctcagcttcgctcctctgcgggggatcccagacaaatccgaggacactgaatggagctctcgccccagcgaggtgagtgaggccctcttccaggccacagctgaagtggcttcagatctggcttcatcccgttttagcgtctctcagcacccactgatcgggagcactgcagtgggctcccaatgtccattcttgccgtcagaacagggcaacaacgaggaaacgatctcctccgtcgacgaactgaaaattcccaaagactgtgatagatacgacgacctttgctcttatatgagttggaaaaccagaaaagacacacagtggcctgagaacaacctggctgataaagaccaggtctccgtcgcaacctcgttcgatatcaccgacgagaacatagctactaagcgctccgaccactttgacgctgcacggagctatgggcagtactggacccaagaagacagcagcaaacaggctgagacatacctaactaaaggtctacagggaaaggtggaatcagacgtgattacactggatggtctcaacgagaatgcagttgtgtgctcagagagagtcgccgagctccagcgcaaaccgacccgagagagtgaatatcattcttccgatctgaggatgttgaggatgtctcccgatacagtccctaaggccccaaagcacttaaaagccggtgatacctccaagggaggcatcgcaaaagttacccaaagtaacctgaagagcggtataaccactacacccgtcgattctgacatcggcagtcacctctcactgagcctcgaggacctgtcccagttagccgtgagctctctggaaactactaccggacagcacacagatactctgaatcagaaaacattggctgacactcacctgaccgaagaaaccttgaaagtgactgccataccagagcccgctgatcagaagaccgctaccccaactgtgttgagctcctcacattctcaccgtgggaaacccagcatattctaccagcaagggctccctgattcccatctcacggaggaggccctgaaggtttcagcagctcctggcctggctgaccagaccaccggaatgagtacactgacttcaacgtcatactctcatcgcgaaaaacctggaaccttctaccagcaggagctccccgagtccaacctgacagaggaaccactggaagtgagcgccgcccccggcccagtggagcaaaagactggcatccccaccgtaagctccacatcacactcacacgtggaagacctcctgttcttctaccgccagaccttgcccgatggacacctgaccgatcaagcactcaaagtctccgcagtaagtggcccagcagaccagaagactgggacagccaccgtactctcaactccgcactcccacagagaaaaaccagggatcttctaccagcaagaattcgcagacagtcaccagacggaagaaactctaacaaaggtgtccgctacacctggcccagctgatcagaagacagagatccctgccgtgcaatcctcctcctattcccagcgggagaagccatctattctttacccccaggacctggccgattctcaccttcccgaggaggggctcaaggtatccgcagttgctggtcccgctgatcagaagacaggtctgcctacagttccatcttcggcttactcgcacagggagaaattgctggtattctatcagcaggctctgctcgactctcatctgccagaggaagctcttaaggtgagcgctgtcagtgggccagcagacggaaagaccgggaccccggctgtgacttctacttcctcagcttcctctagtctgggagagaaaccatcagcgttttatcagcagacactacccaattcacacttaaccgaggaagccctaaaagtgagcatcgtgccaggccccggggaccaaaaaactgggattccgagcgctcctagtagtttctatagccatcgagaaaaaccgattattttcagccagcaaacattgcccgatttcctgtttcctgaggaagctcttaaggtgagcgcggttagtgtcctggcagcccagaagaccggaacacccacggtctcatccaactcacactcccatagcgagaagagttcggtcttctaccaacaagaactgcctgactctgacctcccccgcgaaagtctgaaaatgagtgccatacccggtctgaccgaccaaaaaacagtgccaaccccaacggtgccctcaggctcatttagccaccgggaaaaaccttcaattttctatcagcaggaatggcctgattcatacgcgactgaaaaagccctgaaagttagtactggccctggcccagcagaccagaagaccgagattcccgccgtccaatctagctcatacccacagcgcgaaaaaccctccgtcctctatccccaggtccttagcgactctcacctcccggaagaatcactcaaagtgagcgcattcccaggcccagccgaccagatgaccgacactcccgcagtcccgtctaccttctactcacagagagaaaaacccggcatcttttaccagcaaaccctgccagagagtcacctccccaaggaggccctcaaaatttctgtggcacccggcctcgctgaccagaaaactggcacacctaccgtgacatcaacatcttacagtcaacaccgagagaaaccttcaatcttccaccaacaggccctgcctggcacccatattccagaggaggctcagaaagtgagcgccgtaaccggacccgggaaccagaaaacttggatcccaagggtactaagcacgttctatagccagagagagaagccaggaatattctaccagcaaaccctccccggatcgcacattcccgaggaggcacaaaaagtaagcccagtactcggcccagccgaccagaaaacagggaccccaactcccactagcgcttcctactctcacactgagaagcctggcatcttctaccagcaggtgctgcctgataatcaccccacagaagaggcactgaagatatccgtagccagcgagcctgtggatcagactacgggcacccctgctgtcactagcacttcatactcacagtatcgggagaagcctagcattttttatcaacagagcctccctagctctcatcttacagaggaggccaaaaacgtgtctgcagttccagggcccgctgatcaaaagacagtgattcctattttgccaagcacattctatagccatactgaaaagccaggagttttctaccagcaggtgctgccccattcacatccaacagaggaagctctgaagatcagcgtcgcaagcgagcctgtggatcagacgactgggacgcccactgtcacatccacaagctactcacagcatacggagaagccctcaattttctatcaacaatcattaccaggctcgcatctgaccgaggaggcgaagaacgtctcagctgtgcccggtcctggtgacaggaaaaccggtataccaacactgccctctacattttattcccatactgaaaagcctggtagcttttaccaacaggtcctacctcacagtcatttgccggaggaggcactcgaagtgtccgtagctcccggccccgttgatcaaaccattggaacaccgaccgtcacttccccctcctcctccttcggcgagaagccgattgtcatctataagcaggctttccctgaaggccatttaccagaggagtctcttaaagtctccgtggctccggggccagttgggcaaacaacgggcgctccaaccatcactagccccagttactcgcagcaccgtgccaaaagtggcagcttctaccagttagctcttctgggctcccagatcccagaagaggctttgagagtcagcagcgcgcccggcccagccgatcaaacgaccggcatccctacaattaccagtacttcgtatagtttcggcgaaaaaccaatcgttaattacaaacaggcatttcccgatggccatttacctgaagaagcgttaaaggtgtcaattgtgagtgggccaaccgaaaagaaaaccgatatcccagctggcccactggggtcttctgccttgggggagaagccaattacgttttatagacaggctctgctcgactcccctctcaataaggaggtggtgaaagtgtccgccgcccctgggcccgcagaccagaaaaccgaaactcttccggttcattccacctcatattcaaaccgtggtaaaccagtcattttctatcagcaaactctaagtgactctcaccttccagaagaggccctgaaggtaccgcccgttccagggcctgatgcacagaagaccgagaccccatcagtgtcatcatccttatacagttatcgggaaaagcccatagtgttctaccagcaagcccttccagactcagagttgactcaggaggccctaaaggtgagtgccgtcccacagcctgctgatcaaaagacaggtctgagtacggtgaccagttccttctacagccataccgaaaagcccaacattagctatcagcaagagctccccgatagtcacctcacagaggaggcattgaaggtaagcaatgttcctggaccggccgatcaaaagacaggggtctctaccgtcacttcaaccagctatagccatagagaaaagcccatcgtgagctaccagcgcgagctgcctcattttacagaggcaggtttaaaaatcctgcgtgtacccgggcccgctgaccagaagaccggtataaacatccttccctctaactcataccctcagcgcgaacattcagtaatctcctatgagcaggagttacccgacctgactgaagttacgctgaaggctattggagtgcctgggccggccgatcagaagactggaatccagatcgcgtcttctagttcttactccaatagagagaaggcttcaatatttcaccaacaggagcttcctgacgtcaccgaggaggctctcaatgtcttcgtggtgcccgggcaaggtgaccgtaagaccgagataccaaccgtcccactgtcctactattcacgaagagaaaaaccatctgtgatatcacagcaggaactgccagactcccatctcacagaggaggctctcaaggtcagccctgtatccatccctgccgagcagaaaaccggcatacctatcggcttaagctcgtcgtactctcacagtcacaaagagaaactgaagatctctaccgtgcatattcctgacgaccagaagactgaattccctgcggcaactctgagtagttacagtcagatcgaaaaaccaaagatttctactgtcataggaccgaatgatcagaagacccccagccagaccgcattccactcatcctactcccaaacagtaaaacccaacattctgtttcagcagcagctccccgatcgggatcagagcaaggggattctgaagatcagcgccgtgccagaactgactgacgtcaatactggcaaaccagtgagtctgagctctagctattttcaccgggagaagtctaatatcttttcacctcaggaattacccggctcccacgtcactgaggatgtgttaaaggtgtccacaattcctggcccggcaggacagaaaacagtcctgccgacggcattaccatcctctttttcccacagagagaaacctgatatcttctatcagaaggacttgccagaccggcacctgacggaagacgcacttaaaatttcaagtgccctgggacaggcggatcagatcactggactccaaaccgtgccaagtggaacctattcccacggcgagaatcataagctcgtgtctgagcacgttcagaggttgatcgataatcttaatagctcagactctagcgtgtccagtaataatgtacttctgaacagccaggccgatgaccgggtcgtgatcaacaagccagaatcggccggtttcagagacgtgggcagcgaggagattcaggacgccgaaaactctgcaaagactctcaaggagatcaggactctgttgatggaggccgagaacatggcactgaaacgatgtaattttcccgctccattagctcggttccgggacatcagcgacataagctttattcagagcaagaaggtggtttgtttcaaggaaccctcctctacaggggtatccaatggcgacctgctccaccggcagcccttcaccgaggagtcaccttctagcaggtgcattcagaaagacattggcacgcagacaaacctcaagtgtcgccgcgggatcgaaaactgggaatttatctcttccacaaccgtgcgctcccctctgcaggaggcagagtcgaaagtgtctatggcgctggaggaaaccttgcgccaataccaggcagcaaagagcgtcatgcggtctgaacccgagggttgctccgggactatcgggaacaaaatcatcatcccaatgatgacagtgatcaagtcagattcatcttcagacgcctctgacggcaatggaagttgttcgtgggattctaatctcccagagtctcttgaatccgtatccgatgtcctgctgaacttctttccatatgttagccctaaaacctctatcacggatagcagagaagaggagggagtatccgagtctgaagacggaggagggtcttcagtagacagcctggcggctcacgtgaaaaacctactccagtgcgaaagctcccttaatcacgcgaaggagatcctccgaaacgcagaggaggaggaatctagagttcgtgcccatgcatggaatatgaagtttaatctggcacacgactgtggctatagcatctcggaactcaacgaagatgacagacgcaaggtagaggaaattaaagccgagctgtttggccatggccgtacaaccgatctttcaaagggcttgcaatcttag

SEQ ID NO: 107971 - DNA, 1944 bp, Artificial Sequence
  Description of Artificial Sequence: Synthetic coding sequence
atggctgcacccgccggtggtggtggtagcgcagtctctgttttggcccccaatggcaggcgccatacagttaaggtgacgcctagcactgtcctgctccaagtccttgaagatacgtgtcgacggcaggacttcaacccttgcgagtacgacttgaaattccaacgaagcgtcctggacctctctctgcagtggcggtttgcaaacctgccgaacaatgccaagttggagatggtgcccgccagccgcagtagggagggccctgaaaacatggtgagaattgccctgcaactcgacgacggttctcggctccaggacagcttttgttcgggtcagactttatgggagttgttatcacatttccctcagattcgcgagtgtctacaacatcctgggggggcaacccccgtctgcgtctatactagggacgaggtcaccggagaagccgcgttgcgcggaacaacccttcagtcattggggcttaccggcgggtctgccaccattaggttcgtcatgaaatgctatgaccccgtgggtaaaacacccggaagcctgggtagctctgctagtgccgggcaggccgcggccagcgccccattgcctctggaaagcggcgagctcagccgcggtgacctgtcaaggcccgaggacgcggacacgtccggaccttgctgcgagcatactcaagagaagcagtctacccgcgctcccgctgccgccccctttgtgcctttctccggggggggacagaggctggggggaccacccggacctacccggcctctcacaagctcctccgccaaactgcctaagtcactgtcctcgccgggcgggcccagcaagcctaaaaaaagtaagagtgggcaagatcctcagcaggagcaggagcaagaaagagaaagagatccacagcaagagcaagaaagggaaaggcccgtcgatcgggaacccgtggacagagagcctgtcgtctgccatcctgatctggaggagaggctgcaggcctggccagccgagctccctgacgaatttttcgaacttacggtggacgacgtcaggcgtaggttggctcagctcaagagcgagcgcaagcgacttgaggaagcccctttggtcacaaaagcttttcgtgaagcccagattaaagaaaaattggagcgataccccaaggtagccctgcgagttttgttccccgacagatacgtattgcagggttttttccggccctcagagacagtgggcgacttaagagactttgtgcggagtcacctgggtaatcctgaactgagcttctatttgttcattaccccacctaagaccgttctggatgaccatacacaaaccctcttccagccacagcttggggatagagttgcacctttcactctgggaccttcattaaagagatgcctgggaccggaacaaagaacaaggcttcccgtggttggcgacggcggcgacgtagattccggcaggctattattctggggtccttcacggggacgggcttcacctagcactgggcagcctccgtgccaccccgtgtgccgacctagttccccgcctagccccaggccctcatctggcgatccgtctcgtgtgaaggccggtcataagcatgtcggcacaggcagggctaacctctttcccgccgctctcgtccacctcggtgcagaggaaccagcgggtgtgtacctcgagccaggattactggaacacgctatcagtccttccgccgcagatgtgttagtagccaggtacatgtctcgagccgccgggtctccctccccactccccgctcccgatcccgcccccaaatctgaacctgctgccgaagaaggcgccttagtcccccctgagccaatcccaggtaccgcccagcccgtcaaaaggagcctgggcaaggtgccaaaatggctcaagctgccagcatcgaagcggtag

SEQ ID NO: 107972 - DNA, 1662 bp, Artificial Sequence
  Description of Artificial Sequence: Synthetic coding sequence
atggctgcaccagccggcggggggggttccgctgtgtccgtattagccccaaacgggcgccggcataccgtcaaggtcacccccagcactgtgcttcttcaggtcctcgaggacacctgccggcgccaggatttcaatccatgtgagtatgacctgaagtttcagcggtccgtcttagacctcagtctgcagtggaggttcgcaaaccttccaaacaatgcgaagctggagatggtcccggcttctcggtcccgcgaaggccccgagaatatggtgaggatagccctgcagctcgacgacggtagtcgtttgcaagactccttttgctccgggcagaccctttgggagttgctgtcacacttcccacaaatcagggagtgccttcagcatccaggtggcgccacgccagtgtgcgtctacaccagggatgaggttactggcgaggccgctcttagggggacaaccttgcagtctctcggtctgactggcggcagtgccactattcgctttgtgatgaagtgttacgatccagtgggaaaaactcctggctccctgggcagcagcgcctctgctggccaggcggcagcctcggctcccctgccgttagagtctggggagctgagtagaggcgacctctctaggccagaagatgcggatacctcagggccttgttgtgaacatacacaggagaagcagagcactagagcccctgccgccgcaccatttgttcctttttcaggaggcgggcagcggctgggcggaccccccgggcctactaggccactgacgagttcctccgccaagctgcccaagtctctaagctcccccggaggcccatcaaagcccaaaaagtccaagtctgggcaggacccccagcaggagcaggagcaagagagggaacgcgatcctcagcaggagcaggagcgggaaaggcctgtggatcgggagcctgttgatcgagaacccgttgtgtgccatcccgacttagaggagcgcctccaggcttggcccgctgagctgcccgacgagttcttcgagctcacggtagacgatgttagaagaagactggctcagcttaaatccgagcgtaaacggctggaggaagctcctctggtgaccaaggcattcagggaggcccagattaaagagaagctggaacggtatcctaaggtggcactgcgggtgctctttccagatcgctacgtcctccaagggttctttaggcccagcgaaactgtcggggacctgagggactttgtccgctcccacctcgggaaccctgagctgtccttttatctgttcattactcctccaaaaactgttctggacgaccatactcagaccctgtttcaggcaaatctgttccccgctgccctcgttcacctaggagctgaggagcccgctggcgtttacctcgaaccaggcctgctggagcatgctatcagcccttccgccgctgatgtgctcgtggcccgatatatgtctcgcgctgcaggcagcccctctccattaccggcccccgacccagccccaaagagtgagcccgcagcagaggaaggagcattggtgcccccagagccaatcccagggactgcccagcctgtcaaaagaagcttagggaaagtgcccaagtggctgaaattgcccgcgtccaagcgatag

SEQ ID NO: 107973 - DNA, 1050 bp, Artificial Sequence
  Description of Artificial Sequence: Synthetic coding sequence
atggtgccagcatcccgttcccgggagggacccgaaaacatggtaagaatagcattacagctggacgatggtagccggctgcaggatagcttttgttccggccagacactttgggaattgctctctcacttcccccagatccgggagtgtctgcaacaccctggcggagcgaccccggtgtgcgtctatacacgcgacgaagtgactggggaggcggccttaagagggaccaccttgcagtctctgggccttacgggagggagtgccacaataagatttgtgatgaagtgctacgacccagtaggcaaaacacccggatcgctgggctcaagtgcatctgctggccaggcagcagcaagtgctcctctcccgttggaatccggagaactctctagaggagacctgtccagacccgaggacgcagacacatctggcccctgttgcgagcacacgcaggagaagcagtcaacgagagccccggccgctgctccatttgtgccattctcgggcggaggacagcgactgggtggccctcctggtccaactaggccgcttacgagtagcagcgccaaactgcccaagagcttatcttcacctggaggccccagcaagcccaaaaaatctaagagtggtcaggatcctcaacaagagcaggaacaggagcgggagagagatcctcagcaggaacaggagagggagagacccgtcgatagggaaccagtcgatcgagagcctgtggtctgtcatccggacctcgaggagagactacaggcttggcccgctgagttaccggacgaattttttgagttgaccgtggacgatgtgcggcgtcgcctcgcccagttgaagtccgaacggaagcgcctggaggaagccccgttggtcactaaagctttccgggaagcacagattaaagagaaactcgagcgttatccaaaaagacgttccctctcactgtccccacgactggagagcgtcgttccctctcagctaacagcctcttctgcttctcgcgtgcaggtcgtgttactgccgcagcctccaaaatag

SEQ ID NO: 107974 - DNA, 981 bp, Artificial Sequence
  Description of Artificial Sequence: Synthetic coding sequence
atggagtttcttagcgaaaaatttgccctgaaaagcccccccagtaaaaatagcgacttttacatgggggccggcggacccttggaacacgtcatggaaaccctggataatgaaagcttttattccaaggctagcgcaggaaagtgcgtgcaggcatttggtcctcttcccagggctgagcaccatgtgcgactggagcggaccagtccatgccaagatagctctgtgaattacgggattactaaggtggaaggacagcccctccacactgagctgaatagggcgatggataactgcaactcactgcgcatgagtcccgtgaaaggcatgcaggaaaagggagaactggatgaactcggggacaaatgtgatagcaatgtatcatcttccaaaaaacgtcgccatagaaccacctttactagccttcaactggaggagcttgagaaggtgttccagaagacgcattaccctgatgtgtatgtaagggaacagttggccctgcgcacagaactgactgaggcacgcgtccaggtgtggttccagaaccgacgcgccaaatggcggaagcgcgagaggtatgggcagatccaacaagctaaaagtcacttcgctgctacttacgacattagcgtcctcccgagaaccgattcctaccctcagattcagaataacctttgggccggcaacgcgagcggtggctccgtagtgacttcctgcatgctgccacgagatacctcaagctgtatgacaccctactcccactctcccagaacagatagctcttacacaggtttttccaaccatcagaatcagttctctcacgttcccctcaacaacttttttacggattccctgctgactggcgccaccaatgggcatgccttcgaaaccaagcccgaattcgagagaagatcttccagtatcgcggtgctgcgaatgaaagctaaggagcataccgccaatatcagctgggctatgtag

SEQ ID NO: 107975 - DNA, 1032 bp, Artificial Sequence
  Description of Artificial Sequence: Synthetic coding sequence
atggacccagaacattgcgcaccatttcgggtgggtccagcacccggcccttacgtcgcctctggtgacgagcctccaggaccacagggtacgcctgccgccgcgcctcacctgcatccagctccccccaggggcccaaggctgacgaggttcccagcatgcggccctttggagccttacctgccggagccagcaaaacctcccgcgaaataccttcaggacctgggacctggcccggctctgaatggaggtcatttttatgaaggacccgcagaggccgaggagaagacatctaaagctgccagcttcccccagttacctcttgactgcaggggggggccacgagatggaccctccaatctccagggcagccccggcccttgcctggcttccctgcatttacctctgtctcctgggctccctgatagtatggagctggctaagaataagtccaagaagcggcgtaatagaacgaccttctccaccttccagctcgaggaactggagaaggtcttccagaaaacccactaccctgatgtgtatgcgagggagcagctcgccctccggacagatctgacagaggcacgcgttcaagtgtggttccaaaatcgaagggctaagtggaggaagcgggaacgttatggaaagattcaggagggccgcaaccccttcaccgccgcctatgatatctccgtgctgcctcgaacagatagtcatcctcagttgcagaatagcctatgggctagcccaggatctggcagcccaggaggaccttgtcttgtatcacctgaaggaatcccctccccttgcatgtcgccatattcacatccacatggatcggtggctggatttatgggcgtacctgctccctccgccgctcaccctggcatctatagcatacacgggtttccgccaacactgggtggacactctttcgagccaagttctgatggagattacaagtccccctctctggtgtccttgcgggttaagcctaaggagccccccggcctcctgaattggaccacctag

SEQ ID NO: 107976 - DNA, 1236 bp, Artificial Sequence
  Description of Artificial Sequence: Synthetic coding sequence
atgaatgcggaaacatgtgtcagctactgcgagtctcccgcagcggccatggacgcctactactctccagtgagccagtcaagggagggctcgagccccttccgagccttcccgggcggggataagtttggaacgacgttcctcagtgcagctgcgaaggcccagggatttggagacgcgaagagccgagcgcggtacggagctggacagcaggatctcgcaaccccactggagagtggtgccggcgcaaggggtagtttcaataaattccagccacaaccttcgaccccccagccccagccacctcctcaacctcagcctcaacaacagcagcctcagccccagcctccagcacagccccatttgtatctccagagaggggcttgcaaaacaccaccagatggctccctcaaattgcaggagggctcgtcggggcacagcgccgccctgcaggtgccatgctatgctaaagagtcttccctgggggaacctgaactcccgcccgattctgataccgttggtatggacagctcctacctgtcggtaaaagaagcgggcgttaaggggccccaggacagggccagctcagacttgccgagtcctttggagaaagcggactcggagagcaacaagggcaagaagagaaggaaccgcacgactttcacctcataccagctggaagagctggagaaggtctttcagaagacccactatcctgacgtctatgccagggagcagctggccatgcggacagatctgaccgaggccagagtgcaggtctggttccagaaccgccgagctaagtggcgtaagcgggagcggttcgggcagatgcagcaggtgcggacacatttttctactgcttatgaactgcctcttctgactagagccgaaaactatgcccagatacagaacccgtcatggctgggtaacaacggggctgcctctccagtgccagcctgcgtcgtgccatgcgatcctgtcccagcgtgcatgtccccccacgcccacccccctggatcaggtgcctcctccgtgacagacttcttgtcagtgtccggagccggtagccatgtgggccagactcacatgggatctctgttcggggccgcatctctctcacccggcctgaatggctacgagctgaacggagaaccagaccggaaaacaagctccatcgccgctttaagaatgaaggctaaagagcacagtgccgcgatcagttgggcaacttag

SEQ ID NO: 107977 - DNA, 630 bp, Artificial Sequence
  Description of Artificial Sequence: Synthetic coding sequence
atgagatctacaatcctactgttttgcttgttgggcagtacaaggtctcttcctcagctaaaaccggctctcggccttccacctaccaaactggcacctgaccaagggactctgccgaaccagcaacaaagcaatcaagtgtttccctccctgtccctcatccctctaactcagatgttgaccctgggccccgacctgcatctgctcaatcctgctgctggaatgacccccgggacgcagacacaccctctgaccctgggcgggctcaacgtgcaacagcagctgcatccccacgtgcttcccattttcgtaactcagttaggggctcaggggaccatattaagctcagaagagctacctcagattttcacttccctaatcatccacagcctttttccagggggaattctcccaactagccaggccggagcaaatcctgatgtgcaagacggcagtcttccagccgggggtgccggagttaatccggccactcaagggacacctgcaggccgcctcccaacaccatctgggaccgatgacgactttgctgtaactacgccagctggcatccagcgctcaacccacgctattgaggaagccacaaccgaatctgcaaatggaatccagtag

SEQ ID NO: 107978 - DNA, 627 bp, Artificial Sequence
  Description of Artificial Sequence: Synthetic coding sequence
atgcgatcaactatcctgcttttctgtctgctcggttcaaccaggagtctgcctctgaaacctgcgctcggcttaccgccgactaagctggcgcccgaccagggcacgttacctaatcagcagcaatctaaccaagtgttcccatcattgtcattgatcccattaacccaaatgcttacattgggtcccgacttgcaccttctgaatcctgccgcagggatgaccccagggacccagacccatcctctgactcttggtggccttaatgtgcagcaacagcttcaccctcacgtcctccctatctttgttacccagctgggcgctcagggcacaatactgtcatccgaagagctaccccagatcttcacatccttgatcatccattccctatttccgggggggattttaccaacgagtcaggcgggcgccaatccagacgtccaagatgggtccctcccagctgggggcgccggtgtaaacccggctacccagggcaccccagctggccgactccccaccccaagtggtacggatgacgactttgccgtcaccactcccgccggcatccagcggtccacacacgctattgaagaagcaacgacagaatccgccaatggtattcagtag

SEQ ID NO: 107979 - DNA, 2256 bp, Artificial Sequence
  Description of Artificial Sequence: Synthetic coding sequence
atgccagcactggggtgggccgtcgccgctattctaatgctacaaacagctatggccgagccgtctcccggtacccttcctaggaaagcaggcgttttcagcgatctgtcaaaccaggagttgaaggcagttcactccttcctttggtcaaagaaagagctccggctgcagccaagctctaccactacgatggccaagaatactgtttttctgatagagatgctcctccctaagaagtaccacgttcttcgctttctagacaagggcgagcggcaccccgtgcgtgaagctcgggccgtcatcttcttcggagaccaagaacaccctaacgtgactgaattcgccgtgggaccacttccgggaccttgttatatgcgcgcactctccccccgacctggctaccagagcagttgggcaagtagaccaatatcaactgccgagtatgctcttctgtaccatacgctccaggaggccacgaagcctttacaccaattttttctgaatactacaggcttctcatttcaggattgtcatgaccgttgcctggcctttaccgacgtggccccacgcggtgttgcatccggccagcggcgatcttggctgatcatccagcggtatgtggaaggctatttcctccatcctactggattggagctgttagtggaccacggctccactgacgccggacattgggcagttgagcaggtgtggtataatggaaagttttatggaagccctgaagagctggctaggaagtacgccgatggtgaagtggacgtagtcgtgctcgaggacccccttcccggtgggaagggccatgactcaaccgaggagcctcctctgttctcctctcacaagcccaggggagactttccctcacctattcacgtgtcagggcctcggctcgtgcaaccccatggcccacgcttccgactcgagggcaatgccgtactctatggcggatggagtttcgcctttaggcttcggtcctcatccggccttcaggtcctcaatgtgcacttcggcggagagaggatcgcatatgaggtctcagtacaggaggcagttgcgctgtacggcggccataccccagctgggatgcagaccaaataccttgatgtggggtgggggctcggttccgtcacccacgagctggccccggggatcgattgtccagaaacggctacctttctggacaccttccactattatgacgcggacgacccagtgcactatcccagggctttatgcctgttcgaaatgccaactggggtgcccctgcgccggcacttcaactctaatttcaagggagggtttaacttctacgccggacttaagggccaggtgctggtgctaagaacaacctcaaccgtgtataactatgactacatctgggactttatcttctaccccaacggtgtaatggaagcaaaaatgcacgccacaggatatgtgcacgctacattctacacccccgaaggtctaagacacgggacaaggctgcatacgcacctaattgggaatatccacacccatctggtgcactatagagtggatttggatgtggccggtacaaaaaattcctttcaaacccttcagatgaagctggagaatatcaccaatccctggagtccaaggcacagggtggtacagcccaccttggagcagacccaatactcttgggaacgtcaggccgccttccgttttaagaggaaactccctaagtacctgttattcacatccccccaggagaatccatggggccataagcgcacttatcgactgcaaatacacagcatggctgatcaggttcttccacccgggtggcaggaggagcaagccatcacttgggcaagatacccactggccgttacgaagtatcgggagagcgagttgtgttcctcatccatctatcatcagaacgatccatggcatcccccagtagtgtttgagcagtttctgcacaacaacgagaatattgaaaatgaagatctagtggcgtgggttacagtaggctttctgcacattccccactctgaggatatcccaaataccgctactcctggcaattcggtgggattcctcctgagaccctttaacttttttcccgaggacccttcactggctagccgcgacaccgtgatcgtgtggccaagggataacggacccaactatgtccagagatggatcccggaagaccgggattgcagtatgccccccccattttcctataatggtacttacagacctgtttag

SEQ ID NO: 107980 - DNA, 2313 bp, Artificial Sequence
  Description of Artificial Sequence: Synthetic coding sequence
atgccggcactgggatgggcggtagccgctatacttatgcttcaaacagcgatggcggagccctcccctggcaccctccctagaaaggcaggagtatttagcgatctgtccaaccaggagttgaaggcagtgcattcctttctgtggtctaaaaaggagctgcgcctacagccctctagtaccacaacgatggcgaagaatacagtttttctgatcgagatgctgctccccaagaagtaccatgtactgaggtttttggacaaaggtgaaagacaccccgtccgagaggcccgagcagtcattttctttggcgatcaggaacatcctaatgtaaccgaatttgcagttggaccactgcctggaccttgctacatgagggccttgtccccgcgaccgggctaccagtcaagctgggcatcacggcccatcagcacagctgagtatgctctcttataccatactttacaggaggcaaccaaacccttacaccagttttttctcaatacaactggcttttctttccaggattgtcatgaccggtgcttggcctttaccgatgtggcaccaaggggggtggcgtcggggcagagaagatcctggctgatcatacagcggtacgtcgagggctatttcctgcaccctaccgggctggaattactggtggatcacggatcaacagacgcaggccattgggcagtagaacaggtatggtataatggtaagttctatggctcgccggaagaactagcacgtaagtatgcggacggggaggttgatgtcgtcgtgctggaggaccccctacccggtgggaagggtcacgactcaaccgaagagccccccctgttttcaagccacaaaccccggggcgatttcccatcacccatacacgtgagtggccctcggcttgtgcagccccacggccctaggtttagactggaaggcaatgctgtgctgtatggaggttggtcatttgctttccggctgaggtcctcgtctgggcttcaggtcctcaatgtacacttcgggggggagagaatcgcttacgaggtaagcgtgcaggaggccgttgcgctatacggagggcatactccggccggaatgcagactaaatacttagacgtcggctgggggttaggatccgttactcacgagctggcaccagggattgattgtccagaaacagccaccttcttagacaccttccactattacgatgcagacgatcccgtccactatccaagggccttatgtctgttcgaaatgccaacaggtgtgcccctgcgacgccatttcaactcaaatttcaagggaggcttcaacttttacgccggattaaaggggcaggtcttggtgctgaggaccacttcaaccgtttataattatgattacatatgggatttcattttttaccccaacggggtgatggaggcaaaaatgcatgccacagggtatgtgcatgcgacattctacactcccgagggactgcgacacggaactcgtctgcatacacacctgattgggaatatacacacacatttggtacattaccgagtcgacctggacgtggcaggcactaagaactccttccaaacactacaaatgaaactggagaacatcaccaacccttggagtccgcgtcatagggtggtgcagcccactcttgaacagacccaatacagctgggaaaggcaggctgcttttcgcttcaagagaaaactgcccaagtacctcctgttcacctcgccacaggaaaacccgtggggccacaaacggacttatcgcttacagatccacagcatggcggatcaggttctgcctccgggatggcaggaggagcaggctatcacttgggctaggactgagggggggcagcctcgggccctgtctcaggcggctagccccgtccctgggcgataccctctcgctgtgacgaagtaccgggaatcagaactctgcagctcatcaatctaccaccagaatgatccttggcaccctccggtggtgtttgagcagttcttgcacaacaatgagaacatcgagaacgaggaccttgtagcctgggtgacagtgggctttctgcacatacctcactccgaggacatccctaacactgcaactcctggcaactcagtgggctttttactccgcccctttaatttcttccctgaagatccttccctggcttccagagacacggttatcgtgtggcccagagataatggtcctaattacgttcagagatggataccggaggatagggattgttcaatgccaccgccatttagctataatggcacttatcggccggtttag

SEQ ID NO: 107981 - DNA, 1884 bp, Artificial Sequence
  Description of Artificial Sequence: Synthetic coding sequence
atgcgcgccctttcgcccaggccagggtaccagtctagttgggcttctagacccatttccaccgcagagtacgctctcctctaccatactctccaggaggccacaaagcccctgcatcagtttttcctgaacactaccggcttcagttttcaggactgccacgatcgatgtttggcctttaccgacgtagcccctagaggggtagcttctggacagaggcggagttggctgatcatacaaagatacgttgaggggtattttcttcaccccactggcctggagttactggtcgaccacggatccactgatgccgggcactgggccgtcgaacaggtctggtataatggtaaattctacggctccccagaggaattggctagaaagtacgcagatggcgaggtcgacgtggtggtgctggaggaccctcttccaggcgggaagggacatgactctacagaagaacctcctctgttttcttcgcacaaacctaggggagattttccaagcccgatacatgtgagcggcccgaggctggtgcaaccccacggcccccggtttcgcctcgagggcaacgctgtgctgtatgggggctggagcttcgccttccgtctcagatcttcctccgggctgcaggtcctcaatgtgcactttggcggagaacgaatcgcttatgaagtttcagtgcaagaggctgtagccctctatggaggccacacaccagcaggtatgcagacaaagtatctggatgtcgggtggggcctcgggagtgttacacacgaactcgccccgggaatcgactgccccgagacggctacctttctggacacattccattactacgatgcagatgaccctgttcactatcctcgagccttatgccttttcgagatgcctactggtgtccctctgcgacgtcactttaattcaaacttcaaaggaggattcaacttttatgccggcctgaaaggtcaggttctggtgctgcgcaccacaagcacggtctacaactatgactacatttgggattttatcttctatccgaacggagtcatggaggcaaaaatgcacgccaccgggtacgtccacgccacgttctatacccctgaagggttgcgacacgggacaagactccacactcacctgatcggaaacattcacactcatctggtgcattaccgggtggatctagacgtagctggtacaaagaactcctttcaaactctccagatgaagctggaaaacattacaaacccttggtcaccaaggcaccgggtggtccagccaacactggagcagacccagtacagctgggagagacaggccgccttcaggttcaagagaaaacttccaaagtaccttctcttcacttctccgcaagagaatccgtgggggcacaaaagaacatatagactgcaaatccattcgatggctgaccaggtacttcctcctgggtggcaggaagagcaggctattacttgggcgcgctacccgctggcagtgacaaaatacagggaatcagaattgtgttctagtagtatataccatcagaacgatccttggcatccaccggtagtttttgaacagttcctccacaacaacgagaatattgaaaatgaggacctggttgcctgggtgacagtgggctttctccacatacctcacagcgaggacattccaaatactgcaacccctggaaactccgttggctttctactgcgtcctttcaacttctttcctgaggatcccagtttagcaagccgcgataccgtgattgtttggccacgggataatggcccgaactatgtccagaggtggatcccagaggatcgcgattgctcaatgcccccacccttctcctacaatggaacctaccgacctgtatag

SEQ ID NO: 107982 - DNA, 750 bp, Artificial Sequence
  Description of Artificial Sequence: Synthetic coding sequence
atgccagctctaggctgggccgtagcagccattttgatgctgcagactgcaatggccgagccgtccccggggacccttccccgaaaggctggcgtattcagcgatctgtcaaatcaggaacttaaagccgtgcactcattcctttggagtaaaaaggagttgcggctccagcctagcagtaccacgactatggccaagaatactgtgttcttaatagagatgttgcttccaaaaaaataccatgtgctcaggtttctcgacaaaggagagcggcatccagtgcgcgaagccagagcagtgattttttttggggaccaggaacatccaaatgtgaccgagttcgcagtcggcccccttccaggaccttgctacatgcgggccctgtctccacgacctggataccagtcctcctgggcatcaagaccaatctccacagctgagtacgcgctactatatcatacactgcaagaggccacgaaaccgctgcatcagttcttcctaaataccacaggcttttccttccaagattgtcacgaccgctgccttgcatttacggatgtcgctccacgcggcgttgccagtggtcagcggcggtcatggctgatcatccagcgatatgtcgaggggtactttctccaccccaccggactcgagctactggtcgatcatggctccactgatgcaggccattgggccgttgagcaggtctggtacaacgggaaattttacggctcacctgaggagctatag

SEQ ID NO: 107983 - DNA, 2256 bp, Artificial Sequence
  Description of Artificial Sequence: Synthetic coding sequence
atgcccgcgctgggctgggccgtcgctgccatacttatgctacagaccgccatggctgagccaagtcccggtacgctaccgaggaaagccggtgtctttagcgatttgtctaatcaggagttgaaagccgtgcactctttcctgtggtcaaagaaagaacttagactccaaccaagttccacaacaaccatggcaaagaacacagtgttcctcatagagatgctgctgcccaagaaatatcatgtgttaaggtttctggacaagggagagcggcatcctgtgcgtgaagctcgggccgtgatcttctttggcgaccaggagcatccaaatgttacagagtttgcagtgggccccctcccaggcccctgctacatgcgcgccctgagcccacggcctgggtatcaaagtagctgggcctcccgaccaatctcaactgctgaatatgccctgctgtaccacaccctgcaggaggccacaaagccgctgcaccagtttttcttgaacacaaccggtttcagttttcaggactgtcacgatcggtgcctggcgtttactgacgtggcccctagaggggtcgcaagtggacaacggagaagctggctgatcatccagcggtacgttgagggatacttcctccatccaaccgggctggagctcttggtggaccacggatccacagatgccggacattgggcggtcgaacaggtgtggtacaatggtaaattctatggctcgcctgaagagttggcccggaagtacgccgatggcgaagtagatgtcgtggtgctcgaagaccccttgccaggtggtaaaggccacgatagcacagaggaaccacctctgttctcaagccataagcctagaggagatttcccctctcctattcacgtctctggaccccggctggtgcaaccgcacggaccaagatttcgattagagggcaacgctgttttgtatgggggctggtcctttgctttccggttgcggagttcaagcggtttgcaggtcctgaatgtccattttggaggcgaacgaatcgcatacgaggtatcggtccaagaagccgtagcactgtacggcggccacacaccagcaggaatgcagactaagtatctcgacgtggggtggggattgggttcagtgacccacgaacttgcccccggtatcgactgccccgagacggcaacttttctagacacgttccactattatgatgcagatgaccctgtgcactaccctcgcgctctgtgcctgttcgagatgccaacgggagtacccctgagaaggcacttcaattctaacttcaagggaggttttaacttctatgccggactcaaaggccaggtcctggttctgagaacgacttctactgtgtataactacgactatatctgggattttatcttctatcctaacggggttatggaggccaaaatgcacgcgacaggatatgtccacgccaccttctatacccccgagggcctcagacatggcacgcgtctgcatactcaccttatcggtaatatccacacacacctggtgcactatcgggtggacctggacgtggcgggaacaaaaaacagttttcagactctgcagatgaaactggaaaacataaccaatccatggagcccaagacaccgcgttgtgcagccaaccctcgaacagactcagtattcctgggagagacaggcggcattcaggtttaagcgaaagctgcccaagtacttgctgttcaccagcccccaggagaatccctggggacacaaacgaacgtaccggctccagatccactctatggcggatcaagtgctaccacctggctggcaggaggaacaggcaatcacatgggctcgatatccccttgctgttacaaagtatcgagaaagcgagctgtgttcctcctccatataccaccaaaatgatccttggcatcccccagtggtgtttgaacagttcctccacaacaacgagaatatagaaaacgaggacctggttgcttgggtgactgtgggctttctgcacatccctcactctgaggatatacctaataccgccacccccggcaattcggtcggtttcctcctcaggcccttcaattttttccctgaagatccctctctggcgtcaagggataccgtgatagtgtggccccgcgataacgggcccaactatgtacagcggtggatccctgaagatcgcgactgtagtatgccgccacccttctcttacaacggcacatatagaccagtgtag

SEQ ID NO: 107984 - DNA, 1014 bp, Artificial Sequence
  Description of Artificial Sequence: Synthetic coding sequence
atgccagcgctcgggtgggccgttgcagctatcctcatgctccagaccgcaatggccgagccatcccccgggactttacccaggaaggcgggggtcttcagtgacctgtcgaaccaggagctcaaagctgtgcatagtttcctttggtctaagaaggagctgaggctgcagcctagctcgacaacaaccatggcaaagaacaccgtctttctgattgagatgttactgcccaagaagtaccacgtactgagattcctcgacaaaggggaacggcaccccgtgcgcgaggcacgagccgtgatcttctttggcgatcaggaacatccgaatgttacggaatttgctgtgggccctctgccgggcccctgttacatgcgtgcattatcgcctcggcctggctaccaatcttcctgggcctcccgcccgattagcaccgccgaatacgccctgctgtatcacaccctgcaggaggccacaaagcctctgcatcagttcttcctgaatacaaccggcttcagttttcaagactgccatgatcgctgtctcgctttcacagatgtagcccccaggggggttgcgagcggacagaggcgaagctggctgatcattcaaagatatgtggagggttactttctgcaccctacaggcttagaacttctggtggatcacggctcaactgatgcgggtcactgggctgtcgagcaggtgtggtataacggcaagttttacggctctcctgaggaactggctcgcaagtacgcggacggagaagtggatgtagtcgtcctcgaagatccgctgcctggcggcaaaggacatgattccaccgaggagccacctctcttctcttctcataaaccacgcggagacttcccatcccccatacatgtaagtggacctcggttagttcagccacacggaccccgcttccgtctcgagggcaatgccgtgctgtacggaggttggagcttcgcctttagacttcgaagttcatcaggtctccaggtgttatag

SEQ ID NO: 107985 - DNA, 582 bp, Artificial Sequence
  Description of Artificial Sequence: Synthetic coding sequence
atggaggcaaaaatgcacgccacaggatacgtccacgctactttttacacgcccgagggtctgcgacacggaacaagactgcatacccatttaatcggcaatatccatacccatctcgtacattaccgggtcgatctggatgtggcaggcaccaagaattccttccagacccttcaaatgaagctggagaatattaccaacccatggtctccgagacaccgcgtagtgcaaccaacacttgagcagacacaatacagctgggaacgtcaggcagctttcaggttcaaacggaagctgcctaagtacctcctgtttacgtcgccccaggaaaatccgtggggtcacaaacgaacttacaggctccagattcatagtatggcggatcaggtcttgccccccggctggcaggaggaacaggccattacctgggccaggtacccattggccgtcacgaaataccgcgaatccgagctctgttccagtagcatataccaccagaacgacccttggcatccttggtccctgtcatcttttttcactacgacaagaaccctgaagatgcggacctggtggcccggctag

SEQ ID NO: 107986 - DNA, 2256 bp, Artificial Sequence
  Description of Artificial Sequence: Synthetic coding sequence
atgcctgcactgggatgggctgtagcagcaatactcatgctgcaaacggctatggctgagcccagtccgggcaccctgccgcgaaaagcgggagttttttccgacttgtccaaccaagaactgaaggccgttcactcttttttgtggtccaagaaagaactgcgcctacagccctcctctaccacaactatggctaagaacacggtgtttctcatcgaaatgctgcttcccaaaaagtaccatgtgttaagattcctagacaaaggcgagcggcatcccgtgcgcgaggcccgtgcggtgatcttttttggagatcaggagcaccccaatgttacagagtttgcagtgggacccctgccaggaccctgttatatgcgagctctgagtcccaggcccgggtaccagagctcctgggcgagcaggcctataagtaccgccgaatacgctctgctgtatcatacactacaagaagccaccaaaccactccatcagttcttcctgaataccaccggcttcagcttccaggattgtcacgaccgctgtctagcttttaccgatgttgctccacggggcgtggcaagtgggcagcgaagaagttggctgattatacagcgctacgttgaaggctattttctgcatccgaccgggctggagttactagtggatcacggctccaccgacgccggccattgggcggtcgagcaggtatggtataacggaaaattctacggctcgcccgaggagttggctcggaaatacgcggatggcgaagtcgatgttgtcgtgctcgaagacccgttacccggtggcaagggtcatgacagtacagaagaaccaccactgtttagctcccacaagccacgcggcgatttcccctcacccatccacgtgtcaggccctcgccttgtacagccacacggaccacgcttccgcctagagggtaacgctgtcctatatggcggctggtcattcgcattcagattgcgcagctcctccgggctgcaggtcttgaacgtccatttcggaggcgaaagaatcgcttatgaagtgagcgtacaggaagccgtggcactgtacggcggccacaccccggcgggtatgcagactaaatacctggatgtaggttggggactcgggagcgtcacccatgagctcgcccccggcatcgactgtcccgagaccgctacctttttggatacgttccattactacgacgcagatgatcccgtgcactaccctagggctctgtgtctgttcgaaatgcctacaggcgtccccctacggagacattttaattctaattttaaaggaggatttaacttctacgcggggctgaagggtcaggtgctggtgctcagaaccacgtccactgtctacaactacgattacatctgggactttatcttttatccgaacggcgtgatggaggccaaaatgcacgcaactggatatgtacacgccacattttatacacccgaaggactgcggcatggaactaggctgcatacacatcttatcggtaatatacatacccatttggtgcactacagggtagacctagacgtggccggcactaagaacagcttccagaccttacagatgaagctggagaatataacaaacccctggagtccccgtcacagggttgtgcagcctacgctggagcagacgcagtattcatgggagcggcaggccgctttccgatttaagcggaaactgcctaaatacttgctgttcacatcaccccaggagaatccctggggtcacaagcggacttaccgccttcagatccactccatggcagaccaggtcctaccacctggatggcaggaggagcaggccatcacttgggcacgatatcctctggccgttacaaaatatcgggagtcagaattgtgtagtagttctatctaccaccaaaacgacccctggcacccccctgtggtcttcgagcagtttctgcacaacaatgagaatatcgagaatgaggacctggttgcgtgggtgacagtgggttttctccacatcccacacagtgaggacatccccaatacagcaaccccaggcaatagcgtcgggttcctgttgagaccttttaatttttttccggaggatccatctctggcctctcgggacaccgtgatcgtgtggccgcgggataacgggcccaattacgtccaacgatggatacccgaggaccgagattgctcaatgccccctcccttcagttataacggcacgtaccgaccggtttag

SEQ ID NO: 107987 - DNA, 1191 bp, Artificial Sequence
  Description of Artificial Sequence: Synthetic coding sequence
atgctgccctcacttcaggagtctatggatggtgatgagaaggaattggagtcatccgaggaagggggatctgcagaagaaaggagactcgagccaccctcatcgagccactattgtttgtatagctataggggatcccggctggctcagcagaggggtgattccgaggacgggtccccctccggcaccaacgccgagactcccagtggagacgattttagcctgtctttggctgacacgaacctacccagtgaagtcgaaccagagttaaggagttttatcgcaaagagactatccagaggagcagtattcgagggcctgggcaatgtcgcctctgttgagctcaagatcccaggataccgggtcggatgttattattgcctgtttcaaaatgaaaaattgctccccgagacagtgaccattgatagcgagaggaacccgtcagagtacgtggtgtgcttcctgggaggcagcgaaaaaggccttgagacctttcgccttgaactggataagtacattcagggactgaaaaacaacatgaactgtgaggcgaggggactggagagccatataaaatcttacctctccagttggtttgaagacgtcgtctgtccaatccagcgggtggtgttgcttttccaggaaaagctgacatttctgctgcatgccgcactgtcctatactcctgtcgaggtaaaagaaagcgacgagaagactaaacgggacatcaatcggtttctctcagtagcctcactccagggactcattcacgaaggaacaatgacctccctgtgtatggccatgaccgaggaacaacataagtccgttgtgattgattgttcttcgtctcagccccagttttgcaatgccggttccaaccggttctgcgaagattggatgcaggccttcctcaatggggcaaagggcgggaacccgttcctgttccgccaggtgctggaaaacttcaagcttaaagcgatacaggataccaataatctgaaaaggttcatcaggcaggcggagatgaatcactacgctctcttcaaatgctacatgtttcttaagaactgtgggtctggagacatcctcctgaagattgtgaaggtggaacacgaggaaatgcccgaggcaaagaatgtcatagcagttttggaggagttcatgaaggaggccctagatcagagcttttag

SEQ ID NO: 107988 - DNA, 1539 bp, Artificial Sequence
  Description of Artificial Sequence: Synthetic coding sequence
atggatcttaaggaatcccctagtgaggggtctttacagccaagtagcatccaaattttcgccaatacttcgactctgcacggaattcgccacatatttgtgtacggcccactgacaatacgtcgggtgctctgggccgttgcttttgtcggctcacttgggctgctcctcgtcgagtcatctgagagagtgtcctactacttcagttaccaacatgtgacgaaagtggatgaagtggtggcacaatcattggtttttccagcagtgacgctgtgtaatctgaatgggtttcgcttttcccgactgaccaccaatgatctgtaccacgcaggagaattactggcgcttttggacgtcaatctccagatccccgaccctcacttagccgacccctcagtgcttgaagctcttcgccaaaaggctaatttcaagcactacaagcccaagcagtttagtatgctcgaatttctgcacagggtgggacatgacctgaaagacatgatgctctactgtaaattcaaaggccaggagtgcgggcatcaggacttcaccaccgtgttcaccaaatatggaaagtgttatatgtttaactcaggggaggatggtaagcccctgcttacaacggtgaagggcgggacaggaaatgggctggagataatgctggacatacagcaagacgaatacctgccgatttggggcgagactgaagagaccaccttcgaggcaggtgtgaaggtgcagattcattcccaaagcgagccgcccttcatccaagaactgggcttcggcgtggctccaggtttccagaccttcgtggctacgcaagagcagaggcttacatacttgcctccaccatggggcgagtgccgctcctctgaaatggggcttgacttcttccctgtgtattctataactgcgtgccggatcgactgtgaaacacgctatatcgttgaaaactgcaattgtcgaatggtgcatatgcccggcgacgcccccttttgcactccagagcaacataaggagtgcgccgagccagccctgggcctcttggccgagaaggacagcaactactgcctctgcagaaccccttgcaaccttacccggtacaataaggagctcagcatggtgaaaattccaagcaagacttccgccaagtaccttgagaaaaagtttaacaagagcgaaaaatatataagcgagaacatcctcgtgctcgacatctttttcgaagcactcaactacgaaaccattgagcaaaagaaagcgtatgaggtcgctgcattgctaggggatattggtggtcagatgggactatttattggagcttcgatcctcactatactggagctgtttgactacatctacgaattgataaaggaaaagctgcttgacctcctgggtaaggaggaagatgaaggatcccacgacgagaacgtgtccacatgtgataccatgccaaatcacagtgaaacaattagtcatactgtcaacgtgcctctccagacaacgctggggactctggaggagatcgcatgttag

SEQ ID NO: 107989 - DNA, 612 bp, Artificial Sequence
  Description of Artificial Sequence: Synthetic coding sequence
atgttcaattcaggcgaagatggaaagccgcttctcactacagtcaagggaggaacaggcaacggcttagagattatgctggatatccagcaggacgagtatctgccaatttggggcgaaactgaagagaccacttttgaggcgggggttaaagtccaaattcactcccagtctgagcctcccttcatacaggagctcgggttcggggtcgcacctggatttcagacctttgtggcaactcaagagcagaggcttacttacctgccaccaccatggggcgaatgtaggtcctctgagatgggtcttgatttcttccccgtctattcaatcacagcttgtagaatagactgcgaaactaggtacatcgttgagaattgtaattgccgcatggttcacatgcctggggatgcccccttctgtacccctgagcagcataaagaatgcgccgaaccagccctaggacttcttgcagaaaaggatagcaattattgcttgtgtagaacaccttgtaacttgacccggtataataaggagcttagcatggtgaaaataccgagtaaaactagcgcaaagtatttagagaaaaagttcaataaatccgagaagtactag

SEQ ID NO: 107990 - DNA, 1287 bp, Artificial Sequence
  Description of Artificial Sequence: Synthetic coding sequence
atggcggttggggcaagtggccttgagggcgataaaatggccggagctatgccgctacagctgctactcctgttaatccttctgggtcccggaaatagcctgcagctgtgggatacatgggcggacgaagccgagaaggcgttagggcctctgttagccagggatcgtcggcaggcgaccgagtacgagtatctggactatgatttcctcccagagactgaacctccagagatgttgaggaattcaaccgacacaactccattaacaggacccgggacccccgagagcacaacggtagagccagcagcccggcgcagtacaggacttgatgccggaggggccgtgactgagctgacaactgaactggccaatatgggaaatctgtcaaccgattctgcagcaatggagatccagacaacccagccagccgccacggaggcacaaacgactcagcctgtgccaacagaggcccaaaccaccccgcttgcggccactgaggcacagaccaccaggctcacagcaacagaggcgcaaaccactccgctcgccgccaccgaggcacagacgacaccacccgccgccacagaggcccagacaactcagcccaccggcctagaggcacaaaccactgccccggccgccatggaggcacagactactgcgcctgctgcgatggaagcccaaacaacaccccctgctgccatggaggctcagacaacccagacaaccgctatggaagctcaaaccaccgctccagaggctacagaagctcagacaacgcagccaaccgcaacggaagcccagaccacccctcttgccgctatggaggccctatccacggagccctcagcaactgaagccctctctatggaacccaccaccaagaggggacttttcattcccttttccgtttcaagtgttacccacaagggaatcccaatggccgcctccaatctgagcgtgaattacccagtcggagccccagatcacatctctgtcaaacaatgcctgcttgctatactaatcttggctctggtggcgacaattttttttgtgtgtacagtggtactggcagtgcggctgtcccgcaaggggcacatgtatccagtgagaaactattcccctaccgagatggtctgcatcagctccctattacctgacggaggagaagggccttcagcgacagccaacggcggactctcaaaggcaaagtctcctgggttgactccggagcccagggaggaccgcgaaggcgacgacctcacattgcactcctttttgccctag

SEQ ID NO: 107991 - DNA, 1587 bp, Artificial Sequence
  Description of Artificial Sequence: Synthetic coding sequence
atggagctcaaggccgaggaagaggaggtcggcggggtccagcctgtttcaattcaggcattcgcgtcgtcgagtacgttacacggtctggcacatattttctcttatgagcggctatcattgaagagagctttgtgggctctttgcttcctgggtagcctggctgtgctgctctgtgtttgtaccgaaagagtgcagtactactttcattaccatcacgtcaccaagctagatgaggtggctgcctcacaattaacgttcccagctgtcaccctctgcaatctgaatgagttccgctttagccaggtgagcaagaacgatctttaccatgccggggagctgctcgcactactgaataatcgatacgagattcctgacactcaaatggcagatgaaaagcagctggaaatactccaggacaaggctaattttcgatccttcaagcccaaacccttcaacatgagagaattctatgaccgggcagggcacgatatacgggacatgttactgtcttgccacttccgaggggaggtatgttctgccgaggacttcaaggtggtgttcaccagatatgggaagtgttatacatttaattcaggtcgggacgggagaccaaggctgaagacaatgaagggcggtaccggcaacgggctggaaattatgctggatatccagcaagatgaatatttacctgtttggggagaaacggatgagacctctttcgaggccggtatcaaagtacagatccacagccaggacgaaccccccttcatcgatcagttaggtttcggcgtggctcccggttttcagacttttgtcgcatgtcaggaacagaggttaatctatctgcctcctccatgggggacatgcaaagctgtcactatggactcagatctggactttttcgattcctactcgataacggcatgtcgcatcgactgtgaaactcgatacctggtagaaaattgcaattgcaggatggtgcatatgcccggtgatgccccttattgtactcctgaacaatataaagagtgtgcggaccctgctctggacttccttgtggagaaagatcaggagtattgtgtttgtgaaatgccatgtaacctgactcgctacggaaaagaacttagtatggtcaagattccaagtaaggcatccgccaaatatttggctaaaaagttcaataaatcagagcaatatatcggtgagaatatcttggtcctcgacattttcttcgaagttttaaattatgagactatagaacagaaaaaagcgtacgagatcgccggcctgcttggcgatatcggcgggcagatgggactctttataggagcctccattctcactgtactcgagctgtttgactacgcttacgaggttattaaacacaaactgtgccggaggggaaaatgtcaaaaggaggcaaagaggtctagcgccgataagggtgtagcgttatcccttgatgatgtgaaaagacataatccctgcgagtcactcagagggcaccccgcgggtatgacatatgcagccaacatcctgccccatcatcctgcccggggaaccttcgaagactttacttgttag

SEQ ID NO: 107992 - DNA, 1689 bp, Artificial Sequence
  Description of Artificial Sequence: Synthetic coding sequence
atgcctatccagattttctgcagtatgtcctttagctccggcgaagaagccccaggtcctctgggggatatttggggcccccatcatcaccagcaacagcaggatatatcagagtcggaggaggaggaggaggagaaagagaaggaggccgtgcgcaaagaggccagcgaaggccatagtcccatggatctggtagcgttcgcaaattcgtgcacactgcacgggacaaaccacatattcgtggagggtggccccggcccccgacaggtcctctgggccgtcgcctttgtgttggctttgggcgcgtttttgtgccaggtcggtgatcgcgttgcatactatctgtcatacccccatgtgaccttactcaatgaagtcgctacaactgagctcgcgttcccagccgtgaccctttgcaataccaatgcagtcaggttatcacagctcagctaccccgaccttctctatctggctcccatgcttggtctggatgaatccgacgacccgggagtcccacttgctccacccgggcccgaagccttctctggcgaaccttttaacctgcaccgattttacaacagatcctgccaccgcctagaggacatgctgttgtattgttcttaccaaggagggccatgtgggccacacaacttttctgtggtgtttactaggtacgggaagtgctacacattcaattcaggacgagacgggagaccgcgactgaaaaccatgaaaggaggtactggaaatggattagagataatgttggatatacagcaggatgaatacctccctgtgtggggggagacagatgagacaagcttcgaggctggcatcaaagtgcagatccacagccaggacgagccgcccttcatcgatcaactcgggtttggggttgcaccaggatttcagactttcgtggcctgtcaggaacaacgcctcatatatctcccgccaccgtgggggacctgcaaagctgtcacaatggactccgatcttgacttcttcgattcctattccattacagcctgccggatcgactgtgaaactcgatatttagtggagaactgtaactgcaggatggtgcacatgcccggagatgccccgtattgcaccccggagcagtataaagagtgcgctgaccctgcattggattttctcgtcgagaaggaccaggagtactgtgtgtgtgagatgccttgtaacctaactagatacgggaaggaactgtcgatggttaagatcccttccaaggcctctgccaagtaccttgcaaagaagtttaacaagagcgaacaatatataggtgagaatatactggtgctggatatcttctttgaggtcttgaactacgaaactatcgaacagaagaaggcctacgagattgctggtttgctcggcgacataggcgggcagatgggccttttcataggagcaagcattctgaccgtgctcgagctgttcgattatgcctatgaggttataaaacacaagctatgccggcgcggcaaatgccaaaaagaggccaagcgatcgtccgccgataagggagtggctctctctctcgacgacgttaagcggcacaatccttgcgaaagtctacgcggacaccccgccgggatgacttatgcggcgaacattctgccccaccaccccgccagaggaacctttgaggatttcacatgttag

SEQ ID NO: 107993 - DNA, 1650 bp, Artificial Sequence
  Description of Artificial Sequence: Synthetic coding sequence
atgaagcctactagtggcccggaggaagctaggcggcctgcctcagatatccgggtgttcgcctcaaactgttccatgcatggactcggccatgtcttcggtccaggatccctatccctacggaggggtatgtgggccgcagccgtcgtgctaagtgtcgccacatttctgtatcaggtggcagagagggtgcggtattatcgcgagttccaccaccaaactgcgctagatgagcgggaatcccacaggctcatcttccccgcagtgactctgtgtaatatcaatccgctgcggcgatcacgcttaacccccaatgatctgcactgggccggctcagccttgttgggcctagaccccgctgagcatgcggcattcctacgggcactcggtcgcccgccggcaccgcctggattcatgcctagcccaacttttgacatggcacaactctatgctagagccgggcacagccttgacgacatgttgttggattgtagattccgcggccaaccctgcgggcctgagaattttaccactatcttcacacgcatgggcaaatgttatacctttaactctggagccgatggggccgagctgttgacaactactcggggggggatgggcaacggcctggacataatgttagacgtgcagcaggaagagtatctgcccgtgtggcgagacaacgaggagacccctttcgaagtcgggatccgggtgcagatccatagtcaggaagagcctccaatcattgaccaattgggactaggcgtctcccccggataccagacatttgtgagctgccaacagcaacagctgtcatttctcccaccgccttggggagattgcagttcagcttccctcaatcctaactatgaacccgagccgagtgaccctctcggcagcccatcaccctcgccatcccctccttacacgctcatgggctgtcgactggcctgtgagactcggtatgtagccaggaagtgtggctgtcgaatggtatatatgcccggtgacgtccctgtctgctccccacaacaatataagaactgcgcacaccccgcaattgacgcaatgttgcgtaaagattcttgtgcatgtcctaacccctgtgcatctacacggtacgctaaagagctgagtatggtgcggataccgtctcgggccgctgcccgttttctggctagaaaactgaaccgctcagaggcctatatagccgagaacgtccttgccctagacatattcttcgaggccctcaactacgaaaccgtcgagcagaaaaaggcgtatgagatgtcggaactcctcggagacatcgggggacaaatgggtctcttcatcggagcctccctgctcacaatcctggaaatcctggactacctttgcgaagtttttcgggataaagtgttagggtacttctggaatcgacaacacagccagagacacagctcgacaaatttactccaggaaggattgggctcacatcgtacccaggtgccacacctgtccctggggccttctaccttactgtgcagcgaggacctcccccccctaccagtgcctagccccagactatccccacctcccacagctcctgccaccctcagccatagcagcagacctgccgtctgcgtcttgggtgcacccccatag

SEQ ID NO: 107994 - DNA, 1596 bp, Artificial Sequence
  Description of Artificial Sequence: Synthetic coding sequence
atgaaaccgacttctgggcctgaggaggctcggaggcctgcgtcagacattcgagtctttgcttcaaactgtagcatgcatggtctgggtcatgtgttcgggccggggtcactcagtcttcgcaggggcatgtgggcagccgccgttgtgttgtccgttgccacattcctttaccaggtcgctgagcgggtgcgatactacagagaattccaccatcagaccgctctagacgagagggagagccaccggctgatctttcctgctgttacactgtgcaacataaacccactccggcgctccagactgacccccaatgacctccattgggctggcagtgcactgctcggcttggaccccgcagaacatgccgcattcttgcgcgcactgggccgccccccagcgccgccaggcttcatgccatcccctacctttgacatggcccagctttacgcccgggcaggccatagcctggacgacatgctgctcgattgcagattccgtgggcaaccttgcgggccggagaacttcactacaattttcactaggatgggaaagtgttataccttcaactccggagccgacggcgccgagctgctgacgaccaccagagggggcatgggaaatggtttggacattatgctggacgttcagcaggaagagtatctccctgtgtggcgcgacaatgaagaaaccccattcgaggtgggcattagagtccagatccatagtcaggaggagcccccgataattgatcagctgggcctgggggtgtctcctggctaccaaacatttgtatcttgtcagcagcagcagcttagttttctcccgcccccttggggagactgttctagtgcttctcttaacccgaattatgagcctgaacctagcgaccctcttggctctccttctccaagtccgagccccccctacaccctgatgggctgtcgcctggcgtgtgagacacggtacgttgctcggaagtgtggctgcaggatggtatacatgccaggtgacgtcccagtgtgttcccctcagcagtacaagaactgcgcccatccagccattgacgccatgctccggaaagacagctgtgcctgccctaatccatgtgcttccacccgctatgcgaaagagttgagcatggtgcgcatcccttctagagcagccgcaagatttcttgctcgaaagctcaaccgctctgaggcatacattgcagagaatgtgcttgccctcgatattttcttcgaggccttaaattatgagactgtggagcaaaaaaaggcctatgagatgtcggagctgctaggagatattggtgggcagatgggcttgttcatcggcgcctcccttctcaccatcctggagatcctcgattacctgtgcgaggtctttagggacaaggtgctgggatatttttggaacagacagcattcacaacggcattcttcaaccaacctcctgcaagaaggcctagggtctcacagaactcaggtcccccacctaagccttgggccccgtcccccaactccaccttgcgccgtgaccaaaacactatctgccagccatagaacatgttacctcgtcactcagctctag

SEQ ID NO: 107995 - DNA, 1632 bp, Artificial Sequence
  Description of Artificial Sequence: Synthetic coding sequence
atgaaacccacatcagggcctgaggaggctagacgcccagccagtgacatccgcgtctttgctagcaactgttcaatgcacggcctgggtcacgtatttggaccgggtagcctaagtctacgccgcggtatgtgggcagctgctgtcgtcctctccgttgcaacatttctttaccaagtggccgaaagggtccgatattacagggagtttcaccaccagaccgcactggacgagcgggaatcccacagactgatctttccggccgtgaccctctgtaacatcaaccctcttcggcggagccggttgactcccaatgatcttcattgggccggctccgccctgctcgggctcgatccggcagaacacgcagcctttctgagggccctggggcgaccccctgcgccccccggctttatgccttctcctacctttgacatggcgcagctctatgcccgcgcaggtcacagcctcgatgatatgttactagactgtcggtttcggggccagccctgtggaccagaaaactttactactatattcaccaggatggggaaatgctatactttcaattccggcgccgacggagctgagctgcttacaaccaccaggggcgggatggggaatggccttgacatcatgctagacgtccagcaggaggaatacttgcccgtgtggagagataacgaggaaacaccatttgaagtgggcattcgcgtccaaatccatagccaggaggagccacccatcatagaccagttgggtttaggggtgagcccaggttatcagactttcgtgagctgtcagcaacagcagctcagctttctacctcctccttggggagactgctccagtgcctcccttaatccgaactatgaacccgaaccaagcgacccgcttgggtctcctagcccctctccaagccctccatacacgttgatgggttgccgtctcgcgtgcgagacaagatacgtagcccgcaagtgcggctgcaggatggtgtacatgcctggcgacgtcccagtgtgctctccacagcagtacaaaaactgtgcacacccagcgattgatgccatgttgcgcaaggactcttgcgcatgtcccaacccctgcgcctctacgagatatgctaaagaactctctatggtcagaatcccttctagagccgctgcccgctttctggcccgtaaacttaacagatcagaagcatacattgcagaaaatgtactggcactggacattttttttgaagcgcttaattacgaaacagtcgaacagaagaaggcctatgagatgtcagagctgctgggcgacataggggggcaaatggggctgtttataggagcaagtctcctgactatccttgaaatcctggactatttgtgtgaggtgttcagggacaaagtcctgggctatttctggaatcgacagcactcccaaagacattcttcaacaaacttaacctcccacccatcactatgccgccaccaggattccctgagactccctccccacctactgccgtgccacaccgccctggatcttctgagcgtgagctccgagccaaggcctgatatcctcgatatgccttcactccatgtggctttcccaagttcaccacaaatcaagtcttag

SEQ ID NO: 107996 - DNA, 1944 bp, Artificial Sequence
  Description of Artificial Sequence: Synthetic coding sequence
atgttgtccggcgcggctggcgctgctaggagaggaggcgcagctcttgccccaagcctcacaaggtctctggccgggacccatgccggggctgattcgtgtgctggtgcagacaaggggagccataaagagacaattgaggagcgagataaacgacaacagagacagcagcggcagcggcagcaccagggctgcggagccgctgggtctgggtcagattctcccacgagtgggccacaccccgttcccgttcttttccctcttgcgttgtctctggaggagcaacctttgccgccgttgcctctcggtcgggcgcccggtttgctcgcacgcgagggacaggggcgcgaggctctcgccagcccttcctcccgcggtcagatgcccatcgaaatcgtatgtaagatcaaattcgcagaggaggatgcgaaacccaaagaaaaggaagccggagatgagcagagtctgctgggcgctgtggctcccggagcagctccgagagacctggccactttcgcctcaacttcaaccctgcatggtcttggccgcgcatgtggacccggccctcatggcctgcggaggaccctatgggccctcgccctcctgacatctctggccgcgtttctttatcaggccgcagggctggctagaggatatttgactcgcccacacttggtggcaatggacccggctgccccagcccctgttgccggctttccagctgtgactttgtgcaatattaatagattccgccacagcgccttgtccgatgctgatatcttccacttagccaatttgaccggtctgccacccaaagatagagacggccacagagcagctgggctgcggtatcctgagcctgatatggtggacattctgaaccgcacaggtcaccagttggctgacatgttaaagtcctgcaatttttctggacaccattgctccgcctctaactttagcgtcgtttacacacgatacggaaaatgttatacattcaatgcagaccctcgctccagcctgccgtcacgagctggaggtatgggctctggtctagagatcatgctcgatatccaacaagaagagtatctcccaatctggagagaaacgaacgagacgtcattcgaggctgggatccgtgtccagattcactcccaggaagagcctccctatatccaccaactgggatttggcgtatctcccggcttccaaaccttcgtaagctgccaggagcagcggcttacctatctgccgcagccctggggaaattgtagggccgagtccgaattgcgcgaaccagaacttcaaggctactccgcctactccgtttctgcttgtcgactgagatgtgaaaaggaagcagtcctgcagcgatgtcactgccgaatggtccatatgccagactccctgggggggggacccgaaggcccctgtttctgtcccactccgtgcaacttaacgaggtacggtaaagagatatcgatggtgcgtatcccaaacaggggcagcgcccgctacctcgcacggaagtacaaccggaatgagacctatattcgggagaactttctggtgctcgacgtctttttcgaagccttaacaagtgaggccatggagcagcgagcagcttacgggcttagtgccctgctaggggatctgggggggcagatggggttatttatcggggcaagcattcttacactccttgagatcctggactatatttatgaagtctcctgggatcgactgaagcgtgtgtggagacgcccaaagacccctctccgtacatctaccggaggcatatctaccctggggttgcaggaactaaaagaacagtctccctgtcctagcagagggagagtggagggcggaggtgtcagctcactcttacctaaccatcaccaccctcatggtccaccgggaggtcttttcgaggatttcgcctgctag

SEQ ID NO: 107997 - DNA, 2001 bp, Artificial Sequence
  Description of Artificial Sequence: Synthetic coding sequence
atgttgtcaggagcagctggagccgctcgtcgcggcggtgctgccctggccccttcactaaccaggtctctggctggcacccatgccggtgcagactcctgtgcaggcgccgacaaaggatcacataaagagacaattgaagagagggataagcggcaacaacgccaacaacgacagaggcagcaccagggatgcggagcagccgggtctggttctgactcccctaccagtggtccacaccccgttccagtgctgttcccccttgccctgtctctcgaagaacagcccctgccccctttgcccttgggacgagcccccggcctgctggcacgcgagggccagggtcgtgaagccttggcctcaccctcttcacgcggccagatgcccattgagattgtgtgtaagatcaaattcgccgaggaggacgctaaaccaaaggagaaagaagccggagatgaacagagtttgctgggtgctgttgcgcctggagcagctccccgggatctcgcaacctttgcatcaacatccaccttgcatgggctagggcgtgcctgtggtccaggacctcacggtctgaggaggacactctgggccctcgcactccttactagtctcgcagcttttctttatcaggcagccggactcgccaggggatacttaactcggccgcacctggtagcaatggatcctgccgctcccgccccagtagctgggttccctgccgtgaccctttgcaacattaacagatttagacacagtgccctgagtgatgcagacatcttccatctcgctaatctgacaggactgccacctaaagaccgggacggacatcgggctgcaggtctgcggtatcccgagcccgacatggtcgacatccttaataggacaggacaccaactcgcggatatgctgaagagctgcaactttagtggccatcattgcagcgcttctaactttagcgtggtgtatacacgttatggaaagtgttacactttcaacgccgacccgcgtagctcattacccagtagagccggcggcatgggctcggggctagaaatcatgctcgacatccagcaggaagagtacctacccatctggagagaaacaaacgaaacctcttttgaggctgggatcagagtgcaaatccatagtcaggaagagccaccctacatccatcagctaggcttcggggtcagcccaggattccagacgttcgtctcttgtcaggaacaaaggctcacatatcttcctcagccttggggaaattgtcgcgcagagagtgaacttagggaacccgaacttcaaggctatagcgcatattccgtgtccgcctgccgactgagatgtgagaaagaggcagtgctgcagcgatgccactgccgaatggtacatatgccaggtaatgagaccatttgcccaccaaatatctacatcgagtgcgcagaccacactctcgacagcttggggggcggtcccgagggcccttgcttctgccctaccccttgcaacctgactagatacggcaaagagatttcgatggtgcggatccctaaccgaggatctgcccgatacttagcccggaaatataaccgaaacgaaacctacattagagagaactttctcgtcctggatgtcttctttgaagctcttacttccgaggcgatggaacaacgcgcagcatacgggctgagcgcactcctgggcgatcttgggggccagatggggctgtttatcggcgcgtccattctgacactcctggaaattctggattacatttatgaagtctcttgggatagactcaagcgggtatggaggcggcctaagactcccttgcggacctctaccggggggatctcgacccttggcctgcaggagttaaaggagcagagcccctgtccctcacggggtcgcgtcgagggtgggggcgttagcagccttctccctaatcaccatcatccacatggcccacccggaggactatttgaggacttcgcatgttag

SEQ ID NO: 107998 - DNA, 2271 bp, Artificial Sequence
  Description of Artificial Sequence: Synthetic coding sequence
atgcaccttaaaatcgttcttgcgttcctcgcattgagcctaatcaccatctttgctttggcttatgtgctgctgacatctccgggcggctcgtcacagcccccccactgtccttcggtttcccaccgcgcacagccgtggccccacccgggccagtcacagctgttcgcagacctgagccgagaggagctgaccgcagttatgagatttcttactcagcgcctgggtcctggcctcgtggacgctgctcaagcccagccatctgacaactgtatcttctctgtagaactccagcttccccctaaagctgcagcgctcgcccacctcgataggggtagccctcctcctgctcgcgaggccctggccatcgtgctgtttggcggacagccacaaccaaacgtcagcgagctggtggtggggcccttaccccatccgagctatatgcgagacgtgacagttgagcggcatggaggtcccctcccataccatcggagacccgttttacgcgcagaattcacccagatgtggcgtcacctcaaggaagtggaactgcctaaggcacccattttcttaagctccaccttcaattataatggatccactctggctgcagtacacgccacgcctagaggtctgaggagcggcgaccgggccacgtggatggctttgtaccacaatatctccggggttggactgtttctgcaccctgtcgggttggagctgctgttggaccatcgagcattggatccggctcactggactgtgcaacaagtcttttatctcggtcactactacgcagacttgggccagttggaacgtgagtttaagagcggacggctggaagtggtccgggttcccctcccaccacccaatggggcctcctcactaagaagccgcaattcacctggcccactcccccctctccagttctcaccccaggggtctcagtatagcgtacaaggaaatctagtggtaagctccctatggagcttcacctttggccacggggtattctccggactaagaatctttgacgttagattccagggggaacgaatcgcatacgaagttagcgtgcaggagtgcgtcagcatttacggagccgacagccccaaaactatgctgacccgctaccttgattccagctttggcctgggccgcaattcccgcggcctcgtgcgtggagttgactgtccataccaagccaccatggtagacatccatatcctggtgggaaagggtgctgtccagctgctcccgggggcagtgtgtgtattcgaggaagcccagggattgcctctacgccgccatcacaactatctccagaatcatttttatggaggcctggcaagctcggccctggttgtgcggtcagtaagctccgtgggtaactatgattacatatgggacttcgtcctgtaccccaacggcgctcttgaaggtagagtgcatgccacaggctacatcaatacagcattcttgaaaggcggcgaggagggactgctgttcgggaacagggtgggagagcgggtgctaggtacggtgcacacccacgcctttcactttaaactcgatctagatgtggcaggcttgaaaaattgggtggtggcggaagacgtggtgtttaagcctgttgcagcaccctggaaccctgaacattggctgcagcggccacagctgacgcggcaggtgcttgggaaggaagaccttaccgcgttcagtcttgggtcacctctcccacgatatctgtatctcgcaagtaatcagacgaatgcttgggggcatcaacgaggataccggattcagattcactctcctctgggtattcacatcccgttggagtcagacatggaacgggctctatcttggggcaggtaccagttggtggttactcagcgtaaggaggaggaaagccaatcttcttcgatttatcaccagaacgatatctggaccccgaccgtgacttttgcggatttcatcaacaacgagacacttcttggggaagacctcgtagcctgggttacagcctcctttttacatattcctcacgccgaggatatccccaataccgtcactctgggaaacagagtcggtttccttctgcggccctacaatttctttgatgaggacccttcaatcttctctcctgggtccgtgtatttcgaaaaggggcaggatgctggcttatgcagcatcaatccagtggcctgcctcccggatctggctgcttgcgtgcccgacttgccccctttctcctaccacgggttttag

SEQ ID NO: 107999 - DNA, 2190 bp, Artificial Sequence
  Description of Artificial Sequence: Synthetic coding sequence
atgcacttgaaaatagtccttgcttttcttgccctcagtctgataacaatcttcgccctggcttatgttcttctcacctcccctggtgggtcctctcagcctcctcactgtccctctgtcagtcatcgagctcagccctggcctcatccgggacagagtcagctgttcgccgatctgtcacgggaggagttgacagctgtgatgcgatttcttacacagagactgggacccggcctagtggacgccgcccaagcccagccatccgacaactgtatattttccgttgaactgcaattgccccctaaggctgccgctctcgcccacctggatcgcgggtcccctccgcccgctcgagaagcactcgctatcgtactgttcggcggacagccccagcccaacgttagcgaattggtggttggaccactcccacacccctcttacatgagagatgtgaccgtggagagacatgggggacccctcccataccaccgtaggcccgtgttgcgtgcggagttcacacaaatgtggcgacatcttaaggaggtggagctgcccaaggcacccatatttctcagctctacttttaactataacggaagcacccttgctgctgtgcatgccacaccccgtggcttgagatcgggggacagggctacatggatggccctataccacaacatttccggcgtagggctattcttacaccctgtgggactggagctgctgctggaccaccgcgctctcgaccccgcgcattggactgttcagcaggtgttttatttaggccattactacgccgatctcggacagttagagcgcgagtttaaatcggggcggctggaggtggtccgtgtgccccttccccctcctaatggcgccagctctcttcggtctcgaaacagcccagggcccctgcctccactacagttttcgccccaagggtcccaatactcagtgcagggaaacctggtcgtttcttctttatggtctttcaccttcgggcacggtgtgtttagtgggctgagaatttttgacgtgcggtttcagggcgaaagaatcgcatatgaagtttctgtgcaggaatgcgtgtcaatatatggcgcagatagccctaagactatgctcaccagatatttggattcctcattcgggctgggccggaattctaggggcctcgtcagaggagtagactgtccctatcaggctacaatggtggacattcacatcctggtgggcaagggcgctgtgcaacttctgcctggggctgtttgtgtgtttgaagaggcgcagggcctccctctgcgccgacatcataattacttgcagaatcacttttacgggggcctggctagcagcgcactcgtggtcagatccgtatcaagcgtggggaattacgactatatctgggatttcgtactgtacccgaacggtgccctggagggccgggtgcacgcaaccggctacataaatacagcctttctgaagggcggggaggagggtctcctctttgggaaccgggtgggcgagagggtgctggggaccgtgcacactcatgccttccatttcaaacttgatctcgacgtggctggattaaaaaactgggtggttgctgaagacgttgtctttaaacccgtggctgccccctggaacccggagcactggctacaacggccccagcttacacgccaggtcctgggaaaagaggatttgaccgctttttctctgggttcccccctgcctcgctacctctatctcgccagcaatcaaactaacgcctggggacatcagcgaggctaccagctggtggtgacacagcgaaaggaagaagaaagccagagttcctccatttaccaccagaatgatatctggactcctaccgttacgttcgcggactttataaacaatgaaaccctgctaggcgaagacctcgtcgcctgggtaactgctagttttctgcatatcccacatgctgaagatattccgaacacagtcaccctcgggaacagggtcggcttcctcttgcgaccatataatttcttcgacgaggatccctcgatctttagccctggaagcgtttactttgagaagggccaggacgctggcctgtgtagcatcaatcccgtggcctgcctgcctgacctggccgcgtgtgtccccgacctgccgccattttcataccacggattctag

SEQ ID NO: 108000 - DNA, 2292 bp, Artificial Sequence
  Description of Artificial Sequence: Synthetic coding sequence
atgaaccaaaaaactatcctggttttgctgattctggccgtgataacgatctttgccttggtctgtgttcttctggtcggacgagggggcgacggaggcgagcctagccagttaccgcactgcccatccgtatccccatccgctcagccttggactcaccccggacagagccaactgttcgcagacctctcaagagaagagctcacggccgtgatgcgattcctcacccaacgattaggtccagggctggtcgacgctgcacaggctcgcccatcagacaattgcgtgttcagcgtcgagttgcagctcccacccaaagcagccgcactagcacatctggatcgaggttctccaccaccggcccgggaggcgcttgcaattgtgtttttcggacgccagcctcagccaaacgtctccgagttggtcgtgggcccattgccacatccatcttacatgagagatgttactgtggagcgccatgggggcccgcttccctaccaccgtcggcctgtgttgttccaggagtacctggacatcgatcagatgatattcaatagggagttgcctcaggccagtgggctgctccaccactgctgtttctataaacaccgggggagaaacctggtgactatgacgactgcaccaagagggctacagtcaggtgatagggcgacctggtttggtctttattacaatatttccggagccggcttctttctgcaccacgtgggtctggagcttctggttaaccacaaagctttggatcccgcccgttggactatacaaaaagtgttctaccagggcaggtactacgatagtttggctcagttagaagcccaattcgaggcaggattagtaaacgtcgtcctgattcctgataacggcaccggaggcagctggtcactcaagagccctgtaccccctgggccggcgccgcctcttcagttctaccctcagggacctcgcttctcagtccaggggagccgcgtcgcttcctctctgtggactttttctttcggactgggagccttcagtggccctaggatctttgatgtgcgctttcagggtgagcgccttgtctatgagatttcactccaggaggccttggccatttatggcggaaattctcctgcggccatgactactaggtatgtagatgggggattcgggatgggtaagtacaccactccgctgaccaggggtgttgattgtccttacctggccacttacgttgactggcatttcctattagaaagtcaggcccctaaaaccatccgggacgccttctgcgtgttcgagcagaaccagggtcttcccttacgccgacatcacagcgacctgtattcgcactatttcggagggctggccgaaactgtgctcgtcgtgcgttccatgtctactctgctaaactacgattatgtttgggataccgtcttccatcctagtggagctattgagattcggttttatgcaacaggctacatttctagcgctttcctctttggagctaccggaaaatacggcaatcaggtcagcgagcatacattaggaacagtgcatactcactctgctcattttaaggtggacctcgacgtggctggactcgagaattgggtgtgggccgaggacatggtgtttgttccaatggccgtaccttggagccccgagcatcagctacaacggctgcaggtcacccgcaaactgctggaaatggaagaacaagccgccttcctggtagggtccgctaccccacgctacctgtaccttgccagcaatcactcaaataagtggggacatcctcgtggttaccgcatacaaatgctgagtttcgccggtgagcctctcccccagaacagttccatggctcggggctttagctgggaacgctatcagctggctgtaactcaaagaaaggaggaagagccttcatcctcctccgtgttcaaccaaaacgacccatgggctccgactgtcgatttttccgattttataaacaatgagactattgcaggcaaagatctcgtcgcctgggttaccgcggggttcttacatataccacacgcggaggatatacccaatactgtgaccgtcgggaacggcgttggtttctttttgcgaccatacaatttttttgatgaggaccccagcttttacagtgcagactccatttactttcggggcgaccaggatgctggagcctgcgaggtaaacccattggcctgtctgccgcaggccgcagcctgcgcccctgacctacctgccttctcacacggaggctttagtcacaactag

SEQ ID NO: 108001 - DNA, 939 bp, Artificial Sequence
  Description of Artificial Sequence: Synthetic coding sequence
atggcgaacaacgatgcagtcctcaagagacttgagcagaagggcgcagaggcagaccagattattgaatatctgaagcagcaagtgtccctcctgaaggaaaaggccatccttcaagccacactgagggaggagaagaagctgagagtggaaaacgcaaaattgaaaaaagaaattgaggaactgaagcaggagctaatacaggcagagattcaaaatggagtgaagcagatcccgtttccttccggcactccactacatgccaacagtatggtctccgagaatgtcatccagagtactgccgtcacaacagttagctccggcacaaaggagcagataaaggggggaaccggcgacgaaaagaaggcaaaggaaaagatcgagaaaaaaggcgagaagaaggaaaaaaagcagcaatctattgccgggagtgccgattctaagcctatcgacgtgtcccggctggatcttcgaattggttgtattataacggccagaaaacatcctgacgccgacagtctgtatgttgaagaggttgacgttggggaaatagccccccgaaccgttgttagcggactcgtgaaccacgtgccattggagcaaatgcaaaatagaatggtgatactcttatgcaatctgaaaccagcaaagatgaggggcgtcctcagtcaagccatggtgatgtgcgcaagctccccagaaaagattgagatccttgcaccccccaacggctctgtcccaggggatcgtattactttcgatgcatttcctggagaacccgacaaggagctgaatcccaaaaagaagatttgggaacagatacagcctgacctccataccaatgatgagtgcgtcgccacgtacaagggcgtgcctttcgaggtgaagggcaaaggtgtgtgccgggcgcaaactatgtcaaattccgggatcaaatag

SEQ ID NO: 108002 - DNA, 1011 bp, Artificial Sequence
  Description of Artificial Sequence: Synthetic coding sequence
atgcttcccgcagtagctgtgtccgagccggttgtgcttagatttatgatcttttgcagattgctcgccaagatggcaaacaacgatgccgtactgaaaagactggaacaaaaaggtgcagaagccgatcagatcatcgagtaccttaagcagcaggttagcttactgaaagaaaaagctatcctgcaggccaccttgcgagaggagaaaaaactgcgggtggaaaatgcaaaattgaagaaagagatcgaggagctgaagcaggagctcatccaggctgaaattcagaacggcgttaaacagataccattccccagcggtactcctctccacgccaactccatggtgagtgagaacgtgatccagtccacagcagtcaccactgtgagtagcggcacaaaggagcagataaaaggaggtacaggcgacgaaaagaaagcaaaggaaaagatcgaaaagaagggggagaagaaggagaaaaagcagcaaagtatcgcgggtagtgccgattcgaagccaatcgacgtgtctcgcctagacttacgcatagggtgtattattaccgctcgcaagcatccggatgcagactctttatatgtggaagaggtcgacgttggtgaaatcgcaccacggactgtcgtatctggcctggtaaaccacgtgcccctggagcagatgcaaaaccggatggttatcttgctgtgtaacctcaagccagctaagatgcggggcgttttatcccaggccatggttatgtgtgcatcatcccctgagaaaattgaaatcctcgctcccccgaatggcagtgtccccggggaccgcattacttttgacgcttttcctggagagccagataaggagttgaaccctaagaaaaaaatctgggagcaaattcagccagacctccacacaaatgatgagtgtgtggctacatataaaggcgtgcccttcgaagtgaaaggtaagggcgtctgccgagctcagacgatgagtaattccggtataaagtag

SEQ ID NO: 108003 - DNA, 810 bp, Artificial Sequence
  Description of Artificial Sequence: Synthetic coding sequence
atggcgaacaacgacgcagtgctgaagaggttggaacagaaaggtgcagaggcagaccagataatagagtatttaaaacagcaggttagtctcctcaaggaaaaagctatactccaagctaccctccgagaggaaaaaaagctgcgtgtggagaacgccaaactaaagaaggagatcgaggagcttaaacaggaactgattcaggccgagatccagaacggagttaagcaaatccccttccccagtgggaccccactacatgccaactctatggtgtcagagaatgtcattcagagtaccgccgtgaccactgtgagctcaggaaccaaggaacagatcaagggcggtactggcgacgaaaagaaagcgaaggagaaaattgaaaaaaaaggggaaaagaaagaaaagaaacagcagagcattgcaccaagaacggtcgtttctggtctcgtgaatcatgtgcccctggagcagatgcagaatcggatggtgatactgctctgcaacctgaagcctgctaagatgcggggggtgctgtctcaggccatggttatgtgcgcaagtagccccgagaaaatcgagatcctagcccctcctaatggttcagttccgggcgaccgcatcactttcgatgcgtttccaggcgagccagacaaggagttgaaccccaagaagaaaatctgggaacaaatacagccagatcttcacactaatgatgagtgtgttgcaacttacaagggtgtgccttttgaagtgaagggaaagggggtctgtagagcccagacaatgtccaactctgggattaagtag

SEQ ID NO: 108004 - DNA, 939 bp, Artificial Sequence
  Description of Artificial Sequence: Synthetic coding sequence
atggccaataatgatgccgtgttaaaaagactggagcagaaaggcgctgaagccgatcagattatagagtatctcaagcagcaggtcagcctcctaaaagagaaggccattttacaggccactctgcgtgaagagaaaaagcttagagtcgaaaatgccaagctgaaaaaggagattgaggaactgaagcaagaactgatccaggccgaaattcagaatggcgtgaaacaaatcccatttccttccggcaccccgttgcacgccaacagtatggtttcggagaacgtgattcagagcacagccgtgacgactgtgtcatctgggactaaggaacagatcaagggcggaaccggggacgaaaagaaagcgaaagagaaaatcgaaaagaagggggaaaaaaaagagaaaaagcagcagtcgatagctggctcagctgattctaagcccatcgatgtaagccgactcgacctgcgtataggctgtataataaccgccagaaaacaccctgatgcagactccctatatgtcgaagaggtggacgtgggtgagatcgcgccccgtaccgtggtctctggactagtcaaccacgtgcctctggagcaaatgcaaaaccgaatggtgatactactgtgtaacctgaagccggccaagatgagaggcgtcttgtcacaagccatggtaatgtgcgcaagctctcccgagaaaattgagatcctggcccctcctaatggaagtgtgcccggagataggataacctttgacgcattccccggcgagcccgacaaagagttgaacccaaaaaagaaaatctgggaacagattcagcccgatttacatactaatgatgagtgcgtcgctacgtacaagggcgtgccatttgaagtgaagggcaaaggtgtctgtagggctcagaccatgtccaattcgggcattaaatag

SEQ ID NO: 108005 - DNA, 453 bp, Artificial Sequence
  Description of Artificial Sequence: Synthetic coding sequence
atggccaacaacgacgcggtgctaaagcggctcgagcaaaaaggagctgaagccgaccagatcattgaatatttaaagcagcaggtgagcctgcttaaggaaaaagctattttgcaggccacgctgcgagaagaaaagaaactcagagtcgaaaatgctaagctgaagaaagaaatcgaagagctgaagcaggaactgatccaggctgagatccagaacggggtaaagcagattccattcccatccgggacccccctgcacgctaattcaatggtgagcgagaatgtaatacaaagcactgctgtgaccacagtgtcatcaggcacaaaggaacagatcaagggagggactggcgacgagaagaaggccaaggagaagatagagaagaagggagagaaaaaagagaagaaacagcagagcatagcgggttctgcagattctaagcctatttag

SEQ ID NO: 108006 - DNA, 1227 bp, Artificial Sequence
  Description of Artificial Sequence: Synthetic coding sequence
atgacaagtaagggtccagaggaggagcacccttcagttaccttgttccggcagtacctacgaatacggactgtgcaacctaagccagactacggcgcggcagttgccttctttgaggaaaccgccaggcagcttggcctcgggtgtcagaaagtcgaggtcgcacccggctacgtggtaaccgtgctgacatggccgggtactaatccaaccttgtcatcgatcttactgaattcccacactgacgttgtaccagtttttaaggagcactggagccacgacccattcgaagccttcaaggatagtgagggctacatttacgcccgtggggcccaagacatgaaatgcgtgtcgattcagtatctcgaagctgttagacgtctgaaggtcgagggtcaccgctttccccggacaattcatatgacatttgtgcctgatgaagaggtggggggccatcagggtatggagctgttcgttcaacgacctgaattccacgcactgcgggccggattcgctctggacgagggcatcgctaatcccactgacgcctttactgtcttctattctgagagatccccctggtgggttcgggttaccagcaccgggagacctggacacgcaagtaggttcatggaggataccgcagccgagaaactgcacaaggtggtaaacagtattctggcttttcgggagaaagagtggcagaggctccaaagcaacccccatctgaaggaaggcagtgttacaagcgtaaacctgacgaaattagagggcggtgtggcctacaacgtgatcccggcaactatgagcgcctcctttgatttccgggttgctcccgacgtcgatttcaaggcttttgaagaacagcttcagtcctggtgtcaggcggccggggagggcgtgactctggagttcgcccagaaatggatgcaccctcaggtgacccctaccgacgactccaacccctggtgggctgccttcagtagagtctgtaaagacatgaatcttaccctcgaacccgagatcatgccggccgcgactgacaatcgttacataagggcagtgggcgtgcctgccttaggattctctcccatgaaccgaacaccagtcctgctgcatgatcacgatgagaggctgcatgaggccgtttttctgaggggagtggacatttatactagattgctgccagctcttgccagcgtgcccgctttaccgtcagatagctag

SEQ ID NO: 108007 - DNA, 1497 bp, Artificial Sequence
  Description of Artificial Sequence: Synthetic coding sequence
atgtggggctgtcaggctcccttaagtagattgcctgccagcggggaaacacctatgagccagtcttggctggtgagccctctagctacccggccatcctttactgcacggtgtagccatagcactcgccatacaggttggagatggtgctgtttcatggaacgtccactcacccttacccgggggagcagctgggcacattgcagttactgccaccggggagccaccggcccttggccccttacgtttcagctgactacacgatccgctatgacatccaagggcccagaagaggagcatccaagtgtaaccctatttaggcagtatttgcggattcggactgtacagcccaaaccggactacggcgccgccgtggccttctttgaggaaactgccagacaattgggcctagggtgccagaaggtggaggtagctcctggctatgtagtgacagtgttaacttggccaggaaccaaccccaccctcagcagtattcttttgaactcccacaccgacgtcgttcccgtattcaaagaacattggtctcacgatcctttcgaagcctttaaagattcagagggctatatttacgcgcgaggtgcccaagatatgaaatgcgtgtccattcaatacctcgaagcggtgcggcgactgaaagtggagggtcacagattcccgaggaccatccatatgacattcgtccccgacgaagaggtgggcgggcaccaaggcatggaactcttcgtacaacgcccagagttccacgcactcagagccggattcgctctggatgagggcatcgccaacccgactgacgcctttaccgtgttctactccgagaggtcaccctggtgggtaagggtaaccagcaccggaaggcccggccatgcttctcgattcatggaggacactgcagccgagaaattgcataaagtcgttaacagcatcctggcgttcagagagaaggaatggcagagactgcagagtaaccctcacctgaaggaaggcagtgtcacttctgtgaacttaactaagctggaaggtggcgtggcatacaacgtgatcccagcaacaatgtctgccagcttcgattttcgggttgctcccgacgtcgattttaaggcttttgaggaacaattacagagctggtgccaagccgcaggggagggggtgacgctagagtttgctcagaagtggatgcacccgcaggtgacaccaacagacgattccaacccctggtgggccgcgttctctcgagtatgtaaagacatgaacctcaccctggagccagagattatgcctgctgcaactgacaaccgatacatcagagcagtaggcgtgcccgctttaggcttttcccccatgaacagaacccctgtgctgcttcatgaccatgatgaaagactacatgaagctgttttcctgaggggcgtggacatttatacgagactgcttcctgccctggcttcggtgccggcccttccaagtgatagttag

SEQ ID NO: 108008 - DNA, 1122 bp, Artificial Sequence
  Description of Artificial Sequence: Synthetic coding sequence
atgacaagcaagggccccgaggaagagcatccatcggtcactctgttcaggcagtatttgcggatacgcaccgtgcaacctaagccagactacggcaccaaccctaccctctcctccattctccttaattctcacacggacgtcgttccagtgttcaaggagcattggtcacacgatccattcgaggcctttaaggatagcgagggctatatttacgcacgtggggctcaggacatgaagtgcgtgagtatccagtacctcgaggccgttcgccggctgaaggtcgaaggccatcgcttccctcgcacaattcatatgacatttgtccccgacgaagaggtgggaggtcatcaggggatggaactgttcgttcaacggccagagttccatgcattgagggcgggttttgcattagacgaaggcatcgcgaaccctactgacgcttttaccgtgttttattcagagcgatctccctggtgggtccgggtgaccagcacaggtaggccagggcacgcaagcagatttatggaggacacggcggccgagaagctccataaagtcgtgaattcaatccttgcctttagagagaaggagtggcaaagactgcaatctaacccgcatctgaaggaaggctcagtgacctccgtaaatctcaccaaactggagggcggagttgcctataatgtgatccccgcaactatgtcagctagtttcgacttccgtgttgccccagatgttgactttaaggcattcgaggagcaactgcagtcctggtgccaggcggcgggcgaaggggtcactctagagttcgcacaaaaatggatgcatccccaggtgacccccactgacgactctaatccctggtgggcagcattttccagagtctgcaaagatatgaatttgactctagaacctgagatcatgcctgcagccacagataacagatacatcagagcagtgggggtgccggctctcgggtttagccctatgaacaggacaccggtgttgctgcatgaccacgacgagcgacttcacgaggcagtgtttctgcggggggtcgacatctacacgaggttgctcccagctttagcttccgtccctgctctcccatctgactcatag

SEQ ID NO: 108009 - DNA, 1032 bp, Artificial Sequence
  Description of Artificial Sequence: Synthetic coding sequence
atgacatctaagggccccgaggaggagcatccaagtgtgaccctcttcagacagtacctgaggattcggaccgtacagcctaaacccgactacggtgccgccgtggctttttttgaagagacggcaagacagctcgggcttggatgtcagaaggtggaggtggcccccgggtacgtcgttaccgtattgacctggcccggcaccaacccgacactaagctctatcctgctcaacagccacaccgacgtggtcccggtcttcaaagaacactggagtcatgacccgttcgaggccttcaaggattcggaaggatacatatacgcccgcggggcacaagacatgaaatgcgttagtatacagtacctggaagcagtgcgtagactgaaagtcgagggtcaccggtttcccagaactatccacatgacatttgtacctgatgaagaggtggggggacaccagggaatggagctttttgtccagagaccagagtttcatgctctcagagcaggcttcgccctcgacgagggcattgccaacccgacagacgcttttaccgtgttttactccgaacggagtccatggtgggtgcgcgtaacgtctaccggacgcccaggacatgcttctcggttcatggaggatactgccgcagagaagctggcattcgaggagcagcttcaatcgtggtgccaggcagcaggcgaaggcgtgacattggaatttgcacagaaatggatgcatccccaggtaaccccaaccgatgactctaacccatggtgggccgcttttagccgggtctgcaaagatatgaacttgacactagagcccgagataatgcctgcggcaactgacaaccggtacatcagggctgtgggcgttcctgctctaggcttctcccctatgaataggacgcccgtcctgcttcatgatcatgatgaacgactccacgaggccgtgtttctgcgcggcgtggacatctacacacgcctgctgcccgcccttgccagcgttccagcactgccttcagactcttag

SEQ ID NO: 108010 - DNA, 1011 bp, Artificial Sequence
  Description of Artificial Sequence: Synthetic coding sequence
atgacttctaaagggcccgaggaggaacatccatctgtcactctgtttcgccagtatctgagaatcagaacggttcagccaaagcccgactacggcgctgctgtcgccttcttcgaggaaactgccaggcaactgggactgggttgtcagaaggttgaggtggctcctggatatgtggtgacagtcctgacttggccagggactaacccaactctctcttccatcctgctcaactcgcacaccgacgtggttcccgtcttcaaagagcactggagtcatgacccgtttgaggccttcaaggactcagagggaatagccaacccaacggatgcttttacagtcttttactccgagcggtccccatggtgggtacgtgtgacgtctactggccgcccagggcacgcttcaaggttcatggaggacaccgcggctgaaaaactccacaaagttgtcaacagcatattggcttttcgagagaaggaatggcaacgcctgcagtcaaacccacacttgaaggaaggatccgtgacttccgtgaacctgactaaacttgaagggggcgtggcttacaacgtaatcccagcaacaatgtcggcctcgttcgacttccgagtggctcccgacgtcgatttcaaagcgtttgaggagcagctccagtcttggtgtcaggccgccggggaaggcgtgactttggagtttgcacagaaatggatgcacccacaggtgactccaactgacgatagtaacccctggtgggccgccttttcacgcgtctgcaaggacatgaacttgaccctggaacccgagattatgccagcggccaccgacaacagatatataagagcagtgggcgtgcccgccctgggatttagccccatgaaccggacccccgtcctactccatgatcacgatgagcggctgcatgaagcggtgttcttacggggcgtcgatatctacaccaggttgctgccagctctggccagcgtgcctgcacttccatctgacagttag

SEQ ID NO: 108011 - DNA, 1278 bp, Artificial Sequence
  Description of Artificial Sequence: Synthetic coding sequence
atgaactatgcccgattcatcactgcggcctccgctgctagaaatccgagtccaatccgaacaatgacagacattctgagcagaggccccaagtctatgatttcactcgcgggcgggctgccaaacccaaacatgttcccctttaaaaccgcggtaattactgtcgagaacgggaaaaccattcagtttggagaagagatgatgaaacgcgctttgcaatattcacctagcgccgggatccctgaactattaagttggcttaaacagctccagataaaactgcataatccccctaccatacactaccctccgagtcagggacagatggacctctgtgttacaagcggctcccagcagggactctgtaaggtatttgaaatgattatcaatcctggcgataacgtgctcctggatgagccggcatactctgggaccctacagtcgctacaccccctgggctgcaatattatcaacgtagcatctgatgagtctggcatcgtacccgacagcttgagggatatcttgtccagatggaagcccgaggacgcgaagaacccacagaagaacacacccaagtttctgtacacggtcccaaatgggaacaatcccactgggaattccttaacaagcgaacgcaaaaaggagatctacgaactggccaggaaatacgactttctgatcattgaggatgacccatactacttcctgcaatttaataagttcagggtgcctaccttcctgagtatggacgtggatggaagagtcatcagagccgatagtttttctaagatcatcagctccggactgcgaatcggctttctgacaggtcccaagccattaattgaaagagtgattttacacatacaagtttcaactcttcatccctctacatttaaccagcttatgattagccagctcttacacgagtggggagaggagggcttcatggcccatgtggaccgcgttatcgacttctattccaaccagaaagatgcgattcttgcagccgccgataagtggctgaccggactggccgaatggcacgtacccgccgcagggatgttcctgtggattaaggtgaaaggcataaacgacgtgaaggagctcatcgaggagaaggctgttaagatgggagttctgatgctcccaggcaacgcattttacgtcgatagctctgctccttctccctacctgagggccagcttctcaagtgcctcccccgaacagatggatgtggctttccaggtccttgcccagctgatcaaggagtcgttgtag

SEQ ID NO: 108012 - DNA, 1278 bp, Artificial Sequence
  Description of Artificial Sequence: Synthetic coding sequence
atgaactacgctcgttttatcacagctgctagcgctgctcgaaatccatccccgattagaactatgacagacatacttagcagggggccaaaatccatgatcagcctggccggagggttgcccaaccccaatatgttcccctttaaaacggccgtgataactgttgaaaacggaaaaaccatacagtttggtgaagagatgatgaaaagagcactacaatattcacccagcgccgggatccctgaactgctcagctggctaaagcaactgcagatcaaactacacaatccccctaccattcattaccctcctagccaaggtcagatggatttgtgtgtgacatccgggtcacagcaaggtctctgtaaagtctttgagatgatcataaacccaggtgacaatgtgctcttggacgagcccgcttatagcgggactctgcaaagcctgcatccacttgggtgcaatattatcaatgtagcctcagacgaaagcggtattgtccctgatagtctcagagatatcttgagcagatggaagcctgaagacgcgaaaaacccgcaaaaaaacactcccaaattcctgtacacggtccccaatgggaacaatccaaccggcaacagcttgacctcagaacggaaaaaggagatttatgagctagcccggaagtacgatttcctaattattgaagacgacccctattattttctgcagttcaacaaatttagggtgcctacatttctctcaatggacgtcgatggcagagtaatacgggcggactcctttagcaaaattatctctagcggcctgaggatcgggttcctgactgggccaaagccacttattgagagagtcatccttcacatacaggtgtcaactctgcaccctagcaccttcaaccaactaatgatctcccagctgctccatgagtggggggaagagggatttatggcgcacgtggatcgggtgattgatttctattccaatcaaaaggacgccattcttgctgctgctgataagtggctgactggcctcgccgaatggcatgtcccagcggccggaatgttcctgtggattaaggtcaagggaattaacgatgttaaggagctcattgaagagaaggccgtgaaaatgggggtgctgatgctgcctggcaacgccttctatgtggattcctcagcaccgagcccatacctccgtgcctctttctccagcgcaagtcccgaacagatggacgtggcattccaggttcttgcccagttaattaaagagagcttgtag

SEQ ID NO: 108013 - DNA, 543 bp, Artificial Sequence
  Description of Artificial Sequence: Synthetic coding sequence
atgaattacgctaggtttatcacagcagctagtgcagctcggaatccttcccctattcgtactatgacagacatcctgtcaaggggtcccaagtctatgatttcgttggcagggggcttaccgaatcctaacatgtttcctttcaaaaccgctgttataaccgtcgaaaacgggaagacaatccagtttggtgaagagatgatgaaacgggctcttcagtatagccctagcgcaggaatccctgaacttctaagctggctcaagcagttgcaaattaagctccataacccaccaactatccattatccgccaagtcagggccagatggacttatgcgtaacaagcggatcgcagcaaggtctgtgcaaggtgtttgaaatgattatcaatcccggtgataatgtccttctagacgaacccgcctactcaggcacactccagtcccttcaccctctcgggtgcaacattatcaacgtggcctcagatgaatcgggaattgtgcctgatagcctgcgcgatatcctctcccgttggaagccgtag

SEQ ID NO: 108014 - DNA, 630 bp, Artificial Sequence
  Description of Artificial Sequence: Synthetic coding sequence
atgaactacgctcggttcattacagcggcctctgctgcgagaaacccgtcccctattcgcaccatgacagacattctctcgcggggacccaaaagtatgatctcactggccggcggactgcccaaccccaacatgtttccgttcaaaactgctgtgatcactgtggagaacggcaagacgatccagttcggcgaggagatgatgaagcgcgccttacagtacagtcctagcgccggaattccagagttgctcagttggttgaaacagctgcagatcaaactgcacaatcctcccaccattcattatcccccatcgcaaggacagatggacttatgcgtgacgagcggatcacagcaggggctctgcaaagttttcgagatgatcattaatccaggagataacgttcttctggatgagccagcctattctggcacgctgcagtctttacatcccctcgggtgcaacattatcaacgttgccagcgatgaatctggaatcgtccccgattctctgagagatattctctcacgatggaagccggaggatgcaaaaaacccgcagaaaaatacgcctaaattcctctatacagtgcctaacgggaacaatcctactggcaattccttgacttag

SEQ ID NO: 108015 - DNA, 1290 bp, Artificial Sequence
  Description of Artificial Sequence: Synthetic coding sequence
atgaactatgccagattcataacagcagcaagtgcagcacggaacccatcacctataaggacgatgagcgaaaaacgcgcagacattctgagccgagggcccaagagcatgatttcactggctggagggctccccaatcccaacatgtttccttttaaaacggccgtgatcaccgtggagaacggcaagacgattcagttcggtgaagagatgatgaagcgtgcactgcaatacagcccaagtgcgggaattcctgaactactgagctggcttaaacagcttcagataaagctacataatccccccactatccactaccccccatcccagggacagatggacctatgtgtgactagtggatcacaacaaggcttatgtaaagtgtttgaaatgatcatcaacccaggtgataacgtattacttgatgaaccagcttattccggcacacttcagtcacttcatccactgggctgtaatattatcaacgtcgcttccgatgagagcggcatcgtgcccgattccctgcgcgacattctctctcgctggaaacctgaggacgcaaaaaacccacagaagaatactcctaagtttctctacacagtgcccaatggtaataatccaacaggcaactctttgacctcggagcgcaagaaggaaatctacgagctggctcgcaagtacgactttttaatcattgaagacgatccttactactttctgcaattcaacaaatttcgcgtccccacattcttgtcaatggatgttgatggacgcgtgattcgagctgactcctttagcaagattatttcctcaggcctgcggattggattcctgaccggccctaaaccgctgatcgagcgggtgatactccacattcaggtgtctacactccatccttccacatttaaccagctcatgataagccagcttctccatgagtggggggaggaggggtttatggcccatgtggatcgtgtgatagacttctacagcaaccagaaagacgcaattctcgccgcagcagacaagtggctgaccggccttgccgaatggcatgtccctgccgcagggatgtttctgtggataaaagttaagggtatcaacgatgtgaaggaactgatcgaagagaaagctgtgaagatgggcgttctgatgcttcccggcaacgccttttatgtggactcatccgcgcctagcccatatctgcgggcctccttctcgtctgccagtcccgagcagatggacgtagcttttcaggtgctcgcccagctaatcaaagaaagtctatag

SEQ ID NO: 108016 - DNA, 1278 bp, Artificial Sequence
  Description of Artificial Sequence: Synthetic coding sequence
atgaactatgcgcgatttatcaccgcagctagcgccgctcggaaccccagtcctattcggaccatgacggatattctcagtcgaggcccaaagtcaatgatatcactagccggtggattaccgaaccctaatatgtttcctttcaagacagctgtgatcaccgtagagaatggcaagaccattcaattcggcgaagagatgatgaagcgggccctacagtattcgccctcggctggtatccccgagctgctctcttggctcaaacagctgcagatcaaactgcataatccgccaaccattcattacccacctagtcagggccagatggacctgtgtgtcactagtgggtctcaacaaggcctctgtaaggtcttcgagatgattattaatcctggggataatgtgctcctcgacgaacccgcctacagcggaacccttcagagcttacatccactcgggtgtaacattatcaatgtcgccagcgacgaaagtggtattgttcctgactccctgagagatatcctgagcagatggaagccggaggacgccaagaatcctcagaagaacacaccaaagtttctgtatacagtccccaacggtaacaacccaaccggcaactcattgacatcagagagaaagaaggaaatttacgaactggccagaaaatatgacttcctgataattgaggatgacccatattatttcctacagttcaataagttcagagttccaacttttttgtctatggacgtggatgggagagtgatcagggctgatagttttagcaaaattatctcatccggactgcgcatagggttcctcaccgggccgaaacccctaattgaacgggttattctgcatatccaggtgtctacactgcacccttctacttttaatcagctgatgatttcacaattgctgcatgagtggggcgaagagggattcatggcccacgtggaccgagtgatcgatttctattctaaccagaaggacgctattctggccgcggctgacaagtggctgaccggactggcagagtggcacgtcccagcggccggaatgtttctgtggattaaagtcaaggggattaacgacgtgaaggagctgatcgaggagaaagccgtcaaaatgggggttctgatgctccccggcaacgcattctatgtagacagctccgcccctagcccttatctcagggcctcttttagttctgcttctcccgagcaaatggacgtggctttccaggtcctggcgcagctgattaaggagtccctgtag

SEQ ID NO: 108017 - DNA, 621 bp, Artificial Sequence
  Description of Artificial Sequence: Synthetic coding sequence
atggctcctagccacctgagtgtgagagagatgagagaggacgagaagcccctggtgctggagatgctgaaggctggtgttaaggacacagagaatagggtcgcgctccatgccctgactaggcctcccgctctactgctgctggccgccgcctcgtcaggtctgcgcttcgtgttggcatccttcgcacttgctctgcttttgccggtgtttcttgcggtggctgccgttaagcttgggctgcgtgctcgctggggcagcctgcccccacccggcgggctcggtgggccgtgggttgcagttcggggcagcggagacgtgtgcggagtcctggcacttgccccagggaccaacgccggcgacggggctagagtgacccggctgtccgtcagcagatggcatagaagacgcggagtgggtcgaagactgttggcttttgccgaagcacgagcccgcgcttgggcggggggcatgggcgagccccgagctcggctggtggttccagtggctgtagcagcctggggtgttggcggaatgctggaagggtgtggataccaagccgaaggcggatggggctgtctgggttataccctcgtgcgtgaatttagtaaggatctgtag

SEQ ID NO: 108018 - DNA, 1842 bp, Artificial Sequence
  Description of Artificial Sequence: Synthetic coding sequence
atggtgtccaaggatgccagcgtcaaggaatatatattcaaagagttacagaagtatttaccttcccacgcagttcctgatgagctcgttcttattgattccctgcctttcacaagtcatgggaagatcgacgtatctgaactaaacaagatttatctcaactacattaacctaaagtcagaaaacaagctcagcggaaaggaggatctttgggagaaactgcagtatctgtggaaatctaccctgaatctgccagaagacctgctccgagtgcccgatgagagcctttttttgaactctggaggggactctcttaaaagtatcaggctcttgtccgaaattgagaagctcgtaggcacttcagtccccggacttttggaaatcattctatcgtcatcaattctagaaatttacaatcacattctccagacagtagtgcccgatgaggacgtcacctttcgcaaaagttgcgctacaaagaggaagctgtccgacataaatcaggaggaagctagtgggacatctctgcatcaaaaggctattatgacgttcacatgtcacaacgaaatcaacgcattcgtcgttctcagtcggggctcccaaatcctctctctcaatagtacgaggttcttgaccaagctggggcattgtagctcggcctgcccttcagacagtgtgtctcagacaaacatccagaacttgaaagggctgaattcccctgtccttataggtaaaagcaaggacccctcatgcgtcgctaaagttagcgaggaggggaagcctgccattggcacacaaaaaatggagcttcacgtgcggtggcgcagtgatactgggaaatgcgtggacgcttcccccctggtcgttatcccgacctttgataagagttccactacagtgtatattgggagccatagtcaccgaatgaaggccgttgatttctattccggcaaagtcaaatgggagcagatacttggggaccgcatcgaaagttccgcttgtgtgtccaaatgtggaaacttcatcgtggtcggctgttataatggcctggtgtacgtgctgaagtcgaactcaggagagaaatactggatgtttactaccgaagacgctgtgaagagcagcgccacaatggacccaacaactgggctgatttatataggcagtcacgatcagcacgcatacgccctggatatctatcgcaagaagtgcgtgtggaaatcaaaatgcggtggcacagtgttctcatctccctgcctgaatctgatccctcatcatctatacttcgccactctcggcggcttgctgttagccgttaaccccgctacgggcaacgtcatttggaagcacagttgcggtaagccgctcttttcctctcctcagtgctgctctcagtatatctgcattggttgcgtggatggaaacttactgtgttttactcactttggtgagcaggtgtggcagttttccactagcgggcccattttttcatcaccctgtacatcaccctctgaacagaaaatatttttcggatctcatgattgtttcatttattgctgcaacatgaagggccacctccagtggaagttcgagaccacaagccgtgtatacgctacaccttttgctttccataactataacgggtccaatgagatgctgctggccgccgcctcaaccgatggaaaggtgtggatcctggagagtcagagcggtcagctacaaagcgtgtatgagttgcccggagaagttttcagcagccccgttgtgctggagtctatgctgattatcgggtgtcgcgacaattacgtctattgcctcgacttgctcggaggcaatcagaagtag

SEQ ID NO: 108019 - DNA, 2574 bp, Artificial Sequence
  Description of Artificial Sequence: Synthetic coding sequence
atgactctccaggaactggtgcacaaggccgcgtcgtgttacatggatcgggtggccgtgtgcttcgatgagtgcaacaatcagttaccagtttactatacatataaaactgttgtgaatgcagccagtgaactctccaacttcttactgctgcactgcgatttccaagggatccgtgagattgggctatattgccagccaggcatcgacctcccatcctggatcttgggcattctgcaggtgcctgctgcatatgtgccaattgaacccgattcacccccatcactttcaactcactttatgaagaagtgtaatttgaaatatatacttgttgaaaagaagcagattaacaaatttaagtcttttcacgagaccctattaaactacgataccttcacagtggagcacaacgatctcgtgctgtttaggcttcactggaagaatacagaagtcaatctgatgctgaatgatgggaaggagaagtatgagaaagagaaaattaaaagcatctcctcagaacacgtcaatgaggaaaaggcagaagaacacatggatctgcggctgaaacattgcttagcctacgtgctgcacacaagcggcactacgggaattccaaagatcgtgcgtgtgccacacaaatgcatcgtaccaaatattcaacacttcagagtgctctttgacatcacccaggaagacgttttgttcttggcttctccattgactttcgatccttctgtcgttgaaattttcctggccctttcttccggcgcttcccttttgatcgtaccaacttccgtgaagttgcttccgtccaaactcgcatcagtcctgttttcccatcaccgggtgaccgtcctgcaggccacacccaccctgcttcgccggtttggctcccagctgatcaaatcaacagttctgtctgcaacgacaagcttacgcgtcttggccctggggggggaagcgtttccctccctgaccgtgctaagaagttggcgtggcgagggaaataagacccaaatcttcaacgtctacggaattaccgaagtgtctagctgggccaccatctataggataccagagaagacactaaatagcacactgaaatgcgaactgcccgtgcagcttgggtttcctctgctgggaacagtggtggaagttagggacactaatggattcacaatccaggagggctcagggcaggtgttcctgggtggcaggaaccgcgtttgttttcttgacgacgaggtcacggtgccgcttggtactatgagagccactggcgattttgtgaccgtgaaagatggagagatttttttcctggggagaaaagactcgcagattaaacgacacggcaaaaggttgaacatcgagctggtccaacaagtggctgaggagctccagcaggtggagagctgtgcggtcacatggtacaaccaggaaaagctgatcctctttatggtgagtaaagacgctagtgtgaaagagtatatattcaaagaattgcaaaagtaccttcccagtcatgctgtacccgatgaacttgtgctgattgactccctgccatttacgtctcacggcaagattgacgtgagcgaactaaataaaatttatttgaattacataaacctcaagtcagagaataagctgtcagggaaagaggacctctgggagaagctgcaatacttatggaagtcaacattaaacctgccagaggatttactgcgtgtgcccgacgagagcctgttcttgaactctggtggcgacagtctgaagagcattcggctgctctctgaaatagagaaactggttggaactagcgtgcctggcttgcttgaaatcatcctgagttccagtatcctggaaatttacaaccatatcttgcagacagtggtccctgatgaggacgtaaccttccggaaatcctgcgctaccaagagaaagctgagcgacataaatcaggaggaagctagcggaaccagcctgcatcagaaagcaattatgacttttacgtgccataatgaaattaatgccttcgtggtgctgagcaggggtagtcagatcctttctctaaactccacaaggtttttaactaagctaggacattgcagttcagcgtgtccatcagattcagtttctcaaactaacattcaaaacttaaaaggtttgaacagcccagttttgattgggaagtcaaaggatccatcatgcgtggctaaggtctctgaagagggaaagccggccattggaactcagaagatggaacttcatgtccgctggaggtccgataccggcaagtgtgtggatgcgagtcccctcgtagtgatacctacttttgataagtctagtaccacggtatatatagggtctcattctcacagaatgaaagccgtcgacttttattctggcaaagtaaagtgggagcaaattctgggtgataggatcgagagctccgcctgcgtgtcgaagtgtgggaactttatcgtggtaggcctcgcagtgctctaccaatggacaaacttattcatcccggtgtatctgactataagagcaaagaacatcttctggtttccttag

SEQ ID NO: 108020 - DNA, 2526 bp, Artificial Sequence
  Description of Artificial Sequence: Synthetic coding sequence
atgacactacaggagcttgtgcataaggctgcaagctgctacatggatcgtgtcgctgtgtgttttgacgagtgtaacaaccagctgcctgtatattatacatacaaaacagtggtgaatgctgctagtgagctgtccaacttcctgctacttcattgcgatttccagggtattcgagagatcgggctgtactgtcagccaggaatcgatttgccatcctggattttggggatattgcaagttcctgctgcgtacgtgccgatcgagccggactctcctccgagcctgagcacccacttcatgaaaaagtgtaatctcaagtacattctggtggagaaaaagcaaataaacaaattcaagtcctttcacgaaaccctgcttaactatgacacattcacagtagagcacaatgatctcgttctgtttaggctccactggaagaacactgaggtcaatctaatgcttaatgacggcaaagagaagtacgagaaggaaaaaattaagtcgatctcctctgaacatgtgaacgaggagaaggcggaagagcacatggatctgcggctcaaacattgcctggcttacgttctgcacaccagcggaaccacagggattcccaagatcgtgagagtcccacacaaatgtatcgtccccaacattcagcactttagagtacttttcgacattacacaggaagatgttctgtttctagcaagtccccttacctttgacccctccgtggtggagatctttctcgccctcagcagtggcgctagtttgttgatcgtgccaacgtctgtgaaacttttacccagtaaactagcctctgtgttgttttcacaccatcgtgtgacagtgctccaggccacaccgactttgctcaggcggtttggatcacagttaattaaaagcacagtgctgagtgctaccaccagcctccgcgtgttggcgctgggaggggaggcatttcctagtctcacagtgctccggtcctggcgtggagagggcaataagacgcagatttttaacgtttatggcatcacagaggtttcttcctgggccaccatttacaggatccccgaaaaaaccctgaatagcactttgaagtgtgagcttccagtccaactaggcttcccactgttgggaacggtcgtggaggttagagatacaaacgggttcacaattcaagaggggagcggacaggtgttcctgggcgggcggaatagagtctgtttcttggatgacgaggttaccgtaccattaggcactatgcgggccacaggggatttcgtgacggtaaaggacggggaaatcttttttctcggaaggaaagattcacaaattaaacggcatggcaaaagactaaacatcgagcttgttcagcaagttgccgaagagctgcagcaggtggaaagctgcgctgtgacatggtacaaccaggagaaacttatactttttatggtgagcaaagacgctagcgtcaaagagtacatcttcaaagagttacagaaatacctgccgtcccacgctgttcctgatgaattggtgttgatagattctctgcctttcacctcacacggcaaaatcgatgtatctgagctgaataaaatatatttaaattacatcaatctgaaatctgagaacaaattgtcgggcaaggaagacctttgggagaagctgcagtacctgtggaaatccactctcaacctgcccgaggatctgctgcgtgttcctgacgaatccctgttcctcaattccggaggcgacagcttgaagtccatcagactcctgagcgagattgaaaagctcgtaggcacgtcggttcccggcctcctggaaataatcttgtcttccagcatcctcgaaatttataaccatatcttgcagaccgtcgtgcccgacgaggatgtgacttttcgcaaatcttgcgccaccaaacggaaactgagtgacatcaatcaggaggaagcctctgggaccagcctgcatcagaaagctatcatgaccttcacatgccacaatgaaatcaatgcttttgttgtactgagccgggggagtcagatcctgtctctgaattcaacccgcttcctgactaagttagggcattgcagttcggcttgtcccagcgactccgtcagtcagacaaacattcaaaacttaaagggactgaattcacctgttcttatagggaagtcaaaagaccctagctgcgttgccaaagtgtccgaagaaggaaagcccgccatcggaacgcagaaaatggaactgcatgtgagatggcggtccgataccggtaaatgtgtagatgcatcaccattggttgtgattccaacgtttgataaaagctctacaactgtgtatatagggtcccattcccaccgaatgaaagctgttgatttctatagtggcaaagtgaaatgggaacagattttaggcgaccgcattgaatcaagcgcatgtgttagcaaatgtgggaacttcatcgtggtcgggaaattcctgaacttgcggtttgtggaattaaattag

SEQ ID NO: 108021 - DNA, 2997 bp, Artificial Sequence
  Description of Artificial Sequence: Synthetic coding sequence
atgaagaagtgcaacctcaaatacattttagtggagaaaaaacagataaacaaattcaaatcattccatgaaacacttctgaattacgacacgtttaccgtggagcataatgacttggtcctcttcaggcttcactggaaaaacaccgaagtgaatcttatgctgaatgacggaaaggagaagtatgaaaaagagaagattaagagcatttcaagcgagcacgtgaacgaagagaaagccgaagaacacatggatctacgattgaagcactgcctcgcatatgtgctccatacaagtggcaccactggcattccgaaaatagtgcgagtaccccacaagtgtatcgtgccgaatattcagcacttccgcgtgctcttcgatattactcaggaggacgtgctctttctggctagccccctgacttttgatcctagcgttgtggagatttttctggccctcagctccggcgccagtctgcttatagtaccgacatcggtgaaactactgccctcaaagttggcctcagtcctgtttagtcaccaccgggtcactgtgctgcaggccactcccaccttgctgagaagattcgggagtcagttaattaaatcgactgtcctctcggctaccacctcactccgggtacttgccctagggggcgaagccttcccaagccttaccgttctgaggtcctggaggggggaggggaataaaacacagatcttcaatgtttacggaattacagaggtctcatcctgggcgactatatacaggattcctgagaaaacactcaacagtacccttaagtgcgagctcccggtgcagttagggttccccctcctgggtaccgttgtggaagtgagagacactaatgggtttacaatccaagaaggatcagggcaggtgtttttgggggggagaaatcgggtatgtttccttgacgacgaggtcactgtgccccttgggacaatgagggccaccggggatttcgtgaccgtgaaagacggggagatattctttctcggtagaaaggatagccagatcaaacgtcatggcaagaggctaaatattgaactcgtacagcaagttgccgaggagcttcagcaggtggaaagctgtgccgtgacatggtacaatcaggaaaaacttattctgttcatggtctccaaagatgccagtgtcaaagaatatatcttcaaggagcttcagaagtacctgccgtctcatgcagtcccagatgagcttgtgctgattgactcactgcctttcaccagccacggcaaaattgatgtttctgagctgaacaagatctatctgaactacatcaatctcaagtcagaaaataaactgagcggtaaagaggatttgtgggagaaactgcagtacttgtggaagagcacgttgaatctcccagaggacctgctccgcgttccagatgagtctctgtttctgaactctggcggagattcgcttaaatctataaggttgcttagcgagattgaaaagctggtgggcacaagcgtccccggactgcttgagattattttgtccagctctatcctggaaatctataatcatatattgcagacagtcgtccccgatgaagacgtcacatttcggaaatcatgtgccacaaaacgcaagctctcagatataaatcaggaggaggcctccgggacaagcctccaccagaaggccattatgacttttacctgtcacaacgaaatcaacgcattcgtggtgctgtctcgtggaagccaaatcctgtcactaaactcaaccaggttcctcacaaaattaggccattgtagttccgcttgtccctcggattctgtttcccagaccaatattcagaatctcaaggggttgaattcgcctgtgcttataggcaagtcaaaggatccctcatgtgtagccaaggtctcggaagagggaaagcctgccattggtactcaaaagatggagctgcacgttcgctggagaagcgatacgggaaaatgtgtggacgcatcccccctcgtggttatacccacttttgataagagcagtactactgtctatataggctctcacagtcacaggatgaaggcggtggatttctacagcggcaaggtgaagtgggaacagatcctgggcgaccggatcgagtcaagtgcctgcgtctcaaaatgcggaaacttcatcgtggtgggctgctacaacgggcttgtttacgtgctgaagagcaactctggcgagaagtactggatgttcactactgaggacgccgttaaatccagcgctacaatggaccccaccaccgggcttatttatattgggagccacgaccaacacgcttacgccctggacatctataggaaaaagtgtgtgtggaagtctaaatgtggaggcacggttttctctagcccatgcctaaatctgataccccaccacctatattttgcaacacttggcggactgctactggccgtcaatccagcaactggaaatgtcatctggaagcactcatgtggaaaaccgttgttctccagccctcagtgctgctcacaatatatttgtatcggctgcgtggatggcaacctgctgtgcttcacccattttggtgagcaggtctggcagttctccaccagtggccccatcttttctagcccctgtacctccccgagcgagcaaaagatcttcttcggctctcatgactgctttatctattgctgtaatatgaaaggccacttgcagtggaaattcgagaccacgtcgagagtgtatgccacgccatttgcttttcacaactataacggctctaacgaaatgctgctcgcagcggcaagcacggacggcaaagtgtggatcctggaatctcaaagtgggcagctgcagagcgtctacgaattgccaggagaagtcttcagttcacccgttgtgttggagtcgatgctaatcatcggctgccgcgataattatgtgtactgcctggacctgctagggggcaatcagaaatag

SEQ ID NO: 108022 - DNA, 2781 bp, Artificial Sequence
  Description of Artificial Sequence: Synthetic coding sequence
atgctccaggtccaccgtactggattggggcgtttgggtgtgtcactgagtaaagggctgcatcacaaagccgtcttagctgtgcggcgggaagacgtgaatgcatgggagcggcgggctccgctcgctccaaagcacatcaagggcatcaccaatctgggctataaggtactcatccagccaagcaatcgccgcgctattcatgacaaagactacgtaaaagctggcggcatattgcaggaggatatcagcgaggcctgcctgattctgggggtcaagcggccgcctgaagaaaaacttatgtctcgaaagacgtatgctttttttagtcacactattaaggcacaggaagcaaacatgggactgctcgacgagattttgaagcaggagattagactcattgactacgagaaaatggtggatcataggggcgtccgagttgttgcttttgggcagtgggccggagtagctggtatgataaacatcttgcacggaatgggtcttcgtcttttagccctgggtcaccacactcctttcatgcatatcggcatggcccataactatcggaactcatctcaggctgtccaggcagtgcgcgatgccggatatgagatctctcttggcctcatgcccaagtctatcgggccgctgactttcgtgtttacgggcacaggaaacgtgtcaaagggagctcaggcaatttttaatgagctgccatgcgaatatgtggaaccacatgagctgaaagaagtctcccagactggcgacctgagaaaggtgtatggtacagtgcttagccgtcatcatcacttggttaggaagacggacgcagtgtatgaccccgctgaatacgacaaacacccggagaggtatatcagcagatttaatacagacattgctccgtacactacttgtttgattaacggtatatactgggaacagaacacacccagactccttactagacaggatgctcagagcttgctggcccccggcaagttctctcctgccggtgtggagggatgtcccgcactgccgcacaagctggtcgctatttgcgacatttcggccgacactgggggcagcattgaattcatgactgagtgcactaccatcgagcaccccttttgtatgtacgatgcggaccagcatattatccatgacagcgtggaaggaagtggtatcctgatgtgtagcatcgataatctgccagcacaactgccgatcgaggctaccgagtgcttcggagatatgctgtatccgtacgtagaggagatgatcttgtccgacgccacccaacccctggagtctcagaacttttcccctgttgtgcgcgacgccgttattacgtccaacgggacgttgccagacaaatacaaatatatccagactcttagggagagccgggaaagggcccagagtttatccatggggaccagaagaaaggtcttggttttaggctcagggtacatatctgagcccgtgttggagtatctgtcacgggatggtaacatagagatcacagtaggctccgacatgaagaatcaaatcgaacagcttggtaaaaaatataatatcaaccccgtgtcaatggacatctgcaaacaggaggaaaaactgggttttttggtcgccaaacaagatttggtcatatctttgctgccctacgtgctgcacccgcttgtagcaaaggcctgcatcacaaacaaagttaatatggtgaccgccagctacatcactccagcgctaaaggaacttgagaagagcgttgaagatgcaggcattacgataatcggcgaattggggctagatcctggactcgatcatatgctcgccatggagactatagacaaggctaaggaagttggggccacaattgaaagttatatttcgtactgtggtggcctgccggcgccagagcatagtaataatcctttaagatataagtttagctggtctcccgtaggcgtgctgatgaacgtgatgcaatccgccacatacctacttgatgggaaggtcgtgaacgtggccgggggcatctccttcctcgatgcagtgacatctatggattttttccccggcctgaacttagaggggtaccccaaccgggacagtactaagtacgccgaaatctatgggatttccagcgcccacaccctgctcaggggtaccctcagatacaagggctatatgaaggcactgaacggttttgttaaacttggccttataaaccgtgaagccctgccggccttccgccctgaggctaatcctttgacctggaaacagctgctttgcgatctggtcggcataagccccagttcggagcatgacgtcctgaaggaggctgtcctgaaaaagctgggtggcgataacacgcaactcgaagccgccgagtggctcggcctgctgggagatgagcaggtcccacaagccgagtctatcctcgatgccctcagtaagcatctggtgatgaagctgagctatgggccagaggagaaggatatgattgtgatgagagacagtttcgggattaggcatccatccgggcaccttgagcataagactatcgacttagtcgcttacggagatattaacgggttctcagcaatggccaaaactgttggtctgcctacggcaatggcagccaagatgctgctggacggagagattggcgccaaagggctgatggggccctttagcaaagagatttatggcccaatcctggagcgtatcaaagctgagggaattatatacactacccagagcactatcaaaccctag

SEQ ID NO: 108023 - DNA, 2781 bp, Artificial Sequence
  Description of Artificial Sequence: Synthetic coding sequence
atgcttcaggtccaccgtactggactgggtcggctgggcgtctcactgagtaaggggttgcaccacaaagcagtgttggctgttcgcagagaggatgtcaatgcctgggaaaggcgcgctcctctggcgcctaagcatataaaggggattacaaacttgggttacaaagtactaattcaaccaagcaacagacgggcaattcacgacaaggactacgtcaaggccggtggcatcctgcaggaagatatctccgaggcttgcctgatcctaggtgtgaaacggcctccggaggagaaactgatgagcagaaaaacatatgcattctttagccacaccattaaggcgcaggaagcgaatatggggcttctcgacgaaatcctgaaacaggaaattcggctgatagattatgagaaaatggtcgaccataggggtgtgagggtggtggcctttggtcagtgggccggcgtggctggtatgattaatattctgcatggcatgggcttgcggctgctggccctgggacatcatacacctttcatgcatatcggaatggcccacaactacagaaattcaagtcaggctgtgcaggctgtccgggatgcagggtatgagatttccctcggtttgatgcccaagtcgatcggccctctaacatttgttttcaccggcactgggaatgtgagtaagggagcccaggcgatattcaacgagttgccgtgcgagtacgtggagcctcacgagctgaaggaagtgtcccagaccggggatttaagaaaagtctatggaactgtactctcgcgacaccaccatctggttaggaaaacagacgcagtctacgaccctgcagagtatgacaagcaccccgaaagatacatcagtaggttcaacaccgacattgccccctatactacctgtctcattaatggcatctactgggagcagaatacaccccgcttactgacccgacaggacgcacagtccctgctggctcccggaaagttctcgccggctggtgtggagggctgtccagctctgcctcacaagctggtcgcaatttgcgacattagtgccgatactgggggtagcatcgaattcatgaccgagtgtaccacgattgaacatcccttttgcatgtacgatgccgaccaacatatcatccatgactcagtggaaggatctggcatcctcatgtgctccatagacaacctgccggcccaactgccaatcgaggcgaccgagtgcttcggcgacatgctgtacccttatgtggaggagatgatcctgagtgatgcaactcaacccctggaaagccagaacttttcacctgtcgtgcgcgacgccgtgatcactagcaacggaacactgccagataaatacaagtacattcagacattaagagagtccagggagcgggcacaatcgctgtccatgggtacaaggcgcaaggtacttgtgctaggttccgggtacatttctgagcctgtgctggaatacctgtcaagagatggcaacatcgagatcaccgtgggctctgatatgaagaaccagatcgagcagttgggaaagaagtacaatattaatcctgtatctatggatatctgcaaacaggaagaaaaactgggctttctcgttgcaaaacaggacctcgtcatcagtttgctcccatacgttctgcatcctctggtagctaaagcatgtattacaaataaggtcaatatggtcaccgcatcctatatcacaccagccttgaaggaactggaaaagagcgtggaagacgccgggatcacaattataggagaacttggcctggaccccggtcttgatcatatgcttgccatggagactatagataaggccaaggaagtcggagcaaccatcgagtcctacatcagctattgcggaggcctgcctgcaccagaacattccaacaacccactgcgttataagttcagctggagcccggtgggagtccttatgaatgttatgcagtctgccacataccttctggacggcaaggtggtgaatgtagcaggggggatctctttcttagatgccgtaacaagtatggacttcttccctggattgaacctcgaggggtatcccaatcgcgattcgaccaagtatgcagagatctatggcatatcttctgcccacacactgctgcggggcaccctacgctataaaggctatatgaaggcccttaacggcttcgtcaagctggggctgatcaaccgtgaagctctccctgccttcaggcccgaggctaaccctctgacatggaagcaacttctttgcgatctggtgggtattagtccaagctccgagcacgatgtcctcaaggaggcagtgctgaagaagctcgggggagacaacacccagctggaagcagcagagtggctcggcctgctgggtgatgagcaggtgccccaggcagagtctatcctggatgccctcagtaagcaccttgtgatgaaactgtcatacggcccagaggagaaggatatgatcgtcatgcgcgactcgtttgggattcggcacccctccggacacctcgagcataaaaccatagacctcgtcgcttacggagatattaacgggttttccgctatggccaagactgttgggttgccaaccgcaatggccgctaagatgcttctggatggcgagatcggtgctaagggtttgatgggccctttttccaaagaaatttatggccctattctggagcgcatcaaggctgaaggaattatttacactacgcagagcactatcaagccgtag

SEQ ID NO: 108024 - DNA, 942 bp, Artificial Sequence
  Description of Artificial Sequence: Synthetic coding sequence
atgcagccacagtctgttttacacagcggatacttccaccccctgctccgcgcttggcaaaccgccacgacaacactcaatgcgtctaacctaatttaccccattttcgtcacttatggagtgaagcgccttgaggagatgttgaggcccctggtggaggaagggttgcgttgcgtgttgatcttcggcgtgccgtccagagttcccaaggatgagcgcggttctgccgcagattctgaagagtctcccgctattgaagctatccaccttctaaggaagacgtttccaaatctgttggtcgcctgtgatgtttgtctgtgcccctatacgtcacacggccattgcgggctcttgtccgagaatggagcctttagagcggaagagtctaggcagcggctggccgaggtcgcgttggcatatgccaaggccgggtgccaagtggtggcgccaagtgatatgatggatgggagagtcgaagccattaaagaagctctgatggctcacggtctgggtaaccgggtgagtgttatgtcctactcagccaaattcgccagctgtttctacgggccttttagggatgccgctaagtcctctcccgccttcggggatcggcgatgttatcagcttcctccgggggcgcggggcctggcactgcgcgccgtggacagggacgtccgagaaggggcggacatgctgatggttaaaccaggcatgccttatctggacatagttagagaggtcaaagataaacacccagacttgcccttagctgtttaccacgtgtccggcgaattcgccatgctatggcacggggctcaggctggagcgtttgacctgaaggccgcagtacttgaggctatgacagccttccggcgggccggagcggatattataattacatattataccccccaactgcttcagtggctgaaggaggaatag

SEQ ID NO: 108025 - DNA, 993 bp, Artificial Sequence
  Description of Artificial Sequence: Synthetic coding sequence
atgcaaccccagtctgtgctgcactctggctactttcatcctcttctccgagcatggcagacagctaccacaacgttgaatgccagtaatcttatctaccctatcttcgtaacggacgtgcccgatgacattcaacctatcaccagtctgccaggtgtggctcgatatggcgtcaagaggctggaagaaatgctgcgcccgttggtggaggagggcctgcgatgtgtcctcatcttcggagtacctagtagagtgcctaaggatgaacgagggtccgccgctgatagcgaagaatcgccagctatcgaagccattcacctgctgaggaagacctttccgaacttgctggttgcttgtgacgtatgtttgtgtccctatacttctcacgggcattgcggcttgctttcggaaaatggcgctttccgggcggaagagagcaggcagcgattggccgaggttgcactagcatacgctaaagccggatgtcaggtcgtagcaccatccgacatgatggacggccgcgtcgaggccatcaaggaagctctgatggcgcatggcttggggaaccgggtgagtgtgatgagctactccgctaaatttgcaagctgtttctatggcccattcagggatgccgcgaagtcatcccctgctttcggagacaggaggtgctatcaattgcctccaggagctcgaggcctggcccttcgagctgtagatcgggatgtccgcgagggggccgacatgctgatggtgaaacctggaatgccgtaccttgatatcgtgagggaagtgaaagacaaacatcctgacctccctttggctgtatatcacgtgagtggcgagtttgccatgctttggcacggagcccaggcaggcgcttttgacctgaaggcggcagtactggaggccatgaccgcatttcgcagggctggtgcggatatcataatcacctattacacaccccaactattgcagtggctgaaagaagaatag

SEQ ID NO: 108026 - DNA, 45 bp, Artificial Sequence
  Description of Artificial Sequence: Synthetic coding sequence
atgcccctgtgccctttagcccacgcgatgcaaccacagagctag

SEQ ID NO: 108027 - DNA, 363 bp, Artificial Sequence
  Description of Artificial Sequence: Synthetic coding sequence
atgcccctgtgtcccctcgctcatgcaatgcagccccagagtgtgttgcattctggatactttcatccccttttaagagcctggcagaccgctacaacaaccctcaacgcctctaacctcatctatcccatcttcgtaacggatgttcccgatgatattcagcctatcaccagcctgcctggagtggctcggtatggagtgaaaaggctggaggaaatgttgagacctttagtggaggagggacttcggtgcgttttgattttcggcgtgccttcaagggttccgaaagacgagcggggaagcgccgcagattcagaggagtcacccgcaattgaagctatacatctcctgcgtaaaacgtag

SEQ ID NO: 108028 - DNA, 180 bp, Artificial Sequence
  Description of Artificial Sequence: Synthetic coding sequence
atgcctctgtgtcctcttgcgcacgccatgcaaccccaatctgttcttcatagcggttatttccatcctctcttaagggcctggcagactgccactacgaccctgaatgccagcaacctgatataccccattttcgtgacggatgtaccggacgatattcaaccaataacatccctatag

SEQ ID NO: 108029 - DNA, 1923 bp, Artificial Sequence
  Description of Artificial Sequence: Synthetic coding sequence
atggagtcggtggtgcgccgctgcccatttctttccagggtgcctcaggcatttctgcagaaggccggaaaatcccttctgttctatgctcagaattgtccaaaaatgatggaagttggcgcaaaacccgctccccgggcgcttagcaccgctgccgtacattaccaacagataaaagagacccctcctgcttccgagaaagacaagacggctaaggctaaggttcagcagacgcctgatggctcacagcagtctcccgacggaacccagctgccatccggccaccccctgccagcgaccagccaaggcacggctagcaaatgccccttcctggccgctcagatgaatcagcggggctccagcgtgttttgcaaagctagtttagaactgcaggaagacgttcaagaaatgaatgccgtgcgtaaggaggtggccgagacaagcgcagggccttccgtggtcagtgttaagacagatggcggagatccctcaggactgctgaagaactttcaggacatcatgcagaaacagagacctgagcgcgtcagccatctgctgcaggacaatctccccaagagcgtaagtaccttccagtacgaccgatttttcgagaagaaaatcgacgaaaagaaaaatgaccacacttacagggtgtttaagactgtcaaccgcagagctcacatttttccaatggctgacgattattctgactccctcatcacgaagaagcaggtgtctgtgtggtgtagtaatgactatctcgggatgtcccggcatcctcgggtgtgcggggcagtgatggataccctcaagcagcatggagctggcgccggcggcactcgcaacatctcagggacaagcaagttccacgtcgatctggagcgcgagcttgcagacctacatggcaaggacgccgcgctcttgtttagcagctgtttcgtcgccaatgactcaaccctctttactctcgcaaaaatgatgcctggatgcgaaatctactctgactcaggcaatcacgcttctatgatccagggtatcaggaattcaagggtaccgaaatatatatttaggcataatgacgtgtctcacctgcgcgagctcttgcaaagaagtgacccctccgtgcccaagatcgttgcttttgaaaccgtgcattctatggatggcgccgtgtgtccactcgaggagctctgtgatgtggcccacgagtttggcgcaatcacatttgttgacgaagtgcacgccgttgggctgtatggagctagaggcggcggtattggagatcgggatggagtgatgcctaaaatggacataatttcaggcaccctgggcaaagcctttggatgcgttgggggctacatcgccagtacctcttccctgattgacacagtgagaagttacgctgctggatttatctttacaacatctcttcccccaatgctgctggccggcgcgctggaatcagtacggattttaaagtctgctgaggggagagtgctgaggcggcaacaccagcggaatgtcaagctgatgcgccagatgctcatggatgccggtttgcctgttgtgcactgtccaagtcacatcattccagtacgtgttgctgatgccgccaaaaacactgaagtgtgtgacgagctcatgtccagacataacatttatgtacaggctattaattaccctacagttcccagaggcgaggaactccttaggatcgcccctaccccccaccacaccccccagatgatgaattatttcctcgagaacttactcgttacctggaagcaagttgggcttgagctgaagcctcatagcagtgccgagtgtaacttttgccgcagacccctccactttgaggtgatgtctgagcgcgaaaagtcttacttctccggattgtccaaactcgtttcggcccaagcatag

SEQ ID NO: 108030 - DNA, 1923 bp, Artificial Sequence
  Description of Artificial Sequence: Synthetic coding sequence
atggaatctgtggtgcgccggtgtccattcctgtcacgagtgccccaggcctttctccagaaagcagggaagtccctgcttttttacgcccagaactgcccaaaaatgatggaagtgggtgccaaaccagcccctagagctctgtctactgcagcggttcactaccaacagattaaggagacccctcctgctagcgagaaggacaaaaccgctaaagccaaggtgcagcagacaccggatggatcccagcagagccccgacggcacacagctgccatccggccacccactgccagctaccagtcagggtacggcttcaaaatgccctttccttgccgctcaaatgaatcagcgaggatcctccgtgttctgtaaggcttccttagaactacaagaagacgtgcaggaaatgaatgctgtgagaaaagaagtggctgagacgtcggccggaccgtctgtagtgagcgtgaagaccgatggtggcgatcccagcggtctgctgaaaaacttccaagacataatgcagaaacagcgaccggagagggttagccaccttcttcaggataacctgcctaagtctgtgtccacctttcaatacgacaggtttttcgaaaaaaaaatcgacgagaagaagaacgaccacacatacagggtgtttaagactgtcaaccgcagggctcacatcttcccgatggccgacgactactcagactcgctcatcacaaaaaagcaggtatcagtctggtgctcgaacgattatctgggcatgagcaggcaccctagggtttgcggcgcggtcatggacacccttaagcaacacggcgcgggtgctgggggaaccaggaatattagtgggacctccaaatttcatgtagatctggagcgtgagttggccgatctccacgggaaggatgctgccctgctcttttcctcctgttttgttgctaatgattctaccctcttcaccttggctaaaatgatgccggggtgcgagatctatagcgatagcggaaaccatgcctcgatgatccagggtattagaaatagtagggtgcccaagtacatctttaggcataacgacgtcagtcatttgagggagttgctacagagaagtgacccttcggtgcccaaaatagtcgcctttgagaccgtccattccatggatggggctgtctgtcccctggaagagctctgtgatgtggcccacgagtttggagccattaccttcgtcgacgaagtacacgccgtcggactgtacggcgctaggggaggcggcatcggcgatcgcgatggcgtgatgcctaagatggatataattagtggcacgcttggcaaagccttcgggtgtgttggtggatacatcgcctccaccagttctttaatagacactgtgcggagttatgccgccgggttcatttttacaacctctttgccaccaatgctgcttgcaggcgcgttagagagtgtgaggatcttgaaaagcgctgaaggcagggtcctgcgccggcagcaccaaagaaacgtcaagctgatgcggcagatgctcatggatgctggcctaccggttgtgcattgcccctcccatatcatcccggtgcgagtggccgacgccgccaagaacacggaggtctgcgatgagctgatgagccgccacaacatctatgtccaggccataaattacccaaccgtgccacggggagaggaactgctgagaattgctccaaccccccatcacacgccacaaatgatgaattactttcttgagaacctcctagtgacatggaagcaagtcggccttgaattgaaacctcattctagtgccgagtgcaacttctgccgccggccattgcacttcgaggtgatgagcgaacgcgagaagagctacttctctgggctgagcaagctggttagtgctcaggcctag

SEQ ID NO: 108031 - DNA, 345 bp, Artificial Sequence
  Description of Artificial Sequence: Synthetic coding sequence
atggagtcagtggttagacggtgtccctttctatctagggtccctcaagctttcttacagaaagcggggaaaagcctgttattctacgcccaaaactgcccgaagatgatggaagtcggcgccaagcctgccccacgcgcactgtctactgctgccgtccactatcaacagatcaaagagacacctcccgcttccgagaaggacaagactgccaaagcgaaggtgcagcaaacacctgacgggagccagcagtcccccgacggaacccagttccgcctcgacaccccttgtctcccccaagctagggcccttcaggccaatgcactgtcctggcagcaccgctag

SEQ ID NO: 108032 - DNA, 1923 bp, Artificial Sequence
  Description of Artificial Sequence: Synthetic coding sequence
atggaatccgtcgtgcgccggtgcccctttctgtcccgagtgccccaagcctttctgcagaaggcaggaaagagtcttttgttctacgcccagaactgtcccaaaatgatggaggtcggcgccaaacccgcgcccagagcactctccacagcagcggtgcactatcagcaaatcaaagagactccacccgcctcagagaaagataaaactgctaaggcgaaggtccagcagacacccgacgggtcccagcaaagtcctgacgggacccagctgccgtctggccatcccctaccagccacttcacagggcaccgccagtaagtgtcccttcttagcagcccagatgaatcagcgaggaagctctgtgttctgtaaggcgagcttggagcttcaggaggacgttcaggagatgaacgctgtgcggaaagaggttgcggaaacatctgccggcccatcagttgtctcggtcaagaccgacggtggcgatccatctggactgctgaaaaactttcaagacattatgcagaaacagagaccagagagagtgtctcacctgctgcaggataacctacccaagtccgtaagtacctttcagtatgaccgcttcttcgaaaagaagattgacgaaaaaaagaatgatcacacctatagggtgtttaagactgtgaaccgtagggcacacatttttcctatggcagacgactactctgatagtctgatcacgaagaaacaagtgagtgtatggtgtagcaatgattacctaggtatgagcaggcatccgcgggtttgtggagccgtcatggataccctaaaacagcatggggcgggggccggcgggactcgcaacatctcaggcaccagcaagtttcacgttgatttagagagagaactggctgacctgcacggaaaggatgcagcccttctcttcagctcctgctttgtagctaacgatagcacactgttcacactggctaagatgatgcccgggtgcgagatctactcagattctggcaatcatgcctcaatgatccaggggatcagaaacagtcgcgtgcccaagtatatcttccggcacaatgacgtgtcgcaccttcgggaactcctgcagcgttccgacccttcagtgccaaagatcgtcgcctttgagacggtgcacagtatggatggagcagtgtgtccactggaggagctgtgtgatgtcgctcacgagtttggggccattacttttgtcgatgaggtccacgccgttgggttatacggagcaagggggggaggaatcggcgacagagacggagtgatgccaaagatggacattatttctgggaccctgggaaaagcgtttggatgcgtcgggggttacatagcatcaacatcttccctcattgataccgtgcggtcttacgccgccggtttcatctttactacttcactgcctccgatgctgctggctggtgccttggagagcgtccgcatcctcaagtcggccgagggacgggtgctccgaaggcaacatcaacgtaatgtgaagcttatgcgccagatgctgatggacgctggattacctgttgtgcattgcccgtcccatattattcctgtaagggtggccgacgccgctaaaaacacagaggtttgtgacgagcttatgtctaggcacaacatctatgttcaggctataaactatcccactgtcccaagaggggaggaactgctgcgaatcgcaccaacccctcatcacaccccccagatgatgaactacttcctggaaaaccttctcgttacgtggaagcaggtggggctagaactaaagccccactctagcgctgagtgcaatttctgccgacgccccctgcacttcgaagtcatgtcagagcgcgagaaaagttatttttctggcttgtcgaagctagtgtcagcccaggcctag

SEQ ID NO: 108033 - DNA, 1923 bp, Artificial Sequence
  Description of Artificial Sequence: Synthetic coding sequence
atggagtcagtggtgcgccgatgccccttcctatctcgtgtcccccaggcttttcttcagaaagctggaaaatcactgctcttctatgctcagaactgtcccaaaatgatggaagttggcgctaaacccgcaccccgagccctctctacagctgccgtccactaccagcagataaaggagactcccccagcttcggagaaggataagactgcaaaggcaaaagtccaacagacacccgatggaagccagcagagccctgacggcacacagctgccctccggacatcctctgccagccacttcacagggtaccgcctcaaaatgcccgtttctggccgcccagatgaatcaacgcggctcctctgtattctgtaaggcctccctggaattgcaggaagatgttcaagaaatgaatgctgtacggaaggaggtggcagagactagcgcgggccctagtgtggtgtccgtgaagacggacgggggcgaccccagcggcctgttgaaaaactttcaggatattatgcagaagcagcggccggagagggtgtctcacctcctgcaggacaatctgcccaaatccgtgagtaccttccagtacgatcgcttcttcgaaaaaaagatagatgagaagaagaatgaccatacatatcgggttttcaagaccgtaaaccgtcgggcacacatatttcccatggccgatgattatagtgactctctgatcaccaaaaagcaggtgtctgtgtggtgctccaacgactaccttggcatgtctcgacatccacgggtgtgcggagccgtcatggacacattgaagcagcacggcgcaggtgccggtggaacccggaacattagtggaacttcgaagtttcatgtggatctggaaagagaacttgcggacctgcacgggaaggatgcggccctactcttcagcagctgttttgtggccaatgacagtaccctcttcaccctcgctaaaatgatgccaggttgcgagatctactcggatagtggcaatcacgcctctatgattcaagggattcgaaacagtagagtacccaaatatatattccgacacaacgacgtatctcaccttcgcgaactgctgcagagatcggatccttctgtgccgaaaatcgtggccttcgagacggtgcactccatggacggcgccgtgtgccctctcgaagaactgtgcgacgttgcccatgagttcggagctatcacatttgtcgatgaagtgcacgccgtgggcctgtacggagcccggggcgggggtatcggcgacagagatggcgtgatgcctaaaatggacatcatctctggcacccttggcaaggccttcgggtgtgtgggaggatacatcgcgtctacgagctctctaatcgacaccgtacggtcttatgcagctggtttcatcttcaccacctccttgcccccaatgctactagccggggctctcgaatccgtgagaatcctgaagtccgctgagggaagggtgctgcgccgacagcatcagagaaatgtgaagttaatgcgccaaatgctcatggacgccggacttcccgtggtgcactgtccttctcacatcattccagtgcgcgtggccgatgcagctaaaaacacggaagtgtgcgatgagcttatgtccagacataacatttatgtccaagccataaactatcccaccgttccgaggggagaggaactcctgagaatagcgccaacaccccaccataccccccagatgatgaactactttttggagaatctgctcgtgacctggaagcaggtggggctcgagctgaagccccacagttccgccgagtgcaacttttgtagaagacctctgcatttcgaagtgatgtcggagcgcgaaaagtcatacttttccgggttatcgaaactggtctcagcacaagcttag

SEQ ID NO: 108034 - DNA, 1764 bp, Artificial Sequence
  Description of Artificial Sequence: Synthetic coding sequence
atggtgaccgccgcaatgctgctccagtgttgccccgtgcttgctaggggcccaaccagtctcctcggaaaagtggtcaagactcaccagtttttgttcgggattggtaggtgcccgatcctggcaacacagggacccaactgttcccagatccatttgaaagcgaccaaggcaggcggcgatagcccctcttgggccaaaggccactgcccgttcatgttgagtgaactccaggacggaaagagcaagattgttcagaaggctgctccggaagtacaggaggacgtcaaagccttcaagacggatttgccatcctctttggtctctgtatcgttgcggaagcctttcagtgggccacaggaacaggaacagataagtggcaaagtgactcacctcatccaaaataatatgccaggcaattacgtcttctcctacgatcagttcttccgcgacaaaattatggaaaaaaagcaggaccatacctatcgggtgttcaagaccgtgaacagatgggctgacgcgtatccatttgctcaacatttctctgaggctagcgtcgcatctaaagacgtaagcgtctggtgttccaatgattacctaggcatgagccggcaccctcaagtgcttcaggctacccaagagacccttcaacggcacggtgcaggagctggtggcacccggaacatttccggtacttcaaagttccacgtggaactggagcaggagctcgctgagctccatcagaaagatagcgctctgctgttcagctcttgcttcgtggcaaacgattctacgctgtttacactggccaagatcctcccaggctgtgaaatctacagcgacgcaggtaaccacgcaagcatgattcaaggcatcagaaacagtggggctgctaagttcgtgtttaggcataatgatcctgaccatctgaagaagctcctggaaaaatccaatccaaagattcccaagattgtagcattcgagactgtgcattccatggacggcgccatctgcccccttgaggaattgtgcgacgtctctcaccaatatggtgcactaacctttgtggacgaggttcatgcagtgggcctgtatggaagccgaggagcgggcattggcgagcgtgatgggatcatgcacaaaatcgatataatctccggtacacttggcaaggccttcggctgcgttggtgggtatattgcttccacgcgagatcttgtcgacatggttagatcttacgccgcgggtttcatcttcacaaccagcctgccacccatggtcctctctggggccctggaaagtgttcgactgttgaaaggtgaagaaggccaagccctgcgcagagcccaccagcgaaacgtaaagcacatgagacaactcctgatggatagagggctgcccgtgattccctgtccttcccacatcattcccattcgagtcggaaatgctgccttaaacagcaaactgtgcgacctgctgttatccaaacacgggatttacgttcaagctatcaactaccccacagttcctcgcggggaagagctgttaaggcttgctccatcaccgcatcactccccacagatgatggaagatttcgtggagaagttgttactcgcttggaccgctgtaggcctccctctgcaggatgtaagtgtcgctgcctgtaatttctgcaggaggccagtacatttcgaactgatgtccgagtgggaacggagttattttggcaatatgggcccacaatacgtcacaacctacgcatag

SEQ ID NO: 108035 - DNA, 1653 bp, Artificial Sequence
  Description of Artificial Sequence: Synthetic coding sequence
atggtgactgctgcgatgctgctccagtgctgccctgtcctagccagagggccaacctccctgctgggaaaggtggtaaagacacaccagttcctatttggaatcgggcgttgtccaattctggccacccagggcccaaactgttcccagatacacttaaaggctaccaaagccggcggggatagtccttcctgggcaaagggacattgccctttcatgctgagcgagttacaggacggtaaaagtaagatcgtgcaaaaggcagctcctgaagtccaggaggatgtcaaagccttcaagaccggcaactacgtgttttcatatgatcagttcttccgcgacaagatcatggaaaaaaagcaagatcatacctatagggtcttcaaaactgtcaaccgctgggccgacgcttatccttttgctcagcatttctctgaggcttcagtggctagcaaagacgtttcagtctggtgctctaatgattatcttgggatgtcaaggcatccccaggttctccaggctactcaggagacactccagcgacatggggcaggggccggcggtacccggaatatttctggtaccagtaaatttcatgttgaactcgagcaagagcttgccgagttgcatcagaaagacagcgcactcctcttttccagttgcttcgtagccaacgactccaccctgtttacactggcaaaaatcctacccggctgtgagatctactcagacgccggaaatcacgcttcaatgatccagggcatccggaacagcggcgccgctaagttcgtgttcaggcacaatgatcccgaccatttaaagaaactgctcgagaaaagtaatcccaagattcccaaaatcgtagcgttcgagacagtccattctatggacggcgccatctgcccacttgaggaactttgtgacgtgagccatcagtacggggcgctaaccttcgtggacgaagttcacgcggtgggcttgtacgggtctagaggtgccggcatcggggaacgcgatgggatcatgcacaaaattgatatcatctcaggtactctggggaaggcattcggatgcgtgggcggatatatcgcctcaactagggacctcgtggatatggttaggtcctatgctgccggttttattttcaccacctcactgccccccatggtgctgtcaggagccctggagagcgtcagactgctcaaaggcgaggagggccaggcgctgaggagggctcaccagaggaatgtaaaacacatgcgccaactgctcatggaccgcggactgcccgtgatcccatgtcccagtcacattattccaatccgcgtagggaatgccgccttgaattccaagttgtgtgacctcctcctgtctaagcacgggatctacgtgcaagctatcaattacccaactgtgccacgtggagaggagcttctccgacttgccccatctcctcatcatagtccccaaatgatggaggacttcgtggagaaactgctactggcctggaccgcagtcggtctgcccctgcaggacgtctctgtagcagcatgtaatttctgcaggcgtccagtgcactttgagcttatgagcgaatgggagcgcagttacttcggaaacatgggaccccaatacgtgaccacatatgcctag

SEQ ID NO: 108036 - DNA, 1725 bp, Artificial Sequence
  Description of Artificial Sequence: Synthetic coding sequence
atgagggggggggaggttgccctcggatggaacaagaagaagcgtctcttttgtgaagattttagattcaagatggtaaccgccgctatgctgctgcaatgctgccctgtcctggctcgaggcccgacgtcacttctgggcaaggtcgtgaaaacacatcagttcttattcggcatcggaagatgcccaatactggccactcagggacctaattgctcacagatacacctgaaggccaccaaggctggtggtgactcccccagctgggccaaagggcactgccccttcatgctgagcgaactgcaggacggaaaatccaagattgtccagaaagctgctcctgaagtgcaggaagatgtgaaagctttcaagaccggaaattacgtgtttagctacgatcagtttttcagggacaaaatcatggaaaaaaagcaggaccatacctatcgggtatttaagaccgtgaacagatgggcagatgcatacccgtttgctcaacacttctccgaggccagtgtagcgtctaaagacgtctctgtgtggtgttccaacgactatctgggcatgtcacggcacccgcaggtcctgcaagccacccaggaaaccttgcagaggcacggagcgggggccggcggtacccgaaatattagtggtacttccaagttccatgtggaactcgagcaggagctggccgagctgcatcagaaggatagcgcattgttgttctcctcatgtttcgttgccaatgattccactttattcaccctggctaagatactgccaggttgcgagatttatagtgacgctgggaatcatgcttcaatgattcagggaatccgaaattccggagccgctaaattcgtatttaggcataacgaccccgaccacctaaaaaagctattggagaaatcgaatccaaagataccgaaaatcgtggccttcgagactgtacattcaatggatggagctatctgccccctggaggagctgtgcgacgtctcacaccagtatggtgcattgacctttgtcgatgaagtgcacgcagtcggtctgtacgggtctcgtggggcggggatcggtgagagagatggcattatgcataagatagatatcatatccgggacgttaggtaaggcatttggctgcgtcggtggttacattgcttcaacacgggatcttgtggatatggtgagatcctatgccgcaggctttatctttactactagcctcccgcccatggtgttatccggcgccttggaaagcgtacggctcctaaagggagaggaaggccaggccctgcgcagagcacaccagcggaacgtaaagcacatgaggcagctactgatggacagagggctgcctgtcattccatgcccatcccacataatcccgattcgggtaggcaatgccgccttaaacagtaaactctgtgacctgcttctgagtaagcacggcatctatgttcaagcaataaactacccaactgtcccccggggagaggagctcttgaggctcgccccatcgccccatcacagtccgcagatgatggaggacttcgtcgagaaactcctgcttgcttggaccgccgtgggtctaccgctgcaagatgtgtctgtcgccgcctgcaatttctgccggcgacctgtccactttgaattaatgtcagagtgggaacgcagctattttggcaacatgggtcctcaatatgtgacaacctacgcatag

SEQ ID NO: 108037 - DNA, 669 bp, Artificial Sequence
  Description of Artificial Sequence: Synthetic coding sequence
taacttagcttcgtcagaccccagtgtagagcaactgactctccctcctgggccaagggccattgccccttcatgctgtcagagctgcaggacggaaagtccaaaattgtgcagaaggctgcacccgaggttcaggaggacgtcaaggcttttaagaccgatttgccatcaagtctagtgagcgttagcctccggaagcctttttcaggccctcaagaacaagaacagatcagcggaaaagtaacccacctcatccaaaacaatatgcccggtaattacgtcttttcctatgaccagttttttcgggataagataatggagaagaaacaggatcacacttaccgagtgttcaagacagtgaaccgttgggctgacgcctatccgtttgcccaacatttcagtgaggcctccgtggcatccaaggatgtctcagtgtggtgttctaacgactatctcggcatgtcaaggcacccacaagtgctgcaggcgacacaagaaacgctccagaggcatggagccggcgccggaggcacgcggaacatctcaggaacatcaaagtttcacgtggaactggaacaggaactggccgaactgcaccaaaaggactctgccctgctgttttcctcctgctttgttgctaatgattcaactttgttcacactcgcctag

SEQ ID NO: 108038 - DNA, 1212 bp, Artificial Sequence
  Description of Artificial Sequence: Synthetic coding sequence
atgcagagagcagtatccgtggttgctcgcttgggctttcggctccaggcctttcccccggcattatgcaggcccctgtcctgtgcacaggaagttctccgtcgcactcctctttacgacttccacttggcccatggagggaagatggtcgctttcgctggttggtctctgccggtgcagtacagggacagccatactgattcccatctacacacaaggcagcactgctcacttttcgacgtcagccatatgctgcagactaagatactgggctccgacagagtgaagctcatggagtcactcgtggtcggagatatcgctgaactgcggccaaatcagggcactttgtcactgttcactaacgaggctggtggtatcctggacgacctcatcgtgacgaatacctcagaagggcacctgtacgttgtgagtaatgcaggctgctgggaaaaggaccttgctctgatgcaggacaaagtgcgcgaactgcagaaccagggccgggacgtggggcttgaagtcctggataatgcgctcttagctttgcagggcccaacagccgcccaggtgcttcaggccggggtggctgatgatcttcggaagctccccttcatgacatccgccgtgatggaagtctttggcgtctccggttgtcgtgtaacgagatgcggctatacgggggaagacggagtggagatttctgttccggttgctggtgcagttcacctcgcaacagcaattttgaaaaaccctgaggtcaaattagccggactggcagcacgggatagcctacggctggaggcaggactgtgcttatatggtaatgacatagacgagcataccacaccagtggagggctcgctgtcttggaccctgggtaaaagacggagggccgcgatggattttcctggggccaaagtgatcgtgccgcagctcaaagggagggtgcagcgcaggcgcgttgggctgatgtgcgagggagcccccatgagggctcactcccccatcctcaatatggagggtaccaagatcggaacagtcacatcagggtgcccctctccttctctcaagaagaacgtcgccatggggtatgttccttgtgagtatagccggccggggaccatgctcctggtcgaggtgcgccgcaagcaacagatggcagtcgtgagcaaaatgccctttgtgcctaccaattactacacgctgaagtag

SEQ ID NO: 108039 - DNA, 1161 bp, Artificial Sequence
  Description of Artificial Sequence: Synthetic coding sequence
atgcagcgggcggtgagcgtggtggctagactgggtttcagacttcaggctttccctcccgccctgtgtaggccattgtcgtgtgcacaagaagtactgagaagaactccactatatgactttcatctggcccatggaggcaagatggtagccttcgcaggctggagcttgcccgtgcaataccgagactcccatactgattctcatctgcacacaaggcaacactgtagcctgtttgatgtaagtcatatgttgcagaccaaaatcttgggatccgaccgggtgaaactcatggaaagtctcgtggtaggggatatagctgagctgaggcccaaccagggtaccttatcgctcttcaccaacgaagcggggggaatattagatgacttgatcgtgactaacacttccgagggccacctttacgtcgtctcaaacgccggttgttgggaaaaagatctggcgttaatgcaagataaggtgcgcgaactgcagaaccaaggaagagacgtgggtctggaagtccttgataacgctttgctggctttacagggccctaccgccgcccaggttcttcaggctggagtggctgatgacctaagaaaactgccatttatgacttcagccgtgatggaagtattcggggtttcgggttgccgcgtgaccaggtgtggatataccggcgaggatggcgttgaaatcagcgtgccagttgctggcgccgttcatctagccactgccatcctgaaaaaccccgaagtgaaactggccggcttagcagcaagggatagcctgaggcttgaagctggcctctgtctgtacggaaacgatatagacgagcataccactcccgtcgagggctccctgagttggacacttggcaagcgtaggcgggccgcaatggacttccctggcgctaaagtcattgtgcctcaacttaagggacgggtgcaaagacgaagagtcgggttgatgtgtgagggagcaccaatgagagcacacagccctatcctgaatatggagggcaccaagatcgggacagttaccagcggatgcccttctcctagcctgaagaagaatgtggccatgggctacgtgccttgcgaatatagccgccctggcacgatgctgttagttgagctgccctcaggcccttgcttttag

SEQ ID NO: 108040 - DNA, 1155 bp, Artificial Sequence
  Description of Artificial Sequence: Synthetic coding sequence
tgagcggtgtctgtagtagcacgcctgggctttcggctgcaagcgttcccaccagccctgtgtaggcctctgtcctgtgctcaggaggtgctccgaagaaccccactttatgatttccatctggctcatggggggaagatggtggcttttgcagggtggtccctgcccgtgcaatatagggacagccacaccgatagccacctacacacccggcagcactgcagtttatttgatgtgtcacacatgctacagaccaaaatcttaggttccgaccgggtgaagttaatggaatccctggtagtgggagacatagcagagctcaggcccaaccaagggacattgtctctctttaccaatgaagccggtggcatcctggacgacctgatagtgactaacacttccgagggacatttatacgtggtaagcaacgctggatgttgggaaaaagacctggcgctgatgcaggataaagtgcgtgagctccagaatcaggggagggatgttggcctggaagttcttgacaacgcgctgttagcactgcagggaccaacggcggcgcaggtgcttcaggccggtgtggcagacgatctgcggaaattacccttcatgacctcggccgtaatggaggtgtttggggttagcggctgcagggtgacccggtgcgggtacaccggggaggacggtgtggaaatatcagtccccgtcgcaggggctgtgcacctggccacagccatcctgaagaacccagaggttaagttggctggcctggctgccagagattctttgcgtctagaggccggcttatgtctgtacggaaacgacattgatgagcatactacccctgtggaaggtagcttaagttggacgttggggaagagacgaagagccgccatggacttccctggtgccaaggttatagttccgcagttgaagggtcgggtccagcgacgacgggttggactgatgtgtgagggggcgccaatgagagctcactctccaatcctaaatatggaaggaacaaaaattggaaccgttaccagcggatgtcctagcccaagcttgaaaaaaaacgtggccatgggatatgttccctgcgaatacagtagaccaggtacaatgctactcgtcgaactgccttcgggcccatgcttttag

SEQ ID NO: 108041 - DNA, 1080 bp, Artificial Sequence
  Description of Artificial Sequence: Synthetic coding sequence
atgcagcgcgccgtatccgtggtcgcccggttgggatttcgtcttcaagccttccccccagccctttgtcggccgctctcttgcgcacaggaggttttgcgccgcacccccctgtatgattttcatttggctcatgggggcaagatggtggccttcgccggttggtctttgcccgtgcagtatcgcgattcacacacagactcgcacctacatacacgccagcactgttctttgttcgatgtgagccacatgcttcagactaagatactgggctcagatcgagtgaagctgatggagtccttggtggtaggggacatcgctgaactgcgtcccaaccaagataaggtcagagaactgcagaatcagggaagagacgtgggcctcgaggtgctggacaatgcgttgctggcactgcaggggcccacagcggcgcaggtgcttcaggccggagtggccgacgatttacggaaactcccatttatgacaagcgctgttatggaagtatttggtgtttctgggtgcagggttacaaggtgcggctataccggagaggatggcgtggagatctctgtacctgtggcgggtgccgtgcatctggcgacggcaatcctgaagaaccccgaagtcaagctcgccgggctggccgcccgggactcccttagactggaggccgggctttgcctgtatggcaacgatattgacgagcacaccacccctgtcgagggaagcctgagttggactctgggcaaaagaaggcgagcagcaatggattttcccggggccaaagtgattgtgcctcagttgaagggtagggtgcaaagaaggcgagtcggcttgatgtgtgagggagctcctatgcgtgctcattctcctattctgaacatggagggcacaaaaattggaacagtgacaagtggctgcccctccccttcgctgaaaaagaacgttgccatgggttatgtcccttgtgagtactcaagaccaggcacgatgctgctggtagaggttcgtcgaaagcagcagatggcagtcgtgagtaaaatgccctttgtgccaactaactattacacactgaagtag

SEQ ID NO: 108042 - DNA, 1044 bp, Artificial Sequence
  Description of Artificial Sequence: Synthetic coding sequence
atgcagagagcagtcagcgtcgtggcccgattgggctttcgcctacaggcatttccgccagccctttgtcgtcctctgtcatgcgctcagactaaaattctgggcagcgatcgagtcaagctgatggagagcctggtggtcggggacatcgcagagttgagacccaatcagggtacactcagcctgttcaccaatgaggcgggaggcattttagatgacctgatagtgaccaacacatccgaaggacacctttatgtggtctccaatgccggctgttgggaaaaggatctggccttaatgcaagacaaggttcgagagctccagaatcagggaagagacgttggacttgaagtgctggacaacgctcttttagccctccaaggccctaccgctgcccaggtgcttcaggctggggtcgcagacgacttgcgcaaactccctttcatgacatcggccgtgatggaggtcttcggggtcagtggatgtcgagtgacgagatgtggatacaccggtgaggacggtgtggagatctcagtgcccgtagctggggcggtccacctggccaccgctattctgaagaaccccgaggtgaaactggcgggtctggccgcccgagactccctacggctcgaagcaggcctatgcctgtacggcaacgatattgacgagcacacaactccagtcgagggaagcctgtcctggactttaggcaagcgcagacgggctgctatggactttccaggcgccaaagtgatcgtacctcaattgaagggtcgtgtacagaggcggagggtgggcttgatgtgcgagggtgccccaatgagagcccactcgccgatattaaacatggagggtactaagattggcacagtgacatccggctgcccaagcccatcattgaagaaaaacgtagccatgggatacgttccatgcgaatacagccggcccggaacgatgttgttggtggaagtccgacgaaagcaacagatggctgttgtgtccaagatgccttttgtaccaacaaattactatacattaaaatag

SEQ ID NO: 108043 - DNA, 921 bp, Artificial Sequence
  Description of Artificial Sequence: Synthetic coding sequence
atggagtccttggtggttggggacatcgccgagctgcgtccaaatcagggcactttgtctctctttacgaacgaagctggaggcatcctggacgacttaattgtgacgaacactagcgaaggccatctgtacgttgtcagtaatgcagggtgctgggagaaggacctcgccctgatgcaagacaaggtccgcgagcttcagaaccaaggccgcgacgtggggttagaagtactggacaatgcactcttggcgctgcagggacccaccgccgcacaggtgctacaagccggggtggccgacgacctgcgtaaactgccctttatgacctccgccgtaatggaagtgtttggcgtctctggctgtcgggtcacacggtgcgggtatactggtgaggatggagtggagatctcagtgcccgtggctggcgcagtccacctggcgactgcaatcctgaagaaccctgaggttaagttagcagggctggcggcccgagatagtctcagactcgaagccggtctttgtctttacggcaatgacatcgacgaacataccacaccagtcgagggctccctctcatggaccttgggcaaaagacgcagagctgctatggattttcctggagccaaagtgattgttccccagttgaaggggcgcgtgcagaggcgaagggtggggctaatgtgcgaaggagctcctatgcgagcacatagccccatcttgaatatggagggaacaaagatcggcactgtgacatccgggtgtccctccccctcccttaaaaagaacgtggccatgggctacgtcccctgcgaatactctcgacccggtaccatgctgttggttgaggtaagaaggaagcagcagatggccgtggttagtaagatgccattcgtcccaactaactactataccctcaagtag

SEQ ID NO: 108044 - DNA, 2760 bp, Artificial Sequence
  Description of Artificial Sequence: Synthetic coding sequence
atgtggctagccgctgctgcaccgtcactagcgcgaaggttacttttcctgggacctccgccgcctcccctactgttacttgttttcagccggagtagccgcagacgtctgcactcacttggtctagcagcaatgcccgagaaacggcccttcgagcgccttcccgcagatgtcagtccgattaattacagcctctgcctgaagcccgaccttctcgacttcaccttcgaaggtaagttggaggccgccgcccaggtacggcaggcaaccaaccaaattgtgatgaactgtgccgatattgatatcattaccgcgagttacgcccctgagggggatgaggagatccacgctacaggctttaactaccagaacgaagacgaaaaggtgacactgtcattcccaagcaccctacagaccggtaccggcacgctgaaaatcgacttcgtgggtgaattgaatgacaaaatgaagggattctaccgcagcaagtatactactccttcaggcgaggttcgatacgctgccgtcacacagttcgaagctacagacgcaagaagagcttttccttgctgggatgaacctgccatcaaagctacatttgacattagtttggttgttccaaaggatagagtcgcattatccaatatgaatgtgattgatagaaagccctatccggatgacgagaacttggttgaagtcaaatttgctcgaacgcctgtgatgagtacctatctcgtcgccttcgtggttggagaatacgacttcgtggagacccggagtaaggacggtgtgtgtgtccgggtgtacacccctgtgggaaaagcagaacaaggtaagtttgccctcgaagtagctgcaaagacccttcccttttacaaagattacttcaatgtgccgtatccccttcccaagatcgatctgatcgccatagctgatttcgccgccggcgctatggagaattgggggttagtgacttacagagagactgccctgcttatagacccgaaaaatagctgtagtagttctagacagtgggtcgcccttgtggtggggcatgagctggctcaccagtggtttggcaatcttgtgaccatggagtggtggacacacctgtggctgaacgaaggctttgccagttggatcgagtacttatgtgtagaccactgcttccctgaatatgatatctggactcagttcgtttctgccgattatacccgggcccaagagctggatgcccttgataatagccatcctattgaggtgagcgttggacacccctctgaagtggatgaaatatttgatgctatatcatacagcaaaggtgccagcgtgatcagaatgttgcatgactatatcggagacaaggattttaagaagggaatgaacatgtacttgaccaagtttcagcagaagaacgctgccacagaggatctgtgggagtcacttgaaaacgcctccgggaaacccattgcagcagtcatgaacacttggactaagcagatgggattcccactaatttatgtagaggctgagcaggttgaggacgacagattattgagactgtcacagaaaaagttctgtgccgggggaagctacgtaggggaggactgccctcagtggatggtgccgatcaccatatccacttctgaggacccaaatcaggctaagttgaagatactgatggacaagccagagatgaatgtggttttaaaaaatgtgaagccggatcagtgggtaaagcttaatttaggaaccgtgggattttatagaacccagtactccagcgccatgctcgaatccttactgccagggatcagggacttaagtctcccaccggtggatcgactgggcttacagaacgacttattctctctggccagggcgggaataattagcactgttgaggtcctgaaggtgatggaagcctttgtaaacgaacctaactacacagtgtggagcgacctatcttgcaacctaggcattctgagcacattgttgagtcacacggacttttatgaggagattcaagaattcgttaaggatgtattctctccgatcggcgagcgccttggctgggaccccaaaccaggagaaggtcacctggacgcacttcttcgcggccttgtgctcggaaagcttggaaaagccggccacaaagccaccttagaggaggccagacgccgatttaaggatcacgtggaaggaaagcagatcctgagtgccgacctgcgcagccctgtgtaccttactgtattgaagcacggcgatggcaccacactggacatcatgctcaaattgcataaacaagctgatatgcaggaggagaaaaatcgcatcgagagggttcttggcgctactctattacctgatcttatccagaaggtcctgacttttgctttgtctgaagaagtacgcccacaagacaccgtaagtgtgattggcggggttgctggcggcagcaagcacgggagaaaagccgcctggaaattcatcaaggataactgggaagaactctacaatcgctatcagggaggctttctgatatcccggctgatcaagctgtcggtcgaaggctttgctgttgacaagatggcaggagaggtcaaggcctttttcgaatctcacccagctccatccgctgagagaacgatccagcaatgttgcgaaaatatccttctgaacgccgcatggctgaaacgggatgccgagtcaattcaccagtacctgctccagcgcaaggccagtcctccaactgtgtag

SEQ ID NO: 108045 - DNA, 1884 bp, Artificial Sequence
  Description of Artificial Sequence: Synthetic coding sequence
atgtggctggccgcggcagcccccagcctagctaggaggctgctgttccttgggcctcccccgccacctttgctgcttctcgtttttagcaggagcagccgtcgcaggttacattcccttggactcgctgacgtcagccctattaactactctctgtgcttaaaaccagatctgctggatttcactttcgagggcaaactagaggcagccgcgcaggtgagacaggcgacaaatcagattgtaatgaattgcgccgatattgacataattaccgcatcctatgcaccagagggagacgaggagatccacgccacaggattcaattaccagaatgaagatgaaaaggtcacactgtctttcccatcaactcttcagacaggaaccgggaccctgaagattgattttgtgggcgagttgaacgacaaaatgaaaggcttctaccggtccaagtacactaccccaagtggcgaagtgcgatatgcagccgttacccagttcgaggctactgacgctaggcgagcattcccatgttgggatgagcctgctatcaaagcaacattcgacatttccctagtcgtgcccaaagacagggtggctctgtcaaacatgaatgtgatcgacagaaaaccataccctgacgacgaaaatctcgtcgaggtcaaattcgctagaaccccagtgatgagcacctacctggtagccttcgtagttggagagtacgatttcgtggagacacgaagcaaagatggcgtgtgcgttcgcgtgtataccccagtggggaaggcagagcagggaaaattcgctttagaggtggcggccaagactctgccattctacaaagactactttaatgtgccatatccactgccgaagattgacctcatcgctattgccgattttgcagctggggcaatggagaattgggggctcgtgacctacagggagaccgccctcctcatcgaccctaagaactcatgcagcagctctcgacagtgggtggctctggtggtaggccacgaactggctcaccaatggtttgggaacctggtaactatggagtggtggacacacctctggctcaatgagggctttgcaagctggatagaatatctgtgcgttgatcattgtttccccgagtatgacatctggacccaatttgtcagcgctgactataccagagcccaggagctggatgcactagataattctcatcctatagaggtctcggttggccatcctagcgaggtggatgagatttttgatgccataagttattctaagggggccagcgttattaggatgctgcacgactacatcggggataaggattttaagaaagggatgaacatgtatcttacaaaattccagcaaaaaaacgccgccactgaggatctgtgggagtcacttgaaaatgccagtggcaagcctatagccgctgtgatgaatacctggactaagcaaatgggtttccctttgatatacgtggaagcggaacaagtcgaggacgatcggctcctacggctgagtcagaagaagttctgcgccgggggatcctatgtaggggaagattgcccgcagtggatggtcccgataactatatccacgtctgaggaccccaatcaggcaaaactgaaaatcctcatggacaagcccgagatgaacgtggtgctgaagaacgtcaaacctgatcaatgggtcaaactgaaccttgggactgtgggcttctatcggacccaatactccagcgcaatgttagagtctctgctccctggtattcgcgatctgagtctgccgcctgtcgatcgactcggactgcagaacgatctgttcagtttgttcatcctgtgcgtgagggaagtgtcaggaaattgctgcagggcctag

SEQ ID NO: 108046 - DNA, 2520 bp, Artificial Sequence
  Description of Artificial Sequence: Synthetic coding sequence
atgcccgagaagcggccttttgagagactccccgccgacgtcagtccaatcaactattccctctgtctcaagcctgacctcctggatttcaccttcgaaggaaagctggaagccgcagctcaggtcaggcaggcgacaaaccaaatcgtcatgaactgcgcagatatcgacatcattactgctagctatgcacccgaaggagatgaggaaattcacgccactggattcaactaccagaacgaggacgagaaagtaaccctatctttcccgtcgaccctgcagaccggtaccgggacattgaaaattgacttcgtaggggaactgaacgataagatgaaggggttttaccgctccaagtacactacccctagtggagaggttcgctacgctgccgtgactcaatttgagaatgtgatcgacaggaaaccatatccggatgacgagaatctcgtggaggtcaagtttgccagaacccctgtcatgtcgacatacctcgtggcctttgtggtgggggaatacgattttgttgagacaaggagcaaggacggcgtgtgtgtccgcgtatataccccagtcggaaaggctgaacagggaaaattcgcgttggaggttgcagccaagaccctcccattttacaaggactactttaacgtaccctacccgttgcctaaaatcgatttgatcgcgattgccgatttcgcagcgggggccatggaaaattgggggctggtgacataccgcgagactgccctattaatcgaccccaagaattcctgttcatcctccaggcagtgggtcgccctagtggtgggccacgaactagcacatcagtggttcggaaacctggtaacaatggagtggtggactcatctttggcttaatgagggctttgcttcatggatcgagtacctatgcgtggaccactgtttccctgagtacgacatttggacgcagtttgtctccgccgattatacaagggcgcaggagctggatgcactggataattcccatcccatagaagtgtccgtggggcaccccagtgaggtggatgagatttttgacgccatttcctattctaaaggcgctagtgtgatacggatgctgcatgattacataggcgataaggatttcaagaagggcatgaacatgtatttgacaaaattccagcagaaaaatgcggctaccgaagacctgtgggagtcgcttgaaaatgcctctggaaagcccatcgccgcagtgatgaacacatggacaaagcaaatggggttcccccttatttatgtagaagctgagcaagtcgaagacgataggctcctgcgtctctcccagaagaagttctgcgctgggggcagctatgtgggggaggactgccctcagtggatggtgcccattaccattagtacttcagaagaccccaatcaggccaagctcaagatcctgatggacaaacccgaaatgaacgttgtcctgaagaacgtgaagcctgaccagtgggttaagcttaatctcggcactgtggggttttatcggacccagtacagctcagctatgctagagagcctactgcccggaattagggacctctctttgccgcctgtcgacagattgggcctccagaacgacctgtttagtctcgcaagggccgggatcattagtaccgttgaggtcctgaaggtgatggaggcctttgtgaatgaacctaattacactgtctggtctgatctatcatgcaatctcgggatcctgagcactctcctgagccatactgatttttacgaggaaatccaggagtttgtcaaggatgtattttccccaatcggagaacgcttgggatgggaccctaagccaggtgaaggacatttggacgctctccttcgagggctggtgttagggaaactgggcaaagctgggcacaaagccacactcgaggaggcccggcggaggtttaaggatcatgtggaggggaaacaaatcttgtccgctgacctccgcagtcctgtgtatctaactgtccttaaacacggagatggcacgactctcgatattatgttgaagctacataaacaggccgatatgcaagaggagaagaacagaatcgagcgggttctgggcgccacgttgctgcctgacctcattcagaaggtcttaacgttcgctttgtccgaggaggtccgaccccaggatactgtgtccgtgattggtggagtggcggggggaagcaaacatgggcgcaaggccgcctggaagtttattaaagacaattgggaggaactctacaatcgctaccaaggcggcttcttgattagtcgactcattaagctgagcgtagagggtttcgctgtagataaaatggcaggtgaggtgaaggcattctttgagtctcatccagcaccatctgccgaacgtacaatccagcagtgctgtgaaaacattctgctcaacgccgcatggcttaaacgcgacgccgaatcaatacaccagtacctgctgcaacgcaaggccagcccgcctaccgtgtag

SEQ ID NO: 108047 - DNA, 1125 bp, Artificial Sequence
  Description of Artificial Sequence: Synthetic coding sequence
atgcgatccccagctgtacccactccagctcgggggcagctcggagtcgctttcgtactgctgccccctcactctgagggagcccgcgtctttggcgctctgggccccattggcccctcgtcccctgggctgactctcggtggcctcgcggtttctgaacataggctatctaacaagctgctggcttggagtggcgtgttggagtggcaagaaaagcgccgcccatacagtgactctaccgcgaagcttaagaggactctcccatgtcaggcgtacgtgaaccagggagagaatcttgagacagaccagtggccccagaagctgataatgcagctcataccacagcagttgctgactacattgggccctttgtttagaaactcccaactggcccagttccacttcaccaatagagactgcgactcactgaagggactgtgcaggatcatgggcaatggttttgccggatgtatgctgtttcctcacatctccccctgtgaggtgcgtgtcctcatgcttctgtattcatcaaagaagaaaatcttcatgggactgattccttacgaccagtctggattcgtgagtgccattcggcaggtcattactaccagaaagcaagcggtcggacccgggggagtgaactctggcccagtccaaatagttaataacaagtttttagcttggagcggcgtcatggagtggcaggaaccccgacctgagccgaattcccgttcaaaaaggtggctgcctagccacgtatacgtgaatcaaggcgaaatcttgcgaacggagcagtggccccgcaaactgtatatgcagcttataccacaacagctgctgactacgctggttccgctgtttcgtaattcccggctggttcagttccattttacaaaagacttggaaacccttaaatccctctgtcgaattatggataacggctttcgacggaaaagcagcttagcaagctcccctatgacacgcgccacgctcagtaccgccagcggcgtgagtttgcccaccagtagcaggagctgctctgggacttggtccagatcaaattcaaacgagggctggggggggagcggttaccctggcttggggccatcacggtctcaccgatag

SEQ ID NO: 108048 - DNA, 594 bp, Artificial Sequence
  Description of Artificial Sequence: Synthetic coding sequence
atgatgttccctcagagccgacacagtggctcctcccacctcccacagcagctcaagtttaccacctccgacagctgtgatcggatcaaggatgagtttcaactccttcaggctcagtaccactccctcaaacttgaatgcgataagctggcttccgagaaaagcgagatgcagcggcactacgtaatgtactatgagatgtcctacggactaaatatcgagatgcataaacaagctgagatcgtgaaaaggcttaatggcatttgtgcacaagtgctgccgtacctgtcccaggaacaccagcagcaggtgctcggggcgatcgagagggctaagcaagtgacagcccccgagctgaatagcataattcgacagcagcttcaggctcatcagctgtctcagttgcaggcattggctctgccacttacaccacttcccgtcggcctccagccaccctctctaccagccgtgtcagccggcacaggactactgagtctgtccgccttaggttcccaggctcatctgtctaaagaggataaaaatggccacgatggagatacacaccaggaagatgatggcgaaaaatctgactag

SEQ ID NO: 108049 - DNA, 1362 bp, Artificial Sequence
  Description of Artificial Sequence: Synthetic coding sequence
atgggtgtgctggggcgggtgctgttgtggctgcagctctgtgccctgacgcaagccgtatccaaattgtgggtgcccaacacagatttcgatgttgctgccaactggtcacagaatcgaacaccatgtgcgggaggagccgtggagtttcctgcggataaaatggtttctgtgctggtgcaggaaggacacgcggtcagtgatatgctgctccccctagacggggaactggtgctggcgagcggagccggattcggcgtttccgatgtgggcagccatttggactgtggcgccggagagccagccgtctttcgtgactctgataggttttcctggcatgatccacatctgtggaggtctggggatgaggctccgggactctttttcgtggacgcagagcgggtgccgtgtcgccatgatgacgtgttttttcctccatctgcgagctttagagtcgggttgggccccggagcctctccagtgagagtgagatctatatccgccctcggccgaactttcacccgcgacgaggatttggcagtcttcctcgcttcgcgcgcaggtcgcttgaggtttcacgggcccggcgccctgagcgtggggcccgaggactgcgcagacccctctggctgcgtgtgtggcaatgccgaggctcagccatggatatgcgccgccttgctgcagccgttgggaggtaggtgcccccaagcagcctgccactctgccctgagacctcaaggacagtgctgcgacctctgtggggctgtggtcctgctgacacatggccccgcctttgacctcgaaagataccgggcaagaattctggatacatttctaggtttaccccagtatcatgggctgcaggtcgctgtttctaaagtgcctcggagttctagactgcgcgaggccgacacagagattcaggttgtgctggtcgagaatggtcccgaaaccgggggtgcaggccgtctggccagggccctgctggccgacgttgcagagaacggcgaggcgctcggagtgttagaagccactatgcgggagagtggggcccacgtctgggggtcctcagccgctggcctggcaggcggcgtggcggcggctgtgctgctcgcgctgctcgtgttgctcgttgcaccacccttgttgagacgagccgggaggcttaggtggagacgccacgaggctgccgccccagctggcgccccactgggttttcgcaacccagtttttgacgtgaccgcgtcagaagagcttcctttgccaaggaggctgtctctcgtccccaaagcagccgccgactctacctcacactcctatttcgtcaaccctctgtttgccggagcagaggctgaagcatag

SEQ ID NO: 108050 - DNA, 1962 bp, Artificial Sequence
  Description of Artificial Sequence: Synthetic coding sequence
atggcagatattaagactggcatttttgctaagaatgtgcagaagcggctcaatcgcgcccaggagaaggtcctgcagaaactcggaaaggcggacgagactaaagacgagcaatttgaggaatacgtccagaactttaaacggcaggaggcggaaggcacgagacttcagcgggaactgagaggctacttagcggctatcaagggcatgcaagaagcttccatgaagctgaccgaatccctgcatgaggtgtacgagcctgattggtacggccgagaggacgttaaaatggtgggggagaagtgcgacgtgctctgggaagactttcaccagaagcttgtcgacggaagtctgttgacccttgacacgtaccttggtcagtttccggacattaagaacagaattgctaaaaggtctagaaagctcgttgattacgattccgcacggcatcacctggaggccctgcagtcctccaaaagaaaggatgagtctaggatatcaaaagctgaggaggaattccagaaagcgcagaaggtctttgaagaatttaacgtcgacctgcaggaagagttaccgtcattgtggagcagaagagtaggcttttatgtgaacacattcaagaacgttagctctcttgaggccaagtttcacaaagaaattgcagttctgtgtcacaagttgtatgaagtgatgacaaaactgggggatcagcatgccgataaagccttcacaatccagggcgccccctctgatagtggcccattgcggatcgccaaaaccccatcccccccagaggaaccttccccacttccctcgccaactgcttcccctaatcacacgctggctccagcctctcctgccccagcgagacctaggtctcctagccagacacggaaaggtcccccagtaccacccctgccgaaagtaacccccactaaagagctgcaacaggaaaatattatatcctttttcgaggacaatttcgttcctgaaattagcgtcactacaccctctcaaaatgaggtgcctgaggtgaagaaagaggaaacgctgctcgatctggactttgacccatttaagcccgaagtaacgcccgccggcagcgcgggcgtgacacatagcccaatgtcacaaacattgccctgggatctgtggactacctccacggatttagtccaaccagcctccggggggagctttaatgggttcacgcagccacaggatacatcgctgtttacaatgcagaccgatcagtcaatgatctgcaatctaattatccctggagcagacgctgatgccgccgtcggcacgctcgtctcagcggctgagggggccccgggcgaagaagctgaggctgagaaagccaccgtccccgccggcgaaggcgtcagcctcgaagaggccaagataggaaccgaaacgacggaaggagccgaatcagcacagcctgaggccgaagagctggaagctacagtgccacaagagaaggtcatcccttctgtggtgattgagcccgccagtaaccatgaggaggaaggagaaaatgaaatcaccatcggcgccgaacctaaagagacaactgaggacgcagctccaccaggcccgaccagtgaaactcccgaactcgcaacggaacaaaaacccatccaggatcctcagcctactccctccgctccagcgatgggtgctgccgatcagctagccagtgcacgggaggcatctcaggagctgcctcctggttttttatacaaagtcgagactttgcacgattttgaggcagccaattctgacgagctgaccttacaacgcggcgatgtagtgctcgtggtgcccagtgactccgaggcagatcaagacgccggctggctcgtaggcgttaaagaatcagattggctgcaataccgcgatctggccacatacaaaggcctgttccctgaaaacttcactcgacgacttgactag

SEQ ID NO: 108051 - DNA, 1794 bp, Artificial Sequence
  Description of Artificial Sequence: Synthetic coding sequence
atgacaaagctgggcgatcagcacgccgacaaagcatttaccatacagggggccccatcagatagtggccctctgcgtattgctaagaccccatctcctcccgaagagccttcccctctcccatcaccgacagcgtcgcccaatcataccctggcgccagcatccccggcacctgcacgtccacgatcgccatctcaaactcggaaggggccacctgtgcccccgctccccaaggtcacacctactaaggagctgcagcaggaaaatatcatctcgttcttcgaggacaattttgtgcctgaaatttctgtgactaccccttctcaaaatgaggtccccgaagtgaagaaagaggaaacgcttctcgaccttgacttcgaccctttcaaacccgaggtgacacctgccggatccgcaggtgtcacacactccccaatgtcacaaaccctcccatgggatctgtggactactcatacattcaatgacgacatcactgattctagtgagagtctgagcttatgcaacctcattatggaggagaccccagattccggcttagctgaggaaatccagaggtctcagaacgatattggtgccttcacttggggtccggatgcttccactgatcgggtaagccaggaagtcactagcggcgggtttggtgaggattccgcttgtccctccgaaactgagcaggacatccgtctgagtacatctcttctctctagcgccgactggccaacagttgcagaagagtctgagcatgctcctggcccagcattccctggcggcaacgagcaactgcctcccaaaccagcccctgaggcgggagtggctatcgctgcatgtgtcgagatggagcagctgtatgatccgctcgatagtgacatgccagcaatggacacagccggcctgttcaaggaaagccacgaagatatgaaaaaatctgacgaggaggaggagaagcaaaaaatggaggatagcctgtgggccggagtagaagcctgtcaaaaagcctctggtggtagcttcaacggctttacccagccgcaggatacctccctgttcactatgcagactgatcaaagtatgatttgcaacctcattattccaggcgcggacgctgacgctgcagtgggaaccctcgtctcggccgccgagggggcccccggagaggaggccgaagcagaaaaagctaccgtgcctgcaggtgagggggtgtccctggaagaagcaaagattggcaccgagaccaccgagggggccgagtcagcccagcccgaggctgaagagttggaggctactgtccctcaggaaaaggtgataccttccgtggtcatcgagcctgcctcaaatcatgaggaagaaggagaaaacgagatcacaatcggggcggagccaaaagagacaaccgaggacgccgcccctccagggcctacatctgaaacaccggagctggctaccgagcaaaagcccatccaggatccccagccaacaccaagcgctcccgccatgggagcagccgatcagctggctagcgcaagggaggccagccaagaactccccccagggtttctctacaaggtggaaaccctgcatgatttcgaagccgctaattcagatgaactgacactccagagaggggatgtggtgctggtggtgccttccgactccgaagcagaccaagatgccggctggctggtaggcgtcaaggaatctgattggcttcagtatagggatttggccacttataaggggctcttcccggagaattttactcggaggttggactag

SEQ ID NO: 108052 - DNA, 2088 bp, Artificial Sequence
  Description of Artificial Sequence: Synthetic coding sequence
atggccgacataaagactggcatctttgccaagaatgtgcaaaagcgactgaatagagcccaggagaaagtgctacagaaactggggaaagctgacgaaacaaaggacgagcagttcgaggaatacgtgcaaaacttcaagcggcaggaagctgaaggaacacgactccaacgcgaactgcgaggatatctcgcagccatcaagggcatgcaagaggccagcatgaagcttaccgagtctctgcacgaggtttatgaaccggattggtatggccgtgaggacgtgaaaatggtgggagaaaagtgcgatgtcctttgggaggactttcatcaaaaactagtagatggctctttactcacattagacacctacctagggcagtttccggatatcaaaaaccggatcgctaagcggtcacgtaagttggtggattatgactccgctcgacaccacctggaggcactgcagagctcaaaaaggaaggacgagagccgaatctcaaaagcagaggaggagttccagaaggctcagaaagtgtttgaggagtttaacgtcgatctgcaggaggagctcccaagtttatggtcacggcgcgtggggttctatgttaatacctttaaaaacgtgagttccctcgaagctaagttccataaagagatagcggtgctgtgtcacaagctttatgaggtcatgacaaaactaggagaccagcacgctgacaaagctttcacgatccagggtgcccccagtgacagcggtcctttgaggattgcaaaaactccttccccacccgaggagccatctcccctgccgagccccaccgctagccccaaccataccctggcacctgctagccctgcccccgcccggcctagaagtccctcgcagacccggaaaggccctcccgttccccctttgcccaaggtgactccaaccaaggaactgcagcaggagaatattatctcattttttgaggataacttcgtgccggagataagcgtgactacaccctctcagaatgaagtgccagaagtgaaaaaggaggagactttgttggacctcgacttcgatcctttcaaaccagaggtaaccccagcaggaagcgccggggtaactcactcgcccatgtcccagaccttaccatgggatctgtggactacatcaacagatctggtacagccagcatccgggggcagctttaacggttttacgcagccccaggacacaagcctgtttacaatgcagacagaccagagcatgatttgtaatctagcggagtcggaacaggcaccccctaccgagccaaaagccgaagagcctctggctgctgtgacgcccgcggttgggctggacctgggtatggacactagagccgaggaacccgttgaggaggccgtgattatccctggtgcagatgctgatgcagcggttggcactttggtctccgctgccgagggtgcaccgggcgaagaagctgaggccgagaaggccacggttcccgccggtgagggcgtttccttagaggaggcgaaaataggaaccgagacaacagagggggcagagtctgcccagccagaggccgaagagctggaagcgaccgtgccccaagagaaggtcatcccatctgttgtgatagagcctgcctcaaatcacgaggaggagggagagaacgagataaccatcggtgccgagcctaaggaaactacggaggatgccgcacctcccggacccaccagtgaaacgcccgaactcgcaactgaacagaagccaatccaggacccacagcccacacccagtgctccagccatgggggccgcagaccagctggcgtcagcccgggaagcctcccaggaactgcctcccgggttcctctacaaggtggagacccttcacgacttcgaagccgccaactccgacgagttgacgcttcagagaggagacgtagtcctggtcgtccccagcgactctgaggcagaccaggatgcgggatggctcgttggcgttaaagaaagtgactggctccagtaccgagatctcgcgacctacaaaggtctttttccagagaacttcactcggcggctcgactag

SEQ ID NO: 108053 - DNA, 591 bp, Artificial Sequence
  Description of Artificial Sequence: Synthetic coding sequence
atggaagaaacccctgactctggattggcagaagagatccagcgaagtcagaatgacattggagctttcacttgggggccagatgcatccactgatagagttagccaggaagtcacttctggcggctttggggaagattctgcctgtccctcagaaaccgaacaggatatcagactcagcacttccttgctctcatccgctgactggccaaccgtcgccgaggaatctgaacatgcacctggccccgcatttcccggcggaaacgaacagctaccccccaaaccagcgccagaggcaggggtggctatcgccgcttgcgtcgaaatggagcaactctacgacccgctggacagtgacatgccagcaatggacaccgccggcctgttcaaggagtcccacgaagacatgaagaagagcgatgaagaagaggaaaaacagaagatggaggattccctttgggccggagttgaggcgtgtcaaaaagcttctggaggcagctttaacggatttacccagccacaggatacgtctctgtttacaatgcagactgatcagagtatgatctgtaacctggaaatcacagttaactag

SEQ ID NO: 108054 - DNA, 1962 bp, Artificial Sequence
  Description of Artificial Sequence: Synthetic coding sequence
atggcagacatcaagaccggcatattcgctaagaacgtgcagaagagactcaaccgtgcacaggaaaaggtgctgcagaagctgggtaaggctgacgagaccaaagatgaacagtttgaggaatatgtgcaaaattttaaacggcaggaggctgagggcacccgtctccagagagagctccgcggctaccttgcggccatcaaagggatgcaggaagccagtatgaaattgaccgagtcattacacgaggtttatgaacccgactggtacggtcgcgaagacgttaaaatggtgggtgagaagtgcgatgtactgtgggaagattttcatcagaagctggtggacggatctttactcacattggacacatatcttggtcagttccccgacatcaagaaccgaatcgccaagagaagcaggaagctggttgactacgattcagccaggcaccacctcgaggcccttcagtctagcaagcggaaggatgagagccgaattagtaaggctgaagaggaattccaaaaggcccagaaggtttttgaggagttcaacgtcgacctgcaagaggaactgccatccctatggtcccggagagttggcttctacgtgaatacattcaaaaatgtgtccagcttggaagctaagttccataaggaaatagctgtcctgtgccataagctttacgaggttatgactaaactgggagatcaacacgccgacaaagcatttacgatacagggagcaccctctgactcgggcccccttagaattgccaaaactccttccccacccgaggagcctagtcccctgccatcaccaacggcaagccccaatcatacgttagctcccgcatctccagccccagcgcggccaaggagtccctctcagacacgcaaaggaccacctgttccacccctgccaaaggtaacccccaccaaggaactgcagcaggagaatattattagcttcttcgaggataatttcgtcccagaaatctcagtgacaaccccgagccagaacgaagtccctgaggtgaagaaggaggagactctgctggatttggactttgatcccttcaaaccagaggtcacaccggcaggttcagcaggagtcacgcactcgccaatgagccaaacacttccgtgggacctgtggaccgccggtgtggaggcctgtcagaaagcttcaggaggaagctttaatggattcacgcagcctcaggatacctccttgttcactatgcagaccgatcagagcatgatttgcaacttgattattccgggggctgacgctgacgccgcggtgggtaccctggtgtctgctgcagaaggggctccaggcgaggaggccgaggctgaaaaagctaccgtccctgctggagaaggggtcagcctcgaggaggcaaagatcgggacagaaacgaccgaaggagctgagagcgcccagccggaggcggaggagctggaggctacagtgccacaggagaaggtgatccccagcgtggttatcgagccagcgtccaatcatgaagaagagggcgagaatgaaattactattggtgctgaacccaaggagacaaccgaggatgccgcaccacccgggcccaccagtgaaacacccgaactggccaccgagcagaaacccatccaagatcctcaaccgactcccagcgcccccgcaatgggtgccgctgatcaactggcttccgctagggaggcaagtcaggaattgccaccgggatttctctataaggtggagacccttcacgatttcgaagccgccaacagcgacgaattaacactccagcgcggcgatgttgtgttagtggttcctagcgactccgaagcagatcaggacgccgggtggcttgttggagtgaaggagagcgactggctgcagtatagagatctcgcaacatataaagggctttttcctgagaacttcacccggcgacttgactag

SEQ ID NO: 108055 - DNA, 1158 bp, Artificial Sequence
  Description of Artificial Sequence: Synthetic coding sequence
atggccgatataaagactgggatcttcgccaagaacgtgcagaagcgtctgaacagagctcaggaaaaggtgctgcagaagttgggtaaggcagacgaaacaaaggacgagcaattcgaggaatacgtccagaatttcaaaagacaggaagccgagggaaccagactgcagagagagctgcgtggatacctggcggccattaaagggatgcaggaagcctcaatgaagcttacagagtctttgcacgaagtttatgagccggattggtatggacgcgaggatgtgaagatggtcggagagaagtgtgatgtgctatgggaagactttcatcagaaactggtggacggctcattgttgaccctggatacatacctgggacagtttcctgacatcaaaaatcgtattgccaagagaagcagaaagctggtcgactacgatagtgccagacatcacctagaggcactgcagtcatccaaaagaaaagacgagagccgaataagcaaagccgaagaggaattccagaaggcccagaaggtgtttgaggagtttaacgtggacctgcaggaagaactgcccagcctatggtctagaagagttggcttctacgtaaatacattcaaaaacgtgagtagcctcgaggcgaagtttcataaggagatagctgtgctgtgccacaagctgtacgaagtgatgactaagttgggagatcaacacgcagacaaagcctttactatccaaggtgcccccaggcagtacctggacagcggtccactgagaatcgccaaaaccccttcacctcccgaagaacctagcccccttcctagtcccaccgcgtcccctaaccatacactggctcccgccagtcctgcacctgcacgcccacgctcacctagccagactaggaaagggcctcccgtgccgccccttccaaaggtgactcctactaaggagctacagcaggagaacattatttcattctttgaagataatttcgttcccgaaattagcgtgaccacacccagccagaacgaggtccccgaggtgaagaaagaagagactctgctcgatctggactttgatcccttcaagccggaggtgactcccgcaggaagtgcaggagtgactcactcaccaatgtctcagacggtgggatggtag

SEQ ID NO: 108056 - DNA, 759 bp, Artificial Sequence
  Description of Artificial Sequence: Synthetic coding sequence
atgcgcgcccccctgcttcccccagctccagttgtccttagcttgctcattctgggaagtggacactacgccgccgggctcgacctgaacgacacctatagcggaaaacgagagcccttttcaggcgatcactccgcagatggcttcgaggtgacaagccgcagcgaaatgtcaagcgggtcggaaatctcccctgttagcgagatgccgagctcatctgaaccctcgtcaggcgctgactatgactattccgaggaatatgacaatgaaccccagatccccggatacattgttgacgattcagttcgggttgaacaggtcgtgaagccgcctcagaataaaactgagagcgaaaatacatcagataaacctaagcggaaaaagaaggggggcaaaaacggcaagaatcggaggaatcgaaagaagaagaacccatgtaatgccgagtttcagaatttctgcatccacggagagtgcaagtatattgagcatctcgaggccgtcacttgtaagtgccaacaggaatatttcggagaaaggtgtggcgagaaaagcatgaagacccatagcatgatcgactcttccctgtctaagatcgccctggctgccatcgctgccttcatgtcagccgtgatcctaacggcagttgccgtcattacagtccagctgagacgccagtatgtcagaaaatatgaaggcgaggcagaagaaagaaaaaagctccgccaggaaaacggcaacgtccatgcaatagcttag

SEQ ID NO: 108057 - DNA, 759 bp, Artificial Sequence
  Description of Artificial Sequence: Synthetic coding sequence
atgagagcgcctcttttgccaccagcacctgttgtgttgagcctcctcatcctcggatctggacattatgctgcagggcttgatctcaacgacacatactcggggaagcgtgagccgtttagcggggatcactctgctgacggcttcgaggtgacctcgcggagcgaaatgtcaagcgggtccgaaatatctccggtcagtgagatgcctagctcgagcgaacctagtagcggcgccgattacgactattctgaggagtatgacaacgagcctcagatccccggatacatcgttgacgatagtgtacgagtggagcaggtcgtgaagcccccccagaacaagacagaaagcgagaatacctctgacaaaccaaagaggaaaaagaaaggtggtaaaaatgggaagaacaggaggaatcgcaaaaaaaagaatccctgtaatgcagagtttcagaatttctgcatccacggcgagtgtaagtatatagaacacctagaagctgtcacatgtaagtgccaacaagaatacttcggcgagcgatgcggagaaaaaagcatgaagacacactcaatgatcgattccagcttgagtaaaattgctctcgcagctatagccgcattcatgtccgccgtaatccttacagcagttgccgtgattaccgtgcagctgcgaaggcagtacgtcagaaagtacgagggagaggcggaagagcggaaaaagctcaggcaggaaaacgggaatgtgcatgccattgcctag

SEQ ID NO: 108058 - DNA, 1536 bp, Artificial Sequence
  Description of Artificial Sequence: Synthetic coding sequence
atgaaactcttctggctgctgtttacaataggattttgttgggcgcagtacagcagtaatacacaacaaggccgtacctccattgtgcacctcttcgagtggcgctgggtggacattgcattagagtgtgagcgttatctagcaccaaagggcttcggaggcgtgcaggtaagtccaccaaatgaaaacgtggccatccacaacccatttagaccttggtgggagcgttatcagcccgtatcctacaaactctgtactagaagcggcaacgaggatgaatttcgaaacatggttacaaggtgcaataacgtcggggtgagaatatacgttgatgcagtcataaaccatatgtgtggcaacgctgtatcagctggtacatctagcacctgcggcagctacttcaatcctggtagccgggattttccggccgtgccctattccggttgggactttaacgatggtaaatgtaagactggttctggggacatcgagaattataatgatgccacgcaggtgagggattgtcggctatctggactgctcgatctggcattgggtaaggattacgtgcgctcaaagatcgcagaatacatgaaccatcttatcgatattggcgtggctggcttccgtatcgatgctagcaaacacatgtggcctggtgatatcaaggctatcctggataaactacataatctaaacagtaactggtttcctgaggggtccaagccattcatataccaggaggtaatagacctgggtggggagccaattaagtcctctgactactttggcaacgggagggtgaccgagtttaagtatggtgccaagctcggcacagttattcgaaagtggaatggtgagaaaatgagctatttgaaaaactggggtgaaggctgggggttcatgcccagcgaccgcgccctggtgttcgtcgacaaccatgacaatcagcgtggacatggagcagggggcgcatccattcttactttctgggacgccaggctgtacaagatggctgtcggcttcatgttggcacacccttacggttttactcgcgtgatgagtagttaccgctggcctcgttacttcgaaaatggaaaggatgtgaacgactgggttggaccgccaaatgacaatggagtgactaaggaggtaaccatcaatccagatacgacttgcgggaatgactgggtctgcgaacacaggtggcgtcagatacgaaatatggtaaatttccgcaatgtagtcgatggacagccatttaccaattggtacgacaatggtagcaaccaggtggcatttggccggggcaaccgtgggtttatcgtgttcaacaatgacgactggactttttccctcacactacagactggtttacccgctggcacgtactgtgacgttatctccggtgacaagatcaatggaaactgcaccgggatcaagatatatgtatccgacgacgggaaagctcatttctcaatctccaactctgcagaagatccctttattgcgatccatgcggagagtaaattgtag

SEQ ID NO: 108059 - DNA, 318 bp, Artificial Sequence
  Description of Artificial Sequence: Synthetic coding sequence
atgaagctgttttggcttttgttcactatcgggttctgctgggctcagtacagctcaaacacccaacaggggagaacaagtatcgtgcatctgtttgaatggaggtgggtggacattgcactggagtgtgaaagatacctggcacccaaaggtttcggaggagtgcaggttagcccccctaatgagaatgtggccatccacaacccattccggccttggtgggaaagataccagcctgtatcatacaagctgtgcacacgaagtggaaacgaagacgagtttaggaatatggtgacccgatgcaataatgtgggatag

SEQ ID NO: 108060 - DNA, 681 bp, Artificial Sequence
  Description of Artificial Sequence: Synthetic coding sequence
atgaaactcttctggctgcttttcactattggattctgctgggctcaatacagctctaacacacaacagggtcggacgagcattgtgcacctgttcgaatggaggtgggtagacatagcgttggagtgtgaacgctacctcgcccccaaaggcttcggcggcgtacaggtgagccctcccaacgagaacgtcgccatacacaatccatttcgcccgtggtgggagcggtatcagccagtgtcatacaaactgtgtactcgatcaggcaacgaagatgagttcagaaatatggtaactcgatgtaacaacgtgggagttcgcatctacgtggatgctgtcattaaccacatgtgcgggaatgctgtgtcggccggaaccagctcaacatgtgggtcctactttaaccccggcagcagggatttccctgctgtaccttattcagggtgggactttaacgacggaaagtgcaagacaggttcaggcgatatcgaaaattacaacgatgccacacaggttcgagattgtagactgagcggtctcctggacttggccctgggcaaagattatgtgcgctctaaaatcgctgagtacatgaaccatcttatcgatatcggcgtagccggctttaggatagatgcctcgaaacacatgtggcccggcgacatcaaagctatcctctag

SEQ ID NO: 108061 - DNA, 1536 bp, Artificial Sequence
  Description of Artificial Sequence: Synthetic coding sequence
atgaaactgttttggttgcttttcacaatcggcttctgctgggcgcaatattcaagtaatacacaacaagggcgaacttccatcgtacatctcttcgaatggaggtgggttgacattgcgctggagtgcgaaagatacttggccccaaaaggctttgggggtgtgcaggtgtctccaccaaatgaaaacgtggccatccacaaccctttcaggccttggtgggagaggtatcagcccgtctcctataagctgtgtaccaggtcaggcaacgaagacgagttccgtaatatggtgaccaggtgtaacaatgtgggggttcgcatctatgtggatgcggtcatcaaccacatgtgtgggaatgccgtgagcgctgggacctctagcacttgcggaagctactttaaccctgggtctagagactttcctgccgtcccttatagcggatgggacttcaacgacggcaagtgcaaaactggcagcggcgatatcgaaaattacaacgatgcaacccaggtgcgagactgtagactatcgggcctgctcgatctcgccctgggcaaagactatgtgaggagcaaaatcgccgaatatatgaatcacctgattgatataggcgtcgcaggatttagaatcgatgcttctaaacacatgtggcctggggacatcaaagctatcctggacaagttacataacctcaattctaactggttccctgagggctccaagccttttatttatcaggaggtcatcgaccttggcggagagccgatcaaatcatcagattatttcgggaacggcagagtcactgagttcaaatacggcgcaaaactgggaaccgtgatccgtaagtggaatggagaaaaaatgagctacctcaagaactggggagagggctggggattcatgccaagcgatcgggcactggtgttcgtggacaatcatgacaatcagagggggcatggcgccggaggagccagcatcctaactttctgggatgccaggctctataagatggccgtcggcttcatgctggcccatccctacgggtttacccgcgtaatgagcagctaccgctggcccagatacttcgagaatggaaaagatgtgaatgactgggtggggccacccaacgataatggggtcactaaagaggtaacgataaaccctgacacgacgtgcggaaacgattgggtgtgtgagcacagatggcgacaaatacgaaatatggtgaatttccgaaatgtagtggacgggcagccattcactaattggtacgacaacgggtctaaccaggtcgcatttggcaggggaaaccggggcttcatcgtgttcaacaatgatgactggacctttagtttaactctacagacggggttgcctgctggaacttactgcgacgtgatcagcggcgacaaaataaacggaaactgtaccggcatcaagatctatgtgtcggatgatggcaaagcacactttagcatcagcaacagtgcagaggaccccttcattgccatacatgccgagtctaaattgtag

SEQ ID NO: 108062 - DNA, 1536 bp, Artificial Sequence
  Description of Artificial Sequence: Synthetic coding sequence
atgaagctgttctggctcctctttactatagggttctgctgggctcaatactcctccaacactcaacagggccggacatccatcgtgcatcttttcgagtggaggtgggtggatatcgctcttgagtgtgaacgctatttagcacccaaaggtttcgggggcgtacaggtaagcccgcccaacgaaaacgtcgctatacacaacccattcagaccttggtgggagcgttaccagcccgtgtcatacaagctgtgcacgagatcggggaatgaagacgaattccgcaatatggtcacccgctgcaacaatgtaggagtgcgcatttatgtggacgctgtaatcaaccacatgtgtggaaatgctgtctccgctggaacctctagcacatgcggctcatattttaacccagggtccagagactttcccgcagttccttattccggttgggacttcaacgatggtaagtgcaaaacaggctccggtgacatcgagaactacaacgacgcaacccaagttagagattgccggctctctggtctgctagatctggccctcgggaaggattacgtgagaagtaaaatcgccgagtacatgaatcatttgatcgacattggtgttgcaggcttccggattgacgcttccaagcacatgtggcccggagatattaaggcaattttggataagttgcataatttaaacagcaactggttccccgagggttccaagccattcatctaccaagaggttatagatctgggcggagagccgatcaaaagctctgactatttcggaaacggacgggttacagagttcaagtatggagccaagcttggaacagtgatccgcaagtggaacggtgagaagatgagttacctgaaaaattggggggagggctggggctttatgccgtcagatagggctctggtgtttgtggataatcatgacaatcaaagagggcatggggcgggaggggcaagtatcctcaccttttgggacgctaggctttataagatggccgttgggtttatgttagcacacccttacgggtttaccagagtgatgtcatcttacaggtggcctcggtattttgagaacggtaaagacgtgaacgactgggttggccccccaaatgataacggagtgacaaaagaggtgacaatcaacccggacacgacctgcggaaatgactgggtttgtgaacaccgctggagacaaattcgcaacatggtcaacttcagaaatgtggttgatggacagccctttacaaactggtacgataacggcagcaaccaagtggccttcggacggggcaatagaggcttcatagtgtttaataacgatgactggaccttcagcctgacactgcagactgggcttcccgctgggacgtactgtgatgtgatctctggcgataagataaacggcaattgcacggggataaaaatctatgttagtgatgacggcaaggcccatttttctatctcaaattccgccgaggatcccttcattgcgatccatgctgagtccaagctgtag

SEQ ID NO: 108063 - DNA, 318 bp, Artificial Sequence
  Description of Artificial Sequence: Synthetic coding sequence
atgaagctgttttggcttctatttacaatcggattctgttgggcacagtactcttccaatactcagcagggtcgcacatcaatagtgcaccttttcgaatggcggtgggtggatatcgcactagaatgcgagcgctatcttgccccgaagggatttggtggggtgcaggttagcccccctaacgaaaacgtcgcgattcataacccttttaggccctggtgggaacggtatcagcccgtgagttataagctgtgcacccggagcgggaacgaagatgagtttcggaacatggtaacccggtgcaacaacgtgggctag

SEQ ID NO: 108064 - DNA, 681 bp, Artificial Sequence
  Description of Artificial Sequence: Synthetic coding sequence
atgaagctgttttggctgctctttacaattggcttctgttgggcccagtactcctctaatacgcagcaagggcggaccagcattgtgcacttattcgaatggcgctgggtcgacattgccttggagtgtgaacgctacctcgcccccaaaggttttggaggcgttcaagtctcaccccccaacgaaaatgtcgctatccataatcccttcagaccctggtgggagaggtatcagcccgtgagttataagctgtgcacccgctcaggcaacgaagatgaatttcggaatatggtgactagatgtaacaatgtcggagttcgtatctatgttgatgccgtcatcaaccacatgtgcggtaacgcagtatcggccgggacttctagcacttgcggatcctactttaaccccgggtcgcgagattttcccgccgtgccctatagtggatgggacttcaacgatggaaagtgcaaaacgggaagcggggacattgagaactataacgacgccactcaggtcagagactgtcggttgtctggtctgctcgacctcgcacttggcaaggactacgttaggtctaaaattgccgagtatatgaatcatctgattgacattggcgtcgctggattccggattgatgcctccaagcacatgtggccaggggacattaaggcaatcctctag

SEQ ID NO: 108065 - DNA, 1536 bp, Artificial Sequence
  Description of Artificial Sequence: Synthetic coding sequence
atgaagctcttctggcttctttttaccataggcttttgctgggcgcagtacagtagtaacacacagcagggccgtacaagtattgtgcacctcttcgagtggaggtgggtcgacatcgctctggagtgtgaacggtatcttgccccgaagggttttggaggcgttcaggtgtcccctccgaacgaaaatgttgcgatccacaatcctttcaggccatggtgggagagataccagcccgttagttacaaactctgcacacgtagcggcaatgaggacgagttccgtaatatggtgacgcggtgcaataatgtaggcgttcgcatttacgtggacgcagtgattaaccatatgtgtggcaacgctgtatctgccggaacctcctcaacatgcggatcctatttcaatccagggagtcgggacttccccgcagttccatatagcggatgggacttcaacgatggcaagtgtaaaacagggtccggggatatcgaaaactacaatgacgcaacccaagtgagagactgcagactgagcggtttgctggatctagcccttgggaaggactacgtccgttcaaagatagccgagtacatgaaccaccttatcgacatcggtgttgccgggttccgaatcgatgcctcaaaacacatgtggcctggcgatataaaagctattctcgacaagctgcacaatcttaatagcaattggttcccagagggctccaagccgtttatctatcaggaagttattgatttggggggagagccaatcaagtccagtgactacttcgggaatggtcgcgtgaccgagttcaaatacggagccaaactgggtacggttatcagaaaatggaacggggaaaagatgtcctatctgaaaaattggggcgaaggttggggttttatgccgtctgatagggcactcgtgttcgtggataatcacgataaccaaagaggccatggcgcaggaggggccagtatactgacgttctgggacgcaagactgtacaagatggcagtaggtttcatgctggctcatccatacggctttacacgggtcatgtcctcctataggtggcccaggtattttgagaatgggaaagatgtgaatgactgggttggcccaccaaacgataacggggttaccaaagaagtaacgatcaatcccgacacaacctgtgggaacgactgggtgtgtgagcaccgatggcggcaaatcaggaatatggtgaacttcaggaacgtggtagacggtcagcccttcacaaactggtacgacaacggtagtaaccaagtcgcatttggcaggggcaaccgggggttcatagtcttcaataacgacgactggacattcagcctaactctgcaaaccggtctgcctgctggaacctattgcgatgtgatttctggcgacaaaataaacgggaattgtaccggcataaagatctatgtgagtgatgatggcaaagcacactttagtatttcgaattccgccgaggatccttttattgccatccacgctgagagtaagctatag

SEQ ID NO: 108066 - DNA, 1536 bp, Artificial Sequence
  Description of Artificial Sequence: Synthetic coding sequence
atgaaattcttcctgcttttattcacaattggcttctgttgggctcaatattctcctaatactcagcaggggcggacgagtatcgtacacctgttcgagtggcgatgggtggacattgccctagagtgcgagcggtacctggcccctaaaggatttgggggggttcaggtgagtcctcccaacgagaatgtggccatatataacccctttcggccatggtgggaacgttatcagcccgtgagctacaaattgtgtactcgctccggaaacgaggatgaatttcggaatatggtgacacgttgcaacaacgtcggcgtacgtatttacgttgacgcagttatcaaccacatgtgcgggaacgccgtgtccgcaggcacctcttcaacctgcggatcttatttcaatcctgggagccgtgatttccccgccgtgccatacagtggctgggattttaatgacggcaagtgcaaaaccggatctggtgatatcgagaattacaacgatgcaactcaggtgagagactgcaggctgacaggcctcctcgacctggctcttgagaaggattacgttcgaagcaagatagccgaatatatgaatcacctgattgatatcggcgttgcagggttcaggttggacgcctctaagcatatgtggcctggcgatattaaggcgattctggacaaactgcataatctgaacagcaactggttccccgccgggtccaaacccttcatctatcaggaggtgattgatctgggaggcgaaccaatcaagagcagcgactactttgggaatggccgagtgacagagttcaagtacggagctaaactgggtaccgtaatccgtaaatggaacggggaaaagatgagctacctgaagaattggggcgagggctggggcttcgtcccatccgaccgcgccttggtttttgtggacaatcatgacaaccagcgcggccatggtgcgggaggcgctagcatcctgactttttgggacgcacgtctctataaaatggcagtgggcttcatgctagctcatccctacggatttactcgagtgatgagttcataccggtggccccggcagttccagaatgggaacgatgtgaacgactgggtgggccctcctaacaataacggagttatcaaagaggtcacaatcaatccagatactacgtgcgggaacgactgggtgtgtgaacataggtggcggcaaatcagaaatatggtaatcttccgcaacgtagtcgacggacagccattcactaactggtatgacaacggctcgaaccaggttgcattcggacgagggaatcggggcttcatcgtattcaataatgacgattggagtttctcattgacactccaaaccggccttcctgcaggcacatattgcgacgtgatctcaggggataagataaatggaaactgcaccggtatcaagatttacgttagcgatgacggaaaggcccacttctccatctccaatagtgccgaagaccccttcatcgctatccacgccgagagcaaactgtag

SEQ ID NO: 108067 - DNA, 1536 bp, Artificial Sequence
  Description of Artificial Sequence: Synthetic coding sequence
atgaagttctttctcctgctattcacaataggtttctgctgggctcagtactcacctaatactcagcaggggagaacctctatcgtgcacttgtttgagtggaggtgggttgacatcgctctggaatgtgagcggtacttggcaccaaagggctttggcggggttcaggtgtctccacccaacgaaaacgtggcaatccacaatccgtttcgcccttggtgggagagataccaacctgtctcctataagttgtgcactagatcgggcaatgaagacgagttccgaaacatggtgaccaggtgcaacaatgttggcgtcagaatttatgtggatgcagtaatcaaccacatgagcgggaatgccgtatcggccggaacctcatctacgtgtgggagttattttaatccgggtagcagggacttccccgccgtcccatacagcgggtgggatttcaacgatggcaaatgtaaaactgggtccggagacattgagaattataacgacgccacccaagtgcgagattgtagactggtgggattgctagacctggcgctggaaaaggattacgtgagaagtaaaattgccgaatatatgaatcatctaatcgacatcggcgtcgccggcttcaggttggacgcttccaaacacatgtggccaggtgatatcaaggcgatcctggataaacttcacaaccttaacagtaactggtttcccgctgggagcaagccctttatttatcaggaggtgattgacctcggaggtgagccaatcaaatcctctgattattttggtaatggcagagtgacggaattcaagtacggagctaagctggggactgtgattagaaagtggaacggcgagaaaatgagctatctgaagaactggggagaaggttggggatttatgccctcggacagggccctggttttcgtcgacaaccacgataaccagcgcggccatggagccggaggagcttctattctcactttttgggacgcccggctgtataaaatggcagtcgggttcatgctggcccacccatacggctttacaagagtaatgagcagctatcgatggccaagacagttccagaatggcaacgacgtgaacgactgggtgggcccacccaacaataacggtgtcattaaagaggtgacaatcaaccctgacacaacgtgcggtaatgattgggtgtgcgaacataggtggagacagatcaggaacatggttaatttccgtaatgtggtagacggacagccatttacgaattggtacgacaacggctctaatcaggtcgcctttggaagaggaaatagggggttcattgtctttaacaacgacgactggacttttagtctgaccctccagacaggcctgcctgcgggaacgtactgtgacgtcatttccggagataagattaacggcaattgtacaggcattaagatttacgtgagcgacgatggtaaggcccacttctccattagcaacagcgcagaagacccctttattgccatccatgcggaaagcaagctgtag

SEQ ID NO: 108068 - DNA, 291 bp, Artificial Sequence
  Description of Artificial Sequence: Synthetic coding sequence
atgaaattcttccttttgcttttcactataggattttgctgggctcagtacagccctaatacacagcaggggaggacaagcatcgttcatctctttgagtggaggtgggtagatatagccctggaatgtgagcgctacctcgcaccaaagggcttcggtggcgtgcaagttagccccccgaacgaaaatgtcgccatacacaatccattcaggccatggtgggaaaggtaccagcctgtgagctacaagttgtgcaccagatctggcaacgaagatgagttcaggaactag

SEQ ID NO: 108069 - DNA, 261 bp, Artificial Sequence
  Description of Artificial Sequence: Synthetic coding sequence
atgaagttttttttactgctgttcacaattgggttctgctgggctcagtatagccctaacacacagcaggggcggacttctatagtgcacctttttgaatggcggtgggtcgacattgccctcgagtgcgaaagatacttggcacccaagggctttggcggggtgcaagtgtctcccccaaacgaaaacgtcgccatccacaacccgtttcgtccctggtgggagagatatcagcccgtgtcttacaaactatgtacctag

SEQ ID NO: 108070 - DNA, 2313 bp, Artificial Sequence
  Description of Artificial Sequence: Synthetic coding sequence
atgcttccaggtcttgccctgctcttgctggcggcctggactgccagagccctggaagtcccaacagacggtaatgctgggctcctcgcagagcctcagatagccatgttttgcggacgactcaacatgcatatgaatgttcagaatggcaaatgggactccgacccaagtggaaccaagacatgtatcgatacaaaggagggaatactccagtattgccaggaagtctatcctgagctgcagatcacaaatgtagttgaggcgaatcagccagtcacgattcagaactggtgcaagcggggaagaaagcagtgcaagactcatccccattttgttattccatatcgctgccttgtcggtgagtttgtgagcgatgccttgttagtgcctgacaagtgtaagttcctgcaccaagagaggatggacgtttgtgaaacacatctgcattggcacaccgttgctaaggaaacctgtagtgagaagtcaacaaaccttcatgactacggtatgctcctcccatgtgggatcgacaaatttaggggagttgagtttgtgtgctgtccgctggccgaggagtctgataacgtcgattcagcagatgcagaagaggacgactctgacgtgtggtggggtggcgccgatactgattacgccgacggatctgaggataaggtggttgaggttgccgaagaagaagaggtagccgaagttgaagaagaggaggccgacgacgacgaggacgacgaagacggggacgaggtggaagaggaggcagaagagccttacgaggaagcgaccgagcgaaccacatctatcgcaacaaccacgaccaccaccacagaatcggtagaggaagtcgttagagaagtgtgttctgaacaggcagaaacggggccttgtcgcgccatgatctcccgttggtatttcgacgttactgagggtaagtgcgctccatttttttacgggggctgcggggggaatcggaacaatttcgataccgaggaatactgtatggctgtgtgcggctctgcaatgtcacaaagccttctgaaaacaacccaagaaccactggctcgcgatcctgtgaaattgccaaccaccgctgcaagcactcccgatgccgtggacaagtacctggaaactcccggggatgagaacgagcacgcccactttcagaaggctaaggaacgcctggaagcgaagcatagggaacggatgtctcaggtcatgagagagtgggaggaagctgaaaggcaggcaaagaacctgccaaaagctgacaagaaagctgtaatccagcactttcaggaaaaggtggagagcctggagcaggaggccgctaacgaacgtcaacagttggtggagacacacatggccagggtcgaagctatgttgaacgatcggcgacggttagcgcttgaaaactatatcactgccctacaggcggtgcccccacggcctagacacgtgtttaacatgctgaagaaatacgtacgggccgagcagaaagacaggcagcatacgctcaaacacttcgaacatgtgcggatggttgacccgaaaaaagccgcacaaatccggagccaagttatgacccacctacgcgttatctacgaaaggatgaaccaatcactttccctactgtataatgtacctgccgttgccgaggaaattcaggatgaggtcgacgaactgctacagaaggaacagaattactccgacgatgtattggctaatatgattagtgagccgcggatatcttatggtaatgacgcactgatgccatcccttacagagaccaaaacgaccgtggaactgctgcctgttaatggcgaattctccctggacgatctccagccttggcatagctttggggcggactcagtacccgcgaacactgagaatgaagtcgagcccgtagacgcccgcccagctgcagaccggggcctcacaacaagaccaggatccgggctcactaatatcaaaactgaagagatctccgaagtgaagatggacgccgaattccggcatgacagtgggtatgaggtgcaccaccaaaagcttgtgttcttcgcggaagacgtagggtctaataagggagcgataatagggctgatggttgggggagtggtgatcgcaaccgtgatcgtaatcacgctggtcatgctcaaaaagaaacagtacacttccattcaccacggcgtggtcgaggttgacgccgctgtgactccggaggagcgacacctttcaaagatgcaacagaacgggtacgagaaccccacctacaagttcttcgagcaaatgcaaaactag

SEQ ID NO: 108071 - DNA, 2088 bp, Artificial Sequence
  Description of Artificial Sequence: Synthetic coding sequence
atgctgccaggccttgcgcttctcctcctcgcagcctggacagctagagccctggaggtgccaaccgacggcaacgcgggccttctggccgaaccacagatagcaatgttctgtggcaggctgaacatgcacatgaatgtgcaaaatggcaaatgggattcggacccaagtgggactaagacttgcattgacaccaaggagggaatactgcagtattgccaagaagtctatccagagctgcagattaccaacgtggtggaggctaaccagcccgtgactatacagaattggtgcaaacgtgggcggaaacagtgcaaaacccatccccattttgttataccttatcggtgtctggtcggagagtttgtttctgatgcacttttggtgccggataagtgcaagttcctccaccaggagcgcatggacgtgtgcgaaacacacctgcattggcataccgtagccaaagagacgtgttctgagaagagcacaaatctgcatgactacggaatgctcctcccttgtggtatcgataagtttcgcggagtggagtttgtgtgttgccccctggctgaggagagtgacaacgtggactctgctgacgcagaagaggacgactcagacgtctggtggggcggcgcggacaccgactatgcagacggatctgaagataaagtggtagaagtcgctgaggaagaagaggttgccgaggtggaagaggaggaagctgacgatgacgaagacgacgaagatggagacgaggtagaggaggaagcagaggaaccatatgaggaggcgaccgagcggactacatccatcgccacaactacgaccacaactaccgaatctgtggaggaggttgtccgcgttcccaccaccgccgcgagcacgcctgatgcagtggataagtatcttgaaactccaggcgacgagaacgagcacgctcactttcagaaagctaaagaaagactggaggcgaagcacagggaacggatgtcacaggtgatgcgcgagtgggaagaggctgagcgccaagcaaagaacttgccaaaagccgacaagaaagccgtaattcagcacttccaggaaaaagtcgaatccttagagcaggaagccgctaacgagagacagcagctagtggagactcatatggctagagttgaggccatgctcaacgatcggcgaagacttgcgctggagaattatattactgcactgcaggcagttccgcctagaccccgccacgtttttaatatgctcaaaaagtacgtgcgcgccgaacaaaaagaccgccagcacactctcaaacatttcgagcatgtgagaatggttgaccctaaaaaagctgcccagataagatcccaagtgatgacccacctgcgcgtgatctatgaaaggatgaatcagagccttagcctgttgtacaatgtcccagctgtcgccgaggagatccaggacgaggtggatgagctgctgcagaaggaacagaactatagcgacgacgtcctggccaacatgatttcggagccaagaatatcttatggcaatgatgccctgatgccctctctcacagagactaaaaccacagtggagttgttaccagtcaacggagagttctccttggacgatttacagccatggcatagctttggcgcagatagcgttccggccaataccgagaatgaggtcgaacccgtggacgcacgcccggctgcagatcggggcttgaccacaaggcctgggtcaggtctgacaaatatcaagaccgaggagatctctgaggtgaagatggacgccgagttccggcacgattcgggctatgaggtgcaccaccagaagttggtattttttgctgaggatgtggggtctaacaagggcgctattattggtctgatggtgggaggagttgtgatagccacagttatcgtaattactcttgtcatgctgaagaagaagcaatacacatccatacatcacggcgtggtcgaggtcgatgcagccgttacccccgaagagcggcacttgagtaagatgcagcagaacggatacgaaaacccaacttacaaattctttgaacagatgcagaactag

SEQ ID NO: 108072 - DNA, 1920 bp, Artificial Sequence
  Description of Artificial Sequence: Synthetic coding sequence
atgctgccagggctggccctcctattgctcgccgcttggaccgccagggctttggaggtgtaccccgaactccagatcaccaacgtggtcgaggccaatcaacctgtgacaatacaaaattggtgtaagcgagggcggaaacagtgtaaaactcacccccactttgtaattccctacaggtgcctggtgggtgaatttgtgtccgacgcactcctggtgccagataagtgtaagtttcttcaccaagaaagaatggacgtctgcgaaacccacttgcattggcacacagtagccaaagaaacatgcagcgaaaaaagcaccaatctacacgactatgggatgctgttaccatgcggcattgataaattccggggggtcgagttcgtgtgttgcccattggccgaggaaagcgacaatgtggacagcgccgatgccgaagaggatgattccgacgtgtggtgggggggcgctgatacagactatgcagatgggtccgaggataaagttgtcgaggtcgcagaggaagaggaggttgcggaagtagaggaagaggaagcagacgatgatgaagatgatgaggatggggacgaagttgaggaagaagcagaggaaccttacgaagaagctacggaacgcactacatcaattgccacaaccactacgacaaccacagagagcgttgaggaagtagtgagggtgcccaccactgcagccagtacccctgacgccgtcgacaaatacttggaaacccccggcgacgagaatgaacacgcccacttccagaaggcaaaagagagactcgaggctaagcacagagagaggatgtcccaggtcatgcgggaatgggaggaggccgaacgacaggccaagaatctgcccaaagccgataagaaggccgtaattcagcactttcaggaaaaggtggagagtctggaacaagaggctgctaatgaaagacaacagttagtggaaacacacatggccagggtggaggctatgctcaacgaccgccgccgcctggcactcgagaactacattaccgcgctgcaagctgtcccacccagaccaaggcacgttttcaatatgttgaagaaatacgtgcgggcggagcagaaagatagacagcacacacttaagcacttcgaacacgtcagaatggtggaccctaagaaggccgcccaaatccggagccaggtaatgactcatctccgcgtgatttacgaacgtatgaaccagtcactgagtttgttatacaatgtaccggcagtggccgaagaaatccaggatgaggtggacgaactgctgcaaaaagagcagaactatagtgatgacgtcctggccaatatgatttccgagccccgaatatcatacggcaatgatgcgttaatgcccagcctcaccgagacaaagaccaccgtggaactgttgcctgtgaacggcgagttttcacttgacgacctgcagccatggcacagttttggcgcagacagtgtaccagctaatactgagaacgaggtggaaccagtggatgccagaccagcagcagatagagggttgaccacccgccccggtagcggcctgaccaacattaagactgaggagattagcgaggtgaaaatggacgccgagtttagacacgattcgggttatgaagtacatcaccaaaagttggtcttttttgcagaggatgtgggctctaacaaaggcgccatcattggtctgatggtaggaggagttgtgattgcaaccgttatcgtaataaccctggtgatgctcaaaaagaaacagtacactagcatccaccacggcgtggtggaggtggatgccgctgtgaccccggaggagaggcacttgtctaagatgcagcagaacggatacgagaatcctacctataagtttttcgaacagatgcagaactag

SEQ ID NO: 108073 - DNA, 2256 bp, Artificial Sequence
  Description of Artificial Sequence: Synthetic coding sequence
atgctgcccggactggcccttctgttacttgctgcttggacggcacgggcacttgaggtgcctactgacgggaatgccggactgctggcagagccccaaatcgcaatgttctgtggaaggctcaatatgcatatgaatgtgcagaacggaaaatgggattcggacccctccgggacaaagacttgcattgacaccaaggagggtatactgcagtattgccaagaggtttaccctgagctgcagatcaccaacgttgtggaagcaaatcagccagtaacaatccagaattggtgcaagcgtggtaggaagcaatgcaagacccatccacattttgtgattccttaccggtgtctcgtgggcgaatttgtttctgacgctctgttggtacccgacaaatgtaaatttcttcaccaggaaagaatggatgtgtgcgagacgcatctgcattggcacacggtggcaaaggaaacatgttccgaaaaatcaacgaacttgcacgattacgggatgttattaccctgtggtattgataaattcagaggggtggagttcgtgtgctgtcccttggccgaggagtccgacaatgttgactccgctgatgctgaggaggatgattctgacgtgtggtggggcggggcggacacggattacgcggacggctctgaagataaagtcgttgaggtcgccgaagaggaggaggtggctgaggtggaggaggaggaagcagatgatgacgaggatgatgaggacggcgacgaggtagaggaagaagcagaggaaccatacgaagaggccaccgaacgtaccacatcaattgctacaacaacaactacaactaccgaatcagtggaggaagtggtgcgggaagtatgcagcgaacaggctgagaccgggccttgtcgggcaatgatttcgcggtggtacttcgacgtcacggaaggcaagtgcgctccctttttttatggcggttgcggcgggaaccgcaataacttcgacaccgaggagtattgcatggccgtatgcgggtccgccatacccaccacggccgcttctactcccgacgcagtcgacaagtatttagagactcccggcgatgagaacgagcacgctcactttcagaaagcgaaggaacggctggaggcaaagcacagagaacgcatgtctcaggtgatgagggaatgggaggaggcagagaggcaggctaaaaatctcccaaaagctgataagaaggccgtcatccagcattttcaagagaaggtggagtccctggagcaggaggctgccaacgagagacaacagctggtcgagacacacatggctagagtggaggccatgctgaacgatcggcgtcgcctagcccttgagaattacatcacggccttgcaggcagtgccgccacgtcctaggcacgtgttcaacatgctgaagaaatatgtgagagcagaacagaaagataggcagcacaccctcaagcattttgagcacgtgaggatggtcgaccccaaaaaagccgctcagattagatcacaggtcatgacccatttgagggtcatatatgaacggatgaaccagtcactgagcctcctgtacaacgtccccgctgtggccgaagaaatacaggacgaggtggatgagctgctgcagaaggaacagaactattccgatgacgttctggctaatatgatttcggagcctcgaataagctacggtaacgatgcactgatgccttccttaaccgaaacaaaaaccactgttgagctcctgcccgttaatggagagttttccctcgacgacctacaaccatggcattcatttggtgctgactctgtccccgcaaacaccgagaacgaggtggagcctgtcgacgcacgccctgcagcagaccgcgggctgactaccagacctggttctgggcttacaaacataaagaccgaagagatttctgaggtaaagatggatgcagagttccggcatgacagcggctatgaggtccaccaccaaaagctggtattcttcgccgaggatgtaggaagcaataagggagctatcatagggttgatggtcggtggtgtcgttatcgcaactgtaatcgtgatcacactggtgatgctgaagaaaaagcagtacaccagcatccaccatggagtggtggaggtagatgccgcggttactccagaggagaggcacctgtcaaaaatgcaacaaaacggatatgaaaacccgacgtataaattttttgagcagatgcagaattag

SEQ ID NO: 108074 - DNA, 2259 bp, Artificial Sequence
  Description of Artificial Sequence: Synthetic coding sequence
atgctgcctggtctggctctgctgctcctggctgcctggacagcccgcgctctcgaagtgcccaccgacggcaatgccgggctgctggcagagcctcagatcgcaatgttttgtggacgactgaacatgcacatgaacgtccagaacggtaagtgggattccgacccttcaggtaccaagacctgtatcgatacaaaagaagggatccttcaatattgccaagaggtgtatcccgagcttcaaatcacgaacgtggtggaggccaatcaacctgttactatccagaactggtgcaaaagggggaggaagcaatgtaaaacccaccctcatttcgttattccctatcgatgcctggtgggcgaatttgttagcgacgccctgctggtgccagacaaatgcaagttcttgcatcaagaacggatggatgtttgcgaaacccacctccactggcacacggtggccaaagagacttgctcggagaaatccacgaacctgcacgactacgggatgctcctaccttgtggcatcgataaattccgaggggtcgagtttgtgtgttgtcccctggccgaggaaagcgataacgtcgactccgctgatgctgaggaggatgactctgatgtttggtggggtggggcagataccgactacgccgacggatcagaagataaggtggttgaggtggccgaagaggaggaggtggccgaggttgaagaggaagaggctgacgacgatgaggacgatgaggatggcgatgaggtcgaagaggaggcagaagaaccttatgaagaggccactgagcggacaacaagcattgctacaacgacaacaactactaccgagtccgtggaggaggttgtgcgggaagtatgttccgagcaggcagaaacaggtccctgtagggccatgatttcaagatggtacttcgacgttaccgaagggaaatgcgctcccttcttttatggagggtgcggagggaatcgcaacaacttcgacaccgaagaatattgcatggcagtttgtggttctgcaatgtctcagagccttctgaagacgacacaggagcccctagccagagatccagtgaaactgccaactaccgccgcctctacccccgatgccgtggataagtaccttgagacacccggcgatgagaacgagcacgcccacttccagaaggcaaaagaacgcttggaagccaagcaccgggaaaggatgagtcaagtgatgcgggaatgggaagaagcagaacgacaggccaaaaaccttccgaaggcagataagaaagccgtgatccagcactttcaggaaaaggtcgaatctctcgagcaggaggctgcgaacgaaagacaacagctagtggagacacacatggcgcgcgtggaggcgatgctgaacgatcgacggagacttgcactggagaactacatcacagccctacaagctgtcccaccgcggcccaggcacgttttcaatatgctgaagaagtacgttagggcggaacagaaggacaggcagcataccctcaagcacttcgagcacgttcgtatggttgaccccaagaaggcagcccagattcgctcccaagtgatgacacatctccgagtgatctacgaaagaatgaaccagtccctttctcttctttataacgtaccagccgttgcagaggaaattcaagatgaggtggacgagctactgcagaaagagcagaattactccgatgatgtcctggcaaacatgatctctgagcccaggattagctacgggaatgacgctctgatgccttcactgaccgaaacaaagacgactgtcgaactgctgccagtgaacggcgagtttagcttggatgatttacagccttggcatagctttggagccgatagcgtgcccgccaataccgagaatgagggatcaggcctcactaacatcaagaccgaggagatatctgaagtcaaaatggacgctgaatttagacacgactcgggctatgaagtgcatcatcagaaacttgtcttctttgcggaggacgtggggtcgaacaagggagcgataataggtctgatggtgggaggtgtcgtgatcgccacagtcattgtgattacactggtgatgctgaaaaaaaagcagtacacatcaattcaccatggcgttgtcgaggttgacgccgccgtcacgccagaggagcggcacctgtccaagatgcagcaaaatggctacgagaatcctacctacaagttctttgagcagatgcagaactag

SEQ ID NO: 108075 - DNA, 2145 bp, Artificial Sequence
  Description of Artificial Sequence: Synthetic coding sequence
atgctccccgggctcgcacttctgctcctcgccgcatggactgcccgggcactcgaggtgcctacggacgggaacgcgggcttattagcagaaccacaaattgcaatgttctgtggccgactcaacatgcatatgaacgtgcagaacggcaaatgggactctgatcccagtggcaccaagacttgtatcgacacaaaggagggtatcctccagtattgtcaggaagtgtaccccgagctccagatcacaaacgttgtggaggccaaccagccagtgaccatccaaaattggtgcaaaagaggaagaaaacagtgtaaaacacatcctcactttgtgatcccttatcggtgcttagtaggggagttcgttagtgatgcactgttagtccccgataagtgcaaattcctgcaccaggagagaatggatgtctgcgaaacgcatctccactggcatacggtggctaaagagacgtgtagcgaaaagtccaccaatctgcatgactatggcatgcttctgccatgtgggatagataagtttcgcggagtcgagttcgtctgttgtccattggccgaagagtcagacaatgtggactcagcagatgccgaggaagacgacagcgacgtgtggtgggggggcgccgacaccgattacgccgacgggagtgaggacaaggtggttgaagtggccgaagaggaggaagtcgccgaggtcgaagaggaagaggccgatgacgacgaggacgacgaggacggcgacgaagtggaggaggaggctgaagagccatacgaagaagctaccgaacgaactacctccatcgcaacaactacgaccactactacggagtctgtcgaggaggtagtacgagtctcccagtctctcctaaagaccacccaggagccgctcgccagggatcccgttaagctccctacaactgctgctagtactcctgatgccgtcgataaatacctggaaacccctggagacgagaatgaacatgcgcactttcagaaagccaaagagcggcttgaggccaagcaccgggagcgcatgtcacaggtaatgcgtgagtgggaggaagctgagcgacaggctaaaaatctgcccaaagcggacaagaaagctgttatccaacactttcaggaaaaggtggagtctttggaacaagaggctgcaaacgagaggcagcagcttgtagagacacatatggcaagagtggaggcaatgttgaacgaccgaaggcgcctggccctggaaaactatattaccgctctccaggccgtccctccacgcccacgccacgtgttcaacatgctgaagaagtatgtgcgcgctgaacagaaagaccgtcagcacacgcttaaacattttgagcatgtgcgcatggtggaccctaaaaaggccgcccagattaggagccaggttatgacgcatctacgcgtcatttatgagcggatgaatcagtccttgagtctgttgtataatgtgccggccgtagccgaagaaatccaggatgaggtggacgaactgctgcaaaaggagcagaactacagcgacgatgttctcgcaaatatgataagcgagcctcgaatctcctatggcaatgatgcccttatgccctcccttacggagactaaaaccaccgtggaactgctgcccgtaaacggcgaatttagtcttgacgaccttcagccctggcacagctttggcgctgactctgtgccagcgaataccgagaatgaagtagaaccagtcgatgctcgcccggcagccgaccgcggcttaaccactaggcctggatcaggtctcaccaacattaagactgaagagatttctgaggtaaaaatggacgcagagttcaggcacgattctggctatgaggtacaccatcagaaactggtgtttttcgctgaagacgtgggctccaacaagggcgctattatcggcctcatggtcggaggtgtcgtcatagccaccgtcattgttattactctggtgatgctcaaaaagaagcagtacacttccatccaccacggtgtagtagaggtggacgctgctgttacccccgaagagagacacctctctaagatgcagcagaacggctatgaaaatccgacttacaaattcttcgagcagatgcaaaactag

SEQ ID NO: 108076 - DNA, 2145 bp, Artificial Sequence
  Description of Artificial Sequence: Synthetic coding sequence
atgttacccggcttggcgcttctgctgctggctgcctggactgcccgggcacttgaggtgtatccagaacttcagattaccaatgtggtagaggctaatcaacctgtcaccatccaaaattggtgtaagcggggccgaaaacaatgtaaaacacatccacacttcgtcattccataccgttgtttggtcggggaatttgtgagcgatgctctattggtgccggataaatgtaaatttctgcaccaggagcgcatggacgtctgtgagacccatctacattggcatactgtggcgaaagagacctgtagcgagaaaagcaccaaccttcatgactatgggatgcttttaccctgtggaattgataaattccgaggagtagaattcgtgtgttgccccttagcagaagagtctgacaacgtggactctgccgatgcggaagaggacgactctgatgtctggtggggaggcgcagatacagattatgctgacgggtcagaggataaagtcgtagaggtggccgaagaggaggaagtcgctgaggtcgaggaagaagaggcggacgacgatgaggatgacgaagatggagacgaagtggaggaagaggctgaggaaccatatgaagaggcaactgaaagaacaacatcaatagcaacaaccacgaccactactaccgaaagcgtggaagaagtggtccgagaggtctgctccgaacaggccgaaacaggaccctgtagggccatgatatcacgctggtacttcgacgtgaccgagggtaaatgtgcaccatttttctatggtgggtgtggtggcaatcgcaacaacttcgatactgaggagtactgtatggcggtctgcggaagcgctatgtcccaatcgctgctgaaaacgactcaagagcccctggcgcgggaccccgtcaagctgcctactactgccgcgtcgacgccggatgccgtggataaatacttggagaccccgggagacgaaaacgaacatgcacactttcagaaggccaaggagagactagaggccaagcaccgggaacgcatgagtcaggttatgcgggagtgggaagaagcggaacgacaagccaagaacctgcctaaggccgacaagaaagcagtgatacagcatttccaggagaaagtcgagagccttgagcaggaggccgcaaacgaacgccagcagttggtcgaaactcatatggcgcgagtggaagcaatgttgaacgacaggcgcaggctggcactcgaaaattacattaccgcactgcaggctgtgccaccccggccacgacacgtcttcaacatgctgaagaaatatgtcagggctgagcagaaggatcgccagcacacattgaagcatttcgagcatgtcaggatggtagaccctaaaaaggcagcgcaaatcaggagccaagttatgacacatctgagagtgatctatgagaggatgaatcagagcctgagtctgctgtataacgtaccagcagtggcagaggaaattcaggacgaggttgacgagctgctacagaaagaacagaactatagcgatgatgttctagcaaatatgattagcgaacccagaatatcgtacgggaacgatgctttgatgccttccctgaccgaaacgaaaacgaccgttgaactcctgcctgttaacggagagttctcgcttgacgacttacagccctggcattccttcggggccgactccgtgcctgcaaatactgaaaacgaagtcgaacccgtcgatgcgaggccagcagctgacagggggctgacgacgcgccccgggtccggcctgactaacataaagactgaggagatctcagaggtaaaaatggacgctgaattccgacacgattcaggctacgaagttcaccatcagaagctagttttctttgccgaagatgtgggatctaacaagggtgcaataataggactcatggtcggaggtgtggtcatcgccaccgtgatcgtaattacacttgtgatgcttaagaaaaagcaatacactagcatccatcatggggtggtggaggtcgacgcggccgtgaccccggaggagcgccatctttcaaagatgcaacagaacggctatgaaaaccccacttacaaatttttcgaacagatgcagaactag

SEQ ID NO: 108077 - DNA, 2241 bp, Artificial Sequence
  Description of Artificial Sequence: Synthetic coding sequence
atggatcaactggaggacctgctcgtccttttcattaactacgtgcccaccgacgggaatgcaggcctgctcgctgagccacagattgccatgttttgcggacggctgaacatgcatatgaacgtccagaacggaaaatgggatagtgatccttcaggaactaagacctgtattgatacaaaggagggcattttacagtattgtcaggaagtatatccggaactgcaaatcactaatgtagtggaggccaatcagcctgtgactatacagaattggtgtaagagaggccggaaacaatgcaaaacacacccacattttgtgatcccctatcggtgcctcgtgggtgagttcgttagcgatgctcttctggtcccggataagtgtaaatttctgcaccaagaacgaatggacgtatgtgagacccaccttcactggcatactgttgcaaaggaaacatgcagtgagaaaagtaccaacctgcacgattacggaatgttgctgccatgtggcattgacaaattccgaggcgtggaatttgtatgctgtcctctggcagaggagtccgacaatgtggactctgcagacgcagaggaggacgacagtgatgtgtggtggggaggcgctgacacggactatgccgatggttctgaagacaaagtggtggaagtggccgaagaagaagaggtggcagaggtggaagaagaggaggctgacgacgatgaggacgacgaggacggcgacgaggttgaagaggaggcagaggagccatacgaagaggccactgagagaactacttctattgccacaacaacaaccactaccaccgaaagcgtggaagaagtggtccgggaagtgtgttctgagcaggctgagaccggtccttgcagggccatgatatcccgatggtattttgacgtgacagagggaaaatgcgctccatttttttacggcgggtgcggcggtaaccgcaataatttcgataccgaggaatattgcatggcggtttgtggttctgcaatccccaccaccgctgcatctacccctgacgccgttgataaatacctcgagacccctggagacgaaaacgaacatgcacacttccaaaaggccaaggaacggcttgaagccaagcatcgagaacggatgagccaagtgatgcgagagtgggaagaggcagagcgccaggccaagaatctgccaaaagccgataaaaaggccgtcatccagcactttcaagagaaagtggagagccttgaacaggaggccgccaatgagcgtcaacaactcgttgaaacgcatatggctcgtgtggaagcaatgcttaatgaccgcagaaggctagcccttgagaattatatcacggcgctccaggccgtgcctccaagaccacgtcacgtgttcaacatgttaaaaaagtacgtgcgtgccgaacagaaggacaggcagcacaccttaaagcatttcgagcatgtgcgaatggtggatccaaagaaggccgcccagatccgctctcaggtgatgacccatctgcgagtgatttacgagaggatgaatcagagcctctccctgctgtataatgtccccgccgtggctgaggaaatccaagatgaagttgatgaactgcttcaaaaagagcagaactactcagacgatgtactggctaacatgatatccgagcctagaatcagttacggaaatgacgccctgatgccgtctctcacagaaactaagaccaccgtggaattgctacctgtaaatggagaattctcgctggatgacctgcagccttggcactcattcggcgcggatagcgtgcccgcaaatactgaaaatgaagtagagccagtcgatgccagaccggctgctgaccggggactgacaaccaggcctggatctgggctgaccaacatcaagacagaagaaatctctgaggtcaagatggatgcggagttccgccacgacagtggctacgaggtgcaccaccagaaactcgtcttctttgctgaggatgtgggcagtaataaaggagctattattgggctcatggtcgggggcgtcgttatcgcaacagtgattgtcattactctggtaatgctgaagaagaaacaatatacgtccatccatcatggagtggtggaagtagatgccgctgtcactcctgaagagaggcacctatccaaaatgcagcagaatggttatgaaaatcctacttacaagttcttcgagcagatgcagaactag

SEQ ID NO: 108078 - DNA, 1983 bp, Artificial Sequence
  Description of Artificial Sequence: Synthetic coding sequence
atgttctgcggcaggctgaatatgcatatgaacgtgcagaacggaaagtgggattccgatccctctggcactaaaacttgtatcgatacgaaggaggggattctgcaatactgccaagaggtgtatccagagttacagattaccaacgttgtggaggcgaaccagcccgtcacgatccaaaattggtgtaagcggggccgtaaacaatgcaagacgcacccacactttgtcatcccttatcggtgcctcgttggggagttcgtgtctgacgctctccttgtgcccgacaagtgtaaattcttgcaccaggagcgtatggatgtgtgtgagactcacctgcattggcacaccgttgccaaggagacatgttccgagaaaagtaccaaccttcatgattacggaatgctgctgccatgtgggatagataaattccggggagtggaatttgtctgctgcccacttgcggaggaatctgacaatgtggattcagcagacgctgaggaggacgatagcgatgtttggtgggggggcgcagacacagattatgcagacggaagcgaagataaagtagtggaagtggctgaagaagaagaagtggcagaggtggaagaggaggaagctgatgatgacgaagacgatgaagacggagacgaggtggaggaggaagcagaggagccctacgaggaagcgactgaacgcaccacgagtatcgcaacgactaccactactacaaccgagtctgttgaggaagtggttagagtccccacaacggctgcttcaacgcccgacgccgtggataagtacctggaaacgcccggcgacgagaatgagcacgcacactttcagaaggcaaaggagcgcctggaagctaagcatcgtgaaagaatgtcccaggttatgcgcgagtgggaagaggcggagcgtcaggccaaaaacctccctaaagccgataaaaaggcagtcattcaacattttcaggaaaaggtggaatcacttgaacaagaggccgcaaatgaacgccagcagcttgtggaaactcatatggcccgagtggaagccatgctcaatgatagacggcggctcgctctcgagaattacattaccgccctgcaggccgtgcctccgagacctagacacgtctttaatatgttgaaaaagtatgtgagggcagagcagaaagataggcagcataccctgaaacacttcgagcacgtgagaatggttgaccccaaaaaggctgcccagatccgatcacaggtcatgacacaccttcgagtgatctatgaacggatgaatcagagcctctccttactgtacaacgtcccggctgttgccgaagagatacaggatgaagtggacgagttactgcagaaagagcaaaactactccgacgatgtgctcgctaatatgatatcggagcctagaatttcttatggtaacgacgcacttatgccatcactcacagagactaagaccaccgtggagctgctgcccgtgaatggagaattcagcctggacgacttacagccttggcacagttttggagctgactcagtgcccgcaaataccgagaacgaagtcgaacccgttgacgctcgcccagcagcggatcgaggactgaccacccggccagggtccggcctgacgaatattaagaccgaagaaattagcgaggtgaaaatggacgctgaatttcggcacgatagcggctatgaagtgcaccaccaaaaactggtcttcttcgccgaggacgtgggaagtaacaagggcgccattattggactcatggtcgggggtgtggtgattgctaccgtcatagtgataactcttgtgatgctgaaaaaaaaacagtatactagcatccatcacggagtggtagaggtggacgccgctgtgactcctgaggagcggcacctcagtaaaatgcagcagaatggatacgagaaccctacttacaagttctttgaacagatgcagaactag

SEQ ID NO: 108079 - DNA, 789 bp, Artificial Sequence
  Description of Artificial Sequence: Synthetic coding sequence
atgcgcgtgcaggatacttcagggacttactattggcatatcccgacgggcaccacacagtgggagccccccggacgtgcatctccctcacagggaagtagcccccaggaagagagccaactgacctggacaggcttcgcacacggcgaggggtttgaggacggggaattctggaaggatgagccgtccgacgaggcaccaatggagctgggactgaaagagcccgaagaaggcaccctgaccttccccgctcagtctttatcgccagagcccctacctcaggaggaggagaaactgccccccaggaacaccaatcctgggatcaagtgctttgctgtgaggtctctgggctgggtcgagatgactgaggaggaattggccccaggacggtcctccgttgctgtgaacaactgcatcaggcagctctcttatcacaaaaacaacctgcacgatccaatgtcagggggatggggagagggaaaggatttgctattacaactggaggatgaaactctcaagctcgtggaaccacagagccaggcacttttacacgcgcaacctattatttccatccgggtgtggggtgtgggcagagattccgggcgcgacttcgcttatgtcgctcgtgacaaactgactcagatgttgaaatgccatgtgtttagatgtgaggcccccgccaagaatatcgccacatcgctgcatgaaatttgtagtaaggcccgcccaccacccttaccaggactggtcgctacttttgcgctgcagggctgcggttggggccattag

SEQ ID NO: 108080 - DNA, 1482 bp, Artificial Sequence
  Description of Artificial Sequence: Synthetic coding sequence
atgctgggtaaggattatatgctcgcaattatcctggtcaactgcgatgatgacctgtggggagatcatagcttagaagtcgaggctggacttcctcccgggtggcggaagattcatgatgccgcaggtacctactattggcatgtcccctctggctcaactcaatggcagagacctacctgggagctgggcgacgccgaagacccaggcacaggcaccgagggaatttggggactgcgcccccccaagggtaggtcctttagttccctggagagcagcttggatcgaagcaattccctttcctggtacggaggggagagctacattcagtctatggagcctggagcaaaatgctttgccgtgcgctctctaggatgggtggaagtgcccgaggaggacctggctcctgggaaatcctctattgccgtgaacaattgtatccagcagctggcccagactaggagccggagtcagccgcccgatggcgcctggggtgagggccagaacatgcttatgatccttaaaaaagatgctatgagcctggtcaatccactggaccattccctgatacattgccagccgctggtccatattagggtctggggggtagggtcttctaagggccgcgactcacctataagtgctcccgcgagggattttgcgtttgtagcctctgacaaggactcgtgcatgctgaagtgtcacgtgttctgctgcgacgtacccgctaaagctatagcctccgccttgcatggactctgcgcacagatcctctcagaaagagttgaggtttccggagacgctagctgttgctcacccgaccctatttctccagaagacttgccacgtcaggtggaactactcgatgctgtgtctcaggctgcccagaaatacgaggcactgtacatgggcaccctgcctgttacaaaggcgatgggaatggacgtgcttaacgaggccattggaacactgacagcccgcggagatagaaacgcgtgggtacccacaatgctctctgttagtgacagcctgatgactgcccatccgattcaggcggaggcaagcacagaggaggagccactgtggcagtgcccagttcggctggtcacttttatcggtgtaggtagagatcctcacaccttcggactaattgctgatctaggtcgccaaagcttccagtgcgctgccttctggtgtcagccacacgctggcggcctgtctgaagccgtccaggccgcctgcatggtgcaatatcagaagtgtctggtcgccagcgcggcaagaggtaaggcctggggagcccaggctcgggctaggctccggctgaaacggaccagctctatggattccccgggaggcccgctccctctgcccctgcttaaaggtggcgtgggtggagcaggggctacaccccggaaaagaggagtgtttagcttccttgatgcctttcgcctcaagcctagccttctgcacatgccatag

SEQ ID NO: 108081 - DNA, 1377 bp, Artificial Sequence
  Description of Artificial Sequence: Synthetic coding sequence
atgatcacaaaaactcacaaggtcgatctcggactcccagagaagaaaaagaagaaaaaggtcgtcaaagaacctgagacaaggtactctgtattgaacaacgatgactactttgcagatgtcagtcccctacgggcaacttcaccgagtaagtcagttgcacatggccaggcccctgagatgcctctcgtgaaaaagaaaaagaagaagaaaaaaggcgtgtcaactctgtgtgaggaacacgtggagcctgagactaccctgccagccagacgcaccgaaaagagtcctagcctgcgcaagcaggtgttcgggcatctggagttcctgtctggggagaagaagaacaagaaaagcccattagcaatgtcacatgcttctggagtcaaaacttcgccagacccccggcagggcgaggaagagactagagtcggaaaaaagctcaaaaaacataaaaaggaaaaaaaaggggcccaggacccaaccgcgttttctgtccaggatccttggttctgtgaggctcgcgaggctagggatgtgggtgatacttgtagcgttgggaagaaagacgaggagcaggcggcactgggacagaaacgaaagaggaagtcaccccgtgagcacaacggtaaagtgaaaaagaaaaagaaaatccaccaggagggcgacgcgctgcccgggcatagtaaaccttcccggtccatggagtcgtcacctaggaagggctccaagaagaagcccgtgaaggttgaagcaccggagtatattcccatctcagacgatccaaaagcaagtgctaagaagaagatgaaaagcaaaaaaaaagtcgagcagccagtgatcgaagaacccgccctgaagaggaagaaaaaaaaaaaacggaaggagtctggagtggcaggagatccatggaaagaagagaccgatacagaccttgaggtggtccttgagaagaaaggtaatatggacgaagcccacattgaccaagttagacgtaaggcattacaggaggaaattgacagagagagtggcaagaccgaggcctcagaaacacggaaatggacaggaacccagttcgggcagtgggacaccgcgggctttgagaatgaagatcagaaactcaagttcctgcgacttatgggaggattcaagaatctgagtccctcattctcaagaccagccagcactattgctaggccgaacatggccctcggcaagaaagccgcagattcactgcagcagaatctccagcgtgactatgaccgagctatgtcatggaaatactctcggggtgctggactggggttttccactgcccctaataaaattttttacatcgacagaaacgcttctaaatccgtgaaactagaagattag

SEQ ID NO: 108082 - DNA, 2214 bp, Artificial Sequence
  Description of Artificial Sequence: Synthetic coding sequence
atggcacatcgaaagctcgagtcagtggggagtggaatgttggatcaccgggtgcgccctgggccggtgccccattctcaggagcctgagagcgaggatatggagctgccactggaaggatatgtgcctgagggcctggagttggcagctctgcgtccggagagtccagccccagaagaacaggagtgccacaaccacagccctgacggggacagcagttccgactacgttaataacaccagcgaagaagaggactacgatgagggcttacccgaagaggaggaggggatcacctactacatcaggtattgccctgaggacgactcctaccttgagggaatggattgcaatggcgaagagtacctggcgcactccgcccaccccgtagacacagatgagtgccaggaagcagttgaggagtggacggatagcgctggcccccacccgcatggacacgaggcagagggatcacaggattaccccgacggacagctgcccattcctgaggacgaaccgtccgtgctggaagctcatgaccaggaagaagatggacactactgcgcatccaaggaaggttaccaggattattaccctgaagaggccaatgggaataccggcgcctccccctataggctgcggcgcggagacggagacttagaggaccaggaggaggatatcgaccaaattgtggcagagattaagatgagccttagcatgacttctattacatccgcttccgaggcgtcccccgagcatgggcccgagcccggcccagaggattcggtggaggcttgcccccctatcaaggctagctgcagtccaagtcggcatgaagctaggccaaagtctctcaatttgctgcccgaagccaaacaccccggcgaccctcaaaggggctttaagcctaagaccagaacaccagaagagagactcaagtggccccacgaacaggtctgtaacggcctggagcaacccaggaagcaacaaagatcagatcttaacgggccagtggataataataacattccggaaacgaaaaaggtggcatcttttccatcctttgtggcggtgcccgggccctgcgaaccagaagatctgatcgatgggataatcttcgctgcgaattacctgggaagcactcagctgttgagcgaaaggaatccctcaaagaacatccgcatgatgcaggcacaggaagcggtgtcacgggtaaaaaatagcgagggagatgcgcagactctcacggaagtcgacctgttcatttccacacaacgaattaaggttttaaatgcggacacccaggagactatgatggaccatgccctgcgcacaatatcatacatcgcagacatcggtaatatagtggttctcatggctaggcgacggatgccccggtcagctagccaggattgcattgagacaacaccaggcgctcaggaagggaaaaaacagtataagatgatttgccacgtattcgaaagcgaggacgctcagctaatcgcgcaatccattggccaagctttcagcgtggcctaccaggagtttctgcgcgccaatggcattaaccccgaggacctgagccagaaggagtattctgatattatcaatactcaggaaatgtataacgatgacctcatccatttttccaatagcgaaaactgcaaggagctgcagttagagaagcataagggcgaaattctcggcgtggtggtggtcgaatctggctggggctcaatcttgccaaccgtgattctcgccaatatgatgaatggagggcccgcagctcggtctggtaaacttagcataggcgaccagatcatgagcattaatggaacatccctggtcggactgccgctggccacctgtcagggtattatcaagggtctgaagaaccaaacacaggtcaagttaaacatcgtgagctgcccccctgtgactacagtactaatcaagcgtcctgacctaaaataccaattgggattctcagtacagaacggcattatatgtagcctgatgcggggcggaatcgccgagcggggcggggtacgggttggacacagaatcatcgagatcaacggtcagtcagttgttgcgactgctcatgaaaaaatcgtacaggccctgagcaactcagtcggtgagattcacatgaagactatgcccgctgcaatgtttaggctccttacagggcaggaaacacccctatatatctag

SEQ ID NO: 108083 - DNA, 84 bp, Artificial Sequence
  Description of Artificial Sequence: Synthetic coding sequence
atggcccaccgcaaactcgaatcagtcggtagcgggatgctcgatcatcgagtgcgccccgggcctgtgccgcacagccaatag

SEQ ID NO: 108084 - DNA, 2250 bp, Artificial Sequence
  Description of Artificial Sequence: Synthetic coding sequence
atggctcaccggaaacttgaatctgtgggttcagggatgctagatcaccgagtccgccccgggcctgtgccccacagtcaggaaccggagtctgaagacatggaactgccactcgagggatatgtgcctgagggattagagcttgccgctctgagaccagaatctccggctcccgaagagcaagaatgccataaccacagtccggacggggactcttcgtctgattacgtcaacaacacgtccgaggaggaggactatgatgaagggctgccggaggaggaggaaggaattacgtactacatcagatattgccccgaggatgactcttatcttgagggcatggattgtaatggggaagagtacttggcgcatagtgcccaccccgtagacacagacgaatgccaggaggccgtcgaagagtggactgattccgcagggccccacccccacggccacgaagccgagggatcccaggattaccctgacggacagctacccattcctgaggacgagcccagtgtgctggaggcccatgatcaggaggaagatggacattattgtgcatctaaggagggttatcaggattattatcctgaagaagccaacggtaatactggggccagtccttaccgcctacgacgaggggacggtgatctcgaggaccaggaagaagacatcgaccaaatcgtggcagagataaagatgagcctgagtatgacatccattacctcagcatcagaagccagtcccgaacatggccctgagcctggtcccgaggatagcgtggaagcctgtcctccaattaaggccagctgttcaccgtcacgccatgaagcccgccccaagagtctgaacttgctaccggaggctaagcacccaggggacccccagaggggcttcaaaccaaagacccggacacccgaggaacggcttaagtggccacacgaacaggtgtgtaatggtctggagcagccacggaagcaacagcggagcgatttaaatggcccagtggataataacaatatcccggagaccaaaaaggtcgctagctttccttcatttgtcgcagttcctggaccctgtgaacccgaagatctaatagatggtatcatctttgccgccaactacttagggtctacccagcttctgagtgagcgaaacccttctaagaatattagaatgatgcaagcgcaggaagctgtttctagggtgaaacggatgcagaaagctgctaagatcaagaagaaggccaacagtgaaggtgatgcacaaaccctcaccgaagtagatctcttcatctctacccaacggatcaaggtgctgaatgctgacacacaagaaactatgatggaccacgccctgagaaccatatcctacatcgctgatattggcaacatcgtagttcttatggctaggagaagaatgcctcggtctgcttcacaggactgcatcgagacaacacctggggcacaggaagggaaaaaacagtataagatgatctgccatgtcttcgagagcgaggatgcccagctgatcgctcaatctattgggcaagctttttctgtggcctatcaggagttcctacgcgcaaatgggattaacccagaggatctctcccagaaagaatactctgacattatcaatactcaggaaatgtacaacgacgatctgatccacttctcaaactctgaaaactgcaaagaactgcagctagagaaacacaaaggggaaatcctgggggttgtggtcgtggaaagcggctggggtagtattctgcccaccgtgattctcgcaaacatgatgaatggcggccccgcagccaggtccggcaagctcagtatcggcgatcagatcatgagcatcaacggcacttccttggttggacttcccttggcgacctgccaaggcatcatcaagggtctgaagaaccagacccaagtgaagttaaacatcgtttcctgcccacctgttactactgtcttaatcaagcggccagacctgaagtaccaactggggttctccgttcagaacggcatcatctgttccctgatgcggggaggtattgcagaacgaggcggtgtgcgggtggggcaccgcattatcgagataaatgggcagtccgtggttgcaactgcacacgaaaaaattgtgcaggccctctcgaactccgtgggcgaaatacacatgaaaaccatgcccgccgctatgttcaggttgctgacgggccaagagacccccctgtatatctag

SEQ ID NO: 108085 - DNA, 2214 bp, Artificial Sequence
  Description of Artificial Sequence: Synthetic coding sequence
atggcccacagaaaactggaaagcgtggggtctggtatgcttgatcacagggtgcggcctggtccagttccccacagccaggaacccgagagcgaagacatggaactcccccttgagggctatgtacccgagggtctagaactggctgctctgagaccggagagcccagcgcccgaggagcaagaatgccataaccactctcctgatggggacagtagtagcgactacgtcaacaatacctcagaggaggaggattacgacgagggactgccagaagaggaagagggtatcacatattacatccggtattgtcccgaagacgatagctatcttgagggcatggattgcaatggggaggagtacctcgctcacagcgcgcatcccgtcgacacagacgaatgccaggaggccgtcgaggagtggacagattctgcaggcccgcatccacacggacacgaagccgaaggttcacaagattaccctgacgggcaattgccaattcctgaagatgagccatcagtgctggaagcacatgaccaagaggaagatgggcattattgcgcgtccaaggaaggataccaggactattatcctgaagaggcgaatgggaacactggggcttccccatatcgactgcgccgaggcgatggcgacctcgaggatcaggaggaggacatcgatcagatcgtagcggaaattaaaatgtcgctttctatgactagtattacaagcgcgagcgaagccagccccgagcatggaccagaacctggacccgaagatagcgtggaagcctgccctcccatcaaagcttcatgctcaccatctcgccacgaagcaagacccaagtcactcaacctgcttccagaagccaaacatcctggagatcctcagcgcggcttcaagccaaaaacacgtacgccggaagaacggctgaaatggccacacgagcaggtatgcaatgggctggaacagcctaggaagcagcagagatcagatttgaacggtccagtggacaacaataacatacccgaaacaaagaaagtagcttccttcccatccttcgtggctgtacccggtccttgtgagccagaggatctcatagatggaattattttcgctgcaaattatctaggctcaacccagttgctgtccgagcgcaaccccagcaaaaatattaggatgatgcaggcacaggaagcagtgtcacgagtgaaaaatagtgaaggggacgcgcaaactcttacggaagtcgacttatttatctctactcaaagaatcaaggtgctgaacgcggatacacaggaaaccatgatggaccatgcattaagaacaatatcttatatcgccgacattggaaacatagtggtcctcatggctaggaggcggatgccacgtagcgcgtcccaggactgcattgaaacaactcccggcgcgcaggagggtaagaagcaatacaagatgatttgccacgttttcgaatcagaagacgcacaactgatcgcccagagcatcgggcaggccttctcagttgcctatcaggagtttctgagagcaaatgggataaatcccgaggatctgtcccaaaaagagtacagcgacataattaatactcaggaaatgtacaatgacgatctaatccacttttctaactcggaaaactgtaaggagctgcagctggagaaacataagggggaaatcctgggcgtggtggttgttgagtcggggtgggggagcatactgcccactgtgattttagctaatatgatgaacggcggtccggccgctcgaagcggcaaattgagtatcggcgatcagatcatgtccatcaacgggacttcgctggtaggtctgcctcttgcaacatgccagggtatcattaagggcctgaaaaatcagacgcaggtgaagctaaatattgtaagctgccctccagttacaaccgtcttgatcaaaagacctgatcttaaatatcagttgggattctccgtgcaaaatgggattatctgtagcctcatgaggggcggcattgccgagcgcgggggggtcagagtaggacacagaatcattgagataaacggacagtctgtggtggctaccgcccacgaaaagatcgtgcaagcactttcaaactctgtgggggaaatacatatgaaaaccatgcctgccgctatgttccgacttttgacgggccaggagacacccctctacatttag

SEQ ID NO: 108086 - DNA, 795 bp, Artificial Sequence
  Description of Artificial Sequence: Synthetic coding sequence
atggcccaccggaagttggaatcagtggggagcggaatgctggatcaccgagtccgccccggacccgtgcctcacagccaggagccagagagtgaggacatggagctgccacttgagggttacgttcctgagggactcgaactggccgctctgaggccggaaagcccagctcctgaggagcaagaatgtcataaccactcccctgatggagactcatcttctgattatgtaaataacacatccgaagaggaggactatgacgagggcctgcccgaggaggaggagggaataacctattatattcgatattgcccggaggacgactcctacctggagggcatggattgtaacggggaggaatatctagcacatagcgcacaccccgtcgatactgatgaatgccaggaagcagtggaggaatggacagacagtgccggcccccatccccacggccatgaggcggaaggctcacaagattacccggacggtcagcttccaattccagaggacgagccgagcgttctagaggcacacgatcaggaagaggatggacactattgtgctagcaaggaagggtatcaggattactatccagaggaggccaacggtaatacaggggcctccccctacaggctgagaagaggggacggcgatcttgaggatcaggaagaagacatcgaccagatagttgccgagatcaagatgtctctctctatgacatcaattaccagcgcgagcgaggcctcccccgaacatggccccgaacccggacccgaagactccgtggaggcgtag

SEQ ID NO: 108087 - DNA, 2250 bp, Artificial Sequence
  Description of Artificial Sequence: Synthetic coding sequence
atggctcaccgcaaactcgaatcagtcggatctggtatgctcgaccaccgcgtgcggccaggcccagtcccacattcacaagaaccagaatccgaggatatggagctcccgctcgaagggtatgtgccggaggggttagaacttgcagcgctacgccctgagtcgccagcccctgaggaacaagagtgccataatcacagccccgacggcgactcctccagcgactacgtgaataacaccagcgaggaggaagactacgatgagggacttccagaggaggaggagggcatcacctactacatacgctactgccccgaggacgatagttacctggaaggaatggactgcaacggagaggaatatctggcccactctgcccaccctgttgacaccgacgaatgtcaggaagctgtggaagagtggacagactcagccggtccacatccccacgggcacgaagcggagggcagccaggattatccagatggtcagcttcctattccagaagacgaaccatccgtcctcgaagcccatgatcaggaagaagacgggcattactgcgcctctaaagaaggttatcaggactattaccccgaagaagcaaacggtaatacgggcgcctcaccatataggctgcggagaggcgacggggatctggaagatcaagaggaagatatcgatcaaatcgtggcggaaatcaagatgtctctgtccatgactagtattaccagcgcctcagaggccagccccgagcatgggccagaacctggaccagaagatagtgtggaggcatgtcccccgatcaaagctagctgctctcccagtagacatgaggcccgccccaagtccctgaatctcctgcccgaagccaagcatccaggcgacccgcagcgcggttttaagcctaaaacaagaacccctgaagagcgcctcaaatggcctcacgagcaggtgtgtaatggactggaacagcctcgcaagcagcagcgctccgatctgaacggacctgtagacaataacaacattcccgaaacaaaaaaagtggcctctttcccaagcttcgtggctgtacccggtccttgtgaacccgaggatctaatagatggaatcattttcgccgccaactatctcggctccactcaattactgtcagaacgaaatccgtctaaaaacatccgcatgatgcaggctcaggaggcagtgagccgggtgaagagaatgcaaaaggctgctaaaatcaagaagaaggcaaattctgaaggagacgcccagacactgaccgaagtggacttatttatctccacacagaggatcaaggtcctgaatgctgatacacaggagacaatgatggaccacgcactgcgcaccatctcatacatcgctgatatcggcaacatcgttgtactgatggcaagaaggagaatgcctaggagtgcatcacaagactgtatcgaaacaacacccggggctcaagaggggaagaagcagtacaagatgatatgccatgtttttgaaagcgaagacgcacaactgatcgcgcagagtattggacaggctttttccgtggcctaccaggagttcttacgtgccaacggcattaacccagaggacctcagtcagaaagaatactctgacatcattaacacacaagaaatgtacaacgatgacctcatccatttttccaactctgaaaattgtaaggagcttcaactggagaaacacaagggcgaaatcctcggcgtggtagtggtggagtccggctggggatctatccttcccaccgttattttagctaacatgatgaacggtgggccagcagccagatccggtaagttgtcgattggcgaccagattatgagcattaatgggaccagcctggtgggcctccctttagctacatgccagggaattatcaaaggactgaagaatcagacccaggttaaattgaacattgtgtcatgtcctcctgtaaccactgtgttgattaagaggcccgatctaaagtatcagttaggtttttccgtccagaatgggattatctgctccctgatgagggggggcattgctgagcggggaggcgtgcgagtgggtcaccgcatcatcgagattaacggacagtcggtagtcgccaccgctcacgaaaagatcgtgcaggctttgagtaattccgtgggggaaatccacatgaagacaatgcctgctgccatgttccgactactgactggacaggagacccctctgtatatttag

SEQ ID NO: 108088 - DNA, 213 bp, Artificial Sequence
  Description of Artificial Sequence: Synthetic coding sequence
atggcccatagaaaacttgaatccgtgggtagtggcatgctcgatcatagagtaaggcctgggcccgtgcctcacagccaagagccggagtctgaagatatggagctgcccctggagggttatgttccagagggcttagagttggccgctcttcgacctgagagtcctgcaccagaagaacaggagtgtcacaatcattctccagatgggtag

SEQ ID NO: 108089 - DNA, 15 bp, Artificial Sequence
  Description of Artificial Sequence: Synthetic coding sequence
atggcccaccgttag

SEQ ID NO: 108090 - DNA, 339 bp, Artificial Sequence
  Description of Artificial Sequence: Synthetic coding sequence
atggcccatcgaaagctagagtctgtgggatccggcatgctggaccatcgtgtgcggcctggacccgtgccccactcacaggagccagagtcagaagacatggagttgccattggaaggatacgtgccagagggacttgagctcgccgctctcagacccgagtcacctgccccggaggagcaggagtgccataaccatagtccagatggcgattcctcttccgattacgtcaacaacacgagtgaagaggaagactatgatgaaggactacccgaagaggaggaggggataacatactatatcaggtactgccctgaggacgacagctatttggagtag

SEQ ID NO: 108091 - DNA, 2250 bp, Artificial Sequence
  Description of Artificial Sequence: Synthetic coding sequence
atggctcaccggaaactcgaatccgtgggatcaggtatgctagaccaccgtgtgcgccctggccctgtcccccattctcaagaacccgaaagtgaggatatggaactgcccttagaaggatatgtgcccgagggcttggagctggccgctctgcgaccggagtcaccagctcctgaagagcaggaatgtcacaaccacagcccagatggggattctagcagtgactacgtaaacaataccagcgaagaagaggactacgacgagggcctgcctgaagaggaggaaggcatcacctactatatcaggtattgcccagaagatgatagctatctcgaaggaatggattgcaacggagaagagtatctggcgcactctgcccaccccgtagacacagatgaatgccaagaggcagtagaagaatggaccgactccgctggcccccatccacacggacacgaagctgaaggcagccaggactaccccgatggacagctcccaatccctgaggacgagcctagtgtgctggaggcccacgatcaggaagaagacggtcactactgtgccagcaaggaaggttatcaggactattatcccgaagaggctaacggaaacaccggggcatccccttataggctccgacgcggcgacggagacttggaagatcaggaagaggacattgatcagattgtggcagagattaaaatgtccctgtcaatgacatctatcacctctgccagcgaggcttcaccagagcacgggcctgaaccaggacccgaggattccgtggaggcatgtccaccaattaaagcctcatgttcccctagcagacatgaggcccggcctaagtccctcaatctgttacctgaggccaaacacccgggagacccccagcgcggattcaagcctaaaacacgtactcctgaggagcggcttaagtggcctcacgaacaggtgtgcaatgggttggaacagccacggaagcagcaaaggtcggaccttaacggacccgttgacaataacaatattccagagaccaagaaagtcgcatcctttccctctttcgtagcggtccctgggccgtgcgaacccgaggacctgattgatggtataatctttgctgctaactacctcggcagcacccagctgctgagcgaaagaaatccttccaagaacattcgcatgatgcaggcccaggaggcggtttcgagggttaaacgaatgcagaaggcagctaaaattaaaaagaaagcgaattctgagggggatgctcaaactttaacagaggttgacctgtttatttcaacccagcggatcaaagtgctaaatgccgatacgcaggagaccatgatggaccatgctctacgcacaatttcttacattgcagatattggaaatattgttgttctcatggctaggagaaggatgccccggtcagcaagccaggattgcatcgaaacaacgccaggagcccaggagggcaaaaaacagtataagatgatttgtcacgtgttcgagtccgaagacgcccagttaattgcacaaagcattgggcaagcgtttagcgtcgcctaccaggagtttctgagggctaacgggattaacccagaggacctgagccagaaagaatactcagacatcatcaatacccaagagatgtacaatgatgacctcattcatttctcaaactccgaaaactgcaaggagttgcagctcgagaagcataaaggggagatactcggggtggtggtcgtagagagtggctgggggagcattttgcctacagttatcctggctaacatgatgaacggggggcctgcggcccgcagtgggaagttaagtattggggaccaaatcatgtctatcaatggtacgagtttggtggggctgcctctggccacgtgccaggggattattaaagggcttaaaaaccagactcaggtcaaattgaatatagttagctgtcccccagtgaccactgtgctgatcaagcgacccgacttaaagtaccagctcggctttagcgttcaaaatggcataatttgctctctgatgaggggcggcatagccgaaagaggcggtgtccgagttggacatagaattattgagatcaatggccagtcagtggttgctaccgcccatgagaagatagtccaggctctcagtaacagcgtgggagaaatccacatgaagactatgccagctgctatgtttaggctgctgactggccaggagacacctttatacatatag

SEQ ID NO: 108092 - DNA, 2127 bp, Artificial Sequence
  Description of Artificial Sequence: Synthetic coding sequence
atgagcgtaccctcctccctttctcagtccgctattaacgccaattcccacggaggtccagcactctccttgccactgccccttcacgcagcccacaatcaactactaaatgccaagctgcaggcaactgccgtgggtccgaaggaccttagatctgccatgggagagggaggaggcccagaacctggtcccgcaaacgctaagtggctgaaggagggccaaaaccaattgcgacgcgcagctacagcacacagagatcaaaatcggaacgtgaccttaacactggcagaagaggcctctcaggagcccgaaatggcccccttgggaccaaaaggcctgatacacctgtactcagaactggaactctccgcccataacgctgctaaccgagggttacgaggacctggcttgatcatttccacacaggaacagggccctgacgagggtgaagagaaggcagctggtgaagcagaggaggaagaagaggacgatgacgacgaggaggaggaagaggacttgtcctccccgccaggcttgcccgagcccctcgagtctgtcgaggccccacccagaccccaggcacttactgacgggccacgcgagcactctaaatctgcatcccttctcttcggcatgcgcaactccgcagccagcgatgaagatagttcatgggcaacactgtcacaaggtagcccatcctatgggtcaccagaggatacagattccttttggaaccccaacgcatttgaaactgactccgacttgccggccggatggatgcgagttcaggatacttctgggacttactactggcacattcccacagggaccacccagtgggaacctccaggaagagcttccccatctcaaggctctagcccgcaggaggaatcacagctgacttggacaggatttgcgcacggggagggattcgaagatggagaattctggaaggacgaaccctcagacgaggccccaatggaacttggcctgaaggaacccgaagagggcacccttacattcccagcacagagtctcagtcctgaacctctgccccaggaagaggagaagcttccacctagaaatactaaccccggtataaaatgctttgccgtgcgaagccttggatgggtcgagatgacagaggaagagctcgctccgggccggtcttcggttgccgtgaataactgtatcaggcagctttcttaccataagaataacctccacgatccaatgtccggggggtggggcgagggtaaagatcttcttctccagctagaggacgagaccctgaagctcgtcgagccccaatctcaggctcttcttcacgcgcagcctattatatccataagagtatggggagtggggcgggacagcggacgtgactttgcctacgtggcgcgagacaagctcacacagatgctgaagtgtcacgtcttcaggtgtgaggccccagctaagaatatagctacgtccctccatgaaatttgcagtaagattatggccgaaaggagaaacgcacgctgtctggtgaacggcctgagtctggatcactccaagttggttgacgtccctttccaggtggagtttccagcccctaaaaatgaactggtgcagaaatttcaagtctactacctgggcaacgtgcctgtagccaagcctgttggcgtagatgtcattaacggggcactagagtccgtgctgagttcctcatcacgggaacagtggacaccaagccacgtctccgtcgcacccgcaaccctgaccatcctgcaccagcagactgaggcagtacttggcgagtgtcgggttcgattcttgagtttccttgcagttggccgcgacgtgcatacctttgcattcattatggctgctggtcccgcctcattctgttgccatatgttttggtgcgagcccaatgccgcgagtctgtccgaggcggtgcaggctgcctgcatgttaaggtaccagaagtgccttgacgcacggtcccaggcttcgaccagctgcttacccgccccacccgccgagagtgttgctcgcagggtcgggtggacagtcagacgaggggtgcagagtttgtggggatctctcaagcccaagcgtctcggtgcgcacactccctag

SEQ ID NO: 108093 - DNA, 2127 bp, Artificial Sequence
  Description of Artificial Sequence: Synthetic coding sequence
atgagcgtgccaagctcactgtcccagagcgctattaatgccaactcccacgggggcccagccctcagcctccctcttcctctgcacgcagcccacaatcaactactgaatgccaagttgcaggccacagccgtcggacctaaagacctgcgaagcgctatgggcgagggaggcggacccgagcccggcccggccaatgccaagtggcttaaggaaggacagaatcagctacgtagagccgcaacggcccatcgggaccagaacagaaacgttacattgacactggccgaggaagccagccaggagccggagatggcccccctcggccctaaaggtcttattcacttatactcagaactcgagctcagtgcacacaatgcagctaatcgaggccttcgcggccctggactgattataagtacacaagagcagggcccagacgagggcgaagaaaaggctgctggagaggccgaagaggaggaggaggatgacgatgacgaagaagaggaagaggatttgtcctcccctcccggactgcctgagcccctggaaagcgtggaagcacccccgaggcctcaggccctgaccgacggccccagggagcattccaagagtgcttccctcctgttcgggatgcggaattctgccgcctctgatgaagacagtagctgggccacactgtcccagggtagcccgtcttatggaagccccgaagacaccgactccttctggaatcccaacgccttcgagaccgattcggatcttcctgctggctggatgcgggtgcaggacacttctggcacttactactggcatattcctactggaacaacccagtgggagccgcctggtagagcctctcccagccaggggtcctccccccaggaagagagccagcttacctggacgggttttgcacacggagaagggtttgaggacggtgaattttggaaggatgagccgagcgatgaagcccctatggagctgggactgaaagagccagaggaaggtacactgacctttccggcacagtctctgtcccccgaacctctgccccaggaagaggagaaactgcctcctcgcaataccaatcctggtatcaagtgttttgccgtccggtctttaggatgggtggagatgactgaagaggaacttgccccgggtcggtcttccgtcgcggttaacaattgcatccgccaactaagctaccacaagaataatttgcatgacccaatgtccggtgggtggggagaagggaaagatctcctgttgcaactggaagatgaaaccctcaagctggtggagccccagtcgcaagctttgcttcatgctcagccgatcatctccattcgcgtttggggcgtggggagggacagtggcagagattttgcatatgtcgcacgggacaaactgacccagatgctaaagtgccatgtgtttcgatgtgaggctcccgcaaaaaacattgctacgtcacttcatgaaatctgctctaagataatggctgagaggagaaatgcccgctgtctggttaatgggttgtcactagaccatagcaagctggtggatgtgccattccaggtggagtttccggcaccaaaaaacgagttagtacagaagttccaggtgtattatcttggaaatgtgcctgtggccaaacctgtgggcgtggacgtaataaacggcgccctggagagtgtgctgagctccagctcccgggaacagtggacaccctctcatgtgtctgtggcccctgcgacactgaccattttgcatcagcagactgaagcagtcctcggagaatgccgagtgcggtttctgtccttcctggccgtcgggcgcgacgtgcatacattcgctttcatcatggcagcagggcccgcctctttctgttgtcacatgttctggtgtgagcccaacgccgcctcattgagtgaggccgtccaggccgcatgcatgctacgctatcaaaaatgcttggatgcgaggagccaggccagtacaagctgcctcccagcccctccagcagaatccgtggcccgtcgagttggttggacagtgaggcgaggcgtccagtcactgtgggggagtctaaaaccaaagagactgggagcccataccccctag

SEQ ID NO: 108094 - DNA, 2133 bp, Artificial Sequence
  Description of Artificial Sequence: Synthetic coding sequence
atgagcgtccctagttctctgagtcagagcgccatcaacgcaaattcccacggagggcctgccctgtctctgcccctgcctctgcacgccgcccacaatcaactgcttaatgcgaagctgcaggcgaccgccgtcggaccaaaagatctcagaagcgctatgggggagggcggtgggccggagccgggacccgcaaatgccaaatggttgaaagaaggccagaaccagttaagaagagctgcaacagctcatcgagaccaaaatcgaaacgttacactcacactcgcagaagaagctagccaggagcctgaaatggcgcctctgggtcctaaaggcttaatccacctgtacagcgaactcgaactttccgcacacaacgctgctaatagagggctgagggggccaggactcatcatttccacgcaggagcagggcccggatgagggtgaggaaaaggccgcgggagaagcagaggaggaggaagaggatgacgatgatgaagaagaggaagaggatttgagctcccctcctggccttcctgagcctctggagagcgtcgaggcaccaccccgtccacaggccctgacagacggccctagagaacatagcaaatccgcatctcttctgtttggaatgaggaactccgccgcatccgacgaggatagcagctgggcgaccctgtctcagggatctccctcttacggcagtcccgaagacacggactccttttggaatcccaacgccttcgaaactgactccgacctgcccgccggttggatgcgagtccaagacacgagtgggacatactactggcacatacctacgggtacaacacagtgggagccacctggccgcgcatcccccagtcagggcagtagccctcaggaggagagccagctcacgtggacaggcttcgcacacggcgagggctttgaagatggggaattttggaaagatgagccatctgatgaagcacccatggagcttgggctgaaagaacccgaggagggcactctaaccttcccagctcaaagcttgtctcctgagcctttgcctcaggaggaagaaaaactgccaccgcgcaataccaaccctggcatcaagtgtttcgctgtgagaagcctgggatgggttgaaatgaccgaggaggagcttgccccggggagatcctcagttgccgtcaacaattgcattaggcaattatcctatcacaagaataatctgcacgacccaatgtcgggcgggtggggagaggggaaagaccttctactccagctggaagatgagacactaaagctagtggaacctcagagccaggcgcttctccatgctcaaccaattatctccatacgcgtgtggggcgttggccgtgatagcgggtcaaaccgagattttgcctatgttgcgagggataaactcacacagatgctgaaatgccatgtgttccgctgtgaagcccccgctaaaaatattgctaccagcctccatgagatatgttctaaaatcatggccgagcgacgcaacgcccggtgtctcgtcaacgggctgagcctggaccactcaaagttagtagacgtgcctttccaggtggagtttcctgcgcccaaaaacgagctggtccagaagttccaggtctattacctcggcaacgtgcccgtcgcaaaaccagttggtgtggatgtgattaatggggctctcgaaagcgtgcttagttcatcaagtcgggagcagtggactccaagtcacgtttccgttgcacctgctactctgaccatcctccatcagcagacggaggctgttcttggggagtgtagagtaaggttcctctctttccttgctgttggcagggacgtgcacacattcgctttcattatggctgcaggacccgcctcattttgctgtcatatgttttggtgcgagcccaatgctgccagcttgtcggaagccgtgcaggcggcttgtatgttgcgatatcagaagtgtctggatgctcggagtcaggccagcacgagctgtttacctgcccctccagcagaatctgtggccagacgggtaggttggaccgtgcgacggggagtgcagtccctatggggctccctgaagcccaagaggctgggggcacatacgccctag

SEQ ID NO: 108095 - DNA, 1356 bp, Artificial Sequence
  Description of Artificial Sequence: Synthetic coding sequence
atgagggtgcaggacacttccggaacttactattggcacatccccactggcacgactcagtgggaaccgcccggaagagcatcccccagtcagggctccagtccccaggaagagagtcagttaacctggacagggttcgcccacggggagggattcgaagatggcgagttctggaaggatgagccctccgatgaagcacctatggagctcggcctgaaggagcccgaagaaggtacactcacatttccagcacaatctctatcccccgagcccttaccgcaggaagaagagaagttaccgcctcgtaatacgaatcctggtataaagtgctttgccgtgcgttccctgggatgggtcgagatgacggaggaagaactcgcaccaggcagaagttcggtagctgtcaacaattgcatccgtcagctaagttaccacaagaacaatctacatgatcctatgtctggcgggtggggagagggcaaagatttgctgctgcagctcgaagacgaaaccttaaaactggttgagccccaaagtcaggccctgttacacgcacagcctattatcagcatccgtgtttggggagtgggaagggattcaggttctaatcgtgatttcgcctatgtggctagagacaaactgacccagatgctaaaatgtcacgtatttaggtgtgaggcccctgcaaagaatatcgcaacaagtctgcatgagatctgttcaaagatcatggccgagaggaggaatgcccgctgtttggtgaacggattgtcgctggaccacagcaaactggtggatgtgccgttccaggtggaattccccgcgccaaagaatgagcttgttcagaagttccaggtatattatctgggcaatgtcccggtcgctaaacctgttggcgtggacgtaatcaacggtgctctggaatcagtcctatcttcaagttcacgcgaacagtggacccctagccacgtgagcgtagctcctgccactcttactatccttcaccaacagacagaagctgttctgggcgagtgtcgggtgcgctttctgtccttcttggctgtgggaagggatgtgcacaccttcgcctttatcatggcagcgggccccgcaagcttttgctgtcatatgttctggtgcgaacccaatgctgccagcttatctgaggcagtgcaagcggcatgtatgcttcgttaccagaagtgcttggacgcacgctctcaggcaagtacttcttgcttgccggccccaccagcagaatctgtcgcccgaagggtgggatggacagtgcgacggggtgttcagtctctctggggatcattgaagcctaaacgcctcggtgcgcatacgccctag

SEQ ID NO: 108096 - DNA, 1680 bp, Artificial Sequence
  Description of Artificial Sequence: Synthetic coding sequence
atgagtgtaccaagctctttgagccagtcagcgatcaacgcaaactcacatgggggacctgccctgagtctgccactgccactacacgccgcccacaatcagttactcaacgccaaactccaggccaccgccgtggggccgaaggacctgcatagtaagagtgcctctttgctgtttgggatgcggaactccgccgcctcagacgaagatagctcatgggcaacactgagccaggggtccccaagttacggtagccctgaggacactgattctttctggaatcctaacgccttcgagaccgactcagacctgcccgcaggatggatgcgcgtgcaggatacgagtggcacatattactggcatattcccaccggaacaacccagtgggaaccacctggcagagctagcccgtcgcaggggtcgagtcctcaagaagaatcccagttaacatggaccgggtttgcccacggggagggcttcgaagatggcgaattctggaaggatgaaccctccgacgaggcacccatggagctgggactgaaggaaccagaggagggcaccctgacgtttcctgcccagtctttatctcccgagccactcccacaggaggaggagaagctgcctcctaggaacaccaatcccgggattaaatgttttgccgtgaggagtcttgggtgggttgaaatgactgaggaggagctcgctcctggtcgttccagcgtggcagttaataattgcatccgccagttgtcctaccacaagaataacttgcacgaccctatgagtggaggttggggggaaggtaaagacctcctgctgcagcttgaggacgaaacgctaaaacttgtggaacctcagtctcaggctctgctccatgcccagccaatcatctccattagagtgtggggagttggtcgcgactcagggtcaaacagagactttgcgtatgtcgcccgcgataagttaacacagatgctgaagtgtcatgtcttccggtgtgaggccccggcaaaaaacatagctacctcactgcatgagatctgcagtaagatcatggccgagagacgcaacgcacgctgtttggtgaacggattgagtctggatcattccaagttagtggacgtcccttttcaagttgaatttcccgctcctaaaaacgagttagtacagaaattccaggtctactaccttgggaacgttccggtcgcaaagccggttggtgtggatgtaatcaatggggctttagaatcagtgctctcatcttcatctcgcgaacagtggaccccaagtcacgtgagtgtggcccctgccacactcacgatcctgcatcagcagacagaggcagtgctgggagaatgtcgagtacgcttcctcagctttcttgccgtgggtcgagatgtccatacgttcgcttttattatggccgccgggccagcatctttttgctgccatatgttctggtgtgaacccaatgctgcctccctttcggaggccgtacaggctgcatgcatgctccgctatcaaaagtgtttagatgcccgatcacaagctagcacctcctgtctgcccgctccgccagccgaaagtgttgcacggagagtggggtggactgttcggcgcggggtgcaaagcctttggggatcgctgaaacccaagcgacttggcgcacatacgccttag

SEQ ID NO: 108097 - DNA, 1428 bp, Artificial Sequence
  Description of Artificial Sequence: Synthetic coding sequence
atgactcaaatgagggattcgttctggaatccaaacgcgttcgagacagattctgacctccctgcgggttggatgagggtccaagacacctccggaacctactactggcatattccgacgggcaccacacagtgggagccccctgggcgggctagcccaagccagggctctagccctcaggaggagtcccaactcacttggactgggtttgcccacggggagggcttcgaagatggggagttctggaaggatgagccatctgatgaggccccaatggagctcggcctgaaggagcccgaagagggaactctgactttccccgcccagtcactgtcaccagagccattacctcaggaagaggagaagcttcctccaagaaataccaatcctgggataaaatgcttcgctgtgaggtccctgggctgggttgagatgacggaagaggaactggcccctggtagaagctccgtcgccgtgaataactgcatcaggcaactcagttaccataaaaataatcttcacgatcctatgtccggagggtggggggaaggaaaagacctccttctgcagctcgaggatgagactctcaaactggtagagccacagtcgcaggccctccttcatgcccagccaatcatcagcattagggtttggggggtcggacgggattccggttctaatcgggattttgcctacgtggcccgagacaagctcacacagatgctcaagtgccatgtgtttaggtgcgaagcccctgccaagaacatcgccacaagtttgcacgaaatatgttccaaaatcatggccgaacgcaggaatgcaaggtgcctcgtgaatgggctgagcctggaccatagcaaactggtcgacgttcctttccaggtcgaattcccagctcccaagaatgaactggtgcaaaagttccaggtgtattacctgggcaacgtccccgtggctaaacccgttggggtggacgtcatcaacggagctttggagtcagtcttgtcgagtagttccagggaacaatggactccctcccacgtgtccgtggctcccgctacacttaccattcttcaccaacagactgaggcggtgctgggcgaatgtcgcgtgcgcttcttatcattcctggccgtgggacgtgatgtgcacactttcgcgtttattatggccgctgggccagccagtttttgctgccacatgttctggtgcgagcccaacgccgcttcgctgagcgaggccgtgcaggctgcttgtatgctgagataccagaagtgtcttgacgcgagatctcaggcatccacgagttgcctcccagctccacccgccgaaagcgtggcccggagagtaggttggaccgtcaggagaggcgtccagagcctgtggggaagcctgaaaccaaagcgcctgggtgcgcacaccccgtag

SEQ ID NO: 108098 - DNA, 2277 bp, Artificial Sequence
  Description of Artificial Sequence: Synthetic coding sequence
atgtccgaggtattacctgccgactcgggcgtggataccctggccgtgtttatggcaagctcaggcaccaccgacgtgacaaacagaaactcgccagcgacacctccgaatacgctcaatctccggagtagtcataacgagctcctcaacgcagagataaagcacactgagacaaaaaatagcactcctcctaagtgccggaaaaagtatgctttgactaatattcaggccgctatggggttgagcgaccccgcagcccagccactgcttggcaatggttctgctaacattaaattagtgaagaatggtgagaaccagctgagaaaggccgccgagcagggccagcaagacccgaacaaaaacctctctccgactgctgtcattaacatcacctccgagaagttggagggcaaagaaccccacccacaggatagcagctcctgtgaaatcctcccttcccagcccagacggactaagtcttttttgaattattatgcggacttggagacttccgcccgggagttagagcaaaaccggggaaatcatcacgggaccgccgaagagaaaagccagccagtgcagggacaggcaagcacaatcatcggcaacggtgacttgctgctacagaagcccaataggccgcaaagcagtcctgaagacggccaggtggctacagttagcagtagtcctgagaccaagaaagatcatccgaagacaggcgccaaaaccgattgcgcacttcatcggatccagaacctcgctcccagtgacgaggagagtagctggactaccttgtcccaggacagcgctagcccctcatcccccgatgaaacagatatctggtcagaccactctttccaaactgacccggatctcccccctggctggaagcgggtatctgatattgccggaacatactactggcacatcccgaccggaactactcagtgggaaaggcccgtgtctatcccggcagatctgcaggggagccggaaagggtctttatcatccgtgacaccgtcccccacaccagagaatgagaagcagccttggagcgatttcgcagtactcaacggcggaaaaataaatagcgacatttggaaggacttgcacgcagccaccgtcaaccctgatccatccctgaaagaattcgagggcgccaccttgagatatgcatccttaaagctgcgaaatgcaccccatcccgatgatgacgactcatgttcaattaactccgatcccgaggcaaagtgtttcgctgtgaggtcactcggatgggtggagatggcagaggaggatcttgctccaggcaagtcctcagtcgccgtcaataactgcattcgccaactgtcctactgcaaaaacgacatccgagacacagtcggcatttggggcgagggcaaagacatgtatctgatccttgagaacgatatgttgtcattagttgatcctatggaccgttctgtcctgcattcccagccgattgttagcatccgggtctggggcgtggggcgcgataatggccgcgactttgcttacgtggctcgagacaaggacactaggatcctgaagtgtcatgtcttcagatgtgacacacctgccaaggccatcgctacatctcttcatgagatctgctcaaaaatcatggcggaaaggaaaaacgctaaagcactcgcctgctcctccctgcaagaaagggctaacgtgaacctcgacgtcccactacaggtagacttccctactccaaagaccgaactagtgcagaaatttcacgtgcaataccttggaatgctgcccgttgataagccagtagggatggatatcctaaattccgccattgagaacttaatgacttctagcaacaaggaggactggctatctgtgaacatgaatgttgcagacgctacagtgacagtcatctcagagaagaacgaggaagaggtgctggtagagtgtagagtacgcttcctcagcttcatgggggttggcaaggacgtgcacacatttgcttttatcatggacaccggaaaccagagatttgagtgccacgttttctggtgtgagcctaatgctggcaatgtgagtgaggcagtccaggccgcctgcatgcttaggtaccaaaagtgcttggtggccaggcccccctcccaaaaagtcaggccccctccaccacccgcagattcggttacccgaagggtcaccacaaatgttaaaaggggtgttctttctctgatagatacacttaaacagaagaggcccgttaccgagatgccttag

SEQ ID NO: 108099 - DNA, 2274 bp, Artificial Sequence
  Description of Artificial Sequence: Synthetic coding sequence
tcccattgtatacccgcagattccggggtagataccttggccgtttttatggcctcaagcggtacaaccgacgtgaccaatcggaattcacccgccacccccccgaatacgctgaacctccgctcctcccataatgagctcttaaatgcagagattaaacacaccgagactaaaaatagtacacctccaaaatgccgaaaaaagtatgccctaaccaacatccaggcagccatgggtctttccgatccagcagctcagcctctgttgggcaatgggtcggctaatatcaaacttgtaaaaaacggcgagaaccagctgcgcaaggccgccgagcaggggcaacaggatcccaacaagaatctgtcccctaccgcagtgattaacattacatccgagaaactggaaggcaaggaaccgcatccccaggactcatctagctgtgagatattacctagtcagcctcggagaactaaatctttcctcaactattatgccgacctggaaacctcagccagagagctggagcagaacagaggaaaccaccacggaacagccgaggaaaagagtcagccagtgcagggccaagcaagtaccatcatcgggaatggcgacctcctcctgcagaagcctaacaggccccaaagctctccggaagacggccaggtggccactgtgagttccagccccgagaccaaaaaagaccaccccaagacaggggctaaaacagactgcgcgctccaccgcattcagaatctggccccttccgatgaagaatcatcatggaccaccctcagccaggacagcgcctccccctcgtccccggacgagacagacatttggtctgatcactcattccagaccgacccagacttgcctccaggatggaagagagtgtctgatatagccggcacatattactggcacatcccgacaggcactacccagtgggaacggcctgtaagcatcccagcggatctgcagggtagccggaaggggagcctctccagtgtcaccccaagtcccactcctgagaacgaaaaacagccctggtctgatttcgccgtgctgaatggtgggaagataaactctgacatatggaaagacctccatgccgcaacagtcaatcccgatccatcacttaaggagttcgagggggccactctccggtacgcctcacttaaactgcggaatgcccctcatcctgatgacgatgactcctgctctataaattctgatccagaggccaagtgctttgcagtgagatccctgggttgggtcgaaatggctgaggaggatctcgctccgggaaaatccagcgtggcagtcaacaattgcattaggcagctaagctactgcaagaacgacatcagggatactgtcggtatatggggcgagggcaaagacatgtatcttatactggaaaatgacatgctgtctctggtggaccctatggacaggagtgtgctccactcccagccaattgtatctatccgcgtgtggggcgtgggtcgcgacaatgggcgcgacttcgcctacgtggcaagagacaaggacacgcggatccttaagtgtcacgtgttccgatgtgatacaccggctaaagctattgccacctccctgcacgagatctgtagcaaaataatggcagaacgaaagaatgccaaagcactggcctgcagctctctgcaagagcgcgctaatgtcaacctggatgtaccccttcaggtggatttcccaaccccaaagacggagcttgtacaaaaatttcatgttcagtaccttggaatgctccccgtcgacaagcctgtgggtatggacattctgaacagcgcaatagagaacttgatgacgtccagcaacaaggaagactggttgtctgtgaatatgaacgtggccgacgctactgtcaccgtcatcagcgaaaaaaatgaggaagaagtgctggttgagtgtcgggtgagatttcttagcttcatgggagtggggaaggatgtacataccttcgcttttattatggatactggcaatcaacggtttgagtgtcatgttttctggtgcgagcccaatgcaggcaatgtcagtgaagccgttcaggctgcatgtatgctgagataccagaaatgcctcgttgctcgacctccaagccagaaggtccggccacctccgcctcctgctgattccgtcacccgcagagtgaccacaaacgtgaaacgcggggtattgtctttaatagatacactcaaacaaaaacgcccagtgacagagatgccctag

SEQ ID NO: 108100 - DNA, 633 bp, Artificial Sequence
  Description of Artificial Sequence: Synthetic coding sequence
atggccgagcgcaagaacgccaaagctctcgcttgttccagtctgcaggaacgggcaaacgtgaatctggacgtacccctgcaggtggacttcccaacgccaaaaacggaactcgtccagaaatttcatgtgcaatacctgggtatgctgcctgtcgataagcctgtgggtatggacatcctgaattcagccattgaaaacctcatgacatcttcaaataaagaggactggctcagcgtgaacatgaacgttgctgacgccacagtcactgtaatatctgagaagaacgaggaggaggtgttagtagagtgtcgagtgcggtttttgtcttttatgggtgtaggcaaggatgtgcacacattcgccttcatcatggatactggcaaccagcggtttgagtgtcacgtgttctggtgcgagcctaacgccggaaatgtttcggaggcggtacaggcagcttgcatgctgcgataccagaagtgtcttgtcgcacgcccacccagccagaaggttagacctccccctccgccagccgattccgtcacccgccgtgtgactaccaatgttaagagaggcgtgttaagcctgatcgacacgcttaaacagaagcgacccgtaacagagatgccttag

SEQ ID NO: 108101 - DNA, 33 bp, Artificial Sequence
  Description of Artificial Sequence: Synthetic coding sequence
atgtcagaagtgctcccagccgatagtggctag

SEQ ID NO: 108102 - DNA, 633 bp, Artificial Sequence
  Description of Artificial Sequence: Synthetic coding sequence
atggcagagcgcaagaatgccaaggccttggcctgcagttccctccaggaacgcgctaacgtgaatttggatgtgccactgcaggtcgatttcccaacccctaaaactgaactcgtccaaaaatttcacgtgcagtatttaggcatgctgcctgtggacaaacctgtgggcatggatattctcaatagcgccatcgaaaatctgatgacgtctagcaataaggaagattggctttccgtgaacatgaacgtcgcggatgcaaccgttacagtgatcagcgagaaaaacgaggaagaagtgctggttgaatgtagagttcgctttctgtccttcatgggtgttggaaaagatgtccacacattcgcattcatcatggacacagggaatcaaagatttgaatgccacgtgttctggtgtgaaccaaatgctgggaacgtttccgaggcagtccaggctgcctgcatgttacgctaccaaaaatgcctcgtcgccaggccaccttcacaaaaggtgcggcccccccctccccctgcagacagtgtcactaggcgcgttactacaaacgttaagcgcggcgtgctgtccctgattgacactctgaagcagaaaagacccgtaacagagatgccctag

SEQ ID NO: 108103 - DNA, 2214 bp, Artificial Sequence
  Description of Artificial Sequence: Synthetic coding sequence
atgagcgaagtcctgccagctgattctggagtggataccctcgctgtttttatggcctcatcaggcacgacagacgtgactaatcgcaacagcccagccactcctcctaacactctcaaccttcgatcatcccacaacgagctactcaacgcagagattaaacataccgaaacaaagaatagcacaccgccaaagtgtaggaaaaaatatgcccttacaaatatacaggctgctatgggactcagcgatccagccgcccaaccactgctgggcaatggcagcgccaatatcaaactggtgaagaacggggaaaaccaattgaggaaggccgcagagcaggggcaacaggatccaaacaagaatctgagccccaccgcagtgattaatattacgtccgagaagcttgaaggcaaagagccacatcctcaggattcatctagctgcgagatactccccagccaaccacgtagaacaaaatcatttctgaattactatgcagatttggaaaccagcgcgcgggaattggagcaaaatcgaggtaaccaccacggcactgcggaagagaagagtcagcctgtgcagggccaggctagtacaataattgggaatggcgatctgcttttgcagaaacccaaccgcccacagtccagccctgaagacgggcaggtggcaaccgttagctcctcacccgaaactaagaaagaccatcctaaaactggggccaagaccgattgcgccttacatagaatccaaaatctcgctccctcagacgaagagagctcatggacgactctaagccaggatagcgcgtcaccgtctagccccgatgagaccgacatctggagtgaccactctttccagaccgatccggacctcccaccaggttggaagcgcgtaagcgacatagctggcacctattattggcacattccaacaggtaccactcagtgggaacgccccgtgtcaattccggccgatctgcaagggagccgaaaaggctcactctcgtccgtgaccccttcaccgacaccggaaaacgaagatctgcacgccgccacggtaaacccagatcccagcctgaaggagttcgagggtgccactctgaggtatgcatccctgaaattgcgtaatgcaccacatcccgacgacgatgattcatgttccattaactcggatcccgaagccaagtgctttgccgtgcgctcgctgggatgggtggagatggctgaggaagacctggcacccggcaagtcctccgtggccgtgaacaactgtatcaggcagctgtcgtattgcaaaaacgatattcgggatactgtcgggatttggggggagggtaaggacatgtacctcatcctagaaaatgacatgcttagtctggttgatcctatggaccggagtgtgctacactcccagcctattgtgtctatacgggtgtggggagttgggcgagataacgggcgagactttgcttacgtcgcgcgggacaaagatactcgtatcttgaagtgtcatgttttccgctgcgacacacccgctaaggccattgctacatcactccacgagatatgtagcaaaatcatggctgagaggaagaacgcaaaggcactggcttgctcctctttgcaagaacgcgccaatgtgaatctggatgttcccttgcaggtcgattttcccacccctaagaccgagctggtacaaaagtttcatgtgcaatacttgggaatgctcccagttgataagccggtgggaatggatatcctgaactctgccattgagaacctaatgacgtcaagcaacaaggaagattggctcagcgtaaacatgaacgtggctgatgccacagtgactgtcatcagcgaaaagaatgaggaggaagtcctggtcgaatgccgcgtgcggttccttagcttcatgggagttggcaaggacgtgcataccttcgctttcataatggataccggcaatcagaggttcgagtgtcacgtgttctggtgtgaaccgaatgccgggaatgtgtctgaggccgttcaggccgcttgtatgctgcgttaccaaaaatgcctcgtcgctcgccctccgagccagaaagtacgccctcctccgccacctgccgattccgtcaccaggcgggtcacaaccaatgtgaaaagaggagttctctctctgattgacaccttgaagcaaaaacgcccagtgaccgaaatgccttag

SEQ ID NO: 108104 - DNA, 2280 bp, Artificial Sequence
  Description of Artificial Sequence: Synthetic coding sequence
atgtctgaagtcttgccagcagattccggtgtagataccctcgcagtctttatggctagcagtggaacaaccgacgtgacaaaccggaattccccagctactcccccgaataccctgaacctccggagtagtcacaacgagctgctaaacgctgagatcaaacatacggaaacaaagaactcaacccccccaaaatgtagaaagaaatacgcactgacaaacatccaggccgccatgggactgtccgaccccgctgcacaaccgcttctgggaaatgggagcgctaacatcaaacttgtcaaaaatggagaaaaccagctgcgcaaagccgcagagcagggacagcaggatcctaacaagaatctctcaccaactgccgtgattaacatcaccagcgagaagctcgagggaaaggaaccgcatccccaggatagctccagttgtgaaatcctcccatcccagccccgaagaaccaaatcatttttaaattactacgctgatcttgaaacgtctgcccgcgaactggagcagaacaggggtaaccatcacggcacagccgaagagaagtcacaacctgtgcagggacaggcaagcactataattggaaatggagacctacttctacagaaaccgaaccgaccccagtcctcccccgaggatggacaagttgccactgtgtcttctagtcccgagaccaagaaggaccaccccaagactggcgctaagaccgactgtgcccttcaccggattcaaaacttggccccatctgacgaagagtcctcttggacaactctctcacaggactcagcatcccctagctctccagacgagactgcagacatctggtcagatcattcattccaaacagaccccgatctgcctcctgggtggaaacgtgtgtctgacatagccggcacgtattattggcacattccgacaggcacgacacagtgggaaaggccagtgtctatcccagcagacctgcagggatctagaaagggcagcctgtccagcgtgaccccctctcctactcctgaaaacgagaagcaaccctggtctgatttcgctgtactaaacgggggcaagattaactccgatatttggaaggacttgcatgccgcgaccgtgaaccctgatcctagcctaaaggaatttgaaggggccacacttcggtatgccagtcttaagctgaggaacgcaccgcatcctgacgatgacgattcctgtagtattaatagcgatcccgaggccaagtgctttgccgtgcggtccctcggatgggtggagatggccgaagaggatctggccccgggaaagagctcagttgcggtgaataattgtattcgacagctgtcttattgcaagaacgacattagagatacagtgggtatctggggggaaggcaaagatatgtatctcatacttgaaaacgacatgctttccctcgtggatcctatggaccgaagcgttctccactctcaacccattgtgtctatccgcgtgtggggagtgggccgggataatggtagggattttgcgtacgtggctcgagacaaggatactagaatactcaaatgccacgtcttccgatgtgatactcctgccaaggccatcgcgaccagtctccacgaaatttgcagcaaaatcatggcggagcgaaagaacgcgaaggctttagcatgttcaagcctgcaggagagggccaacgtcaatcttgacgtgccactgcaggtagacttccctactcccaaaacagagctggtccagaagtttcacgtgcagtacctcggcatgctgcccgtggacaaacccgtgggcatggatatcctgaattcagccatcgaaaacctgatgactagcagtaacaaggaggattggctctcagtaaatatgaacgtagccgacgctaccgtcactgtgatcagcgagaaaaatgaggaagaggtgttggtggagtgcagagtgcgctttctctcctttatgggcgttggaaaagacgtgcacactttcgcattcattatggacacagggaatcagcgcttcgagtgtcatgtattttggtgtgagccaaatgctggaaacgtctctgaggccgtacaggcggcatgtatgctgcggtaccagaaatgcctggtggcacgacccccttcacagaaagtccgaccacccccacctcctgccgactctgtgacaaggcgagtaacaactaatgttaaacggggggtattgagtctgattgataccctcaagcaaaagagacctgtgaccgaaatgccctag

SEQ ID NO: 108105 - DNA, 84 bp, Artificial Sequence
  Description of Artificial Sequence: Synthetic coding sequence
atgtcggaggtgctgcctgcagactcgggcgttgacactctggctgtctttatggcctcctctggtactacagacgttacgtag

SEQ ID NO: 108106 - DNA, 207 bp, Artificial Sequence
  Description of Artificial Sequence: Synthetic coding sequence
atgtcagaggtgctcccagccgatagcggtgtcgacacactggcagtgttcatggcttcctcgggcactacagatgtcaccaaccggaactccccagcgacacctcctaatactcttaacctgcgctccagtcacaacgagctcctgaacgccgagatcaagcatacagaaacgaagaactccactccccctaaatgtaggaaatag

SEQ ID NO: 108107 - DNA, 2211 bp, Artificial Sequence
  Description of Artificial Sequence: Synthetic coding sequence
atgtctgaagttctccctgccgacagtggagtggacacacttgccgtgtttatggccagcagcggtacaactgatgttactaaccgaaatagcccggcgaccccacccaatactctcaacctcagatccagccataacgagctgttgaatgctgaaatcaagcacacggagacaaagaactccacgccccctaaatgtcgtaaaaagtatgccttgaccaatatccaagccgcaatgggcctctctgaccctgctgcacagccccttcttggcaacgggtccgccaacattaaactggtgaagaatggtgaaaaccagttgcggaaggccgctgaacagggtcagcaagaccccaacaagaacctgtcccccaccgcggttataaatattaccagcgagaagctcgagggcaaagagcctcacccccaagattcatcatcttgtgaaattctgccatcccaacccaggaggactaaatctttcttaaactattacgctgacctcgagacatcagcccgcgagctagagcagaatcgaggcaaccaccacggtaccgcggaggaaaagtcccaaccagtccagggacaggccagcactatcattggcaatggcgacttattgttgcagaaaccaaaccggccccagtcatcgccagaagacggccaggtggctaccgtgtcgagctcccccgagaccaagaaagatcatcccaaaaccggcgctaagactgattgcgccctacaccgtatacaaaacctggctccatccgacgaggaatccagctggacaacgctaagtcaggacagcgcctctcccagtagcccagacgagactgacatctggagcgaccacagttttcaaactgatcccgatttgcccccagggtggaagcgggtctctgatatagcgggcacatattactggcatatacccaccggcactacccagtgggaaaggccagtgtcaatccccgctgatctccaaggcagtaggaaggggtctctgtcatccgttacaccctcccctactccggaaaacgaagatttgcacgcggctacggtgaacccagaccctagcctgaaggaatttgaaggggccacccttaggtacgcctcgctaaaactcaggaatgcgccacatcctgacgatgacgattcttgctccattaactcagatcctgaggcgaaatgtttcgcagtcagaagcctgggatgggtggagatggcagaagaggatttagctcctgggaagtcaagcgtagccgtcaacaattgcattagacagctgtcctactgcaaaaacgatattagagataccgtcggcatctggggtgagggcaaagatatgtatctcatacttgagaatgatatgctctctcttgttgatccaatggatagatctgtcttgcactcacagcccatagtctcgataagggtctggggagtaggcagggataatggaagggatttcgcctatgtcgcccgcgacaaagataccagaattttgaaatgccatgtcttccggtgcgacaccccagccaaggcaatagcgacaagcttgcacgagatctgctcaaagattatggccgagcggaaaaacgcaaaagcgctggcttgcagctccctgcaggagagagcaaatgttaacctcgacgtgcccctgcaggactttccgacacccaaaactgagctggtccagaagttccacgtgcagtatctggggatgctccctgtcgataaacccgtcgggatggacattcttaacagcgcaatcgagaatctcatgacctcctcgaataaggaggactggctcagcgtaaatatgaacgtggctgatgccactgttactgtgatcagcgagaaaaacgaagaagaagttctcgttgaatgcagagtgcgcttcttatcattcatgggggtcggaaaagacgtgcatacattcgcctttattatggacacgggaaatcagcggtttgaatgccatgtcttttggtgcgagcccaatgcaggaaacgtgtcagaagctgtgcaggcagcctgcatgctgcgttatcagaaatgtctcgtggcccgtcctccatcacagaaggtcagaccgccaccgcccccagccgactccgtgacccgacgggtaaccaccaatgtgaagaggggggtgctgtctctgattgacacccttaagcagaagcgtcctgttacggagatgccgtag

SEQ ID NO: 108108 - DNA, 2187 bp, Artificial Sequence
  Description of Artificial Sequence: Synthetic coding sequence
tgagacactctcgccgtctttatggcatcctctggtacaaccgacgtcaccaatcgcaatagcccggccacccctcctaatacattaaacctccgatcttcgcataacgagttacttaacgcagagatcaagcacaccgagacaaagaactccacccccccaaagtgtcgaaagaagtatgctctcaccaacatccaagctgcgatgggtctttctgaccccgcagcacagcctcttctcggcaatggcagcgccaatattaaattagtgaaaaacggagaaaatcaactgcgaaaggccgcagagcaaggccagcaagacccaaacaaaaatttaagtcctaccgctgtgataaacataaccagtgagaaactggagggcaaggagcctcaccctcaagacagctccagctgtgaaattctcccatctcaacctaggcggacaaagtcttttctgaactactacgccgacctcgagactagtgccagggagctagagcaaaaccgcggaaaccaccatggtactgctgaggagaagtctcagcctgtgcagggccaggcatctaccataatcggaaatggcgatctccttttgcaaaagcccaatcgtccccaatcatctcctgaagatggccaggttgctactgtgtcttcttcccccgagactaagaaggaccaccccaaaaccggcgctaagacagactgtgccctgcaccgcatccaaaacttagctccttctgacgaagaaagttcttggaccacactgtcccaggattccgcctcaccttcttctcccgatgagactgccgacatctggtcagaccattctttccagaccgatccggatctgcccccagggtggaagcgagtatccgacattgccggtacctactactggcatattcctaccggcaccacgcagtgggagcgccccgtctccataccagccgaccttcaaggatcacgcaagggcagcctgtcaagtgtcacacccagtcctaccccagagaatgaggacctgcacgcggccacagtcaaccccgatccaagtttgaaagagttcgaaggcgctactctgagatatgcctctctgaagctgagaaatgccccccaccccgatgatgacgactcttgttctataaacagtgatcctgaagctaagtgtttcgccgttcgaagtctgggatgggtggaaatggccgaggaggacctcgcccccggcaagagctcagtcgcggtgaataattgcatacggcagctgtcatattgtaagaacgacatccgagatactgtgggtatctggggagaaggtaaggatatgtatctgattttggagaacgacatgctaagtctggtggaccccatggataggtcagtactgcatagtcaacccattgtgtctatccgtgtctggggcgtgggccgggataatggccgcgatttcgcctacgtcgcccgcgacaaggatacgcggattctgaaatgtcatgtgtttaggtgcgacactcctgcaaaggccatcgccacttctctgcacgaaatctgttctaagataatggcagagaggaagaatgcaaaggcgctggcatgttcatcattacaggagcgagccaacgtcaatctcgacgtccctttacaggtggacttcccaacaccaaagaccgaactggtgcagaagtttcatgttcaatacctgggtatgctgccagtagataaacccgttggcatggatatcctgaactcggccatcgagaatctgatgacttcttcaaataaggaggactggctgtcagtcaacatgaacgtcgcagacgccaccgtgaccgtaatcagcgagaagaacgaggaggaagttctggtcgagtgtagggttcgcttcctttccttcatgggcgtcggcaaggacgtgcacacctttgcattcatcatggacacgggcaaccagcgcttcgaatgtcacgtgttttggtgcgaaccaaatgccgggaatgtctcagaagcagtgcaggctgcttgtatgctcaggtaccagaagtgcctcgtggcaagaccaccctcccagaaggtgcgacccccaccccccccggctgattcagtaacacgtagggtcactaccaacgtcaagaggggagtcctgagccttatcgacaccctgaagcaaaagaggcccgtcactgagatgccttag

SEQ ID NO: 108109 - DNA, 633 bp, Artificial Sequence
  Description of Artificial Sequence: Synthetic coding sequence
atggccgagcgtaaaaacgcgaaagctcttgcttgcagctcactgcaagaaagagctaatgtgaacctggacgtgcccttgcaggtggatttccctacgcccaagactgaactggtgcagaaattccatgtacagtacctcggcatgctgccagtggataagccagtgggcatggatatccttaattccgccatagaaaatctgatgaccagctcgaacaaagaagactggttatctgtaaatatgaatgtggccgacgctacagtaaccgtaataagtgagaaaaacgaggaagaagtgctggtcgaatgcagagtgagattcctgagctttatgggcgtcggtaaagatgtgcacaccttcgcatttatcatggacaccggtaaccagcggtttgagtgtcatgtgttctggtgcgagccaaacgctggcaatgtgagcgaggccgtgcaggcagcatgcatgctgagataccagaaatgtctagttgcaagacctccctcccagaaagtaagaccgccaccaccacccgcagacagcgtgacgcgcagggtcacaacaaatgtcaagaggggagtgctgtccctgatcgacactctgaagcagaagagaccggtaacagaaatgccttag

SEQ ID NO: 108110 - DNA, 1476 bp, Artificial Sequence
  Description of Artificial Sequence: Synthetic coding sequence
atgctagggaaggattatatgcttgcgatcatactggtgaattgcgacgacgacttgtggggagaccattctctcgaggtggaggcgggtctgcccccaggctggagaaagatacacgacgcagccggtacatattattggcatgtcccttctggctcaacacaatggcaacgtcccacttgggagctgggagatgccgaagatccaggcaccgggacagaaggaatctggggactaaggcctccgaaagggaggagcttcagttccttggagagttccctggatagaagcaattccctgtcgtggtatggaggcgaaagctatattcaaagcatggaacctggagccaaatgttttgccgtaagatcgctaggatgggtcgaggttccagaggaggacctagcacctggaaagtcctctatcgcagtaaataattgcatccagcagctggctcagactaggtctcgatcccagccccccgacggggcgtggggcgagggacagaatatgctgatgattctgaagaaggatgcaatgtccctggtgaatcctttggaccactcacttattcactgccaacctcttgttcatatacgcgtgtggggtgtgggaagcagtaaaggtaggcctatctcagccccggctcgagactttgccttcgtcgcatccgacaaagacagctgtatgttgaagtgccacgtattttgctgtgatgtgcctgcgaaagcgatcgccagcgccctgcacggcctgtgcgctcagatactttcagaaagagttgaagtatccggcgacgcaagctgttgttctccggatccaatttctccggaggacctcccccggcaggtggagctcttggacgctgtatcacaggctgctcaaaagtacgaggccctgtacatgggcactcttcccgttactaaggctatgggaatggacgttttaaatgaagcgataggtaccttgactgcaaggggcgataggaatgcttgggtgcctacaatgctttctgtttcagatagcctgatgactgcccatcccattcaggctgaggcctcgacagaggaggaaccactctggcagtgtcccgtgcgccttgtcacattcatcggagtcgggagggatcctcacacttttgggctgatcgccgacctgggtcggcagagttttcaatgcgcagctttctggtgccagccccacgctggcggactctccgaggccgtgcaggccgcgtgtatggttcagtaccagaagtgtctcgtggccagcgccgcccgcggcaaagcttggggcgcacaggcgcgggctcggttgagacttaagcgcacatctagtatggattcacccggcggcccactgccattgcctcttttaaagggcggtgtggggggggctggtgcgacgccgaggaaacgcggggttttctcgtttctggacgcctttagactcaaacctagtcttttacacatgccgtag

SEQ ID NO: 108111 - DNA, 1461 bp, Artificial Sequence
  Description of Artificial Sequence: Synthetic coding sequence
atgttgggcaaagattacatgcttgctattatacttgttaattgcgacgatgacttatggggtgaccacagtctggaggtagaagcggggttgcctcctggatggaggaaaatccacgatgccgccggtacttactactggcacgtgccatcaggaagcactcagtggcagcgccctacatgggaactgggcgacgcagaagatccgggcaccggtacagagggcatctggggtctacgccctccaaaaggccggtccttctcatccttggaatcttctcttgaccggtcgaactccctgagctggtatggcggcgaaagctatattcagtccatggaaccaggagcgaaatgcttcgccgtgcggagcctgggctgggtagaggttcccgaggaagatttggcccccgggaagagctctattgctgtgaacaattgcatacagcagctggcacagactcgaagtagaagccagcctcctgatggggcctggggtgaaggccagaacatgctaatgattcttaaaaaggacgcaatgagcctcgtcaatccactcgatcactccctgatacactgccagcccttggtacacatacgcgtttggggcgtgggctcttccaaagggcgagatagggatttcgcttttgtggctagtgacaaggattcctgtatgcttaagtgccacgtcttctgctgcgacgtgccagccaaagcaatcgcctcagccctccacggcttatgcgcacagatcctgtccgaacgcgtagaagtgtctggcgacgcatcatgttgcagccccgacccaatcagtccagaggacctcccacgccaggtggaactgcttgacgccgtgtcccaggcggcgcagaaatatgaggccctctacatgggaactttacctgttacaaaggctatgggaatggatgtgctgaacgaagctataggtaccctgactgcaagaggggaccgtaacgcttgggtgccaaccatgctctcagtgagcgattccctgatgacggcacaccctatccaggccgaggcctcgacggaggaggagcccctctggcagtgtcctgtccggttggtgacctttatcggggtcggccgggatccgcacacgttcggtctgattgcagatctggggaggcagagctttcagtgcgctgctttctggtgtcagccacacgccggcggactctccgaggccgttcaggccgcttgtatggtgcagtaccaaaagtgtcttgtggcaagcgcggcgcgggggaaagcctggggggcacaagcccgtgccagactgaggctgaagcgcacctctagcatggattcccccggaggccctctcccactccctctgttgaagggcggagtggggggggcaggggcgaccccacgcaagcgcggcgtgttcagcttcctcgatgcattccgcctgaaaccctccctgttacatatgccctag

SEQ ID NO: 108112 - DNA, 1020 bp, Artificial Sequence
  Description of Artificial Sequence: Synthetic coding sequence
atgttgggtaaagattatatgctggccataatccttgtaaactgtgacgacgacttatggggcgatcactcgctggaagtggaagccgggctgccaccagggtggaggaaaatccacgacgccgccgggacttattattggcatgtgccatctggttccactcagtggcagcggcccacatgggaactgggcgacgcggaggaccctggcacggggactgaaggcatctggggcttacgaccccccaaaggcaggagcttttctagcttggaaagttctctcgacaggagtaattccttaagttggtacggcggcgagagttatatccaatcaatggagcctggcgctaaatgcttcgccgttaggtctttagggtgggtcgaagtccctgaggaagatctcgctccaggaaagagctccatcgccgttaacaactgtatccagcaactggcgcagacacggtctcggtctcaacccccggatggagcctggggtgaggggcagaatatgttgatgatcctcaagaaagacgccatgagtcttgtcaaccctttggaccactccttaattcattgccagcccctggtacatattagggtgtggggcgtgggctcctccaaaggcagagacagagacttcgccttcgttgccagcgacaaggatagctgcatgctgaaatgtcacgtgttctgttgtgatgtgcccgccaaggccatcgcatctgccctgcacgggttgtgcgcccagatcctctctgagcgcgtggaggtgtcaggagacgcctcctgttgtagccccgatccgatatctccggaggaccttcctcgccaggtcgagctcctggatgcagtctcgcaggccgcccagaagtacgaggcattatacatgggtaccctgcccgtcaccaaggctatgggccgcggacaatatagaggaggagccatagtcgcagtgccttgcgctccctgtgatatttactggtgttggccaaggccaacacacctgtggccccaccggtag

SEQ ID NO: 108113 - DNA, 1455 bp, Artificial Sequence
  Description of Artificial Sequence: Synthetic coding sequence
atgctgggcaaggactacatgctagcgatcatccttgtcaattgcgatgatgatctctggggcgaccactccctggaagtagaggccggccttcctcccggctggcggaagattcatgacgcagctggcacatactactggcacgtgcccagtgggagcactcaatggcagcgacccacatgggagttgggagacgcggaggatccgggtacgggaaccgagggcatctggggtttaagaccacctaaaggacgcagcttctccagcctggagagcagtctcgacagatctaactcattatcctggtatggaggggaatcctatatacagtccatggagccgggagccaaatgcttcgccgtgaggtctttgggatgggtcgaagtgcccgaagaggaccttgcccctgggaaaagctctatcgccgtgaataactgtattcaacaactggctcagacccgctctcgaagtcagccccctgacggagcatggggtgaggggcaaaatatgctcatgatcctgaagaaggacgccatgtcacttgtcaatccgttagaccattctctgatacattgccaacccctcgtgcacatccgcgtttggggagtgggcagcagcaagggaagggacttcgcgttcgtcgctagcgataaggacagctgcatgctaaaatgccacgtcttctgctgtgacgttcccgcgaaggccatcgctagtgctctccacggtctttgcgcccaaattctgtccgagcgtgtcgaagtttccggagacgctagttgttgcagccctgacccaatatccccagaggatctgcctagacaggtggaattactcgacgccgtatctcaggctgcccagaagtatgaagctctgtacatgggaacactacctgttacaaaagccatgggaatggacgtcctgaatgaggcgatcggcacactgactgccagaggggaccggaacgcatgggtcccgactatgctctccgtctcagacagcctcatgaccgcccatcctatccaggccgaagcctcgacggaggaggagccgctctggcagtgtcctgtgcgattggtgacctttattggtgtggggcgagaccctcatacgttcgggttaatcgcggatctgggacggcaaagttttcagtgtgccgcgttttggtgccagccgcacgctgggggattgtcagaggccgtgcaagccgcttgtatggtccaataccaaaagtgcctggtcgcaagtgcagccagagggaaggcctggggtgctcaggccagagctaggctcaggctaaagcggaccagctcaatggattcacccggcggccccctgcctctgcctctgttaaaaggcggcgtgggaggtgcgggagctaccccgcggaagagaggcgtgttttcgtttcttgacgcttttcgcttaaagccttccctcctacacatgccatag

SEQ ID NO: 108114 - DNA, 738 bp, Artificial Sequence
  Description of Artificial Sequence: Synthetic coding sequence
atgctggggaaggactacatgttggccatcatcctagtcaactgtgatgacgacctctggggagatcacagcctcgaagtggaggctggcctcccacccggttggcgcaagatccatgatgctgccggcacctattactggcatgtacccagcggcagtacccaatggcagagaccgacatgggagctcggcgatgccgaggaccccggcaccggcaccgaaggaatttgggggctaaggcccccaaagggaagatcattttctagcctcgagtcatcactagacagatcgaatagcttaagctggtacggaggtgaatcctacatccagagcatggaacccggggccaagtgtttcgccgtgcgctctctgggatgggtggaagtgcccgaagaggaccttgctccaggaaaaagctcgattgccgtgaacaattgcattcagcagctggcccaaacaagatcacgctctcagcccccagacggtgcatggggggaaggacaaaacatgctgatgatactgaagaaagacgcgatgagtctcgtaaatccgctcgatcacagtttgatccattgccagccgctggtccacatcagagtgtggggcgttgggtctagtaaggggagaagcagcgatgtggatccagggctccttcccttgcccggccctgctctggtaggggagggaggcccaagtagcgccggaacggtgtggggcgagtctgagcgtctcggatag

SEQ ID NO: 108115 - DNA, 792 bp, Artificial Sequence
  Description of Artificial Sequence: Synthetic coding sequence
atgctaaagtgccacgtgttttgctgcgatgttcccgccaaggcaattgcatccgccctgcacgggttgtgtgcccagattttatcagagagagttgaagtcagcggagatgcttcttgttgttctcccgatccaatcagtccagaggaccttccgcgccaggtagagctgctagatgctgtttctcaagctgcccaaaagtacgaagcgttgtacatgggcacactgcctgtgacaaaggcaatgggtatggacgtgcttaacgaagccatcggtaccctgacagcgcggggagacaggaacgcctgggtgccaaccatgctctcagtgtccgactctctgatgactgctcatcctatccaggcagaggccagtactgaggaagaaccactctggcagtgccctgtccgattagtcactttcattggggtaggacgggatccacatactttcggactgattgcagatttaggcaggcagtctttccagtgtgccgccttttggtgccagccccacgcagggggacttagcgaggccgtacaagccgcctgcatggtgcagtatcagaagtgcctggtagcaagcgccgcacggggaaaagcctggggagctcaggccagagcccggctccggttgaaaaggacctctagcatggattctcctggaggcccgctgcctctccctctgctcaaagggggcgtgggaggggctggtgccactccaagaaagcggggggtcttcagctttctggatgctttcaggctgaagccctccttactgcacatgccctag

SEQ ID NO: 108116 - DNA, 645 bp, Artificial Sequence
  Description of Artificial Sequence: Synthetic coding sequence
atgctgggcaaagactatatgttggctattattctggtcaactgcgatgacgacctgtggggtgatcactcactggaggtggaggcgggcctgccacctggctggcgaaagattcacgacgccgcggggacctactattggcatgtgcccagcggctcaacccaatggcaaagaccaacttgggagctgggcgatgccgaggatcccgggactggaacggaaggcatctgggggctgcggcctcctaaggggaggtctttttcctctctggaaagttccctggacaggtccaattcattgagttggtacgggggcgagtcatacatccagtccatggagcccggcgcgaaatgctttgcagttaggtctctgggctgggttgaggttcctgaggaggatctggcacctggtaaatcgagtatcgcggtcaataactgcattcagcagctcgcacagactcgttcacgctcccaacctcctgacggggcctggggcgaggggcagaatatgttgatgattctaaagaaagacgccatgtcgcttgttaatcccttggatcattcccttatccactgtcaaccgctggccgtcatccccacggacgctgacccccagtacctaaatccatggacccagattctgtag

SEQ ID NO: 108117 - DNA, 378 bp, Artificial Sequence
  Description of Artificial Sequence: Synthetic coding sequence
atggagcctgatgggacctacgagcctggtttcgtcggaattagattctgccaggaatgtaacaacatgctctaccccaaagaagataaggaaaatcggattctcctgtatgcatgtaggaattgtgactatcagcaggaggcagataattcttgcatctatgtgaacaaaattacccatgaagtcgatgagttgactcagattatcgccgatgtttcacaagacccgacactgccgcggacggaagaccatccatgccagaagtgtggtcacaaggaggccgtgttttttcagagtcatagcgcccgtgcagaggatgctatgcggttgtattacgtgtgtactgcgccccactgcggacacaggtggacggaatag

SEQ ID NO: 108118 - DNA, 1836 bp, Artificial Sequence
  Description of Artificial Sequence: Synthetic coding sequence
atgttagcatctctagagaaagacaaaacagcacccgggagcgcccaggtggcgggcctgtgcggcagattaaccctccaccgcgacttaaggaccggacgatgggagcctgacccacagcgctcccgccggtgcctgcgagaccctcaacgagtgctggaatattgtcggcagatgtaccctgagctgcagatcgccagggtagagcaggccacgcaggccattccaatggagcggtggtgcggtggctctcgcagcggatcttgtgcacaccctcaccaccaggttgtgccctttagatgcctgccgggtgaattcgtatcagaagcacttctcgtcccagagggatgtcgtttccttcaccaggaacggatggaccaatgtgagtcaagcacccgaagacatcaagaagcacaggaagcttgtagctcccagggactcattctgcacgggtcaggcatgctgctgccttgtggctcggataggttccggggagtagagtacgtgtgctgccctccacctggcactcccgacccaagcggaacagccgtgggcgatccctcaaccaggtcatggccccctggatctcgggtggaaggggccgaagatgaggaggaggaagagtctttcccccagccagttgatgactatttcgtggaacccccgcaggccgaagaagaggaagagactgtccccccaccctccagtcacacactagccgtagtgggcaaagtcaccccaactcctaggcccaccgacggcgtagacatttacttcggcatgccaggtgaaataagcgaacacgagggtttcttgcgggccaagatggacctggaagaaaggaggatgcgacagattaacgaggtgatgagggaatgggccatggcggacaatcaatcgaagaacctgcccaaggctgatagacaggcattgaatgaacacttccagtccattcttcagacgctcgaagagcaagtaagcggagagcgccagcggctggttgaaacccacgccactagagttattgccctcattaacgaccagcgcagggcagccttggaaggattcttggctgcactccaggcagatcctcctcaggccgagcgcgttctcttagctttgcgcaggtacctacgagctgagcagaaggaacaaaggcacactctaagacattaccagcatgtggctgccgtggaccctgaaaaagcccagcagatgcgctttcaggtccatacacacctccaagtgatcgaggagcgggttaatcagagcctcggactgcttgaccagaatcctcacctcgctcaggaattgagacctcagatccaggaattgctgcacagtgaacacctaggaccatctgaactggaggctcctgcgccaggcggcagcagtgaggacaaaggcggactccaaccccctgacagcaaagacgatactcccatgaccttgcccaagggttctacggaacaggacgccgcctctcctgaaaaagagaaaatgaatcccctggagcagtatgagagaaaagtgaacgcttctgtgccaaggggatttcccttccactcaagtgagatccagagggacgagctggcccccgccggcactggggtgtcgcgcgaggcggtgtctggactgctgataatgggtgccggcgggggaagcctcatagtgctgtctatgttactgttgaggcgaaagaagccctacggggccatatctcacggagttgtggaggttgaccccatgttgactcttgaagagcaacagttgagggaattgcagaggcatggatacgagaatccaacctatcgttttctggaggagcggccttag

SEQ ID NO: 108119 - DNA, 2292 bp, Artificial Sequence
  Description of Artificial Sequence: Synthetic coding sequence
atggccgccacagggacagcagctgccgcagcaaccggaagactcctcctgctattgctcgtaggactaaccgcacccgccctagcacttgcggggtacattgaggccctggcagctaacgcaggcacaggatttgctgtcgccgagccccagatcgcaatgttctgcgggaagttaaacatgcacgttaatattcagaccgggaaatgggaacccgatcctaccggcactaagagctgtttcgagaccaaggaagaagtcctgcaatactgtcaggagatgtaccctgagctgcagatcacgaacgttatggaggccaaccagagagtgtccattgacaattggtgtaggcgggataagaagcagtgtaaatcccggtttgttactcctttcaagtgtcttgtgggggaattcgtgtccgacgttttgctcgtgccggaaaaatgccagttctttcacaaggagcggatggaggtgtgcgagaatcaccagcattggcatactgtggtgaaggaggcgtgtctgacccaggggatgacattatattcctacgggatgctgctcccatgtggagtagaccagttccatggaacagaatacgtatgctgtccccagaccaaaataatcgggtcagtttccaaggaagaagaagaggaggatgaagaggaagaggaagaggaagatgaagaagaagactacgacgtgtataagtcggagttccctaccgaggccgacttagaggactttacggaggctgcggtcgacgaggatgatgaggacgaggaggaaggcgaggaagtagttgaggatcgagactattattatgataccttcaaaggagacgactacaatgaagagaaccccactgaacccggatcagatgggaccatgtccgacaaagagatcacgcatgacgtcaaagcggtctgcagtcaggaggccatgacaggaccttgtcgagcagtgatgcccagatggtactttgatctttcaaagggcaagtgtgtcagatttatctatggtggttgtgggggcaaccgcaacaacttcgagtctgaggactactgtatggctgtttgtaaggctatgatccctcctacaccactgccgacgaacgacgtcgacgtgtatttcgagactagcgctgatgacaatgagcatgcgagattccaaaaggcaaaagagcagctcgaaatcaggcacagaaacagaatggatcgggttaagaaagaatgggaggaagctgaactacaggccaagaaccttcccaaggccgaacgacagaccctcatccagcactttcaggcaatggtgaaggccctggagaaggaggccgctagtgagaaacagcaattggtggaaacacacctggccagagtcgaagcaatgctgaatgaccggaggcgcatggcactggagaactatctcgcagcgcttcagagcgatccaccccggccacaccgcatcctgcaagccctgcggaggtacgtcagggccgagaacaaggacagactgcatactattcggcattaccagcacgtactcgcagtagacccagaaaaagctgcccagatgaaatcacaggtgatgacacaccttcacgtaatagaggagcgtagaaaccagagccttagccttctgtacaaggttccgtatgttgcgcaggaaattcaagaggaaatcgacgagctgctccaggaacaaagagcagatatggatcaatttacggcgtctatctccgaaaccccagtcgatgtgagggtgtcttcggaggagagcgaggaaatccccccattccacccatttcatccttttccggccctgccagagaatgaagatacccagcccgaactctaccaccctatgaagaagggttcgggcgtgggggaacaggacggcggtcttatcggagctgaggagaaggtcatcaacagtaaaaacaaggtcgatgagaacatggttattgacgaaactctggatgtcaaagagatgatctttaatgctgaacgggtggggggcctggaggaggaacgtgagagtgttgggccacttagggaagatttcagtctcagctcttcggcacttatcggactcctcgttatagccgttgccatcgccacagtgatagtgatctctctggtcatgctgcgaaaaaggcaatacggaacaatttctcacggaattgtggaggtcgatccgatgctgactcccgaggagagacatttgaacaaaatgcagaatcatggttacgagaatccaacctataaatacctcgagcaaatgcaaatatag

SEQ ID NO: 108120 - DNA, 2286 bp, Artificial Sequence
  Description of Artificial Sequence: Synthetic coding sequence
atgctgagggctccaggagaattgcccaggcaggcagctcgctgtagcctgtgccggctcggaccagggcggggacgcgctttcttcaagtggcgttgcctccccgcaagtgtagatcgtggaaaccccttgtgggcacttgccgccaacgctggaactggattcgcagttgccgaaccacagatcgctatgttttgcggcaaactcaacatgcatgtcaatatccagaccggcaagtgggagccagatcccaccggcacgaagtcctgctttgagacaaaggaggaggtgctgcagtactgccaagaaatgtaccccgagctgcaaatcacaaacgtcatggaagccaaccaaagagtgtctatcgataattggtgcaggagagataagaagcaatgcaagagcaggttcgtgacgccctttaagtgcctcgtcggtgagtttgtttccgacgtactcctggttcctgagaagtgtcagttcttccacaaagagcgaatggaggtttgcgaaaatcatcagcattggcataccgtggtaaaggaggcctgcctgacccaggggatgacgctatattcatacgggatgctgctgccgtgtggtgttgaccagttccacggcaccgagtacgtatgttgtccccagacaaagattattgggtctgtgtctaaagaagaggaagaagaggacgaggaagaggaggaggaagaggacgaggaagaagattatgatgtttacaagagcgaatttcctacagaggccgatctcgaggactttaccgaagcagctgtggatgaggacgacgaagacgaagaagagggggaagaagtagttgaggatcgggactattactatgatacttttaagggagacgactataacgaagagaaccccaccgagcctggtagcgatggaaccatgtctgacaaggagatcacccatgatgtgaaagcggtctgcagtcaggaggcgatgaccgggccttgcagggccgttatgcctcgctggtatttcgacctgagcaaaggaaaatgcgtgaggtttatatacggaggatgcggcggaaatcggaacaatttcgaaagcgaagactattgcatggcagtatgtaaagctatgatcccccccacaccacttcctacaaacgatgtagacgtttatttcgaaaccagcgcagatgacaacgaacacgcaagattccaaaaagctaaagagcagcttgagattcgccatagaaatagaatggacagagtaaaaaaagagtgggaggaagccgagttgcaggcgaagaatttgccaaaggccgagcgtcagaccctcattcagcacttccaagccatggtgaaagcccttgagaaagaagctgcctctgagaagcagcagttagtggaaacccacctggcccgggtcgaggctatgttaaacgaccgtcggcgtatggctctggagaattacttggccgccctgcagtctgaccctcctaggccccataggatcctccaggcacttaggagatacgtgagggccgagaataaggataggttacatactatcaggcactaccagcatgttcttgcagttgatcccgagaaagccgcgcagatgaaatcgcaagtgatgactcacctgcatgtaatcgaggagaggcgaaaccaaagtttaagcctcttgtacaaagttccgtatgtcgcccaagaaatacaggaggagattgatgagctgctgcaagaacagagagctgacatggaccagttcacggccagcatttctgagaccccagttgatgtgcgtgtgtcgtccgaagaatcagaggaaattccccctttccatccttttcatccctttcccgcactcccagagaacgagggcagtggtgtgggagagcaggatggtggactcatcggcgccgaggaaaaagtaatcaacagcaaaaacaaggttgatgagaacatggtcattgatgaaaccctggacgtcaaagagatgatctttaatgctgagcgcgtcggaggacttgaggaggagcgagagagcgttggacccctcagagaagacttctccctcagctcttccgccctcatagggctgctcgtgattgcagttgccattgccacggtgatcgtcatctccttggtgatgctgcgaaagaggcagtacggaaccatcagccacggtatagtggaggtagacccaatgctgacacccgaggagagacacttaaacaagatgcagaaccatggctatgaaaacccaacttacaagtacctggagcagatgcagatttag

SEQ ID NO: 108121 - DNA, 2256 bp, Artificial Sequence
  Description of Artificial Sequence: Synthetic coding sequence
atggcggctactggtacagccgctgccgccgctacgggccgcttgttactcctgttactggtcgggctgaccgccccagccctggccttagccggttacatcgaggctctggccgcgaatgccggtacaggattcgccgttgctgaacctcaaattgccatgttctgcggaaagctgaatatgcacgtcaacattcagaccggtaaatgggagcccgacccaactggaaccaagagctgtttcgagacaaaggaagaagtccttcaatattgccaggagatgtacccagaattgcaaatcacgaacgtcatggaagccaaccagcgagtatccatagataactggtgtaggcgggataaaaaacagtgtaaatcgcgctttgtgactccatttaagtgcctggtgggtgagtttgtatcagatgtgcttctagtgcctgaaaagtgccaattcttccacaaggaaaggatggaggtttgcgagaatcatcagcactggcataccgtcgtgaaggaagcatgtctgactcagggcatgaccctgtattcgtatggaatgctactgccctgcggagtcgatcagttccacgggactgaatacgtgtgctgcccacagaccaagattatcggtagtgtctctaaggaagaagaggaagaggatgaggaggaggaagaggaagaagacgaagaagaagattacgatgtgtataagagcgagtttcccaccgaagccgacctggaagactttaccgaagcagccgttgatgaggatgatgaggatgaggaagagggcgaggaggtggtagaagatagggattattactatgatacctttaaaggcgatgattacaatgaggaaaacccaacagagccgggcagtgacggcacaatgtctgacaaagagatcacacatgacgtcaaggcagtgtgcagtcaggaagccatgaccggaccatgccgggccgtgatgccaaggtggtacttcgatttgtctaaaggcaagtgcgtccgcttcatatatggaggatgcggtggtaaccgcaataatttcgagagtgaagactactgcatggcagtctgtaaagcaatgataccccccacgccacttcctacaaatgatgtcgacgtctatttcgagacatcagccgatgacaatgagcatgcccgcttccagaaagcaaaggagcagctcgaaatccgccatcgcaatagaatggaccgggtgaagaaggagtgggaagaggccgaactacaggcgaagaacctgccgaaggccgagcgtcagactcttatccagcattttcaggcgatggtaaaagctctggagaaagaggcggcttccgaaaagcaacaacttgttgaaacacacttagccagggtcgaggccatgcttaacgaccggaggcggatggccctggaaaactatctggccgcgctccagtcagacccgccccgcccccatcggattctgcaggccctcaggcgatatgtccgagcagaaaacaaggaccggctgcataccatcaggcactatcagcacgtcctggctgtcgacccagaaaaggccgctcaaatgaaatcacaagtcatgactcaccttcatgttatagaggaaaggagaaatcagtcattgtctttactgtacaaagtcccctacgttgcacaagagattcaagaggaaatcgacgagttattgcaggagcagcgagcagatatggaccagtttactgcttccataagtgagacccctgtagacgttcgggtgagcagtgaggagtctgaagagatccctccattccaccccttccatccatttccagccctgcccgagaatgagggcagtggagtgggggaacaggacggagggcttatcggcgctgaagagaaggtgatcaattccaaaaataaggtggatgagaatatggttatcgacgagacgctcgatgtgaaagagatgattttcaatgccgagagggtgggaggcctcgaagaggagcgggagtcagtgggccccctgcgagaagacttctctttgtcaagttctgcccttatcggtctgcttgtgatcgctgtggccatcgccaccgtcattgttatcagtttagttatgttgagaaaacgccagtacgggacgatctcccacggaatagtcgaagtcgatcccatgctcacaccagaagagaggcatcttaataaaatgcagaatcacggatacgagaatccaacttacaagtacctggaacagatgcaaatctag

SEQ ID NO: 108122 - DNA, 1569 bp, Artificial Sequence
  Description of Artificial Sequence: Synthetic coding sequence
atggctgccaccggcactgccgcagccgctgctactgggcgcttgctcttactgctgttggtggggctcactgctcccgcactggctctcgcaggctatattgaggcactcgctgcaaacgctggaacgggatttgcagtcgccgaaccccagattgccatgttttgtggcaaactgaacatgcatgtgaatatacagactgggaagtgggagcctgatcccacgggcactaagtcgtgttttgagacaaaggaggaggttctacagtactgccaggagatgtaccccgagctccagatcactaatgtcatggaggctaaccaacgggtctctatcgataactggtgccgaagggacaaaaaacagtgtaagtctcgattcgtgacaccatttaaatgcctcgtacccccaactccactccctacaaatgatgtggatgtctattttgagacctccgctgacgataacgagcatgcccggttccaaaaggccaaagagcaactggagatccgacatagaaataggatggaccgtgtgaagaaggaatgggaggaggcagaactccaggcgaagaacctgcccaaggctgagcgccagacccttatacagcacttccaggctatggtcaaagccttagagaaggaagcagcgagcgaaaagcagcaactagttgaaacacacctggcacgggtagaagcgatgctgaatgaccgacggcgcatggcattggaaaactacctggcggccttgcaatcagatccccctcgcccccatcgcattctacaggctctgcgccgctatgtgcgggccgaaaataaagatcgtctccatactatccgccattaccagcatgtgttggcagtcgatccggagaaggctgctcagatgaagagccaggtgatgacgcacctgcacgtgatcgaggagcggaggaatcagtccctgagtctcctttacaaggtcccatatgtggctcaggagattcaggaggagatcgatgaattactgcaggagcagagagcggatatggatcaatttacagcgagcattagcgaaaccccagttgacgtgcgcgtgagctcggaggagtcagaagagatcccccctttccaccccttccacccgttcccagccctaccggaaaatgagggttccggcgtgggggaacaggatgggggactgataggagccgaggagaaggtgatcaattccaaaaataaggtagatgagaatatggtgatcgatgaaactcttgatgtgaaggaaatgatcttcaacgccgaaagggtgggtgggttggaggaggagagagagagcgtggggcccctgagggaagatttctccctgagctcctccgcattgatcggtctgctcgtgatcgctgttgctatcgccacagttatcgtgataagcttggttatgctccgcaaaagacagtacggaaccatcagccacggcatcgtggaagtggacccaatgctcacacctgaagagcggcatctcaacaaaatgcagaatcacgggtatgaaaaccctacctataaatatctcgagcagatgcagatatag

SEQ ID NO: 108123 - DNA, 2088 bp, Artificial Sequence
  Description of Artificial Sequence: Synthetic coding sequence
atggcagccactgggaccgcagcagctgccgcaactggccgtcttcttctcctgctgctagttggtctcaccgcaccggcactggctttagctggctacattgaagctctggccgcaaacgcgggcacgggatttgccgtagccgaaccgcagattgcaatgttctgcggaaagctgaacatgcatgttaacatccagactggcaagtgggaacctgacccaacaggaacaaaatcttgcttcgaaaccaaggaggaggttttgcaatactgccaggagatgtacccggagctacagataactaacgtaatggaggcaaaccaaagagtatcaatcgataactggtgtagaagagacaagaagcaatgtaagagtcgattcgtcacccctttcaaatgcctggttggggaattcgtatctgacgtgctgctcgttcctgaaaagtgccagtttttccacaaggaacgtatggaggtttgcgagaatcaccagcactggcataccgttgttaaggaggcttgtctcacacagggcatgacgctgtactcctatgggatgctgttgccctgcggagtggatcagttccacggcacagagtatgtctgttgccctcaaaccaaaattatcggttcggtttcgaaggaggaggaggaagaagacgaggaggaggaagaagaagaggacgaagaggaggattacgatgtgtacaaatctgaatttccaaccgaagcggatctcgaggacttcacggaagctgccgtggatgaggatgacgaagatgaagaagagggagaagaggtcgtcgaagaccgggattattattatgacaccttcaagggtgatgattataacgaagagaaccctacggaaccgggatcggatggtaccatgtccgataaagaaataactcacgacgtaaaagtgccccctacccctctgccaactaatgatgttgatgtctacttcgaaacgtctgctgatgataatgagcatgctcgatttcaaaaggcaaaagaacagctcgaaatccgacatcggaaccgaatggatcgtgtcaagaaggagtgggaagaagcagaactgcaagctaaaaacttgcctaaggcggagagacagaccctgatccaacactttcaggccatggtgaaagccctcgaaaaggaggccgcaagcgagaagcaacaacttgttgagacgcatttggctcgggtggaggcaatgcttaatgatagaaggaggatggcccttgagaattatctcgccgccctgcagagtgacccaccccggcctcatcgcattctccaggccctgcggaggtatgtgcgggccgagaataaggatcgacttcacacaatcagacattaccagcatgtgctggcagtagaccctgaaaaagcggcccagatgaagtcgcaggtgatgacacacctgcatgtgatagaggagaggagaaaccagagtctgagcttgctttataaagtgccgtatgttgcacaagagattcaggaggaaatcgatgaattgctccaggaacaacgcgcagatatggatcagttcacagccagtatatctgaaactccggttgatgtacgagtcagcagtgaagagagcgaggagattcctccattccacccattccacccattcccagctctgcctgaaaatgaaggcagcggagtgggcgaacaggatggaggtttgatcggcgccgaggagaaggtgatcaattctaaaaacaaagtggatgagaacatggtgatagacgagactctcgacgtgaaggagatgatctttaacgccgagcgagtcgggggtcttgaggaagaacgcgaaagtgtaggtcctctcagggaagactttagcctctctagttccgctcttattggtctcctggtcatagcagtggcaatcgctacagtgattgtgatctccctggtgatgcttcgcaaacggcagtacggcactatttctcatggcattgttgaggtggaccccatgttgactccagaagagcgccacctcaacaagatgcagaaccacggatacgaaaaccctacttataagtacctggaacagatgcagatatag

SEQ ID NO: 108124 - DNA, 480 bp, Artificial Sequence
  Description of Artificial Sequence: Synthetic coding sequence
atggcagctaccggtacagccgcagccgctgccaccgggaggctcctgttgctcctgctggtcggcctgactgcgcctgcacttgcccttgctggctacattgaatctagccagatctgctgctccccgagaagctttcttatcagcactcttaagtgtttgatcgtcgacgagatcaatgcactcgccgcaaatgctggcactgggtttgccgtggctgaaccacagattgctatgttctgtggcaagcttaatatgcacgtgaacattcaaaccggcaagtgggaacccgaccctaccggaactaagtcttgcttcgaaactaaagaagaagttttacagtattgtcaggagatgtatcccgaactgcagatcactaacgtgatggaagcaaaccagagagtgtctatcgataattggtgtagaagagataagaagcagtgtaagtcacgatttgtgaccccattcaaatgcttatag

SEQ ID NO: 108125 - DNA, 351 bp, Artificial Sequence
  Description of Artificial Sequence: Synthetic coding sequence
atggctgcaaccggaaccgctgctgcagctgccacagggcgtctgctcctccttctgctagtgggtctgactgctccagcactggccctggccggatatattgaagcccttgcggcaaatgctggaaccggctttgccgtcgccgagccacagatcgctatgttttgtgggaaattaaacatgcatgtgaacatccaaacggggaaatgggagccagacccgactgggacaaaatcttgtttcgaaactaaggaggaagtgctccaatactgtcaagaaatgtatcctgaactgcaaataactaactcgggctggagatgcgtgcggattactagcacggggacacgttag

SEQ ID NO: 108126 - DNA, 1656 bp, Artificial Sequence
  Description of Artificial Sequence: Synthetic coding sequence
atggaagtgtgcgaaaatcaccaacattggcacactgtagtgaaagaggcttgccttacccaagggatgaccctatatagctatgggatgttgctgccttgtggcgtggatcagttccacggcactgagtatgtgtgctgtccccagactaaaatcattggtagcgtgtccaaggaggaggaagaggaggacgaagaagaagaagaggaggaggacgaggaggaggactacgacgtttacaaatccgaatttcccactgaggccgacctggaggacttcaccgaggccgcagttgatgaagacgacgaggacgaggaggagggggaggaggtggtggaggatcgcgactactactacgatactttcaagggcgacgactataacgaagagaatccaacggagccaggctctgacgggaccatgagcgacaaggaaattacccacgacgtgaaagtgccccctacaccgcttcctaccaatgatgtagacgtctacttcgagaccagcgccgatgacaatgagcatgcacggttccagaaggcgaaagaacagttggaaatccgtcatagaaaccgcatggacagggtcaaaaaggaatgggaagaggcagaattgcaggcaaagaatctgcccaaagccgagcgacagaccctcatccaacactttcaggcaatggtgaaagccttagaaaaggaagcagccagcgagaaacagcaattggtcgagacccacttggcccgggtcgaagccatgttaaacgacaggagacgaatggcacttgagaattacttggctgcactgcagtctgatccccctcggccacatcgtatcctccaggccctgcggcgctatgtccgagccgagaataaggatcgactccacactatccgacattatcagcacgtcctcgccgtggatccggagaaagctgcccaaatgaaatctcaggtgatgacacacctgcacgtaatagaagaacgacgcaaccagagcctgtctctcctatataaagttccttacgtggcacaggaaattcaggaggaaattgatgagctgctgcaggagcagcgagcggacatggaccagttcaccgcctccatatctgaaacccctgtagacgtaagggtaagttcagaggagtcagaggagatcccccctttccacccgttccatccatttcccgcgctgcctgagaatgaggacacgcaacctgagctttaccatccaatgaagaaaggctcaggggtgggcgaacaggatggcgggctaattggtgcggaagagaaagttatcaattctaagaacaaagtcgatgagaacatggttattgatgagacactcgatgtcaaagaaatgattttcaatgctgaaagggtgggagggcttgaagaagaaagggagtcagtggggccactgcgggaggacttctcactgagctcttccgcccttatcgggttactggtgatcgcggttgccattgcaactgtcatcgtcattagcctggtgatgctccgaaagcggcagtatggaaccatctcacacgggatcgtagaagtcgaccccatgttgactccagaggagcgtcatcttaacaagatgcagaatcacggttatgaaaacccgacatataagtacctggagcaaatgcagatttag

SEQ ID NO: 108127 - DNA, 1977 bp, Artificial Sequence
  Description of Artificial Sequence: Synthetic coding sequence
atgtaccccgagctgcagataacaaacgtaatggaagcaaatcagcgggtaagcatcgataattggtgtcggcgagacaagaaacagtgtaagtcgagattcgtgacaccattcaagtgcttggttggggaatttgtttctgatgtgctactcgtacccgagaagtgtcaatttttccacaaggagcggatggaggtgtgtgagaatcatcagcactggcacacagttgtgaaggaggcctgcctgactcagggaatgacgctctactcctatggaatgttgctcccttgcggtgtggatcagtttcatggtacagagtatgtgtgttgtccccaaaccaagattattggcagtgtctctaaggaagaggaggaggaagacgaagaggaagaggaggaagaagacgaggaggaagactacgatgtgtataagtccgagttcccgaccgaggcagatctggaggactttactgaggcagccgtggatgaggatgacgaagatgaagaagagggggaagaggtggttgaagatcgtgattactattacgatacatttaaaggagacgactacaacgaagagaatcccaccgaaccgggaagtgacggaaccatgagcgacaaggagattacccatgacgtcaaggccgtctgttcccaagaagccatgactggtccttgtagggctgtcatgccccggtggtactttgacttatctaaaggaaagtgcgtgcgattcatttatggcggatgtggcgggaacagaaataactttgaatcagaagattactgtatggctgtttgcaaagcaatgattcctcctacacctctgcctaccaacgacgtagatgtgtattttgaaacctcagccgatgataacgagcacgctaggttccaaaaggcaaaggagcaactggaaatcaggcaccggaaccgaatggatcgggtgaaaaaagagtgggaagaggcagaattacaggccaagaaccttccaaaggccgagcgccagacactgatccaacattttcaagcgatggtcaaggcgctcgagaaggaggcagcctcagagaaacaacagctcgttgagacccatctggcccgtgtcgaagccatgcttaatgatagaaggaggatggctcttgagaactatctggccgctcttcagtccgatccacccaggcctcaccggatactgcaggccctgagaagatacgtgcgagctgaaaataaggatagacttcacaccattcggcactatcagcatgtgcttgccgtggacccagagaaagctgcacagatgaaatctcaggttatgacccacttgcatgttattgaggagcggcgcaatcaatctctaagcttactctacaaagttccctacgtggcccaagagatccaggaagaaatagatgagttgctgcaggagcaacgggctgacatggatcagttcaccgcctccatcagcgaaacgcccgttgacgtgcgggtctctagtgaagagagtgaagaaataccgccttttcacccctttcatcccttcccagccctcccagaaaacgaaggctcaggcgtcggcgaacaggatggggggctgatcggtgcagaggagaaggttataaacagcaaaaacaaagttgatgagaatatggttatcgacgagaccctcgacgtgaaggagatgattttcaatgcggagcgcgtaggagggttggaggaagagagggagtccgtcggacctctgcgtgaggatttctccttgtcatctagcgccctgatcggactcctggtaatagcagtcgctattgcaaccgtgatagtgatctcacttgttatgctgaggaagaggcagtacggcacaattagtcacggcatagttgaggttgacccgatgcttacccccgaggagcgtcacctgaacaaaatgcagaaccatgggtacgaaaatcctacctataaatacctggaacaaatgcagatctag

SEQ ID NO: 108128 - DNA, 1758 bp, Artificial Sequence
  Description of Artificial Sequence: Synthetic coding sequence
atggccgctgttgaactcgagtggatccccgagacactgtacaataccgctattagtgccgtggttgacaattacatccgttccaggcgcgatatacgctctctgcctgagaacattcagttcgatgtctactacaagctctaccagcaaggcaggctctgtcagctcggctcggaattctgtgaactggaggtttttgccaaggtcctgcgcgccttggacaagcgacaccttctgcatcactgcttccaagctctaatggaccatggggtaaaagtagcgagtgtgctggcgtattcattttctagacggtgctcttatatagcagaaagcgacgccgcggtcaaagaaaaggctattcaagtgggctttgtgttgggcgggtttctgagcgatgcaggctggtacagcgatgctgaaaaagtattcctcagctgccttcaactctgtaccctgcacgacgagatgctgcactggttccgggctgtggagtgttgcgtaaggctgttgcacgtgagaaacggaaattgtaaatatcacctgggcgaagaaacgttcaaactcgcgcagacatacatggacaaactgagtaaacatggacagcaggctaataaggcagccctgtacggagaattgtgcgcgttacttttcgctaaaagccattatgatgaggcttacaaatggtgcatcgaagcaatgaaagagattacagctgggcttcccgtcaaggtcgttgtggacgtactgcggcaagcatcaaaggcttgcgttgtgaaacgcgagttcaagaaagcagagcaactcatcaaacacgccgtctacctggcacgggatcattttggatctaagcatccgaagtactccgatactctgctggattacggtttttacttgctaaacgtggataatatttgccaaagcgtggctatttatcaggctgccttagacattagacagtccgtgttcggcggaaaaaatatacatgtggccactgcgcacgaggatctggcatactccagttacgttcatcagtattcctccgggaagttcgacaacgccttattccatgccgaacgggctataggtattataacgcacatactccctgaggaccatctgctgctggcaagcagtaaacgcgtgaaggccctcatactggaggagatcgctatcgattgccataacaaagagactgaacagaggctcctgcaggaggcccacgatctacatctgtcatcactgcagctagctaaaaaggcatttggcgaatttaacgtccagacagcaaagcattatggtaacctggggcggctatatcagtcaatgagaaaattcaaagaagccgaggaaatgcatattaaagccatacaaattaaggaacagctcctcggacaagaggactatgaggtggcattgagcgtgggacacctagcttctctttacaactacgatatgaatcaatacgagaatgcagagaagctatacctgaggtctatcgcaattggaaaaaaactgttcggcgagggttacagcgggttggagtatgattacaggggactgatcaaactgtataatagcataggcaattatgaaaaagtgtttgagtatcacaatgtactaagcaattggaatagattacgcgaccgccagtattcagtgacagatgccttggaggacgtctcaacttctcctcagtccactgaagaggtagttcaatcattcctcatttcccagaacgtggaaggaccttcgtgttag

SEQ ID NO: 108129 - DNA, 4974 bp, Artificial Sequence
  Description of Artificial Sequence: Synthetic coding sequence
atggactccaagaagcggtcgtcaactgaagccgagggctccaaggaaaggggcttagtccacatctggcaagccgggagcttccccataactcccgagcggctccccggttggggcgggaagacagtgttgcaggccgcgcttggggtgaaacacggagtgctgctcactgaggacggggaagtctactctttcggcactctgccatggcgatcaggccccgttgaaatctgcccatcttcgccaattctggaaaacgcgctggtcgggcagtatgtcattactgtcgccacgggctccttccactccggagccgtcaccgacaacggcgtggcatatatgtggggggagaacagcgcaggacagtgcgccgtggccaatcagcagtacgttccagaaccgaatcccgtgtctatagccgactcggaggcctctcctttgctcgctgtcagaattctccaattagcctgtggcgaagagcacactttggctctcagcatttctcgcgagatttgggcctggggcactgggtgtcagttaggcctgatcaccacagcattccccgtcacaaaacctcaaaaggtcgagcacttggcgggccgagtggtgctacaggtcgcatgcggtgctttccactctctggcccttgttcagtgtctgccgagccaggatttgaagcccgtgccagaaaggtgtaaccagtgctctcaattgctgatcaccatgacggataaggaggaccacgtgataataagtgattcgcactgttgtcccttgggggttactcttactgaaagtcaagctgaaaaccatgccagtaccgcactgagcccttccacggaaaccctggatagacaggaagaagtattcgaaaacactctggtggccaacgaccagagtgtcgccactgaactcaacgctgtttccgctcagatcacaagcagcgacgccatgtcttcacaacagaacgttatggggacaacagaaataagctctgctcggaatattccatcctaccccgacacacaggccgtgaatgaatacctgcggaagttgtccgaccactcagtgcgcgaagacagcgagcatggggagaaacctgttccgagtcagcccctcctggaggaggcaatccctaacctgcacagcccaccaacaacttcaacgagtgcactaaattctttggtcgtgtcatgtgcaagtgccgttggagtcagagtcgcagccacttatgaggcaggcgcactgtccctcaagaaggtcatgaacttttatagtacgacaccttgcgaaacgggcgctcaggcaggctctagcgctatcggccctgaggggttaaaggactccagagaggaacaggtgaaacaagaatccatgcagggcaagaagtccagctcactcgtggacataagggaagaggaaaccgagggcgggtcccgacggctgtcccttcctggattacttagtcaggtttccccgcgcctgctgcggaaagctgcccgcgtgaagactcgaactgtggttctaactccgacctattcaggagaagctgatgccttgctcccttccctgcggacggaggtttggacctggggaaagggaaaggagggccagctgggacacggcgatgtgctaccacgactacagcctctgtgtgtcaagtgcctcgacgggaaggaagtcattcatctggaggcgggaggatatcatagcctcgctttaaccgccaagtcacaggtgtatagctggggctccaatacctttggacagctgggtcacagcgatttcccgactaccgtgcctaggctggccaagatctcgagcgagaatggggtgtggtccatagcagccggacgtgactactcccttttcttggttgacaccgaggattttcagccaggcctctattattccggaagacaagacccaaccgaaggggacaaccttcctgagaaccactccggctccaaaactccagtcctactaagctgcagcaagctgggttatattagtcgggtgacagctggtaaagattcctatttggcactggtcgacaagaatataatgggctatatcgcctcactccacgagctggcaaccaccgagagacggttttattctaagttgagcgacatcaaaagccaaatcttgagacctctcctgagcctggagaacctcgggactacaacaacagtccagctgctccaggaggtcgcttctagatttagcaagttatgttatctgattggccaacatggggcctccctgtcttcttttctccatggggtgaaagaggcgcgctccttggtcatccttaagcattcttccctctttctggacagctacacagagtactgtacatcgatcaccaatttccttgtcatgggaggattccaactcttagccaaaccagcaattgacttcctgaataagaatcaggagttgttgcaagatttgtctgaggtcaatgacgaaaatactcagctgatggagatcctgaatactctattttttcttcccatacggcggcttcacaactacgccaaggtgttattgaagttggccacttgtttcgaggttgcctcccctgagtatcagaaactgcaggacagttcctcttgctatgaatgcctggcactccacctgggccgaaagcggaaggaagccgagtataccctgggtttttggaaaaccttccccgggaaaatgactgatagcttgcgaaaacccgagaggcggctgctctgtgaatcttctaatcgcgccctgtccctgcagcacgccgggagattctcggtgaactggttcatcttattcaatgatgcgctggtacacgcccaatttagtacccaccatgtgtttcccctggcaacgctttgggccgaaccactatcagaagaggccggtggggtgaacgggctcaaaatcacgacacctgaagaacagtttacgttgatttcctctaccccacaggaaaaaacaaagtggctgcgcgccatcagccaggctgtggaccaggccttaaggggcatgagtgatttacccccatatgggtcggggagcagcgtgcagcgccaggagccaccaatttctagatcagcaaaatatactttctacaaggaccccagacttaaggatgcgacttacgacggcagatggctcagtggaaagccacacgggagaggagtgctgaaatggcccgacgggaaaatgtattccggcatgtttaggaacggtctggaggacggatatggcgagtaccgcattcccaacaaagctatgaacaaggaagaccactacgttgggcactggaaagaaggaaaaatgtgcggccaaggtgtgtatagctatgcatccggagaggttttcgagggctgcttccaggataatatgcgccatggccatggcctcctacgcagcgggaagttgaccagttcctcaccctctatgttcattgggcagtgggttatggacaaaaaagcggggtacggagtcttcgatgacatcacccgtggtgagaagtacatggggatgtggcaggacgatgtgtgtcaggggaacggtgtggttgtgactcagtttgggctgtactacgaggggaattttcacctcaacaagatgatggggaacggcgtgctccttagcgaagacgatactatctatgagggggaattcagtgacgattggacgcttagcggcaaggggacgctcactatgcccaacggcgactatattgagggctatttctcaggggagtggggcagtggtatcaaaatcactggcacctatttcaagccttctctatacgaatcagataaggataggccaaaggtatttcgcaagctgggcaatctggccgtgcctgccgacgaaaagtggaaagccgtatttgacgagtgctggaggcagctgggctgtgagggtccaggccagggcgaggtttggaaagcgtgggacaacattgctgtggccctgacaacttcacgtcgccagcaccgcgattctcccgagatcttgtcgcgtagccaaactcagaccttagaatctctagaattcataccccagcacgtaggagccttttcagttgagaagtatgacgacatacgaaagtacttgatcaaagcttgcgacaccccactgcatcccttgggaagattggtggaaactctcgtggctgtctacaggatgacctatgtgggagtaggggccaatcggcgtctgctgcaggaagctgtgaaagagatcaagtcttatctgaagcgaatctttcaactggtgaggtttctgtttccagagttacctgaagaaggatcaacaatccctctgtccgctcctctgcctaccgaaagaaaaagcttttgtaccggcaaaagcgattcccggtccgaatcacccgagcctggatacgtggtcacttcctcgggcctactgctgcctgtgttgctgcctcgcctttaccctccattgttcatgctgtacgctctggataatgaccgtgaagaggacatatactgggagtgcgtccttcggctaaataagcaaccggacatcgctctgctcggcttcctcggggtccagagaaaattctggccagcaacgctgtcaatccttggagaaagcaaaaaagttctgcctacaaccaaggatgcgtgtttcgcctcggctgtcgagtgtcttcagcagatctccacaaccttcacaccgtctgacaaacttaaagtcattcagcagacattcgaggaaattagccagagtgtcctggcttcactccacgaggattttttatggagtatggacgacctcttccccgtgttcctgtacgtggtgctcagggcacgtatccgaaaccttggcagcgaggtgcatctcatcgaagatctgatggatccctacttacagcacggagaacaaggcatcatgttcaccactctgaaagcttgttactatcagattcagcgcgagaaattaaattag

SEQ ID NO: 108130 - DNA, 420 bp, Artificial Sequence
  Description of Artificial Sequence: Synthetic coding sequence
atggacagcaagaagcggtcaagcacggaggcggaaggctcaaaggaacgaggactggtccatatctggcaagctggtagcttccccattacaccggagagactcccgggctgggggggtaaaacagtgctgcaggcagcacttggggttaaacatggtgtgctgctgactgaagacggtgaggtgtacagcttcggaacattgccctggcgcagtggccctgtggagatctgtccatcatcccctattctggaaaacgcgctggtgggacaatacgtaatcacagttgctaccggcagcttccactctggtgccgtaactgacaacggtgtggcttacatgtggggtgaaaatagcgctgggcaatgcgcagtggccaatcaacagtacgtgccagaacccaaccccgtgtctatctag

SEQ ID NO: 108131 - DNA, 321 bp, Artificial Sequence
  Description of Artificial Sequence: Synthetic coding sequence
atggacagcaagaagcgatcctcaaccgaggccgagggttcaaaggagagagggctggtgcacatctggcaggctggctcatttcccattactcccgaaaggctgcctgggtgggggggaaagactgttctccaggccgcattaggcgttaaacatggcgtgctcctgactgaagacggagaggtgtacagctttggaacactcccgtggaggtcaggtcctgtagagatctgcccctcaagcccaatcctcgaaaacgccctggtgggacagtatgtgatcactgtggcaacagggtcatttcatagcggcgccgtatag

SEQ ID NO: 108132 - DNA, 1758 bp, Artificial Sequence
  Description of Artificial Sequence: Synthetic coding sequence
tgacttgccctcgtcgacaaaaatataatggggtatatagcatccctccacgaactggcaacaaccgagcgccggttttactccaagctgagcgacatcaaatcccaaatcctcaggccactgctaagcctggagaatctgggaacgaccacgaccgttcaactgttgcaggaggtggccagcaggttttccaagctctgctatcttatcggtcaacatggtgcgtccctgtcgtccttcctgcacggggttaaagaagccagatctctggtgattctgaaacacagttcactctttctggacagctataccgagtactgtactagtattaccaactttctagtgatgggtggtttccagctgttagccaagcctgcgatcgacttcttgaacaaaaaccaggagctgttacaagatctctcggaagttaacgatgaaaacacccagttaatggaaatccttaacacccttttcttcttaccgatccgtagacttcataactatgcgaaggtgctgctgaagttggccacgtgcttcgaagtggctagtcccgaataccagaaactccaggattccagtagctgctatgagtgcctagcgcttcatcttgggcggaaaagaaaggaagcggaatacacattaggattctggaaaacatttcccgggaaaatgactgacagtctgcgcaaacctgaacggagactcctttgcgaaagttccaatagggccctctccctgcagcacgcggggcgattctctgtgaattggttcatattgtttaatgacgcattggtgcacgcccagtttagcacacatcacgtcttccctctcgcaacactctgggccgagccactgagcgaggaggccggaggggtgaatggattgaaaattacaacaccagaagaacagtttacacttatatcctcgacgcctcaggaaaaaaccaagtggcttagagccatctcccaggccgttgatcaggcccttcggggcatgtctgacttgccgccctacgggagcgggagttcagtgcagagacaggagccgcccatctcaagatcagccaaatacactttctataaagaccccagactgaaagacgccacttacgatggacgatggctctctggaaagcctcacggacgcggagtcctgaagtggcctgatggcaaaatgtatagtggcatgttcagaaatgggcttgaggacggctacggggagtaccggattccaaataaagcaatgaataaggaggatcactatgtggggcactggaaggaggggaaaatgtgcggccagggcgtatattcttatgcctccggcgaagttttcgagggatgtttccaggataatatgcggcatgggcacggcttgctgcgttctggaaagctaacttcctctagcccttcaatgttcatcgggcagtgggttatggacaagaaagccggctatggagtgtttgacgacattacccgcggtgagaagtatatgggcatgtggcaagatgacgtgtgccaggggaatggcgtcgtagtgacccaattcggattgtactacgaaggaaatttccacctgaacaaaatgatgggaaatggcgttttgctctccgaggacgataccatttacgaaggagagttctcagatgactggacactgtccggaaaggacaacagcgggctcattgagcaggtcggaaagtgcagtctcctgccttacttcttgaaggtttgtgaggctctagttctgttcctgctgtag

SEQ ID NO: 108133 - DNA, 1731 bp, Artificial Sequence
  Description of Artificial Sequence: Synthetic coding sequence
atgggctacatcgcttccctacacgagcttgcaactacagagcggcgcttttacagcaagctgagtgatataaagagtcaaattctccgccccctgttgtcactcgagaatctggggaccacgacaacagtgcagctgcttcaggaagtggctagtcgtttttctaaactctgttacctgatcgggcagcacggtgcctctttgagcagctttctccacggcgtcaaagaggccaggagtttggttattctgaagcacagttccttgttcctggacagctacactgagtactgtacatccatcaccaattttttggtgatgggaggcttccaactcctggcgaaaccagccattgactttctcaacaagaaccaggaactgcttcaggatctgagcgaagtcaacgacgagaatacccagctgatggaaatacttaatacattgttctttctgccgattaggcgactgcataattatgctaaggtgctattgaagttggccacctgtttcgaggttgcctcacccgagtatcagaaacttcaggatagctcatcatgttatgaatgtctggctctacatttgggccgcaaacggaaagaagccgagtacacactaggattttggaagaccttccccggaaaaatgactgattcccttcgcaagccagaacggcgattgctctgcgaaagtagtaacagagctctctctctgcagcatgcaggccggttctccgtgaattggtttatactgttcaacgacgccctcgtgcatgcccagttttctacgcaccacgtattccccctcgctacactgtgggccgagcccctgtcagaagaggcaggaggggtcaacggactgaaaataacgacccccgaggagcagtttactcttatatcctcaacaccccaagagaaaaccaaatggttgagggcgatcagccaggccgtcgaccaggccctgaggggcatgagcgatctgcccccatacggctccggatcatccgtgcagaggcaggagccacccatctctcggtccgccaagtacactttttacaaagatccacgtctgaaggacgctacctatgacggacgatggctctccgggaaacctcacggccggggagtgttgaagtggccagacggaaagatgtattcaggaatgtttaggaacggcctggaagacggctacggagagtaccgaatcccaaataaggcgatgaacaaggaagatcattatgttggccactggaaggagggaaagatgtgcgggcagggcgtatatagctatgcatccggtgaggtttttgaggggtgctttcaggacaacatgagacacggtcacggcctgctcagatcaggcaagctgacatcttcttcccctagtatgtttattggccagtgggtgatggacaaaaaagcgggttacggggtctttgacgatatcacgagaggcgagaaatatatggggatgtggcaagatgacgtgtgccagggcaacggcgtggtggtgacgcagtttggcctgtattacgaaggaaactttcacctgaacaagatgatgggtaatggtgtgctgctcagcgaagacgacacgatctacgagggtgagttttctgacgactggacactgagcggcaaggacaacagcggcctgatcgaacaggtgggcaaatgttcgctgctaccatacttcttgaaggtatgtgaagccctggtgctgttcttgctttag

SEQ ID NO: 108134 - DNA, 1191 bp, Artificial Sequence
  Description of Artificial Sequence: Synthetic coding sequence
atggactccaaaaagcggtcttccacagaagccgaaggatctaaggaacgtggactggtgcacatttggcaggccgggtcattccccatcactcctgagagactccccgggtggggaggaaagaccgtgctccaggccgctttaggtgtgaagcacggagttttgctgactgaagacggagaagtgtattcttttgggacactcccctggcggtccggtcccgtggagatttgccccagctctccgatcctggaaaatgcactggttggccagtatgtgattaccgtggctaccggctccttccactctggggcggtgacagacaatggcgtagcttacatgtggggcgaaaattccgcaggccagtgtgctgttgctaaccagcagtacgtcccagagcccaacccagtgtctatcgcggatagtgaggctagcccactgctggccgtgaggatccttcagctggcctgcggtgaagaacatactctggctctgtcaatcagtcgggaaatatgggcgtggggaaccgggtgtcagctgggccttatcactaccgccttccccgttactaagccgcagaaggtagaacacctggccggacgagtggtgctgcaggtggcttgtggggccttccatagtctcgcactcgtgcagtgcctcccatcccaggacctgaagcccgttcctgaacgctgcaaccagtgctcgcaactcctcatcacaatgaccgacaaagaagaccatgtgattatctctgattctcattgctgtcctctgggtgtgacgttaactgaaagccaggccgaaaatcacgcctctaccgccctgagtccttcgacggagactttggatcgacaggaggaggtattcgaaaataccctggtagccaacgatcagtccgtggcaaccgagcttaacgctgtgagcgcccagataacttcatccgatgcaatgtcaagtcagcagaatgtgatgggaaccaccgaaatatcttctgcccgtaatattcctagctatcccgatacacaagctgtcaatgaatatttaaggaagttaagcgaccactcggtgcgcgaagactccgaacacggtgaaaagcctgtcccttctcaagtaccagcacaattctataaaataaaggtgtgcctcgaactcaactgtatgggcttctccctggaaacacttaaatag

SEQ ID NO: 108135 - DNA, 2178 bp, Artificial Sequence
  Description of Artificial Sequence: Synthetic coding sequence
atggagcagagcaatgattccttgcgtgttaaccataatgacggagaagaatccaagacttcagcacaagttttcgagcaccttatctgcatggatagccgggactctagttttgggcagaatgattcacccactgtcctgcccatcaccacacgtgaggctaacaattcccttatctctcagaatatccccggtccacttactcaaactcagacactcagcgccgagcagtttcaccttgtcgatcagaatggacaggccattcagtacgagcttcaaagtctgggggaatccaacgcccaaatgatgattgtggcctcccccactgaaaacggacaggtcctcagagtcattcctccaacccagaccgggatggctcaagtgatcatcccccaagggcagctggtggacgtgaattctccaagagacgtgccagaagaaaagcctagcaaccggaacctgccaaccgtgagggtggacacactggcggacaataccagcaactacatcctccatccacaaaccagttttcctctgcccaagaagtctgtgactggaatgcttgaagagcccctgttaggccctttacagccactgagctctaacacccccatttgggcctgtcgcctgcggagctgtgagaaaatcggagattcgtatcggggatactgtgtcagtgagactgagctggagtccgtgctgactttccacaagcaacagactcagagtgtgtggggcacaagacagagcccaagccccgcgaagcctgccactaggctaatgtggaaatcacaatatgttccttatgacggtattccctttgtaaacgcaggctcaagagcagtggtcatggagtgccagtatggaccaaggcgcaaaggattccagttgaaaaaggtcagcgagcaggagtctcgtagttgtcagttgtacaaggcaacatgcccggcccggatttacatcaagaaggtgcaaaaattccccgagtacagggttcccactgaccccaaaattgataagaaaatcatccggatggagcaggagaaggcttttaacatgctgaagaaaaaccttgtggatgctggcggcgttttacgatggtacgtacagctgccgacccaacaggcccatcaataccatgagctggagacgccatgcctgacactgagcccctcccccttcccagtgagctcattggaagaagaggaaactgcagtcagggacgaaaactgcgcattgccgtctcggttgcatccgcaggtggctcataagatccaggaactagtgtcccagggcattgaacaggtctatgctgtgaggaagcagctaagaaaatttgtggagagggagctgttcaagccagacgaagtccctgagcggcataatctcagcttcttcccaaccgtcaacgatatcaaaaatcatatccacgaagtgcagaaaagtctgagaaacggcgacactgtgtacaattctgaaatcattccggccaccctgcagtggaccacagacagtggcaacatcctgaaagaaacgatgaccgtcacgtttgcagaagggaattcacccggtgagtcaattactaccaaagtggagacgaatcagacccgtggtagtctgtcaccagagcccacccatctactctcttctctctctagctttcagccgaagatcttcacacaactgcaaggacttcaattgcagccacgctacacttccccagatgaatcccccgccgtcgtaagcgtgaataatcaaccttcttccagcccctctggactgcttgacactattgggtcagccgttatgaataataattctctcctgcttggccagtcacatagtctccagcgggacacttgcctcactcagaacaactctacagccagtaccatgggcaaccttcctgagccagatcagaacctagtggccatggacgaacttgtcgaggtgggagacgtggaagacactggaaatcttgagggaacagttcatcggattctcctaggggacgtccaaactattcctatacagattatagacaatcacagcgccctaatagaggaaaacccagaatccacaatcagcgtctcccaagttaaacaggagcccaaagaacctgcgttgtcgatggaagccaaaaagactgtggactataaaaagttgtccgcgacctag

SEQ ID NO: 108136 - DNA, 2178 bp, Artificial Sequence
  Description of Artificial Sequence: Synthetic coding sequence
atggaacagtccaatgattcccttcgcgttaatcataatgacggcgaagagtcaaaaaccagcgcacaggtgtttgagcacctcatctgcatggattctagggatagtagttttgggcagaatgactctcctacagttctgccaattacaacaagggaggcgaataattccctgattagccagaatatacctgggccgttaactcagactcagactttaagtgcagagcaatttcacctcgtggatcagaacgggcaagcaatccagtacgagctccagtcactcggggagagcaacgctcaaatgatgattgtcgctagtcccaccgagaacggccaggtgctacgcgtgattccccccacacagactgggatggcccaggtgatcatccctcaaggccaactcgtagatgtcaacagccctcgagatgttccagaggaaaagccctcaaacaggaatttacccacagtgcgagtggatacactggctgacaacacaagcaactatatcctccaccctcagacaagtttcccactgcctaagaaaagtgtgacgggcatgctggaggagcccctcttgggtcctctgcagccgctgtcctctaatactccaatctgggcttgccgtctgaggtcttgcgaaaaaattggcgattcctataggggctactgtgtaagcgagacagaactggagtcagtgctgactttccacaagcaacaaacgcagtccgtgtggggtacacgccagtctccatcgcccgctaagcccgcaacccgactgatgtggaaatcacagtatgtgccctacgacggcatacccttcgttaacgctgggagtcgcgctgtagtcatggaatgccaatatgggccacgtcgcaaaggcttccagttgaagaaggtaagtgaacaagaatcgaggagttgccaactatacaaagccacatgtcccgccagaatctacataaagaaggttcagaaattcccagaatatcgggtccccacggatccaaagattgataagaaaattatccgcatggagcaagagaaggccttcaatatgctgaaaaaaaatctggttgacgcaggcggagtgcttaggtggtacgtgcagctgccgactcagcaggcacatcagtaccatgagctggagacgccctgtctcaccctctctcccagcccatttccagtgtcatccctggaagaagaagagactgctgttcgtgatgaaaactgtgcgctgccaagccggcttcaccctcaggtcgcacataagattcaggaacttgtatcccagggcatcgagcaagtttatgccgtgagaaagcagctgcggaaattcgtggagcgggagctcttcaaaccagatgaagtgcctgaaagacacaacctgtccttcttccctacggtgaacgacataaagaaccacattcatgaagtgcagaaaagcttgagaaacggcgacactgtctacaattcagaaataattccggcaaccctgcagtggactaccgactccggaaatatcctgaaggaaactatgacggtgactttcgccgagggaaactctcccggagagtccataactacgaaggtcgagaccaaccaaacccgcggctcactgtctccagagcctacccacttattgtcatcgctgtcaagctttcagccaaagattttcacccagcttcagggtctacagctccagcccaggtatacctcccctgacgagagtcctgcagtagtgtccgttaacaatcagccatcatctagccccagcggccttctcgataccatcgggtcggcagtcatgaacaacaactccctgctgttgggacagtcccattccttacagagggatacatgcctgacccagaacaatagcaccgcaagcacaatgggtaatctccccgaacctgatcagaatttagtcgcaatggatgagctggtcgaagtgggcgatgtagaggacaccggaaaccttgaaggcaccgttcatcgaattctgctcggagacgttcagaccatccccattcagatcattgacaaccactctgccttgatcgaagagaaccctgagtccaccatttccgtatcgcaggtcaaacaagaacccaaggagccagcactcagtatggaggctaaaaagacggtggattataagaagcttagcgccacgtag

SEQ ID NO: 108137 - DNA, 165 bp, Artificial Sequence
  Description of Artificial Sequence: Synthetic coding sequence
atggaacagtctaatgactctctgcgggtaaaccataacgacggcgaggaaagcaagacttctgctcaggttttcgagcatctaatttgtatggatagccgtgactcaagttttggccagaatgactcccccacagttttaccaataactactcgggaggcatag

SEQ ID NO: 108138 - DNA, 396 bp, Artificial Sequence
  Description of Artificial Sequence: Synthetic coding sequence
atggaacagtctaatgacagcctgagggtaaaccacaatgatggggaggagagtaagacttctgcgcaggtgttcgagcacctcatctgcatggatagtagagacagtagcttcggtcagaacgactctcccactgtcctgccgataactacacgtgaggctaataattctcttataagccaaaacattccaggtcctctgacccagactcagacgctcagtgccgaacagttccacctcgtggaccagaatggccaggccatccaatacgaactgcagagcctcggggaatccaacgcgcagatgatgatcgtagcatctcccaccgagaacggacaggtgcttcgggtgatccccccaacacagactggcatggcccaggtgattattccatag

SEQ ID NO: 108139 - DNA, 66 bp, Artificial Sequence
  Description of Artificial Sequence: Synthetic coding sequence
atggaacagtcgaatgatagcctgagagtcaaccataatgatggcgaagagtctaagacatcctag

SEQ ID NO: 108140 - DNA, 222 bp, Artificial Sequence
  Description of Artificial Sequence: Synthetic coding sequence
atggagcagagcaatgactcccttcgcgtgaatcacaatgacggtgaggagtctaaaacttccgcacaggttttcgagcatcttatttgcatggattctcgggatagctcattcgggcagaacgacagccccactgtcttgccgatcacgacaagggaggccaacaatagcctgatttctcagaatatccccggcccactgacccagacccaaacactgtag

SEQ ID NO: 108141 - DNA, 2178 bp, Artificial Sequence
  Description of Artificial Sequence: Synthetic coding sequence
atggagcagagcaacgatagcctaagagtcaaccacaatgacggcgaggaatccaagaccagcgcccaggttttcgagcacttgatctgcatggattctcgggactcatctttcggccagaatgactctccaaccgtactccccattacaacccgggaagccaacaacagtcttataagccagaacatccctgggcccttgacccaaacccagaccctctcggccgagcaattccacctggttgatcagaacggccaagccatacagtatgagttgcaatcactaggggagtccaatgcacagatgatgattgtagcctcgcccaccgagaatggtcaggtgctccgtgtgatccctcccacccagaccggaatggcccaggttattattccacaagggcagttggtagacgtcaattccccgcgcgatgtcccagaagagaaacctagcaaccgtaacctgcctacagtccgggtggacacgctggccgataacaccagcaattacatcctccaccctcagactagctttcctctgcccaaaaagagcgtgactggcatgctcgaggaacctctgctgggaccacttcaacccctgtcttcgaatacaccaatctgggcctgccgactgaggagctgcgaaaaaatcggcgactcttatagggggtactgtgtgtctgagaccgaactggagagcgtccttacgtttcacaagcagcagactcagtccgtttgggggacacggcagagcccatcacccgcaaagccagccacacgcctgatgtggaaaagccagtatgttccctacgacggaattcctttcgttaacgccggtagtagggctgtggttatggaatgccagtacggccctcgtagaaaggggttccagctcaaaaaggtgagcgaacaggagtcgcgcagctgccaactctataaagctacctgccccgctagaatttacattaagaaggttcagaagttccccgagtacagggtgccaacagatcccaagattgacaagaagattatccgaatggagcaagaaaaggcatttaacatgcttaagaaaaacctagtggatgccggtggcgtcctaagatggtacgttcagcttcccactcagcaggctcatcagtatcatgaactcgagaccccatgcctgacgctttctccaagccccttccccgtcagctccttggaagaagaggagactgctgtgcgggatgaaaactgtgccttgccaagccgattgcatccgcaggtcgcgcataaaattcaggagttggtttcccaggggattgagcaggtctacgctgtgagaaagcagctgaggaagtttgtggagcgagaattgtttaaacctgacgaggtgcccgagcggcataacttgagcttcttccccaccgtgaatgatatcaagaaccatattcatgaggtgcagaaatcactccgaaacggggacaccgtatacaattcagaaataattcccgcgacgctgcagtggacaacagatagtggaaatattttaaaggagaccatgacagtcactttcgctgaagggaattcaccaggcgaatccattacaactaaggttgagactaaccagacacgcggatccctcagccctgagccaacacacctgttgtcttccttatcatccttccaacctaagatcttcactcagctacaggggctacagctacaacctcgttacactagccctgatgagtctcctgccgtggtatcagttaacaatcagcccagcagctcaccctctggactccttgataccataggcagcgccgtgatgaataataattctttgcttctgggacaaagtcattctttacagagagacacttgcctgacccagaataactccactgcttctactatgggtaatctgcctgaacctgaccagaatctcgtcgccatggatgagcttgtcgaagtaggtgacgtggaagacacagggaacctggaaggcactgtgcacaggattctgctgggggatgtccagactatccctattcagataatcgataaccatagcgcactaatagaggaaaatccagagagtacaatatccgtgtcacaggttaagcaagaacccaaggagcccgccctgagtatggaggctaagaaaactgtcgactataagaaattgtctgccacctag

SEQ ID NO: 108142 - DNA, 222 bp, Artificial Sequence
  Description of Artificial Sequence: Synthetic coding sequence
atggagcaatccaacgactccctacgcgttaaccacaatgacggtgaagagtccaagacttctgctcaagttttcgaacacctgatctgtatggacagccgtgattcttcatttggccagaatgactctccaacagtgctgcccatcaccactcgtgaggcaaataattccttaattagccagaacattcccggcccgttgacccagacccagaccttgtag

SEQ ID NO: 108143 - DNA, 288 bp, Artificial Sequence
  Description of Artificial Sequence: Synthetic coding sequence
atggaacaatccaacgacagtctgcgggtaaatcacaacgacggcgaagagagtaagacaagcgcccaggtattcgagcaccttatttgtatggactctcgtgactcctccttcggacagaacgattctcctacagtgcttcctataactacccgtgaggccaacaactctttaatctcccagaacattccgggccccctcacacagacgcagactctctccgcggagcaatttcacctcgtggatcagaacggccaagcaatccagtacgaacttcagagcctgtag

SEQ ID NO: 108144 - DNA, 624 bp, Artificial Sequence
  Description of Artificial Sequence: Synthetic coding sequence
atgctggaggcctggaatctgaacctgagccactatctgaagcaccttatctgtatggactcaagagacagcagcttcggccagaatgatagcccaactgtccttcccatcactactagagaggctaataatagcttaatcagccagaatatcccaggtcccctgacgcagacccagaccctctcagcagagcagttccatctcgtggaccagaatggacaggccattcagtacgagctgcagagcttaggcgaatctaacgcccaaatgatgattgtagcaagccccaccgaaaatggacaggtcctccgagtgattcctcctacccagaccggaatggcccaggtgattattccccaggggcagctggtggacgtcaatagcccaagggatgttccggaagaaaaacctagcaaccggaacctcccgaccgtgagagtcgacactctggcggacaatacctcgaactacatcctgcatccccagacctcctttccattgcccaaaaagtctgtcactgggatgttagaagaaccattgctcgggccattacaacccctgtcaagcaacactccgatttgggcttgtcgcctgagatcttgcgaaggcgtcgaactgtggtag

SEQ ID NO: 108145 - DNA, 1914 bp, Artificial Sequence
  Description of Artificial Sequence: Synthetic coding sequence
atgctggaagcgtggaacttaaacctctctcattaccttaaaatgatagtggccagtccaacggagaacggtcaagtgctcagggtgatcccacccactcagacaggaatggctcaggttataataccccagggccagctggtggatgtcaactctcctagggacgtcccggaggagaaaccctctaacagaaatctgccaacggtacgtgttgacacgttagcggacaacactagcaactatatactccacccccagaccagcttcccactgccaaagaagtcagttacggggatgctggaagaacccctactgggcccgctccagccccttagctccaatacgccaatctgggcctgtcgtctgaggagttgtgagaagatcggcgatagttacagagggtactgcgtgagcgagactgaactggagtcagtcctgaccttccacaagcaacagacacagtctgtctggggaacaagacagtccccatcccctgccaaaccagccactcgtctgatgtggaagtcgcagtacgtgccttatgatggaataccctttgtgaacgccggaagccgcgccgtagtgatggagtgccagtatggtccacgaagaaagggctttcaactgaagaaggtgtctgagcaagagagcagaagctgtcagctgtataaagccacttgtcctgcacgaatctatattaaaaaggtgcagaagttccccgagtaccgagttcctacagatcccaagattgacaagaaaatcattcgaatggagcaggagaaggcatttaacatgctgaagaagaacctggttgatgcaggcggcgtgctgcggtggtacgtacaacttccaactcagcaggctcatcagtaccacgaactggaaacaccatgcctgactctgagtcctagtccgttcccagtctccagtctcgaagaagaggagacagcagtgcgagacgagaattgcgccctgccatcgcggctgcatccgcaggtggcacacaagatccaggaacttgtgtcgcaagggatcgagcaggtgtacgccgttcggaaacagctgcgaaagttcgtggaacgcgagctgttcaaacctgacgaggtgcccgagaggcataacctctctttctttcctaccgtcaatgacattaaaaaccacattcacgaagttcagaagtccctgaggaatggggataccgtgtataatagcgagatcatccccgccacactgcaatggactacggacagcggcaacattttaaaggaaactatgacggttacttttgctgaaggtaatagcccgggggagagcatcaccaccaaggttgaaactaaccagactcgaggatctctgagcccggagcccacccatctgttgagttcgttgagctctttccagcctaagatcttcactcagttacagggcctgcagttgcaaccacgctacacaagtccagacgagagcccggcagtcgtgtcagtcaataaccagcctagttcgtctcccagcggcctgttggacacaatcgggtcggctgttatgaataataacagccttctgttgggccagagccactctttgcagagggacacatgtctgactcagaataacagcacagccagcaccatgggcaacctcccagaacctgaccagaatctagtggccatggatgagctggtggaggtaggagacgtcgaggatactggcaatctggagggcaccgttcatcgcatattgcttggcgacgtgcagacgatccccatccaaatcatcgataaccattccgcccttatcgaggagaaccctgagagcactatttccgtgtcacaagtcaagcaggagccgaaagaacccgccctgtccatggaagctaaaaaaacagtggactataaaaagctttccgccacctag

SEQ ID NO: 108146 - DNA, 1950 bp, Artificial Sequence
  Description of Artificial Sequence: Synthetic coding sequence
atggaacagtctaacgattccctgagggtgaatcataacgacggggaagagtctaagacttccgcccaggtgttcgaaatgatcgtggcctcccctacagaaaatggtcaagtactgagagtgatcccccccactcagacaggcatggcccaggtgataattccacagggacagctagtggatgtgaatagcccgagggacgttcccgaagagaagccctccaaccgcaacctgccgactgtgcgagttgatacgctcgccgacaatacctccaactacatcctgcatccccagacttcattccctctacccaagaaatcagtgaccggcatgctggaggagcctctattgggacctcttcaacccctttcttcaaatactcctatctgggcgtgtcgcctgaggagctgcgagaaaataggggacagttatagagggtactgcgtgagtgagaccgagcttgagtccgtgcttacttttcataaacagcagactcagtctgtctgggggacaaggcagtcccctagccccgccaagcctgcgaccaggttaatgtggaagtctcagtacgtaccctacgacggaattccattcgtgaacgccgggtcccgggctgtcgtaatggagtgtcagtacggtccaagacgcaaaggtttccagttgaaaaaggtgtctgagcaggagagtcgttcttgtcagctgtacaaggctacttgtccggctaggatctacatcaagaaggtgcaaaaattccccgagtaccgggtccctacagaccctaagatcgacaagaaaattattagaatggaacaggagaaagcatttaacatgctgaagaagaaccttgtggatgctggcggtgtgctgagatggtacgtgcagctgccaacgcagcaagcccaccagtatcatgagctcgaaaccccttgcctcaccttgagtccctccccatttccagtgtcttcacttgaggaagaggagaccgctgtgagagatgaaaactgcgctttacccagtcggttgcatccccaggtcgctcataagattcaggagttggtttcccaagggatcgaacaagtgtatgcagtgcgcaaacagcttagaaagtttgttgaaagggaacttttcaaaccagacgaggttccagagcggcacaatctcagctttttccctacagtgaacgacatcaagaaccatatccatgaggttcagaagtctctccgcaacggtgatacagtgtacaatagtgagattatccctgccactctccagtggacaacagattcgggcaacatcctgaaagagacgatgacagtcacttttgcagaaggcaactcacccggcgagtccattactactaaagtggaaacgaaccagacgcgagggagtttgagcccagaacctacccacttgctctccagtctctcaagcttccagcccaagatctttacccagctgcagggcttacagttgcagcctcgctacacttcacctgacgaatccccggcggtggtatctgtgaacaatcagccctcatcctctccaagtggtctgttagacaccatcggtagtgccgtgatgaacaataactccctcctcctcggacagtcgcacagtttacaacgggatacctgtctcacgcagaataacagcacagcctccacaatgggcaacctgcccgagcctgatcagaatctggtcgctatggatgaactcgtggaagtgggtgacgtcgaagacaccggcaatctcgaggggaccgtgcaccgcatcctgctaggcgatgtgcagacaattcccatccaaattattgacaatcactcagctctgatcgaggagaatccggagtcaactatttccgtgagccaggtaaagcaggaacccaaggagcctgcccttagtatggaggccaagaagactgtcgattataaaaaattatcagcgacatag

SEQ ID NO: 108147 - DNA, 558 bp, Artificial Sequence
  Description of Artificial Sequence: Synthetic coding sequence
atgacaacccctaataaaacaccccctggcgcggatccaaagcagctcgagcggacaggtacagtccgcgaaattggttcacaggcagtatggtccttatcttcatgcaaacccggatttggcgtagaccagctgcgggatgataacctcgagacatactggcaatctgacggctctcagcctcacttggttaacatccaattcaggaggaaaacaaccgttaaaacactctgcatttacgccgactacaagtctgacgagtcttacactccctccaagatctccgtcagagtagggaataacttccacaatctgcaggagattaggcaattggaactggttgagccatctgggtggatacacgtgcctttaacagataaccacaaaaaaccaacccgaacgtttatgatccaaattgcggtgctggccaaccatcagaacgggcgtgatacacatatgcgccagatcaagatttacacccccgtcgaggagtccagtattgggaagttccctagatgcactacaatagactttatgatgtatagaagcattcgctag

SEQ ID NO: 108148 - DNA, 558 bp, Artificial Sequence
  Description of Artificial Sequence: Synthetic coding sequence
atgacaacccccaacaagactccccccggcgccgaccccaagcagctggagcgaactggcactgtccgtgagattggcagccaagccgtctggagcctgtcatcttgcaagccggggttcggggttgaccagctgcgtgacgataatctggagacctattggcaatctgacggatctcaaccccatttggtgaacatacagtttagaagaaaaactacagtgaaaacactgtgcatttatgccgactataagtccgacgagagttacacccctagcaagatcagtgtgagggtcgggaataattttcacaatctccaggagatccgccaactggaactggtggagcccagtggctggattcatgttcctttaacagacaaccataagaaaccaacacggacattcatgattcaaatcgccgtgttggctaatcaccagaacggtagggatactcatatgagacaaatcaagatttacacgcctgtggaggaaagttccatcgggaaattcccccggtgtaccacaatcgactttatgatgtatcgtagcatccggtag

SEQ ID NO: 108149 - DNA, 207 bp, Artificial Sequence
  Description of Artificial Sequence: Synthetic coding sequence
atgactacccctaacaagacgccaccgggagcggatcctaaacagttagaacgcaccgggacagtccgagaaatcgggtctcaagctgtgtggtccctgtcttcctgcaagcctggatttggcgtggatcaactgcgcgatgataatcttgagacctattggcagtctgacgggagccagccccatttggtgaacattcagttctag

SEQ ID NO: 108150 - DNA, 330 bp, Artificial Sequence
  Description of Artificial Sequence: Synthetic coding sequence
atgactacccctaataagacaccacccggggccgatccaaagcagctggagagaacggggacggtaagggagataggaagtcaggctgtttggtctcttagttcatgcaaacccgggttcggtgtagatcaactgagggacgacaaccttgaaacatattggcagtcagatggctcgcagccacacctggtcaacatacagttcaggcggaaaacaacagtaaaaactctgtgtatctacgccgattataagtccgacgagagctataccccctccaagatctcagtgcgcgtaggtaacaattttcataacctgcaggaaattagatag

SEQ ID NO: 108151 - DNA, 558 bp, Artificial Sequence
  Description of Artificial Sequence: Synthetic coding sequence
atgaccacgccgaacaaaacgcctcccggggcagatccaaaacagttagagcgcactggcactgtgagggaaatcggctcacaggccgtatggagcctgtcctcttgcaaacccggatttggcgtggaccagctgagagacgacaacttggagacatactggcagagtgatgggagccagccacatctcgtgaacatccaattccgcagaaagactacagtgaaaacattgtgtatttatgccgattataaatctgacgagtcttataccccttctaaaattagcgtgcgcgtagggaataactttcacaatttgcaggaaattcggcagctggagttagtagaaccctcaggctggattcacgttccactgactgacaaccataagaaaccaacacgcacatttatgatacagatagcggtgctagcaaatcaccagaatggccgcgacacacatatgcgtcaaataaaaatttacactcctgtggaggagtcctcaatcgggaaattccctcgctgtaccaccatagatttcatgatgtatcggtctattagatag

SEQ ID NO: 108152 - DNA, 477 bp, Artificial Sequence
  Description of Artificial Sequence: Synthetic coding sequence
atgacaacaccaaataagacccccccgggcgcagatccaaagcaactggaacgaacaggaaccgtccgggagatcggaagtcaggccgtctggtctttgagttcttgcaagccaggattcggtgtggatcaactccgcgacgacaatctggagacttactggcagagtgatggttcccaacctcacctcgtgaatatccagtttcgaagaaagaccacagttaagactctgtgtatctacgcggattataagtccgacgagagttataccccaagcaagattagtgtgcgggtgggcaacaacttccacaatctccaagaaatcaggcagcttgaactggtggagcctagcggatggatacacgtgccactgacagacaatcacaagaaaccaactcgaacgtttatgattcagattgccgtgctggctaatcaccagaatggcagggatacccacatgcggcaaatcaagatatag

SEQ ID NO: 108153 - DNA, 477 bp, Artificial Sequence
  Description of Artificial Sequence: Synthetic coding sequence
atgaccacccccaataaaactccacctggcgccgacccaaaacagttagagcgcaccggcaccgttcgggagatcggtagccaggcagtgtggtccctatcaagctgtaagcctggctttggtgtggatcagctacgagacgataacctggagacttattggcaatctgatggctcacagccacatttggtcaatatacaattccggaggaaaacaaccgttaaaactctgtgcatctatgctgactataagtccgatgaatcctatactccatccaaaatttccgtgagggtgggtaataattttcacaacctgcaagagatccgtcagcttgaattggtggaaccctccggctggatacacgtgcctctgacagataaccacaaaaaaccaacaaggaccttcatgatccagatcgccgtactggctaatcatcaaaatgggagggatacacacatgaggcagatcaaaatctag

SEQ ID NO: 108154 - DNA, 333 bp, Artificial Sequence
  Description of Artificial Sequence: Synthetic coding sequence
atggccgcctcatccagttcatcaagcgcaggaggagtgagcggcagctccgtaactgggtcaggtttctccgtttctgatcttgctcctccacgtaaggctctctttacatatcctaaaggcgcaggggaaatgctcgaggacggcagtgagagatttttatgtgagagtgtgttctcttatcaggtggctagtactctgaagcaggttaaacatgaccaacaggtggcacgtatggagaagctggccggactagtggaagagctggaggcagatgaatggaggttcaaacccatcgaacagttactaggattcacccctagttcaggctag

SEQ ID NO: 108155 - DNA, 2427 bp, Artificial Sequence
  Description of Artificial Sequence: Synthetic coding sequence
atgctgagattcccaacatgcttcccaagcttccgggtggtaggggaaaagcaactgccccaggaaattatctttttggtgtggtcccccaagcgcgatctaattgcccttgcaaacactgccggcgaggtgttgctgcatcgcctggcttcgtttcaccgggtgtggtctttccccccaaatgagaacaccggcaaagaggtcacttgtcttgcctggagaccggacggtaaactgttagctttcgcgttggccgataccaagaaaatagtcctctgtgacgtagaaaagccagaatccctgcactccttctctgtggaggcgcctgtgagttgcatgcattggatggaggtcaccgtggaatcctctgtcctgacgtctttctataatgctgaggatgagtctaacctgctccttcccaaactgccgactctccctaaaaactactctaacacctctaaaattttttctgaggagaatagcgatgagatcataaagctgctcggcgacgttcgtctgaatatactggtgttaggagggtcttcaggattcatagagttatacgcctatgggatgttcaaaatcgctcgggtcactggcattgcgggtacttgtctggcgctttgcctttctagtgacctgaagtccctcagcgtagttacagaagtttccaccaatggtgccagtgaagtaagttactttcagctggagaccaatctgctatactccttcctccccgaagttactcggatggcgaggaaattcactcacattagtgcccttctccagtacattaacctaagcctgacctgtatgtgcgaagcttgggaggagatcctcatgcaaatggattcccgcctaacgaaattcgttcaggagaagaatacaaccacaagtgtccaagatgagtttatgcatctgcttctctggggcaaagcatctgccgagctgcagacattgttgatgaatcagctcacagttaagggtctgaagaagttaggtcaatccatcgaatcttcctactccagtattcaaaagcttgtgatatctcatctccaatcaggaagcgaatcactcttgtaccatttatccgagctgaaaggtatggcgtcctggaagcagaagtacgagcctctgggtttggacgccgccggtattgaggaggctataacagcagtgggctctttcatcttgaaagctaatgagctcttacaggtcatcgattcctcaatgaaaaatttcaaggcatttttccggtggctatacgtggcgatgctccgcatgactgaagaccacgtactgccggaattgaataaaatgacccaaaaggacatcacttttgtggccgagtttcttaccgagcatttcaatgaggcacccgatctctacaataggaagggcaagtacttcaacgtcgagcgggttggccagtacttaaaggacgaggatgatgaccttgtaagtccacctaacacagaaggtaaccagtggtacgattttttgcagaattctagccatctgaaggaaagccccttactgttcccctactaccctcggaaaagcctgcatttcgtaaagaggagaatggaaaacataatcgaccagtgcctccagaaacctgccgatgtcatcgggaagagcatgaatcaagcaatttgcattccgctgtacagagatacacgatctgaagattccactaggcgtctattcaaatttccgttcctttggaacaataagacatctaatctgcactatctactgtttaccatcctggaagatagcttatacaagatgtgtattctaaggagacacacagatatcagccagtccgtgtctaatggcctgatcgcgattaaattcggtagcttcacctatgctactactgagaaagtccgtcgctcgatctacagctgtttggatgctcagttttatgacgatgaaaccgtcaccgtggtactgaaggatacagttggccgagagggaagggaccgcctgctggtgcagctgccgttgtcactagtgtacaatagcgaggactccgcggagtaccaattcacgggcacatactccacgaggctggacgagcagtgtagcgcaatccccacccgcaccatgcactttgaaaaacattggaggttgttggaatctatgaaagctcagtatgtggccgggaatggctttcgaaaagtgtcatgtgttttgagctctaacctgaggcacgtgagagtgttcgaaatggatattgacgacgagtgggagcttgacgagtcaagtgacgaggaagaagaggcttccaacaagccggtgaagataaaggaagaagtgttgagcgagtctgaggctgagaatcagcaagccggagccgctgcactggctcccgaaatcgtcatcaaagtggagaaattagatccagagttagactcatag

SEQ ID NO: 108156 - DNA, 489 bp, Artificial Sequence
  Description of Artificial Sequence: Synthetic coding sequence
atgctgaggttccccacctgcttccccagttttagggtggtcggcgaaaagcagctgccacaagaaatcatcttccttgtgtggtcccctaagcgtgatcttattgccctcgcaaacactgctggcgaagtcctcctgcataggctcgctagtttccatagagtgtggtcctttccgcccaacgagaacacgggaaaagaagtaacctgtctggcctggcggcccgatgggaagctgttggcgtttgcgctggccgacactaagaagattgtcctgtgtgacgttgagaagccagaatccctgcatagcttttctgtcgaggcccctgtgtcgtgtatgcattggatggaggtgaccgtcgaatcctctgtgcttacatctttttacaacgcagaggacgagtccaacttgttattgcccaagctacccacattacccaaaaactattccaatacctctaagatctttagcgaagagaactcagattag

SEQ ID NO: 108157 - DNA, 2430 bp, Artificial Sequence
  Description of Artificial Sequence: Synthetic coding sequence
atgcttcggttcccgacatgttttccctcgttccgcgttgtgggggagaaacagcttccgcaagaaatcatttttctcgtgtggtcacctaagagggacctgatcgcattggccaacacagctggcgaagttctgctccacagattggcttcctttcaccgcgtgtggtcctttccgcccaatgagaacactggtaaagaagtaacctgcctggcatggaggccagacgggaaactcctggctttcgccctggcagacacgaaaaaaatagtgttatgcgatgtggaaaagcccgaaagtttgcattccttcagcgtcgaagctccagtgagttgcatgcattggatggaagtgacagtggaatcatctgtgctcacctcattctacaacgcagaggatgaaagtaacctgcttctgccaaaactcccgaccctgcctaagaattatagtaacacttccaaaatcttcagcgaggagaattccgacgagatcataaagcttcttggcgacgttcggcttaacattctcgtgctaggcggaagctctggcttcatcgaattatacgcctacggcatgtttaaaattgccagagtgaccggtatagccggcacgtgtctggctctgtgcttatcatcagacctgaagtccctgtccgtggtcacagaggtgtcgacaaatggcgcctctgaggtatcttactttcagctggagacgaacctgctttattcattcctgcctgaggttacgcgcatggcaaggaagttcacccatatctctgcactcctacaatatataaacctgtccctcacatgcatgtgcgaggcctgggaagagatcctcatgcaaatggatagtaggcttaccaaatttgtgcaggaaaaaaatactaccacctcggtacaggatgaattcatgcatctactgctgtgggggaaggcttcggcagagctgcagactctgcttatgaaccaactgacagtgaaaggactgaagaaactcgggcaaagcatcgagagttcatatagttctatccagaagcttgtaatatctcacctccaaagtggaagtgaaagtcttttgtaccacctcagcgaactgaagggtatggcaagctggaaacaaaaatatgagccactcggtcttgacgcagctggcattgaggaagcgatcactgcagttggatcctttatattaaaagccaatgagctgctgcaggtgattgatagcagtatgaaaaattttaaggctttcttcagatggttgtacgtggctatgctgaggatgacagaggaccacgtactgcctgaactgaataaggtgatgactcagaaagatattactttcgtggctgaattccttacagagcatttcaatgaggccccagatctttacaatcgcaaagggaaatatttcaatgtggaaagggtgggtcagtacctgaaggacgaggacgatgacctcgtcagcccaccgaacacggaaggaaaccaatggtacgactttctacaaaacagcagtcacttaaaagaatccccactcctcttcccctattatcctcggaaaagcctgcattttgtgaagagacgaatggagaatatcattgaccagtgtctgcaaaaacccgccgacgtgatcgggaagtccatgaatcaggcaatttgtatccccctttatagagatacgaggtccgaggactcaacgaggcgactctttaaattccctttcctctggaataacaaaacgtccaatcttcactatttgttattcacgatcctagaagactcactatacaagatgtgcattttgagacgtcacacggatatttctcagtccgtcagcaatggactaattgcaattaaatttgggagtttcacgtacgctaccactgaaaaggtgcgtcgcagcatctattcatgtctggatgctcagttctatgacgatgaaactgtaactgtagtccttaaggacacagtcggaagagaggggcgagaccgtttactggtacagctccccctgtctctggtttacaatagcgaggactccgccgaatatcaattcacgggcacctactctaccaggttggacgagcaatgctccgccatcccgacccggactatgcacttcgagaaacactggcgcctcctggagtccatgaaggctcaatacgttgccggaaacggcttccgtaaagttagctgcgtgctatcttctaatctgagacatgtccgagtctttgaaatggacattgatgacgagtgggaacttgatgaatcaagcgacgaagaggaggaagccagcaataagcctgttaagatcaaggaagaagtgctgagtgaaagcgaagccgagaatcagcaagcaggtgccgctgcactcgcccccgagatcgtcataaaggtcgagaaactggaccctgaactggactcatag

SEQ ID NO: 108158 - DNA, 2268 bp, Artificial Sequence
  Description of Artificial Sequence: Synthetic coding sequence
atggcctctgtccacgagagcctgtatttcaatccaatgatgaccaatggtgttgttcacgccaacgtctttggcatcaaagactgggtgacaccctacaaaattgctgtattggtgctgctgaatgaaatgtcacggaccggtgagggggctgtaagcctgatggaaagacggaggttgaaccagctgcttctccctctgctccaggggccagatattaccttatctaaactctataaactaatagaggagtcctgtcctcagctcgctaactctgtgcagattcgcatcaagctgatggcggaaggtgaattgaaggacatggagcagttttttgacgacctcagtgactctttttcggggaccgaacccgaagtgcacaaaaccagcgttgtgggcctgttcctccgccacatgatacttgcatattcaaagctgtcctttagccaggtgtttaaactctacactgcactccagcagtacttccagaacggcgagaagaaaacagtcgaggacgcagatatggagttgaccagccgtgacgagggagaacgcaagatggaaaaggaggaacttgacgtgtccgtgcgggaagaagaagttagctgtagcggtccactgtcccagaagcaggctgagttctttttgtctcaacaggcctccctgctgaagaatgacgagacaaaggcccttacccctgcctccctgcagaaggagctgaacaaccttctgaagtttaatccagactttgccgaggcgcattacttaagctatctcaacaacctcagagtgcaggatgtgtttagcagcacccattctcttttgcactacttcgatagactgattcttacaggggctgaaagcaagtccaatggcgaggagggttacggcaggagcctgcgctacgccgcactcaacctggccgcccttcactgtagattcggccactaccagcaggccgagctggccctgcaggaggcaataaggatcgctcaggaatccaatgaccatgtgtgcctacagcattgtcttagttggttatatgtgctcggccaaaagcggtctgattcttatgtgttgcttgagcacagtgtgaagaaggccgtccactttgggctgccctacctggcttcactcggcattcagagtctggtacagcaaagagccttcgcgggaaaaacagctaacaagcttatggatgcactgaaggatagcgatctgctgcattggaaacacagccttagcgagctcattgatatcagtattgctcaaaagacagcgatatggagactatacggccgcagtactatggcccttcagcaggcacaaatgctactgtccatgaatagtctggaagctgttaatgcaggggtacagcagaataacaccgagtcatttgctgtcgcattatgtcatctcgccgagcttcacgcggagcaaggatgttttgcagccgcttccgaggtgttaaagcacttaaaagagcgattcccacctaactcacagcatgcccagctttggatgttgtgcgaccaaaaaattcagtttgaccgagctatgaatgacggaaagtatcatttagctgatagtctcgttaccgggatcacggcgctcaattcaatcgaaggggtgtataggaaagccgtggtcttgcaggctcagaaccagatgagtgaagctcacaaactgctccagaagttgctcgtgcattgccagaagctgaaaaacacggaaatggttatatctgtcttgttgtcagtggctgagctgtattggcggagctcttctcctactatcgctttgccgatgctgctacaggcgctggctctgagcaaagagtaccgcttacagtatctcgcatctgagactgtgttaaacttggctttcgcacaactgatcctcggcatacccgaacaagcattatccctgctgcatatggctattgagcccatcctggctgacggcgccattttagataagggacgtgccatgttcctggtggcgaagtgccaggttgcgagcgccgcctcatatgaccagcccaagaaagcggaagccctggaagccgcaatcgagaacctcaacgaggcgaaaaattatttcgctaaggtcgactgtaaagagcggatcagagatgtggtttactttcaagcgcggctgtatcacacattgggcaaaacgcaggagcggaaccgctgcgcaatgctgtttcgacaactgcatcaggagctgcctagccacggcgtgcctctgattaatcatctttag

SEQ ID NO: 108159 - DNA, 1932 bp, Artificial Sequence
  Description of Artificial Sequence: Synthetic coding sequence
atggcggagggtgagttaaaggatatggagcagttctttgacgatttgtccgattcattcagtgggactgaacccgaggtgcataaaaccagcgtcgtcggtctgttcctccgacatatgatcctagcctatagtaaactgtctttcagccaagtgtttaagctatatactgcattacagcagtactttcaaaacggggagaagaaaacggttgaagacgccgatatggagctaacgagcagggacgagggagagaggaaaatggagaaggaggagctggacgtcagcgtcagagaagaagaggtttcctgtagtgggcccctgagccagaagcaggctgagttttttctttcccagcaggccagccttttaaagaacgacgaaactaaagctcttacaccggcatctctccagaaagaactgaataatttactgaagttcaaccctgatttcgcggaggctcattacctctcctaccttaataatctcagggttcaagatgtcttttctagtactcatagcctgttgcattatttcgataggctgatcctgacgggcgctgaaagcaagagtaatggtgaggaagggtatgggaggtctttgagatatgctgcgttgaatctggcagccctgcactgccggttcggtcactaccagcaggccgaactggcgctccaagaagccattcggatcgcacaggagtcaaatgaccacgtgtgtctgcagcattgtctgtcatggctgtacgtgctgggccagaagcgcagcgattcttatgtgttgctcgagcattcagtgaaaaaagccgtgcatttcgggctcccacgcgcctttgccggtaagacagccaacaagctgatggacgcactgaaggactccgatctgcttcactggaagcacagtctctccgagctgattgatatctcaattgcccaaaagaccgctatttggcgcctctacggaagatctacaatggctttgcagcaggctcagatgctgctgagcatgaatagcctggaggctgttaacgctggtgtgcagcagaataataccgagagctttgcggttgcactttgtcacttggctgagctgcatgcagaacaggggtgtttcgccgctgcgtccgaggtactcaaacaccttaaggagagattcccaccaaacagccagcacgcgcagctctggatgctatgtgaccaaaagattcagtttgatcgcgcaatgaatgatggtaaataccacctggctgattcccttgtaaccgggataaccgctctgaattctatcgaaggagtgtaccgaaaagccgtggtgctgcaagctcagaaccagatgagcgaggcccataagctgctgcaaaagctgctcgtgcactgccagaaactgaaaaatacggagatggtgatctctgtactgctgtcagtggcggagctttattggcgcagctcttcccccactattgcgctgcctatgctgctccaggcactggcactgtctaaagagtaccgcctccagtacttggcatcagagactgtcctgaacctggcatttgcccaacttattctgggaatcccagagcaggcactgagcttacttcatatggctattgaacctatattggctgacggcgctatacttgacaaaggccgcgctatgttcctcgtcgcgaagtgtcaggtggccagtgctgcctcctacgaccagcccaagaaagctgaggcactcgaggccgccattgagaatcttaacgaggcaaagaattatttcgccaaagtcgactgtaaggaacggattcgggatgttgtctacttccaagctaggctctaccataccttaggtaagactcaggaacgcaatcgttgcgccatgcttttccgacagctccaccaggagctgccgtcacacggcgttcctttgattaaccatttgtag

SEQ ID NO: 108160 - DNA, 1932 bp, Artificial Sequence
  Description of Artificial Sequence: Synthetic coding sequence
atggctgagggggagctgaaggacatggagcagttctttgatgatctgtccgactcctttagtggcaccgaaccagaagtacataagaccagtgtggtgggactttttctgcggcacatgatcctggcctactcgaaactgagctttagtcaggtgttcaagctgtatacggccttgcagcagtactttcagaacggggagaagaagaccgtcgaggacgccgatatggaactgacctcaagagacgaaggcgagaggaagatggagaaggaggagctagacgtctctgtcagagaagaggaggtgtcatgctcaggccccctgtcgcaaaagcaggccgaattctttttgtcccagcaggcctccttgcttaagaatgatgagacgaaagccctaactcctgcaagcttgcagaaggagctgaacaatttgctcaagttcaaccctgacttcgccgaggctcattacctgtcctatttgaacaatctcagagttcaggacgtcttttcaagcacacattctttgctccattacttcgaccgtctgatccttaccggcgccgagtcaaagtcgaatggggaagagggttatggtagatcactgagatatgcagccttgaatctggcagcactccactgtcggtttgggcattaccagcaggctgagttagcccttcaggaagctatccgaattgcacaggagagcaacgatcacgtgtgtctgcagcactgcctaagctggctgtacgtgctgggacagaagcgatccgacagctacgtgcttttagaacactcagttaagaaagctgtgcattttggtctgccaagggcgtttgcgggtaagacagctaataagttgatggacgccctaaaagactcggatctgctacactggaaacactccttgagcgagctgatcgatatttctattgctcagaaaaccgcaatatggcgactgtacggcagaagtactatggctctgcagcaggctcagatgctgctgtcaatgaactcgctagaggcagtgaacgccggcgtgcaacagaataacaccgaaagctttgctgtggccctctgtcacctggcagaattgcatgccgagcagggctgtttcgccgccgcgagcgaagtgctcaagcacttaaaagaacgcttccctcccaactcccagcatgcgcagctgtggatgctttgtgatcagaaaattcaattcgatagggctatgaacgacggcaagtaccacctcgccgattccctcgtgaccggaatcacagccctgaattccattgaaggcgtctatcgcaaggctgtggtgttacaggcgcaaaaccagatgagtgaggcccataagctgctccaaaagctcttagttcattgtcaaaagctgaaaaacacggagatggtcatctcagtgctgttgagcgttgcggagctgtactggcgttcaagttcgcccacaattgcattgccaatgctgctgcaagccctcgcactaagtaaagaataccgcctgcaatatttggcctccgaaacagtgctcaacttagctttcgcccaactgatcctggggataccggagcaggcacttagcctactccatatggctattgagccaatcctggctgatggggccattcttgacaaaggtcgggccatgttcctggtggccaaatgccaggtggccagcgctgcctcctatgaccaacccaaaaaggccgaggcactggaagccgccattgaaaacttgaatgaggctaaaaattattttgcaaaggtagactgtaaggagcgaatccgtgatgtggtgtacttccaggccagactctaccataccttggggaaaacccaggaaagaaaccgatgcgccatgctcttccggcagcttcatcaggagctccctagccatggggtgcctctgatcaaccacttgtag

SEQ ID NO: 108161 - DNA, 660 bp, Artificial Sequence
  Description of Artificial Sequence: Synthetic coding sequence
atgttatctccctgccttagttcttactttgtgggccttttcttaagacatatgattttagcctattcgaagctttctttctctcaggttttcaaactttacaccgctctgcagcaatactttcagaacggtgaaaagaagaccgtggaagatgctgatatggaactgaccagtcgagacgaaggggagcggaaaatggaaaaggaggaactggacgtctctgttcgggaggaggaagtcagctgctccggcccactgtcccaaaaacaggctgagttttttctcagccagcaggcctctctattaaagaatgacgaaacaaaggcacttacgcctgcctctttgcagaaggagttaaataacctgcttaagttcaacccagactttgcagaggcgcactacctatcctacctgaataatctccgagtacaggacgtcttttccagcacacacagcttgctccattactttgataggctaatcctcaccggtgctgagtcaaaaagcaatggcgaagaaggctatgggaggtccttgcgatatgccgccctgaatctagcggcactccattgcagatttggacactataccagcccaccttgggagtacagccccctgttcaatcgggaactactgttgggacgccgtcagacctcatag

SEQ ID NO: 108162 - DNA, 135 bp, Artificial Sequence
  Description of Artificial Sequence: Synthetic coding sequence
atggccgagggcgagctgaaagacatggagcagttctttgacgacctgtctgatagcttctcagggaccgaacctgaggtacataagacgtccgtagtgggactctttctgcggcatatgattcttgcgtattag

SEQ ID NO: 108163 - DNA, 1074 bp, Artificial Sequence
  Description of Artificial Sequence: Synthetic coding sequence
atggacgccctgaaggactctgacttgttgcactggaagcattctcttagcgagctgattgacatcagtattgcccaaaaaaccgcaatttggagattgtacggaaggtccaccatggccttgcagcaggcacagatgcttctgagtatgaactctctcgaggccgtgaacgctggggtgcagcagaataacacggaaagcttcgccgtggcgctgtgccacctggccgaactgcacgccgagcaaggttgcttcgccgctgcgtctgaggtgctgaagcatttgaaagaacgctttccccctaattctcagcacgcccaactgtggatgttgtgcgatcagaaaatccagtttgaccgagccatgaatgatgggaagtaccacctggctgattcccttgtgacgggcatcaccgctcttaacagcatcgaaggcgtctatcggaaagccgttgtgctccaggcccagaaccaaatgtctgaagcccataagctgctacagaagctgttggtgcactgccagaagcttaaaaatacagaaatggtgatcagcgtgctgctcagcgtggcagagctctactggagaagtagctcccccaccatcgccttacccatgctcctgcaggccctcgccctctctaaagagtaccgcttgcagtacctggcctctgaaacagtcctcaatttggcttttgcgcagctcattctgggaatcccagaacaggccctgtctcttcttcatatggccatcgaaccaattttagctgatggtgcaatactggataaaggacgcgccatgtttctggtggctaagtgtcaggtcgcatctgcagccagttatgaccagcccaagaaggcagaggctctggaagcagccattgaaaatctgaacgaagccaagaactatttcgccaaagtggattgtaaggagagaattagagacgtcgtttactttcaagcacgcctctaccacactttggggaaaacccaggagagaaaccgttgcgccatgctatttagacaactgcaccaagagctgccaagtcatggcgtacctctgattaatcacctgtag

SEQ ID NO: 108164 - DNA, 2229 bp, Artificial Sequence
  Description of Artificial Sequence: Synthetic coding sequence
atggcgtctgtccacgagtccctgtatttcaacccaatgatgactaatggggtggtgcacgcaaatgtcttcggcataaaggattgggttactccttacaagatcgccgtcctagtactgctgaacgaaatgtctcgaactggtgagggcgccgtgtccctcatggaacgccgaagactgaatcagttactacttccgctgctgcagggacccgatatcactctgtctaagctgtacaagctcatcgaggaaagctgtccacagttagctaactctgtacagatcaggatcaagttaatggctgaaggtgagctcaaggacatggagcagttctttgacgacctgtctgacagctttagcggcactgagcctgaagttcacaagacgtccgtcgtggggctgttcttgagacacatgatactggcatatagcaagctgtcgttcagtcaggtttttaagctgtacactgcattgcagcagtatttccagaacggcgagaaaaagacagtggaggacgcagacatggaactgacaagtagggacgaaggcgagcgtaagatggagaaagaggagctggacgtcagtgttagggaagaggaagtcagttgttcaggaccactttcacagaaacaggccgagttctttctgtcacagcaggcatcactgctgaagaatgatgagacgaaagccctgacccctgccagcctccaaaaggaactgaacaaccttttgaagttcaaccctgactttgcggaggcacactatctgagttacctcaataacctcagggtacaagatgtgtttagcagcacacacagcctcctgcactattttgaccgccttatcctaactggagctgaatctaaaagcaacggtgaggagggctacggacgcagcctgagatatgcagccctcaacctggccgcgctacactgccgatttgggcactaccagcaggccgagctggccctccaagaggccatccgaattgctcaggagagtaacgaccatgtgtgtttgcagcattgccttagttggttgtatgtgttgggccagaagagaagcgattcctatgtgctgttagagcattcagtgaagaaggctgtgcacttcgggctgccgagagctttcgctggtaagaccgccaacaagctcatggatgcccttaaggactccgatttgctacattggaaacactccctctctgagctgattgacatcagcattgctcaaaagaccgctatttggcgactgtacggcagatccaccatggcccttcagcaggcacagatgctgctgagtatgaattccttagaagccgtgaacgcgggagtacaacagaataatacagagtcctttgctgttgctctctgtcatctggccgaactccacgccgagcaagggtgttttgccgcagcttccgaggtgcttaaacacctgaaagaacggttcccaccaaattctcagcacgctcagctatggatgttgtgcgaccagaagatccagttcgaccgggctatgaacgacggaaaatatcacttggcagactccttggtgacaggcatcacagcattgaatagcatcgaaggggtgtaccgcaaggccgtcgtgctccaggcccaaaatcagatgtcagaagcccacaaactgcttcagaagctgctcgtgcactgtcagaaactgaagaacaccgaaatggtaatcagcgtgctgcttagcgtcgccgaactgtactggaggagctcttctcccacaatcgcactgccaatgcttctgcaggcacttgccttatctaaagagtatagattacagtacctagcctcagaaactgtactgaatctggctttcgcccagctgattctgggaatcccagaacaggctttatctctgcttcacatggccattgagcccattcttgccgatggggctatcttagacaagggacgagccatgttcctggtcgctaaatgtcaggtggcatctgctgccagctatgaccaacccaaaaaagcggaggccctcgaagccgcaatcgaaaacctcaacgaggccaagaactatttcgcaaaggtagattgcaaggagcggatccgcgacgtggtgtactttcaagctagactttaccatactctgggcaagacacaggagcgtaaccgctgtgctatgctgtttcgccagctgcatcaggagttaccgtcccacggcgtgcctctcataaatcacttatag

SEQ ID NO: 108165 - DNA, 1425 bp, Artificial Sequence
  Description of Artificial Sequence: Synthetic coding sequence
atggagctgccaagcggtcccggacctgagcggctgtttgattcgcaccgtctgccaggcgactgcttcctacttctcgttcttctgctctacgcgccagtgggattctgtttactggtactgaggctctttctcgggatacacgtcttccttgtgagttgtgccttgcccgattctgtcttgcgtcgcttcgtcgttaggactatgtgtgccgtcttagggctcgtggcgaggcaggaggacagtggcctccgggatcacagtgttcgtgtcctcatttctaaccacgtgacaccatttgatcataacatcgttaacctgttgacaacgtgcagcacggtgagcgagagcgaggcggagagcgcaaccgggaggtttcccggggcccaattaaaggcccccctttcacctctcgctttccccatggaagacacagagcttccattgaccccaattctgtatcctacatgccagttttttttcatcttcctgaacattttcctgcttgccttttcaagccctggtagccagccattactcaactccccaccttcatttgtgtgttggagccgtggcttcatggagatgaatggtcgcggcgagctggttgaaagcctgaaacgcttctgtgcttccactcgactgccccccacccccctactgttattcccggaggaggaagctacaaacggacgcgaggggcttctgagattttcctcttggccgttctctatccaggatgttgtgcaaccgcttactcttcaagtgcagcggcccctggtctctgttaccgtgtcagatgcttcatgggtctccgagctgctgtggagtctgtttgtgcccttcaccgtctatcaagttagatggctgcggcccgtgcataggcagttaggcgaggctaacgaggaattcgccttacgtgttcaacagctcgttgccaaagagttagggcagactggcacccggctgacgcccgcggacaaggccgaacatatgaaacgtcagcggcacccgcgtttgcgaccccagtccgcccagtcttctttcccccccagcccagggcctagccctgacgtgcagctggctactctggcacagagggtgaaagaagtcctccctcacgtcccgcttggggtaattcagagagacctggcaaagaccggatgcgtggacctgacgatcaccaatctactggaaggcgctgtggctttcatgcctgaagatataactaagggaactcagtctcttccgactgcgtcagcaagcaaattcccttctagtggccctgtcaccccacagcctaccgccctgaccttcgcgaagtcatcctgggctaggcaggaatccttgcaagagcgcaaacaggccttgtatgaatacgcccggcggcgttttacagaaagaagagctcaggaggccgactag

SEQ ID NO: 108166 - DNA, 1233 bp, Artificial Sequence
  Description of Artificial Sequence: Synthetic coding sequence
atggaactgccttccgggccagggccagagaggctgtttgattcacacaggctcccaggcgactgcttccttctgcttgttctcctgctgtacgctcccgttggattttgcctgcttgtcctgcgcttgtttctgggtatccatgtatttttggtctcctgtgcacttccagactccgtcttgagacgttttgttgtgcgaactatgtgcgccgtcttagggctcgttgcaaggcaggaagactccggtctgagagaccattccgtccgtgtcctcataagtaatcacgtgacaccgtttgaccacaacatcgtgaacctgctaacaacctgcagcaccccgctgcttaattcccctccatcattcgtatgctggtctcggggatttatggaaatgaacgggaggggcgaactcgttgaatcattaaagcggttttgcgcctcaacacggcttccccctacccccctgctgctgtttccggaagaggaggccaccaatgggcgggaaggtctgttacgattttcaagttggcctttctcaatccaggatgtcgtccagcccttgactctgcaggtccaaaggcctctggtaagcgtgaccgtttccgatgcaagctgggtctcggagctcctgtggtctttatttgtccccttcacagtctaccaggtccgatggctcaggcccgtccatcgacagctgggcgaagcaaacgaggaatttgccctgagagtgcagcaactggtcgcgaaggaactcggccagaccggcaccaggttgacacctgctgataaagcagaacacatgaagaggcagcggcacccccggctgcgcccccagtccgcccaatcatccttccctccctctccaggcccgtcccccgacgtccagttagcaacccttgcacagagagtgaaggaggtcctgccccacgtgccactaggggtgatccagagagacctggccaagaccggttgtgtggacttgactattacaaaccttctcgagggggctgttgcattcatgcctgaagacatcaccaagggcacgcagtccctaccaacagcctctgcttcgaagtttccctctagcggacctgtcaccccccagcctaccgcactgacgtttgccaagtcttcttgggctagacaggagtcgctgcaagagcgcaagcaggctctgtatgaatacgctcggcggcgcttcaccgagaggcgagcccaggaagcggactag

SEQ ID NO: 108167 - DNA, 1128 bp, Artificial Sequence
  Description of Artificial Sequence: Synthetic coding sequence
atggagctgcctagtgggcccggtcccgagagactgtttgactcacaccggcttcccggagactgcttcctgctgttggttctcttgttatacgcgccagttgggttctgtctgcttgtgctgcgcctctttctcggtatccacgtgttcctggtctcttgtgccctgccagatagcgtgctccgccgtttccggttcgtggtcaggacaatgtgcgccgtgctgggattagtcgcaagacaggaggatagcggactgcgtgaccattccgttcgggtcttgatctccaaccacgtgacccctttcgatcacaacatcgtcaacctgctcacaacttgctccactcctctgctgaacagccctccgtcctttgtgtgctggagcaggggcttcatggagatgaacggacgtggcgaactcgtagagagtcttaagcggttctgcgctagcacccgcctccctcctacaccacttctgctgtttccggaagaagaggcaaccaacgggagggagggactgctgaggttcagctcatggccattctccatccaggacgtcgtgcagccgttaacgttacaagtgcagagacctctggtgagcgtgactgtctctgacgcaagctgggtatcagagcttctgtggtctctgttcgtcccctttaccgtgtatcaagtgagatggttacgcccggtgcatcgacaactgggggaagccaacgaagaattcgccttacgggtacagcagctcgtcgcgaaggagctcggccagaccgggacaaggcttacacccgccgacaaggcagagcacatgaaaaggcagcgtcacccccggctcagaccacagtccgcacaaagcagctttcctccgtctccaggcccgagccccgacgttcagctggctacactggcacagagggtaaaagaggtgttaccccacgtgcctctaggggttattcaaagggatctggccaaaactggatgcgttgacttgaccatcacgaatttactggaaggcgcagtcgcctttatgccagaggatataacgaaaggcacacagtccctacctaccgcttcagcgtcaaaagcttttgacgcctgcttgatgatgatgaccccacaggctttgtag

SEQ ID NO: 108168 - DNA, 2145 bp, Artificial Sequence
  Description of Artificial Sequence: Synthetic coding sequence
atggcctcggaggccccatctccacctagaagccctcccccaccaaccagtcctgaacccgaactggctcagctccgcagaaaggtggagaagttggagagagaacttaggagctgcaaaaggcaagtgcgcgaaatcgaaaagctgctccatcacacagaacggctttaccagaacgctgaatctaataaccaagaactgcgtacccaggtagaggaactgtccaagattttgcagcgagggagaaatgaagacaacaagaagtcagatgtcgaagtgcaaaccgaaaatcacgcgccatggtccatcagcgactatttttaccagacatactataatgacgtgtcacttcctaacaaggttactgagttatccgaccaacaagaccaggctatcgagacatctattctcaattccaaagatcacctgcaggtggagaatgatgcataccctggaactgaccggaccgaaaatgtcaaatatagacaggtggatcattttgcaagcaactctcaggagcccgccagcgccctcgcaaccgaggatactagcctagagggctctagtttggccgaaagtttgagggccgcagcagaagcggccgtcagccagacgggcttttcgtacgacgagaataccgggctgtattttgaccactctacgggtttttactatgattctgagaaccagctgtactatgacccctcaacgggaatctattattattgtgatgtggagagcggcagatatcaatttcactcccgggtggacctccagccctaccccacgagtagcactaagcaatctaaggataagaaacttaagaagaaacgtaaggatccagattcttcagctactaacgaagagaaggacttgaacagcgaagatcagaaggcgttcagcgtggaacacacctcctgcaacgaggaagaaaactttgccaacatgaaaaagaaagcgaagatcggaatccaccacaaaaatagtccgcccaaggtcacagtgccgacaagtggaaatacaatcgagagcccactgcacgaaaatattagtaatagcacctctttcaaggacgagaaaataatggagacagactcagagccagaggagggggaaatcactgatagccagacagaggattcctacgatgaggctatcacatctgagggaaatgtaacggccgaggactctgaggacgaagacgaggataagatctggccaccttgtataagggttatcgtgattaggtctcctgtccttcaaattggctctttattcattatcaccgccgtcaatccggccactattgggcgagagaaagatatggaacatacattacgcatccctgaagtgggagtctccaagtttcatgccgaaatatacttcgatcacgatttgcaatcgtacgtgctggtggaccaagggtcccagaacggaaccatcgtcaatggtaagcagatcctgcagcctaagacaaaatgtgatccttatgtcttggagcacggagacgaggtcaagatcggagaaactgtgctatcattccacatccacccaggttccgacacatgtgatggctgcgaaccaggtcaggtcagggcccacctgcggctggacaaaaaggatgagtctttcgttgggccaacactgagcaaagaggagaaggagctcgagagacgaaaggaactcaagaaaatcagggtgaagtacggcctccagaacaccgagtacgaggatgagaaaactcttaagaacccgaaatataaagacagagcaggcaagcgccgggaacaggttggctccgaagggacttttcagcgagatgacgctcccgcttcagtgcacagcgagatcaccgatagtaataaaggtaggaagatgctagaaaagatgggttggaaaaagggggagggcctgggaaaggacggaggcgggatgaagacccctattcagctccagctacggcgcactcacgccggtctcgggacggggaagcctagtagcttcgaagacgtccacctattacagaataagaacaaaaaaaactgggataaagctagggaacgcttcacagaaaatttcccagaaaccaagccacagaaagacgacccaggtaccatgccttgggtgaagggaaccttggaatag

SEQ ID NO: 108169 - DNA, 531 bp, Artificial Sequence
  Description of Artificial Sequence: Synthetic coding sequence
atggctagcgaggctccctctcctccacgttctccacctccaccgacaagccctgagccagaattagcacaactgcgccgaaaagtggaaaaactcgaaagggagctgagatcatgtaagcggcaggtaagagaaattgagaagctactccaccacaccgagcgcctctaccagaacgcagaaagtaataatcaggagctgcggactcaggttgaagagctcagcaagattcttcaacgcggcaggaatgaagacaacaaaaagagtgacgtcgaagttcagaccgagaaccatgctccctggtctatctccgattacttttaccaaacatactataatgatgtgtccctccccaataaagtgaccgagctttctgatcaacaagaccaggctattgaaacttcaattcttaattccaaagatcacctgcaagtagagaatgacgcttatcccggaacagacaggacggagaacgtcaagtatagacaagtggatcattttgctagtaacagccaggtgataaaatgttag

SEQ ID NO: 108170 - DNA, 2028 bp, Artificial Sequence
  Description of Artificial Sequence: Synthetic coding sequence
atgccccgggctcaaccttcttccgcttcctaccagccagttccagctgacccatttgctatcgtgtctagagcacagcagatggtggagatactcagtgacgagaaccgaaatctgaggcaggagctggagggctgttacgagaaagtggcccgactacagaaggtcgaaacagagatccaacgggtatccgaagcctatgaaaatctggtgaagtcctctagtaaaagggaggctcttgaaaaggcaatgaggaacaaactagaaggcgagattcggagaatgcacgacttcaaccgagatttgcgggaacgcctggagactgccaataagcagctggcagagaaggaatatgagggctctgaggataccagaaagaccatttcacaactgttcgccaaaaacaaggagagccagcgtgaaaaggaaaagctagaagccgagttggctaccgctcgctcgaccaatgaagaccagcgtcgtcacatcgagatccgtgatcaggcgcttagcaacgcgcaagccaaggtggtgaaactggaggaagaactgaagaagaagcaggtgtatgtggataaggtggagaagatgcaacaggcactagtgcagctgcaggcggcctgcgagaagcgcgagcagttagagcaccgattgagaactcggctggaacgcgaactggaatccctgcggatccagcagcgacagggcaattgccaacctacgaacgtgtcagagtacaatgccgctgcactgatggagttgctgcgcgaaaaggaagagagaatcctagcgctggaggcggatatgaccaagtgggagcagaagtatttagaagaaaacgttatgcgacattttgcgctcgatgcggcggcaacagtcgctgcacaacgcgatactaccgttataagccatagtccaaatactagttacgatacagccctggaggctagaatccagaaggaggaggaagaaatcctgatggctaacaaaaggtgcctggatatggagggtcgcattaagaccctccacgcacagatcattgagaaagatgcaatgattaaggtacttcagcagcgaagtcggaaagagccctcaaagacagagcagctgtcttgcatgcggcccgctaagagcctaatgagtatttctaacgccggaagcggactcctttcccactcttctaccttaaccggatctccgattatggaagagaaacgggatgacaagagctggaagggtagtctaggaattcttctgggtggagactatcgcgccgaatacgtgccctcaaccccgtcacccgtcccaccatctacccctctgctgagcgctcattccaaaaccggctctcgcgattgttctacccaaacggagagggggaccgaaagcaacaagactgcggcagtcgctcccatttccgtgcccgccccagtggcagcagccgctactgctgcggcgatcacagctactgccgccacaataaccactaccatggtggcagccgccccagtagccgtggccgcagccgccgctcccgccgccgctgccgcaccctctcccgcaaccgccgccgccactgccgccgccgtgagccccgctgcagctggccagatccctgcagcagccagtgtcgccagtgctgcagctgttgccccgagtgcagccgcagccgcagctgtgcaagtggcaccggcagcacccgcccctgtaccagcgcccgcccttgtgcccgtaccagctccggccgcagcccaggcatccgcaccagcacaaacccaagcaccaacttcagcccccgcggtggcaccaaccccagcgccaaccccgacccccgccgtggctcaggccgaggtacctgcctccccagctacggggccagggcctcaccggctgtctatcccttcactgacttgcaatcctgataaaactgatgggccagttttccattcgaataccctggaacggaaaacacccattcagatacttggccaggagcctgatgcggaaatggtggaatacctcatttag

SEQ ID NO: 108171 - DNA, 1794 bp, Artificial Sequence
  Description of Artificial Sequence: Synthetic coding sequence
atggagcacagaggtccgccgcctgagtatccttttaaaggcatgcctccccagagcgtggtgtgcaagccccaggagcctggacacttctactctgaacaccgactaaaccagcctgggagaaccgagggacagttgatgcgctatcaacacccccctgaatacggcgccgcgcgcccagcccaagatatatccctaccgcttagcgcaagaaactctcagccccattccccaaccagcagcttgacatctggaggtagtctcccccttctacagtcacctccttccactagactgagcccagctcgccaccccttggttcctaaccagggggaccactctgctcacttgcctcgcccacagcagcactttctccctaaccaagcccatcagggggatcactaccgcctctcccagccagggctgtcccagcagcagcaacagcagcagcagcagcatcaccaccaccaccaccatcagcagcaacagcagcaacaaccacagcaacagcccggcgaagcatatagtgcgatgccgcgcgcccagccaagctccgccagttatcagcccgtgccggcagatcctttcgcgatcgttagcagggcgcaacaaatggtggaaattttgagcgacgaaaaccggaacctccgccaggagcttgaaggttgctacgagaaggtggcccggctccaaaaggtagagaccgagatccaacgtgtgtctgaggcctacgaaaatctggtaaagagcagtagcaagcgggaggcactcgagaaagcaatgcggaacaaactggaaggggaaatccgtcgcatgcatgatttcaacagggacttgcgtgagagacttgagacagctaacaaacaactggccgaaaaggaatatgagggcagcgaagatacaagaaaaacgatctctcagctgtttgccaagaacaaagagtctcaacgcgaaaaagaaaaattggaagcggaattagccactgccagaagtacaaatgaggatcagcggagacacatcgaaattcgagatcaggccttaagtaacgcgcaggcaaaggtggtgaagttagaggaggaactgaagaaaaagcaagtgtatgtggacaaagtcgagaagatgcaacaggcgctggttcagctgcaggcagcatgtgaaaagagggagcagctggagcatcggctgagaactcgcttggaaagggaactcgagagtctgcgcattcagcagaggcaaggaaactgtcagcccaccaatgtgtcagagtacaacgccgcggctcttatggaactactgagggaaaaagaggaaaggatcctggccctcgaggccgacatgaccaagtgggaacagaagtatctagaagagaatgtcatgcgtcattttgccctggacgctgctgccaccgttgctgcccaacgcgacactacagtcatctcccattctcccaacacctcctatgacacagccctggaggctcgaattcagaaggaagaggaagagatcttgatggctaacaaacgctgcttggacatggagggacgcatcaagaccttgcacgcgcagattatcgagaaggatgctatgattaaggtcctgcaacagcgaagccgaaaagagccctcaaaaacagagcagctctcctgtatgagaccggccaagtctctgatgtctatttcaaacgctgggtcaggcctgctgtcccattcctccactctgaccggctcccctatcatggaagagaagcgggacgacaagagttggaaggggtccctagggaatgactctaaatag

SEQ ID NO: 108172 - DNA, 3255 bp, Artificial Sequence
  Description of Artificial Sequence: Synthetic coding sequence
atgcgcaacagcgaggaacagccttctggaggaactactgtgctgcaacggctgctgcaggaacagctcagatacggaaatccttcagaaaaccgttctctgctggcaattcaccagcaggctaccgggaacggccccccctttccatcaggctcgggcaaccctggcccacaaagtgacgtgctaagcccacaggaccatcatcagcagttggtggctcacgctgcgcgacaagagcctcaaggtcaggagatccagagcgaaaatctgatcatggaaaagcagctgagtcctaggatgcagaataacgaggagctgcctacctacgaggaggccaaggtgcagtcccaatacttccgagggcagcagcacgcctccgttggggcggcgttctatgtgaccggcgtcactaaccagaagatgaggacagagggtagaccttcagtgcagcgcctgaaccccggtaagatgcaccaggacgagggcttacgagacctcaaacagggtcacgtccggtcactgagcgagaggttaatgcagatgtctcttgcaacaagcggcgtgaaggcacatccaccagttacatcagcaccactgagtcctccacagcctaacgacctgtataagaacccaactagctctagtgagttctacaaggcccagggacctctgccaaaccaacacagtttaaagggaatggaacacaggggccctcctccggaatacccgttcaaagggatgcctccccagtccgtggtctgtaaaccccaagagccagggcacttctattccgagcatcgactgaatcagcctgggcgaacggagggtcagcttatgcgttatcaacatcctcctgagtacggcgctgctagacccgcgcaggacatatcccttcctctctccgctcgcaacagtcagccccactcacccacctccagtctcacatccggaggctccttgcccctgctccaatctcctccttctacacggctttcccccgctcgacatcctttggtccctaaccaaggcgatcactcagcccacttgcccaggccccagcaacactttttgccgaaccaggcgcatcagggagaccattatcgtttgtctcagcccggcttaagccaacagcagcagcagcaacagcagcagcaccaccaccaccaccaccatcagcaacagcaacagcaacagccccagcagcaaccgggcgaagcctatagcgcaatgccccgcgcacagccttctagcgcctcatatcagcccgtccctgccgatccattcgctattgtttcacgggcccagcagatggtggaaatcctcagtgatgaaaatcgtaatttgcgacaagagctggaaggatgctacgaaaaagtggcacggctgcagaaagtggagaccgaaatccaacgcgtctccgaagcgtacgaaaacctggttaagagtagctctaagcgggaggcccttgagaaagctatgaggaataaactggaaggagaaatcaggcgcatgcacgacttcaacagggatctccgggagcgtctggaaaccgcaaataagcagctggccgagaaggagtacgaaggctcagaggatacccgcaagaccatttcacagttattcgctaaaaataaagaatcccagagggaaaaggagaaattggaggctgagctggcaacagccaggagtaccaatgaggatcaaagaaggcatattgaaatccgagaccaggcattatccaacgcgcaggccaaggtagtcaagttagaggaggaactgaagaagaagcaggtttacgtagataaggtagagaagatgcagcaggctttggtgcagttacaggcagcctgtgagaagcgagagcaactggagcatcgcctgaggactaggctggagcgcgagttagagagtctacggattcagcaacgacagggcaattgccagcccacaaacgtctctgaatataatgccgcagcattaatggagcttcttcgcgaaaaggaggagcgcatcctggctttggaggccgatatgactaaatgggagcaaaaatacctggaagaaaacgtgatgcggcactttgctctcgatgcggctgcgacagtggctgcccagcgggatacgaccgtcatctcccactcacccaacacctcctacgatacagcacttgaggcccgaattcaaaaagaagaagaagaaatcctgatggccaacaagcgttgcctggacatggaaggaaggataaagacactacacgcccagataattgaaaaagacgcaatgatcaaagtactgcagcagaggagcaggaaggagcctagcaagacggaacagcttagttgtatgaggcccgcgaagtctctgatgagtatctctaacgccgggagtggacttttgtcccacagctctaccctgacaggcagtccgatcatggaggagaagcgcgacgacaaatcctggaagggttcactgggcatactgctcgggggggactatagagcagagtatgttccctcaacaccgagtcccgtgcccccctccacacccctcctgagcgcgcactcaaaaacaggatcacgggattgttccactcaaactgaacgcgggacagagtcaaacaaaacagccgcagtggcacctattagtgtcccagcacccgtcgctgccgcggctactgccgcagcgattacggcaacggcagctaccatcaccacaactatggtcgctgcagcccctgtcgcagtggcagccgctgccgctcccgctgccgctgctgccccgtctcccgcgacggcagcagctactgccgccgctgtgagccccgcagccgcgggacagatacccgctgccgctagcgtggcttctgctgcagccgtcgccccatctgctgccgccgccgccgccgtacaggtggcacctgctgctccagcaccagtgccagcccccgcattggttccagtgcccgcccccgcagcggcccaggcctccgcgcctgctcagactcaggctcctacgagcgcacctgcagtggcacctacaccagctccaacaccaactcccgcagtggcacaagccgaggttcccgcctctcctgcaactggacccggtcctcatcggctgagtattccctcgctgacttgtaacccagacaagacggatgggcccgtgttccatagtaacactctcgagagaaaaactcccatccagatcctagggcaggagcctgatgcagaaatggtcgagtacttgatctag

SEQ ID NO: 108173 - DNA, 2559 bp, Artificial Sequence
  Description of Artificial Sequence: Synthetic coding sequence
atggaacatcggggacctccccccgaatacccattcaagggcatgcctcctcaaagcgtagtgtgcaaaccacaggagcctggacatttctactcagaacaccggcttaatcagcccgggcgcacagagggccagctcatgcggtatcagcaccctccagagtatggcgctgccaggccggcacaagacattagcctgccactcagcgccaggaattcccagccacactctcccacctctagtcttacttccggtgggtctctacccttgttacagtcgcctccaagcacacgcctgtctcccgcccgccatcccctggttcctaatcagggcgaccactccgcacatctgccccgacctcagcaacacttcttaccaaaccaagcccatcagggggaccactacagattgtcccaaccagggttgagccagcagcaacagcaacagcaacagcagcatcaccatcatcatcaccatcagcaacagcagcagcagcagccacagcagcagcccggcgaggcctattccgcgatgccccgtgcacagcctagtagcgccagttatcaaccagtgcccgccgacccgttcgcaatagtgtcccgggcacagcagatggtagaaattttgagcgatgagaatagaaatctgcgccaggaattggagggctgctatgaaaaggttgcacgcctgcagaaggttgaaacagagatccagagagtgagcgaagcctatgagaatctcgtgaagtcgtcctctaagcgtgaagctttggagaaggcgatgcggaacaaactggaaggggaaatccggagaatgcacgattttaaccgcgatttacgggaacgcctggagacagcaaataagcaactggctgagaaggagtatgaaggcagcgaagatacccggaagacaatctctcaattgtttgcaaaaaacaaggagtctcaaagagagaaagaaaaactggaggcagaactcgccacggcccggagtactaatgaagaccaaaggcggcacatagaaattagagaccaggctctgtcaaacgcccaggccaaagtggtcaagctggaagaagaactgaagaagaaacaggtctatgtggataaggttgagaagatgcagcaggccctggttcagctgcaggccgcatgcgagaagcgcgagcagctagaacataggctgaggactcgccttgaacgcgagctggagagcctgcgaattcagcagcgtcagggaaactgtcagcctaccaacgttagtgaatacaatgctgccgcgctcatggagttgttgagagaaaaggaagaacgaatattggcactggaggcagacatgaccaaatgggagcagaagtaccttgaagagaatgtgatgcgacatttcgctctcgacgctgcggccacagtggctgcacagcgagataccaccgtgataagccacagcccaaacacatcatatgatactgccttagaggcccgaatacagaaggaggaggaggaaattctgatggcgaacaagaggtgcctcgatatggaaggacgaattaaaactctacatgcccaaattatagaaaaggacgcaatgataaaggtgctgcagcagcgatcccggaaagagccgagcaagacagaacagctttcctgcatgaggcccgccaaaagcctgatgagcatctcaaacgcagggtccggcctactgtcccactcgtctactctgacaggctcaccaatcatggaagaaaaacgggacgacaagtcctggaaggggagtctgggtatactgcttggcggagactacagagctgagtatgtgccctcgacaccaagtcccgttcctccgagcacacccctgctgagtgcccattctaaaaccggttcacgcgactgttccacccaaactgagcgtggtactgagagtaataaaactgctgcggtggccccaatttccgtgcctgcaccagtggctgccgcagccaccgccgcggccatcacagctacggctgccactatcacaaccacgatggtggccgcggccccagtcgcggtcgctgccgccgctgcacccgccgccgcagctgctccaagtcctgccaccgctgcagctaccgccgcggcagtctcgcctgctgccgctggccagattcctgctgcagccagcgtagcaagcgccgctgccgtggccccatcggccgccgctgctgctgcggtccaggttgctccagcagctccagcccctgtgcccgctcccgctctggtcccggtgccagccccggccgcggctcaggcctccgcccctgctcagacccaggcgcccacatctgcgcctgctgttgcgcctacaccagctcctacaccaacaccagctgttgcccaggccgaggtcccagcttcacccgccacaggacccggcccccaccgactcagtattcctagccttacctgcaaccctgacaaaacggacggccccgttttccatagcaataccttagagcggaagactccaattcagattctcggccaagagccagatgcagagatggtggaatatctgatttag

SEQ ID NO: 108174 - DNA, 549 bp, Artificial Sequence
  Description of Artificial Sequence: Synthetic coding sequence
atgataaaggtcctgcagcagcggagtagaaaggaaccatccaagactgaacagttgtcctgcatgagaccagctaagagtctgatgagcatctcaaacgctgggtctgggttactgagtcattcgtctacactgaccggatctccgatcatggaagagaaacgagatgacaaatcttggaagggtagtctaggaattctgcttggcggagactatagggccgaatacgtgccttcaaccccgagccccgtacctccatctactccgcttctgagcgctcatagcaaaacaggtagcagggactgttccacccagactgagcggggtaccgaatctaacaaaacagccgctgtggcccccatctcagtgcccgctccagtcgccgcagcagctaccgcagccgccatcactgctactgcagcaaccataaccactaccatggccgctgccgccgcgccaagccctgcaacggcagctgcaaccgccgctgccgtgtcccccgctgccgccgggcaaatcccagcggccgcctctgtggcttcagcctag

SEQ ID NO: 108175 - DNA, 3255 bp, Artificial Sequence
  Description of Artificial Sequence: Synthetic coding sequence
atgagaaattctgaagagcagccgtcaggagggaccacggtgttgcagagactattgcaggagcagttgagatacgggaacccctccgagaatagaagccttctggcgatccatcagcaggccacaggaaacggcccgccgtttccctcaggctcaggtaacccggggcctcagagcgatgtgctctcccctcaggatcaccatcagcagcttgtggcacatgcagcacggcaagagccacaagggcaggaaattcagagcgaaaatctgatcatggagaagcagctgtcacccagaatgcagaacaacgaggaactgccaacgtatgaagaagccaaggtacaatctcagtatttcaggggacagcaacacgcctctgtcggtgcagcattctacgtcacaggcgtaactaaccagaagatgcggaccgagggcagaccatcagtgcagcgtcttaaccccggtaagatgcaccaggacgaaggcctgcgggatttaaaacaaggccatgtcagaagcttgagcgagagactcatgcagatgagcctggcaacaagcggtgtcaaagctcacccccccgtcacgtctgcgccattatctccaccgcaacctaacgacctttataagaacccaaccagttcatctgagttctataaggcccaggggcccctccctaaccagcactcactgaaagggatggaacaccgcggcccccctccagagtaccctttcaagggcatgccaccccagtccgttgtctgcaagccacaagagcctggtcacttctattcagagcaccgcttgaaccagccaggacgtaccgaaggccagctcatgaggtatcaacacccccctgaatacggagctgctagacccgctcaggatattagccttccactatccgccaggaactctcaaccacattcccccacctcatccctgacatccggtggttcattgcccttactgcaaagccccccctctacccgcctttcccctgcccgccacccattagtaccgaaccagggcgaccactccgcgcatttgccgagaccacagcagcacttcctgcctaaccaggctcaccaaggcgatcactatcgtctgagtcagcccggcctctctcagcagcaacagcagcaacagcagcagcatcatcaccatcatcaccaccaacaacagcagcaacaacagcctcagcagcagcccggggaggcctattcagcaatgccaagggcgcagcccagttctgcctcatatcagccggtgccagccgatccctttgcgatcgtatcacgcgcacaacaaatggtcgagatcctgtctgatgagaatcgaaatctacgacaggaactggaaggctgttatgagaaggtcgccaggctgcaaaaggtggaaacggagatacagcgtgtaagtgaggcctacgagaatctggtgaaatcctcatcaaagcgagaagccttggagaaggcgatgcgtaataagctcgagggggagatcagacgcatgcacgacttcaatagagacttacgagagaggcttgaaactgctaacaagcaactcgccgagaaagagtatgaggggtccgaagatactcgcaaaactatcagccagctgttcgccaagaacaaggaatcccagagagaaaaggaaaagctcgaggccgagctagcaacggcaaggtccaccaatgaggaccagcggagacacatcgagatccgggaccaagctctgtccaacgcacaagcaaaagtggtcaagctggaggaggagctcaaaaagaaacaggtgtacgttgacaaggtagagaaaatgcaacaggcgcttgtgcagctccaggctgcatgcgaaaaaagagaacaacttgagcaccgactccgtacacggctggagagagaattagaatccctcaggattcaacagcgccaggggaattgccagcctaccaacgtctccgagtacaatgctgccgctctgatggaattgctgagagagaaagaggagcggattttagccctcgaagccgacatgaccaagtgggagcagaagtatcttgaagaaaacgtcatgcgtcactttgcactcgatgccgcggcaactgttgctgcccagcgcgatacaactgtaatttctcactctcctaacacaagttatgacaccgcactcgaggcacggatccagaaggaggaagaggaaatactcatggcaaataaacgatgcctggatatggaaggccggatcaaaaccctgcatgcccagatcatcgaaaaagacgccatgatcaaggtactgcagcagaggtcgcgtaaagaacccagcaagactgaacagctgtcttgtatgaggcccgctaagtccctgatgtcaatctctaacgcagggtctggcctgttatctcattcgtcaacactgaccggaagccctatcatggaagaaaaacgtgatgataaatcgtggaagggttccctgggtatccttctgggaggagattatagagccgagtatgtgccttccactcccagtccagttccacctagtacaccgctgttgagcgctcattcaaagacaggttcgcgcgactgctcaacccagaccgagcgaggaacggaatccaacaaaaccgcagcagtagcccctatcagcgtccccgcccctgtcgcagctgccgcgacggcagctgcaattaccgctaccgccgcgactatcacgacgaccatggtggcggcggccccggtggccgtagccgccgccgctgcacccgctgcagctgcagccccctcacccgctaccgcagcagcgaccgctgcagcggtgtccccagcagctgcaggccagatacctgctgccgcttctgttgccagcgccgcggcagtggctccatccgccgctgccgcagccgccgtacaggttgcccctgcagccccagctccagtacctgcccccgcgctagtgcccgtccctgctccagccgctgcacaggcctctgcgcctgcccagacccaggcccctacatcagcgccggccgtcgcccccacccctgcccctacgcctactccggccgttgcccaggcagaggtgcctgcttcccctgcgaccgggccagggcctcatagactctccatcccaagcttgacctgcaatcccgataaaaccgatggacccgtctttcactccaatacactcgaacggaaaacaccaattcagattctgggccaggagccggacgccgagatggtggagtacctgatctag

SEQ ID NO: 108176 - DNA, 1512 bp, Artificial Sequence
  Description of Artificial Sequence: Synthetic coding sequence
atgctttctcagttagccatgctccagggaagcctgctgctggtggtggccacaatgagcgtcgctcagcagaccaggcaggaagctgaccgggggtgcgagacattggtagttcagcacggacactgctcgtacacatttttgcttccgaagtccgagccatgtcctcctggtcccgaagtcagcagggactctaacaccctccagcgtgagtcgctcgcaaatccgctgcacctcgggaaactgcctacgcagcaggtcaaacagctcgaacaggcccttcagaataatacacagtggcttaagaagctggaacgcgctatcaagactattcttcgttcaaaattggaacaggttcagcaacagatggcccagaaccagaccgcgcccatgctcgaactggggacgtccctcctcaatcagacaacagcgcagatccgcaagctcacagacatggaagctcagctactgaaccagacttcccggatggatgcacaaatgccagagacttttctgtcaactaataaacttgagaaccagctcctgctacagcgccaaaaattacagcagctgcagggtcagaactctgctctcgaaaagaggctccaggccctggagaccaaacaacaggaggagttggcctccatcctatcgaagaaagccaagctgctgaacaccctgtcccgtcagtccgccgcactaacaaatatcgaacgcggcctgcggggcgtaaggcacaacagcagcctgctgcaagaccagcaacatagtctgcgtcagcttctcgttttactgcgacacttggtgcaggagagggcaaacgcttctgcccctgccttcatcatggctggagaacaagttttccaggactgtgccgagatacagcgatccggcgcctcagcgtccggtgtctataccattcaagtgtcaaatgcaaccaagcctcggaaggtattctgcgacttgcagagctctgggggtaggtggactctgatacagcggcgtgaaaacggtactgtgaacttccagagaaactggaaggattataagcaaggtttcggagatcccgccggcgagcactggctcgggaatgaagtcgttcaccaattaacccgcagagccgcttactctttgagggtagaactccaggattgggagggacatgaggcatacgcacaatacgaacactttcacctaggatcagaaaatcagctgtatcgcttgagcgtcgtcgggtactcgggatcggccggaaggcagtcttcactggtgttgcaaaacacctcctttagtactttggacagcgataatgaccactgtctgtgtaaatgcgcccaagtgatgtctggtggatggtggttcgacgcctgtgggctgagtaatctaaatggtgtctactatcatgctcctgacaataagtacaaaatggatgggatcaggtggcactacttcaaagggcccagctattcccttcgcgcttcgagaatgatgattagacccctcgacatttag

SEQ ID NO: 108177 - DNA, 1233 bp, Artificial Sequence
  Description of Artificial Sequence: Synthetic coding sequence
atgctctctcagcttgccatgctgcagggctcgctgctccttgtagtggctacgatgtccgttgcccaacagacacggcaagaagccgacaggggatgcgagacactggtagtccagcatgggcattgttcatacacctttctgctgcccaaatccgagccctgtccacctggaccagaggtgtcccgcgactccaatacgctgcagagagaatctttagcaaaccccctgcacttgggaaagctgccgactcaacaagttaagcagctggaacaggctctacagaataacacacagtggctaaagaagctcgagcgcgcaattaagactatcttgagatcgaaactcgagcaagtccaacaacagatggctcaaaaccagactgcacccatgcttgagctcggaacttcccttcttaaccagacgactgctcaaataagaaagcttacagatatggaggctcaactgttgaaccagacctctcgtatggacgcccagatgccggaaacctttctatcgacaaataagctcgagaatcagctgctgctccagagacagaaactgcagcagctgcaggggcagaattctgcactcgaaaaacggctgcaagcactcgagaccaagcagcaggaggagttggctagcattttgtccaagaaggccaagttgctgaataccctgtctaggcaatccgcagcgcttacgaacatagagcgtggattgaggggcgttaggcacaactctagcctactgcaagaccaacaacactccctgcgtcagctgctggtgctgcttcggcatttagtgcaggagagggccaacgcctctgcgccagcctttattatggccggtgagcaagttttccaggattgtgcggagatccagcggtcaggcgctagcgcatccggggtgtacaccattcaggtctccaatgccacaaaaccccgcaaggtgttctgtgacctgcagagctctggagggaggtggacactgattcagaggagggagaacggcacagttaactttcaacgaaattggaaagattataagcagggatttggcgatccagctggcgaacattggctggggaatgaagtggtgcaccagctgactcgcagggcggcttatagtttacgcgttgaattgcaggactgggagggccacgaggcctacgcccagtatgagcacttccacctcgggtccgagaatcagctgtacagagtcgtggtgtag

SEQ ID NO: 108178 - DNA, 1383 bp, Artificial Sequence
  Description of Artificial Sequence: Synthetic coding sequence
atgttcacaataaagctcttgctgtttatagtgcctctggttatttccagcaggatcgatcaggacaatagtagctttgacagtctctcacccgaacctaagtcacgttttgccatgctagacgatgtaaaaattttagcaaatggcctgctgcaactgggtcatgggcttaaagacttcgtgcacaagacaaagggccagatcaatgacatattccagaagctgaatatctttgaccagagtttctatgatctgtccctgcagacttccgagattaaggaagaggagaaggagctccggcggaccacctataaactccaggtgaagaacgaggaagtgaagaatatgagtcttgagctaaatagcaaactcgagtctctgctggaggaaaagatactgttacagcagaaagtgaagtatttggaagagcagttgaccaacctgattcagaaccagcccgagacccctgagcacccagaggtaacttcgctaaaaacctttgtagaaaaacaggacaattccattaaagacctcctccagaccgtggaagaccagtacaaacaattaaaccagcagcattctcagataaaagagattgaaaatcagctgcggcgtacatcaatccaggaacccacagaaatttctcttagttctaaacccagagcacctaggacaaccccatttctccaacttaacgagatccggaacgtcaagcacgatggcatacctgccgagtgtaccacaatttataacagaggggagcacacatcaggcatgtatgctattcgacctagtaattcacaggtttttcatgtgtattgcgacgtcatctccggtagtccttggacactgatccagcacagaatcgacggctcgcagaactttaatgagacatgggagaattacaaatacggcttcggccggttggacggagaattctggcttggtctcgagaagatatatagtatagtcaaacagagtaattacgtgctgcgaatcgagctcgaggactggaaagataacaagcactacatagagtatagtttctacttggggaatcacgagacgaattatactctgcatctggtcgcaataacagggaacgtgccaaacgctatccctgagaacaaagacttggttttctccacttgggatcataaagctaaagggcacttcaattgccccgagggttacagtggcggctggtggtggcacgacgagtgcggtgagaacaacctcaacgggaaatacaacaagccgcgcgcgaagtcgaagcctgagcggaggaggggcctatcatggaaatcacagaacggtcgactatactccattaagtctactaagatgttgattcacccaacagattctgaaagcttcgagtag

SEQ ID NO: 108179 - DNA, 1167 bp, Artificial Sequence
  Description of Artificial Sequence: Synthetic coding sequence
atgatgtcaccgtcacaggccagtcttctgttcctgaatgtgtgcatattcatctgcggggaagctgttcagggtaactgtgtgcaccattctactgactcttctgtggtcaatattgtggaggacgggtccaatgcgaaggacgagtcaaaatcaaatgacaccgtttgtaaggaagactgcgaagaatcatgcgacgttaagactaagatcactcgagaagagaaacatttcatgtgcagaaatctacagaattctatcgtgagctacacgaggtctaccaagaaactgctgaggaacatgatggatgaacagcaggcttccctggactacctgtcaaatcaagtcaatgagttaatgaaccgagtgttgctgctcacaactgaggtgttcagaaagcagctggaccctttccctcaccgtcccgtccagtcccacggcttggactgtaccgacattaaagatacaatcggttcggtcaccaagacaccctcaggactttacatcatacatcccgaaggaagtagctaccccttcgaggtcatgtgcgacatggactacagagggggcggacgtaccgtaatacagaagaggatcgatggtattattgatttccaaagactgtggtgcgactacctggacggattcggggacttgcttggtgagttttggctgggtcttaaaaagattttctacattgtaaaccagaaaaacactagctttatgctttatgtcgctctggagtctgaggacgatacgctagcttatgctagttatgacaatttctggctagaagatgaaacccggttctttaagatgcatcttggccgctactcaggcaacgccggggacgccttccgtggcctgaaaaaggaagacaaccagaacgctatgccttttagcacctccgatgtggacaacgacggctgccgcccagcctgcctggtcaatggccaaagcgtcaaatcttgcagccacttgcacaataaaacaggatggtggtttaacgaatgcggcttagctaatctaaacggaattcaccacttctcaggaaagctactcgctacagggatccaatgggggacttggaccaagaataattcccccgttaaaataaaaagtgtgagcatgaaaatacgtcggatgtataacccttactttaaatag

SEQ ID NO: 108180 - DNA, 1413 bp, Artificial Sequence
  Description of Artificial Sequence: Synthetic coding sequence
atggggaaaccctggctacgcgctttgcagcttttactgctgctgggggcgtcttgggcacgggccggggcccctagatgtacgtacactttcgttctgccgccccagaagttcacaggagcagtttgttggagtggacccgcatcaacccgcgcaacacccgaggccgcgaatgcctccgagctggctgctcttaggatgcgggtggggcgccatgaggagcttcttagagagctgcagcgacttgctgcagctgacggcgcagttgccggcgaagtaagggccttaaggaaggagtcccggggtctttcagccaggctgggacagctacgcgcccaattgcagcatgaggctggaccaggagccgggcctggagctgatcttggtgctgagcccgctgccgcactggccctgctgggagagcgagtcttaaacgcctctgcagaagcacaaagggctgccgccaggtttcatcagcttgatgtgaagtttcgcgaactcgcgcagctggtgacacagcagagtagtttgatagcgaggctggagaggttgtgcccgggaggtgctggaggacagcaacaggtactgcctccaccacctcttgtaccagtcgtccccgtccgactcgttggttctacatcagatacctcgcgaatgcttgacccagcgccagaaccacagcgtgatcagacacaacgacagcaggagcctatggcatcaccaatgcccgcaggtcatcccgccgttcctacgaagccggtgggcccctggcaggattgtgctgaggcccgccaggccggccacgaacagtccggcgtctatgagttaagagtaggcagacacgtagtgtctgtgtggtgcgaacagcagcttgaagggggaggatggacggtgattcagagaagacaggatggctcagtgaatttttttacaacatggcagcactacaaagcagggttcggtcgccccgatggagaatactggttaggcttggaacccgtgtaccaactgacgtcacgcggcgaccacgagctgttggttctccttgaagactggggcgggcgcggtgctcgtgcccattatgatggtttttcactcgaaccagaatcagatcactaccggttaagactcgggcagtatcacggagacgcaggcgactctctctcctggcacaacgacaaacctttcagtaccgtggacagagaccgcgattcttatagtggaaactgtgcgctctatcagcggggaggctggtggtaccatgcctgtgcccactccaatttaaacggagtgtggcaccacggtggccattaccgcagcaggtaccaggacggtgtctactgggctgagtttcgtggcggagcttacagccttcggaaggccgcgatgctgatccggccactgaagctatag

SEQ ID NO: 108181 - DNA, 2199 bp, Artificial Sequence
  Description of Artificial Sequence: Synthetic coding sequence
atggggcaggggtgggcaacagctgggcttccttccttgctgttcctgttgctttgctacggccatcccctgctggttccttcccaagaagcctcacagcaggtgaccgtcacacacggaacctcctcacaggcaacgacatcttctcagacaactacccaccaagccaccgcacaccaaacctctgctcagtcccctaatctggtcaccgacgaggctgaggccagcaagtttgttgaggaatacgaccggacctcacaggtggtgtggaatgagtacgcagaagccaattggaattataacacaaacattactaccgaaacatccaaaatcctgttgcagaaaaatatgcagattgccaaccacaccctgaagtacgggactcaggctcgcaaattcgacgttaatcagctgcagaatacgacaatcaagagaataataaaaaaagtccaggatttggaacgagcggctctcccagcccaagagcttgaggaatataacaagattttgctggatatggaaactacctactctgtagccacagtgtgccaccccaatggatcatgcctgcagctggaacctgatctcactaatgttatggctacgtctcgcaagtatgaggacctattatgggcatgggagggctggagagataaggctggaagagctatcttgcagttttaccctaagtatgttgagctgattaatcaggcagcacggctgaacggttacgtcgatgctggtgattcctggcgttcgatgtacgaaaccccctctttagaacaggatctggagcggctgttccaggaattacagccattatatctcaatctccacgcgtacgtccggcgtgccctacacaggcattatggcgcccagcacatcaacttagaaggacctatcccggcacacttgctcggaaacatgtgggcccagacgtggtcaaacatttatgatttggtggttcccttcccaagtgcgccctccatggatacgactgaggccatgctgaaacagggctggacacctaggagaatgtttaaagaagcagatgatttcttcactagtttgggactgctacccgtaccccctgagttttggaacaagtctatgctggaaaagccaacagatgggcgggaggtagtgtgccacgccagcgcctgggacttctacaacgggaaagacttccgaataaaacagtgtaccaccgtaaacttggaggacctggttgtggcacaccatgagatgggacatattcagtactttatgcagtacaaagacctgcctgtggcactgcgggagggtgccaatcccgggtttcacgaagccattggcgacgtgttggccctcagtgtgagcaccccaaaacacctccactccttaaacttactcagttcagaaggcggctctgacgaacacgatataaatttcctgatgaagatggctctagacaaaatagctttcataccctttagctacttagtggatcagtggagatggcgggtctttgacggcagtattaccaaggagaattataaccaggaatggtggagcctcagactcaagtaccaaggactttgtcctccagtccctcgtactcagggggacttcgatccaggagctaaatttcatataccttcttccgtcccatatatccgttattttgtgtcctttattatacagttccaattccacgaggccctttgccaagctgccggccatacaggccccttgcacaaatgcgatatataccagtcaaaagaggccgggcagcggcttgctaccgcgatgaagttaggcttctctaggccctggcctgaggcaatgcagctgattacgggtcagcccaacatgagcgccagtgccatgctgagctattttaagccacttctggactggctgaggactgagaatgagcttcacggtgagaagctgggctggccacaatataattggactcctaattccgcgcgcagcgagggcccgctgccagactccggtcgcgtcagttttctgggactggacctcgatgcccagcaagcacgagtcggccagtggcttttgctgtttctcggcatcgcgctccttgttgcgaccctcgggctatcccagcggctcttttccatccgtcaccggtccctgcacagacactcccatggaccccaatttggatctgaagtggagttgcgccacagctag

SEQ ID NO: 108182 - DNA, 3921 bp, Artificial Sequence
  Description of Artificial Sequence: Synthetic coding sequence
atgggggcggccagcgggcggcgcggacccgggctcctgctgccactgccgttgcttctgctgctgcctccccaaccagcgctggccctcgacccaggcctccaacctggcaacttctctgcagatgaagctggtgctcagctcttcgctcagtcatacaactcctctgccgaacaagtgttattccagagcgtggccgcttcctgggcccacgatacaaatatcactgcggagaacgccagacggcaggaagaagcagcgctgctgtcccaagagttcgctgaagcatggggccagaaagccaaagagttatatgagccaatctggcagaactttacagacccccaattgcgcagaatcatcggcgccgtccgaacccttggctccgcaaacctgccgctagctaaaagacagcagtacaatgccctgctatcaaacatgtcccggatctactcaacagcaaaggtgtgtttgcccaataaaaccgccacctgctggtctctcgaccctgacttgactaacatccttgcgagctctcggagttatgccatgcttctgtttgcctgggagggatggcacaacgcagctggcattccactgaagccgctgtacgaagacttcaccgcactgtccaatgaggcttataagcaggacgggttcaccgacaccggggcctactggagaagctggtataattcgccaacattcgaagacgacctggaacatctgtaccaacagctggagccactctatttaaatctccacgcgttcgtccgtcgggccttacatcggaggtatggcgacaggtatataaatctgcgggggcccatcccggcgcacttgctcggggacatgtgggcacagagttgggaaaatatttacgacatggtcgtaccattccccgataagccaaacctggacgtgacaagcaccatgcttcaacaaggatggaacgccacacatatgttccgcgtcgcagaggaattctttacctccctagagctgtcacccatgcccccagagttttgggaaggctcgatgctggagaagccagccgatggcagagaggtagtctgccatgcctcagcctgggatttttacaaccggaaggacttccggatcaaacaatgtacgcgcgtgacaatggatcagctgtccaccgtacaccacgaaatgggccacatacagtattacttgcagtataaagacttgccagtgtctttgcgccgcggagcgaatcccgggttccatgaggcaatcggtgatgtcttagccctgtcagtgtcaacaccagagcatctgcataaaattggcctgttggaccgcgtgactaacgacaccgagagcgacattaattacctacttaagatggcccttgaaaagatagccttcttgccttttggatacttggtggaccagtggagatggggagtgttctccgggaggacaccccccagtcgctataacttcgactggtggtacctccgtaccaagtaccagggcatatgccccccagtgacacgcaatgagacccacttcgatgcaggagccaaattccacgttcccaatgtgaccccttatatccgctatttcgtttcttttgtactccagttccagtttcacgaggctttatgcaaggaagcaggatacgaggggcctctgcatcaatgtgatatctaccgatccaccaaggcgggagcaaagctgcgaaaagtgctgcaggcaggctcctccagaccttggcaggaagtcttaaaagacatggtggggctggacgccctggatgcacagccactcctgaagtattttcagcccgtgactcagtggctgcaggagcaaaaccagcagaacggcgaagtgctgggatggcccgaataccagtggcacccgccattgcccgataattacccagaaggcatagatctcgtgaccgacgaagcagaagcatccaaatttgtggaagaatatgatcgcacctcccaggtcgtgtggaacgagtacgccgaggccaattggaattataataccaatataaccacggagaccagtaaaatcctgctacaaaagaatatgcaaatcgctaaccacacgttgaaatacggcacacaggccaggaaattcgatgtgaatcagctgcaaaacaccaccattaaaaggattataaaaaaggtccaagacctggagcgagcagctttaccagcacaagagctggaagaatataacaagatcctgctggacatggagacaacctacagcgtcgcaaccgtgtgtcatcccaatggttcttgtctgcagctggagcctgatttgactaacgtcatggccacttcccggaagtatgaggacctcctctgggcctgggaaggatggagggataaggccggaagggctatcctgcagttctaccccaagtatgttgaactcatcaaccaagctgcaaggctcaacggatatgttgacgcaggtgactcctggcgcagcatgtatgaaacacccagcctggaacaggatctcgagcgactcttccaggagctccagcccttgtacctcaatttgcacgcttatgtgcgcagagccctgcacaggcattatggagcacagcacattaatctggagggtcctattcccgcccatctgcttggaaacatgtgggctcaaacctggtcaaacatctacgacctggtagttccttttccatctgctcctagcatggacaccacggaagctatgcttaagcagggctggacaccaagacgtatgttcaaggaggccgatgactttttcactagcttaggacttctcccagtccctccggagttctggaataaatcaatgctggaaaagccaacagacggacgagaggtcgtttgtcatgcaagtgcctgggatttttataacggcaaagacttccgtatcaaacagtgtacgactgtcaacctcgaagatctggtcgtcgcccaccacgagatgggacacattcagtactttatgcagtacaaggatctgcccgtggctctgcgggaaggagcaaatccaggcttccacgaggctatcggtgacgttctcgccctgtccgtttctaccccgaaacatttgcacagcttgaatctactgtcatcggagggcggaagtgacgagcatgacatcaattttctcatgaagatggcactcgataagatcgctttcatcccttttagctacttggtggaccaatggaggtggcgcgtgtttgatggttctattacgaaggagaactataatcaggaatggtggtcactcagacttaaataccaaggactgtgcccgcccgtcccgaggacccagggagactttgatccgggcgccaagtttcatattccctcaagcgtcccatatattagatattttgtgagcttcattattcaattccagtttcatgaggcgctgtgtcaggccgcaggccacaccggacccctgcataaatgtgacatctaccagagtaaggaagccggacaaagactggctactgcaatgaaactgggcttcagcagaccatggcccgaagctatgcaactgataaccggccagcctaatatgagtgccagcgctatgctctcctactttaagccgctgctcgactggctcagaactgagaacgagctgcacggagagaaactggggtggccccaatataattggacacctaatagcgcacggtccgaagggccccttccagacagcggacgcgtgtccttcctgggccttgaccttgatgcacagcaggcccgcgtcggtcagtggttgttgctttttctgggcatagccctgctcgtggcgactctggggctgtcccagaggcttttctccatcagacacaggtcacttcacaggcattcccatggaccccaattcgggtcagaggtcgaactaaggcacagctag

SEQ ID NO: 108183 - DNA, 2076 bp, Artificial Sequence
  Description of Artificial Sequence: Synthetic coding sequence
atgggacagggttgggctacagcaggtctaccttccctgctattcttgctgctttgctacgggcaccccttgctcgtcccaagccaggaagcctctcagcaagtcaccgtcacccatggaactagcagtcaggctacaacgtcctctcagaccaccacccaccaggccaccgctcatcagacatctgcacagagccctaacctcgtgactgatgaggcagaggcaagcaagttcgtggaagagtacgaccgaacatcccaggttgtgtggaacgagtacgccgaggctaactggaactacaacacaaatatcacgaccgaaacgtccaagattcttttgcaaaaaaatatgcagatcgcaaatcatacactaaaatacggtacacaggcgcggaagtttgatgtcaaccaactgcaaaatacaactatcaaaaggattatcaaaaaggtgcaagatttggaaagagcagcgctcccagctcaggaactggaggagtacaacaagatcttgcttgatatggaaaccacgtacagtgtggctactgtgtgtcatcccaatggcagttgtttgcagctcgaacctgacctgacgaacgttatggccacatcccgaaagtatgaggatctgctgtgggcatgggaagggtggagagataaagccggaagggctatacttcagttctacccaaaatatgtcgagctgatcaatcaggccgcacggctcaacggatatgtagatgcgggtgattcttggcgaagtatgtatgaaactccctcgctggaacaagatctcgagaggttgttccaggagctgcagcctctgtatctgaacctgcacgcgtatgtcaggagggccctccaccgccactatggcgcccagcatatcaacctcgaaggacccatccccgcgcacctgctgggcaacatgtgggcacagacctggtccaatatttacgacctggtggtgccattcccttcggcccctagcatggacacaacggaggccatgctaaaacagggctggaccccgagacggatgttcaaagaagctgatgatttcttcactagcctgggattacttccagtgcctcccgaattctggaacaagtctatgctggagaaaccaaccgatggtcgggaggtcgtctgccacgcaagtgcctgggacttttataatgggaaagacttcaggattaagcagtgtaccaccgttaatctggaggatctcgtggttgcccaccatgagatgggacatatccagtactttatgcagtataaagacttacccgtggcactccgagaaggggcaaatccaggctttcacgaggcaatcggagatgtcctggcactaagtgtctccactcctaagcacttgcacagcctgaacctgctgagtagcgaaggggggagcgatgagcacgatatcaactttctgatgaaaatggcgctggacaagattgcctttataccgttcagctacctggtagaccagtggaggtggcgcgttttcgacggttcgataaccaaggagaattataatcaggaatggtggagtctgcggttaaagtatcagggtctgtgtccaccagtgcctcgcacacagggtgacttcgaccctggcgcgaaattccacatccccagttctgtgccttatatacgcactgccatgaaactgggattttccagaccttggcctgaagcgatgcagcttattaccggccagccaaacatgtcagcgtcagcaatgctgagctattttaaacctttgctggattggctgaggaccgagaacgaattgcacggcgagaaattaggatggccccagtacaactggaccccaaacagcgctagaagtgaagggcccctaccagattccggccgcgtctctttcctcgggctggacctggatgctcaacaagcgagagttggacagtggttactgcttttcctgggcatcgcgctgttagtggccactcttggcctgtcacaaaggctgttcagcatacgtcaccggagccttcacagacactcacatggtccccagttcggatccgaagtggagcttaggcacagctag

SEQ ID NO: 108184 - DNA, 1536 bp, Artificial Sequence
  Description of Artificial Sequence: Synthetic coding sequence
atgcagattgcaaaccatacactgaaatatggtactcaggctcgcaaatttgatgtaaaccagttacagaacaccacaattaagcggattattaagaaagtgcaggacctggaacgggccgccctgccggcgcaggaactggaagagtataataagattctgctggatatggagaccacttacagtgtggcaacagtttgccaccccaatggtagttgtttgcagctggagccggacctcaccaacgtcatggctacgtcccgtaaatatgaagatctgctgtgggcttgggaaggctggagagataaggcggggagagccattttacagttttacccaaaatacgtggaactgattaatcaggccgctcggctgaacggaaatatgtgggcacagacttggtccaatatttatgatcttgtggttcccttcccttccgctccctcaatggacaccactgaagccatgctgaaacaggggtggacccctagaagaatgtttaaggaagccgatgacttctttacttccttggggctgctcccggtgcctcctgaattttggaacaagagtatgctggaaaagcccactgacggaagagaggtcgtgtgccatgctagcgcctgggacttttacaatgggaaggattttcggatcaagcagtgcaccacagtgaacttagaggatctggtggtggcccaccacgagatgggccacatacagtactttatgcagtacaaggacttaccagtcgcactgagagagggcgcaaatcccgggtttcatgaggctattggggatgtcctggcactctctgtgtccactcccaagcaccttcactccctcaacctcctgtcttccgagggcggctcagatgagcatgatatcaatttccttatgaagatggcgttagacaagatcgcattcattcccttctcctacctggtggaccagtggagatggcgcgtctttgatggcagcatcaccaaggagaactacaaccaggagtggtggtcactacgcctaaaataccaagggctgtgcccaccggtgccacgtacacaaggggacttcgatccaggggcgaagtttcacatccccagttcagtgccatacattaggacagcaatgaagttaggcttcagcaggccttggccggaagccatgcagctgatcacgggtcaaccaaatatgtcggcatccgcaatgctgtcttatttcaagcccctgcttgactggctcaggactgaaaatgaactccatggggagaagctggggtggccccagtataattggactcccaattcagctaggagtgaaggaccgctacccgatagtgggagagttagttttctcgggcttgacctggacgcacaacaggcaagggtggggcagtggctccttcttttcttaggcatcgctctgctcgtcgcaacactaggcctctctcagaggcttttttccattcgccaccgatccctgcaccggcacagccacgggcctcagtttgggtcagaggtggaactgcgccatagctag

SEQ ID NO: 108185 - DNA, 3438 bp, Artificial Sequence
  Description of Artificial Sequence: Synthetic coding sequence
atgggggctgcttctggaagaaggggacccgggctgcttcttcccctgccgctgctgctcttgctccccccacagccagctcttgccctcgaccccggcttacagccgggcaacttctccgccgatgaggcaggggctcagctcttcgcccagtcgtataattcctcagctgagcaggtcctatttcaaagcgtagccgctagctgggctcatgatacaaatatcaccgctgagaatgctcgccgacaggaggaggccgccttgctgagtcaagaatttgcagaggcctggggtcagaaggccaaggaactgtatgagccaatttggcagaacttcacagacccccagcttcggcgaattataggagcggtgcggactctgggttcggcaaatttacccctggcgaagcgccagcaatacaacgcccttttgagtaacatgagccggatctactcgaccgccaaggtttgcctccctaataagaccgctacctgctggagcctggaccctgacctgacaaacattctggcaagctctcgatcgtatgcaatgctcttattcgcgtgggaagggtggcacaacgcggcaggcattcctctgaagccattgtatgaggactttaccgccctgagtaatgaagcttacaaacaggacggcttcactgatacaggtgcctattggcgcagttggtacaactcccccacgtttgaggacgacctggagcacttatatcagcagctggagcccctgtatctcaacttgcacgcgttcgtacgccgtgcacttcaccggaggtacggggacagatacatcaatctccggggtcccatacccgcccacctgctgggagatatgtgggctcaaagttgggaaaatatatacgatatggtggtcccatttcctgataagcctaatctggatgtgacctctacgatgttgcaacaaggttggaacgccacacacatgttcagggtggccgaggagttttttacaagcttggaacttagtcctatgcctccagagttctgggaaggaagtatgttggaaaagccagcagacggtagagaagtagtctgtcatgcttctgcatgggacttttataataggaaggatttccgcatcaagcagtgtacgagagttactatggaccaactcagcaccgtccatcatgagatgggacatatacagtattatttacagtacaaagaccttccagtgtctcttcggcgtggagccaatccaggcttccacgaggcaataggcgatgtgttagccctttctgtgtctactcctgagcatttgcataaaatcggactcttggatagagtcactaatgacacagagagcgacatcaactacctgctcaagatggcactcgagaaaatagcttttctaccgttcggatacttagtggaccagtggcgttggggagtgtttagtgggaggacacccccttcccgttacaattttgattggtggtatctgcgcaccaaataccaaggaatttgcccgcctgtgaccaggaacgaaactcactttgatgccggggccaaattccacgtgccaaatgtgacaccatatattaggtatttcgtgtcctttgtgttgcagtttcagtttcacgaagccctgtgtaaggaagccggctacgaaggacctctccaccagtgtgacatctaccggagtactaaggcaggcgctaaactccgaaaagtgcttcaggctggctcttcaaggccatggcaggaagttttgaaagacatggtgggcttagacgcactggatgctcagccactattgaagtattttcagcctgtgacccagtggctgcaggaacagaatcaacaaaacggcgaagtgctgggctggccagagtaccagtggcacccaccactgccagacaattaccccgagggtatcgatcttgttaccgatgaagctgaggcctcaaaatttgtggaagaatatgatagaacgagtcaggtcgtgtggaacgagtacgccgaggcaaattggaactataatactaatataacaaccgagacatctaaaatcttgctgcaaaaaaacatgcagattgccaatcacaccctgaagtatggcacacaggccaggaagttcgatgtgaaccagctccagaacacaactatcaagcggataattaagaaggtgcaagacttagaacgggctgctctgcctgcgcaggagctggaggagtacaataagatcctcttggacatggagacgacatacagtgttgccactgtgtgccatcccaacggatcatgtctccagctggagccggatttgacgaatgtaatggccaccagtaggaaatacgaggacctgttatgggcatgggagggatggcgggacaaagctggccgcgctatcctccagttttaccccaaatacgtggagctgatcaaccaggccgccaggttgaatgggtatgtggatgccggtgactcatggcggtcaatgtacgaaacccctagccttgagcaggatctcgagaggctctttcaggagctacagcctctgtacctgaacctccacgcttacgtacgaagggcactgcataggcactatggcgcacagcatatcaacctcgaaggacctattcccgctcacctgttggggaacatgtgggcgcaaacctggagcaatatatatgatcttgtggttccattcccatcagccccatcgatggacacaaccgaggcaatgctgaagcaaggctggacacctagacgcatgtttaaggaagccgacgattttttcacgagtctgggactccttcccgttccccctgagttctggaacaagagcatgcttgaaaagcctacagacggtagggaggtggtctgccacgcatctgcctgggatttctataatggtaaagattttcgaatcaaacagtgtaccaccgtgaacctggaagatctggtagtggctcatcacgaaatgggacatatacagtacttcatgcagtataaagacctgcctgtggcactccgcgagggcgcaaaccccggattccatgaagcaatcggcgacgtgcttgctttatccgtctctactcccaagcatctccactccctgaatctcttaagctccgagggcgggagtgacgaacatgacataaactttctaatgaaaatggccctcgacaagatagctttcatccccttttcgtacctggtagatcagtggcggtggcgggtgttcgacgggagcatcacgaaggagaactacaatcaggaatggtggagtttgcgactgaagtaccagggtttatgtccacctgtgccccggactcaaggcgatttcgaccctggcgccaagttccacatcccaagcagtgtcccatatatccggtacttcgtaagcttcatcattcagttccacccattctctcagcataccgcagcttag

SEQ ID NO: 108186 - DNA, 1428 bp, Artificial Sequence
  Description of Artificial Sequence: Synthetic coding sequence
atgggggctgcctccggcagacgcgggcccggcttactgctgccattaccgctcctgctgctgctgcctccccagccagctctagctttagatccggggctccagcccggcaatttcagcgccgacgaagccggagcgcaactgttcgcccagtcttataactccagtgccgaacaagtgttgtttcagtcggtcgcagcaagctgggcacacgacaccaatattaccgcagagaatgcccgcagacaggaagaagctgccctcctatcccaggaattcgctgaggcatgggggcagaaagctaaggaactatatgagcctatttggcagaattttacagacccccaacttaggcggatcattggagctgtcaggaccctgggatcagcgaacctgccactggccaagaggcagcagtataatgcccttctgagcaatatgagtaggatttactccacagcaaaagtatgcctgccgaacaaaacagctacctgctggagcctggacccagatctgacaaacatcctggcttcctccaggagttacgcaatgcttctttttgcctgggagggttggcataacgcggccgggatccccttgaaaccactctatgaagatttcaccgcgcttagcaatgaagcgtataaacaggatggcttcactgacactggtgcttactggcgctcttggtataattctccgacttttgaggacgatctggagcacctctaccaacagttagagcccctttatctgaacctgcacgcatttgttcgccgagccctgcaccggcggtacggcgatcggtacatcaatctgagaggccctatccccgcacacctgctaggggatatgtgggcacagtcatgggaaaatatatacgacatggttgttcccttccctgataaacctaacctcgatgttaccagtactatgctgcagcagggatggaatgctacccatatgttcagagtggctgaggaattcttcacgagtctagaactgagtcccatgccccctgaattttgggagggcagtatgctggagaagccagccgacggtcgcgaggttgtgtgtcatgcatccgcttgggatttctataatcgcaaagatttccggatcaaacagtgtacgagggtgactatggaccaactgtcgaccgtacatcacgaaatgggccacatccagtattatcttcagtacaaagacctgcccgtatccctgcggcggggggctaatcctgggtttcacgaagccattggcgatgtgctggcactttcggttagtactcccgaacacctccacaagatcggattgctcgaccgtgtaaccaatgacaccgagccctctatacgtggaagcgtcctcttgctccccgaaactaaacccacactgatgcttgagctgtcctttatgtttcagatgtag

SEQ ID NO: 108187 - DNA, 1080 bp, Artificial Sequence
  Description of Artificial Sequence: Synthetic coding sequence
atgattctgaattcctctacggaagatggaataaagagaattcaagatgattgccctaaggccggacggcacaattacatctttgttatgatcccaacgctgtacagcatcattttcgtggtgggcatcttcgggaacagtttggtggtaattgttatttacttttacatgaaactgaagaccgtcgcatccgttttcctgctcaatttggccctggcggacctatgctttctcctcacccttccgctgtgggctgtctacaccgctatggagtatagatggcctttcggtaactacctgtgcaagattgcaagtgcttccgtctcttttaatctgtacgcctcggttttccttttgacctgcctttctatagacagatacctagccatcgtgcacccaatgaaatccaggctcaggcgcaccatgctggtggcaaaggttacctgtattataatctggctgctcgcgggactggcttcccttcctgctatcattcaccgcaacgtgttcttcattgagaatacaaatattacagtgtgtgccttccactacgagtcccaaaacagtactctgcccatcgggctcggcctgaccaagaacattctgggctttctttttccttttctcattatactcacctcttacacgctgatttggaaagcacttaagaaggcatatgaaatacagaagaacaaaccccgaaacgatgatattttcaagatcattatggcaattgtcctctttttttttttctcgtggataccccatcaaatttttacatttctcgacgtcctcatacagctggggatcatacgtgactgcagaatcgccgatatcgtcgacacggccatgccaataacgatctgtatcgcctactttaacaattgcctgaatcctctgttttatggcttcctgggtaaaaagtttaaacgctactttttgcaacttctgaagtacattccacccaaagccaaaagtcacagtaatctgtctactaagatgtccaccttgtcctaccggcctagtgacaacgtgagctcctcaactaagaagccagccccatgtttcgaagtggaatag

SEQ ID NO: 108188 - DNA, 1080 bp, Artificial Sequence
  Description of Artificial Sequence: Synthetic coding sequence
atgatcctcaattccagcactgaggacggtatcaaacgaattcaagatgattgtccgaaagccggcaggcacaattacatattcgtcatgattcctaccttgtactctatcatttttgtcgtggggatctttggaaactcgctggtagtgatcgtgatttatttctacatgaaactcaagaccgtcgcctccgtgttccttctgaacctagcccttgccgatttgtgtttcctgctcactctcccgctgtgggccgtctacaccgcaatggagtataggtggcctttcggtaattatctgtgcaagatcgcctccgcctcagtcagcttcaatctatatgcctctgtttttctgctgacgtgtctttctatcgataggtatctggctatagtccaccctatgaaatccagactccgccgcacaatgcttgtagctaaggtcacttgtatcattatctggctcttggctggtttggccagtctgccggctattattcaccggaatgtcttttttatcgagaatactaacatcacagtatgtgcattccattacgagtcccagaactcaaccctgccgatcggcctgggcctcacgaagaatattctaggattcttgtttccattcctgatcatacttacgtcctataccctgatttggaaggctttaaaaaaagcttacgaaatccaaaagaacaagccgcggaacgatgatatcttcaagataatcatggcgatcgtacttttcttcttcttcagctggatacctcaccagattttcacttttcttgacgttcttatccagctgggcattatccgggattgcaggatcgcggatatagtagataccgccatgcctataacaatttgtatcgcctatttcaacaattgcctgaatcccctgttctacggctttttgggaaaaaagtttaagaggtactttctgcagttattaaaatacatccctcccaaagctaagagccattctaatttatctaccaaaatgtcgacactgtcctacaggccttccgataacgtgagctcgtccacaaaaaagcctgctccgtgcttcgaggtggaatag

SEQ ID NO: 108189 - DNA, 1080 bp, Artificial Sequence
  Description of Artificial Sequence: Synthetic coding sequence
atgatcctgaatagctccactgaggacggaatcaagcgaattcaggacgactgtcccaaggcaggccgtcacaactatatttttgttatgatacccaccctgtattccattatctttgtggttggaattttcggaaattccctggtagtcatagtcatctatttctatatgaagcttaagacagttgcctctgtgtttctgcttaacttggctctggccgatctctgtttcctcctcaccctcccactgtgggccgtgtatactgccatggagtaccgctggcctttcggcaattacctgtgcaagattgcctcagccagcgtgtcatttaatctgtacgcctcggtgtttctgcttacctgcctgtccatcgatcgttacctggctattgttcacccgatgaagtccaggctgcggagaactatgttagtggccaaggtgacatgcatcatcatttggttgctggcagggttagccagtcttccagccataatccaccggaatgtctttttcatagagaatacaaatataaccgtgtgtgcatttcactacgagagccaaaactctactctgcctatcggcttgggcctgaccaagaatattttggggtttctttttccctttctgattattctgacttcatacacattgatctggaaggcgcttaaaaaggcctacgaaatccagaaaaacaaacctcggaacgacgacatttttaagatcatcatggcaatcgtgctctttttttttttctcttggatcccccaccagatatttacattcttggatgtgctaatacagctcgggataatccgcgactgccgcattgccgacatagtagacactgccatgccgattaccatctgcatcgcatacttcaataattgcctaaaccctttgttttatggcttcctggggaaaaaatttaaacggtatttcttacagttgctaaaatacattccgcccaaggcgaagtcacattctaatctgtccacaaaaatgagcaccttgtcttaccggccatcagataacgtgagttccagcaccaagaaaccagccccctgctttgaggtggagtag

SEQ ID NO: 108190 - DNA, 1080 bp, Artificial Sequence
  Description of Artificial Sequence: Synthetic coding sequence
atgattctcaattcctcaacagaggatggaataaaacgaattcaggacgattgcccgaaggcagggcgacacaactacattttcgtcatgattccaacattgtacagtatcattttcgtggttggcatctttggcaattctctggtggtaatcgtaatttatttctacatgaaactgaagaccgtggcctccgtctttctgcttaacctggcactagccgacctgtgctttttgcttacccttccattgtgggccgtctacacagccatggaatatagatggccattcgggaattacctgtgtaaaatcgcatccgctagcgtgagtttcaatctctacgctagcgtctttcttctgacgtgcctgtcaatcgacaggtacctggccatcgtacaccctatgaaatcaaggctgcgtaggactatgcttgtggctaaagtgacctgtataattatttggctgctcgctgggcttgcctctctgccagctatcatacataggaacgtattttttatcgaaaacactaatatcacggtatgcgcgttccactatgaatctcagaactccaccctcccaattgggctcgggttgactaagaatatactgggtttcctatttcccttcttgattatcctgacctcctacaccctgatttggaaggctctcaagaaagcgtatgaaattcagaaaaacaaaccaaggaacgatgatatatttaagattattatggcaatagtcttgttcttcttcttttcttggattcctcatcaaatattcacgtttctcgacgttttaatccagctcggcatcattagggattgtagaattgcggacatcgtcgacacagcaatgcccattaccatctgcattgcttatttcaacaactgtctcaatcctctgttctatgggtttctggggaagaagttcaaacgctacttcctgcaactgctgaagtatatccccccaaaagcaaaaagtcattccaatctgtccactaaaatgagtacactgtcgtaccgtcccagtgataacgtgagctctagcaccaaaaagcctgcaccttgttttgaagttgagtag

SEQ ID NO: 108191 - DNA, 1080 bp, Artificial Sequence
  Description of Artificial Sequence: Synthetic coding sequence
atgatacttaatagctcgaccgaagatggcatcaaaagaattcaggatgattgtcctaaggctgggagacataactatatcttcgtcatgataccgacgctctactccattatcttcgtggtaggcattttcggtaacagtttggtcgtcatcgtcatttacttctacatgaaactcaaaaccgtggcgtcagtcttcctgctgaacctcgcactcgccgatctgtgtttcctcctgactttgcctctgtgggctgtctatacagccatggagtacaggtggcccttcggtaactacctctgtaaaatcgcttctgcaagcgtgtcctttaacctatacgcttctgtttttctgctgacatgtctgtcaatagaccgctatttagccatcgttcatcccatgaaaagcaggttgcgcagaacgatgcttgtcgccaaggtgacttgtatcataatttggctattggccggcttggccagtctgcccgcaattattcatcggaatgttttcttcatcgaaaatacaaatatcaccgtctgtgcatttcattacgagagccagaattccacactaccaattggtctgggactgactaagaacatcctcgggtttctgtttcccttccttattatcctgacttcatatacactcatctggaaggccctgaagaaagcttacgagattcaaaaaaacaagccaaggaatgacgatatttttaaaattattatggcaattgtgttgttctttttcttcagctggattccccaccaaatctttacatttctggacgtgttgatccagttggggataatccgggattgccgaattgccgatatcgttgatacagccatgccaatcactatctgtatcgcgtatttcaacaactgtctaaaccccttgttttacgggttcctcggcaagaaattcaaaaggtacttcttgcaattattaaaatacatccctccaaaagcaaaaagtcattccaatttatctaccaaaatgtctacactctcatataggccctctgacaatgtgagcagctcaaccaagaaacctgcaccatgtttcgaagtcgagtag

SEQ ID NO: 108192 - DNA, 1080 bp, Artificial Sequence
  Description of Artificial Sequence: Synthetic coding sequence
atgatacttaactcatctacagaagacggcattaagaggatccaggatgattgccctaaggcagggcggcataactatatcttcgtcatgatcccaacactttacagcataatcttcgtggtcggtatattcgggaattcactggtggtgatcgtgatctatttctatatgaaacttaaaactgtagcctccgtgttcctcttgaacctagcgctcgccgacctatgttttctgctaacattacctctttgggcggtgtacactgcgatggaatacaggtggcctttcggaaattacctctgtaaaatagctagcgcatcggtgagctttaacctatacgcaagcgttttcctgctgacctgtctatccatcgatcgctatctggcgattgtccacccaatgaaatcccgtctgcgccgaactatgcttgtagccaaggtcacctgtattattatatggctcctggctggcctggcttctctgcctgccataattcacaggaatgtgttttttatagagaataccaacataacagtttgcgcgttccactacgagtcccagaattcaacgctgcctataggtttgggtttgactaaaaacatcctagggttcctgttcccatttttgatcatccttaccagctacacactgatatggaaggctctcaaaaaagcttacgagatccaaaagaacaagcctagaaacgatgacatctttaagatcataatggcgatcgtgctgttcttctttttctcgtggatcccccatcaaatttttaccttcctggacgttttgattcagttaggtatcattcgcgactgtcgaatcgccgacatcgtcgacaccgcaatgcccatcaccatctgtatcgcctattttaataactgtctcaacccattattttacggcttcctgggtaaaaagtttaagcgctatttcctgcagctgttaaagtatatcccccccaaggccaaatctcacagcaatttgagtactaaaatgagtacgctgtcctaccgtccttcagataatgtcagtagctctaccaagaagcctgccccttgcttcgaggttgagtag

SEQ ID NO: 108193 - DNA, 1080 bp, Artificial Sequence
  Description of Artificial Sequence: Synthetic coding sequence
atgatcctaaacagttctacagaggatggaattaaacgaatacaagacgattgccccaaggctggtcgccacaattatatctttgtaatgatcccaactctctattccatcatatttgttgtcgggatttttggcaactctttggttgtaatcgtcatctatttttatatgaaattgaagaccgtcgcctcagttttcctcttaaatttggcactagcagatctgtgctttttgctgacattacccctgtgggccgtctacactgcaatggagtaccggtggccctttggaaactacttatgcaaaatagcaagcgcttcagtctcttttaatctctatgcgtccgtgtttcttctcacttgccttagcatagacagatacctggcgatcgtgcaccctatgaagagtcgccttcggcgtaccatgttagtagctaaggtcacctgcatcataatctggcttctggccgggctggcttcactgcccgctattattcaccgaaacgtcttctttatcgagaacacaaatatcactgtgtgcgccttccactatgaaagccagaattcaactcttcctattggcttggggctaaccaaaaacatcctgggattccttttcccctttctgatcatcctcacgagctataccctgatttggaaggcactgaagaaggcctacgagatccagaagaacaaaccaagaaatgatgatatcttcaagattattatggccattgttctcttcttttttttcagctggatcccacatcagatctttaccttcctggatgtactgatccagttgggcattatccgggactgtagaattgccgatatcgtcgacacagccatgcctattaccatatgcattgcttacttcaacaactgcctgaacccgctgttttatggattccttgggaaaaaatttaaaagatatttcctccagctccttaaatatatccccccaaaagcaaaatcacatagtaacctttccaccaagatgagcaccctctcctataggccatcagataacgtgtcctcatcaacaaagaaacccgcgccttgctttgaggtggagtag

SEQ ID NO: 108194 - DNA, 1080 bp, Artificial Sequence
  Description of Artificial Sequence: Synthetic coding sequence
atgatcttgaacagctccaccgaagacggaataaaaaggatacaagatgactgccctaaagcgggtcggcataactacattttcgtgatgattccgaccttgtattccattatatttgtggtgggaatcttcggcaattccctcgtcgtaatagtgatttacttttatatgaagttaaagactgtcgcatcagtgttcctgctaaacctggcactggccgatctgtgcttccttctaacactccccctgtgggccgtgtacaccgctatggaatataggtggcccttcgggaactacttatgcaaaattgcctctgcctccgtgagctttaacttatacgccagcgtattcctgctgacatgcctgtccatcgataggtacctggcaattgtgcatcccatgaaatctcgcctcaggagaaccatgttggtcgccaaagtgacgtgtatcatcatctggctcctcgcaggtctggcctctcttcctgcaattatccacagaaatgtctttttcatagagaacaccaatatcacagtgtgtgcatttcattatgaaagtcagaacagcactcttcccataggcttggggctaactaaaaatattctcggctttctctttccttttttaattatattgacgagttacacactcatatggaaagctctgaagaaagcatatgaaatccagaaaaacaaacctcgcaatgatgatattttcaagattattatggctattgtgctcttcttttttttttcgtggattccgcaccagatctttacattcttggacgtgctgatccagttggggatcattagggattgtcgtattgcagacatcgttgacaccgccatgccaattaccatctgcatcgcttatttcaataattgtcttaaccctctgttctatggtttcttgggaaagaagttcaagaggtatttccttcaactgctgaaatacattcctcctaaggccaagtctcactcaaacctttcaaccaagatgtcaaccctttcttaccggcccagtgataatgtgagctcatctacaaagaaaccggccccctgcttcgaggttgagtag

SEQ ID NO: 108195 - DNA, 1080 bp, Artificial Sequence
  Description of Artificial Sequence: Synthetic coding sequence
atgatcttaaacagctccacagaggatgggatcaagcgaatccaggacgactgcccaaaggcaggaagacacaactacatattcgtgatgataccaacactgtactctatcatcttcgtagttggaatcttcgggaattcactagtggtgattgtgatttacttctatatgaagctcaagaccgtcgcaagcgtgttcctgctgaatcttgcgctagccgacctgtgctttcttctgaccttaccactctgggccgtctacacagcgatggaatatcgctggccattcggtaattatctttgtaagattgcgtcagcgagtgttagcttcaacctgtacgccagcgtgtttctgcttacctgtttgtctattgatcgttacttagccatagtccatccgatgaagtcaagactgcgccgaacaatgctggtggcaaaagtcacatgcatcattatatggctgctggcaggcctggctagtttacccgcaatcattcacaggaatgtctttttcatagagaacacaaatataaccgtttgtgcctttcattacgagtctcaaaacagcacattaccaataggcctgggccttacaaagaatatactgggcttcctcttcccatttttaatcattcttaccagttacacgctgatctggaaagccctgaagaaggcatatgagatccaaaaaaacaagcctcggaacgacgatatctttaagatcataatggcgatcgtcctgttcttcttttttagttggattccccaccagatcttcacattcctggatgtgttgatccagctcggtattatccgcgattgtcgaatcgcggacattgttgacaccgctatgccaatcactatctgcatcgcttacttcaataactgccttaacccgttattttatggcttcctgggcaaaaagttcaagaggtactttctccagctcctgaaatatatccctccaaaggcaaagtcacactccaaccttagcaccaagatgagcaccctcagttaccggcctagcgataacgtgtcgagttctactaaaaaacccgcaccctgctttgaagtggaatag

SEQ ID NO: 108196 - DNA, 1092 bp, Artificial Sequence
  Description of Artificial Sequence: Synthetic coding sequence
atgaaagggaacagcacgctggcaaccacgagcaagaacatcacgagcggccttcattttgggctggttaatatatccggcaacaatgaatctacactcaattgcagccaaaagccttccgacaagcacctggacgcaattccaattctttactacattatctttgtgattggctttctggtgaacatagtcgtggttactctgttttgttgtcagaaaggtccaaaaaaggtgagcagtatttacatcttcaaccttgctgtcgctgacttgttactgctggccactctgcctctatgggctacctactactcctaccgatatgactggctcttcggaccagtcatgtgtaaggtgttcggctccttcttaactttgaacatgttcgctagtattttctttatcacctgcatgagtgtggatcgataccagtccgtgatctatccctttctttcgcagagaaggaatccatggcaagcctcttacatagtccctctcgtatggtgcatggcttgtctgtctagcttgcccactttctacttccgcgatgttcggactatagagtatctcggagtgaatgcatgtattatggcctttccccctgagaaatatgcccagtggagcgcaggcattgcattgatgaagaacatcttgggctttattatcccacttatcttcatagcaacctgttattttgggatcagaaaacatctgctgaagaccaatagttacggaaagaaccgcatcaccagagatcaggtgctaaaaatggctgcagcagtagtacttgctttcattatttgttggctgcctttccacgtcttaacattccttgacgcacttgcatggatgggagtgataaactcctgcgaggtgatagctgtgatcgacctggccctgcccttcgccatattgctaggattcacgaacagttgtgtgaacccttttctctattgcttcgttggcaaccggttccaacaaaagctccgttccgtcttcagggtgcccattacctggttacaggggaaaagggagtccatgagctgccgcaaaagctcatctttgagagaaatggaaacctttgtttcatag

SEQ ID NO: 108197 - DNA, 1458 bp, Artificial Sequence
  Description of Artificial Sequence: Synthetic coding sequence
atgcgaaagcgtgcaccgcagtcagagatggctccagccggggtttctctgcgtgcaaccatactgtgcctgctggcgtgggctgggttggctgccggtgaccgcgtgtacattcatcccttccacttggtgatccataatgagtctacttgcgagcagctagctaaggcgaatgccgggaaacctaaagacccaaccttcatacccgccccaattcaggcaaagacctcgccagtggacgagaaagcattacaggaccagctggtcttagtcgcagccaagctggatactgaagataagctgagagctgctatggtgggcatgcttgccaacttccttggattccggatctatggcatgcacagtgagctttggggggtggtccacggtgctacagtgctcagtcccacagccgtcttcggaacactggccagtctgtacctcggcgctctggatcacacagctgaccggctgcaagcaattctcggggtcccctggaaggacaaaaactgtaccagcaggctcgacgcccacaaagtgctgtccgccctgcaggctgtgcagggcctgctagttgcgcagggccgtgcagatagccaagcccagttactgctgagtacggtggttggtgtctttacggcacccggactccatctgaaacagccatttgtccaaggattggcactctataccccagtggtccttcctagatcactggacttcaccgaactcgacgttgcagcagagaagatcgaccggttcatgcaggcagtaaccggctggaaaaccgggtgttccctgatgggggccagcgtggactctaccttggcgttcaacacctacgtgcacttccaggggaagatgaagggatttagcctcctggccgagccgcaggaattttgggtcgacaactctacaagcgtgtccgttcctatgctcagtggcatgggcaccttccaacactggtctgacatccaagataatttctcagtaactcaagtgccctttaccgagtccgcctgccttcttctgatccaaccccactacgcctcagatctggataaagtagaaggccttacctttcagcagaacagccttaattggatgaaaaaactgtcacctagaaccatccacctgacaatgcctcagctcgtactccagggctcatatgaccttcaggatctcctggcccaagccgagttgcccgctatcttacatacagaacttaatctgcagaaattgtctaacgataggatcagggtgggagaagttctgaattccatcttttttgaactggaggcagatgagcgggagcccactgagagcacccagcagctcaacaaacctgaagtgttggaagtgaccctaaaccgcccgtttctctttgccgtatacgaccagagcgccacggccttacacttcctcggccgagttgctaatcccctaagcactgcttag

SEQ ID NO: 108198 - DNA, 1212 bp, Artificial Sequence
  Description of Artificial Sequence: Synthetic coding sequence
atgcggaaaagagcacctcaatccgagatggccccagctggcgtctccctgcgggcaaccatcctgtgcctgctggcatgggccggattagcagcaggtgaccgggtgtatatacatccgttccacctggtcatccataatgagagcacatgcgagcagttggcaaaagccaatgctgggaagcctaaagatcctacctttatccccgctcccatccaggccaagacaagtccagttgacgaaaaggccctacaggaccaacttgtgttagtggcagcgaaactcgataccgaagataagctcagggccgcaatggttgggatgctggccaacttccttggattcaggatttacgggatgcacagcgagctgtggggtgtggttcacggagcaaccgtccttagccctacagccgttttcggaaccttggccagcctctaccttggtgccctcgaccatacagccgaccgcctgcaggcaatcttagatgtggccgccgaaaaaatcgaccggtttatgcaggccgtgacgggatggaaaacgggttgctcccttatgggagcctcagtggattctacactggccttcaacacctacgtgcacttccaagggaagatgaagggattttccctcctcgcagagcctcaggagttttgggtcgataactctacgagtgtgtcggtgccaatgctctccgggatgggcacttttcaacactggtccgacattcaggacaacttctccgtcacccaagtgccttttacggaatcagcttgtctactcctgatacagccacactatgcctcagatctcgacaaagtcgaaggtttaacctttcagcagaactctctcaattggatgaaaaaattatcaccgcgcacaatccatctgactatgcctcaacttgtgcttcagggatcctacgacctccaggacttgctggcccaggctgaattacccgctattttgcacacggagctgaacctccagaagctttccaacgatcgaatcagggtaggagaagtgctgaactcgatattcttcgagctggaggccgacgaacgcgaaccaacagaatcaacccagcaactgaacaagcccgaagttctggaggtgaccttgaatcgcccctttttgtttgccgtgtatgaccagtctgccactgctctgcactttctgggtcgggtcgccaaccccctgtctactgcctag

SEQ ID NO: 108199 - DNA, 1479 bp, Artificial Sequence
  Description of Artificial Sequence: Synthetic coding sequence
atggtaaagtttccagcactgacacactactggccattaatccgctttttagtgcccctgggtatcacaaatatcgccattgactttggggagcaggcccttaaccgcggaattgcagctgttaaagaagacgccgtcgagatgctcgcgagctatggactggcctattcattgatgaagttctttaccggcccaatgtctgatttcaaaaacgtgggccttgtattcgttaactccaaaagagaccggacgaaggctgtgctgtgcatggtcgtcgctggcgccattgctgctgtctttcatacacttatcgcctattccgacctgggatattacattatcaacaagctgcaccatgttgacgaatctgtcggctccaaaacgagaagggcattcctgtatttggctgccttccctttcatggatgctatggcatggacgcacgcaggcattctgctgaagcacaagtattccttcctggtggggtgtgcatctatatccgatgtcatagcccaagtggtctttgtggcgattctcctccactcccaccttgaatgccgtgaacctctcctgatccctattctctccttgtatatgggagccttagtgcggtgcaccacgttgtgtctcggttactataaaaatatccatgatattattccggatcgcagtggccccgaactgggcggggatgcgacaattcggaagatgctcagtttttggtggccccttgccctcatcttggctacccaacggatctctcgccctatcgttaacctgtttgtatcacgggatctgggaggcagctctgctgcaaccgaggccgtggccatcctgaccgctacctatcccgtggggcatatgccatacggatggctcaccgaaattagggcagtctacccggccttcgacaaaaacaatccaagtaataaactggtcagtacctccaataccgttacagcagctcacatcaaaaagttcacttttgtatgcatggctctatcactaactctgtgtttcgtaatgttctggacccccaatgtgagcgaaaaaattcttatcgatattatcggcgtagattttgcattcgcagagctctgtgtagtgccacttcgtatcttctccttcttcccagtacccgtcacagtcagagcccacctaacgggctggctgatgactctgaaaaagacattcgtgcttgcaccaagctcagtgttgagaatcattgttctgattgcatcactggtcgttcttccgtatttgggagtacatggtgctacgctcggcgtcggtagtctgctggcagggtttgtgggggagagcactatggtagctatcgcagcctgctacgtgtatcggaagcaaaagaagaagatggagaacgagtctgccactgagggagaagacagcgccatgactgatatgccgccaaccgaagaagtgactgatattgtggaaatgagagaggagaacgaatag

SEQ ID NO: 108200 - DNA, 885 bp, Artificial Sequence
  Description of Artificial Sequence: Synthetic coding sequence
atgggcgctctggtcaggtgcaccactttatgcctgggttactacaaaaacattcacgacatcattcccgatcgatccggcccagagctaggcggggacgcaacaatccgtaagatgctgtccttctggtggcccttggcactgattttagcaacccagcggatcagccggcctattgtgaatctatttgtctctagagatcttggcggctcctccgctgccacggaggctgtcgccatcctcacggccacataccccgtggggcatatgccctacggctggttgacggagattcgggcagtgtaccctgcctttgacaagaacaatcccagtaacaaacttgtgtctacctctaataccgttactgccgcccatattaagaaatttacattcgtctgcatggccctgagtctgactctgtgcttcgttatgttttggacgcctaacgtatccgagaaaattctgatagacattattggagtggacttcgcctttgctgagttatgcgtcgttccgctgcgtatattctctttcttccccgtcccggtgacagtgcgggcgcatctcaccggttggctcatgacactcaagaaaactttcgtcctcgccccaagcagtgtgttgagaattatagtcctgattgcatccctcgtcgtgctcccatatttgggggtccacggcgcgaccctgggtgtgggaagtctgctggcagggtttgtgggtgaatctaccatggtcgctatcgccgcttgctacgtctaccggaaacaaaagaaaaaaatggaaaacgagtcagccactgagggagaggacagcgctatgacagatatgcctcctacggaggaagttactgatatagtggagatgcgagaggagaacgagtag

SEQ ID NO: 108201 - DNA, 471 bp, Artificial Sequence
  Description of Artificial Sequence: Synthetic coding sequence
atgtggaccttcgtcacccagctcctggttacgcttgttctgctcagtttctttctggtctcatgtcagaacgtgatgcacatcgtgcggggctctttatgtttcgtgctgaaacatatccatcaggagcttgacaaagaattgggcgaaagtgaggggctttccgacgatgaagagacaatttctacacgtgtggtgcgccggagggtgtttcttaagggaaatgaatttcagaacattcctggggagcaggtgaccgaggaacagtttaccgacgagcagggcaatattgtcactaaaaagatcattaggaaggtcgttaggcaaattgatctcagctctgcagatgccgcccaggagcacgaggaagtgactgtggaaggtccactcgaggatcctagtgaattggaagttgacattgattattttatgaagcattccaaggatcatacctctacacctaatccttag

SEQ ID NO: 108202 - DNA, 5694 bp, Artificial Sequence
  Description of Artificial Sequence: Synthetic coding sequence
atggcccaggccgctaaacagctgaagaagattaaggatattgaagctcaggcacttcaagagcagaaagaaaaagaagagtcaaacaggaagcgccggaaccgcagccgcgaccgcaaaaaaaaagccgacgccgctacatcatttttacgggcggccagatcaggaaacctagataaggccctcgaccacctccgaaacggagtcgatatcaatacctgcaatcagaatggtctgaacgggcttcacctcgcttctaaagaaggacacgtgaagatggttgtggaactcttgcataaagagatcatcctggaaaccaccactaaaaaaggtaatacggcactgcacattgcggcactagcaggtcaggatgaagtggtgcgagagctcgtgaattacggggccaacgttaatgcacagagccagaaaggtttcacacccctttatatggccgcccaggagaaccatctcgaagtcgtcaagtttctgcttgagaacggagcaaatcaaaacgtggccacagaagacggattcactcctctggctgtggcgctccagcaaggtcacgagaacgtcgtcgcacatttgattaattatggaaccaaggggaaggtgcgcttgccagcccttcatattgcagctagaaacgatgataccagaaccgccgcagttctgctgcaaaacgatccgaacccagacgtcctgagcaagaccggctttacacctctgcacatcgccgctcactatgaaaacctgaatgtggcgcaactcctgctgaacaggggagcctcggtgaatttcacacctcagaacggcatcacccctttgcatatcgcttccaggaggggcaatgtgatcatggtgcggctcctcctggacagaggggcgcagattgagaccaagaccaaggatgagctcacccccttgcactgcgccgcgcggaacggacacgtgagaatcagcgagatcctgctggaccatggagcccccatccaagccaagacgaaaaatggattgtcccctattcatatggccgctcagggagatcacctcgactgcgttagactgttactgcagtacgacgctgagatcgatgacatcactttggaccacttgactcccttgcacgttgcagcccattgtggtcatcaccgggttgccaaagtgctgcttgataaaggcgccaaaccaaactcacgtgcattgaatggatttacacctcttcacatagcatgcaaaaagaaccacgtgagagttatggagctgctgttgaagaccggggctagcatcgacgcagttacagagtccggcctgaccccattacatgtggcctccttcatggggcacctgcctatcgtcaagaatctgttgcagcgtggggcgagccctaacgtgagcaatgtcaaagtcgaaacccctctccacatggccgccagagcaggccacaccgaagtcgcgaagtatttgttgcagaataaggcgaaagtgaacgccaaagctaaagatgaccagactccgttacattgcgcagcccggataggccacacaaatatggtgaaactcctcctcgagaacaacgccaatccaaatctggctacaacggcagggcacacccctcttcacatagccgcacgggaaggtcacgtagaaacggtgctcgcactgcttgaaaaagaagctagtcaggcttgcatgacaaaaaaggggtttaccccactgcatgtggccgccaaatacggtaaggtccgggtcgctgagctgctgctggagcgtgacgctcacccaaatgccgcgggaaagaatggtttgacccctcttcatgtggcagtacaccacaataatttggatattgtaaaactcctcctaccacggggaggaagtcctcattcccctgcctggaatggttatacacctctccatattgccgcgaagcaaaatcaggtggaagtggccagatccttactgcagtacggcggctctgctaacgccgagtcagttcaaggagtcacgccactacatttggccgcccaggagggacacgcagagatggtagccttgctgctgtccaagcaggctaacgggaatctggggaacaagtcaggcttaacccccttgcatctggtagcccaggagggtcacgttcctgtggcggatgtcctcataaaacatggagtgatggtggatgccacaacacggatgggttatacacccctgcacgtggcaagtcattacggcaacatcaaattggtcaagtttctgctacagcaccaggccgatgtaaacgctaagactaaactcggttactcaccgctgcaccaagcagcacaacagggtcacacagacattgtgaccctgttgctgaagaatggggcctctcccaatgaggtgagcagtgacgggactacaccccttgctatcgctaagcgcctggggtatatctccgttacagacgttctgaaagtcgtgaccgatgaaacgtcgttcgtgttggtcagtgataaacacaggatgtcttttcccgagactgtggacgagatattggacgtgtcggaggacgaaggcaccgctcatatcaccattatgggtgaggaactgatcagttttaaggccgagcgccgggactcccgggacgtggatgaagagaaagagctactcgatttcgtccctaagttggaccaagtggtggagtcgcccgctatcccaagaataccctgcgctatgccagagacagtggtcatacgtagcgaggagcaggaacaggcttccaaggagtacgatgaggattccctaatcccttccagtccagccaccgagacatcagacaacatttcgcccgtagcgagtccagtgcataccggtttcctagtgtctttcatggtggacgctagaggcggatcaatgaggggttccagacacaacggccttcgagtggtcatcccaccgcgtacttgcgctgctcccacaaggatcacttgtcgattggtgaagcctcaaaagctctcgacccccccccctttggccgaagaggaaggattggcgagcagaattatagcactgggcccaaccggagcgcagtttctgtctcccgttatcgtggaaattccacattttgccagccacgggcgtggcgaccgcgaattggtggttctgcgctccgaaaacgggagcgtctggaaggagcaccggtctagatatggggagtcttacttagaccagattctaaatggaatggacgaagaactgggcagtttggaggagttagaaaaaaaacgagtctgtagaatcatcaccaccgattttcccctctacttcgtcatcatgtctcggctttgtcaagactacgatacaataggacccgaaggcggctcgctgaaaagtaaactggtacctctcgtacaggccacctttccagagaacgctgtcacaaagcgggtgaagctcgctttgcaggcccagcctgtgcccgatgaactggtgaccaagttactgggaaatcaggctacctttagtcctatcgtaaccgtcgagccccggcgccggaaatttcatagaccaataggcctgagaattcctttgcctcctagttggaccgacaatcctcgggatagtggtgaaggagatactacatcgctccgcctgctgtgtagtgtgattggtggtaccgatcaggctcagtgggaagacatcaccggcaccactaagctcgtttacgcaaacgaatgcgccaactttactaccaatgtgagcgccagattctggttgtcagattgtccgcgcactgccgaagctgtgaactttgcaactttactgtacaaggagctgaccgcagttccgtacatggcgaaattcgtcatatttgccaagatgaatgaccctagagagggccgccttcgctgttactgtatgactgatgacaaggtcgataagacgcttgaacaacatgagaattttgtggaggttgcaaggtctcgggacattgaagtgctcgaggggatgtctctctttgctgaactttccggcaatttggtccctgtcaaaaaagcggcccagcagaggagcttccattttcagagctttcgggagaatagattggccatgcccgtgaaggtgagagacagttccagagagccgggggggagcctaagcttccttcgcaaggctatgaagtatgaagatactcagcacattctgtgccacctcaacattacaatgcctccatgtgccaaagggtctggcgcagaggatcggcggagaactccgacgccccttgccttaagatacagcatattgtcagaatccaccccaggatcattgagtggtaccgaacaagcagaaatgaagatggcagtcatcagcgagcatcttggactaagttgggctgagctcgcacgggagctgcagttttctgtggaggatattaacagaatcagagtcgaaaatcctaactcactgttagagcaatctgtggcactgctcaatctgtgggtgattagggaaggacagaacgccaacatggagaacctgtatactgccctgcagagcattgataggggagaaatcgtgaacatgttggagggaagtgggcggcagtcaaggaacttgaagcccgatcggcgccacacggacagagactacagtctgtctcccagtcagatgaacggttactcgtctctgcaggatgaactgctgtcccccgcctctctaggctgtgccctttcgagcccccttagggctgaccaatactggaatgaagtcgctgtgctagacgcgatccccctggcggccaccgagcacgacacaatgctcgaaatgtcagacatgcaggtctggtcagccggcttaacaccaagtctcgtgaccgcagaagatagcagtttagaatgtagcaaggccgaagattccgatgccactggacacgaatggaagctcgaaggagccctgagcgaagagcccaggggaccggagcttgggtctctagaattggtggaggacgacaccgttgatagcgacgctaccaacgggctgatcgatctcctggagcaggaagaaggacagcgcagcgaggaaaagctgccgggtagtaagcgccaggacgacgcaacgggggccggccaagactccgagaatgaggtttccctcgtgtccggccatcagaggggccaggctaggatcacacattctccgaccgtcagtcaagtaaccgaacgttcacaggataggctccaggactgggacgccgacggaagcatcgtttcttatctccaagatgccgcacagggctcttggcaagaagaagttacgcaaggaccccacagtttccaggggacttcaacaatgacggagggcttggaacccggtggctcacaggaatacgagaaggtccttgtctcagtatcggaacatacctggaccgaacagcccgaggctgagtcctcccaagcagaccgcgatcggaggcaacagggtcaagaggagcaggtgcaagaggccaagaacacgtttacccaggttgtacagggcaatgagttccaaaacatcccgggggagcaggtcactgaggagcagttcaccgacgagcaaggaaatatcgtgaccaagaaaatcatcagaaaggtggtgcggcagatcgacctgtcttctgcggatgcagcccaagagcatgaggaagatcacactagcaccccaaatccctag

SEQ ID NO: 108203 - DNA, 5643 bp, Artificial Sequence
  Description of Artificial Sequence: Synthetic coding sequence
atgccctattcagtaggcttcagggaggcagacgcagccacttcttttctgagggcagccaggtccggcaatctggacaaggccctcgatcatcttcgcaatggagttgacataaacacttgtaaccagaatggactgaacgggctccatctagcttctaaagaaggtcatgttaagatggtcgttgagttgcttcacaaagagatcatcctggaaaccaccactaagaaaggaaatacagccctgcacatcgctgccctcgccggacaagacgaagtcgtgcgggagctggttaactacggagccaacgttaacgcacagagccagaagggattcaccccactttacatggccgcccaggagaatcatctcgaagtggtgaagttcttgctggagaatggcgccaaccaaaatgttgccaccgaggatggatttacacctcttgctgtagccttacagcagggccacgaaaacgtggtggcccatctgatcaattacggaaccaagggtaaagttcgtcttcccgctcttcacatcgcagcaagaaacgatgacacgaggacagcagctgtgttattgcagaatgacccaaatccggacgttctttccaagactggtttcactcccctgcacatcgctgcccactatgagaacttgaatgttgcacagcttctgctcaacagaggcgcaagcgtaaacttcacgccgcagaatggcatcacccccttgcacatagcgtccaggcgcggcaatgtgatcatggtgcgcctactgctggataggggcgcacaaatcgaaactaaaaccaaggatgaactgacccccctgcactgcgccgcgcgtaatgggcacgtcaggatctccgagattctgcttgatcatggcgctcccattcaggccaagacaaagaatggactgtcccccatccacatggccgcgcaaggggaccatctcgattgtgtccggctgctccttcagtatgatgcggagatcgatgatattacactggaccatttaacccccctgcacgtggccgctcactgtggacatcaccgggtagccaaagttctgctcgacaaaggggctaagcccaattcacgtgccctcaatggctttactcctcttcatattgcttgtaagaaaaaccatgtgcgggtgatggaactgcttctcaagaccggagcttcgatcgatgccgtgaccgagtccggcctgaccccgctccacgtggcttctttcatggggcacctccctattgttaagaacctccttcagcggggtgcatcccccaacgtgagtaatgtcaaagtggaaacgcctctccacatggctgctcgagcagggcatacagaagttgctaaatatttactgcagaacaaggctaaggtcaatgccaaagcaaaagacgatcagacacctctccactgtgccgcccgaatcggccacaccaatatggtgaagctcctgctggaaaataatgctaacccaaacctcgcaactaccgcggggcatacaccactgcatatcgccgctcgggagggtcatgttgaaacagtattggcactgcttgagaaagaggcatcacaggcctgcatgaccaaaaagggcttcacaccccttcacgtcgccgccaagtatggaaaggtcagagtagctgagctcctgctcgaacgggatgcacaccctaatgccgcggggaaaaacgggctgacacctttacacgtagccgtgcatcacaataacctggatattgtcaagctcttgcttcctcgtggaggcagccctcactccccagcctggaacggttacactccattgcacattgctgctaagcaaaaccaggtggaagtggcaagatcactgctgcagtatggcggcagcgcaaacgcagagagcgtgcagggcgtgacaccactgcacctcgccgcccaggagggccacgcagagatggtggccctgctcttgtctaagcaggcgaacggaaatctcggaaacaaatctggattgactcctttgcatcttgtggcccaggagggccatgtgcctgtagccgatgttctaataaagcacggtgtgatggttgatgccaccacacgcatgggatacacacccctccacgtggcctcccattatggcaacatcaagctcgtcaagtttctgcttcagcaccaggcggacgtcaatgcgaagactaagttgggctactctccgcttcatcaagcagctcagcaggggcacactgatattgtaaccctgttactaaagaatggcgccagccctaacgaggtctcaagcgacgggactactccactcgctatcgctaaaaggttggggtatatctctgtgaccgacgtccttaaagtggtcaccgacgaaacaagtttcgtcctcgtaagcgacaagcaccggatgtctttccctgaaacagtggatgagattctggatgtgtcagaggatgaaggggaggagttaatctcgttcaaggccgaaaggcgtgactccagggatgtagacgaggagaaggaactcttggattttgtgcccaagctggaccaggtggtggagtcacccgcgatccctagaatcccgtgtgcaatgcctgagaccgtggttattcggtctgaggaacaggagcaggcgtctaaggaatatgatgaagacagcctgatcccgtcatcacctgctactgaaacatccgataacatcagtccagtcgcttcacccgtccacacagggtttcttgtcagctttatggtggatgcccggggcggtagcatgaggggttccagacataacggactacgcgtggtgatcccacctagaacatgcgctgccccaaccagaatcacctgtcgcctggtgaagccacaaaagctgtctaccccccctcctcttgctgaggaagagggtcttgccagcaggatcatagccttgggtcccacaggcgcccagttcctgtctcccgtcattgttgagatacctcatttcgcgtcccacggcaggggtgatagggaattggttgtgctccggtccgaaaacggatcagtttggaaagagcatcggtcacgttatggggaatcttatctcgaccagatccttaatggcatggacgaggagctgggttcgctggaagagttggagaagaagagagtctgtcggattataaccaccgacttcccactgtactttgtcataatgtcccggttgtgccaggattatgataccatcggaccggagggtggaagcttaaaaagcaagctggtgcctttggtccaggccactttccctgagaacgccgtcaccaagcgcgtaaagctggcactacaggcccagcctgtgcctgatgagctcgtaaccaagcttctcggaaaccaagccacatttagtcctattgtcaccgtcgagcctagaagacgcaagtttcatagaccgatcggtctgaggatcccccttcccccttcttggactgacaaccccagggacagtggtgaaggagatacgacatccttaaggctgctttgttctgtcatcggcgggacagaccaagcccaatgggaggatatcacgggtacaaccaaactggtatacgccaacgagtgtgccaatttcacaactaacgtctccgccaggttttggttatccgactgtcccaggacagcggaggctgtcaactttgctaccctgctgtataaagagctaaccgccgtgccctatatggcgaagttcgtgatttttgcaaagatgaatgaccctcgcgaaggtagactgcggtgctactgcatgacggatgacaaagtcgataaaacactggagcagcatgaaaacttcgtggaagttgccaggtccagagatatagaggtgctggaggggatgtctttgtttgctgagctcagtggtaacctagttcccgtcaaaaaggctgcccagcagaggagtttccacttccagtcttttcgtgagaaccgattggccatgcccgtcaaagtacgggatagctcccgtgaaccaggtggctcattgagtttcttgagaaaggccatgaagtatgaggatacacaacatatactatgtcatctgaacatcaccatgcctccgtgtgccaagggatctggggctgaagatcgtagaaggacaccaactccccttgccctcaggtattcgatcctcagtgagagcacaccaggcagcctgtctgggaccgagcaggcagaaatgaaaatggccgtaatcagcgagcacctcggcctttcctgggcagagttggcccgtgaactccagttttccgttgaggatataaatcgaatccgagtggagaaccccaacagcctcctggagcagtccgtggcgctgctcaatctgtgggtcatacgtgagggacagaatgcaaacatggaaaacctgtacaccgcactgcagtctatagaccgcggagagatcgtgaacatgctggaaggctcagggcgtcagtcaagaaatctgaagccagaccgcagacacaccgatagagattactcactatccccctctcagatgaacgggtattccagcctgcaagatgaactgctctctcctgcctccctagggtgtgccctatctagcccactgagagcagatcagtattggaacgaagtcgcggttcttgacgctattccccttgccgctaccgaacacgacactatgctggagatgtcagacatgcaggtatggtcagccgggctcactcccagtctcgtaacggccgaggactcatccctggaatgctctaaggctgaagattccgatgccacgggtcacgaatggaagctggagggagccctgtccgaagagcctcgtggacccgagctgggcagtctggagctagtagaagatgacaccgtggactccgatgctactaacggccttatcgacctactggagcaagaagagggccagcggtccgaagagaagctgccgggctcaaagagacaggatgatgcaacgggcgccgggcaggactcagaaaacgaggtgagcctcgtgagcgggcatcaacgaggacaggcccgaattacacactcccctactgtatctcaggtgacagaacgttctcaggaccgcttacaggattgggatgccgatgggtcaatcgtttcatatcttcaggacgccgcgcagggttcttggcaggaagaggtcactcaagggccgcacagctttcagggtacctcgacaatgacagagggtctggagcctggcggcagtcaagagtacgaaaaagtcctggttagcgtgtcagagcatacatggaccgaacagccagaagctgagtcctcccaggccgatagggatagaaggcaacaaggacaggaagagcaggtgcaggaagctaagaataccttcacgcaagtggtccaaggaaatgagttccagaatatccccggtgaacaggtcacagaggaacagttcaccgatgaacagggaaacattgtcaccaagaaaatcattcgcaaggtggttcgacagatagatctatcatcagctgatgccgcccaggaacacgaagaggtagaactacgcggctctggtctgcagccagacctgatcgagggacgcaaaggggcccagattgtgaagagagcgagtctcaaacgcggcaaacaatag

SEQ ID NO: 108204 - DNA, 468 bp, Artificial Sequence
  Description of Artificial Sequence: Synthetic coding sequence
atgtggacatttgtgacacaactgctcgtgactcttgtgctcctatctttcttcctggtctcttgtcaaaatgtcatgcacattgttaggggctctctgtgcttcgtgctgaaacatattcaccaggaactcgataaagaacttggtgaatctgagggtcttagcgacgatgaagaaacaatttccacacgagtagtcagacgtcgggtgttcttaaaaggtaatgaatttcaaaacattcccggagagcaagtaacagaggagcaattcaccgacgagcagggcaatattgttaccaagaagatcataaggaaagtagttcgacagattgacctgtcctctgcagatgcagcccaggaacacgaggaagtggagcttagaggatcaggcttgcagcctgaccttattgagggcaggaagggcgcccagatcgtgaaacgcgctagcctgaagcggggtaagcagtag

SEQ ID NO: 108205 - DNA, 5646 bp, Artificial Sequence
  Description of Artificial Sequence: Synthetic coding sequence
atgccttatagcgttggttttcgagaagcggacgcggccacttctttcctacgtgccgccaggagcgggaatctcgacaaggcactagaccacctacgcaacggcgtagatattaacacatgcaaccagaatggattgaacggtttgcacctggcaagcaaagagggacacgtgaaaatggttgtggaactcctacacaaggagatcattctcgaaactaccacaaagaagggtaacacagccctgcacattgccgctctggccggccaggacgaagttgtacgtgagctagtgaactatggcgctaatgtcaacgcccaaagccagaagggctttactccactttacatggcagctcaggagaaccacctggaagtcgtgaagtttctgttggagaatggtgctaatcagaatgttgcaactgaggacggatttactccactggccgtggcgctccagcaggggcatgagaacgtggtggcacacttgattaactacggcacgaaaggcaaggtaagactgcctgcattgcatattgccgccaggaatgacgatacccggactgctgctgtgcttctccagaacgaccccaatccggacgttttgagtaaaaccggcttcacacctctacatatcgcagcccattatgaaaatctgaacgtagctcaattgctattgaaccgcggggccagtgtcaattttaccccccagaatggcattacacccctgcatattgcctcacgaagaggaaacgttataatggttagactgttattggaccgaggtgcgcagattgagactaagaccaaagacgaacttacaccattacactgcgcagcacggaatgggcacgtgcggatatctgagattctgcttgatcacggcgctcctatccaggcaaagacgaagaatggcctgtctcctatccatatggccgcacagggcgatcacctcgattgtgtgcggctgctgttgcaatacgatgccgagatcgacgacattacacttgaccatctcacacctctgcacgtagccgcgcactgtggccaccatcgggttgctaaggttctgttagacaagggagcaaagcctaactcccgcgccttaaacggctttaccccactccatattgcatgtaaaaaaaatcacgtacgcgtcatggaactgctgcttaagaccggcgcctccattgacgctgtgaccgagtcagggctgacaccccttcatgtggcgagttttatggggcacctgcctattgtaaagaacttgctccaacggggggcgagcccaaacgtatcaaatgtgaaggtggagactcctctgcatatggctgcccgggctggacatacggaggtggctaaatatctgctccagaacaaggccaaggtgaatgctaaggccaaagatgaccagacacctctccactgcgctgcccgcattgggcacacaaatatggtaaaactgcttctggagaacaatgcaaatccaaatttggccactacagcaggtcacacccctctacatatcgcagccagggagggccacgtcgaaaccgtgttagccctgctcgagaaggaggcctctcaggcctgcatgaccaagaaagggttcactccactgcatgttgctgcaaaatacggaaaagtgagagtggctgagcttctccttgagcgcgacgctcacccgaatgcagcagggaaaaacggcctaactccgttgcatgtggccgtgcaccacaacaaccttgatatcgtgaaattgctactgcctcggggtgggagcccacactcacctgcatggaacggatataccccccttcacatcgccgcgaaacagaaccaagtcgaggttgctcgatctcttcttcagtatggcggatccgccaacgctgagtccgtgcagggcgtgaccccattgcatctggctgcccaggagggccacgccgagatggttgctctgttgttaagtaaacaggctaatggcaacctgggaaataagtccggcctgacacccctgcaccttgttgcacaggaagggcatgtacccgtggccgacgtcctgataaagcatggcgtcatggtcgacgccacgacacgaatgggctatacaccattgcatgtggcgagccattacggtaatatcaagctcgtcaagttcctgttgcagcaccaggcagatgtcaatgctaaaacaaaactggggtacagcccactgcaccaggcagcacaacaaggacacacagacattgttacgctcttactaaagaacggtgcgtctcccaacgaagtaagcagcgacgggacaacccccttagctattgcgaaaaggctcggctatatctctgtcactgacgtgttgaaagtggtcacggacgagacctcatttgtactggtgagcgacaagcaccgcatgtcctttcccgaaacagtggatgagatacttgatgtctccgaggacgagggtgaggagctgattagtttcaaagccgagaggcgcgatagcagagatgtcgatgaagagaaagaattgctagattttgttcccaagttggatcaagttgttgagagtcccgccatcccgagaatcccttgcgctatgccggaaaccgttgtaataaggtctgaggaacaagagcaggcttctaaagagtacgacgaagactctctgattccttcttcccctgctaccgagacttccgacaacatatccccagttgctagtccagtccataccggctttttggtcagctttatggttgacgccagaggcggctctatgagaggtagcaggcacaatggactgagagtcgttatccccccgcggacttgtgccgcccccacgcgaatcacctgccgcctggtgaaacctcagaaactgtcaactccaccacccctcgctgaagaagaaggattggcctcacgcatcattgctctgggccccaccggagctcaattcctctccccggttatcgtggaaattcctcacttcgcttcacatggtagaggtgacagagagcttgtagtgctgcggtccgaaaacggatcggtttggaaagaacacagatcgagatacggagaatcttacttagatcaaatcctgaacggcatggacgaggaattgggctctctcgaggagttagagaaaaaaagagtgtgtcggatcattaccactgattttccattgtactttgtcattatgagccgcctctgtcaagactatgacacaattggtcccgaaggtggctcactcaagtctaaattggtccctttagttcaggccacgtttcccgaaaacgccgttacgaagagggttaaattggccctccaggcccagcccgtgcccgacgaactggttacaaaattgttaggaaaccaggcaaccttctcgcctatagtgactgtggaaccccgtcggaggaagtttcatagaccaatcggattgaggatcccactgcctccgagctggactgacaatccgagggactccggcgagggagatacaacatcattgcgcctgttatgcagcgtcatcggcggaaccgatcaggcccaatgggaagacatcacgggcacaacaaagctggtttacgccaacgaatgtgcgaacttcacaaccaatgtttcagccagattctggttgtctgattgcccccgaactgccgaggctgtcaactttgctacactgctgtacaaggagctgacggcagtgccttacatggctaaatttgtgatattcgccaaaatgaacgaccctagggagggtaggctgcgatgctactgtatgactgacgataaggtggacaagactttggagcagcatgagaattttgtcgaagtagcacggtcacgcgatatcgaagtcctcgaaggaatgtccctgttcgccgagctctctggcaatctagtaccggtaaagaaggctgcacagcagcggtctttccactttcaaagttttcgtgaaaaccgactcgctatgccagttaaggtgcgggactccagccgggagccgggcgggagtctgtcttttctccggaaggctatgaaatatgaagatacccagcacattttgtgccacttgaatattaccatgccgccttgcgccaaggggtcaggcgccgaagaccgcagacggactcccacgccactggccctgcggtactccatcctctcagaaagtacgcccggttccctgagcggcaccgagcaggccgaaatgaagatggccgtaatctctgaacacctggggctcagctgggccgagctggcacgggagttacagttttccgttgaagatatcaacagaatccgagttgaaaaccctaattctttgctggaacagtccgttgcattgctgaatctgtgggtcattcgggagggtcagaacgccaatatggaaaatctttacacagcgttgcagagcatcgacagaggcgaaatcgtgaacatgctggagggcagcgggcggcaatccaggaaccttaaacctgacaggaggcacactgatcgcgattatagtctgagcccttcccagatgaacggttattcatctcttcaagacgaactgctgtctcctgccagcttgggatgtgcccttagcagcccgttacgcgccgaccagtactggaacgaggtggccgtgctcgacgccataccactcgccgcaaccgagcatgatactatgcttgagatgtccgacatgcaggtctggtctgcgggactgactccgtctttggttacagcagaagattctagccttgagtgcagcaaggctgaggactcggacgcgaccggtcatgagtggaaactggagggagcactgagtgaggaacctcgaggacccgagctgggaagtctggagctggtcgaggacgataccgtggatagcgatgccactaacggccttattgacttactcgagcaggaggagggacagcgaagcgaggaaaagttacctggctctaaacgacaggacgatgccacgggagcgggtcaggacagcgagaacgaggtgtcactcgtgtccggacatcaacgaggccaggctcgtatcacacattcccccacagtcagccaggtcacagagcgatcacaggaccggctgcaggactgggacgctgacggatcaatcgtttcctatctacaggacgctgcccagggttcttggcaagaagaagtcacacagggaccccatagctttcaaggtacaagcacaatgacagaaggactagagccaggcggctcccaggaatacgaaaaggtcttggtttctgtctcggaacacacatggaccgaacagcctgaagcagaatcttcacaggcggatcgcgaccgcaggcagcagggtcaggaggagcaggtgcaggaggcaaaaaacaccttcacccaagtggtgcaggggaacgaattccagaacatccccggtgaacaagtcacagaagagcagttcaccgacgagcagggaaacattgtaacaaagaaaattatccgtaaagtggtgagacagatcgatctgtcatccgccgacgccgctcaggaacacgaagaggtgacagttgagggtccattggaggatccatcagagctggaagttgacatcgattattttatgaaacacagcaaggaccacaccagcaccccgaatccttag

SEQ ID NO: 108206 - DNA, 330 bp, Artificial Sequence
  Description of Artificial Sequence: Synthetic coding sequence
atgtggacatttgtaactcagctgctggtgaccctggttctactgtcattctttctggtatcctgccagaacgtaatgcacattgtgaggggtagtctgtgctttgtattgaagcacatccaccaggagctagacaaggagctcggggaatctgagggtctttccgacgatgaggaaacgattagcaccagagtggtgcgtcggagagtgttcctgaaaggcaacgaattccagaacatcccaggcgagcaggtcactgaggagcaattcaccgacgaacagggcaatatcgtgacaaaaaaagaccacacatccacccccaacccttag

SEQ ID NO: 108207 - DNA, 5577 bp, Artificial Sequence
  Description of Artificial Sequence: Synthetic coding sequence
atgccatactcggttggattccgcgaggctgacgccgctactagctttctgagagcggcccgcagtgggaacttggataaagccttggaccatttgcggaatggcgtagacatcaacacttgcaatcagaacgggctgaacggactgcatctggctagtaaggagggacatgtcaagatggtcgtggaactcctacacaaagagatcatccttgaaactacgacgaagaagggaaataccgctcttcatatagctgcgctggcaggacaggacgaagtggtcagggagttggtcaactacggagccaacgtgaatgcacagtcccaaaagggcttcactccactgtatatggcagcccaggagaatcatcttgaggttgtgaaattcctactcgaaaacggagcaaaccaaaatgtggccactgaggacggttttactccactcgctgttgcactccagcagggccatgagaacgtggttgcccacctgatcaattacggcacgaaaggcaaggtccggctgccagccttgcacatcgccgccagaaatgacgacacgcggacagcggcggtattgctccagaatgatccaaacccagatgttctatccaagacaggcttcaccccactgcacattgccgcacactatgaaaacctaaacgttgctcagctgttgctcaaccggggagctagtgtgaatttcacaccacaaaacggaattactcccctgcacatcgctagccggagaggcaacgtgataatggttagactactgttggatcggggagctcagatagagacaaagaccaaagatgagctgacacctctgcactgtgcagctagaaacggacatgttagaatttcagagattctgctggatcatggagctcccattcaggctaaaactaagaacgggctgtcaccaattcacatggctgcccagggggatcatttagattgcgtgcgtctcctcttgcagtacgacgcggagatagacgacataacactggatcacctgacccccctgcacgtggccgcccattgcggccaccatcgagtcgccaaggttttgttggataagggagcaaagcctaacagcagagctctcaacggattcacaccactccacatcgcctgtaagaaaaaccacgttagggtgatggaactgctcctgaaaactggagccagtatagatgctgtcaccgaatcggggctgactccactccacgttgcctcatttatgggccatctccctatcgttaaaaacctgctgcagagaggggcttccccaaacgtctccaatgttaaagtggagacgcccttacacatggctgctagggccggacatactgaagtggccaagtacctgctccaaaataaagctaaagtcaatgcgaaagctaaagatgaccagacacctctccattgtgcggctaggatagggcatacaaacatggttaaattactcctggagaacaatgccaatcctaacctggctacgaccgccggccataccccacttcacattgccgcccgtgagggccatgtggagactgttctggccctgttggagaaggaagcctcacaggcatgtatgaccaaaaagggttttacgcccctgcatgtggcagcaaagtacggaaaagtccgggtggctgagttgctattggagcgtgacgctcatccgaacgccgcgggaaagaatgggctcacacctctccatgtggcggtgcaccacaacaatttggacattgtgaaactgctcctcccccgaggtggctctccacacagcccggcttggaatgggtatacgcctctacacatagctgcaaagcagaatcaggtggaggtggcccgttcactactgcagtatggaggctctgccaacgccgaatctgttcaaggagttacacctctgcatctcgccgcacaggaaggccatgccgagatggtcgccttgctgctgtccaaacaagcaaatggaaacctgggcaataaaagcggactgaccccacttcaccttgtggcacaagaaggacatgtgcccgtcgctgacgttctgattaaacatggcgttatggtggatgcaacaacgagaatgggatataccccattacacgttgcatctcattatggcaatattaaacttgtgaaatttttgctgcagcaccaggcagatgtgaatgccaagaccaagttaggctattctcccttgcatcaggcagcacagcagggacataccgatatcgtgaccttgctacttaaaaacggagccagcccgaatgaggtctctagcgacgggaccaccccactggctatcgcaaagaggctgggctacatctccgtcacagatgtgctgaaggtcgtaaccgacgaaacatcgttcgtactggtcagtgataagcatcggatgtccttccccgaaaccgtcgacgagatcttagacgtaagtgaggatgagggcgaagagctgataagtttcaaggctgaaagaagagatagcagagatgtagacgaggaaaaagagctcttggacttcgtccctaagctagatcaggtggtggaaagccctgcaattccaagaatcccatgtgccatgcccgaaaccgttgtgattcggtcagaggaacaggagcaggcctcgaaagaatacgatgaggatagtttgattccatcgagccccgctaccgaaacaagtgataacatatcccctgtggctagccccgtgcacacagggttcctggtgagcttcatggtggatgcaaggggcggcagtatgaggggctctaggcataacggactgcgcgtcgtcatacccccccggacctgcgcggcgcccacacgtattacctgtaggctggtaaagcctcagaaactgtcaactcctccccctttggctgaagaagaagggctggcatcacgcataatagcccttggccctacgggagcacagtttttatctcccgtgatagtagaaattccacactttgcaagtcacgggcggggcgacagagagttggtggtgttaagatccgaaaatgggtctgtgtggaaggagcaccggtctcggtatggggagagctatctggatcagatattgaacggcatggacgaggaactgggtagtctcgaggagctggagaaaaaacgggtgtgtcgcatcattacaacggatttcccactatattttgtgatcatgagcagattatgtcaggattatgacaccatcggccctgagggtggatctcttaaatccaagctggtcccactcgtccaagccactttcccagagaacgccgtcacgaaacgggtgaagcttgccctgcaggcacaacccgtgcctgacgaactggtcactaagctgcttgggaaccaggccacgttctcccccattgtcactgtggagcctcggcggcgcaagttccataggccaatcgggctcaggattccacttcccccgtcttggaccgataatcctcgggacagtggggaaggtgatactaccagcctgcgactgttgtgcagcgtcattggaggtactgatcaggctcagtgggaagacataacagggacaaccaaattagtttatgcaaatgagtgtgctaatttcactactaatgtgtccgcaaggttttggctgagcgactgcccgcgcactgctgaagcagtgaacttcgcaactctcctttataaggaattaaccgcagtcccttatatggccaagtttgtcatttttgctaagatgaacgatccgcgcgaagggcgcttgcggtgctactgtatgactgatgataaggtggacaaaaccctggagcaacatgaaaactttgtggaggtggcacggtctagagacatcgaggttctggagggcatgagcctctttgctgagctgtccgggaaccttgtgccagtgaaaaaggctgcccaacagcgctcctttcacttccagtccttccgggagaatcgactggccatgcctgtaaaggtaagagatagctcgcgtgagccagggggttctctgtccttccttcggaaagccatgaagtatgaagatacacaacacattctgtgtcatctgaatattactatgccaccttgcgccaaaggatccggagccgaagaccgccggaggacccctacacctctggcactgaggtattccatcctgagtgagagcaccccggggagccttagcggtactgagcaggccgaaatgaagatggccgtgatcagcgagcacctgggcctgagctgggccgaactggcgcgtgagctgcagtttagcgttgaggacatcaaccgtatccgggtggaaaatcctaatagcctcctggagcaaagtgtggcgttgctgaatctgtgggttattcgagaaggtcaaaacgccaacatggagaatctttacactgctcttcagtctatcgacaggggagaaatcgtcaacatgctcgaagggtccggacgccagtcacggaacctcaaacccgaccggagacatactgacagagattactcgctatcaccgagccaaatgaacgggtactcctcactccaagatgaactgctatcacctgcgagcctagggtgtgctctctccagccctcttcgagctgatcaatactggaacgaagtggctgtgctggatgctatccctttggctgccactgagcacgatacaatgctggagatgagtgacatgcaggtctggtctgctggattaacaccaagcctggtcactgccgaggattccagccttgagtgctccaaagccgaagattctgacgccaccgggcatgagtggaagcttgaaggcgcactgtccgaagaacctagaggcccagaattggggtctctggaacttgtcgaagacgacaccgtagacagcgatgcgaccaatggattaatcgacctcctcgagcaggaggaggggcaaagatcagaagaaaagctgcccgggagcaagaggcaggacgatgccacaggcgccgggcaggattccgaaaatgaggtttctttggtcagcggacatcagagaggccaggctcggattacgcacagcccaacagtttcacaggtgacggagcgatcccaggaccggctgcaggactgggacgctgatgggtcaatcgtgtcctacctccaggatgctgcccaaggctcatggcaagaagaagttacacagggcccccattccttccaggggactagcaccatgacagaaggccttgagccagggggaagccaggaatacgaaaaagtcctggtgtccgtgagtgaacacacctggaccgagcaacctgaggcagagtcatcccaagccgatcgcgaccggagacagcagggccaagaagagcaggtgcaggaggctaagaatacgtttacccaggtcgtgcagggaaacgaatttcaaaacatccccggagagcaggttacagaagaacaattcactgacgagcagggaaacatcgttacaaaaaaggttgaacttcggggtagcggattacagcctgatctgatagagggtcgcaaaggagcacagatagtcaaaagggcatcactcaaacgcgggaagcagtag

SEQ ID NO: 108208 - DNA, 4560 bp, Artificial Sequence
  Description of Artificial Sequence: Synthetic coding sequence
atgccttactctgttggctttagggaggccgacgccgcgacttccttcctgagagctgcgaggtccggaaacctcgacaaggccctggaccatctgagaaacggcgtagatattaacacctgcaaccagaacggtctgaacggactgcacctcgccagtaaggaaggccacgttaaaatggtggtggagctgcttcataaggagatcatcctggagacaacaactaaaaagggtaatactgccttgcacatcgccgcacttgccggacaggacgaggtagtccgcgagctggtgaactacggcgctaacgtcaatgcacagagtcagaaggggttcacacccctctatatggcggcccaggaaaaccacctggaagtggtgaagttcctgctcgagaacggcgcaaaccagaacgtcgctacagaggatggctttacacctctggccgtcgccttgcaacagggccacgagaatgtagttgctcaccttattaactacgggacaaagggcaaagtgcggcttcctgcccttcatattgcagcccggaacgatgacacaaggacggcagccgtcctcctgcagaatgaccccaacccggatgtgctgagcaaaactggatttactcccctccatattgccgcgcattacgaaaatctcaatgtggctcagctgttgttaaatcgtggcgcaagcgttaacttcacaccgcagaacggaattacccccctgcacatagccagtagacggggcaacgtgatcatggtgaggcttttgttagatcgtggggcccagattgagacaaaaaccaaagatgaattgacacccctgcattgtgcggcccggaatggccacgtgaggatcagcgagattctgctggatcacggcgcacccattcaggccaaaaccaaaaacgggttgagccccatccacatggctgcgcaaggggaccatctagattgtgttaggctcctactgcaatacgatgcagagattgatgacatcactttggaccatttaaccccgttgcatgttgccgcacattgtggtcaccacagggttgccaaggtcctgctggataaaggagcaaaaccaaactctcgcgctctgaacggatttacgcctcttcatatcgcctgtaagaagaaccatgtcagagttatggagctcctcctcaagaccggcgctagcatcgatgcagttactgagagcggtctcactcccttacacgttgcaagctttatgggccatctgccaattgtcaaaaacctgctgcagcgcggtgcatccccaaacgtaagcaatgtgaaggtcgagactcccttgcacatggctgcccgcgcaggtcacactgaagttgcaaaatatctgttgcaaaacaaagccaaggtcaacgcgaaggcaaaagacgatcagacccccctccactgtgccgctaggattggacacacaaatatggtgaagctgctattggagaacaatgcaaacccaaatcttgctacgacagccggccatacgccgcttcacatagccgctagagaaggccacgtcgaaactgttctagccttgctggagaaggaagcatcacaggcatgcatgacgaaaaagggattcacacctctacacgttgcagcaaaatacgggaaggtgagagtcgccgagctactcttggagagggacgcgcaccccaatgccgccgggaagaatggtctgaccccactgcacgtggccgtacaccacaacaaccttgacatagtcaagctgcttctcccgcggggaggttcacctcatagccctgcctggaacggctatacaccattgcacatagcggcgaaacagaatcaggtggaggtagcacggtcgctcctgcagtatggaggctcagccaacgctgaatctgtccagggggtgactccgttgcatctggccgcgcaagaggggcatgccgagatggtcgctcttctgctctctaagcaagctaatggtaacctaggcaacaaatccgggttgactcccctgcatctggtggcacaggagggccacgtccccgtggcagacgtcctgatcaaacatggggtgatggtcgacgcgaccacacgcatgggctatacccctctccatgtcgcttcacattatggtaatattaagctcgtaaaatttctgctgcagcaccaggccgacgtaaacgccaagacgaagctggggtacagccccctgcaccaggccgcccagcaagggcacaccgatatagtgacccttttactgaaaaacggagcttcacccaatgaagtatcaagcgatggaactacccctctggccatagccaaaagattggggtatattagtgtcacagatgtacttaaagttgtaacagacgagacgtccttcgtccttgtgagtgacaagcatcgcatgtcctttccagaaacagtggacgaaattttagatgtatcggaggacgagggagaggagctcatctcgttcaaagcagagcgcagggactctagggatgtggacgaagaaaaggagcttctggatttcgtcccaaagctcgaccaagtggtggaatctccagcaatcccgcgaattccctgtgctatgcctgaaactgtggtaatccgctcagaggagcaggagcaggctagcaaggaatacgatgaggatagtctcattccctctagtccagctacagagacctccgacaatatcagccccgttgcgtcccctgtccatacaggttttttagtttctttcatggtggacgcccggggtgggtctatgcgtgggtcaaggcataacgggcttcgcgtggttataccccccagaacctgcgctgcccccaccagaatcacctgcagacttgttaaaccacagaagctgagcacacccccaccccttgccgaagaagagggtctcgcctctaggatcattgctctcggaccaacaggagcccaattcttatcccctgtcattgttgagattccccactttgcttctcacgggaggggggatcgcgagcttgtggtgttaagatcagaaaatggtagtgtgtggaaagaacacaggagccgttacggagagtcctatctggaccaaatcctaaatgggatggacgaggaactcggaagtctggaagagctcgaaaagaagagagtgtgcagaattattacaacagattttcctctgtactttgtgattatgtccaggctttgccaagattacgacaccattggtcccgagggcggatccttgaaatccaaactggtgccgttagtgcaagctacattcccagagaacgcagtcactaagagggtgaagctggccttacaagctcagcccgtacccgacgaattggttactaagttgctcggtaaccaggcgacgttctcacccatcgtcaccgtggagcctagacgacgtaagtttcatcggccaattgggctgaggatccctctgcccccctcatggaccgataaccccagagacagcggggagggcgatactacatcactacgcttgctgtgcagcgtaatagggggtactgatcaggcccaatgggaggatataaccggcacaacgaaactggtctacgccaacgagtgtgctaacttcaccacaaatgtgagcgcgcgtttctggctgagcgattgcccgagaacagcagaggcagtaaacttcgctactctcctgtacaaagaactgacagctgtgccctacatggcaaagttcgtgatcttcgctaaaatgaacgatccccgggaggggcgacttcgctgctattgcatgaccgatgataaagtcgataaaacactggaacagcatgagaactttgtagaggtagcaagaagtcgggatatcgaggtgctcgagggcatgtctctcttcgctgagttaagtgggaacctcgtgccggtcaaaaaagccgcccagcagcgctcattccactttcaatcctttcgcgaaaatcgcctggcaatgcctgtcaaagtcagggactcctcaagagaacctggtggtagcctatcctttctgagaaaggcaatgaagtacgaagatacgcagcatatactctgccacctgaacatcacaatgcccccttgcgctaagggttcaggagcagaagataggcggaggaccccaacgcctctggctttgcgctactccattctgagcgagtccacccccggatcactgtctggaaccgaacaggctgaaatgaagatggctgtgatttcagagcacctgggattgtcctgggctgaactggcacgagaactacagttctccgtggaagatattaaccggatcagagttgagaaccccaattctctcctagagcagtcggtcgctcttctgaacctctgggtgatcagggagggccagaatgctaatatggaaaatctttacactgccctgcagagcatcgatcggggcgaaatcgtgaatatgctggaaggcagtggacggcaaagccggaaccttaagccagaccgtagacacacagaccgcgattattccctgagtcccagtcagatgaatgggatttccacgaacaacccttag

SEQ ID NO: 108209 - DNA, 5505 bp, Artificial Sequence
  Description of Artificial Sequence: Synthetic coding sequence
atgccatactcagtgggattcagggaggccgatgctgccacgtcgtttctgcgagcagctcggagtggaaacttggataaggccttagaccatctgcgcaacggcgttgatattaacacctgtaatcagaatgggcttaacgggttacatcttgctagtaaagaaggacacgttaaaatggtcgtggaactgctgcataaggagattatactggaaacaaccactaagaaggggaataccgcgctgcacattgctgccctcgcaggccaagatgaggtagtgagggagttagtcaattacggtgctaatgtcaacgctcagagccaaaaaggattcacaccactatacatggccgctcaggaaaaccacctggaggtggtcaagtttctgctggaaaacggagccaatcagaatgtggctacggaagacggctttacgccccttgccgttgccttgcaacaaggccacgaaaacgttgtggcccatctgattaactacggcactaagggaaaagtgcggctgcctgcgctccacatcgccgccagaaacgatgacaccagaacagccgccgtcctgctacagaacgatcctaatcctgatgtgctgtccaagaccggatttacccctttgcatatcgccgcccactatgaaaatctgaacgtagcccagttgttattgaacagaggtgcctccgttaacttcacccctcagaacggcataacccccctccacatagcaagccgtcgaggcaacgtgattatggtgagactgcttctcgacagaggtgcccagatcgagactaaaacgaaggacgaactgacccccctgcattgcgctgcacgaaatggacacgtgaggatttctgaaatcctcctagatcatggagccccaatccaggccaagacaaagaatggcctaagtcctatccacatggctgctcagggggaccacttggactgcgtgaggcttctgctgcaatatgatgcagagattgatgacattacccttgatcacctaacacccctgcacgtggctgcccattgtgggcaccatcgtgtggccaaggttctgctcgataagggcgctaagccaaactctcgggcactgaacggcttcacaccccttcatattgcttgcaaaaagaatcacgtgagggtcatggaactgttgctgaaaacgggggcttcaatcgatgcggtgactgagtctggtctgactccactgcatgtagccagctttatgggtcacctgcccattgtgaaaaacctcttgcagcggggggcctccccaaacgtctctaatgtgaaggtagagacgccattacatatggccgcacgggccgggcacaccgaagtagccaagtatctccttcaaaacaaggccaaggtgaatgctaaggctaaagatgatcaaactcccctgcattgcgccgctagaatcggacatacgaatatggtgaagttgctgcttgaaaataacgctaatcccaatctggcaactacagccgggcacaccccactgcatatcgcagctcgggaaggccatgttgagaccgtcttagcccttctggaaaaagaagctagccaggcatgtatgactaaaaagggctttaccccgcttcacgttgccgcgaagtatggaaaggttagagttgcggagctgcttctggaaagagacgctcatcccaacgctgcagggaagaacgggctcactccccttcatgtggccgttcatcataataacctcgatattgttaaattgcttctgcccaggggtggcagtccacactctcctgcatggaatggatacacaccacttcacattgccgcaaagcagaaccaggtcgaagtggccagatctcttcttcagtatggtggctctgctaatgctgagtccgtccagggggtcactccactgcacctcgccgcacaggaggggcatgccgaaatggttgctttactcttaagtaaacaggctaatggtaacctgggtaacaaaagcggcctaacccctctgcaccttgtggctcaagagggacacgtgccggttgccgatgtgctgatcaagcatggcgtgatggtggatgctaccacccggatgggctatacccccctgcacgtcgcttctcactatggcaacattaaactggtcaaatttctgttgcagcatcaggccgatgtaaacgcaaaaacaaagctgggctatagtcctttgcaccaagctgcacagcagggccatactgatatcgtgacgctacttttaaaaaatggagctagtcccaacgaggtctcttcagatggtaccacacccctcgcaattgctaaacgactcggctatatttccgtcaccgatgtgctaaaggtggtgacggacgagacaagttttgtcttagtgtccgacaaacaccgaatgtccttcccagagaccgtggatgaaatcctggacgtgagcgaggacgaaggcgaggagctgatatccttcaaggctgagaggcgggatagtagggatgttgacgaggagaaggagttgctggactttgttcctaaactagaccaggtcgtggagtcccctgcaatacctaggatcccatgcgccatgccagaaaccgtggtgatacgcagcgaggaacaagagcaggcgagcaaagaatacgatgaggactcactgataccctcttcacccgcaaccgagacttcagacaacatcagccctgtcgctagccccgtgcatacaggttttctggtgtcatttatggtggacgcccgcgggggaagcatgagagggagtcgtcacaatgggttgcgcgttgtcatcccaccacggacatgtgccgcacctactcggatcacttgtcgtttggtgaaaccacaaaaattgtctacacctccacccctggcagaagaggaaggactggcgagtcgcattatcgccttgggcccaacaggtgcccagttcctgagcccggtgatcgtagagatcccccacttcgcctctcacgggagaggcgacagggaactagtggtgcttagaagcgaaaatgggtctgtgtggaaggagcataggtctcgatacggcgaaagctaccttgatcagattctgaatggcatggatgaagagctaggaagtctagaggagcttgaaaagaaacgcgtatgcaggattattacaaccgacttccccctctattttgtaatcatgagccggctttgtcaggattatgatactataggccccgaaggcgggtctctcaagagtaagctggtgcccctcgtccaggccacgtttccggagaacgcagttacgaaacgtgtgaagcttgctttacaagctcaaccagtgccagacgaattagtcacaaagctgctcggtaatcaagcaaccttcagccctatagtgactgtagagccacgccgtcgcaagttccatcgccctattggactccgtatccctcttccccccagctggactgacaaccctagggacagcggcgaaggcgatactacatccctcaggttactgtgtagcgtgattggtgggactgatcaggctcagtgggaggatataaccggcaccacaaagctggtgtatgcgaacgaatgcgccaacttcaccacaaacgtctctgcccgattttggctgagtgactgcccccgcaccgctgaggccgtcaatttcgctactctgctgtataaggagttgactgccgtgccctacatggctaagtttgtgatctttgccaaaatgaacgaccctcgggaaggcagacttagatgctactgtatgaccgacgacaaggtggataaaaccttggagcaacacgaaaactttgtagaagtggcgcgatctcgtgatatcgaggtcttggaaggcatgagcttattcgctgagttatccggcaacttggtccctgtcaagaaggccgcccagcagagatcatttcatttccagtcctttagagagaacaggctcgccatgcctgtcaaggtgagagactcctctcgtgagccgggggggagcctgtcttttctgcgaaaggccatgaaatatgaggatacgcagcacattctctgtcacctcaatattacaatgcccccatgcgccaagggctccggagcagaagataggagacgaaccccaaccccactagccctcagatatagcattcttagcgaaagcactcctggtagtctttccggcacagagcaggccgagatgaaaatggccgtgatcagcgaacacctgggcctgtcctgggcggagctcgccagggagctccagttctccgtcgaggacattaaccggatacgggttgagaaccctaactcgctccttgagcagagtgtcgcgctgctgaatttgtgggtgatccgggaagggcagaatgccaatatggaaaatttgtacaccgcactgcagagcattgaccggggtgaaatcgtgaatatgctggagggtagtggacggcaatcacgaaacttaaagcctgatcgtcggcatacagatcgcgattatagtttatctcctagccagatgaacggatacagcagtctccaggacgagcttctttccccagcaagtcttggctgcgcacttagttccccgctgcgggctgatcaatactggaatgaggttgccgttttggacgcaattcctctcgccgcaactgaacacgatactatgctggagatgagtgatatgcaagtgtggagcgcaggcctaactccatcactcgtcacagcagaggatagctccctggagtgttccaaggccgaagattcagacgccaccggtcatgagtggaagctggagggggcactatccgaagaaccgcgggggcccgagcttggcagtctggaactcgtggaggacgatacagtggacagcgatgccactaacgggctcatagatctcttggagcaggaggagggacaacggtccgaggagaagctgcccggctcaaagagacaagatgacgcaacaggggccggacaggatagcgagaatgaagtgagccttgtgtctgggcaccagagaggccaagcccggattacccacagtcctacagtgagccaagttactgagagatctcaggatcggctgcaagactgggacgccgacggctccattgtatcctacctgcaagatgccgcccagggaagttggcaggaggaggtgacacaaggaccacacagcttccagggtactagcaccatgaccgagggactggaacccggaggctcacaggaatacgagaaggtgctcgtgtccgtgagtgaacatacgtggaccgagcaacccgaggccgaaagcagtcaggcagaccgggatcgtcggcaacagggccaagaggagcaggtgcaggaggcaaaaaataccttcacccaggtagtgcagggcaatgagttccagaatatccctggagagcaggtcaccgaggaacagtttactgatgaacagggaaacatcgtcaccaagaaggaccacactagtactcccaacccttag

SEQ ID NO: 108210 - DNA, 5718 bp, Artificial Sequence
  Description of Artificial Sequence: Synthetic coding sequence
atgccctattccgtcgggtttagagaagctgatgcagcgacttcttttctccgggccgctaggtctgggaacttggacaaagccctggaccacctaagaaatggagtcgatattaacacgtgcaatcagaacgggctcaacgggcttcacctagcttctaaggagggtcatgtgaagatggtggtggagctactgcataaagagatcattctggagacgaccacgaaaaaggggaatacagccctgcacatcgctgctctggcaggtcaggacgaggtagtgagagagctcgttaattatggcgctaacgtgaatgcccaatcgcagaaaggcttcactcccctctacatggccgcacaggaaaaccacttggaagtggtaaaattcttacttgaaaatggtgcaaaccagaatgtggccactgaagacggcttcacacctctggcggtggcgctgcagcaggggcacgagaatgtggtggcgcatctcataaattatgggactaagggtaaggtcaggttgccagcactccacatcgcggcacgcaatgacgatactaggaccgccgctgtcctcttgcagaatgaccctaaccccgacgtcctttccaaaacaggcttcacccccttgcatatcgccgcgcactacgagaacctcaacgtcgcacagctgctcttaaatcggggtgcttcggtgaacttcaccccccagaatggcatcaccccactgcatatcgcttcccggaggggaaacgtgataatggtgcgactgttgctggaccgtggagcccagatcgaaaccaagacaaaagacgagctgacccctctccactgcgccgcgcgaaatggccacgtcaggatctctgagatacttctggaccatggcgccccaatccaggctaaaactaagaatgggctgagtcccatccatatggccgctcagggggaccatctcgattgtgtcaggttgttgttacagtatgatgccgaaattgatgatataaccttggatcacctcacacctctccatgtggctgctcactgcggtcaccacagggttgctaaagttctcctggacaagggggctaaaccaaactcaagagctctcaacggttttactcccctgcacatcgcctgcaagaagaatcacgtccgcgtgatggaactgctactcaaaacaggcgcttccatcgatgctgtgacagagtccggactgacacccctgcacgtcgccagtttcatgggtcacctgcctatcgtgaaaaacctgctccagaggggtgcttctccgaatgtttcaaatgtgaaagtcgagaccccattacacatggccgctagggcaggtcataccgaggtggccaagtacctcctgcaaaacaaggctaaggttaacgctaaggctaaagatgatcagacacccctgcattgcgctgcacgaattggacacacgaacatggtgaaactccttttggaaaacaacgccaaccctaatttggccacaactgccgggcacactccgcttcatatagctgcccgggaaggtcacgtcgagactgtgctggcccttttggagaaggaggccagtcaggcgtgtatgacaaaaaaggggtttacccctcttcatgtcgccgctaaatatggcaaagtccgggtggccgaattactgctcgagcgggacgcccatcctaacgccgccggtaagaatggtctgacaccgcttcatgtggctgtgcatcataacaatcttgacatcgtaaagctcctcctgcccagaggcggatcacctcacagtcctgcctggaacggttacacccccttacacatagctgccaagcagaatcaggttgaagtggcccggtcccttctccagtatggcggctcagctaacgccgagtccgttcagggggtgacacctcttcacctggccgcccaggaggggcatgcggagatggtggctctcctactttcgaaacaagctaacgggaatttaggaaataaaagcgggctgaccccactgcacctcgtggcccaggaaggccacgtgccagtggccgacgtcctgattaagcatggcgtaatggtcgacgcaacaacacgtatgggctatactcccctccatgtggccagccactatggcaacattaagctcgtgaagtttttactgcaacaccaggctgacgttaacgcaaaaacaaaactgggatacagccctctgcatcaggccgcacagcagggacacaccgatatcgtgaccctactgctgaagaatggcgcaagccctaatgaagtgtcgtcggatggcacaactcccctggcaattgcgaagcgtctcggatatatcagcgtcactgacgtactcaaagtcgtgaccgacgaaaccagctttgtgctggtgtccgataaacatcggatgtcatttccggagactgtggatgagattctggatgtgagtgaagacgaaggggaggagttgatcagcttcaaggctgagcggagagactcaagggatgtcgatgaagagaaggagctgctggactttgtgccaaagttggaccaggtagtcgaaagccccgccattccccgcatcccgtgtgcaatgcccgaaaccgtcgtgatccggtctgaagaacaggagcaagcctcaaaagagtatgatgaggactccctgatcccctcttcccctgcaaccgagacaagtgataacattagtccagttgcatctcctgttcacacgggcttcctagtgtccttcatggtcgatgccagagggggctcaatgcgaggcagcagacacaatggcctgcgggtagtgatcccaccccggacctgtgccgcccctacgaggattacgtgtcgtctcgtgaagccccagaagctgtccaccccaccccctctggccgaagaggaaggcctggcttccaggatcattgcactgggaccaacaggcgcccagtttctgtcaccagtgatcgtggagattccccactttgcttcacacggtagaggggaccgcgagttagtcgtgcttagatcagaaaacggatcagtttggaaagagcatcgtagtcggtatggcgagtcttacttagatcaaatcttgaatgggatggacgaagaactcggctccctcgaggagcttgaaaagaagcgggtctgtcgtataatcacgacggacttcccgctttatttcgtgatcatgtccaggctttgtcaggattacgataccatagggcccgagggcggaagccttaagtccaaactagtgccactggtccaggccacattccccgaaaatgcagtgaccaagagggtcaagttggccctccaagcccagccagtgccagacgagttggtaactaagctgttaggtaaccaagcaacgttttccccgatagtgaccgtggagcctcggaggagaaagttccatcgacccatcggcctgcggatccccctgcctccatcttggaccgataaccctagggacagtggtgaaggagataccacatcactgcgactgttatgttccgttataggcgggactgaccaggcgcagtgggaggatatcacagggaccacaaaacttgtctacgcaaatgagtgcgccaacttcacaaccaatgtttccgccaggttctggctctccgactgccctcgcacggctgaggcagtaaatttcgctacgctactgtataaggagttaaccgccgtcccttacatggccaagttcgtaatctttgctaagatgaacgaccctcgggagggtagacttcgctgttactgcatgaccgacgacaaagtggacaagaccctggagcaacacgaaaacttcgtcgaagttgccaggagtagagatattgaggtccttgaagggatgtccctcttcgccgaactcagcggcaacctggtgccagtgaagaaggccgctcagcaacgctctttccatttccaaagctttcgggagaatcgcctggctatgcctgtgaaagtacgggacagttcaagagaacccggcggcagcttgtcattcctgaggaaagcgatgaagtacgaagatacgcaacacatactgtgccatctgaacataactatgcctccctgtgccaaagggtctggagcagaagaccggagaaggaccccgacaccactggctcttcgatactccattctgagcgagagcacacctggaagcttgtcaggtacggaacaggctgagatgaagatggctgtgattagcgaacatttgggtcttagttgggctgagctggcgcgcgagttgcagttttctgtcgaggatatcaatcgaattcgtgtcgaaaaccctaattctctgctggagcagtctgttgccttgctgaacttatgggtaattagagagggacaaaacgctaacatggagaacctatacaccgcccttcagtcaattgatcggggcgaaatcgtgaacatgttagagggctcaggccgccagagtcgtaatctgaagcccgatcggcggcacaccgacagagattatagtctgtcccccagtcagatgaatggatattcctctttgcaggatgaactgctctcccctgcgagtttaggatgtgccctgagcagccctttacgtgctgatcaatactggaacgaggtggccgttctcgacgctattcccctcgcggctacagaacatgacactatgctggagatgtccgacatgcaagtgtggagtgcaggtctgacgccctccctggtcacagccgaggatagttctttagaatgctcaaaagccgaggattccgacgcaactgggcacgaatggaagctggaaggggcccttagcgaggagccgagggggccagaactggggagcctggagctcgtcgaagatgatactgtggactccgacgccaccaatgggctgattgacctcctcgagcaggaggagggccaacgcagtgaggagaaactgccaggatccaaacgccaggacgacgcaacaggagcaggccaggattccgagaatgaagtctcattggtgtccgggcaccagagaggccaggcaaggattacgcatagccccaccgttagccaggtgaccgagcggtctcaggaccgtctccaggattgggatgcggacggatcaattgtttcgtatttgcaggacgcggcccagggctcatggcaggaggaagtcacgcagggtccgcactctttccaggggacatctaccatgactgagggattggagccaggaggttcacaagagtacgaaaaagtccttgtctctgtttctgaacacacgtggaccgagcaaccggaggccgaatcttcccaggccgatcgcgacaggcgccagcaggggcaggaagagcaagtgcaggaggcaaaaaacacatttactcaggtggtgcaaggtaacgagtttcaaaacatcccgggggaacaggtgacagaggaacagttcacagacgagcagggtaatattgtaacgaaaaagattattcggaaagtcgtccgacagattgacctttcctctgccgatgctgcccaggagcacgaggaagtaaccgttgagggcccactggaggaccctagcgagctcgaagtcgatattgactacttcatgaaacatagcaaagtggagctcaggggttctggactacagccggacctgatcgagggacgcaagggtgctcagatagtaaaaagagcctccctgaagcggggcaagcaatag

SEQ ID NO: 108211 - DNA, 5421 bp, Artificial Sequence
  Description of Artificial Sequence: Synthetic coding sequence
atgccctattctgttggcttccgggaagctgatgccgcaacgtccttccttagagcagctcgctccgggaatctggacaaagccctcgaccacttgcgaaacggggtggacatcaacacatgtaaccagaatggcctgaacggcctgcacttggcaagtaaagagggccacgtgaagatggtagtggagctgcttcataaggaaatcatactcgaaactacaactaagaagggtaataccgctcttcacatcgccgctctggctgggcaggacgaagtggtgagggagctggtcaactacggagccaatgtaaatgcgcaatcacagaaaggatttacccccctctatatggcggcccaggagaatcatttggaggtggtcaagtttctgttagaaaacggcgcgaatcagaacgtcgccaccgaggatggatttaccccattggcagtagccctgcagcaagggcacgaaaatgttgttgcccaccttattaactatggcacaaaaggtaaagtgagacttccggccctacatatagccgcgagaaatgatgacacccgcactgccgccgtactgctgcagaacgaccccaatccggatgtcttgtccaaaacaggatttactccactccatattgcagctcactacgagaatctgaatgtcgcacaattgttactaaataggggagctagcgtcaacttcactccacagaacggaataacgccgctccacatagctagtcgtagagggaatgtgatcatggtgcgcttactgctggacaggggagctcagatcgagactaaaactaaggatgagcttacgcccctgcactgtgccgcacggaatggccacgtgcggatcagcgaaatcctgctagaccacggggcacctattcaagcaaaaaccaaaaatggtctgagccccattcacatggctgcgcaaggggatcacctggactgtgtgcgattgctcctccagtatgatgccgagattgatgatattacactcgatcacctaacaccactacacgtggcagcccattgcgggcaccacagggttgccaaagtactcctggataagggcgctaaacctaattcacgggcgctcaatgggttcactcctcttcatatagcctgcaagaaaaatcatgtgcgagtgatggagttgctcttaaagaccggggcatctatagacgctgtaaccgaatccggcctcactcccctccacgtagcgagcttcatggggcacctcccgatagtgaagaatctgctccagagaggagccagcccaaatgtgtccaatgtgaaagtggaaactccccttcacatggccgcaagagctggtcatactgaggtggcaaagtacctgctgcagaataaggccaaggtgaatgccaaagccaaggatgatcagactcccctgcattgcgctgcccgaattgggcacactaacatggtcaagctcctgctggaaaataacgctaatcctaacctcgctaccacagctggacatactcccctgcatatagccgctcgggagggccacgtggaaaccgtcctcgctttgcttgagaaggaggcgtcgcaggcctgtatgaccaaaaaaggattcacaccactccacgtggctgcaaagtatggaaaggttcgggtcgccgagctactcctggagcgagatgcccatccaaatgcagccgggaaaaatggactcactccgctccacgtggccgtacatcataataacctggatattgtgaagttacttctgccaaggggggggtctcctcatagccccgcttggaacggatacacaccgctgcatatcgctgctaaacagaatcaggttgaggtggcccgctctctgcttcagtacgggggaagtgcaaatgcggagagtgtgcaaggagtaaccccactgcatttggcagcgcaagagggtcacgccgaaatggttgcactgctattgtctaagcaggcaaacggcaatttgggaaacaagtccgggttaacccccctccatctggttgcacaggagggacacgtcccagtggctgacgtactgatcaaacacggtgttatggtcgatgccacaacacggatgggctacacccccctccacgtggcaagccactatggtaatatcaaacttgtgaaattcctgctccagcatcaggccgacgtgaatgccaagacgaagcttggctactcccccttgcatcaggccgctcagcagggtcacactgacatagtgaccctgctcctgaagaacggggcctctccgaacgaagtttcctctgacggaacaactcctctggcaatcgctaagaggctcgggtatatatctgttactgacgttctgaaagttgtgactgacgagacatcattcgtgctcgtgagcgacaaacacagaatgagcttcccagagacagtcgatgaaattttggatgtgagtgaagacgaaggcgaagagctcatctcatttaaagccgaacgaagagactcccgtgacgtggacgaggaaaaagaattgctggactttgtgccgaagctggaccaggtcgtggagagcccagctataccccgcatcccatgcgcaatgccagagactgtagtgattcgaagcgaggagcaggagcaggctagcaaagaatatgatgaagattcactgattccatcatctcctgccacagaaacctctgacaatatctcacctgtggcttcgccagtgcacaccggcttcctcgtctccttcatggttgacgctcgcgggggcagtatgagggggtcacgacataacggtttgcgagtggtgatccctccacggacttgtgccgctccaactcggattacctgcagactggtgaaaccgcagaaactgtctaccccgcctcctctcgcggaggaagagggcctggcaagcaggatcattgcactgggtcccactggggctcagtttctgtcacccgtgattgtcgaaatacctcacttcgccagtcatggccggggggatagggagttggtggtcctgcgttctgaaaacgggagtgtgtggaaagagcacaggtctaggtatggtgagagctatctggatcagatcctgaatgggatggacgaggagctgggttcattggaggaattggaaaaaaagagggtctgtcggatcatcactacagacttccctctttatttcgtaatcatgtctaggttgtgtcaggactacgacacaattggcccagaagggggaagcctgaagtccaaactggtcccactggtgcaggccacctttcccgagaatgcagtgaccaagcgggtcaaactggctctgcaggctcagcctgtgccagatgaacttgtcacaaaattgctcggcaatcaagcaacattcagccctatagtcactgttgagccccgccgtaggaagttccatagacccatcggactccgcattcccctgcccccatcatggaccgataatcctcgagactcaggcgagggggatacaacatcattaaggttactgtgctccgtcattggcgggacggaccaagctcagtgggaggatatcactggaactacgaagctggtttacgctaatgaatgcgctaacttcacgaccaatgtctcagcccgcttctggctaagcgactgtccgaggacagctgaagccgtcaacttcgccaccctgctgtacaaagaactgactgcagttccatatatggctaaatttgtgatcttcgctaagatgaatgacccccgcgagggcagattacgttgttactgtatgaccgatgacaaggtcgacaaaacactggaacaacacgagaactttgtggaggtagctcgctcaagagacattgaggtcctggaggggatgagcctgttcgcagagctatccgggaacctggtgcctgtaaagaaagcagctcaacagcgcagcttccattttcagagttttcgggagaaccgtctcgctatgcccgttaaagtgagagacagttctcgagagcccgggggcagcctatctttcttacgcaaagccatgaagtatgaagatactcaacatattctttgtcacctgaatatcacaatgcccccttgcgctaagggaagtggggctgaagataggcgcagaactcctaccccccttgccttgagatattccattctctccgagtcgacgcccggctccctgagtggaactgaacaagcagagatgaaaatggctgttatcagtgagcatctgggactatcatgggccgaactggctcgcgagttacaattcagtgtagaggacatcaatagaatcagggtggaaaacccaaacagcctgctagaacagagcgttgccctccttaacctgtgggtcattcgcgaaggacagaatgccaacatggagaatttgtacactgccctgcagtctattgataggggagagatcgtgaacatgcttgagggctccggcagacagtctcgcaacctaaaaccagacagaagacacactgatcgggactattctttgtctccctcccagatgaacggatattcttcacttcaagacgagctcctgtccccagcatcactgggttgcgctctgagcagtcccctgcgggccgaccagtactggaacgaggtcgccgtgctggacgccatacctctggctgccacagagcacgataccatgctggaaatgtcagacatgcaggtctggtctgctgggctgaccccaagtttggtcaccgccgaggattcttctcttgagtgctcgaaagctgaggactctgatgcaaccgggcatgaatggaagcttgaaggagctctgagcgaggaaccccggggacccgagctcggctcactcgagttagtggaagatgacacggtagatagcgatgccaccaatggactgattgatcttctggagcaggaagaaggacagcggtccgaggagaagctgcccggttcaaaaagacaggatgacgccactggcgccggacaggattccgagaacgaggtgagcttggtatcaggccaccagcggggtcaagctcggatcacccacagcccgacagtgtcccaggtcaccgagaggagtcaggaccgactgcaagactgggatgctgatggaagcatcgtttcttaccttcaggacgcagcgcaggggagttggcaggaagaggtcacacaaggtccacactcattccagggcaccagcaccatgacggagggcctggaacccgggggctcccaagaatatgagaaagtgttggtgagcgtgagcgagcacacttggaccgagcaaccagaggccgagtcaagtcaggccgatcgggacagaaggcagcaggggcaggaggagcaggtccaggaagccaaaaacacttttacccaagtcgtacaagaccacacttctacccccaacccatag

SEQ ID NO: 108212 - DNA, 330 bp, Artificial Sequence
  Description of Artificial Sequence: Synthetic coding sequence
atgtggacgttcgtaacacagttactagtgacactcgtgcttttatcttttttcctggtgagttgccagaacgtaatgcatatcgtcaggggttcgttatgtttcgtattgaaacatattcatcaagaattagacaaggaactcggcgagtccgaggggctgtccgatgatgaggagacaatttcaacgagagtggtgaggcgccgcgtctttttgaaagggaacgaatttcagaacattcccggcgaacaggtgacagaggaacagtttacagatgagcaggggaacattgtgactaaaaaggaccatacttctactcccaatccatag

SEQ ID NO: 108213 - DNA, 11775 bp, Artificial Sequence
  Description of Artificial Sequence: Synthetic coding sequence
atgatgaacgaagacgccgcccaaaagtccgacagcggggaaaagttcaacgggtcatcgcaacgcaggaaacgacccaaaaagtccgactcaaatgcttcttttttgagggccgcacgcgcgggaaacctagacaaggtcgtcgagtacctaaaaggaggcatcgacatcaacacctgtaatcagaacggcctgaacgccttacacttggctgcaaaggaaggtcacgtagggttggtacaggagttactgggcaggggctccagcgttgactctgctacgaaaaaaggcaatacagctcttcatattgcctctctggctgggcaggcagaagtggtgaaggtcctggtgaaagaaggcgcgaatattaatgctcagagtcagaatggatttaccccgctctacatggccgctcaagagaaccatatcgacgtggtaaaatatttgctcgaaaatggagctaaccaatccaccgctactgaagacgggttcacacctcttgcggtagcccttcagcagggccacaatcaggccgtggctattctattagagaacgacacaaagggcaaagtgaggttgcccgcattacacatcgccgctcgaaaggacgacacaaagtcagccgctctacttctgcagaatgaccataacgccgatgtacagtctaaaatgatggtgaacagaacgactgagtcagggttcacccctttgcatattgccgcacactacgggaacgtgaatgttgcgactctcctgcttaacagaggcgccgcagtggactttaccgcaaggaacggcattacccctctgcacgtagccagtaagcgcggaaacaccaacatggtcaagttgctgctggacagagggggtcagattgatgctaaaaccagagatgggctgaccccactccactgcgccgctcggtctggacacgaccaggtcgtggagctcctgctcgagaggggtgcaccactgcttgcaagaactaagaatggactgtcacctctgcacatggcggcacagggggaccacgtggaatgtgttaagcacttgctgcagcacaaggcaccagttgacgatgtgacactagattaccttaccgcactccatgtggccgctcactgcgggcactaccgtgtgactaagcttctcctcgataagcgcgctaacccaaacgccagggcacttaacggatttaccccattgcatatcgcgtgtaaaaagaacaggatcaaagtaatggagcttttggtcaagtacggcgccagcattcaggctatcactgagagcggattgactcccattcacgtggcagcctttatgggacacttaaatatcgtcttgctcctgttgcagaacggagcttctccagatgtgaccaatattagaggagagacagccctgcacatggcagctagagcggggcaggtggaagtggtgcgatgcctactgcgaaacggggccctggtggacgcacgcgccagagaagagcagactcccctgcatattgcatcacgtctgggtaagacggagattgtgcagttgctgctgcagcatatggcacacccagatgcggcaaccactaacggctacactcccctccacatctctgctagagaagggcaggtggatgtggccagtgtccttctcgaagccggagcagctcactccctggccaccaaaaagggttttacacctctgcatgtggcagctaagtacggcagcctggatgtagctaagctattactgcagagacgagccgcagccgactcagccggcaaaaacggcctgactccattgcacgtcgctgcccactatgataaccagaaagtggcgctcctactgctggagaaaggggcgagtcctcatgcaaccgccaagaatggctacaccccactacacattgcagctaagaagaaccagatgcagatcgcctccacacttctcaattacggggctgaaactaatattgtcactaagcagggcgttacccctctgcatcttgctagccaggaaggacacaccgatatggtgacgctgctgcttgacaaaggtgctaacatccatatgtccactaaaagcggactgacctctctccacttggccgcacaggaggataaggtcaatgtggcagacatcctgacaaaacatggagccgaccaggatgcgcataccaagctaggctatacccccttgattgtggcttgtcattacgggaatgtcaagatggtcaacttccttctgaagcaaggggctaatgtcaacgcaaagaccaaaaacggctatacccctttgcaccaagcagcccagcaggggcatactcacattattaacgtgctgctgcagcatggcgcgaaacccaatgccacgaccgcaaatggcaacaccgcattagcgatcgcgaaaagactcgggtacatttccgtggtagacaccctgaaggtggtgacagaggaggtgaccactacaacgaccacaatcacagagaaacacaaattgaatgtccccgagacaatgacagaggtgctcgacgtcagcgatgaggaaggagacgatacaatgacaggcgatggtggcgagtatctgcgccctgaggatttgaaggagctgggcgacgacagcctcccaagcagccagttccttgatggcatgaattacctccggtacagcttagaaggcggaaggagcgactccttgagatctttctcctctgacaggtctcacacacttagccatgcttcttacttgcgtgactctgctgtgatggacgactctgtagtgataccatcacaccaggtgtcaaccttagccaaagaggccgaaaggaactcctatcgcctgtcctggggcacagagaacctggataatgtggccctgagcagcagtcctatccactctgggttcttagtgtcgttcatggtggatgctcggggcggcgcgatgcgcgggtgccggcacaatggccttcgcataatcatccctcctcggaaatgcactgccccgacgagagttacctgtcggctggtcaagaggcacaggctcgccaccatgcctccgatggtagagggagagggacttgctagccggttgatagaagtcggtccatctggggctcaattcttgggaccggttatagtggaaatcccccacttcgcagcgctgagggggaaagagagggagctggtggttctccgaagtgagaacggcgacagttggaaggaacatttttgtgactacactgaggatgagctaaatgagatactgaatggcatggatgaagtgctggatagtcctgaggacttggagaaaaaaaggatttgccgcattatcactcgcgatttcccgcagtatttcgcggtggtcagtcgcataaaacaagacagtaacttaatcggccctgagggaggcgtactaagttccacagtggtaccacaggtccaagccgtgttccctgagggcgctttgacaaaaaggatccgggtcgggctgcaggcccaaccaatgcacagtgaactcgtaaagaaaattctcggcaacaaggcgacgtttagccctattgttacactcgaaccacgtagacgcaaatttcacaaacccattaccatgacgatcccagttcccaaggcttctagcgacgtgatgcttaacggctttgggggggatgcccccaccttgagattgctgtgttcgatcactgggggcaccaccccagcccagtgggaggatatcacaggcacaacacccctgacattcgtgaacgagtgtgtaagttttaccaccaatgtgagcgctagattttggctgattgactgcaggcagatccaggaatcagtaacattcgcctcacaggtatatcgtgaaatcatctgcgtaccgtatatggccaaattcgtcgtattcgccaagtcgcacgaccctatagaagcgcgcctaagatgcttctgcatgaccgatgacaaggtggataaaactctcgagcagcaggaaaattttgctgaggtcgccaggtcccgggacgtggaagtattggaaggaaagccgatttatgtggactgctttgggaacctagtgcctctgacaaaaagcgggcagcatcatatctttagtttctttgcctttaaggagaaccgcctcccattattcgtcaaggttagggataccacccaggaaccctgcggtcgtctaagttttatgaaggagcctaagtccaccaggggactcgtgcatcaggcaatctgtaatctgaatatcaccttgccaatctatacaaaagagtcagagtcagatcaagagcaggaggaggaaattgacatgacgtccgaaaaaaacgacgaaactgaatccaccgagacatctgtgctgaagagccatctcgtcaacgaggtgccagtgctcgccagtcctgatctgctgtcggaggtttccgaaatgaaacaggaccttatcaagatgacagcaattctgaccactgatgtgagtgataaggccgggtctataaaagtgaaggaactggttaaggccgccgaggaggagcccggcgaacccttcgaaatcgtcgagcgggtgaaggaggacctggaaaaggtgaacgagatcctgcgctccggaacttgcacccgagatgagagctctgttcagtcctctagaagcgaaaggggtctcgtggaggaggaatgggtgattgtgtccgatgaggagatcgaagaggctagacagaaagccccactcgagataaccgagtacccctgtgttgaagtgagaattgataaggagattaaggggaaggtggaaaaagactccacaggattggtgaactacctgaccgatgacttgaatacctgcgtacctctcccaaaggaacaacttcagacagtgcaggataaggcgggtaagaaatgtgaggcactggctgtgggcagaagcagcgagaaagagggtaaagatatccctcccgacgaaactcagtctactcagaaacagcacaaaccatctctaggcatcaagaaacctgtgcgaaggaaacttaaggaaaaacaaaaacagaaggaggagggactccaagccagtgcagagaaagcagagctgaaaaaagggtcatccgaggagtccttgggtgaggatcctggtcttgcccccgagcccctacccacagtgaaagcaacatcacccctaatcgaggagaccccaataggatccattaaggacaaggtcaaagccttgcagaagagggttgaggatgagcagaagggcagaagcaaactgcctataagagtgaagggtaaggaagacgtgcctaagaaaacaactcacaggccacatccggcagcctccccttcccttaagagtgaacgacatgccccaggcagccccagtcccaaaacagagaggcactctaccttgtcttcaagtgccaagactgaacgtcaccctccggtcagtccctcctctaagaccgagaagcatagtcccgtgtctccatctgctaaaactgagcgtcactcacccgccagttcctcttctaaaaccgagaaacattcccccgtctcgccgtctaccaagaccgagcgccactcacccgtctcatccacgaagactgaaaggcaccctccagtttccccttcggggaaaacagataaaaggccgcctgtgtctccatcagggcgcacagagaaacaccctcccgttagccccggacggaccgagaagaggttgcctgtgtcaccttctggaagaacggacaagcatcagcctgtgtctaccgctggaaaaacagagaaacaccttcccgtttcaccatccggtaagactgagaagcagcccccagttagccccaccagtaagacggagcgtattgaagaaacgatgtcggtcagagaactgatgaaagctttccaaagcggccaggacccaagtaaacacaagactggcctgtttgaacataaatctgccaaacagaagcaaccgcaggaaaagggtaaggtgagagtagaaaaggaaaagggcccaattttgacacagagggaggcacagaaaacagagaatcagactataaaacgcgggcagagacttcctgtcaccggcaccgctgagagcaagagaggcgtgagagtctccagcatcggggttaagaaagaggacgccgctggaggaaaagagaaggttctctcacacaagattccagaacctgtgcagagtgttcctgaagaagaatctcatcgggagtctgaagtgcctaaagagaagatggcagatgagcaaggggatatggacctgcaaatctcacccgaccggaaaacatccacagacttttctgaggtcatcaagcaggagctggaggataatgataagtaccagcagtttcgcctgagtgaggaaacagagaaagcccagctgcacttggaccaggtgctcacttcaccgtttaacaccacgtttcccctagactacatgaaagacgaatttctgcccgctcttagtctgcagtcaggcgccctcgacggctccagtgagtcactgaaaaatgagggggtagccggaagtccatgcggttccctcatggaaggaacgcctcaaatatcaagcgaagagtcatacaaacacgaaggcttagcggagacccccgaaacgtcacccgaaagcctgagcttctctcctaagaaatcggaggagcagactggggaaacaaaagagtctaccaagactgagacgacaaccgaaattagaagcgagaaggaacaccccaccaccaaggacatcacaggcggttcggaggaaaggggggccaccgtaacggaagacagtgaaaccagtaccgagagttttcagaaagaagccacactggggtccccaaaagacacatcacccaaaaggcaggacgactgcacaggtagctgctccgtggctctggcaaaagagacgccgacaggcctgacagaggaggccgcttgcgatgagggacagcggacttttggctcaagcgctcataagacccagaccgattcagaggtccaggaaagcaccgcgacctccgacgaaaccaaggcgctgccactcccagaggcctccgtgaagaccgatacaggcactgagagtaagccccagggtgtgattcgttcacctcagggtcttgagttggccttgccgtcccgggatagcgaagtgctgtctgccgtcgcagacgacagcttggctgtctcacataaagattccctcgaggccagccccgtgctggaggacaatagctcgcataagacgcccgacagcctggaaccaagtccactgaaggaaagcccctgccgggattccttggaaagttcaccggtagagccaaagatgaaagccggcatctttcctagtcacttcccacttcccgccgccgttgccaagactgaactcctaactgaggttgcttccgtgagatcaaggctccttagggatccagatggctccgcggaggacgactccctggagcagacttctctcatggagtcgtccggtaagtctcccctcagtcccgacacacccagctcagaagaagtttcttacgaggttactcccaagaccaccgacgtctcaacacctaagcccgctgtgatccacgaatgcgcagaagaggatgattcagagaacggcgagaaaaaaagatttacccccgaggaggaaatgttcaagatggtgacaaaaatcaaaatgttcgatgaacttgagcaggaagccaagcaaaagcgggactataagaaggagcctaagcaggaagaaagctcttcaagtagcgaccccgacgctgactgttctgtggacgtcgacgaacccaaacacaccggatctggggaggacgagagcggagtccccgtgctcgtgacctcagaaagccgaaaagtgtcctcctcctctgagagtgaaccagaactcgcacagttgaagaagggagctgactccgggctgttgcctgaacccgtcataagggtccaaccgccttctcctctcccaagtagtatggatagcaactcaagccctgaagaggtccagttccagccggtcgtatcaaaacagtacacgttcaaaatgaatgaggacacccaggaagagccaggtaaaagcgaagaggaaaaggacagcgaatcacatctggcagaagacaggcacgcagtttctacggaagccgaagatcggtcttacgataaactgaatcgggacactgaccagccaaaaatctgcgacggacacggatgcgaagccatgagtccctcttctagcgcagctcccgtctcttctgggctgcaatctcctactggcgatgacgtcgatgagcagcctgttatctacaaagaatctctcgccctacagggcacgcacgagaaagatacagaaggcgaggagttagatgtgtcacgggcagagtcgccacaggccgactgcccctccgagagcttttcttcttcttcttccctaccccactgccttgtgtcggagggcaaggagttagacgaggatattagtgccacgtcctcaattcagaaaacggaagtgaccaagaccgacgaaaccttcgagaatctgcccaaggactgcccgtctcaagacagctctatcactacacagacagatcgtttctccatggatgtgcctgtgtctgatcttgcggagaacgatgaaatttacgacccacagatcacgagcccctatgagaacgtgccatctcaaagctttttcagctcagaagagagcaaaacccagaccgacgctaatcacactacgagctttcacagctccgaggtgtatagcgtgacaatcacctcccccgtcgaggacgtcgtggtggccagttcttctagcggaactgttttgagtaaggagtccaatttcgagggccaggacataaagatggaatctcagcaggaaagcaccttgtgggagatgcagagtgactctgtttcttcttctttcgagccgaccatgtctgctactacaacagttgtcggggagcagatcagcaaggtaataattactaaaactgacgtcgactctgattcatggagtgaaatccgcgaggacgacgaagcgttcgaagccagggtcaaagaagaagaacagaagatctttggcctcatggtcgaccgtcaatcccaaggaaccacgcctgataccacacctgcccgaacaccaactgaagaaggtacgcccacttctgaacagaatccatttttgttccaggagggtaagcttttcgaaatgacccgttctggtgccatcgacatgaccaagaggagttatgctgacgagagtttccatttcttccaaattggccaggagagccgagaagagaccttatctgaggatgtcaaagaaggcgcgaccggcgccgacccgctgccgctcgagactagcgctgaatcgttagccctcagcgaatcaaaagagacagtggacgacgaagccgacctcttacccgatgatgtctccgaggaggtggaagagattcctgcatctgacgcccagttgaatagccaaatggggatttcagcctctaccgagactccgacaaaagaggccgtatctgtaggcaccaaagacctaccaactgtccagaccggcgacattcccccactctccggtgtaaagcaaatctcttgccccgattcgtccgaacccgccgttcaggtgcagctggatttctcgacgctcaccagaagcgtttacagcgaccgaggagacgattccccagacagttcccctgaggaacaaaaatcagtaatcgaaatcccaacggcccctatggaaaacgtgcctttcactgaatccaaaagcaagattccagtgcgcactatgcccacctcaacaccagctccaccatcggccgaatacgagtcatcagtaagcgaagacttcctgtcaagcgtggacgaggaaaacaaggccgatgaggcaaagcccaagagcaagctgccggtgaaggtgcctctacagagggtggaacagcagctgtcagatctggatacgagcgttcagaagaccgtggcccctcagggccaggatatggcaagcatcgcgccagacaaccgtagcaagtccgagtccgatgctagctccctagattctaagaccaagtgtcccgtgaaaacaaggtcctatacagaaactgagaccgagtctcgcgagagagctgaggaactggagctggaatccgaggaaggtgccacccggcccaagattcttaccagcaggctccccgtgaagtcccggtccacaacttccagttgtcgggggggaacatctccaacaaaagagtctaaggagcacttctttgatctctacagaaattcaatcgagtttttcgaggaaatcagcgatgaagcttccaagctggttgaccgcctgacccagagcgaacgcgagcaagagattgtgtcagacgacgaatcgtcctctgctctggaagtttcagtgattgaaaatctaccccctgtcgaaacagaacactccgtgccagaggatatctttgacacccggcctatttgggacgagtctattgagactctgattgagaggatcccggacgagaatgggcacgatcacgccgaagaccctcaggatgaacaagagagaattgaagaacggctcgcctatatagctgatcaccttggattctcctggactgagctcgctcgggaactcgacttcaccgaagaacagatccaccagatccggatcgaaaatccgaatagcctgcaggatcagagccacgcacttctgaagtattggctggagcgcgacgggaagcatgcgacagatactaacctggtagagtgcctcacaaagattaaccgaatggacattgtgcacctaatggagacaaatactgagcccctgcaggagagaataagccacagctacgctgagatcgaacaaaccatcacactggatcattccgaggggttcagtgtcctacaggaggagttatgtaccgcgcagcataaacagaaggaggagcaggccgtttccaaagagtctgaaacatgtgaccaccctcccattgtctcggaagaggatatcagtgtgggctactcaacttttcaagatggcgtgccaaagacggaaggggatagcagtgccacagccttgttccctcagacacacaaggaacaggtgcagcaggacttctccggtaaaatgcaggacctgccagaggagtcatctctggaataccagcaggaatacttcgtcaccacgccaggtaccgaaacaagcgagactcagaaggcgatgattgtccccagctccccatctaagacaccagaagaagtgtcaacccctgccgaggaggaaaagctatatctccaaacccccaccagctccgagagaggtggcagccctattatccaagaacccgaggaaccatctgagcacagggaagagtctagtccccggaagacaagcctcgtgattgtggaaagcgcggacaaccagccagagacgtgtgagcgactcgatgaagacgctgcctttgaaaagggcgacgatatgccggagattccgcccgaaacggtaaccgaggaagaatacatcgatgaacatggacataccgtcgtcaagaaggtgacccggaaaattatccggagatatgtgtcatcagaaggtaccgaaaaagaagagatcatggtccaggggatgccacaagaacctgtcaatatagaggaaggcgatggttacagcaaggtcatcaaaagggtcgtgctgaagtccgatacggaacagtcagaagataacaatgaatag

SEQ ID NO: 108214 - DNA, 5592 bp, Artificial Sequence
  Description of Artificial Sequence: Synthetic coding sequence
atgtctcaccacatccagcggtccgattcaaacgcctctttcctgagggcggccagggccgggaacttagataaggtggtggagtatctgaaggggggtatcgatatcaacacttgtaatcagaacgggttaaacgctcttcatttagctgcaaaggaagggcacgtgggcctggtacaggaattgttaggccggggtagctcggttgactcagctacaaaaaagggtaacactgccctccacatcgctagtctggctggacaggccgaagtggtcaaggtgctggtgaaggagggcgcaaatatcaacgcccagagccagaatgggtttactcccctgtacatggccgctcaagaaaatcacattgatgtggtgaaataccttctcgagaatggcgctaaccaatctaccgctactgaagatgggttcacacctttggccgtagccctacagcagggccacaaccaggcagttgcaatactgcttgagaacgacacaaaaggcaaggtgcgactgcccgcactgcacattgccgcgcgaaaggatgatacaaaaagtgccgcccttctgcttcagaacgaccacaatgctgatgttcagtcgaaaatgatggtgaatcgtacaaccgagagcggctttactccgctgcatatcgccgctcactacggaaacgttaatgtcgcaaccttactgctaaaccgcggagcagcggttgacttcacagcccgtaatggcattaccccactgcatgttgcctcaaagagaggcaataccaacatggtgaaactgttgctagatagaggcggacagatcgatgctaaaaccagggacgggctgacgccccttcactgcgctgcaagatctgggcatgatcaagtagttgagctgctgctcgaacggggcgctccattgctggctagaacaaagaatggcctgagtcctctgcatatggcagctcagggcgaccatgtcgagtgtgtgaaacatctcctgcagcacaaggcccccgtggatgacgtgacgctggactacctgaccgcactgcatgtggctgcccactgtggccactatcgggttactaaactcctgctcgataagcgggctaaccctaacgcccgcgcgctcaatgggtttacccccctgcacatcgcttgcaagaaaaatagaatcaaggtgatggaactcctcgttaaatatggggcgagcatccaggcaatcacagaatctggcttaacacccatccacgttgccgctttcatgggtcatctgaatatcgtgctgctgcttctgcagaatggggcctcaccagacgtcaccaatatccgcggcgaaactgcactgcatatggcggctcgagccgggcaagttgaagtggtccggtgcctactgcgtaatggagcactggtggatgccagagcaagagaagagcaaactccattacacatagctagccgcctgggaaaaacagagattgtgcagctgttgttacaacatatggcgcatccggacgcagctaccacaaatggctatacgccattgcacatctcggccagggagggccaggtggacgtggccagcgtcttactggaggccggtgctgcccactctcttgccacaaaaaagggatttaccccattacatgtagccgcgaaatacggctctttagatgtggccaaactgctgcttcaacggagagcagctgccgattctgctggcaagaacggactgacgcctttacatgtggctgcccattatgacaaccagaaagtggccttactgctgttggagaagggtgcctcccctcatgcaactgctaaaaacggctacacaccccttcacattgccgcaaagaaaaaccagatgcagatcgcgtcaaccctgctgaactatggtgcagagacaaatattgtgaccaaacagggagtgacccctctacaccttgcctcccaggaagggcatacagatatggtgacactgctgctggataaaggcgcgaatatccatatgtccacaaaatcgggtctgacatccctgcacttagcagcccaggaggacaaagtgaatgtcgctgacatcctgacaaagcacggtgcggaccaggacgcccacaccaaactgggctacacccctctcatagtggcatgtcactacgggaatgtaaagatggtgaactttctattaaaacagggcgcgaatgtaaatgcgaagacaaagaatggctatacccctcttcatcaggccgctcagcagggccacacccatattatcaacgttctgctccagcacggagccaaacctaacgctaccaccgccaatggtaataccgccctggctatcgcaaagaggcttggatacattagtgttgttgatactctgaaggtggtcacggaagaggtgaccactactactacgaccatcacagagaagcacaaactgaatgttcccgagaccatgaccgaagttctggacgtttctgatgaggaaggggatgacacaatgaccggagacggtggagaatatttacggccagaggacctgaaagagctaggggacgactctttgcccagctctcagttcctggacggtatgaattatctgcgctacagcttggaagggggtaggagtgattctctgaggtcctttagcagcgacagatcacacaccctgtcacacgccagttacctgagagatagcgctgtcatggacgattccgtcgtcattccctctcaccaggtctcaacactggctaaagaggcagaacgcaactcttatcggctgtcctgggggactgagaatctagataatgtcgccctctctagtagcccaatccacagtgggagagcaagcccatgcctggagcgcgacaactccagctttttggtctctttcatggtggatgctcgagggggcgcgatgagggggtgccggcacaatggactgcgcatcattattccgccacgcaagtgcacagcaccaacgcgtgtgacgtgtcgcctggtgaagaggcaccggctcgccacaatgcccccaatggtggaaggggaagggctggcctctaggctcatcgaagtgggtccatccggggcccagtttttaggcaaactgcatctacctaccgccccacctcctctgaacgaaggggagtctcttgtatcgaggatccttcagttaggtcctcctggtacgaaatttctcgggcctgtgatcgtggaaatcccccattttgcagccctgaggggaaaggagcgagaacttgtggtgctgcgctccgagaacggggatagttggaaagagcacttttgtgattatactgaagacgagttgaatgaaattctcaatgggatggacgaggtactggattcacccgaagatctcgaaaagaagcgcatctgccgcatcattaccagagacttcccccagtacttcgccgtggtcagccgaatcaagcaagactccaacctgattgggccagaggggggcgtgctaagttcaacagtggtgcctcaggtgcaagccgtttttcccgagggtgccctcactaagcggatccgagtgggcctgcaggcccagcctatgcacagcgagctggtgaagaagattctaggaaacaaagccacattttcccctattgtaacactggagcctcggagacgcaagttccataagcctattactatgaccatcccagtgccaaaagccagctctgatgtcatgctcaatggattcggaggggacgcccccactcttaggttgctgtgttccatcacaggtggcacaacccctgcgcagtgggaggatatcacgggaacaactcccctgacattcgtgaatgagtgtgtaagcttcacgacgaatgtatccgctaggttctggctcatagactgtcgccaaattcaggagtcggttacatttgccagtcaggtctatcgggagattatttgtgtgccgtacatggcgaaattcgtggtgtttgccaagagccatgatcccatcgaggcaagacttagatgtttctgtatgaccgatgataaggttgataagaccttggagcagcaggagaactttgcagaagtagcgagatcaagggacgtggaggtgctcgagggaaagcccatatatgtggactgttttggcaacctggtgcctcttactaaaagtggacaacaccatatcttttccttctttgccttcaaagagaatcgactgcccctgtttgtgaaggtgagagacacgacccaggagccctgcgggcggctgtcgttcatgaaggaacccaagtcgactcgcggcctggtgcaccaggccatctgtaacttaaacataactcttccgatctacactaaagaaagtgaatcagatcaggagcaggaggaagagataggccaagaaagccgtcggtatcctcaggacgaacaggaaaggattgaagagcggctggcatacattgcagaccatctgggattttcatggaccgagctggcgagagagctggacttcactgaggagcagatacaccagatccgtattgaaaacccaaactctctccaggaccagtctcacgccttgctgaaatattggctggagcgggacggtaagcacgccaccgatacgaacctggtggaatgtctcacaaagataaaccggatggacatcgtccatctgatggagactaacactgagcccctccaggagcgcatctcccacagttacgcagaaattgaacagactattaccctggaccactccgaaggtttttctgtgttgcaagaggagttatgcacagctcagcataagcaaaaagaagaacaggctgtgagtaaggaaagcgaaacgtgcgatcaccccccgatcgtaagcgaagaagatatttccgtcggctacagcaccttccaagacggggtgccaaaaaccgaaggcgatagctccgccactgcgctctttccgcagacgcataaagagcaagttcaacaagacttttccggcaaaatgcaggaccttcccgaagagtctagcctggaatatcagcaggagtacttcgtgacaacccctggtacagaaacttccgaaacacagaaagctatgatcgttcctagtagcccttctaagacacctgaggaggtgagcacacctgcggaagaggagaagctgtatctccagacccccacgagttcggagcgtggggggtcccccataatacaggaacctgaggagccttccgaacacagggaagaatcgagtccaaggaagacatctctggtgattgtggagtccgctgacaaccagcccgaaacgtgcgagaggttagacgaggatgctgcattcgaaaaaggcgacgacatgcccgagattcccccggagacagttacagaagaggagtatatcgatgagcacgggcacactgttgttaagaaagtcacgcgaaagatcatcagacggtatgtctcatcggagggcacagagaaggaggagattatggtgcagggcatgccccaggagcccgtgaacattgaggagggggacggctatagtaaggtgatcaagagagtggttctcaaatccgacactgagcaatccgaggactccatggaatag

SEQ ID NO: 108215 - DNA, 11874 bp, Artificial Sequence
  Description of Artificial Sequence: Synthetic coding sequence
atgatgaacgaagacgccgcacagaagtcagacagcggggaaaagtttaatggaagttcccaaaggagaaagaggcctaaaaagtcagactctaacgcgtcttttctcagagctgcaagagcagggaatttagataaggtcgtggaatacttgaaaggcggcatcgatatcaacacctgcaaccagaatgggctgaacgccctgcatcttgccgcaaaagaaggccacgtgggcctggtgcaggaactcctgggacgtggatcatccgtggacagcgcaaccaagaagggaaatacggcactgcacattgcaagccttgctggccaggccgaggtggtgaaagttctggtaaaggaaggtgcaaatatcaacgctcagtcacaaaacgggttcactccattatacatggccgcacaagaaaatcacattgatgttgtcaagtacttgctggagaacggcgcaaatcagtccaccgctacagaggatggattcacgccacttgccgtggccctccagcagggtcataatcaagccgtggctatcttgcttgaaaatgacaccaagggcaaagtgagactgcctgcattgcacatcgctgccaggaaggacgacactaagtctgccgccctactgctccagaacgatcacaacgctgacgtacagtctaaaatgatggtaaaccgtactacagagagcggcttcaccccgttacacattgcggcgcactacggcaatgtgaacgtcgccacattgctgctgaaccgcggagctgcagtagattttacagcacgaaacggcatcacaccgctgcatgtggctagcaaacgcggcaataccaacatggtgaagttgctgctggacagagggggccagatcgatgccaaaaccagggatggcctgacacctctacattgcgctgctcgatctgggcacgatcaagtggttgagctgctacttgagcggggagccccactactggcacgcaccaagaatgggttaagccctctccatatggccgcccagggcgatcacgtggagtgcgtaaaacacttgctgcagcataaggcaccggtcgacgacgtaacccttgattatttaacagccttacacgtagccgcccactgcgggcactaccgagttaccaaacttcttctagacaagagggcaaatccaaatgcaagagcactaaacggctttacacccctgcacatagcttgcaagaaaaaccgaataaaggtgatggaactgctcgtcaagtatggcgctagcattcaggctattaccgaaagtggactgacaccaatccacgttgcagcctttatgggtcatctgaacatagttctcctgctgctgcagaacggtgctagccccgatgtaaccaacatcaggggagagacggctctgcatatggcagccagggctggccaggttgaagttgtgaggtgtttgctaagaaacggtgcgctcgtggatgcccgcgctcgggaggaacagacacctctgcatatcgcgagcagactcggcaaaactgaaattgtccagcttctgctccagcacatggctcaccctgacgccgccacaacgaacggctacaccccgctacatatttcagccagggaggggcaagtcgacgtcgcgtcggtactccttgaagccggggcggcacactctcttgctacaaagaagggttttacgcccctgcacgttgctgcaaagtacggaagtctcgacgtggctaaactgctgctgcagagacgagccgctgctgactccgcgggcaagaacggactgacccccttacatgttgctgcacactatgataatcagaaagtggctctcttgcttcttgaaaagggagcttccccgcacgctaccgcaaagaacggctacacacctctgcacatcgccgcaaaaaaaaatcagatgcagattgcctccaccctgcttaattacggcgccgagacaaatatcgttacaaagcagggggtgactcccttgcatctcgcctcccaggaaggccatacagatatggttacgctgctactggataaaggagcgaacatccacatgtcgactaaatctggcctgacctctctgcatctggcagcacaagaggataaagttaacgtagctgatatccttactaaacacggggcggaccaggacgctcataccaagctgggctacacgcctctcattgtggcatgtcattatggaaacgtgaagatggtcaattttctcctcaaacagggcgcaaatgtgaacgccaaaacgaagaacgggtacacaccccttcatcaggcggcccaacaaggtcatacccatattattaacgtactgctgcagcatggcgctaaacccaacgcaaccacagcgaacggcaatacagcgcttgccatcgccaaaaggctaggatacattagcgtcgtcgataccctaaaggttgtgacagaggaagtcactactaccactacaaccatcacggagaagcacaagctgaatgtacccgagactatgaccgaggttctggatgtgtcggatgaggagggcgatgatacaatgacaggagacggcggcgagtatctgaggcccgaagacctgaaggaactcggtgacgacagtctccccagctcccagttcctggacgggatgaattacctaagatactccctggagggcggcagatctgatagcctcaggagctttagctcagacaggtcccacacgctgtctcacgcctcatacctgcgggatagcgcggtgatggatgattccgtggtgatcccctcccaccaggttagcacccttgctaaagaagcagagcggaattcctaccgcctgagttggggcaccgagaatctggacaatgtggcactgtcttcttccccaatccatagcggctttctggtgagtttcatggtcgatgccagaggcggcgccatgcggggctgccgccataatgggctgaggatcattattcctcctaggaaatgcaccgctccaacgcgcgtcacctgtaggctggtcaagaggcatcggcttgctaccatgcctcccatggtcgagggtgaagggctagcctcccgcctgatcgaagttggccccagtggtgctcaattcttgggaaagttgcacttgccaacagctccaccgccactgaacgagggcgaatccttggtctctcgcattctccagctgggacctcccggaactaagtttttgggccccgtcatcgtggagattccccactttgctgccctgagaggaaaggagagggagctcgttgttctgcgctccgaaaatggcgattcttggaaggaacacttctgcgactacacggaggacgagctgaacgaaattcttaacgggatggatgaggtgctggatagccccgaagatctagaaaagaaaaggatctgccgaattatcacccgtgacttcccacagtatttcgccgtggtatccagaattaaacaggattctaacttaatcgggccagaaggcggagtcctaagcagtacagtggtgcctcaagtgcaggctgttttccccgagggagcactgacaaaaaggatcagggttggactccaagctcagcctatgcacagcgagttagttaagaaaattctcggaaacaaggccaccttctcccctatcgtcactctggagccgcggaggcgcaagtttcataagcctataacaatgaccataccagtacctaaggccagctcagatgtgatgctaaatggctttgggggagacgccccaaccctgcggttgttatgctcgataactggtgggaccaccccagcccagtgggaagacatcacaggtactacccccctgactttcgtcaacgaatgcgtgtcctttaccaccaacgtctctgccagattttggctgatcgactgtagacaaattcaggagagtgtaactttcgcgtcacaggtgtatcgggagataatatgtgtgccatacatggcaaaatttgtcgtgtttgccaaaagccatgatcccatcgaagcccgtttgcgctgtttctgcatgactgacgataaagtcgacaagaccctagagcagcaggaaaatttcgccgaagttgctaggtcccgggatgtggaggtccttgaaggtaaacctatctatgttgattgcttcggaaatcttgttccgctaaccaagagcggccagcatcatatattcagctttttcgcctttaaggagaacaggcttccactttttgttaaagtgcgcgataccacacaggagccctgcggacgcctgtctttcatgaaggaacctaagagcactcgagggctcgtgcaccaggccatctgtaacctcaatatcaccctgcccatctacacaaaagagagcgagagtgaccaggaacaggaggaagagatcgacatgacttcagagaagaatgatgagaccgagagcacagaaacaagcgtcctcaaatcgcatcttgtgaacgaggtgcccgttttggcgtcacccgatttgctcagtgaggtgtctgaaatgaagcaggacctgataaagatgaccgccatactgacaaccgacgtgagcgataaggccggctctatcaaagtgaaagaactagtgaaagctgctgaggaagaacctggagagcccttcgaaatcgtagagagggtgaaggaggatttggagaaggtcaacgagatcctgcgctctggaacatgtaccagggatgaatcatcggtccaatccagtagaagcgagcgcggcctagtggaagaggagtgggtgattgtaagcgatgaggaaatagaggaagcccggcagaaggcgccgctcgaaatcactgagtatccttgcgtagaggttcggatagataaggagatcaagggcaaagttgagaaggacagtacaggcctggtcaattacctgaccgacgatctgaacacttgcgtgccgctgcccaaggagcagttacagaccgtccaggacaaagccggtaaaaaatgcgaggcattggccgtggggagatcatctgagaaggaaggtaaagatatcccacccgacgaaacccaatctactcaaaaacagcacaagccttcactggggataaagaagcccgtgcggagaaagcttaaggaaaaacagaagcagaaggaggaggggttgcaagcatctgcagaaaaggcagagctcaagaagggatcgtcagaagagagcctaggggaagatcccgggttggctcccgaacccctcccgacggttaaggccacctctcccctgatcgaagaaacgcctattgggagtataaaggataaagtaaaggcgcttcagaagcgggtggaggacgagcagaaaggaagatcaaagcttccaatccgtgtgaaaggaaaagaggacgtgccgaagaagaccacacatcgcccgcaccccgctgcaagccctagtcttaagtctgagcgccacgctccaggttcgccctcaccaaaaacagagaggcattcaactctgagtagctccgccaaaactgagcggcatccccccgtttcaccttcttcaaagaccgagaagcatagcccagtgagcccgtctgccaaaaccgagcgacacagtccagcctctagctcaagtaaaaccgaaaaacactctcccgtgtctccgtctactaagacagagagacactcccctgtatctagcaccaagaccgagagacacccccccgtgtcaccttccggtaaaaccgataagcgcccaccagtgagtccctcaggccggacagagaagcaccccccagttagccctgggaggaccgagaaacgcttgccagtaagcccatctggacggactgacaagcatcagcctgtaagcacagcgggcaagaccgagaagcatctgcctgtgtctcccagcgggaaaaccgaaaagcagcccccagtttccccgacctctaaaacagagaggattgaggaaacaatgagtgtgcgggaacttatgaaagccttccaaagcggccaggatcccagcaagcacaaaacaggcctgttcgagcacaaaagtgccaaacaaaaacaaccccaggagaaaggaaaggtgcgggtggagaaggaaaagggacccatattgacacagagggaggcccagaagaccgagaaccagactatcaagagaggccagcgactgcctgtaacaggtaccgctgaaagcaagcggggcgtgcgcgtgtcctctataggggtgaagaaggaggatgccgcgggcgggaaggagaaggtactgtctcacaaaattcccgagcctgtacagagcgtcccagaggaggaaagccaccgggaatccgaggtccccaaggagaagatggctgacgaacagggagacatggatcttcagattagccccgaccgcaaaacctccacagatttctctgaagtcatcaagcaggaattggaagataatgacaagtaccaacagttcagactttctgaagaaactgaaaaggcgcagctgcaccttgatcaggtgcttacatctcccttcaacacaaccttccccctcgattacatgaaggacgagttcctgcccgcattgtctctgcaaagcggggcactcgacgggagctcggagagcctgaaaaatgagggagtggctggttccccttgcggcagcctcatggaaggcacacctcaaatcagtagcgaggaaagctacaaacacgaaggtttagccgagactcccgaaacctcacccgagtctttgagcttttctcccaagaagtccgaagaacagaccggagaaaccaaagagtccacaaaaaccgagactaccacagaaattagaagtgaaaaggaacaccccacgaccaaagacataaccggtggatccgaagagcgtggcgccactgtgacagaagacagcgaaacctccacagaatcctttcaaaaggaagcaactttggggagccctaaggacacttcaccgaaaaggcaggatgactgcacaggtagctgctcagttgcccttgctaaagaaaccccgactggcctaaccgaggaagccgcgtgcgacgagggccagaggacctttgggagcagtgcacacaagacgcagacagactccgaggttcaggaatctacagcaactagtgacgagacaaaggccctccctcttcctgaagcctccgtaaaaacggataccggtacagagtctaagccacaaggtgtgattagatctccccagggcctggagttggcccttccgagcagggactccgaagtgctcagtgccgttgccgacgactcccttgccgtaagccacaaggactccctagaggcttcccctgtgctcgaagacaatagttcccataagacaccggactcattagagccgtcaccactgaaagaatccccatgtcgcgacagtttagagtcgagccctgtggagcctaagatgaaagcaggaattttcccatctcactttcctctacccgccgctgtagcgaagacagaactcctgaccgaagtagcttcagtcagatcaagacttctgcgcgaccccgatggtagtgctgaggatgattccctcgaacagacttccctgatggagtcatccggaaaaagcccgctgagccctgacactccctcctccgaagaggtctcttacgaggtgactccgaagaccacagatgtatctacgcccaaacctgcagtgattcacgagtgtgccgaagaggatgatagcgaaaacggcgagaagaaacgctttacacctgaggaagagatgtttaaaatggtcactaagatcaagatgtttgacgaactggagcaggaggccaagcagaagagggactataaaaaagagcccaagcaagaggagagctccagttcaagcgatccggatgcagactgtagtgtcgatgtagacgaaccaaaacatacagggagcggagaggacgaatccggagtgccagtgctggtgacttccgaatcacggaaggtgtcaagcagttctgaaagcgagccggagctggcacagctgaagaagggcgcagactccggcttgctcccagaacctgtgattagggtccagcccccaagccctttgcctagctcaatggactctaactcctcacctgaagaagtgcagtttcaacctgtggtgtcaaaacagtacacgtttaagatgaatgaggatacacaggaagagccagggaaaagtgaggaggaaaaagactccgaatctcaccttgccgaagacagacatgctgtgtcaactgaagccgaggacaggtcttatgacaaactgaaccgagataccgaccaaccaaagatctgcgatggacatggatgcgaggcaatgtcacccagcagctcagcggcacctgttagcagcgggctgcagagtccaaccggggacgatgtggacgagcagcctgtgatatacaaggagtcgttggccttgcaaggcacacacgagaaagacacggagggagaagagctggacgtgtcacgggctgagtctccacaagccgactgcccatctgagagcttttcctcatcctccagcctaccgcattgcttggtcagtgaggggaaagagctagacgaggatatttcagccacctcaagcatacagaagacagaagtgacgaaaactgacgaaaccttcgaaaaccttcctaaagactgtccatcgcaggattccagtatcacaacccagacggatagattttccatggacgtgcccgtctcagatctcgcagaaaatgatgagatctacgaccctcagatcacttccccatatgagaatgtgcctagtcagagcttcttcagcagtgaagagtccaaaacccagaccgacgctaatcacacaactagttttcacagtagcgaggtttacagcgttaccataactagcccagtggaagatgtggtggtggccagtagttcgtctgggaccgtgctctctaaagagagcaacttcgaggggcaggatattaagatggaatcccagcaggagagcactctttgggaaatgcagtcagattcggtgtcttccagcttcgagcccacaatgtctgccactaccaccgtggtgggcgaacagatttccaaagtgattatcacaaagaccgacgtagatagtgattcctggtcagaaattagggaagatgatgaggcgtttgaagctagagtgaaagaggaggaacagaagatattcggactcatggtggaccggcaaagccagggcaccacccctgacacaaccccagcaagaaccccaacagaggagggcacaccaacaagcgaacagaacccattcctgtttcaggaaggcaaactgttcgaaatgacccggtccggtgcaatcgacatgaccaagcgatcctacgctgatgagtcttttcacttttttcaaattggtcaggagtcaagagaagagaccctctctgaagatgttaaagagggagctacaggggctgaccctctcccactggagactagtgccgagtctctggccctgtctgagtcaaaagaaacagttgacgacgaggccgatctcttacctgatgacgtgagcgaagaagtcgaggagattcctgcctcggacgcccagctgaacagtcaaatggggatcagtgcttccactgaaacccctactaaagaagccgtctcggtgggaacaaaagatctacccactgtgcaaacgggcgacattcctccgttgtcaggagtcaaacagatttcttgcccagacagctccgaaccagctgtacaggtacagctggattttagtactttaacgaggtctgtgtattctgaccggggggatgattcccccgattcaagccctgaggaacagaagtctgtgattgaaattccaacggcacccatggagaatgtgccatttaccgaaagtaaaagtaagatacctgtgaggactatgcccaccagtacacctgcccccccttccgctgagtatgaatcatccgtgtccgaagatttcctcagtagcgtcgacgaagagaataaggcagatgaagcaaagcccaagtcgaaattaccagttaaagtgccccttcagagagttgagcagcagctgtccgatttggacacttcggtccagaaaacagtggcccctcaagggcaggacatggctagcattgcccctgataatagatcaaaaagtgaatccgatgctagctccttggacagtaagaccaaatgcccggtcaaaacccggagttacaccgaaacggaaactgagtctcgtgagagagcagaggaacttgagctcgagtctgaggagggggccacccgacctaaaattctgacaagcagattacctgtcaaatctcgttctacaactagctcgtgccgcggaggtacctcgccaacaaaagaatcaaaagagcattttttcgatctctatcggaattctattgagttcttcgaggaaatttcagacgaggcgtcgaagcttgtggatagactcactcagtcagaacgcgagcaggaaatcgtgtcggacgacgagtcttccagtgccctggaggtatccgttattgagaatctcccccctgtcgagacagagcacagcgtaccggaggatatctttgatacacgccctatttgggacgagtctatcgagactctgattgagagaattccggatgaaaacggacacgatcatgctgaggatccacaggatgaacaggaacgtatcgaggagcgactcgcatatatagcggatcatcttggattcagctggaccgaactggcaagagaacttgactttacagaagaacagattcaccagatcaggatcgagaaccccaacagtctgcaggatcagtcccacgctctcttaaagtactggctggagagggatggtaagcatgccactgacactaatctggtagaatgtctcaccaaaatcaatcgcatggacatagtgcacctcatggagactaacaccgaacctctccaagagcgtatcagccactcttacgccgagatcgagcaaacaatcaccctagaccacagtgagggcttctctgtgttacaggaggagttgtgcactgcgcagcataaacagaaggaggagcaagccgtgagcaaagagtcagagacctgcgatcacccacccatcgtctcggaagaggatatttctgtagggtattcaacatttcaggacggcgtacccaaaacagagggagactcctctgcgaccgccctcttcccccagacacacaaggaacaggtgcagcaggacttttctgggaaaatgcaggatctgcctgaggaaagctccctggaatatcagcaggaatactttgtaaccactcccggcaccgagacctctgagacccaaaaagctatgattgtgccttcatctccgtctaagacccctgaggaagtgagcacacctgcagaggaggagaaactgtatctccaaacgcccaccagctccgaacgcggcgggtctcctatcattcaggagcccgaggagccgagtgagcacagggaggagtcttctcctcggaagacatccctggtcatcgtcgagagcgctgataaccagccagagacatgcgagcgtcttgatgaagacgcagcattcgaaaaaggcgacgacatgccagagatccccccagagaccgtgacggaagaggagtatatcgacgaacacggacacaccgtagtgaaaaaggttacaagaaagataatcaggaggtacgtgagcagtgaagggactgaaaaggaagaaattatggtacagggaatgccacaggaaccagttaacatagaagagggcgatggttatagcaaggtcatcaagagagtagtgctgaaatctgacacggaacagtcagaggacaacaatgagtag

SEQ ID NO: 108216 - DNA, 5619 bp, Artificial Sequence
  Description of Artificial Sequence: Synthetic coding sequence
atgatgaacgaagatgccgcacagaaaagtgacagcggagagaaattcaacggctctagccaaagacgtaagagaccaaagaagtcagattctaacgcctcatttctgagagccgcacgagctgggaatctggacaaggtggtcgagtatttgaaggggggtatcgatatcaacacttgcaatcagaatggcttaaacgctttgcatctggccgccaaagaaggccacgtaggcctcgttcaagaactgctgggccgcggctctagtgtggatagcgctactaaaaaggggaataccgccctacacatcgcctcattagcgggccaggccgaagtcgtgaaggttctagtgaaagaaggggcgaacattaacgctcagtcacagaatggttttacacccctctacatggctgcccaggaaaatcacatcgatgtggtaaaatatctcttggagaacggcgccaaccagtctacggccaccgaagacgggtttacccccctcgcagtggcgctgcagcagggccataatcaggctgtggcgatactgttagagaatgacacgaaagggaaagtgagactgccagctctgcacattgctgcacgaaaggatgatacgaaatcggccgcattactgcttcaaaatgaccacaatgcggacgtgcagagtaagatgatggtgaatcgcacaactgagagtgggttcacccctctgcatatagcagcacactatggaaacgtcaacgtggccaccctgctgctgaacagaggggcagccgtagatttcaccgcccgtaacggcatcacacctctgcacgtagctagcaagagagggaatacgaatatggttaagttgcttctcgatcggggcggacagattgatgccaagacccgtgatggacttacaccgctccactgcgccgcccgatcaggtcatgaccaggttgtggagctgctactggagcgcggtgctcccctgttggcaagaactaagaatggactgtctcccctgcacatggccgcccagggagaccatgtggaatgtgtgaaacacctgctgcagcataaggcgcctgttgatgatgtcacactggactacctcaccgcactgcacgtggcggcccactgtggacactaccgagtgactaaactcctgctggacaagagagccaatccaaatgcccgagccctgaacgggttcacccctcttcacatcgcttgtaagaagaacagaataaaggtcatggagcttctggtgaaatacggagcttccatccaggccataacagaatctggactgacccccatccacgtggcagcttttatgggacacctgaacatcgttctccttcttttgcaaaatggggcctccccggacgtcactaatatccgcggagaaaccgcgctgcacatggccgcccgggccggccaagtcgaggtggtgcgctgtctcttgagaaatggagcgctggtggacgcccgagcaagagaggaacagacaccgctgcatattgcctctcgtctgggaaagaccgagatcgtccagttgttattgcagcacatggcacacccggatgcagccacaaccaacggatacaccccattgcatatttcagcacgggaagggcaggtggacgtcgccagtgttctcctcgaggctggagccgcgcattctctggcaacgaagaagggcttcactcctttgcacgttgcggccaaatacggcagcttggatgtcgcgaagctgctgttgcagagaagggcagcagccgactctgcaggtaagaatggcctcaccccccttcatgtagccgcccactacgacaaccaaaaggtagccctgctgctgttggaaaagggcgcatctccccatgccacggccaagaatggctacaccccactgcacatcgctgcaaaaaagaatcagatgcagattgcctcgactttgctcaactacggagctgagactaatattgttaccaaacagggagtaacgcctctccatctggcctcacaagagggacacacagatatggtgactctgctactggataaaggtgcaaatatccatatgtccactaaatctggactgactagtctacacctcgcagcccaggaagataaggtcaatgtcgctgacattctcactaagcacggtgcagatcaggatgcgcacactaaactgggatatacgccactgattgtggcctgccactatgggaacgtgaaaatggtcaactttctcctcaagcagggagcgaatgtgaacgccaaaactaaaaatggatatacaccactgcaccaggccgcccagcaaggacacacacacattatcaatgtgctgttacagcatggagctaaaccaaacgcaacaaccgctaatggcaacactgcccttgcaatcgccaaaaggctcggttatatctctgttgtggacacactcaaagtagtgacagaagaagtgaccacgaccactactaccataaccgaaaagcataaattaaatgtacccgagacaatgacagaggtgctcgatgtatcagacgaagagggagacgatactatgacaggcgacgggggcgaatacctgcggccagaggacctgaaggagttgggagacgattcactgccatcaagtcagtttctggatgggatgaactaccttcggtacagtttggaggggggacgctccgacagccttcgtagtttctcttccgaccgttcacataccctaagtcacgcttcctatctgagagatagcgcagtgatggacgacagcgttgtcatccctagccaccaagttagtacactggccaaggaggcagagcgaaattcatatcggctatcttgggggaccgaaaatctggacaatgtggccttgtcttccagtccaatccactctggattccttgttagctttatggtggacgccaggggtggagccatgcgcggatgtcgtcacaacggactgcgaattatcatacctcctcgcaaatgtactgcccccacacgcgtgacatgcaggttggtgaagaggcacagactcgccaccatgcctccgatggtcgagggcgaaggactcgctagtcgcttgatcgaggtgggtccttccggcgctcagtttctagggaagctccatctgcctacagcccccccaccactcaacgaaggcgagtcactcgtgagccgaattttgcagctgggaccccctggtactaaattcctcggccctgtgatcgtcgaaattccgcacttcgctgcactgcgcggtaaagagcgggagctagtcgtgctccggtcagagaacggcgattcatggaaagagcatttttgtgattataccgaagatgaactgaatgaaatactgaacggcatggacgaggtgctggacagccccgaagatcttgaaaaaaaacggatctgtagaataatcactagagattttccccagtacttcgctgtggtgtcccggataaaacaggactcaaatctgatcgggcctgaagggggcgttttgtcatccacggtagtgccacaagtccaggccgtcttccctgaaggtgccttaaccaagaggatccgcgtgggcctgcaggctcaacccatgcacagtgaacttgttaagaagattctgggcaataaggccacctttagcccaatcgtcactctggaaccgcgccggcggaaatttcataaaccaatcacaatgaccatccctgtacccaaggcgtcttctgacgtgatgctcaacgggttcggtggggacgcccctacgttgcgcctactctgtagcataacaggtggcacaacccctgcccaatgggaggacatcacaggcaccacaccgttgacttttgtaaatgaatgtgtctcgttcacgacaaatgtgagcgcgaggttctggctgattgattgtcgccaaattcaggaaagtgtgacatttgcgtctcaagtgtacagagaaatcatctgcgtcccctatatggccaagttcgtggttttcgcgaaatctcacgatccgatcgaggctcggctcaggtgcttttgtatgactgacgacaaggtggacaagacactggagcagcaggaaaattttgctgaagtggcaaggtccagggacgtggaggtgctggaagggaaacctatctatgtggactgcttcggcaatttagtcccattaactaaaagcggacagcatcatattttcagtttttttgcgttcaaagagaatcgtctccctctcttcgtgaaggtcagagacaccactcaggagccctgtgggcgtctctcttttatgaaagaacccaaatccacccgggggctggttcaccaggccatatgtaacctgaacatcacattgcctatttatacaaaagagtccgagtctgatcaggaacaggaagaggagatcgacatgacttcggaaaaaaacccacaggatgagcaggaacggatagaagaaaggctagcctacatcgccgatcatctgggcttcagctggactgagctggctagagagctggattttaccgaagagcagattcaccagatcaggatcgagaatcccaacagtctccaggatcagagccatgccttgctcaagtactggctggaaagagacggaaagcatgccacagacaccaacctcgtcgagtgcctgaccaaaataaacaggatggatatcgtgcaccttatggaaacaaacacagaacctcttcaagaaagaatttcccattcctacgccgaaatcgaacagactattacactggatcattctgaaggattcagcgtcctccaggaggagctgtgcaccgcacagcacaagcaaaaagaggagcaggccgtgagcaaggagagcgaaacatgcgatcacccaccgatagtctccgaggaggacatcagtgtgggttacagtactttccaggacggagtgcctaagactgagggtgactcttctgctaccgcgttgttccctcagacacataaagagcaggtccaacaagacttttcaggaaagatgcaggacctgcccgaggaaagcagcctcgaataccagcaggaatattttgtgactacacctgggactgaaacctcggagacccagaaggcaatgatcgttcctagcagcccatctaaaacacctgaagaggtctctacccccgctgaggaggagaagctctatctgcagacccccacctcatcagagaggggcggttctcctatcatccaggagccagaggaaccttcagagcaccgggaagagtcttccccccgaaagaccagcttagtcatcgtggagtccgcagacaaccaaccagaaacatgtgagaggcttgacgaggatgccgcattcgagaagggcgacgacatgcctgagatccccccagagacagtaactgaagaagagtacattgatgagcacggacacacagtcgtcaagaaggtgactcgcaagattatacggcgctacgtgtcctcagagggcactgagaaagaggagataatggtccagggtatgccgcaagagccggtgaatattgaagaaggcgacggctattcaaaagtgatcaagcgggtcgtgttgaagagtgacacagagcagagcgaggataataatgagtag

SEQ ID NO: 108217 - DNA, 2988 bp, Artificial Sequence
  Description of Artificial Sequence: Synthetic coding sequence
atggacgattccgtagtgattccatcccaccaagtgtcaacgctggcgaaggaggctgagcgcaacagttatagactttcctggggaacggaaaacctggacaatgtggcattgtcttcttcccccatccattcggggtttctcgtgagtttcatggtggatgcaagaggcggggccatgaggggctgtagacataacggcctgaggattatcattcctcctagaaaatgtaccgccccaacaagggttacttgtagactcgtgaagaggcaccgcctggctactatgcctccgatggtggaaggagaaggactggcctctcgcctcatcgaagttggcccttcgggcgctcagtttctgggccctgtcatcgtggagatcccccacttcgcagctcttagaggaaaggaacgagaacttgtggtgctcaggtctgaaaacggagattcgtggaaggaacacttctgcgattatacggaggacgagctgaatgaaatcctcaatggcatggacgaggtccttgattccccggaggatttggaaaaaaaacgaatttgtagaatcataacccgcgacttcccacagtattttgcggttgtatcgaggatcaagcaggattccaacttgattggacctgaaggtggcgtgctgtcgtccaccgtcgtcccccaggttcaggccgtctttccggaaggggcattgacgaagcgaatccgggtgggcctgcaggcacagcccatgcactctgagctagtgaaaaagatcctcgggaataaggcaacctttagccctatcgtcacactcgaaccaaggaggcgtaaattccataagcccattactatgactatcccagtgcccaaagcaagctcagatgttatgttaaacgggttcgggggagatgctcccaccctcaggttactttgcagcattacagggggaaccacaccagcacaatgggaggacataactgggaccacgcccttgacttttgtgaacgagtgcgtgtccttcacgaccaatgtaagcgcaagattttggctgattgattgccgccagatccaggagtcagttacttttgcgagccaggtctacagggaaattatctgtgttccctatatggccaagtttgtggtttttgcgaagagccatgatccaattgaagccagactgcgttgtttctgcatgaccgacgacaaggtggataaaaccctggagcagcaagagaactttgcagaggtggcccggtccagggatgtagaagttttggagggaaagcccatttatgtggattgttttggtaatctcgtacccctcacgaagtccggacagcaccacatcttttcgttttttgcgtttaaggaaaaccgactccctctatttgtaaaggtgcgggataccactcaagaaccgtgcgggcgccttagtttcatgaaggagcccaagtcaactagaggcttggtgcaccaggctatttgcaatctgaacatcaccctgcctatctacaccaaaactgaaacaaccactgagattcatccacaggatgagcaggagcggattgaagaaagacttgcctacatagcagatcatttgggttttagctggactgagctggcacgggaactcgattttacagaggagcaaattcatcagatccgtatagagaatcccaattccctgcaggatcagagccatgccctactgaagtattggctcgagcgagacggaaaacatgctacagatacaaacctcgtggagtgtctgactaagattaataggatggatatcgtgcatcttatggaaactaatacagagccactgcaggagcgcattagccatagttatgctgagatcgagcaaaccattacactggaccattcagagggcttctccgttctgcaggaagaactgtgtacagcccagcacaaacagaaggaggagcaggccgtgtctaaagaatcagagacatgtgatcaccccccaattgtttcagaggaagatatatccgtcggatattctaccttccaggacggcgttcctaagaccgagggcgactccagtgccaccgctctgttccctcagacccacaaggaacaggtccaacaggatttttctggaaagatgcaggatctccctgaggagagctctctggaatatcaacaagaatacttcgtgactacaccgggtactgaaacttctgagacacagaaagccatgatcgtgccgagcagcccttcgaagaccccagaagaggtgtctacacctgcagaagaggagaaattatacctgcagacacctacatcgagcgagaggggagggagcccaatcatccaagagcctgaagagccttcagagcaccgggaggagtcaagcccgcgcaagaccagcttggtgatcgtagaatccgcagataaccagcccgaaacctgtgaaaggctcgatgaggatgcagctttcgagaaggagctcaccgaagaattaggcgagctcgaagcctccagcgatgaagaagcaatggtgacaacccgagtcgtccgccgtcgcgtgatcatacagggagatgatatgcctgaaattcccccagagactgtgacagaggaagagtatattgacgagcacggtcacaccgtggttaagaaggtgactagaaaaattatacggcggtatgttagctccgagggaacagagaaggaggagataatggtccagggcatgccacaggagcccgtgaatattgaagagggcgacggttattccaaggtaattaaacgagttgttctcaagtctgacaccgagcagagcgaggtgaccctgtgcgaaccctctatcctctccagtacttcacagttccaggccgagcctgtggagggaaggcgggtgtccaaggttgttaagaccaccgtggtcctgggcgagagaatggagaagcatctgggggatagttccttagcgactgaccttcctagcgctaaagatgacttcgaggagtag

SEQ ID NO: 108218 - DNA, 3345 bp, Artificial Sequence
  Description of Artificial Sequence: Synthetic coding sequence
atgaccaccatgttgcagaagtccgacagtaacgcgtccttcctgcgggcggccagagccggaaatctggacaaggtggtggagtaccttaaggggggcatcgacattaatacctgcaatcagaacggtctgaacgctttacatctcgctgctaaggagggacacgtcgggctcgtgcaggagcttcttggcaggggctcaagcgtggactctgctacaaagaagggcaatactgcactgcacatagcttccctggctggccaagccgaggttgtgaaggtcttagtcaaagaaggcgccaacattaatgcgcagtcacaaaacggttttacccccctttatatggctgcacaggagaatcacattgatgtagtgaaatacttgcttgaaaacggcgcaaaccaatctaccgccacagaggatgggtttactcctctcgcagtcgctctgcagcagggccacaatcaggcggttgcaatcttgctcgagaacgacacaaaaggaaaagttcggctcccagctctgcacatagcagcccgaaaagacgacaccaaaagcgcggcactacttttgcagaatgaccataacgcagacgtccagagcaaaatgatggtgaatcgaaccaccgaaagcggcttcactcccctgcacatcgccgcccattacggtaacgtgaacgttgcgacacttctactcaaccgaggcgctgctgtggatttcaccgctcgcaacggaatcacacccctgcacgtcgccagcaagaggggcaacacaaacatggtgaagttgctgctggacagggggggtcaaatagacgcgaaaactagggacgggctaactccgttacactgcgccgctaggagcgggcacgatcaagtggtggagctgcttcttgaaaggggtgcccccctgctggcccggaccaagaatgggctgtcccctctacatatggctgctcagggggaccacgtcgagtgtgtaaagcacttactgcaacacaaagcccccgttgacgacgttacgctggattacttgaccgccctccatgtggccgctcactgcggacactatagggttaccaaattgttactggacaaacgggcaaacccgaacgccagggctctgaacggcttcaccccactccacatcgcttgcaagaaaaacagaattaaagtgatggagttacttgttaaatacggagcctcgattcaagctataaccgaatcaggcctgacccctatccatgtggccgcttttatgggccatctgaacatagtgctgttattgcttcagaatggagcttctcctgacgtgaccaacattcgcggcgaaactgcgcttcatatggccgcaagagcaggccaggtagaggtggtgcgatgtctcctgagaaacggcgccctggtcgatgcgagagcccgggaggaacagacgcccctgcatattgcctcgcgccttggtaagacagagatcgtgcagctgctactgcaacatatggcacacccagacgcggccactaccaatggctacaccccccttcacatttccgcccgggagggtcaggttgatgtagcgtccgtcttgctggaggccggtgcggctcattcgctggctaccaagaaaggctttacacccctccatgtcgctgccaaatacggctccctcgatgttgctaagctgttactgcagcgtagagccgccgcggacagtgctggtaagaacggcctgactcctctacatgttgcggcacattatgacaatcaaaaggtcgctttgttgctactcgaaaaaggggccagtcctcatgcgaccgcgaaaaacggctatacccctctccacatagcagctaaaaagaatcagatgcagatcgcaagcactctgcttaactacggtgcagagactaatatagtcactaagcagggcgtaacgcccctccacttagcaagccaggagggacacacagatatggtaacccttttgctagacaaaggcgctaatatacacatgtccacaaaatccgggctcacatcactgcacttagccgcccaggaggacaaagttaatgtggccgatatcctgacaaaacatggggctgatcaggacgcacacaccaagctggggtatacgcccttgatcgtggcttgtcattacggcaatgtgaaaatggtgaactttctgctcaagcagggtgctaacgtcaatgctaagacaaaaaatgggtacactcctctgcatcaggcagcacagcaaggccacacccacatcattaacgtgctcctccaacatggcgccaagccaaatgctactaccgcaaacgggaacaccgcactggcaattgccaagcggctcggatatataagcgtcgttgacacactgaaggtcgtcactgaagaggtgaccacgactacaacaacaattactgaaaagcataaactcaatgtcccggaaactatgacagaggtgttggacgtctcagacgaagagggcgatgacaccatgaccggggacggcggtgagtacttacgaccagaggacctgaaagaacttggtgacgattccctgccttcatcccagttcctagacggcatgaactatcttaggtactcactggagggtggacgaagcgatagcctaaggtccttttccagcgataggagtcataccctgtcccatgcttcatacctccgcgattccgccgtgatggatgactctgtggtgattccctctcaccaggtcagtactctggctaaggaagcagaacgtaatagctaccggctgagttgggggaccgaaaacttggataacgtcgcgcttagctctagtcctattcactctggctttcttgtgagtttcatggtcgatgctagaggaggcgcaatgcgaggatgccggcacaatggactgcgtatcataattcctccgaggaagtgcacagctccgacgcgcgtcacttgtagactggttaagcggcatcggttggcaacaatgccacctatggttgagggggaaggacttgcatcgcggctgatcgaggtgggtccatcgggggcacagtttctagggaagttgcacctccccaccgcccctcctccgctcaatgagggggaatctctggtaagccgtattctgcaactcgggccgccaggcacaaagtttctaggccccgtaatagtggaaattccccacttcgccgcccttcgaggcaaagaacgcgagctggttgttctccgctctgaaaatggagattcctggaaggagcatttctgtgactatacggaagatgagctgaatgagattctcaatggaatggatgaggtcctggacagccctgaagacctggagtag

SEQ ID NO: 108219 - DNA, 5193 bp, Artificial Sequence
  Description of Artificial Sequence: Synthetic coding sequence
atgatgaacgaagacgcagcccagaaaagcgattcgggagaaaagtttaatggtagtagccagcggaggaagcgcccaaaaaaagtgacttgcccgcagatgaaacccgaagctgctaatatcgaaaaatcagattcgaacgcgagcttcttacgtgccgccagagccgggaaccttgataaagttgtggagtacctgaagggcgggatcgacatcaatacctgcaaccaaaatgggctaaacgccctccacctggctgccaaggagggtcatgtaggactggtgcaagagctgttgggcagggggagctccgtcgactccgccacgaagaaaggcaacactgctctgcatattgcgtccctcgccgggcaggccgaggtcgtgaaagttctggtaaaggagggtgccaacattaacgcacaaagtcagaacggctttacacccttgtacatggccgcgcaggagaaccatattgatgtggtgaaataccttctcgagaacggtgccaaccaaagcaccgctacagaagatggctttactcccctagccgtggccctccaacaaggccataatcaagcagttgctatcctcctcgagaatgacactaaaggtaaagttcgccttccagccctccacattgccgcccgaaaggatgatacgaaatcagccgccctcttgctgcagaatgaccacaatgccgatgtgcaatctaagatgatggttaataggacaacagaaagtgggttcaccccacttcacattgccgcacattatgggaacgtgaacgtggctaccctcttgttgaatcgaggcgcagctgtggacttcaccgcccggaatgggatcacccctcttcatgtcgcatcgaagcggggtaataccaatatggtaaagctgctgctggatcgaggagggcagattgacgcaaagactcgtgacggcttaacacctcttcattgcgccgcaaggtccgggcacgatcaagtcgttgagctattactggaacggggggccccactcctggcaagaactaagaacggtctgtcccccctgcacatggctgcccagggagaccacgtggagtgcgtaaaacatcttctgcagcataaggccccagttgatgatgttacgctggactatttgaccgcccttcacgtagctgcgcattgtggtcactatcgggtcaccaaattgctgctagacaaaagagctaatcctaatgcccgggcattgaacggctttacacctctccacattgcctgtaagaaaaatcgcattaaggtgatggaactcctcgtcaagtatggcgccagtattcaggctattacggagtcaggcctgacgcctattcacgttgcagccttcatggggcacctgaatattgtactcttgttactgcagaatggcgcctctccagacgtgaccaatatacggggagagacggcactccacatggccgcaagagctggccaggtggaggtggtcaggtgcctgctgcggaatggcgccctagtcgacgctagagcacgggaagagcagacgcccctgcatatcgcttcaaggctcggcaagacggagatagtccagcttcttttgcagcatatggctcatcccgacgccgcaacaacaaacggatacactcctctccacatcagtgcgcgcgagggacaggtggacgttgcgtccgtgctactggaagcgggtgccgctcactccctggctaccaagaaggggtttactcctctgcacgtagctgccaagtatggatcacttgatgtcgcgaaactgttactgcagcgccgggccgccgcagattcagctggaaaaaatggactcactcccctccatgtggcggctcattatgataaccagaaagtggctctgttacttttggagaagggggctagccctcacgcaactgcgaaaaatgggtatactccattgcacatcgcagccaagaaaaatcaaatgcagatcgcatccaccttactgaactatggtgctgagacaaatatagtgacaaagcagggagtaacaccgctacacttggcttcacaagagggacataccgatatggttactctcctgttagataaaggagccaacattcacatgtcaaccaagtcgggacttacttcattacacttggccgctcaagaggacaaggtgaatgtcgctgatatcctgaccaagcatggtgctgatcaggatgctcacacaaagctaggttacacgcctttgattgtagcatgtcattatgggaatgtgaagatggtgaacttcctgcttaagcaaggggccaacgttaacgccaagacaaagaatggttatacccccctgcatcaagcagctcagcagggacacacccacatcataaacgttcttctccagcacggagccaaaccaaatgctactactgccaatggaaacacggccttagccatcgccaaacggctgggctatatctcagttgtagatactttgaaagtggtcactgaggaagtgacgactacaacgacgactattacagagaagcataagcttaatgtgcccgagactatgactgaagtgctcgatgtctccgatgaagagggcgatgatactatgacgggggacgggggagaatatctgcggcctgaggatctcaaagaattgggtgacgactcattaccatcttctcaattcctggatggcatgaattatctgaggtactctctggaaggaggccgtagcgacagtctgaggtccttctcgtccgacagaagccacacattatcacacgcctcatacctccgggattccgcagtcatggatgattcagttgtgattccttcccaccaggtatcaaccttagccaaggaagcggaacggaatagctaccgacttagttggggtaccgaaaatttggataatgtggcgcttagctcttcaccgatccacagcggcttcttggtgtcttttatggtcgacgctcgcggtggagcaatgagaggctgtcgtcacaacggacttcggatcattattcccccacgcaagtgcactgccccaacaagggtgacttgtaggttagtaaagcgacataggctggccactatgcctccaatggtggagggcgaaggtctggcttcccgactcatagaagttgggccctctggtgctcagttccttggaaaactgcacctgcccacggcacccccaccgctcaatgagggcgagtctttggtcagtcggattctgcagttaggccccccaggcacaaaattcctgggccctgtgatcgtcgagatcccacacttcgctgcgcttcgaggtaaagagagggagttggtagtgttgcgatcagagaacggcgattcttggaaagaacatttctgcgattatacagaagatgagttgaatgaaattcttaatggtatggatgaggtccttgacagtcctgaggacctcgaaaagaaacggatctgtaggataatcactagagacttcccccagtacttcgccgtagtatccaggatcaagcaggactccaacctcatcggccctgaggggggcgtactgagctctacagtcgttcctcaggtccaggctgtcttccccgagggggctctgaccaaacgcatcagggtcggtctgcaggcccagcccatgcactctgaactggtaaagaaaatcttggggaataaggcgacattttctccaatcgtgacactggagccccggcggagaaaattccataagccgatcaccatgacaatacccgtcccaaaggcttcatctgacgtcatgttaaatggcttcggaggtgacgcccctactctgcggctgttatgtagcattacaggtgggacaacacccgctcagtgggaggacattaccggcaccacgcctctgacattcgtgaacgaatgcgtttctttcacaacgaatgttagcgccaggttttggttaatcgattgcagacaaatccaggaatccgtgaccttcgcctcacaagtataccgtgagatcatttgcgtgccatacatggctaagttcgtggtgtttgctaaatctcacgaccccatcgaagcccgtttacggtgtttctgtatgacagacgacaaagttgataagacccttgaacagcaggagaatttcgcggaggtggctaggtcgagggatgtagaagtccttgaaggcaagccaatttacgtggactgtttcggcaacctggttcccttgaccaagtccggtcagcaccacattttctcgttctttgcttttaaggagaatcgcctgccattgttcgtaaaagtcagagatacaactcaggagccatgcggcaggttatctttcatgaaggagccaaaaagtacgaggggccttgtgcatcaggccatttgtaacctcaatattacgctgcccatttacaccaaggagtccgaatccgatcaagagcaggaggaggaaatagatatgacttccgagaagaacgacgagacagaaagcacggagacaagcgtgctaaagtctcacctggtgaacgaagttcccgtcttggcgagccctgacctactctcagaagtcagcgagatgaaacaggatttgataaagatgaccgccatcctgaccacagacgtgtctgataaggccggcagcattaaagtcaaagagttggtgaaggccgccgaggaagagcccggtgagccgtttgagatcgttgagagggtgaaggaggatctggagaaagtgaatgagatcctgcgcagcggcacctgcacaagggatgaaagctctgtgcagtcctcccgatcagagagaggcttggtcgaagaagaatgggtcattgtgagtgacgaagagattgaggaggcacgacagaaggcgcccctggagatcacagagtacccatgcgtggaggtgcggattgataaggagataaaggggaaagtcgaaaaggattccaccggcctggttaactacctgactgatgacctgaacacctgtgtcccactgccgaaagagcaactccaaaccgtacaggacaaggccgggaagaaatgtgaagcgctggcagtcggccgcagtagcgagaaggagggaaaagatattccaccagacgaaacccagagcacccagaaacagcataaaccctctctggggataaaaaaaccagtgagaagaaaactaaaagagaaacagaaacagaaatag

SEQ ID NO: 108220 - DNA, 5592 bp, Artificial Sequence
  Description of Artificial Sequence: Synthetic coding sequence
atgaccacaatgctgcagaaatcggactcgaatgcaagttttcttcgcgccgcacgggcgggtaatctggataaagtagttgagtacctcaaagggggaatcgatattaacacatgcaatcagaacggcctaaatgcattacatttggccgcgaaggagggtcatgtgggcctagtccaggaactgctgggtaggggatcatcagtggacagcgccaccaagaaaggaaataccgccctccacatcgcctcactcgccggccaggcggaggtagttaaagtgctcgtaaaggaaggagccaacatcaacgcccaaagccagaatggcttcacccctctgtatatggccgcccaggaaaatcacattgatgtggtaaagtatcttctggagaacggcgctaaccagagtacggcgacggaagacgggtttacaccattagctgtggcactacaacagggtcacaatcaggctgtggccatcctattagagaacgatacaaagggcaaagtgagactcccagcactgcatatagccgcccggaaggacgacaccaagtccgccgccctactgttacagaacgatcataacgctgacgtacagtccaagatgatggtaaacagaacaaccgagagcggtttcacccctctacatatcgccgcccattatggaaatgttaacgtggcaacgctacttttgaataggggcgcggctgtagattttactgcacgaaatggtattacgcccctgcatgtggcctcaaagagggggaatactaacatggtgaagctcctgttggatcggggcggacagatcgacgctaagacgagggatgggctcacccctttgcattgcgccgcgcgctctggccacgaccaggttgttgaattgctgctcgaacgcggcgctccactccttgcccggaccaagaatggactgtctccattgcatatggctgcgcaaggggaccacgttgagtgcgtcaagcacctgctccagcacaaagccccagtagatgatgtgacattggactatttaactgcactgcatgtagcagctcactgtggccattatcgcgtcacaaaattgctcttggacaagagggccaaccccaatgcacgcgcacttaacggctttacccccttgcatatcgcttgtaagaagaatcgcataaaagtgatggaactcctagttaagtacggcgcttctatccaggctataacagaatccggtcttacccctattcatgtcgccgcctttatgggccacctaaacattgtgttactcttgttacagaatggcgccagtcccgatgtgacaaacattagaggcgaaactgctttgcatatggcagctcgggcaggacaagtcgaagtggtccgttgtttgctcaggaacggcgcgctggtggacgctagggcacgtgaggaacagaccccccttcatatcgctagtagactcggaaaaacagaaatcgtgcagttgctgttacaacacatggcacacccagacgccgccaccacaaatgggtacactcccttgcacatctcggccagggaggggcaggtggacgttgccagcgtgcttctggaggctggcgccgctcatagtctcgctacaaaaaaaggttttactcccctgcacgtggccgccaaatatggcagcctagacgtggccaaactgcttttgcagaggcgtgctgccgccgactctgcaggcaaaaacggcctcacaccactccacgttgccgcccactacgataatcaaaaggttgctctgctcttgttagagaagggtgcttccccacacgcaaccgctaagaacgggtatacaccgctgcatatcgctgctaagaagaatcagatgcagattgctagcaccctcttgaattacggcgctgaaacgaatatagttaccaagcagggcgtgacacctctgcatttagcttcgcaggagggccacacagacatggttactctgctgctagacaaaggtgccaacatccatatgagcactaagtctggtttgacctcccttcacctggctgcacaggaagacaaggtaaatgtggccgatatcttgacaaagcatggcgccgaccaggatgctcacaccaagctgggctacacacctctcattgttgcctgtcactacggtaatgttaagatggtgaacttcctcttgaagcaaggggccaacgtaaacgccaagaccaagaacggatacacacccctgcaccaggctgcccagcaggggcatacacacattatcaatgtgctcctccaacacggcgcaaagcctaacgccaccactgccaacgggaataccgcgctggcgatagctaaacgactgggctatatcagtgtggtggacaccttaaaggtggtcaccgaagaggtgacaactactacaactaccatcaccgagaaacataaactaaacgtccccgaaactatgactgaagttcttgatgtctctgatgaggagggtgatgacactatgacaggcgacggaggcgaatacctgaggccggaagacctgaaggagctgggagatgactcattgccttcaagtcaattcctggacggcatgaattacctccggtactctttggagggcggcaggtccgactcgctgaggtcattttcaagcgatcgcagtcacaccctgtcgcatgcttcttacctgagagacagcgcagtgatggacgatagcgttgtcattccctcacatcaggtgtcgacgctggctaaagaggctgaacgtaacagctatcgactatcttggggcacagagaacttggacaatgtggccctgagttcttcaccaatccattcaggcagggcctctccatgtctggagagggacaactcgtcttttctagtgtcgttcatggtggacgctagagggggagccatgaggggctgcaggcataatgggctgcggattattattccgcctcgtaaatgcactgcccccacccgtgtgacgtgtagactggtgaaacggcataggcttgccaccatgccgccaatggttgagggagagggcctcgccagcagactaatcgaggttgggccaagcggggcccagttccttggtaagttgcacctcccaacagcgccaccccctctgaatgaaggggagtccctcgtttcacgcatactgcagctgggacccccgggcactaagtttctggggcctgtaattgtggaaattcctcatttcgcagccctgaggggaaaggagcgcgaactcgtggtacttaggagtgagaatggagactcttggaaagagcacttttgcgattacaccgaggacgagttaaacgagatcttaaatggcatggatgaggttctggattcacccgaggacctggaaaaaaagagaatatgcaggataatcacaagagactttcctcagtattttgccgtggttagcagaattaagcaagatagcaatctgattggccctgaggggggtgttctgtccagtactgtggtacctcaagttcaagccgtgtttcctgagggggcactgaccaagcgcatcagagtgggtctgcaggcccagccgatgcacagtgagctcgtgaagaaaattcttgggaataaagcgaccttctccccaattgtcaccctagagcctaggcggcgcaaattccacaagcccataacaatgaccatccccgtgccaaaggcatcttccgatgtaatgcttaatggttttggcggggatgcaccgactcttcggctgctgtgctctatcacaggtgggacaaccccagcccagtgggaagatattaccggaacaaccccactgacatttgtcaatgagtgtgtgtcatttactaccaacgtttccgctagattctggttgattgattgccgacagattcaggagagtgtgaccttcgcctcgcaggtgtatcgagagatcatctgcgtcccctacatggcaaaattcgttgtctttgcgaagtctcacgatcccatcgaggccaggcttaggtgcttctgcatgaccgatgacaaagtggacaaaacactagagcaacaggagaattttgccgaagttgctcgatcaagggatgtcgaagtgcttgaaggtaagcccatctatgtagattgcttcggcaacctagtgccgttgacgaaatccgggcagcatcatatattctcctttttcgcattcaaagagaaccgtcttcctctgtttgttaaagtgcgggatacaactcaggagccatgtggtaggcttagcttcatgaaagaaccaaagagcacaagggggttggttcaccaggctatctgcaacctgaacatcactctgccaatctacacaaaggagtctgaatccgatcaggagcaagaggaggaaattgatatgaccagtgagaagaacccccaggacgaacaagaaaggatagaagagagactggcgtatatcgctgaccaccttggtttcagctggacggaattggcacgggaattggactttaccgaggagcagatacaccaaattagaattgagaacccaaattctcttcaggatcagtcccatgccctacttaagtattggcttgagagagatggaaaacacgcgacagatactaacttggtagaatgccttactaagattaatcgtatggatatcgttcacctcatggagactaatacagaaccacttcaagaaaggatttcgcacagttacgcggaaattgagcaaacaatcacattagaccacagcgagggtttctcagtgctgcaggaagaattgtgtactgcacagcacaaacagaaggaagagcaggcagtgtcaaaggaaagcgagacctgcgaccatccacccatcgtgtctgaagaagacatcagtgtgggctactcgacgtttcaggatggcgtgcccaagacagagggcgattccagcgccactgctttgttcccacaaactcacaaggaacaagtgcagcaggacttctctgggaaaatgcaggaccttcccgaggagtcaagcctggagtaccagcaagaatactttgtaaccaccccaggcacagagacgtctgaaacccagaaggctatgatcgtgccctcctcacccagcaagacacccgaagaagttagcacgcctgccgaggaagaaaaactgtacctccaaacccccacaagtagcgagcgcggcggatctcccataattcaggaaccggaagagccgagcgaacaccgcgaagagagctccccccgcaagacatctcttgtcatcgtcgagtctgccgataaccagccagaaacatgcgaacgactcgacgaggatgccgcattcgaaaaaggggatgacatgccagaaataccgccagagactgtgacggaggaagagtacattgatgagcatggccacactgttgttaagaaggtgacacgcaaaatcatcaggaggtacgtgagctcagaaggaaccgagaaagaggagatcatggtccaggggatgccgcaagaacccgtcaacatagaagagggggacggatactcgaaggttattaagcgagtagtcttaaagtccgacacggaacaatcagaagacaacaacgaatag

SEQ ID NO: 108221 - DNA, 5586 bp, Artificial Sequence
  Description of Artificial Sequence: Synthetic coding sequence
atggcctctagcgccagttcatcccccgccggaacagaggactcggcccctgcacaggggggcttcgggtcagactactctcggagctcgcggaaatcagacgcaaacgcttcatatctgagagccgcccgggctggccaccttgagaaagcccttgactacataaagaacggagtggatatcaatatttgcaatcaaaacggattaaacgctctccacttagcatccaaagagggccatgtcgaggtggtctctgagctgctgcaacgcgaggctaatgtggatgctgccactaaaaaaggaaacactgccttacacatagcaagtctggctggtcaggccgaagtggtgaaagtcctcgtaaccaatggcgctaatgtgaacgcccaatcacaaaacggatttacaccgctgtatatggccgcacaagaaaaccacctggaagtcgttaagtttctgctggataacggcgcctcccaaagcctagcgaccgaggatgggttcacgccactggctgtcgccctgcaacagggccacgatcaagtcgtgtcgcttctgctggagaacgatactaagggaaaagtgcggcttcccgccttgcacatagccgcccgcaaggacgatactaaagccgcagccctgctactgcagaacgataacaacgcagacgtggagtcgaagtctggatttaccccactccacatcgccgctcactacgggaatatcaacgtagcaacattgctgctcaatagagccgccgctgttgatttcacagccaggaacgacataacacccctgcatgttgcttccaagaggggtaatgccaacatggttaagcttcttctcgaccggggagctaaaatagatgcaaaaaccagagatggcctcaccccgctgcactgcggtgcacgctccgggcacgagcaggtggtagagatgctgctcgaccgcgccgctcccattctcagcaaaacaaagaacggcctctctccattacatatggccacccagggcgatcacctgaattgtgtgcagctgctgttacagcataacgtgccagtggacgatgttaccaacgactaccttacagccctgcatgttgcagcccattgcggtcattataaagtagcaaaggttctattagataagaaagccaatcctaacgctaaggcgctgaatggctttacccctctgcacattgcatgcaaaaagaaccggatcaaagtcatggaactgctgcttaaacatggcgcatcaatccaggccgttacagagtctggtctcacccctatccacgtggccgcgttcatgggccatgtgaacatcgtgagtcaactgatgcaccacggcgctagcccgaacaccacgaacgtcagaggagagacagcgttgcatatggcagcccgcagcggccaggctgaggtggttaggtatctagtccaggatggggcacaagttgaggcgaaagcgaaggatgaccagacgcccttgcacatttccgcaagactaggcaaagccgatatcgtccagcagcttctgcagcaaggggctagtcccaacgccgctacaacgagtggttacaccccactccatctgtcggccagggaaggccatgaggatgtggccgctttcctgttggatcacggcgcaagcctgtctattacaacaaagaaaggttttacacctctacacgtggcagctaaatacggaaaactggaagtggctaacctgttgttgcagaagagcgccagccctgatgctgcaggaaagagtggcttgaccccgctacacgtggccgcccattacgacaatcaaaaggtcgccttgctgctgctggatcagggagcctcacctcacgctgcggccaagaacggatataccccattgcacatcgccgctaagaagaaccaaatggatattgccacgacgctgctcgaatacggcgccgatgctaatgctgtaacccgccagggcatagcaagcgtgcacctcgcggcccaggaagggcacgtggacatggtgagcctcctgctgggccgcaacgccaacgtaaacctttctaataagagcggactgacaccactccatcttgcggctcaagaagatcgtgtgaatgtcgcagaggtactggtaaatcagggtgctcacgtggatgcacagacaaagatgggttatacgcccctccacgttggctgtcattacggaaatataaagatcgtaaactttctgttgcagcacagcgcaaaggtaaacgcaaaaactaaaaacggctacactccgcttcatcaagcagcgcaacaggggcatacacacatcatcaacgtgctgttacagaacaacgcttcacccaacgaattgaccgttaatggaaatacggccctaggtatagcacggcgcctcggttacatttccgtcgttgatactctgaagatcgtgacagaagagactatgacaacaacaacagttacagagaagcacaaaatgaacgtcccggagacaatgaatgaggtactggacatgagcgacgacgaagtgcgaaaggcgaacgctcccgaaatgctatctgatggggaatacatttcagatgtagaggaaggcgaggacgctatgacaggcgatactgataaatacctgggcccacaagatttgaaggaacttggagatgattccctccctgctgaagggtacatgggattttccctgggcgcccggtcagctagcctaagatccttctcatctgacaggtcctatactctgaacagaagttcttacgccagggattctatgatgattgaagagctcctcgtgccctcaaaggaacagcatctgacttttacccgcgaattcgattcagactccctgcgccactactcctgggctgcagacacacttgacaacgtcaatctggtatcatcccccatccattctgggttcctcgtgtcattcatggtggacgcaaggggtggatcgatgcggggatctcggcaccacgggatgagaataataattccgcccagaaagtgcaccgcccctaccagaatcacatgccgtctggtcaaacggcataaattagctaatcctcctcctatggtggaaggagaagggcttgcaagtcggttggttgaaatgggccccgccggcgcccagttccttggccccgttatcgtcgagatcccacactttggcagtatgcggggtaaggaacgcgagttgatcgtgcttcgctccgaaaacggcgagacatggaaggagcatcagttcgatagcaagaacgaggatctgaccgaactcctgaacgggatggacgaggaacttgacagccccgaggagctcgggaaaaagaggatttgtcgcatcataaccaaagacttcccgcagtactttgcagtggtatcccggatcaaacaggaatctaatcagattgggcccgaagggggcattctcagtagcactactgtccctctcgttcaggcctcatttccagaaggtgccttgaccaagcgaataagagttggcttgcaggcgcagccagtccctgatgaaattgtgaagaagatcctcggaaacaaagccacctttagccctatagtgactgtggagccccgacggcgcaaattccataagccgataactatgactattccggtcccaccccccagcggcgagggagtttctaacgggtacaagggggacaccactcccaacctcagattgttatgctcgatcaccggcggcacatcccccgctcagtgggaggacattacaggcacgacacctttaacctttattaaggactgtgtatcattcaccacaaacgtatctgccagattctggttggcggactgccaccaggtgttagagacagtgggtcttgccactcagctgtatagagaactgatctgtgtaccctacatggccaaattcgtcgtctttgccaagatgaatgacccggtcgagagtagcctcaggtgtttctgtatgactgacgacaaagtggacaaaacgcttgagcaacaagagaacttcgaggaagtggctcgcagcaaggatatagaagtcctcgagggaaagccaatctacgtggactgctatgggaatctggcgcccctaacgaagggtgggcaacaactggtattcaatttttactccttcaaagagaatagactgcctttcagcattaaaattagagacactagccaggagccctgtgggcggctgtctttcctgaaggagcctaagacaaccaaaggcttgccgcagaccgccgtatgtaatttaaacatcacacttcccgcacacaaaaagattgagaagacggatagacgtcagtcattcgcctccctggcattgcgtaagcggtacagttatctgaccgaacccggtatgagtcctcagtccccctgcgagagaacggatattcggatggccattgtggcagaccacctgggcctcagctggactgagctggctagagagctgaatttctcagttgatgaaattaatcagattcgagtcgaaaatcccaattcgcttatctcacagtcttttatgctgttgaagaagtgggtcaccagggatggcaagaatgcaaccactgatgctctcacgtcagtgcttaccaaaattaatcggattgatatcgtaaccctgctggagggccctatcttcgactatgggaatatcagcggcactagaagttttgccgacgagaacaacgtgtttcatgatcccgtcgatggttacccctcgctgcaggtagagctggagacccctacaggtctgcactataccccgcctacacccttccagcaggacgattatttctccgatattagtagcattgagtctccactgagaactccatctagactctccgatggcttagttccaagccaagggaatatcgagcactccgccgacgggccccccgttgtgactgctgaggatgccagtttggaagactccaaactggaggactccgtacccctgactgaaatgcccgaggcagttgatgtagacgagagtcagctggaaaatgtgtgcctctcatggcagaatgaaacatccagtggcaacctggagtcctgcgctcaagctcgcagggttacaggtgggctgctggacaggctcgatgactcccccgaccagtgccgcgattcaatcactagttacctgaaaggggaggccggcaaatttgaagcgaatggctctcacacagaaattaccccggaagcgaaaacgaaatcctacttcccggagtcacaaaatgacgtgggcaagcagagtactaaagaaacccttaagcccaagattcacggttcaggccacgtagaagagccagcctccccacttgccgcctatcaaaagagcctggaagagacttcgaaactcattattgaagagaccaagccttgtgtgcctgtatcaatgaagaagatgagtcgtaccagcccagcggacgggaaaccgaggttgtcattgcacgaagaggaaggcagttcaggcagtgaacagaagcagggcgaaggatttaaggtgaaaaccaagaaggagattcggcacgttgagaaaaagtcacactcatag

SEQ ID NO: 108222 - DNA, 5607 bp, Artificial Sequence
  Description of Artificial Sequence: Synthetic coding sequence
atgtcggaagagcccaaggaaaaaaatgccaagcccgcccatcgcaaaagaaaggggaaaaaaagtgacgccaatgcgagctacttgagggcggctagggccggacatttagaaaaagccctcgattatattaagaacggcgttgacatcaatatatgtaatcagaatggcctcaatgccttgcacttagcttccaaagaaggccacgtggaggtagtgagcgagctgctccaacgggaagccaacgtggacgccgcgactaaaaaaggtaatacggccctgcatattgcctccctggccggacaggccgaagttgtcaaggtcctcgttacaaacggagcaaatgtgaatgcccaatctcagaatgggttcaccccactgtacatggcagctcaggagaaccatctcgaagttgtaaagttcttgctggataatggggctagtcagtctttggccactgaggatggctttacacccttggcagtggccctccagcagggacacgatcaggtggtgtctctgctccttgaaaatgacactaagggaaaggtgcgcttgccggcgctgcacatcgctgcccggaaggatgacacaaaggccgcagctctcctattgcaaaacgacaacaacgccgatgtagaatcaaaaagtggctttactccccttcatatcgccgctcactatggtaatatcaatgtggccaccctcctgctgaaccgagctgccgctgtagactttacagcgcggaacgatataacccctctccacgtcgctagcaagcgagggaatgccaacatggttaagctgttgctcgaccggggcgcgaagattgacgctaaaacccgggatgggctgaccccgctacactgcggagccaggtctgggcacgaacaggtggttgagatgttgcttgatagggcagccccaattctgtctaaaaccaagaacgggctcagccccctgcatatggctacccagggagatcacttaaattgtgtgcagctcctcttacagcacaatgtcccagtcgacgatgttacaaatgactatctgacagccctgcatgtagctgcccactgcgggcactacaaggtagctaaagttttgcttgacaagaaggctaatcccaatgctaaggcgcttaatgggttcacccctttacatattgcctgtaagaagaatcggataaaagtgatggagctcctgttaaagcacggtgcttcaattcaggccgtcacagaatccgggttgacaccgatccatgtcgctgccttcatgggacacgttaacattgtcagccagctgatgcaccatggtgcaagccccaataccaccaacgtccgcggggagaccgcattgcatatggccgccagaagcggccaagctgaagtggtgagatatttggtacaggatggggcgcaggtagaagccaaagccaaagacgaccagacacccctgcacatatccgcgcgcctcggcaaggccgatatcgtccaacagctgttgcaacaaggcgcatcgccaaatgccgctaccacatctggctacaccccccttcaccttagcgcacgtgagggacacgaggacgtcgccgcttttctactggatcacggagctagcctgtccatcactaccaaaaagggtttcacgccattgcacgtcgcagccaagtacggaaagttggaggtggcaaaccttctgcttcaaaaaagcgcctctcctgatgccgccggaaagtccggcttaacacctttgcacgtggctgcacactacgacaaccagaaagtggccctccttctgttggaccagggagcgtcaccgcatgcagctgccaagaatggctacacccctctacatatagcagccaaaaagaaccagatggacatcgcaacaacactcttagaatatggagcggacgcaaatgcagttactcggcagggcatcgcaagtgtgcatctggctgctcaggagggccatgtggacatggtgtccctcctactgggccggaacgctaacgtcaatctgagcaataagtccgggctgactcctttgcatctggctgctcaggaggacagagtgaatgtggccgaggtcctggtaaatcagggggcccatgtggacgcccagacgaaaatgggttatactcctttgcatgtgggctgtcactatggtaacattaagatcgtgaattttcttttacagcacagcgcgaaagtgaacgccaagacgaaaaacggatacacacccctgcaccaagccgcccaacaaggccacacgcacatcattaatgtgctgctgcagaataacgcttcgcccaacgagctgaccgtaaacggcaacactgccctaggaattgctcgccgccttggttacatatccgtggtggacactctgaagattgtaacagaagagactatgaccactacaacggtaacagagaaacacaagatgaacgtcccagaaaccatgaacgaggtgctcgacatgtccgacgacgaggtacggaaagccaatgcccctgagatgctgagtgatggtgagtacataagtgacgtggaagaagggaacaggtgcacttggtataagatccctaaggtgcaagagtttacggtcaagtcagaagacgccatgaccggtgataccgataagtacctggggccccaggacctaaaggagctgggggacgacagtctgcccgccgaaggatacatggggtttagtctaggcgcgcgctctgccagcctcaggagtttctcctccgatcggtcttatactctaaataggtcgtcatatgcccgcgacagcatgatgattgaggaactcctggttccttctaaagagcaacacctaacgtttactcgcgagttcgactctgacagcctgcgccactacagctgggcagcagacacactcgataatgtcaaccttgtctctagccctattcactccgggttcctcgttagctttatggtggatgcccgcggcggaagtatgcgcggaagccgtcatcacggcatgcgcatcatcatcccccccagaaagtgtaccgccccgacccggattacctgccgcctggtgaagaggcataaactggcaaatccccccccaatggtggagggtgaagggctggccagcaggctggtggaaatgggcccagccggcgctcagttcctggggccagtgatcgtcgaaatccctcacttcgggagtatgagaggcaaagagcgagagttgatcgtcctacgcagcgagaacggcgagacatggaaagagcatcagttcgattccaagaacgaagatctgactgagttgcttaacggtatggacgaagaactcgactcgccggaggagctgggcaaaaaaaggatctgccggataatcacaaaggattttcctcagtacttcgccgtagtctctcgaatcaagcaagagtccaaccagatcggaccggagggcggaatcctgtcgagtaccactgttcccctcgtccaggccagctttcctgaaggtgccctcaccaagcgtatcagagtgggcctccaggcgcagcctgtacccgacgagattgtgaaaaaaatcttggggaacaaggctactttctcacccatagttacagtcgaaccacgtcggcggaagttccacaaacccattacaatgacaattcctgttccccctcctagtggcgaaggcgttagtaatggttacaaaggggacaccacccctaatctgcggctgctgtgcagtatcacaggtggcaccagccctgcccagtgggaggacattacaggtaccacgccactgacctttatcaaagactgcgtgtccttcactaccaatgttagcgcccgattttggctcgctgactgtcaccaggtattggaaacagtaggccttgccacacaactgtatcgagagctgatttgtgttccttatatggccaagtttgttgtattcgcaaaaatgaatgaccctgtcgaatcatcgttgagatgtttctgtatgaccgacgacaaagtagacaagacactggaacaacaggaaaacttcgaggaggtcgcaaggtccaaggacatagaagtgctggagggcaaaccaatctacgtggactgctacggaaacctggccccattgacgaagggcgggcagcaactagtgtttaacttctactccttcaaagaaaatcgactgcccttcagcataaagataagggacactagtcaggagccctgcgggaggctgtccttcttgaaggagcccaagacaacaaaaggcctgccccagaccgctgtctgcaatctgaacatcactttaccagcccataagaaaatcgagaagacagacaggcggcagtcatttgcgtcactggccctgcggaaacgctatagttacttaactgaacccggcatgtcgccccagagcccctgcgaaaggactgacatccgcatggctatcgtggccgaccacttgggcctatcctggacggaactcgccagggagctcaatttcagcgtggacgagataaatcagatccgggtggaaaacccaaactccttgataagtcagtcttttatgttgctaaagaagtgggtcacaagggatgggaaaaatgccactaccgatgctctgacatcagtgctgactaagatcaataggatcgacatcgtgacactcctagaggggccgatttttgactatggcaacattagcggcacgaggtcttttgccgatgaaaataacgtctttcacgacccagtcgacggctatcctagcctgcaggtcgaactcgagaccccaacgggattacactacacacctccaaccccattccagcaagacgattacttttccgatatttcctcaatcgaatcaccactcagaacaccaagtagattatcagacggactggtgccatcccagggcaatattgagcacagcgctgatggaccacccgtcgtaaccgctgaggatgcatccttggaggattccaagctggaagatagcgtgccattgaccgaaatgcccgaagccgtcgacgttgatgagagtcaactggagaatgtctgtttgagctggcaaaacgagacttcttctggtaatcttgaatcatgtgcgcaggctcggagggtgacgggcggccttctggaccgtctggacgacagtcctgaccaatgtagagatagtataacctcttatctgaagggcgaggcgggcaagttcgaagctaatgggtcccacactgagatcacccctgaggcaaagaccaagagctactttcccgaatcccagaatgatgtcggtaagcagagcaccaaggagactttgaagccaaaaatacacggaagcggtcacgtggaagagcctgcttctccgctcgcagcttaccagaaatccctggaggagacatccaaattgatcattgaagagaccaagccctgtgttcctgtaagcatgaagaagatgtcaagaacttctccagctgatggaaagccccgtctgagtctacacgaggaggagggatccagtggctctgagcaaaaacagggagaaggcttcaaagttaagacaaagaaagaaatcaggcacgtggaaaagaagtctcacagttag

SEQ ID NO: 108223 - DNA, 13134 bp, Artificial Sequence
  Description of Artificial Sequence: Synthetic coding sequence
atggcccatgcagcatctcagttaaaaaaaaacagggatctcgagatcaacgccgaagaggaaccggagaaaaaacgtaaacatcggaagcgcagtcgggacaggaagaagaagagcgatgccaacgcatcttacttgagagccgcacgagctgggcatctggagaaggccttagactatattaagaatggagttgacattaacatatgtaatcagaacggactgaatgccctccatctggcctcaaaagaaggtcatgtcgaggtggtatctgagttgctgcagagagaggcaaatgtggatgctgcaaccaagaaggggaatactgctctgcatatcgcctccctggctggacaggcggaagtcgttaaggtgctggtaactaacggagccaacgtgaacgcccagagtcagaacggtttcaccccactttatatggccgcccaagaaaatcacctcgaggttgtcaagtttctgctcgacaatggcgctagccagagtctggcgacagaagacggcttcactcctctcgcggtggcgctccagcaggggcatgaccaggttgtctccctgcttcttgaaaatgacaccaaaggaaaagtacgcttacccgctctgcatatcgctgcacggaaggacgacaccaaagccgccgctcttctgcttcagaacgacaataacgccgacgtggaatctaagagtggcttcacccctcttcatatcgcggcccactatgggaacatcaatgtcgccacattattactcaacagagccgccgcagttgatttcaccgctagaaacgatattacaccgctgcatgtcgccagcaagaggggcaacgccaatatggtcaagctcctgttggatcgaggagccaagattgatgccaaaacccgggatggcctgacacctttgcattgtggggcgcgttccggacacgaacaggttgtggaaatgctgctggaccgcgctgcaccaattctgtcaaaaaccaaaaatggtctctcccctttacacatggcaactcagggagatcacctaaactgcgtgcaactgctgctgcagcacaacgtgcctgtcgacgacgtgacgaacgactacctcactgcgttgcacgttgccgctcattgcggtcattataaggtggccaaggtgctactggataagaaagcaaacccaaatgctaaggccttaaatggattcaccccgcttcacatcgcctgcaagaaaaatcggatcaaggtaatggagttgctactgaagcatggtgcatccatccaagctgtgacggagagcggccttacaccgattcacgtcgcagccttcatgggccacgtgaacatagtgtcacagctaatgcaccatggtgcgagcccaaacacgaccaatgtgaggggggaaaccgcgctacacatggctgcaagaagcggacaagcagaggtggtgcgctatctcgttcaagatggagctcaggtggaggccaaagcaaaagacgaccagactccacttcatatatccgctcggttgggcaaggccgatattgttcaacaactactacaacaaggagcaagccctaacgccgctactacaagcggctatacacctctgcacctctctgccagagaggggcatgaagatgtggcagcttttctgttggatcacggcgccagcctttcgataaccaccaagaaggggtttaccccattgcatgtggcagctaaatatggcaagctcgaggtggccaatctgctcctgcagaaatcggccagccccgatgccgccggtaaaagcgggctcacaccgttgcacgttgcggcccattacgacaatcaaaaggtggcactcctgctccttgaccagggcgctagccctcacgccgcggcgaagaacgggtacacccccctacacatcgctgcaaaaaagaatcagatggatattgccaccactctcctcgagtatggcgccgacgcaaatgccgtaacgaggcagggaatagcctcagtgcatctggctgcccaggagggtcacgtggatatggtaagcctgctgttagggcgtaacgcaaacgttaacctgtccaataagtctggattaactccactgcacctcgcagctcaagaggatagagtgaatgtagccgaagttctggtaaaccaaggcgcccatgtcgacgcccagaccaagatgggctatacacccctgcacgtgggctgccattacggcaacataaagatcgttaactttcttttgcagcattcagcgaaagtcaacgccaagacaaagaatggttacactcctctgcaccaggcagctcaacaggggcatacacatattatcaatgtgctgttacaaaacaacgctagtcccaacgagcttacagtgaatggcaacacagcgctggggatcgccaggcgtctgggctacattagcgtggtcgatacgctcaagattgtgaccgaggaaacaatgaccacaaccacagtaactgaaaagcacaagatgaatgtgccagaaaccatgaatgaggtcctggatatgtccgatgacgaggtccggaaggcaaatgcccctgaaatgctatcagatggcgaatatatatcagacgttgaggagggcgaagacgccatgacaggggacaccgataagtacctgggacctcaggacctgaaggagctgggggatgactcgttgcctgcagaaggttatatggggttttccctgggggcccgatctgcctctctgcgctcattctcaagcgacaggtcctacacattgaataggagttcttacgctagagactctatgatgatagaagaactgctggtgccaagcaaggagcaacacttgactttcaccagggagttcgacagcgattcgctaagacactatagctgggctgccgacaccctcgacaatgtgaatctcgtaagctcacctattcacagcgggtttttggtgagtttcatggtagacgcacggggtggcagcatgagggggtctcggcaccatggtatgcggattattattccacctcggaaatgtaccgcccccactaggattacctgtaggctggtgaaacggcataaactggccaaccctcctcccatggttgagggagagggactggcaagtcgactagtggagatgggcccagcgggagctcagttcctcggtcccgtgatcgttgaaatcccgcactttggctccatgaggggtaaagagcgtgagctcattgtccttcggagtgagaatggcgaaacttggaaagaacatcaatttgatagcaagaacgaggatttgaccgagcttctgaatggaatggatgaagagctcgatagtcctgaagaattggggaaaaagagaatctgcaggattatcaccaaggatttcccgcaatattttgccgttgtaagtcggattaagcaagagtcaaaccagattgggcccgaaggaggaattctttccagtacaaccgttcccctggtccaggctagcttccccgaaggcgccctaactaagcgcatacgggtaggcctccaggcccagccagtccctgatgaaattgttaagaagatcctcggaaacaaagccacatttagccctattgtaaccgtcgagccccgccgccgcaagttccacaaaccaattactatgacgataccagttccgccaccatctggggaaggcgttagtaacggttacaaaggagacacgacgccgaacttgaggctgctgtgcagcataaccgggggaacatcccctgcacagtgggaagatattacaggcaccacgcccctgacctttatcaaagattgtgttagcttcaccaccaatgtttctgcgagattttggctggccgactgccaccaggtgttggagacagtgggattagccacacagctttatagagagttgatttgcgtcccttatatggctaaattcgtggtgttcgcgaagatgaacgacccggttgaatcatctctaagatgcttctgcatgacagatgataaggtcgataaaacactggagcaacaagagaacttcgaggaagttgctaggtcaaaggacatagaggttctggaagggaaacccatctatgtggactgctatgggaacctggccccactgacaaagggaggacagcagctcgtgtttaacttctattcttttaaagagaaccgcctcccattctccatcaaaatccgcgacacctcccaagagccttgcggtcgcctgtcctttttgaaagaacctaaaacaactaagggtttgccccaaactgccgtgtgcaacctaaacattaccttacctgctcacaagaaggagacggagagcgatcaagatgacgagatcgagaaaactgatcgaagacaatcctttgcgagccttgccttaagaaagcggtacagctacctgacagaaccaggtatgatagagaggtcgacaggcgccacacgttccttgccgacaacctattcctataagcccttcttctctaccaggccttaccagagttggaccacagcgcctatcacagttcccggaccggctaagagcggttttacctcactctcttcctcttctagtaatactcctagcgcgagccctctgaagagcatctggtcagtgagcaccccatcgcccattaagagcactttgggtgccagtaccacgtcgagcgtgaaaagtatttcagatgtggcttccccgatccggtccttcagaaccatgagttcaccaattaagaccgtggtttcacagagcccctacaatattcaggtgtcatctgggacactggcgcgcgctcctgccgtgaccgaagctacccccctaaaggggttagcctccaactccacctttagctctcgcaccagcccagttactacagccggcagcctcctggaaagatcctccattaccatgacaccaccagcttctcccaagagtaacatcaacatgtattcctccagtctcccgtttaaatcaatcataacttctgccgcccctctgatttctagtcctctgaagagcgtggtgtctcccgtgaagagcgccgtcgatgtgattagtagcgctaagattacaatggcaagtagtctttcgagcccggtgaaacagatgccaggccacgctgaggtcgccctggtgaacggatccatcagccctctcaagtacccatcatcctccaccctcattaatggctgcaaggccactgcaactctgcaggagaaaatttcgagcgccacaaattcagtcagctccgtggtatccgcagcgacagacaccgtggagaaggttttttccacaaccacggcgatgcctttctcacccctccgctcctatgtgtcggccgcgccctccgctttccagtctctccgtacaccctccgctagcgccctgtatacgtccctgggatccagtatctcagctaccacatcaagtgtgaccagttctattataaccgtccccgtttactccgtggtgaacgtgctgccagagccagcacttaagaaactgcccgactccaactcattcaccaagagcgccgccgcgcttctgagccccatcaagacactcaccacagaaacacaccctcaacctcacttcagtcggacatcttctccagtgaagagtagcctttttctcgcaccctccgctctgaagttgagcaccccctcctcattatcctcctcacaagagatcctgaaggacgtggccgaaatgaaagaggacctgatgcggatgacagctatcctacagacagacgtgccggaggagaagcctttccaacccgaattacccaaggagggtaggattgacgatgaagaaccctttaaaattgtcgagaaagttaaggaagatcttgtgaaggtgagcgaaatccttaagaaggacgtgtgtgttgataataagggcagccccaagagtcctaagtctgataagggccattcaccagaagacgactggatcgaatttagctctgaggaaatcagggaggctagacagcaggcggccgccagccagagtcctagcttgcccgaaagggttcaggtgaaagcaaaggccgcaagcgaaaaggattacaaccttaccaaagtgattgactacctgactaatgatatcggcagctctagcctgacaaatctcaagtacaaattcgaggacgcaaagaaggacggcgaggaacggcagaagagagtgctgaagcctgcaatcgccctccaggagcacaagctcaagatgccccccgctagtatgcggacttctaccagcgaaaaggaactctgtaaaatggctgacagcttcttcgggactgacacgattcttgaatcccctgacgatttctctcagcatgaccaggacaagtctccgctttcggactccggctttgagacccgatcagaaaagacacccagtgcgccccagtccgctgagtcgaccgggccaaagccattgttccacgaggtccctatcccacccgtgatcacggagacaaggactgaggtcgtgcatgttattcgaagctacgacccatctgccggtgacgttcctcaaactcaacccgaggagccagtgagccccaaaccgtcaccgacttttatggaacttgagcccaagcccaccaccagctcgatcaaggaaaaggttaaggcatttcagatgaaggcatcttccgaggaggatgaccacaaccgggtcctaagtaagggcatgagagtaaaggaggagactcacattacaaccacaaccaggatggtctatcactcacccccaggcggagagggtgcatctgagagaatagaagagaccatgtccgtccatgatatcatgaaggcctttcaaagcggccgagacccaagcaaggagctggccggcttgtttgaacataagagcgccgtgtccccagacgtacacaagtccgccgctgaaacttccgctcagcacgccgaaaaggataaccagatgaaacccaaattagagcgaattattgaggtccacatcgagaaaggtaatcaggctgaacctactgaggtcataattcgggaaacgaagaagcatcccgaaaaagaaatgtacgtctaccagaaagacttgtctagaggagacattaacttgaaggatttcctgcccgagaagcacgacgccttcccctgttcagaagaacagggtcagcaggaggaagaagaactcaccgccgaagaatcgctcccctcctacctggaatctagccgcgtgaacacaccggtcagccaagaggaagatagtcggccatcgtcagcgcagctcatcagcgacgactcttacaagacactgaagctgctgtcgcagcactccatcgaataccacgacgacgaactctccgagctgcgaggcgaaagctatcggttcgcggagaagatgctgctgtctgagaaactcgacgtgagtcactctgacaccgaagagtctgtcacggaccacgccggaccaccatcatctgaattgcagggctctgataaacgcagcagggaaaaaatagctacagctccaaaaaaagaaatcctgagtaaaatttacaaggatgtctcagagaatggcgtcgggaaagtctccaaagatgagcatttcgataaggtgacagtgctgcattacagtgggaatgtctcctcaccaaagcatgcgatgtggatgcggtttactgaagaccgcctggacagaggaagggagaagctaatatatgaagacagagtggatcgcacagtgaaagaggcagaagaaaagctgaccgaagtgagtcagttttttcgggacaaaaccgagaagctgaatgatgagcttcaaagtcctgagaagaaggctcgacccaagaatggcaaagagtactcttcgcagagtccgacttcctcctcccccgagaaggttctcctgacggagcttctcgcgtctaacgatgaatgggttaaagcgcgtcagcacggccctgacggccaaggcttcccgaaagcagaggagaaagccccttcgctgcccagttctccagaaaagatggtgttgtcccaacagactgaggactcaaagtcaacagtggaagcaaaggggtctatcagtcagtctaaggcaccagacggcccacagagcggttttcagctgaagcagagtaaactgtcgagcattcgtctcaagttcgagcagggaacgcatgctaagtctaaggatatgtctcaggaagataggaagagcgacggacagtccaggattcctgtcaaaaaaatccaggagtcgaagctgcctgtatatcaggttttcgcccgtgagaagcagcagaaagctatcgatctaccagatgagtcggtaagcgtgcaaaaggacttcatggttcttaagacaaaggacgagcatgcccaatctaatgaaatcgtggtcaatgacagtggatcagataacgtaaagaaacagagaacagagatgagcagtaaagccatgcccgacagcttctccgagcagcaagctaaagacttggcatgccacattacatccgatctcgccactcgtggtccttgggacaaaaaagtgttccgcacctgggagtcatcaggcgcgacgaataataagtcacagaaggagaaactcagccacgtgttggttcacgacgtcagagagaatcatatcggccaccctgagtcaaagagtgtggaccaaaaaaatgaattcatgtcagtgaccgaaagagagcgcaagctcctcacaaatggcagcctctctgagattaaagaaatgacggtcaaatctccctccaaaaaggtgttgtatcgcgaatacgtagtaaaagaaggggaccatcccggggggttactggatcaaccttctcgccggtctgagtctagcgcagtgagtcatatcccagtccgcgtggctgatgagcgcaggatgctgtcttccaatatccccgatggattttgtgagcagtctgcatttcccaagcatgagttgtctcagaagttatctcaatcaagcatgtcaaaggagacagtggagactcaacactttaatagcatcgaagatgagaaagtaacctactccgagatctccaaagtgagtaaacaccaatcttacgtcgggctttgtccgccgctggaggagacggaaacctcacctaccaaaagtccggactccttagagttctcccccggcaaagaatcaccttccagtgacgtctttgatcatagccccatcgacggtctggagaaactcgcgcccctcgctcagactgaaggcggcaaagagattaagactttaccagtctatgtctcattcgtgcaggtgggcaagcagtacgagaaggaaatacaacagggcggcgtgaaaaaaatcattagtcaggagtgcaagaccgtgcaggagacccgcgggacattttatacaacacggcaacagaagcagccccccagtccacagggatctccagaggatgacacgttagagcaggtgtccttcctagacagctctggcaagtcaccccttaccccagagaccccaagctcagaggaggtgtcctacgaatttacctccaaaacacctgacagccttatcgcttacattccgggaaaaccatctccaatacccgaggtgtctgaagagtccgaggaagaagaacaggccaagtcaacctctctgaaacaaacaacggtggaagagaccgcagtagaacgggagatgccgaacgatgtttcaaaggatagcaatcaaagacccaaaaacaatagggtggcctacatcgagttccctccccctccaccattggatgccgatcagatcgagagcgacaaaaaacaccactatctccctgagaaagaggtggacatgattgaagtcaacttgcaggatgagcacgacaagtaccagttggcggaacccgttatacgcgtacagccaccgagccccgtacctcccggagctgacgtgagcgattcatcggatgacgagtccatctaccaaccagtgccagtgaagaaatatacatttaaactgaaagaggtcgacgatgaacaaaaggagaagcctaaagccagcgccgagaaagcatcaaatcagaaagaactggaatccaacggatcgggcaaggacaatgaatttggactcggattggactccccccagaatgagatcgcacagaacggaaacaacgaccagtcaatcaccgagtgcagcatagccaccacggcggagttcagccacgacacagatgccactgagattgattctctggacggatacgatctgcaggatgaggacgatgggttaactgaatccgactccaaactgcctatacaggccatggaaatcaagaaggacatctggaatactgaaggcattctgaagccagccgaccggagttttagtcaaagcaagcttgaggttattgaagaagaaggtaaggtcggccctgacgaggacaagcctcccagcaagagcagctcctccgaaaagacgcctgacaaaacagaccagaagagcggggcacagttttttactctggaaggccgccaccctgatagatcggtctttcccgatacctatttttcttacaaggtggatgaagagtttgcaacccctttcaaaacagtcgccactaagggacttgacttcgatccctggagcaacaatagaggcgacgatgaggtcttcgatagtaagagccgggaagacgagaccaaaccatttgggctggcagtcgaggatcgctcccccgcaacaacccccgacactacacccgccaggaccccaacagatgaaagcactcctactagtgagcctaatccattcccttttcatgaggggaaaatgtttgaaatgacccgaagcggcgcaattgacatgtctaagcgagattttgttgaggaacggcttcagttctttcagataggcgagcatacttcagagggtaaatctggagatcagggcgaaggcgacaagagcatggttaccgccacccctcagccgcagtctggcgataccaccgttgaaaccaatcttgagcgcaacgtggaaactcccacagtagagcctaacccctctatccccacctctggggaatgccaggagggaacttcaagctccggatccctggagaagtctgccgctgctaccaacacatcaaaagtcgatcccaagctgcggacccccatcaagatggggatatctgctagcacaatgactatgaaaaaggaaggaccgggtgaaatcaccgataagatagaggcagtgatgactagctgccaggggctggaaaacgaaaccatcaccatgatcagcaataccgccaattctcaaatgggcgtcaggccgcatgagaaacacgacttccagaaagacaattttaataacaataataatctggactcaagcaccattcaaactgataatatcatgtccaacatagtgctcacagaacactctgctcctacctgcacaaccgaaaaagataatccagtaaaagtatcctcaggcaaaaaaacgggcgtcctacaggggcactgtgtacgggataaacagaaggtcctcggggagcaacagaagaccaaagagctgattggtattcgacagaaatcaaagttgccaatcaaagcaacttcgccaaaagatacattcccacccaatcacatgagtaacacgaaggcaagcaagatgaagcaggtctctcagagcgagaaaacgaaagccctgaccacctcatcttgcgtggatgtaaagtcacgcatccccgtcaaaaacacccaccgcgacaacattatcgccgtgcggaaggcttgtgccacccagaaacaaggccagcccgaaaagggaaaggctaagcagctgcccagtaagttgccagtaaaagttaggtccacatgtgtaacaaccacaacaactaccgctactacaacaaccacgactaccacaaccactacgacttcctgtactgtcaaggttcgcaagtctcagctgaaggaggtctgtaaacactcaatcgaatattttaaaggcatcagcggagagacactgaagcttgtcgatagactcagtgaggaggaaaagaagatgcagagtgagttgtccgacgaggaggagtccacctcacgcaatacaagtctgagcgagacatcccgtggggggcagcccagcgtgaccactaagtctgctcgtgacaaaaaaaccgaggctgcccctctgaaatccaaaagtgagaaagccggatccgaaaagcggtccagtcggaggaccgggccccagtccccctgtgagcgaactgacatcagaatggcaatcgtcgcggaccacctcggactcagttggaccgagttggctagggagttgaactttagcgtcgatgagataaatcagattcgtgttgaaaatccgaatagtctcatttctcagtcatttatgcttctgaagaaatgggtgacaagagatggtaaaaacgccacgaccgatgcacttaccagcgtgctgactaaaatcaacagaatcgacatcgtgaccctcctggaaggtcccatttttgactatggcaacattagcggcacaaggagcttcgccgacgagaataacgtatttcatgacccagtagacgggtggcaaaatgagacaagctcaggtaaccttgagagctgcgcccaggctcggcgcgtgactggaggactgctcgacaggctggatgattcccccgaccaatgcagggattccattaccagctatttgaaaggtgaagctggcaaatttgaggcaaacggatcccacacagaaattacaccagaggctaagacgaagagctactttcccgaatctcagaacgacgtcggcaaacaaagtactaaagagacgttgaagccaaagatccacgggagcggccacgttgaggaacctgcgagcccattggcagcatatcagaaatccttggaggagacgtccaaactgatcatcgaagaaaccaaaccctgcgtgcctgtatccatgaaaaaaatgagccggacctcacccgctgacggtaagcctagactgtctctccacgaagaagagggcagctctggttcagagcagaagcagggggaaggttttaaggtcaagacaaagaaagaaattagacatgttgaaaaaaaatctcacagttag

SEQ ID NO: 108224 - DNA, 3006 bp, Artificial Sequence
  Description of Artificial Sequence: Synthetic coding sequence
atggctttgccacagagtgaggacgctatgacaggtgatactgacaaatatcttgggccacaggatctgaaggagcttggagatgacagtctacccgccgagggttacatgggattctcccttggcgcaagatcagcctcgttacggagttttagttctgaccggagctacacattgaaccggtcttcatatgctagagattccatgatgatcgaggagctcctcgtgccctccaaagaacagcatctgacttttacacgggaattcgactctgactcgctgcgacactactcatgggcagcagacacgcttgataatgtgaacttagtatcaagccctatacactcgggcttccttgtctcttttatggttgacgctcgtgggggttcgatgcgggggagtagacaccacggcatgcgcattattatcccgcccagaaagtgcacagcccctaccaggattacgtgtagattagtgaagcggcataagctggccaatccacccccaatggtcgaaggtgaagggttagcgagccgccttgtggagatgggtcctgcaggggcccagtttctaggccccgtgatcgtcgaaatcccacacttcgggtctatgagaggaaaggagcgggaactaattgtgctgcgatcagaaaatggtgagacatggaaggaacatcagttcgattccaaaaacgaggatctcacggaactcctgaacggcatggacgaagagctcgatagcccagaggagcttggcaagaagagaatctgtagaattatcactaaagacttcccccagtacttcgccgtggtgagccgaatcaagcaggagagcaaccagattgggcccgaaggaggcatactcagctccacaactgttccactagtgcaagcatcttttcccgaaggtgcgctgacaaagcgaataagggttggacttcaggcccaacccgtccctgatgagatcgttaagaagatcctagggaacaaagcaacctttagtcccatcgtaacagtagaacctcggagaaggaaatttcacaagcccattactatgaccatccctgtcccacccccatctggcgagggggtcagtaacggctacaaaggggacaccaccccaaatctcaggttgttgtgctccatcaccggcgggacttccccggcccaatgggaagacattaccgggactaccccactcacttttatcaaggattgcgttagctttactaccaacgtttcagcaagattttggcttgctgattgtcaccaggttttagagaccgtgggtctggctacgcagctttatcgagagctgatatgcgtgccatacatggccaagttcgtggtatttgccaaaatgaatgaccccgtagagagtagcctgaggtgtttctgtatgacggacgacaaggtggataaaacactcgagcagcaggaaaactttgaggaggtggcaagatctaaagatatcgaggtactagaaggaaagccgatctatgtggactgctatggtaatctggcccccctgaccaagggcggccaacagctggtttttaacttctattctttcaaagaaaacagattaccattctctattaaaatcagagatacctcacaggagccatgcggcagactaagtttcctgaaggaaccaaaaaccaccaagggcctaccccagacagccgtttgtaacttgaatatcacccttcccgctcacaagaaaattgagaagacagatagacggcaatcctttgccagcctcgctctgaggaaaaggtactcatacctcaccgagccaggtatgagcccccaatcaccctgcgagcggaccgatatccgcatggctattgtcgcggaccatcttggtctgagctggacggaactcgcgcgggaacttaattttagcgtggacgagatcaaccaaatccgggtcgagaaccctaatagcctaatttctcagtcttttatgcttttaaagaagtgggtgactcgcgatgggaaaaacgcaacgaccgacgccctgacctctgtgttaactaaaatcaaccggattgacatcgtaactctgctggaagggccaattttcgactacggaaacatatcaggaacgcggtccttcgctgacgaaaataacgtgttccacgatccagtcgacggatacccctccctccaggtggagcttgagacccccactggcttgcattacactcccccaaccccctttcaacaggacgactacttttcagacatctcaagcatcgaatcacctctgcgtactccctccaggctctccgatggactcgttccgagtcagggaaatattgagcactctgccgatgggccgccagtggtgacagcagaagatgcgagtctggaagatagtaaactcgaagactcagtgcctttaactgagatgcccgaggcggtggatgtcgacgaatcacaactcgaaaatgtatgcctttcgtggcaaaatgagacttcaagcggcaacctcgagagctgtgcccaggccagacgggtgactggaggtcttctggaccggctggatgacagccccgatcagtgcagggactcaataacaagttatctgaaaggcgaggccgggaagttcgaggctaacggaagtcacaccgaaataactcccgaagccaagaccaagtcatattttcccgaatcccaaaacgacgtaggaaagcagagtaccaaagaaaccctcaagcctaaaatccacggttccggtcacgtcgaggagccagcatcccctctggcagcgtaccagaagagtctggaagagacgtccaagctgattatcgaggaaaccaaaccttgcgtcccagtctccatgaaaaagatgagcaggacatcaccagccgacggcaagccgcggctcagcttacacgaagaggaagggtcttctgggtcagagcagaagcaaggcgaagggttcaaggtgaagactaagaaggagatcaggcatgtggagaaaaaaagccactcctag

SEQ ID NO: 108225 - DNA, 3306 bp, Artificial Sequence
  Description of Artificial Sequence: Synthetic coding sequence
atgagcgaggagccaaaggaaaagaacgccaaacctgcgcaccgcaagagaaagggaaaaaaatctgacgccaacgctagctacctgcgcgctgccagagcggggcaccttgaaaaagctctggactacatctccgtagtagatacactaaaaattgtcaccgaagaaacaatgaccactacaaccgtcacagagaagcacaaaatgaatgtcccagagacaatgaatgaggtcctagacatgagcgacgacgaagtgagaaaagccaacgcacctgaaatgctttctgacggtgagtacatttctgacgtcgaagaaggagaggacgccatgacgggggacacagataaatacctgggcccacaggatctgaaggagctgggcgatgactcgctcccagcagaagggtacatgggattctccctcggcgcgagaagcgcttctctccggtccttctcctccgatcggagctacactctgaaccgttcttcttatgctcgtgatagtatgatgattgaggagttgttggtgccgtcaaaagagcagcatctgacttttacaagggaatttgactccgattccttgcggcactattcttgggccgcagacacactggataacgtgaacctggtgtcaagtcctattcatagcggattcctcgttagctttatggtggacgcgcggggtgggtccatgcgcggttccaggcaccacgggatgagaataatcatccctcctcgtaagtgtaccgcccccacccgcattacctgtcgccttgtgaagaggcacaagctggcgaatccgcctcccatggtcgaaggagaagggctggcttcaaggctagtagaaatgggccctgctggcgctcagtttctcgggccagtgattgtggaaattccccacttcggttctatgcgcggcaaagagcgggagctgattgtactgcgaagcgagaacggcgaaacatggaaagagcaccagtttgattctaagaatgaggatttgaccgagctgctaaatggcatggacgaagagctcgacagccccgaggagctggggaagaaacggatttgccgaattataactaaggatttccctcagtactttgctgtcgtatcacgcatcaaacaggaatccaatcagatcggcccagaaggcggcattctgagttctacaacagttcccttggtgcaggcctctttccccgaaggcgccctgacgaaacgcatccgcgtgggtctgcaagcacagcctgtgcccgatgaaatagttaagaagatcctggggaataaagccacattctcacccatagtgaccgttgagcccaggcgtagaaagtttcataagcctataacaatgactattcctgttcctcctccatcaggggaaggggtgagtaacgggtataaaggagacaccactcccaatctgcgccttctgtgtagcattaccggaggaacatcacctgcccagtgggaggacataaccggcaccacgccactcacattcattaaggactgtgtcagctttaccaccaacgtgtcagcccggttctggctggctgattgtcaccaggtgctggaaaccgtcggccttgccacgcaactttaccgcgagttgatttgtgtaccctacatggccaagtttgtggtctttgcaaagatgaatgatcctgttgaaagttctctgcggtgcttctgcatgacagatgataaggtcgataaaacactggagcagcaggagaactttgaagaggtggcccgctccaaggacattgaggtccttgagggcaaaccaatctacgttgattgctatggaaatctggcgccattaaccaaaggaggacagcagctggtgttcaacttttatagcttcaaggagaatagactgcctttctccatcaagatccgggacacctcacaagagccctgcggacggctatctttcctgaaggagccaaaaacaactaagggactgcctcagactgcagtctgcaatttaaacatcacactgcctgcccacaaaaaaatcgaaaagacagatcgcaggcaatcttttgcctccctcgcactgagaaagcgttattcttatttgaccgagccagggatgtcacctcaatcaccatgcgagcgaacagatattaggatggctattgttgctgaccacttgggtctgtcttggacggagctagctcgcgagctgaattttagcgttgatgagatcaatcaaattcgtgtggaaaaccccaattccttgatatcccaatctttcatgctcctgaaaaagtgggtgacccgagacggtaaaaacgcaactacagacgccctgacatccgtcctcacgaaaatcaatcggatcgacatcgtgacactactggaggggcccatctttgactacggtaatatctccgggacccggagcttcgcagatgagaataatgtgttccacgatcctgtggatggttacccaagtctgcaggtggagctagaaacccccacaggccttcactataccccgccaactccatttcagcaggatgactatttctccgacatctctagcatcgaatcccctttacgcacaccaagcaggctgtcggatggtttggtaccatcgcagggaaacatcgaacattcagcggacggtccgccagtcgtgaccgcagaagatgcttctctggaggacagcaagctggaagactcagtgcctttgacagaaatgcccgaagccgtggacgtggacgaatcccaactcgagaacgtttgtcttagctggcagaatgagactagttctggcaaccttgaaagctgtgcacaggcccggcgggtgacgggaggactgctggaccgactcgatgatagccccgatcagtgcagagatagcatcacatcatacctcaaaggggaggccggaaagttcgaggccaatggaagtcatacagagatcaccccggaggctaagactaaaagttatttccccgaatctcagaacgacgtgggcaagcagagcaccaaagaaacgctgaaaccaaaaattcacgggtcaggccacgtggaggaacccgcctccccccttgctgcctaccagaagtctttagaggaaacctctaagttgattattgaggagactaagccttgtgtgcccgtttccatgaagaaaatgtcccgtacctccccagcagatggcaaaccccggttgtcactgcatgaggaagaaggttctagcgggagcgagcaaaagggcgaggggtttaaagtgaagaccaaaaaagagatacggcatgtagaaaagaaaagccattcatag

SEQ ID NO: 108226 - DNA, 3387 bp, Artificial Sequence
  Description of Artificial Sequence: Synthetic coding sequence
atggcaacgcaaggggaccatctcaattgcgtacagcttctgttgcagcataacgttcctgtcgacgatgttaccaacgactacctaaccgccctgcacgtggccgcccactgtggacactacaaagtagctaaagttctgcttgataagaaggcaaaccctaacgccaaggccctgaatggtttcacgcccttacacattgcctgtaagaaaaacagaattaaggtgatggaactcctgctgaagcacggagccagcatccaggccgtgactgagagcgggctcacgcctattcatgttgctgcctttatgggtcatgtaaatattgtgtctcagcttatgcaccacggtgctagtcccaatacaacaaacgtgaggggggagaccgccttacacatggctgcaaggtctggacaagccgaagttgtccgctacctggttcaggacggggctcaggtggaagccaaggccaaagacgatcagacccctctgcatatttctgccagactaggaaaagccgatatagtacaacagctgctccaacaaggggccagtcctaatgctgctactacttcgggttatacccctctgcatctgtctgccagggagggacacgaggacgttgccgcatttctgctggatcacggagcgagcctgtccatcacaactaagaaaggatttacccctttgcacgtggccgcaaagtatggaaagctcgaggtagccaatctgctcctccagaagtccgcttcccccgacgcagcaggcaagagcggtctgacaccactgcacgtggcggcgcactatgataaccagaaagttgctttgttactccttgatcagggagcctcacctcatgctgccgcaaaaaatggttacactcctctgcatatcgcggccaaaaagaaccagatggacatagccactaccttacttgagtatggagctgatgcaaatgccgtaactcggcaaggcattgcatctgtccatctggccgcccaagagggacacgtggatatggtcagtcttctgcttggcaggaacgctaatgtgaatctttccaacaagagcggcctcactccattacatctggccgctcaggaggacagggtcaacgtcgctgaagtgctggtgaaccagggcgcccacgtcgatgcccaaaccaagatggggtacaccccactgcatgtgggttgccattacggcaacataaagattgtaaattttctcctgcagcattctgccaaggtaaacgcaaaaacaaagaatggctatacccctttgcaccaggcagcgcagcaggggcatacccacataattaacgtcttgctgcagaataacgcgtctcctaatgagctaactgttaatgggaatactgcactgggcatagctcgtaggcttggctacatttcagtcgtggacaccctcaagatcgtcactgaggagacgatgacgaccaccaccgtcaccgaaaagcacaagatgaacgtgccagagaccatgaacgaagtgctcgacatgagcgatgatgagggggaagacgcaatgacaggtgacacagataagtatttagggccccaggatctgaaggagttgggagacgatagtctgcccgctgaggggtacatgggttttagcctgggtgctcggtctgccagttcagacaggtcatacacacttaatagaagttcttatgcgagagactccatgatgatcgaagaactcctggtgcccagcaaagagcagcaccttaccttcacccgggagttcgacagcgactccttgaggcattattcttgggctgccgacaccctcgacaatgtgaatctcgtgtcttccccaatacacagcggttttctggtaagttttatggtggacgctcgtggcggaagtatgcgtggtagccgccaccatggcatgcggatcattatccccccccggaagtgtactgccccgacacgcattacttgccgactggttaaaaggcacaagttggccaatcccccaccgatggtcgagggagaaggtttagcaagtagactcgttgagatgggccctgccggagctcagtttctggggcccgtgatagtcgagatcccccatttcgggtcaatgagagggaaagaacgggagctcattgtgctgcggagtgaaaatggggagacatggaaagagcaccaatttgactccaagaatgaggatctaactgagcttcttaacggtatggatgaggagctggactcaccagaagagctgggcaagaaaagaatttgtcgcatcataacaaaggacttcccacagtattttgctgtcgtctcaaggataaaacaggagagtaatcaaattggccctgaaggaggtatcctctcctccaccaccgtcccactggtgcaggcgagcttccctgagggagctctgacgaaaagaattagagtaggcctgcaagcccagcccgtccccgatgaaatcgtgaagaagatcctgggtaataaggccacctttagtcctatcgtgactgttgagccaagacgtagaaagttccataagcctattactatgactatcccggtgccaccgccaagcggggaaggggtgtccaatggctataaaggtgatacaactccgaaccttcgcttgctctgcagcataaccggggggacatcccccgctcagtgggaggacattaccgggacaacaccactgacatttataaaggactgcgtttcctttacgaccaacgtgagcgcccgcttctggcttgctgactgccaccaggtgctcgaaactgtgggactggccacacagctatatagagagttaatctgcgttccttacatggctaagtttgttgtgtttgctaaaatgaacgatcctgtggaaagctccctaagatgcttctgtatgactgacgacaaggttgataaaaccctcgagcaacaggagaacttcgaagaagtcgctcgctcaaaggatattgaggtgttagaaggaaagcctatttacgtggattgttacggcaacctggccccactcaccaaggggggccagcagctggtgtttaacttttattcctttaaggaaaacagattgccctttagcatcaaaattcgagatacgagccaggaaccatgcggcaggctgagcttcctgaaagagcctaaaaccacaaaggggttgccacagaccgccgtctgtaacctaaacataacattgccagcacacaaaaaaatcgagaagaccgaccgcaggcaatctttcgcgtcgctcgcactcaggaagcgctatagctacctgaccgagcccgggatgtctgagttccccaacacatttacaaatacttggatctttatacgcagagacatctttagcatccagacaaagttttag

SEQ ID NO: 108227 - DNA, 5544 bp, Artificial Sequence
  Description of Artificial Sequence: Synthetic coding sequence
agcgatgccaatgcctcttatttgcgcgccgctcgtgctgggcatctggagaaagcactggactacatcaaaaacggggtcgatatcaatatatgtaatcagaatggcctgaacgctctgcacttggcaagcaaagaggggcacgttgaagtggtctctgaattgctgcaacgagaagctaatgtcgacgctgctactaaaaaaggaaatactgccttgcacatagctagcctggcaggacaggcagaggtggtcaaagtgttagtcactaatggcgcaaatgtgaacgcccaaagccaaaatggctttacccctctgtacatggcagctcaggaaaatcacttggaggttgtcaagttcctgctggacaatggcgcttcccaatctctggctacggaagacggcttcaccccactggctgtagccctacagcagggtcatgaccaagtagtgagcctgttgctggagaacgacacgaagggcaaagtgcgcctccccgcattgcacatcgcggctagaaaagacgataccaaggccgccgcactgttattacagaacgacaacaatgcagatgtcgagagcaagagtggattcacacctctccacatcgctgcacattatgggaacatcaacgtggccacattgctcctgaaccgggcagcggccgtcgattttacagcacgcaatgacatcacacctctacatgtcgcatctaagagaggcaacgccaacatggtgaaacttctgctggatcggggcgctaaaattgatgccaagaccagagacggtctcacccccctgcattgtggagcgcggagcggtcacgaacaggtggtggagatgctacttgacagagccgccccaattctcagcaaaacaaaaaatggattgtctcctctacatatggctactcagggggatcacctcaactgtgtccagttgctgttgcaacacaatgtgccggtggatgacgtgaccaatgattacctgactgctctgcacgtggccgcacattgcgggcactacaaagtagcaaaggtactcctggacaaaaaggctaaccctaacgccaaagccctaaatgggttcacaccactacatattgcatgcaagaagaatcgaattaaggtcatggaattgcttctgaagcacggagccagcattcaggccgttacagagtctggcctcactcctatccatgtcgctgcctttatgggacacgtgaacattgtgtcgcaactaatgcatcacggggcttctcccaatactacaaacgttaggggtgagacagccctccatatggcggcccggtccgggcaggccgaggtggttagatacctagtgcaggatggagcacaggtggaggcaaaagccaaggacgaccaaacgcccctgcacatctccgcacgtcttggcaaagcggacatcgtacagcagctcctccaacagggggcctcacctaatgccgccactacctcaggttataccccactacatctctccgcaagggaaggtcatgaggacgtcgcggccttcttgctggaccatggggcctccctcagtattaccacaaagaaagggtttacacccctgcatgttgcagctaaatacggcaagctggaggttgctaatcttttgctccagaagtctgctagtcccgacgcagccggaaaatctggactgacgccgttacatgtagccgcgcattacgataaccagaaagttgcgctgctcctgctggatcaaggcgccagccctcatgccgcggctaagaacggctatactcctttacacatagccgctaaaaagaaccagatggatatcgccactactctgctcgagtatggagcagacgccaacgcagtgacacggcagggaatcgcctctgttcacctggctgcgcaggagggtcacgttgatatggtctcattgctactcggcagaaacgccaacgtgaacttgagcaataagtcaggcctcaccccactccacttggccgcccaagaagacagggttaatgttgcagaggtgctagtgaatcaaggagcgcatgtggacgcccagacaaagatgggatataccccccttcatgtgggttgccactacgggaatattaaaatcgttaatttcttactgcaacactcagccaaagtgaacgctaagacaaagaacggatacaccccgcttcaccaggcagcccagcagggacatacccacattataaacgtcctgcttcagaacaacgcctcaccgaatgagttgactgtgaacggcaatactgctctcggcatagccagacgactaggatacatcagtgtcgtcgacactctcaagatagtcactgaggagacgatgaccacaaccacagtgacagagaagcacaaaatgaatgtcccggaaacgatgaacgaagtgttggacatgagcgacgatgaagttcgtaaggcaaacgctcccgaaatgctgtccgacggggaatacatatcagatgtcgaggaggggaaccgctgcacatggtataaaatccccaaggtccaggagttcaccgtgaagtctgaagatgcaatgaccggggatacagataaatacctgggaccacaagacttgaaggaacttggggacgactccctccctgccgaaggatacatggggttctctctcggggcacggagtgcatccttaaggtcctttagcagtgaccggagttatacattaaatcgatcgtcatatgctcgcgactctatgatgatagaggagctgctggtgccctccaaggaacagcacctaacatttacacgtgagtttgactcagactccctccggcactatagctgggctgccgataccttggacaacgtaaacttggtgtctagtccaatccactccggctttctggtctcgtttatggttgatgcaagagggggatcaatgaggggatctaggcatcatggaatgaggataatcataccacctcggaaatgcacagctcctactcgcattacttgcagactggttaagcggcacaaactggctaaccccccacctatggtcgagggcgagggcctggcctctcgcctcgtggagatggggccggctggcgctcagttcctgggcccagtcatagtggagatccctcacttcggctctatgcgcggcaaggagcgggaactgattgtcctgcggagtgagaatggcgagacatggaaagaacaccagttcgatagtaagaacgaagatctcaccgaactgcttaatggcatggacgaggagctagacagcccggaggaattgggaaagaagcgaatatgtcggatcatcactaaagactttccccagtactttgctgttgtgagccgcatcaagcaggaaagcaaccaaatcggccccgagggaggaattctgagctcaacaacagtcccactggtgcaagcctccttccccgaaggcgctcttacgaaacggattcgggtggggctgcaggcgcaacccgtaccagacgaaattgtcaagaaaatactcggaaataaggctacatttagtcctatcgttaccgttgagccacggagacgaaagttccacaagcccatcacaatgactatccccgttccccctccttccggggaaggagttagcaacgggtataaaggggacacaacccctaatctgcggctgctctgcagtatcacaggaggtacatctcccgctcaatgggaggatatcacaggcactacccctctgacattcattaaggactgtgtgtcctttaccaccaacgtgtctgctaggttttggctggctgattgtcaccaggtcttggagaccgttgggctcgcgacccagctgtatagagaactcatctgcgtaccctatatggccaagttcgtggtattcgctaagatgaatgatcctgttgaaagctccctgcgatgcttctgtatgactgacgacaaggttgacaaaaccctggagcaacaagaaaattttgaggaggtggctcggagtaaagatattgaggttttggaaggcaagcctatctatgtcgattgctacgggaatttggcaccattgactaaaggcggacagcagctggtctttaacttctattcctttaaggaaaaccgcctaccatttagcattaagatccgagacacatcccaggaaccatgtggacgactgtcctttctcaaagagcctaagacaaccaaagggctgccccaaacagccgtctgcaacttaaatattacgctgcctgctcacaagaaaatcgaaaagacagaccgccggcagtcgttcgccagcttagcccttcgaaaacgatattcttatctcaccgaaccaggcatgtctccacagagtccatgcgagagaaccgacattcggatggccatcgtggccgatcatttggggctctcttggactgagctggcacgtgaactgaacttcagcgtggacgaaatcaaccaaatccgggttgaaaacccaaactctctgatatctcagtccttcatgcttctgaagaagtgggtgaccagagacggtaagaacgccaccaccgacgccctcacaagcgtgctgactaagattaataggatcgatatcgtcactctcctcgaaggtccaatttttgattatggcaatatctccgggacaaggagctttgccgatgaaaataacgtgtttcatgatccggtggatggatacccctctctccaggtggagcttgagacccccactgggctgcactacacaccgccgaccccattccagcaggatgactacttctctgatatctcctccatcgagagtccactgaggactccgagccggctttcagatggattggttccatcgcaaggtaacatcgaacacagtgccgatggcccgcctgttgtgaccgctgaggatgcttctctggaggattccaagcttgaagattccgtgcctttgacggagatgccagaggccgtcgacgtcgatgagtcccagctggagaatgtctgtctgtcatggcagaacgagacgtccagcggaaatttagagtcgtgtgcccaggcccgtagagtaaccgggggactcctcgatcgcctggatgattctcctgaccagtgcagagattctatcacgtcgtacttaaagggagaagccggtaaattcgaggcaaacgggtctcacacagagataaccccggaggctaagactaagagctacttccctgagtctcagaatgacgttgggaagcagagcaccaaggaaactctcaagcccaagatccatgggtctggacatgtggaggagcctgcatcgccgcttgccgcctaccagaaatccttggaggagacaagcaaactgattattgaggagacaaagccgtgcgtgcctgtgagcatgaaaaaaatgagtagaaccagccccgctgatggcaagccccgattaagcctgcacgaagaagagggatcttctggtagtgaacagaaacagggggaaggcttcaaggttaaaaccaagaaagagatcaggcacgtcgaaaagaagagccatagctag

SEQ ID NO: 108228 - DNA, 3354 bp, Artificial Sequence
  Description of Artificial Sequence: Synthetic coding sequence
atggccacccaaggggaccacctgaactgtgtgcagttgctgctgcagcacaatgtgccagtggatgatgtgacaaatgactacttaaccgcccttcatgtggcagcccactgcggccattataaagtcgccaaggtccttcttgataaaaaagcgaatcctaatgccaaggccctaaacggttttacaccattgcatatagcctgtaagaaaaatcgaattaaagtgatggagcttctcctgaagcacggagcaagcatccaggctgttaccgagtcaggactgaccccaattcacgtcgcagcttttatgggccacgtcaatattgtgtcccagctgatgcaccatggagcttcacccaatacgaccaatgtccgtggagaaaccgcacttcacatggcagcacggagcgggcaggctgaagtagttcggtatttggtgcaggatggcgcccaagttgaggcaaaggctaaggacgatcagacacccctgcacatctcagcacggctgggcaaagctgacattgtgcagcaactgttacagcagggcgcctccccaaatgcggccactacatcaggctatacacctctgcacttgtcagccagagaggggcatgaggacgtggcagccttcctgcttgaccacggtgccagtctctctatcacaaccaagaagggcttcactccactgcacgttgccgccaaatatggaaaactagaagtggccaatctactgctgcagaagagcgccagccctgacgccgccggaaaatctggtttgacaccactgcatgtggctgcacattacgacaatcagaaggtcgcactgctcctcctggaccagggagcctccccccacgcagctgccaaaaatggctatacccccctgcacatcgccgcgaagaaaaaccaaatggacattgcaaccaccctcctggaatacggagctgatgctaatgctgttacacgacagggcattgccagtgtgcacctagcagctcaggagggccatgtagatatggtctccttgctgttgggcaggaatgccaacgattctgggctcacaccccttcatctggccgcgcaggaggatcgtgtgaacgttgcagaggtactagttaatcagggagctcacgtggacgcacagaccaagatggggtataccccgctgcatgtgggttgccactatggcaacatcaagattgtgaattttctcctgcagcactctgcaaaagtgaacgcaaaaactaagaatggctatactcccctccaccaggccgcccagcagggccatactcacattatcaatgtgctgctccagaataacgccagtcccaatgaactcaccgtgaatggcaacactgctctggggatcgctcggagactgggttatattagcgtcgttgacaccttgaagattgtcaccgaggagactatgactaccactaccgtgaccgagaaacacaaaatgaatgtgccggagactatgaatgaagttttggacatgtcagatgatgaaggagaagacgcaatgactggagacacagacaagtatctggggccccaggacctgaaggagcttggagacgacagtttaccagccgaagggtacatggggttctctctgggcgccaggagcgcaagcctgagatcctttagttccgatcgtagctataccctcaaccggtcaagctacgccagagattcaatgatgattgaggagcttctcgtaccctctaaggagcaacatctgacattcacccgggagttcgatagcgattcactgaggcattacagctgggccgctgacactctggacaatgtgaatctggtttcgagccccatccactctggttttttggtgtcttttatggtcgatgctcgggggggcagcatgcggggaagtcgccatcatggaatgcggatcattatccctccacgtaaatgtacggctcctacgcgcattacatgtaggcttgtcaaaaggcacaagttggctaatccccctcccatggtggagggcgaaggtttggccagcaggcttgtggaaatggggccagcaggcgctcagttcctgggtcctgtaatcgtggaaatcccgcactttgggtccatgcggggtaaggaacgcgagctaatcgtcctgagatctgagaacggggaaacatggaaagagcaccagttcgatagtaagaatgaagacctgacagagctactcaacgggatggacgaggaattggatagcccagaagaactgggcaagaaaagaatttgtaggatcatcacgaaggacttcccccagtacttcgctgttgtctctcgcatcaaacaggagagcaaccagataggtcctgaaggcggtatcctctcatctaccaccgttccccttgtgcaggcatcgtttcccgagggcgccctgaccaagcgtattcgagtggggcttcaagcgcagcctgtcccagacgaaattgtgaagaagatcctcggaaacaaggccacctttagtcccatcgtgacagtggaaccccgaagacgaaagtttcacaagcccataacaatgacaatccccgtgcctcctccttccggagaaggagttagcaatggctacaaaggcgacactacacccaatctaaggttactctgcagtattacgggggggaccagcccagcccagtgggaggatatcactggtactactcctcttacatttattaaagattgcgtatcttttacaactaacgtgtcagccaggttctggcttgctgactgccaccaggtgctagagaccgtgggcctggccacacagctgtatcgagagctcatttgtgtgccctacatggcaaaatttgttgtcttcgcaaagatgaatgacccagttgagagttcgttgaggtgtttttgcatgactgacgacaaagtagataaaacgctcgagcaacaagaaaatttcgaggaagtggcaaggagcaaggatatcgaagtactggaaggaaagccaatatatgttgattgttacgggaaccttgcacctctcacaaaaggtgggcaacaactggtgttcaatttttattccttcaaggaaaaccgccttcccttcagcatcaagatcagggatactagccaggaaccctgcggccggttgtcattccttaaagaacccaaaactaccaaaggcctgccacagacagccgtctgtaatctgaatatcactctccccgctcataaaaaaatcgagaagacggacagacgccaaagtttcgccagcttggctcttagaaaaaggtacagctacctgaccgagcccggaatgagcgagtttccaaatacgttcacaaaccttagggggttctcctag

SEQ ID NO: 108229 - DNA, 2436 bp, Artificial Sequence
  Description of Artificial Sequence: Synthetic coding sequence
atggccctgccacagtccgaggacgctatgaccggagataccgataagtacctcgggccccaggacttaaaggaattgggtgacgactccctccccgcggagggctatatgggtttttctctgggcgcccggtctgcctcactgcgatcattctcttctgatagaagttacacattaaaccgcagcagctacgccagggatagtatgatgattgaggagctgctggtgccctctaaggaacagcatctcactttcacccgcgaattcgacagtgactcgctcaggcactactcttgggcggccgataccctggataatgtcaatctagtgagctctcccattcactccggtttccttgtgtctttcatggtagatgcccgaggggggagcatgagggggagccggcaccatggcatgcgtattattataccgccacggaagtgtaccgcccccacgaggattacatgtagactggtgaaacgacacaaactggcaaaccctcctccaatggtcgagggagaaggccttgcaagtaggctggtggaaatgggccctgcaggggcacagttcctggggcctgtcattgttgaaatcccccacttcggctcaatgaggggcaaggaacgagagctgatcgttctgcgctcagagaacggggagacgtggaaggagcaccaattcgatagtaagaacgaagatctgacagaattactgaatggaatggatgaggagctcgatagcccggaggagttgggtaagaagcgtatctgtaggattataactaaagatttcccccaatatttcgcagtggtctcccgcattaaacaagagagcaatcagattggcccggaaggcggaatcctgtcaagcacaaccgtgcccctggtacaagccagtttcccagagggcgcacttacaaagcggattagagtggggttgcaagcccaacctgtgccagatgagatagttaaaaagatcctgggaaacaaggctacttttagtccaattgtaaccgtagagcctagacggagaaagttccataagcctatcactatgacaatcccggtgccgcccccaagtggggagggggtcagcaacggctacaagggggacacaacccctaacttaagactcctttgcagcatcacaggcgggacttcgcctgctcaatgggaagatattacaggtaccactccactgacattcattaaagactgtgtttctttcactaccaatgtgagcgctagattttggctggccgattgccatcaggttctggagacagtgggcctggcaacccagctctaccgcgagctgatatgcgttccttatatggccaaatttgtcgtgtttgccaagatgaatgatcccgtggaaagctcactgaggtgcttctgcatgactgacgataaagtggataagacattggaacaacaagagaacttcgaggaagtggctaggtctaaggatatcgaggttctggaggggaaaccaatttacgtggactgttatggcaacctcgcacccttaaccaaagggggccagcagttggtctttaacttctacagcttcaaagaaaatcggctgcccttcagtatcaagatacgggatactagtcaagaaccttgtggtagactgagttttctcaaagagcctaagacaacaaaggggctcccacaaacggccgtgtgtaacctcaacattactctacctgcacacaagaaaatcgagaagacagacagacggcagtctttcgccagtctggcattacggaaacgatacagctatctgacagaacccggaatgtctcctcagagtccttgtgagcggacagatatccgaatggcaatcgtggccgatcacctgggactcagctggaccgagttggcaagggaactgaactttagcgtggacgagatcaatcaaatcagggtggaaaacccaaactccctcatatctcagtcttttatgctgttgaagaaatgggtgacccgggatggtaagaatgccaccactgatgccctgacatctgttctcactaagattaatcgcattgatattgtaactctgcttgaaggtcctatttttgactacggcaatatcagcggaacgcgcagtttcgcagacgagaataacgtttttcatgatcccgtggatgggtacccatctctgcaggtggagctggagacccctacgggcttgcactacacccccccaactccatttcagcaagacgactacttcagtgacatcagttccatcgaaagcccgctgagaactccttcacggctgagtgacggcctggtcccctcccagggcaatatcgagcactcagctgatgggcctcccgtggtgactgccgaagacgcgagcctcgaggactccaagctggaggactccgtgccactgacagagatgccagaggctgtgatgtag

SEQ ID NO: 108230 - DNA, 2796 bp, Artificial Sequence
  Description of Artificial Sequence: Synthetic coding sequence
tttaccctggcacacgtcccacaaagaggcgaaacggctctccacatggccgcccggagcggccaggcagaagtggtgcgttacttggtgcaagacggggctcaggtggaggcgaaagccaaagatgaccagacacctctgcatatctctgcccggctcgggaaggcggatatagtccaacagctcctgcaacagggggccagccccaacgcggccaccacaagcggttatacacctcttcatctgagtgcgcgagaagggcatgaggacgttgcggcattcctcttagatcacggggcatctctgtctattaccaccaagaaaggatttactccactccacgttgcggccaagtacggcaaactggaagtggccaatctgctgctgcaaaagagtgcctcccctgatgctgccggcaagtccggcctcactccactgcatgtggccgcccattatgataaccagaaggtcgctcttctgctgcttgatcagggtgcatccccgcacgctgccgccaagaacggatacacgcccctgcatatagcagctaaaaagaatcaaatggacattgccaccacccttctcgaatacggcgctgatgccaacgcagtgaccaggcagggtatcgcgtccgtgcacctggccgcgcaggagggacacgtggatatggtgtcactgctcttgggtaggaatgccaatgtcaatttgagtaacaaaagcgggctgacaccacttcatctggcagcccaggaggatagagtgaatgtggccgaggtgctggtgaatcagggggcccacgtggatgcccaaaccaaaatgggttatacgcctctacacgtcgggtgccactatggcaatatcaagatcgtcaatttcttgcttcaacattctgcgaaggtgaacgccaagaccaagaacggatatactcctttgcaccaggctgctcagcagggacacacccatatcattaatgtactgctgcagaacaacgccagccctaatgagctcaccgtgaacggcaataccgccctggggattgcacgcaggctgggctacatctccgtggtggacacccttaaaatagtgaccgaggaaactatgaccacaaccacagtgactgagaagcataagatgaatgtccccgagaccatgaatgaggtgctcgacatgtctgacgacgagggtgaagatgcaatgaccggagataccgataagtacctcggcccacaagatttgaaagaactcggcgatgatagcctacctgctgaaggctacatggggttctcactcggtgctaggtccgcatcaagatctttctcttcagaccgaagctataccttgaacagaagtagttacgcaagagacagtatgatgatagaagagcttctcgttccaagcaaagaacagcacctgacgtttacccgagaattcgactcggattcgctgcgtcactactcctgggccgcagacaccctggataacgtcaacctggtctcttctccaatccattctggatactcaagccccctcccccagtacgattctaggtttctcgtttcctttatggttgacgcccgaggcgggtcaatgcgcggttccagacaccatggtatgcggattattatcccgcctcgaaaatgcacggcccctacacgcataacgtgccggctggttaagcgtcataagctggctaatccacctccgatggtggaaggcgagggcttggctagtcggttggtcgaaatgggacccgctggcgcccagttccttggacctgtcattgtagagattccgcattttggctctatgaggggaaaagagcgtgaattgatcgtattgagatcggagaacggtgagacttggaaagaacaccaattcgatagcaagaatgaggacctgacggaactcttgaatggaatggacgaggaacttgactcacccgaggagctgggcaagaagagaatctgccgaatcatcaccaaggacttccctcagtattttgccgtggtgtcaaggattaaacaagagtccaaccagattgggccagaagggggtattcttagcagcaccaccgttccactcgtgcaagcatcattccctgagggagcactgacaaagagaattcgggtaggactccaggcacagccggtcccagacgagatcgtaaagaaaattttgggcaacaaggccaccttctcccctattgttaccgtcgagccacgacgcaggaaatttcacaagccgattaccatgacaatccctgttcccccgccctctggagagggtgtgtccaacggctataagggagataccaccccaaacttacgtctcctttgtagcatcactggcggaacctcgcccgcccagtgggaggatatcacaggaactactcccctgacattcattaaggactgtgtgtctttcactacaaacgtgagcgcgagattttggctcgccgactgccaccaagtactggaaaccgtcggactggccacccagctatatcgagaactgatttgtgtgccctacatggcaaaattcgtagtttttgctaagatgaacgatcccgtggagtcaagcttgcgttgcttttgcatgacagatgataaggtggacaagaccctggagcagcaggaaaattttgaggaggtcgcaaggtcaaaagacattgaggtaccctgctcccaaaagcaggttcattttatcacttattcaagatatgaagtcctgttctgtggattaaactcgactcactataagattccttccgccctgttgattctgctgcttctgtag

SEQ ID NO: 108231 - DNA, 1647 bp, Artificial Sequence
  Description of Artificial Sequence: Synthetic coding sequence
tcactccctgagagcgaagatgcaatgacgggtgacactgacaagtatctagggccacaggaccttaaggaactgggggatgacagcctgcccgctgagggatatatgggatttagtttgggtgccagatctgccagcctcaggtccttctcctctgacagatcatataccctgaatcgcagcagctacgcccgtgacagcatgatgatcgaggagctcctcgtaccttctaaagagcaacacctgacctttactcgggagtttgattccgacagcctaaggcactactcgtgggccgcagatacacttgacaacgtgaatctagtgagctcgccgatacattctggattcctggtttccttcatggttgacgcacgcggcgggagtatgagaggttcccggcatcacggaatgcggataatcattcctcctaggaagtgcactgctcctacacgcataacatgccgacttgttaagcggcataaacttgctaaccctcctccaatggtcgaaggggaaggccttgcttctcgcctggtcgaaatgggccctgccggagcacaatttctggggcccgtgatcgttgaaatccctcatttcgggagcatgcgaggcaaagagcgcgagcttattgtgttgagaagcgaaaacggcgagacctggaaggaacatcagtttgattcaaagaatgaggatctgaccgagctgcttaatggtatggacgaagagctggactcgccggaggaactggggaaaaagcgtatatgccgcattattaccaaggacttcccgcagtattttgcagtcgttagtcgtatcaaacaggaatcaaaccagattggccctgaagggggtattctttcgtcgacaacagtaccattggtgcaggccagctttcccgagggggctctcaccaaaagaataagggttggcctgcaggcacagccagtgccggatgaaatcgtaaaaaaaatattgggcaacaaggctacattttcgccaatcgtgactgtggagccacggcgtaggaagtttcataagcctataacgatgacaatccctgtgcctcctccttccggcgagggagtgtccaacggctacaagggggacaccaccccgaacctaaggctgctgtgcagcataacaggggggaccagccccgcgcaatgggaggatattactggaacaactccgctaacctttatcaaggattgcgtatcgttcacaaccaacgtttcagccaggttctggttggccgactgccaccaggtgctagagaccgtcggtctggctactcagttatatcgcgaactgatctgtgtcccctatatggccaagttcgtagtgtttgcaaagatgaatgaccctgttgagagctctctccggtgtttctgcatgaccgatgataaagtcgataaaacacttgagcagcaggaaaacttcgaggaagtagcccgaagcaaagacattgaagtcctggaggggaaacccatctacgtggattgttatggcaacctcgcacccctgactaaagggggccagcagctcgtgttcaatttttacagtttcaaggaaaaccgcctgcctttcagcatcaagataagagacacttcacaaaatattgtccaactgtcctgcctgttgtag

SEQ ID NO: 108232 - DNA, 1443 bp, Artificial Sequence
  Description of Artificial Sequence: Synthetic coding sequence
atggccgtcgctagagctgcactcggcccgctggtcacgggcctgtacgacgtacaggcattcaaattcggggactttgttctaaagtccggtctatcatcccctatctacatagacctgcgggggatcgtgtctagacctaggcttctatcccaggtggctgacatcctttttcagaccgcgcagaatgcagggatttctttcgataccgtttgtggagtaccgtacacggccttgcccctcgccacagtgatttgcagcaccaaccagattcccatgctgataagacgcaaggagacaaaagattacgggacaaagagactcgtggaaggtacaattaaccccggagaaacctgtttgatcattgaagatgttgtgaccagcggctcttctgtgctggaaaccgtggaggttctgcagaaggaagggctgaaggttaccgatgccatcgtgctcctagaccgggaacaaggtgggaaagacaaattacaagctcatggcatccggcttcattctgtgtgcacactgagcaaaatgctggaaatccttgagcagcagaagaaagtcgatgccgaaactgtcggccgcgtgaagaggtttatccaggagaatgtgtttgtagcagccaaccataacgggtcccccctgtcaatcaaagaggctcccaaggaactgtccttcggagcgcgcgccgagctgcctcgaatccaccccgtagctagtaagttgctgcggcttatgcagaagaaagagaccaatctgtgtctcagcgctgacgtgtcactggctagggagcttctccagctcgccgacgccctgggcccaagcatatgcatgctgaagacccacgttgacattctaaacgatttcacactcgatgttatgaaggagctcattacgctggctaagtgccacgagtttttaatttttgaggacaggaaatttgcagacataggaaacacggtgaagaagcaatacgaggggggcattttcaagatagcctcttgggcagatttggtcaacgcacacgtggtgcccggttctggagttgtgaaaggattacaggaagttgggctgcctttacaccgcggctgcctgctgattgccgagatgagctccaccggtagtcttgccactggcgattataccagggcggcagtgcggatggccgaagagcatagcgagtttgtggtgggatttatttctggcagccgcgtgagtatgaagcctgaattcctccacttgacccctggagtacagctggaggccggcggggataatctcggacagcaatacaacagcccacaggaagtaatagggaaaagaggatccgatatcattatcgtggggcgtgggattatctccgcagcagaccgtctggaagctgcagagatgtatcggaaagccgcctgggaagcttacttgtcacggcttggagtctag

SEQ ID NO: 108233 - DNA, 1218 bp, Artificial Sequence
  Description of Artificial Sequence: Synthetic coding sequence
atggatacgtctgatctgttcgcctcttgcaggaaaggtgacgtcggaagagtgaggtacttactggagcaggttctgtatctgctggccaacggtgctaggtgcgaggcaaatacctttgatggcgaacgctgtctctacggtgcacttagcgatcctatccggagggctctcagagactacaagcatcctttgctctgggatttgttgtcagacctcgaggccaaatgcgagaaagtctctgaattcgtggcttcaaagcctggcacgtgcgtaaaggtcctgactattgaaccaccacctgctgacccaaggctgcgagaggacatggctttgctggccgactgcgcactccctcccgagttaagggcgtttttctgcgggcgcagtgactactttcgggctcttctcgacgaccatttccgcgagagcgaggaacccgcaacctccggcggacccccagccgtgaccttacatggcattagcccagatgtttttacccacgttctatattacatgtactcggaccatacagaactgtcaccggaggcagcctacgatgttttgagcgtcgctgatatgtaccttctccccggcttgaagagactctgcgggcgctccctggctcagatgctcgatgaggacactgtggtgggagtttggcgagtggccaagctctttcgtcttgcgaggctggaggatcaatgcactgagtacatggctaaggtcatagaaaaattagtggaacgagaggatttcgttgaagccgtaaaggaagaagctgccgctgtggcagctaggcaggagacggatagcattccacttgtcgacgatataaggtttcacgtagcctctacagttcagacctacagtgcgatcgaggaggctcagcagcgtctgcgggccctggaggatactagcatgtgtatgcggctctgcgccgccctgctgccggcaccttgtaccttgagggcctcttggggggtacgaggagcccaatggggtttctcatccctacacgaaccgggagaccctaggggcggatctatctgggacgaaccacctccccccaatgctcaagctagcccacaggacccaggcgggggccatcactccggaaaaccgggagtaggtgttggcttcggcctgtcaacattcttgctgcagattccgcctacccatccatcccccaagtcctcgcccctggctcttgcatag

SEQ ID NO: 108234 - DNA, 1011 bp, Artificial Sequence
  Description of Artificial Sequence: Synthetic coding sequence
atgcttgacacaaagtggaagggcaagagtgtggtcgtcctgcgccatcctctcatcaaccctgtagccttcggcgcacttttgcagtacctgtacaccgggagactcgatattggcgtcgagcatgtatctgactgcgagagattggccaaacaatgccagctctgggacctgctctcagatctagaggcaaaatgcgagaaagtttctgagtttgtagctagtaaacccggtacatgcgttaaggtcctgactatcgaacccccccccgccgatcctcgcctgcgggaagatatggctctgctcgcagattgtgctctgcctcctgagctgagaggcgatttgtgggagctgccctttccatgccccgatggcttcaactcatgcccagatatttgtttccgagttgccggatgtagtttcctgtgtcacaaagctttcttctgtgggaggagcgactactttagagccttattggacgaccacttccgagagagcgaagagccggctacgagcggcggtccgccagctgttacactgcacggcatttcccctgacgtcttcacccacgtactgtattatatgtacagtgaccatacggaactcagtcccgaggcagcttatgacgtgctcagtgttgccgatatgtacttacttcccggtctcaaaagactctgcggccggtcgctggcgcagatgcttgacgaagacaccgtcgtcggagtgtggagggtggccaaattatttcgcttagcccggctggaggatcagtgcacagagtacatggcaaaagtgatagaaaagctcgtcgaaagagaagatttcgtggaggctgtcaaggaagaagccgcagcggtcgccgcgcgccaggagacggactccatcccgctcgtggatgatatccgcttccatgtcgcctcaaccgtgcagacctactctgcgatagaggaagcacagcagcgccttagagccctcgaggatctcttggtgagtatcgggttagattgctag

SEQ ID NO: 108235 - DNA, 1011 bp, Artificial Sequence
  Description of Artificial Sequence: Synthetic coding sequence
atgcttgacacaaagtggaagggcaagagcgtggtggttctacgccacccgttgattaatccagtggcatttggagcactgctgcagtacttgtacacaggaaggctggatatcggagtagagcacgtctccgactgtgagcgtctagccaagcagtgccagctgtgggatctgttgagcgatttggaagctaagtgcgagaaagtaagcgagtttgtggcgagcaagcccgggacgtgtgtgaaggtcctgaccattgagccaccccctgccgatccacggctgcgagaggacatggccctcctggctgattgcgctctgccacctgaactgcggggcgatctgtgggagctccctttcccgtgtccagacgggttcaactcttgccccgacatttgcttccgggtagcaggctgcagcttcctctgccataaggcttttttctgcggccgttcagactactttcgggcgctgttagatgaccatttccgcgagtctgaggaaccagctactagcggtgggcctccagctgtaacactgcatgggatctcacccgacgtgttcactcatgtgctgtattacatgtatagcgaccacactgaactctcaccagaagccgcctatgatgtgctgagcgtcgctgatatgtacctcttacctggattaaagcggctctgtggtcgctcgctcgctcagatgctagacgaggacacagtcgtgggagtttggcgcgtggcaaagctttttcgtttggcccgtttagaagaccagtgtacagagtatatggcaaaggtgattgagaagctggtagaaagggaggactttgtcgaggccgtgaaggaagaggccgcggccgttgctgccagacaggaaaccgacagcatcccactggtcgatgatattcgctttcacgtggcttccaccgttcaaacttactccgccatcgaggaggcccagcagagattacgggccttggaagatcttctggtgtcaatcggattagactgttag

SEQ ID NO: 108236 - DNA, 1011 bp, Artificial Sequence
  Description of Artificial Sequence: Synthetic coding sequence
atgctagacactaagtggaaaggcaagagtgtggtggtactgcgacatcctctgattaaccctgtggcatttggcgcacttctgcagtacctctatacgggcagactagatattggcgtggagcacgtttcagactgcgaaagattagctaagcagtgtcaattgtgggatctgctgtccgacctggaagccaagtgtgaaaaggtgtcagaatttgttgcttccaagcctgggacttgcgtgaaggttctgaccatcgaaccccccccggccgaccccagacttcgcgaggacatggcacttttggccgattgtgccctgccacccgagctcaggggcgatctatgggaattacctttcccctgccccgatgggttcaactcttgccccgacatatgctttcgggtcgccggatgctcgttcttgtgtcacaaggcttttttctgtggacggagtgattattttagggccctcctcgatgatcacttcagagaatccgaagagccagctacttctggcggacctcccgctgtcacccttcacggtatttctccggacgtgtttacccatgtgctgtattacatgtactcagatcacactgagctgagccccgaagccgcctatgacgtgctgagtgtggctgatatgtatcttttacccggtctgaaacgcctgtgcggaagatctctggctcagatgctcgatgaggacactgtggtgggggtatggagggtggctaaattgtttagactcgcgagactggaggatcagtgcacagaatacatggcaaaagttatagaaaagcttgtggaacgggaggactttgttgaggccgttaaagaagaggccgctgccgtggccgcaaggcaagagactgacagcataccacttgtcgatgacatcagattccacgtagcctccaccgtccagacgtactctgctatcgaggaggcccaacagagacttcgcgcactcgaagatctgctcgtgtctataggcttagactgttag

SEQ ID NO: 108237 - DNA, 2061 bp, Artificial Sequence
  Description of Artificial Sequence: Synthetic coding sequence
atggaggcatcccaggagggacacctggagctggtgaagtatctcctggcaagtggagcgaacgtccacgcgaccactgccacaggggataccgccttaacctacgcttgtgaaaacggacacactgatgttgccgacgtacttctgcaggcaggggctgatctagataagcaggaagacatgaagaccattctagagggcatcgatcctgcgaagcatcaggaacatgagagcgagggcggccgaacacccctgatgaaagccgcccgagcgggccacctttgtacagtccaatttcttatctcgaaaggggctaacgtcaaccgggctaccgcaaacaacgaccataccgtggtgtcactggcctgtgccggcggccatctagccgtcgtggagctccttctggcacatggcgccgacccaacacaccggttgaaagatggatcaaccatgcttattgaggctgcaaagggtggccacactaatgtggtgagttacctcctcgactaccccaataacgttctgtccgtacctaccaccgatgtatcccagctgccgccacccagccaagaccagtctcaagagcctgatcgaaccagccaagagaacagtcccgcccttttgggtgtccagaaagccgtgagcacccgcgtgccaactggctcaaatagttccagtcagacgacagaatgcttgaccccagaatcatgctcgcagaccacaagcaatgtggctagccaatcaatgcctccagtatacccgagcgttgacatcgatgctcacaccgaaagcaatcacgatactgccctgacccttgcttgcgcaggcggccatgaggaacttgtttctgtgttgattgcaagggatgcaaaaattgaacaccgtgacaaaaaaggttttactccactcatcctggctgccactgccgggcacgtaggagtcgtcgagatactgctggacaagggcggtgatatcgaagcccagagcgagcgtaccaaggacaccccattgtcgttggcatgctctggtgggcggcaggaggtagtcgatctgttgcttgctcgcggcgccaacaaggaacacaggaacgtcagtgattacacccctctcagcctggccgcgtcagggggctacgtgaacattatcaaaattttgctgaacgcaggtgcagaaatcaactcccgaacaggatctaagctcggaatttcaccccttatgctagccgccatgaatggacacgtacccgcagttaagctgttgctggacatgggtagcgacattaacgcccagattgagacaaatcgtaataccgctttgacgttagcctgcttccagggcagggcagaggttgtgagtttactcctggacagaaaggctaacgtggagcaccgcgccaagacgggattgactcccctcatggaggcagctagcggaggctacgctgaagtgggtcgagtgctgttagacaaaggggcagatgtgaacgctccgcccgtgcccagctcgcgcgacacggccctgactatcgccgccgataaggggcattataaattttgcgagctgcttattcaccggggggcccatatagacgtgcggaataagaagggtaatactccactctggttagcaagtaatggcgggcattttgacgtcgtacagctgttagttcaggcgggtgctgacgtcgatgccgctgataaccggaaaattacgcctctgatgtcagccttccgcaaaggccacgtaaaagtcgtgcaatacctggtgaaggaggtgaatcagttcccatccgatattgaatgcatgcggtatatcgctaccatcactgataaagagctgctgaaaaagtgccaccagtgcgttgagactatcgtgaaggccaaggatcagcaagcagcggaagctaataaaaatgcttccatattattaaaggagctcgatctcgaaaaaagccgagaagaaagccgcaagcaggcactggcagcgaagcgtgaaaagcggaaggagaagcgaaaaaagaagaaagaggaacaaaagcgaaaacaggaggaggatgagtag

SEQ ID NO: 108238 - DNA, 7623 bp, Artificial Sequence
  Description of Artificial Sequence: Synthetic coding sequence
atgcttaccgattctggagggggaggcaccagcttcgaagaggatctggactcagtcgccccccgaagtgctccagcaggtgcctcagaaccacctccccccggcggcgtaggcctggggatcaggaccgtacggttgttcggagaggcaggacctgcatccggggtggggtcttcgggtggtggtggaagcgggtccggcactgggggcggggacgccgcattagactttaagttggcagcggcggtcctgcggacaggtggtggggggggggccagcggatctgacgaagatgaagtcagtgaggtcgagagttttatcctggaccaggaagacttggacaatccagtgctcaagacaacctcagagatctttctgagctccactgccgaaggagcagatttaagaacagtggaccccgaaacacaggcccgccttgaagccctccttgaggccgcgggcattggaaagctctccacagccgatggtaaggctttcgcggaccccgaagtcctgagacgccttactagttcagtgtcctgcgcgctggatgaagccgcagcagccttaaccagaatgaaagcagagaattctcataatgccggccaggtggatactcgtagtctggctgaggcctgctcagacggagacgtcaatgccgttagaaaactcctcgatgaaggaaggtctgtcaatgaacatactgaggagggagaaagcctgctgtgcttagcctgctctgctggatactacgagttggctcaggttctcctggccatgcacgctaatgttgaggaccgcgggaataagggcgacattacccccttgatggccgcctcctctggcggctacctggatatcgtgaagttgttgctgctccacgacgcggatgtaaactcccaaagcgctactgggaacaccgcccttacctatgcatgtgcaggaggctttgtcgatatcgtcaaagtccttctcaatgaaggggccaacatcgaggaccacaatgaaaatggccacactcccctaatggaggcggcgagcgccggtcatgtcgaagtggctcgggtactcctggaccacggagctggaattaatactcattctaacgaattcaaagaatccgcccttaccctcgcctgttataagggtcatctggacatggtgagatttctcctggaggccggtgcagatcaggaacacaagaccgatgaaatgcatactgctctgatggaggcgtgtatggatgggcacgttgaggttgccaggctgttactggattctggggcacaagtgaatatgcccgccgattcgtttgaatccccattaacactggctgcctgcgggggtcacgtcgagctagcggccctgctgatagagagaggtgctaacctggaggaggttaatgacgagggatatacacccctgatggaagctgcccgagaggggcacgaggagatggtggcgctgctgctagcacagggagctaacatcaatgctcagaccgaggagactcaggagaccgccctgacacttgcgtgctgcggcggattttctgaggtggccgattttctgatcaaggctggagccgatattgaactgggttgttctacaccactgatggaagcaagtcaggaagggcacttggagcttgttaagtacttgttagcctcaggggctaacgtgcacgcaacaaccgcaactggagacaccgccctgacttatgcctgcgagaacgggcatacagatgttgccgatgtcctcctgcaggctggtgcagacttagaacatgaatccgagggcggccgaactccattgatgaaagctgccagggccggccatttgtgtacggttcagttcctcatctccaagggtgccaatgttaaccgggccacagctaataacgaccatacagttgtgtcattggcctgcgccggaggacatctcgcagtggtggagctgcttctagctcatggcgcagaccccacccatcggctgaaggacgggagtacgatgctcattgaggcagccaaaggcggtcacacaaatgtggtgagttacctgctggactaccctaataatgtgctaagcgtgcctacgactgacgtgtcccagctgcctcctccgagtcaggaccagtcccaggtgcctagggtgccgacccatacactagccatggtggtgccacctcaggagccggacaggaccagtcaggagaactctcccgctttactgggagtgcaaaagggcacaagtaagcagaagagctcaagtctgcaggtggctgatcaagatttactgccatcatttcatccctatcagcccctggagtgcattgttgaagagaccgagggaaagcttaatgagctcggccagcgcataagtgctatcgaaaaggctcagttgaaatctctggagctgatccagggggagccactgaacaaagacaagatcgaggaactgaagaaaaaccgggaggaacaggtccagaagaaaaagaaaattctgaaagagctgcagaaggtcgagagacagctgcagatgaaaacccagcagcagtttactaaagaatacctcgagacgaagggccagaaggacactgtcagtctgcaccagcagtgttctcacagaggggtattccctgagggtgagggcgacggctcactacccgaggatcattttagtgagctgccccaggtggacacaatcctttttaaggacaatgacgtagacgatgaacagcagtcgccgccatctgcagaacagatagatttcgtgccagtgcagcctctgtcttctccccagtgcaatttttcaagtgacctgggatcaaacggaacgaacagcttggaactccagaaggtatccggcaatcagcaaatcgttggtcagcctcagattgctatcaccggacacgaccagggcctgctggtccaggagccagatggcttaatggttgcaacgccggcccagaccctaactgataccctcgacgatctgatcgctgcagtatcaacccgtgtgcccacaggaagcaactctagctctcagaccaccgagtgcctgacccccgagtcttgcagtcagactacgagcaacgtcgccagccaaagcatgcctcccgtctacccatctgtcgatattgatgcacacaccgagtccaaccacgatacagccctgacactggcttgcgcagggggccacgaagaactggtctcagtccttatcgcccgagacgccaaaatagagcatagagacaagaagggttttactcctttgatcctggctgccactgccggccacgttggcgtggttgagattctactggacaaagggggtgacattgaggcgcaatcagagcggacaaaagatacacctctctcccttgcctgctcaggcgggcgacaggaggtggtggacctgctgttggcccgaggggccaacaaggaacaccggaatgtaagcgactatacccctctctcgcttgccgcgagtggtgggtatgtgaatattataaagattctgctgaatgccggagcggagattaattcaaggaccggcagcaagcttgggatctcccccctaatgctggccgctatgaacggtcacgtgcccgcagttaaattattgctggacatggggtctgatattaacgctcagatcgagacaaacagaaatacagccctgactttggcttgctttcaaggtcgcgccgaagttgtaagcctcctgctggatcgcaaagccaatgtggagcacagagccaaaaccggcctcacccccctgatggaggctgcctctgggggttacgccgaagtggggcgtgtgctgctggataaaggcgctgatgttaacgctcctcccgttccatcatcccgtgacacagctctcactattgccgcagacaaaggtcattataaattttgcgaactgcttatacatcgaggtgcacacatcgatgtgcggaacaagaagggaaacactcctttatggttggcctcgaatgggggacatttcgacgtcgtccagctcctggtccaggccggagcagatgtagatgcggctgataaccgaaaaattactccgctaatgtctgcattcagaaaaggacacgtgaaagtggtgcagtatctggtgaaagaggtcaaccagtttccaagcgatatagagtgtatgcggtacattgccacgataacagataaggaattgttaaagaaatgccatcaatgtgtagagactattgttaaggcaaaagaccagcaggctgccgaagccaacaaaaatgcatctatcctgcttaaagagctggaccttgagaagagcagggaggaatccaggaagcaggctttagccgccaagagggaaaagagaaaggagaaaaggaagaagaagaaggaagaacagaaacgaaagcaagaagaagatgaggagaataaacctaaagagaactcagaactccctgaggatgaggatgaggaagagaacgacgaggacgtggaacaggaggtacctatcgagcccccttccgctactacaaccactactattggtatatccgcaacatccgctactttcacaaatgtcttcgggaaaaagagggctaatgttgtgactacacccagtacgaacagaaagaacaaaaaaaacaaaaccaaagagacgccacccactgcccatctcatattgccagaacagcacatgagcctggcacaacagaaagctgacaagaataaaatcaatggggagcccagaggcgggggcgccggggggaattccgattcagataacttggactccacagactgtaactctgagtcttccagcgggggcaaatcccaagaactcaacttcgtgatggatgtcaactctagcaagtacccatctcttctccttcatagccaagaggaaaagacaagtactgcaacgagtaagactcaaactcggcttgagggcgaggtcactccaaacagcctctcaactagttataaaacggtgagtctgccattgtcttcgcccaatattaaactcaacctgacttcccccaaacggggccagaagcgtgaggagggttggaaggaggttgtgaggcggtccaagaagttgtctgtgccagccagtgtggtgtcccggatcatgggccgtggcggttgtaatattacagccatccaagatgtaaccggcgcgcacatcgatgtcgataaacagaaggataagaacggcgagcggatgattacaatcagaggaggaactgagtctacgcgctatgctgtccagttgataaacgccctgatccaggacccggcgaaggagttggaggatcttatccccaaaaatcatataaggacacctgccagtacgaaatccatccatgctaacttctcatcgggtgtcggtacaaccgctgcgagcagcaaaaacgcttttcccctgggcgctccgactctggtcacaagccaggctacgacattgtccaccttccagcctgcaaacaagttgaacaaaaacgtgcctactaatgtccggtcctccttccctgtatcgctcccccttgcttaccctcacccacattttgccctgttggccgcccagacgatgcagcaaatccgacacccccggttgcctatggctcaatttggaggcactttctctccgtcccccaatacatggggacctttccctgtccgccctgtgaatcccggaaatactaattcttctccaaagcacaacaatacaagtcggttgcccaaccagaatgggacagttctcccctcggagagtgcgggactagccaccgcaagctgcccgatcacggtgtctagtgttgtggccgcatcccaacagctctgtgtgacaaatacccgaacaccgtcatccgtgaggaagcagctttttgcttgcgtgccgaagacttcgcccccagccactgttatttcttcagtaacctccacttgctcatccttaccttccgtctcttcagcaccaataaccagcggtcaggcccccaccaccttcctccccgcgtctaccagccaggctcagctatcctcccagaaaatggagtctttctcggccgtgccacccacgaaagaaaaagttagcactcaggaccaaccaatggccaatttatgcacgcctagcagcaccgcgaatagctgcagctcctccgcatctaacacgccaggggcccccgagacacatccctcttcaagccctacgcctacatcatctaatacgcaagaagaggctcagccttcaagcgtgtctgacctgtcacccatgtccatgccctttgcttccaattcagagcctgcaccactcacacttacgagccctagaatggtcgccgccgacaaccaggacacaagcaatctcccgcaactggcggtccccgctcctagagtgtctcacaggatgcagccacgcggatccttctactcaatggtcccaaacgctacgattcatcaggatcctcagtcaatctttgtgactaatcctgttactttaactcctccacaaggcccgcccgcagcagtccagcttagtagcgcagtaaacattatgaacggaagccaaatgcatattaaccctgccaataagagcctgccacccaccttcggccccgctaccttattcaatcatttcagtagcttgttcgactcatcccaagtgccggccaaccaagggtggggggacggccccttatcttcccgggtcgccactgacgcaagtttcacagtgcagtctgcatttctcgggaattctgtcctggggcacctggaaaatatgcatcccgacaattcaaaggctccaggttttagaccaccatcccaacgtgtgtccacaagtccggtgggtctgccatccatcgatcccagcggcagcagtccatctagctcttctgctcccctggcaagctttagtgggatcccaggcactagggtctttttgcagggacctgctccagtggggactccttcgttcaaccgccagcatttttcgcctcatccctggacatctgctagcaacagctgtgattcccctatccctagcgtgagtagtgggtcgagctcaccactgtccgctacctccgccccgccgaccctagggcagccaaagggcgttagcgcctcgcaagatcgaaaaatcccacccccgatcggaaccgaaagacttgctcgaatccgccagggcggcagcgtggcccaggcaccggccgggactagcttcgtcgctcctgtgggacacagcggaatatggagcttcggtgtcaacgcggtgagcgaaggcctctctggctggagtcaatcagtgatgggaaatcatcctatgcaccaacagctcagtgatccctccaccttctctcaacatcagccaatggagcgcgacgacagtgggatggtggccccctccaacatcttccatcaacccatggcgagcggattcgtagacttctctaagggactgccaattagtatgtatggcggcacaattataccttcacacccgcagctggcagacgtgcctggtggacccttgtttaatggcttgcataatccggacccagcctggaaccctatgataaaagtcattcagaactcaacagaatgcaccgatgcccaacaatag

SEQ ID NO: 108239 - DNA, 7854 bp, Artificial Sequence
  Description of Artificial Sequence: Synthetic coding sequence
atgcttaccgattccggagggggcggaacaagcttcgaagaagatttagattcagtcgccccaagatccgcaccagccggtgcttccgagccacccccccctgggggagtcgggttagggatcagaaccgttcgcctcttcggggaagccggtccagcctctggcgtgggatcttctgggggcgggggctcaggttcagggaccggcggcggcgatgcggccttggattttaaattggctgccgcagtgctgcggaccggaggcggtgggggagcctcaggatctgatgaagatgaggtttctgaagttgaaagtttcatcctcgatcaagaagatctggacaacccggtcctcaagacgacttcagaaatattcctgagctcaaccgcagagggggccgacctacgcaccgttgatcctgaaacccaggcgaggctcgaagcactgctggaggctgctgggattggaaaactctccacagccgatggcaaggctttcgctgatccagaggttcttagaagactcactagctcagtgtcatgtgcactggatgaagcagccgccgcgttaacccggatgaaagctgaaaatagccacaatgccgggcaggttgatacaaggtcgctggcggaggcgtgcagtgacggagatgtgaatgctgttcgcaagcttctggatgagggaaggtcagtcaatgaacacacggaagagggcgagagcctgttgtgtctggcttgttctgccggatactatgaattggcgcaggtgttactggcaatgcacgctaatgtggaagacagggggaacaaaggggatatcacacccctgatggctgccagctccggtggatacctggacatcgtgaaactgttgctcctacacgatgccgatgtcaactcgcagagcgccaccggcaataccgccctgacctacgcgtgcgcgggtggatttgtggatattgtgaaggttctgttgaatgaaggagcgaacatagaggatcacaacgagaacggacataccccgctgatggaagctgcttccgctggtcatgttgaggtggctagagtcttactagaccacggagccgggattaacacacatagtaatgaattcaaagagtcagccctgaccctcgcttgctacaaaggacatcttgacatggttcggtttctgctcgaggccggcgccgatcaggaacacaagacggatgaaatgcatactgcacttatggaagcttgcatggatggacatgtcgaagtggcacgccttctgttggactcaggtgctcaggtcaatatgcccgcagattcattcgagtctccgctgactttggctgcctgtggaggtcacgtcgaactggctgcattgctcatagagaggggggccaatctggaggaggtcaacgatgaaggatacacccccctcatggaggcagcacgagaagggcacgaggagatggttgcactcctcctcgcccagggggcaaacatcaatgcccagaccgaagaaactcaggagacagccctcaccctcgcctgctgcggcggtttttccgaggttgcagactttttaatcaaggccggggctgatattgaattagggtgttccacccctctgatggaagcttcacaggagggacacctggaactcgtcaagtacctcctggcatccggagcgaacgtgcatgccacgactgctacgggagatacagcgctcacttacgcatgcgaaaacggtcatacagacgtagcagacgttctgctgcaggctggcgccgatctcgagcacgagtcggaaggtggccggactccactcatgaaggctgcccgcgctggtcatctctgtacagtgcaattcctgataagtaaaggagcaaacgttaatagagccacggccaacaacgatcacacagtagtgtccttggcctgtgcaggagggcatctcgccgtggtcgagctgctactagcgcacggcgccgatccaacacacaggctcaaggatggcagtacaatgttaatagaagcagccaaaggcggacataccaacgtagtgagctacctgctcgactaccctaataacgtgctatctgtccctaccacagacgtcagtcagctgcctcctcccagtcaagaccagagccaagtacctagggtccctacacacacactcgccatggtggtgcccccacaggagccagatagaacgtctcaggaaaattcccctgccctcctgggagtgcagaaggggacctcaaaacagaaatcctccagcttgcaggttgcagaccaggacctcctcccatccttccatccctaccagcccctggagtgcatcgtcgaggagacagaagggaagcttaacgaactgggtcagaggatctctgcgatcgagaaagcccaactaaaatccttggagttgatccagggggagccgctgaacaaggataagatcgaagagcttaaaaaaaaccgcgaagagcaggtacagaagaagaagaagatcttaaaagaactccagaaagtagaacggcaactgcagatgaagacccagcagcagtttaccaaggagtatctcgagaccaaagggcaaaaagacaccgtgagcctgcatcaacagtgcagtcacaggggcgtgttccccgaaggagaaggcgatggcagtcttcccgaagatcatttttcagaactgccacaagtggataccattttgtttaaagacaatgacgtggatgacgagcagcagagcccccccagcgctgagcagattgacttcgtccccgtccagccattgtcctccccacagtgcaacttctcttccgacctggggagcaatggaaccaacagcctcgaattacagaaggtctcaggcaaccagcagatcgtgggacagccacagattgctatcactgggcacgatcaaggcttgctggttcaggagcccgacgggctgatggttgcaacacccgcccagactttgactgatactcttgatgatcttatagctgccgtgtccacgcgggtacctacaggatccaattcgagttcacagactaccgaatgtctgacaccagagtcctgctctcagactactagcaacgtagcgtcacaatcaatgccaccagtctaccccagcgtcgacatcgatgcacatactgagtcaaaccacgacacggcactaaccctagcctgcgcaggcggccatgaggagctggtttccgttttgatagcccgggatgcgaagatcgagcacagagataagaagggcttcacacccctgatcctagctgccacagcaggccatgtgggcgttgtggaaattctcttggacaaaggcggggatattgaggctcagtctgagcgaacaaaagatacgccgctgtctctcgcctgctcaggagggcgccaggaggttgtggacctgctgctcgcaaggggcgccaataaagagcaccggaatgttagtgactacacaccgctcagcctggcagccagcggtggctatgttaacatcatcaaaattctccttaacgctggagccgagattaactctcgaacaggatccaaacttgggatcagtccactgatgctggcagctatgaatggccacgtccctgccgtgaagcttctcctggatatggggagtgatatcaacgcacaaatcgaaaccaatcgcaacaccgccctaacattagcctgcttccagggccgggccgaagtggtatctctcctcctggatcggaaagctaacgttgagcacagagccaagaccggactgaccccgctgatggaagccgcaagtgggggctatgccgaggtggggcgggtgctgctagataaaggcgccgatgtcaacgctccacccgtgccttcaagtcgcgataccgctctcacgattgccgcagataagggccactacaaattttgtgaacttttgattcaccgcggtgcacacattgatgtgagaaataaaaaggggaatacacctctttggctcgcctctaatggaggccacttcgatgtggtgcagcttttggtgcaagccggagcagatgttgatgcggcggacaataggaagattactcccctgatgtctgcgtttcgaaaggggcacgtgaaagtggtgcaatacctcgtgaaggaggtgaatcagttccctagtgacatagagtgtatgcggtatatcgctacaattaccgataaagagctgctgaagaagtgccatcagtgcgtggaaacaattgtcaaagctaaggaccaacaggcagctgaggccaataaaaatgcatccatcttactcaaagagttagaccttgaaaaatcaagagaggaaagccggaagcaagcccttgccgccaagagagagaaacgtaaagagaaaaggaagaaaaagaaggaggagcaaaagcgcaagcaggaggaagatgaagaaaacaaacccaaagagaacagcgaactacctgaggatgaggacgaagaagagaatgatgaagacgttgaacaagaagttccgattgaaccgccatctgccacaaccacgacaacaataggcatctccgcgaccagcgctactttcactaacgtgtttggcaagaagagagcgaacgttgtgactaccccttcgacaaacaggaaaaataaaaaaaataagacaaaagagactccccctaccgcacatctaatcttgccagaacagcatatgtcactggcacaacaaaaagcagacaagaataagatcaacggggagccgagaggagggggggccggaggtaacagcgattccgacaacctggattccaccgactgcaatagcgagtcatctagcggcgggaagagtcaggagctcaatttcgttatggacgtgaactcatcgaaatatcccagtttactacttcacagtcaagaagagaagaccagcaccgccactagcaaaacccagaccagactcgagggagaggttacgccgaacagtctgtcaacctcatacaaaaccgtgagtttgcccctgtccagtcccaatatcaagctgaatttgacatcgccaaagagaggacagaagagggaagagggctggaaggaagttgtgcgccgcagtaaaaaactctccgtgcccgcgtctgtggtctcgcgcatcatgggacgaggggggtgcaatatcacagctatacaggatgtgaccggggctcacattgacgttgacaaacagaaggataagaatggagaacggatgattactattcgcggcggcaccgagtccactagatacgctgtgcagttgatcaatgctctgatccaggaccctgccaaggagttggaagacctgatacctaaaaatcacataagaaccccagcgtccactaaatcaattcatgcaaatttcagtagtggtgtcgggacaacagccgccagctccaaaaacgctttcccccttggagcaccgaccctggtgacaagccaggcaacgaccctgtctacattccagcctgctaacaaactcaacaagaacgtcccaacgaatgtacgctcctctttccctgtgtcattgcctctcgcttacccacacccccacttcgctcttctagctgcccaaaccatgcagcaaataaggcatccgcggcttccaatggctcaatttggaggaacattttcgccctcaccaaatacttggggcccctttcctgtcagacctgtaaaccctggtaacacgaatagctcccccaagcataataatacctcgaggttaccaaatcagaacgggaccgtgttgccctcagaaagcgctggacttgcaacggctagctgtccaatcactgtatccagcgtggttgcggcctctcagcagctatgcgttacgaacaccagaacacccagttctgtgaggaagcagcttttcgcctgtgtgcccaagacaagccctcccgctaccgtcatttcatctgtcacctcaacctgtagctcattacctagcgtatcttccgcccccataactagcggccaagctccaaccacttttctacctgcttcaacctctcaagcccagttaagttcacagaaaatggagtcgttttcggcggttccccccaccaaggagaaggtgtctacgcaggaccagcccatggctaacttatgcaccccttcttctactgcaaactcgtgctcatcatccgcgagcaatacacctggagcacccgaaacgcacccatctagtagtcctaccccaactagtagcaacacgcaggaggaggcgcagccgtctagcgtttcagatctgtcaccaatgagtatgccctttgccagtaactccgaacccgcaccgctgacgcttaccagcccccggatggtggcagctgataatcaagacacatccaacttacctcagctggccgtccccgcaccaagagtgtcacatcgcatgcaacctagagggagtttttactcaatggtgcccaacgccaccatccaccaagatccccaatccatcttcgtgactaaccccgttaccctgactccccctcaaggtcctcccgcagcagtccaactatcgtcggcagttaatattatgaacggatcacagatgcatatcaatccagccaacaagagcctgcctccaactttcggccccgccacactgttcaatcattttagcagcctgtttgattctagtcaggtgcccgcaaaccagggatggggggacggtcctctctcatcccgcgtagccaccgacgccagcttcaccgtgcagtcagcttttcttggtaactctgtgctaggacaccttgagaacatgcaccccgataattcaaaggctccaggatttcggcctccttcacagcgggtctccacgagtcctgtgggactgccaagcatcgacccttctgggtccagccccagtagttcatcggccccactggccagcttctctggcatccctggcacccgagtctttctacagggccctgcacctgtaggaactcccagtttcaacaggcagcactttagtccacatccctggacctcagcctctaactctagtacctctgcccccccaactctgggccagcccaagggcgtctcggccagtcaggatagaaaaatcccaccacctatcggcactgaaagactggctcgcatacggcaggggggaagcgtggctcaggcacccgccggcacatcgtttgtcgcccccgtaggacattctggaatttggagcttcggagtcaacgcggtcagtgaggggctctcaggctggagccagtccgtgatgggcaaccatcccatgcaccaacagttgagcgatccgtccacgttctcccagcaccagcctatggaaagagacgatagcggaatggtcgcacccagtaacatttttcatcagccaatggcatccggattcgtggacttcagtaagggtctgccaatcagcatgtacggcggaaccatcatcccatcacaccctcagctggctgatgtacccggcgggccactttttaatggattgcacaacccagatcccgcctggaatccaatgatcaaggttattcaaaattccaccgagtgcaccgatgctcagcaggctagtcttttgccctcagtgcccgccctgaaaggcgaaatccctagcccccagctgacgagacctaagaagagaattggccgccccatggttgctagcccaaaccagcgccatcaggaccacctgcgccccaaagttcctgcaggcgtccaagaactgactcactgccctgacacccctttactgcctccttcggattcaagggggcataactcctcgaacagcccctcactgcaagcaggtggagcagaaggggcaggggacagagggcgggacactaggtag

SEQ ID NO: 108240 - DNA, 3024 bp, Artificial Sequence
  Description of Artificial Sequence: Synthetic coding sequence
atggtggccctcttgctggcccagggcgctaacatcaatgcccagactgaagaaacacaggaaaccgcactgacccttgcgtgttgtgggggcttctccgaggtggcagactttttgatcaaagccggcgccgatatagaattagggtgttctacccccctgatggaagctagtcaggaaggccatctggagttggtgaagtaccttttggcatccggcgcaaatgtgcatgcaacaaccgccacgggcgatacagccctcacctatgcctgcgagaatggccacaccgacgtggcagacgtccttctgcaggcaggggcagatctggataagcaggaggatatgaagacaatcctcgaaggaatcgatccagccaaacatcaggaacacgaatctgagggcggccgcacccccctgatgaaggcggcgagagccggacatctctgcacggttcagttcttgatctctaagggtgcaaacgtcaatcgtgccactgccaacaacgatcataccgtggtgagcctggcttgcgcaggaggtcatctggccgtggtggaattactgttagcgcacggcgctgacccgacacaccgtctcaaagacggttcaaccatgctgatcgaggccgcaaagggggggcacactaacgtcgtgtcttatttgctggattacccgaacaatgtgctttccgtgccaaccaccgacgtttctcagttgccacctcccagccaggaccagtcgcaggtgccacgcgtgcctacgcacactctagccatggtagtgcccccacaggaaccagacagaacatctcaggagaacagtcctgctctgctgggagttcaaaagggaaccagcaagcagaagtcgtcgagccttcaagtcgccgatcaagaccttctccccagtttccacccatatcaacccctggagtgtattgtagaggaaaccgagggtaaactaaacgagttagggcaacgaatcagtgccattgaaaaagcgcaattgaaatccttggagctgattcagggggagccgcttaataaggacaagatcgaagagctgaagaaaaacagagaagagcaggtacaaaagaagaaaaaaatcctgaaagaactgcagaaggttgaacgtcagctgcagatgaaaacccagcagcagttcacaaaggagtatctggaaaccaaaggccagaaagacacggtgtcactgcaccagcagtgctcccatcggggcgttttcccagagggtgaaggagacggcagcctccccgaagatcacttctcagagctcccacaggtggacacaatactctttaaggataatgatgtggatgatgagcagcagtccccacctagcgccgaacaaatcgatttcgtcccggtccaaccactgagttctcctcagtgtaacttcagtagtgacctaggaagtaatggaactaattccttggaattgcagaaagtttcaggtaaccagcaaatcgttggacagccacagattgcaatcacgggacacgatcagggcttgctggtccaagaacccgatgggcttatggtggcaacaccggcccagacccttaccgatacactagacgatctgattgccgcagtctcaaccagagtgcccacagggtccaatagctcttctcagacaactgaatgccttacacccgaatcttgtagtcagactacctctaacgtggcaagtcagagcatgccccctgtttatccctccgtggatatcgacgcccataccgagagcaaccacgacacagcactgaccttggcctgtgccgggggtcacgaggagttggtgagtgtcctgatcgccagggatgcaaagatcgagcaccgggataaaaaggggttcaccccactcatcttagcagcaacagctgggcacgtcggtgtcgtagaaatccttctcgataagggcggcgacatcgaggctcagagtgaacgtacaaaggacacacctttgagcctggcctgctccggtggacgccaggaagtagtggacttattactggcccggggtgcaaacaaagagcatagaaatgtgtctgattataccccactctcactggctgcttctggaggttatgttaatatcatcaaaatcttactgaacgccggcgctgagataaattccagaactggtagtaaactcggtatatcaccgcttatgctagcagcaatgaatggacacgtgccagctgtaaaactgctgctcgatatgggatccgatataaatgcccagattgagactaacaggaacacagctctcaccctggcgtgtttccagggcagagcggaggtggtgtctcttctgctggatcgtaaggccaatgtggaacaccgggctaaaacaggtctgacccctctcatggaagccgcatcaggcggctatgcggaggtgggacgggtcctgctggataagggggccgatgttaatgcacctccagtcccttcgtctcgggataccgcacttactattgccgccgataaggggcattacaagttttgcgagcttctgatacaccggggtgcacacatagatgtgcgcaacaagaaagggaacactcccctgtggcttgccagtaatggagggcattttgacgtggtgcagctactcgtccaagccggcgcagatgtggacgccgccgataaccgtaagatcacgccactgatgagtgccttcaggaaaggccatgtgaaagttgtgcagtacctggtcaaagaggtgaaccaattcccctcggacattgaatgcatgagatacattgcaacgatcacagataaggaactgcttaagaaatgtcatcaatgtgttgagacaatcgtcaaggcaaaagatcagcaggccgctgaggctaataaaaatgccagcattctgctgaaggaacttgacctcgagaagagtcgagaggaatcaagaaagcaggccctggccgcaaagcgcgagaagcgtaaggaaaagcggaaagagaaacgagggaccgagaaggagacaggacgaaggtag

SEQ ID NO: 108241 - DNA, 7629 bp, Artificial Sequence
  Description of Artificial Sequence: Synthetic coding sequence
atgcttacggactctggcggaggcggcactagctttgaggaagatttagattcggttgcccccaggtcagcccccgccggcgcatccgaaccaccgccacccggcggcgttgggctcggtatccgcacggtcaggctgtttggtgaagccggaccggcctccggcgtaggcagtagcgggggtgggggctccggcagcggcaccggagggggggacgccgccctggatttcaagctggccgcagccgtgctgcgtactggtggcggagggggggcatctggctccgatgaggacgaagtctcagaggtagagtcctttatcttagatcaggaggacctggacaatccggtactcaagactacttccgaaatttttctttcttctacagccgaaggagccgatctgcgaactgttgaccctgagactcaggccaggttagaagctctcctcgaggccgccggaattggtaagctctcaacagctgacgggaaagcattcgccgacccagaagtcttgcggcgcctcacgtcttcagtgtcatgtgctctcgacgaagcagccgccgctcttacaagaatgaaggctgagaattcccacaatgcaggtcaggttgacacacggtcactggctgaggcatgttcagatggcgacgtaaatgcggtacgcaagctcctcgatgaaggtcggtccgtgaacgaacataccgaggagggcgagtcacttctgtgtcttgcatgcagcgccgggtattacgagctggctcaggttctcctcgccatgcatgctaacgtcgaagatagaggaaataaaggagacattactccactgatggctgcctccagtggaggttatctcgatattgtcaaactgctcttgttgcacgatgctgacgtcaattcccaatccgccacaggaaatactgctctcacctatgcctgtgctggaggatttgtggacatcgtcaaagtgctcctgaatgagggggctaatatcgaagatcacaatgaaaatggacacacaccactgatggaagctgccagtgctggccacgtagaggtggccagggtgctcctcgaccacggggccggtataaacacccattccaatgaattcaaagaatccgccctgaccctggcctgctacaagggacatctagacatggtgcggttcctgctagaggctggagccgaccaggagcacaagaccgacgagatgcatacagccctgatggaggcctgtatggacgggcatgtggaggtggccagattactcctggattcaggagcacaggtcaacatgccggcggacagtttcgagtcgccgctgacacttgctgcctgcggaggacatgtcgagctggctgcccttctgattgaacggggagccaacctcgaagaagtgaacgacgaggggtatactcccctgatggaggccgcccgggaaggccacgaagagatggttgcacttttactggcacagggagcaaatatcaacgctcagacagaggaaacccaggaaactgccctcaccctcgcttgctgtggtggctttagcgaagtggccgactttttgatcaaggccggggcggatatcgagcttggctgcagtacaccattgatggaagcaagtcaagaagggcacctagaacttgtcaaatatctcctggcttccggcgctaacgtgcacgccacaactgccacgggagacacagccttgacctacgcctgtgagaatggccacacggatgtggccgacgtgttacttcaggcaggcgctgatctggaacatgagtcagaggggggtcggactccacttatgaaggctgctcgagctggtcatttgtgcacagtccagttcctcatcagcaaaggagcaaatgttaatagggcaaccgctaacaatgatcacaccgtcgtgagcctagcctgtgcaggcggccatttggccgtggtggagctcttattggcccatggcgccgacccgacacaccggctgaaagatggcagcaccatgctgatcgaggcagcaaaagggggacatactaacgtggtcagctatctgctggactaccccaacaacgtgctgtctgtgccgaccaccgacgtgagccagctgccaccgccatcacaagaccagtctcaggtacccagggtccccacccacactttggccatggtggtcccaccacaggagcctgacagaacttctcaagaaaactccccagcccttctgggtgttcagaagggtaccagtaaacagaaatccagcagtttgcaggtggccgatcaggatttgctccccagcttccacccctatcagcccttagagtgcattgtggaggaaactgagggcaagttaaatgagttgggccagaggataagtgctatagagaaagcccaactcaagtctctggaactgattcagggggagcccctgaataaggacaagatcgaagagcttaaaaagaacagagaggagcaggtgcagaagaagaaaaaaattctgaaggagttgcagaaagtagagcgccagctgcagatgaaaacccagcaacagttcacaaaagagtacctggagaccaaaggtcagaaggacactgtgagtcttcaccaacagtgcagccaccgaggcgtttttccggagggagagggagatggttctctgccagaagaccatttctcggagctgccacaggttgacacaatactgtttaaggataatgatgttgacgatgagcagcagagtcctccgtcagccgagcagatcgatttcgtgcctgtgcagccattgtccagtcctcagtgtaacttcagctccgatttggggtcaaatggcaccaacagcctggagctccagaaagtcagcggaaatcagcagatcgtgggccaacctcaaattgctatcacaggtcatgaccagggcctgctcgtgcaggagccggatggcctgatggtggccacccctgcacagacattaaccgatacattggatgatctcatcgccgccgtctctacccgggttcctactggctccaactcctcgtctcagaccacggaatgtcttaccccagagagctgctcccaaaccacctcaaacgtggccagccagagcatgccaccagtttacccttcagttgatattgacgcccataccgagagcaatcacgatacagccttgaccctggcctgcgcaggaggtcatgaagagctcgtttccgtgctcattgcccgggatgcaaaaatcgaacaccgggacaagaagggattcacgccattaatcctcgccgcaactgcaggccacgtcggagttgttgaaatcctgttagataaggggggagacatcgaggcacagtcagagcgcacaaaagacacaccattgagtttggcctgtagcggagggcgacaggaagtcgtcgacttattgctagctcgcggtgctaacaaggaacacaggaatgtgtctgactacacccctctttccctcgccgcctctggcgggtatgtcaatatcataaaaatcctgcttaacgctggggccgagatcaacagtaggacgggcagcaaactgggaatatcacccctcatgcttgcggcgatgaatggccatgtgcccgccgtcaagctgttgctcgatatgggctccgatattaacgcccaaattgagaccaatcgcaacacagctctgacactcgcctgctttcagggacgtgcggaagtggtgagcctgctgctggaccgtaaggcaaacgtggagcaccgggctaagactggacttaccccgctgatggaggccgctagtggcggatacgccgaggtgggacgggtcctgctagataagggagcagatgtgaatgcacctcccgtccctagtagccgcgacacagcgctgactattgcagctgacaaaggccactataagttttgcgagttgctgattcatcggggcgcacatatcgatgtgagaaacaagaagggaaataccccactgtggctggccagcaacggagggcacttcgacgtggtccagcttttggtgcaggcgggtgccgatgtggacgcagctgacaataggaagattacacccctgatgtccgccttccgcaaagggcacgtgaaagttgtccagtacttggtcaaggaggttaaccagttcccaagtgacatcgagtgtatgagatatatagccacaataacggataaagagcttctcaaaaagtgccaccagtgcgtagagaccattgtaaaagccaaggatcagcaggccgccgaagccaacaagaacgctagtattcttctcaaagagctcgacctggagaagagtcgggaggagagccgtaagcaggccctggcagctaagcgagagaagaggaaggagaagcgtaagaagaaaaaagaagaacagaaacgtaaacaggaagaggacgaggagaacaagcccaaggagaattctgagctccccgaggatgaggacgaagaagagaacgacgaggacgtcgagcaagaggtccctattgagcccccctcagccacaacaaccactacaataggaatttccgctacctccgccacatttaccaacgtgtttggcaaaaagcgggcgaatgtcgtgacaacaccttctaccaaccgaaaaaataagaagaataagacaaaagagacaccccccacagcgcaccttatactccccgaacagcatatgtcgttggctcagcagaaagccgataaaaacaaaatcaacggcgaaccccgtggcggaggagctggagggaattccgattctgacaatctggacagcacggactgcaattctgaatcatcatccggcgggaaaagtcaggagctgaactttgtgatggacgtgaacagcagcaagtatccatctttgctccttcactcacaggaggagaaaacctcaacggcaaccagcaagacccagacccggctggagggtgaagtaacccccaattccctatctacctcatacaagacagtttcactgcccctttcctccccaaacatcaagctcaacctcacgtcacccaaacgcggccagaagcgggaagagggatggaaggaggtcgttaggcgctccaagaaactttcagtccccgcgtcagtagtaagcaggatcatgggacgcggaggctgtaacattaccgccattcaggatgtcaccggggcacatattgacgtggacaaacagaaagacaaaaacggagagcggatgatcacgatccgcggggggacagagagtacaaggtatgccgtacagctgattaacgccttaatccaggaccctgccaaggagcttgaagacctaatccccaagaaccatatccggacacccgcctcaacgaaatccatccacgctaacttttcaagcggcgtggggacaactgccgcaagttccaagaacgcttttcccctgggggcacccacgctagtcacatcgcaggccactaccctaagcaccttccagcctgctaacaaactgaataagaatgtccctaccaacgttcgctcaagcttccctgtgtctttaccactcgcctacccacacccacattttgcgctcctagccgcacagacaatgcagcagattcggcatccccggctcccgatggctcagtttggtggcactttttcacctagccctaacacttggggaccctttcctgtgcggccggtaaacccaggcaatacaaactcttccccaaaacacaacaatacatctcggctgcctaaccagaatggcaccgtgctgccgagtgagagcgcaggcttggcaacagctagctgtcccataaccgtatcatcagttgtcgctgccagtcaacagttatgcgtgacaaatacccggacaccatctagcgtccgaaaacagcttttcgcgtgcgtgcctaagacctcaccccccgccactgttatcagctctgtcacgtcaacctgcagctctttacctagcgtgtcgtccgcccccattacatcaggccaggcacctaccaccttcctcccagcctccactagccaggcccagctgtcgtcccagaagatggaaagcttctccgctgttcctccgacgaaagaaaaggtatccacgcaggatcagccgatggccaatctatgtaccccaagttccacggctaactcttgctcaagttccgcttctaacacgcccggtgctccagagacacaccctagttcatctcccacacccacaagcagtaatacgcaggaagaggcccagcccagtagtgtttctgacttgtctccaatgtctatgcccttcgcctcaaatagcgagcctgccccactgacgttgacctcgccccgcatggtcgccgctgacaaccaggatacgtctaatctgccccaacttgctgtgccagctcctagggtgtcccaccgaatgcagcctagagggtccttctactccatggtgccgaacgccaccatccaccaggaccctcagtctatatttgtgacaaatccagtgacactaacccccccacaggggccacctgccgcggttcagttatcttcagctgtcaacatcatgaatggatcacagatgcacattaaccctgccaataaaagtcttcctccaacgttcggccctgccactctcttcaaccactttagctctcttttcgacagcagccaggtgccagccaatcaggggtggggcgacggtccgctttccagtagagtagctaccgacgccagtttcaccgtgcagagcgcgttcctcggcaactctgtcctggggcatctagagaatatgcatccggacaattcaaaggcccccgggtttaggcctccgtctcagcgtgtctccacgagccctgtgggcctgccaagtatcgacccttccggctcctcaccatcatcctccagcgcccctctggccagcttttctggtattccgggcacccgcgttttcctgcagggccccgcccccgtcgggacacccagctttaaccgccagcacttcagcccccacccgtggacatcagcttcaaattccagcactagtgctcccccaaccctcgggcaacccaagggcgtttcagccagccaggacaggaagattccccccccaattggcactgagcggctggcgcggatccggcaaggcgggtccgtcgcccaggctccagctggcacgagcttcgtagccccagtaggtcattcgggcatctggtccttcggcgtgaatgcagtcagtgaaggactcagcgggtggagccaaagtgtcatgggaaaccaccccatgcatcagcagttgagtgacccgtccaccttttcgcagcaccagcccatggagcgagacgactccggcatggtggccccgtcaaatatcttccaccaacctatggcctccggatttgtggactttagtaaagggcttccgatctcgatgtatggtggcacgatcattccctcacatcctcagctggccgacgtcccaggcggtcccctttttaacggacttcacaatcctgacccggcatggaatcctatgattaaggtaattcagaactccactgagtgcaccgatgcacagcagatctggcccgggacttgggcacctcacattggtaacatgcatctaaaatatgttaactag

SEQ ID NO: 108242 - DNA, 1851 bp, Artificial Sequence
  Description of Artificial Sequence: Synthetic coding sequence
atgctgacggacagtggtggaggtggcactagcttcgaggaagacttggacagtgttgctccccggtccgcgcccgcaggggcaagtgaacctccgcccccgggaggggtcggtctcggaataagaaccgtccgtctctttggcgaggctggccctgcatccggggtgggttcaagtgggggcgggggcagtggctccggcactggcggtggcgacgcggcgctggacttcaaactggcggctgcggtgttacgcaccggcggcggcggcggcgccagtggcagcgacgaggatgaggtgtccgaggtggaaagcttcatcttagaccaagaggatctggacaatcctgttcttaagactacatccgaaatctttctttcaagcaccgccgagggtgcagatttgcgtacggtggacccggagactcaggcccgcctggaggccctgctggaagccgccgcttttgctgatcctgaagtcttgaggaggttgaccagtagtgtctcttgcgccttggatgaggctgccgccgctctgactcgcatgaaagccgagaacagccacaacgcagggcaagtggacacccggtccctagcggaggcttgttctgatggcgacgtgaatgcagtcagaaaactgcttgacgaaggtcgaagtgtgaatgaacatacagaggagggggagtctctcctttgtttggcctgcagtgcaggatattacgagcttgctcaggtgctactggcaatgcatgctaatgtagaggacagaggaaacaaaggagatatcacccctctcatggctgcatcctctggggggtacctcgacattgtaaagctgctgcttcttcacgacgccgacgtgaactcccagtccgcgacaggtaatactgcactgacatacgcctgcgcagggggctttgtcgatatagttaaggtgttgctaaacgagggggcaaatatcgaagatcacaacgagaacggccacacaccccttatggaggccgctagcgcaggacatgtcgaagtggcccgggtcttactcgaccatggcgcaggaatcaacacacacagcaacgaattcaaggagagcgctctgacactggcatgctataaagggcacctggacatggtgcgattccttctggaggcgggcgcagaccaggagcacaaaactgatgagatgcacactgcgctcatggaagcctgtatggatgggcacgtcgaagttgccaggttgttgctggactctggtgcgcaggtcaatatgccagcagactcatttgaatcacccttgactctggccgcctgtggaggacatgtagagctggcagccttgctgattgagaggggcgcaaatctcgaggaagttaatgacgaaggttacacacctctgatggaagcagcaagagagggccacgaggaaatggtcgccctattactggcgcaaggcgctaatataaacgcccagacggaagagacacaggaaaccgcactgacactggcgtgttgtggcggtttcagtgaagtagctgatttcctgatcaaagcaggcgcagacatcgagctgggctgcagcactcctctgatggaagcgagccaggaaggacatctggagctggtaaagtatctgctggcatccggcgcgaacgtgcatgcaaccactgctacaggggacaccgctctgacatacgcctgtgaaaatggtcatactgatgtggctgacgtcctgcttcaagccggagcagacctggacaagcaggaagatatgaaaaccattcttgaaggtattgaccctgcaaaacatcaggtgcgtgtggcttttgacgcctgcaagctgctgaggaaagaatag

SEQ ID NO: 108243 - DNA, 1884 bp, Artificial Sequence
  Description of Artificial Sequence: Synthetic coding sequence
atgctcactgactcagggggcggggggacctcctttgaagaagaccttgatagtgttgctccgaggagcgccccagctggagcctccgagccacctcctcccggcggcgttggtctgggcatacggaccgtgcgcctgttcggagaagcaggccctgcctcaggtgtcggttcttcaggaggcggaggatccggttctgggaccggcggaggggacgctgcgctggatttcaaactcgcggccgcagtcctgagaacagggggcggtggcggcgcctccggctcagatgaggatgaggtgtccgaggtcgagtcatttattttggaccaggaggatttggacaaccccgtgctgaaaacaaccagcgaaatttttcttagtagcaccgccgagggagccgatctccgtaccgttgacccagagacccaggcacgtttagaagctctcctggaagccgcgggaatcgggaaactatccaccgctgacggcaaagcctttgccgacccggaggtgttgcggagactcacctcctccgtgagttgtgccctagatgaggctgcagcagccctcactcgtatgaaagccgagaattcccacaacgccgggcaggtggatacacgttccctcgctgaggcttgctccgacggcgatgttaacgcagtcagaaagcttctagatgagggccgatcagtgaatgagcacactgaggagggtgaaagcttactctgcttagcatgcagtgccggttactatgagcttgcacaggtacttctcgccatgcatgccaatgtcgaagataggggcaacaaaggcgacataactccactgatggcagcctctagcggcggctatctggacattgtaaaattgctgctgttacacgatgctgatgtcaactcccagtccgccactgggaacacagccctgacttatgcctgcgccggtggcttcgtggatatcgtcaaggtgctgctgaatgagggggcaaacatcgaggatcacaacgaaaatggccatacacctctaatggaggcagcatccgctggacatgtcgaagttgcaagagttctgctggatcacggtgccggaattaacactcattctaatgaattcaaggagtctgcactaaccctggcctgctacaaagggcatctggacatggtgcgatttctcctagaagctggggcagaccaagagcataaaaccgatgagatgcatacggcacttatggaggcatgcatggacggtcacgttgaagtggccaggcttctcctggactctggcgcccaagtcaacatgcctgctgattccttcgagagccctctgacactggctgcctgtgggggccacgtggagttggcagccctcttgattgaaagaggcgcgaacctagaggaggtcaatgatgaaggctacactcccctaatggaggccgcacgggagggccatgaggaaatggtggcactgctcctggcgcagggcgcaaacattaatgctcagacggaggaaacccaagagaccgccttgacactggcctgttgcggtggattttcagaggtggctgatttcttaataaaggccggagccgatattgagttgggctgcagcacccctttgatggaagcaagccaggaaggccacttagagttggtgaaatatttacttgcctctggggctaatgtgcacgcaacgactgccaccggggataccgcccttacttatgcttgcgagaatggtcatacggatgtggctgatgtcctgcttcaggccggtgcggatctcgataaacaagaggacatgaagacaatactggaagggatcgatccggctaagcaccaggtccgtgtcgcctttgacgcctgcaaactgcttcggaaggagtag

SEQ ID NO: 108244 - DNA, 4461 bp, Artificial Sequence
  Description of Artificial Sequence: Synthetic coding sequence
ccgcgagtcggacgacatcgactacgtctccgagtgaggacaatgcttactgactccggtgggggtggaaccagcttcgaggaggatcttgattcagtggcaccccggagcgctcccgccggcgcttcagagccaccccctcccgggggggtcggcctgggaatcaggaccgtccgtctttttggggaggcggggcctgccagcggcgtggggagttccgggggcggaggatccgggtctggaactggtggaggagacgctgccctggacttcaagctggcggcagctgttctgcgtacggggggcgggggcggagctagcggcagtgacgaagatgaggtttctgaggtggagtctttcattctcgatcaggaagaccttgacaatcccgttctgaaaacaacaagcgagatttttctcagcagcactgcagaaggagcggacctgcgcacggtcgaccccgaaacccaggctagactggaagctttgttggaagcggcgggcattggaaagctgagtacggcagacgggaaggcattcgccgaccccgaagtgctgcgccgcctgactagctcagtctcctgcgcgttggatgaagccgctgccgccctgactcggatgaaagccgagaatagtcataacgccggtcaggtcgacactcgaagcctggccgaagcatgcagcgacggcgacgtcaatgctgtgaggaagctcctcgacgagggccgctcggtcaacgaacacaccgaagagggcgagtctctgctctgccttgcctgcagcgctgggtactacgaacttgcacaagtgcttctggctatgcacgcaaacgtcgaggatcgcgggaacaagggagatattaccccattgatggctgccagctccggaggatacctggatatcgttaagctacttttgctccacgacgccgatgtaaacagccagagtgcaactggtaacactgcactcacctatgcatgtgcaggggggtttgttgatattgtcaaagtcctcctgaacgagggggcaaacatagaggatcacaacgagaatggccatacccccctgatggaagccgcctcagccggtcacgttgaagtcgcccgggttcttttggaccacggtgctgggattaacacacattctaacgagttcaaggaaagcgcgcttacccttgcatgttataagggccacctcgacatggttcgattcctcctggaggcaggagccgatcaggagcataagaccgatgagatgcatacagctttaatggaagcatgcatggatggccatgttgaggtcgccaggctgctcttggacagcggcgcacaggtaaacatgcccgccgattcctttgaaagtccactgacactggctgcctgcggaggacacgtggaactagccgcactactgatcgagagaggagccaacctggaagaggtcaatgatgaaggttatactccattgatggaagctgccagagagggtcacgaggaaatggtggcactcctacttgcccagggcgcgaacattaacgcccagaccgaagagactcaggaaaccgccttaactttagcctgttgtggagggtttagcgaagtggccgattttctgataaaggctggagccgatattgagctagggtgctcgacacccctgatggaagcttctcaggagggacatctggagctggtcaaatacttgctggccagcggtgcaaacgtacacgctaccaccgctactggggatacggcccttacctatgcctgcgagaatgggcataccgacgttgctgacgtactgctgcaggctggcgctgacctagataagcaggaggacatgaagacaatcctcgaaggtatcgatcctgctaaacatcaggagcacgaaagcgaaggcgggcgaactccactgatgaaggctgcccgggcggggcatctttgcaccgtccaatttctcatctctaagggtgcgaatgtgaatagggccacagccaacaatgatcacacagtagtttctttggcatgtgcaggtggacacctggccgtggtcgaactcctgttagcccacggcgcagaccccactcatcggttgaaggatggtagtaccatgctaatcgaggccgcaaagggcgggcatacaaatgtggtgtcatatctgctcgactaccctaataacgtgttgagtgtgccgaccacggatgttagtcaactcccccctccaagccaggatcaatctcaggtacctcgggtgccgacccacaccttagcaatggtggtgcctccacaagagccagatcggacatctcaagagaactcacccgcgttgcttggggtccagaagggcacctcaaagcagaaaagttcctctctgcaggtggctgaccaggacctactgccaagctttcacccataccagccccttgagtgcattgtagaggagacggaggggaaactgaacgagttggggcaacggatttctgcaatcgagaaagcgcagctgaagagcctggagctgattcaaggggaaccactgaataaggacaagatcgaggagctcaagaagaacagggaagagcaggtgcaaaaaaaaaagaaaatcttaaaggagctgcaaaaggtggagcgacagcttcaaatgaaaacgcagcaacagtttaccaaggagtacctcgagacgaagggtcagaaggacactgtcagtctgcaccagcagtgctctcatcggggggttttccccgagggcgagggtgatggtagtctgccagaagaccatttctccgaactaccacaggttgatactatccttttcaaagacaatgacgtcgatgacgaacagcagtcaccccccagcgctgagcagatagatttcgtaccagtgcaaccactatccagcccacagtgcaattttagttccgacttggggagcaatggtacgaactccctggaattgcaaaaagtgagcgggaatcagcagattgtgggccagcctcaaatcgctatcactggtcatgaccagggcctcctggtccaggaaccggatggcctgatggtagcaacccctgctcagacgctgactgatacgctggatgatctcatcgcagctgtgagcacacgcgtccctactggctcaaatagtagttcgcagacaaccgagtgcctgactcccgaaagctgtagtcagacgacttcaaacgtagcctcccagtcgatgccgcctgtttatccctccgtagatattgatgcccacacggagtctaaccatgatactgcgcttaccctcgcatgcgctggcggacacgaagagctggtgagtgttttaattgctagggatgccaaaatcgaacacagggacaagaaagggtttactccacttattctggccgccactgccgggcacgtgggggtggttgaaatcctcctggacaagggcggagacattgaggctcagagcgagcggaccaaagataccccactgagtttagcctgtagcggcggaagacaggaggtggttgatctcctgttggcgaggggtgcaaataaagaacaccgaaacgtgtctgactacactcctctgagcttagccgcgagtggtggatacgtaaacatcatcaaaatccttctcaacgctggggctgaaattaactctcgtaccgggtcaaagttgggaattagccctctgatgctggccgccatgaacgggcacgtcccggctgtcaagttgcttctggatatggggtccgacatcaatgcacagatcgagacaaatcgcaatacagcccttacgttggcttgcttccagggaagagcggaggtggtatcacttctgttggaccggaaagctaatgttgaacatagagctaaaaccggactgacccctctgatggaggcagcctctggcggttatgctgaggtgggccgagttcttctggacaaaggagctgacgttaacgcccctccagtaccatcttcccgggacacagccctgaccatcgctgccgataagggtcactataagttctgcgaactgctgatccaccggggagcacacatcgacgtgcgcaacaaaaagggcaatactccactgtggctggcttccaacgggggtcacttcgacgtggttcaacttctcgtgcaggccggagctgacgtcgatgcagctgacaaccgcaagatcaccccactaatgtccgcctttaggaaggggcacgtgaaggtggtgcaatacctagtaaaagaagtcaatcagttcccctccgacatcgagtgtatgaggtacattgccaccataaccgacaaagagttactaaaaaagtgtcaccagtgtgttgaaacaatcgtgaaggccaaagatcagcaggctgctgaggctaataagaatgccagcattctgctcaaggagctagatcttgaaaagtcaagagaagagagccggaagcaggcattggctgctaaacggtag

SEQ ID NO: 108245 - DNA, 1863 bp, Artificial Sequence
  Description of Artificial Sequence: Synthetic coding sequence
atgtcgttagctcaacagaaggcggacaaaaacaagattaacggcgagccgcgtggggggggggctggcggaaattcagacagtgacaacttggattcaactgactgcaactctgagtcctctagcggaggcaagtctcaggagcttaacttcgtaatggacgtcaatagcagcaagtatccctctctgctactgcactctcaggaagaaaaaacatccacggctacatcaaaaacccagaccaggctggagggagaggtaactcctaattctttgagcactagttacaagacagttagcttgcccttgtcttcccctaatattaagctaaacctcacatctcctaagagagggcagaaacgagaggagggatggaaggaggttgtaagacgtagtaagaaattatccgttcctgcaagcgttgtgtctagaattatgggaaggggcggctgtaacattactgctatccaggacgtaacaggagcccacatcgatgtggataagcaaaaggacaaaaacggggagaggatgattaccattcggggtgggactgagtccacacgttacgctgtgcagctgattaatgcactcattcaggatccagcaaaagagctggaggatctcatccctaaaaaccacattagaactccagcaagtaccaaaagcatacatgctaacttctcttctggggtaggaactacagccgctagctctaagaatgcatttcctctgggcgctccaacattggtgacatctcaagccacaactttatctacttttcagcctgctaataaattgaacaagaacgtacccaccaacgtccgttcaagtttcccagtgtcgttaccactggcctacccccatccgcattttgccctcctggcagcacagactatgcaacagattcgccaccctaggctgcctatggcacaattcgggggaacttttagccccagccccaatacatggggaccctttcctgtgcgacctgtgaatcctggtaacaccaatagctcacccaagcacaataacacttctcggctgcctaaccaaaatgggacagtacttccaagtgagagtgcgggacttgcgacagcctcatgtccaatcacagtctcttccgttgttgcggccagccagcagctgtgcgtcaccaatacacgaacaccctcctcagtacggaagcagttgttcgcatgtgtgcccaagaccagcccaccagccacagtaatcagttctgtgacctccacctgctcatccctgccgagtgtgtcttccgcgccgatcactagtggtcaggctccaacaacatttctgcctgcctccactagccaggcacagctttctagtcagaagatggaatctttttccgctgtccctcctactaaagagaaggtgtctacgcaggatcagcccatggcaaacttgtgcacacccagctcaaccgccaactcttgttccagctccgcttcgaacacaccaggcgctcccgagacacacccaagcagtagcccgactcccacatcttcaaacacacaggaggaggcccagcctagctcggtgtcagatttgtccccaatgagcatgcccttcgcatcaaactctgagcctgcgcctctcacacttacttcaccaaggatggtggctgctgacaaccaggatacctccaatctgccacaactggccgttccagcccccagggtcagccatcggatgcagcctagaggttcattctactctatggtccccaatgccactatccaccaagatcctcagtcaatttttgtcaccaatcccgtcaccctatgggaggccgaagcatccggcctgcatgaagtgcgatcccttcgacaagcctggtag

SEQ ID NO: 108246 - DNA, 2601 bp, Artificial Sequence
  Description of Artificial Sequence: Synthetic coding sequence
atggatgtcaatagctcaaaatatcctagtttactcctgcattcccaagaggagaaaacctctacagccacctctaaaacccaaacaaggctcgagggggaggtgacacccaattctctgagcacaagttataagacagtgagcctgcccctatcatctcccaatataaagctcaatctaaccagccccaagcgcgggcagaaaagagaggagggctggaaagaagttgtgagacgatccaagaagcttagcgtgccagctagtgtggtgtctaggatcatgggccggggcggatgtaacatcacagctatccaagatgtgacaggcgcccacattgatgtggacaagcagaaagataagaatggtgaaaggatgatcaccattcgaggcggaactgagtccacccgttacgctgttcagctgattaacgcgctgattcaagaccccgccaaggaactggaggatcttatccctaagaatcacattcggactccggccagtaccaagtcaattcacgctaacttcagcagtggcgtcgggacgacagcagcatccagtaagaatgccttcccgctcggagcgccaaccctggtgacgtctcaggcgacaactttgtccacctttcaacctgccaacaagttgaacaaaaatgttccaacgaacgtccgtagctcgtttcccgttagtctgcctctggcgtacccacatcctcacttcgctctcctcgccgcccaaactatgcaacagatccgtcatcccagattgcctatggcacagttcggcgggactttcagcccgtccccgaatacctgggggccatttccagtaagaccggtgaacccaggcaatacaaatagcagcccaaagcataacaatacttcaagactgccaaatcagaacgggaccgttctgccctccgagtccgccggcctcgccaccgcatcctgtcctattacagtgtcctcagtggtcgctgcctcccaacagttatgcgtcacaaacacaagaaccccttccagcgttcggaagcaactctttgcctgtgtacccaagacaagcccacctgccaccgtgataagcagtgtgacctctacgtgcagctctctcccctctgtgtcaagcgctcctataacttccgggcaggcaccaactactttcttacctgcgtccacttcacaagcacagctgagcagtcagaaaatggaaagctttagcgcagtgcctcccactaaggaaaaggtgagcactcaggaccagccaatggctaatctctgtaccccttcatccaccgccaattcctgttcttcctccgcgtccaatacaccaggcgctccagaaacgcatccaagctcctcccctacccctacctcctcgaacacccaagaggaagcccagccatcatcagtgtccgatttgagtcctatgtccatgccgtttgcatccaacagcgagcctgcccccttaaccctcacttctccgcggatggtggctgctgataatcaagatacttcaaatctgcctcaactggccgtgcccgcccccagggttagtcaccgaatgcaaccacgcggttcattttattccatggtacctaatgccaccattcatcaggacccacagtccatctttgttactaatccggtcactctgactcctccccaaggtccacccgcagcagttcaactctctagcgccgtgaacattatgaacggctcccagatgcacataaacccagctaataagtccctgccgccaacttttggacctgcaactctgttcaaccacttctcttcattatttgatagcagccaggttccagccaatcagggatggggcgatggtccactgagctcccgtgttgcaacagatgcgagtttcactgtgcagagcgccttcctaggaaatagcgtattgggtcatctcgagaacatgcaccccgacaactcaaaggcccccggtttcagacctccctcacagcgtgtctccacttcaccagtggctactagtgccccaccgacgctgggccagccaaagggggtgagtgcctctcaggacaggaagatcccacccccaatcggaacagaaaggctggcccgaatacgccagggaggatccgttgcccaggcacccgcaggcacttcctttgtcgcccccgtcggccatagcgggatatggagtttcggtgtgaacgcagtctctgaaggactctcaggatggagccagtcggtcatgggtaatcaccccatgcaccagcagctgtccgatcctagtaccttttcccagcatcagcccatggagagggacgattcaggcatggtcgccccctccaatatctttcaccagcctatggccagcggttttgtcgactttagtaagggcttacccattagcatgtacggtggcacaatcatcccgtcccatcctcaactggccgatgtacccggaggccctttgttcaatgggctgcataacccagaccccgcatggaatcctatgattaaagtcatccaaaactccacagaatgcacggacgcccagcagatttggcccggtacctgggcacctcacattgggaacatgcatctgaagtatgtgaattag

SEQ ID NO: 108247 - DNA, 2298 bp, Artificial Sequence
  Description of Artificial Sequence: Synthetic coding sequence
atggctgctgaccctactgaacttcggctgggcagcctccctgtgtttaccagggacgacttcgaaggtgattggaggttggtcgcctctggggggttttcccaagtcttccaagccaggcatcgtagatggcggacagagtacgccattaaatgtgccccttgtctgcccccggatgccgcatcttcggatgttaattatctgattgaggaagcagcaaagatgaaaaaaattaaattccaacacatcgtgagcatttacggggtatgtaagcaacctcttggcattgtgatggagttcatggctaacgggtccctagaaaaagtcctgtcaacacattccctctgctggaaattaaggttccgaattatacacgaaacatctctcgccatgaattttttgcatagtatcaagccaccactgcttcacctcgacctaaaacctggaaacatactgctcgactctaacatgcacgtcaaaatatccgacttcggactctcgaagtggatggagcaaagcactaggatgcagtatatagaaagaagcgcacttaggggaatgttaagctatatccctcctgaaatgttcttggaatcaaacaaagcccccgggccaaaatacgatgtgtatagttttgccattgtgatttgggagctccttacacaaaaaaagccctactctggctttaatatgatgatgattattatcagggtggcagccggcatgcgaccttcactgcagcccgtgagcgaccaatggccaagcgaggctcagcaaatggtcgacctgatgaagaggtgttgggaccaagatccgaagaaacgtccctgtttcctcgacatcacaattgagacagacatcttgctgtccctcctgcagtctagggtggccgtcccagagtccaaagcattggctcgtaaggtgtcttgcaagctgtctctgcgacagccaggcgaagtaaacgaagacatttctcaggaactgatggatagcgattctgggaactatctgaagagagccctgcagctgtctgataggaagaatctagtcccaagggatgaagagctgtgtatttacgaaaataaggtaacaccactacatttcctcgtggcacaaggctccgtggagcaggtccgcctgctgctggctcatgaggtggatgtggactgccagacagcctcgggatatactccactgctgatcgccgctcaggatcagcagcctgacctctgcgcactgctactggcacatggcgcagatgctaatagagtcgatgaagatggctgggcccctctgcatttcgctgcccaaaacggcgatgatggcacggcaaggctgcttctcgaccacggcgcctgtgtggatgcacaggagagagaaggttggactccgctgcatcttgcggctcagaacaatttcgagaatgttgccaggcttctagtgtctcgacaagcagacccaaacctccatgaagctgaggggaagacaccactccacgtcgcggcatatttcggtcacgtctcattagtcaaactcttgacaagccagggcgcagagctcgacgcacagcagaggaatctcaggactcctttgcatctcgccgtggaacggggcaaagtgagggccattcagcatctgctgaagtccggtgctgtccctgacgctttggatcagagcggctatggccctctccacacggctgccgcacgaggcaagtatctgatctgtaaaatgctccttagatatggagcaagcctagagttaccaacacaccaaggctggacccctctgcatctggcagcctataaaggacacctggaaattatccatctcttggccgagtctcatgcaaacatgggggcactcggtgctgtcaactggactccgcttcatctggccgcccgccatggcgaggaggctgtggtgtcggccctactccaatgcggcgccgatcctaatgccgctgagcagagcgggtggacacctttacacctcgcagtacagcgctctacttttctatcagtcataaaccttctcgaacatcacgctaatgttcacgccagaaacaaggtgggatggactcccgcccacctggccgccttaaaggggaacactgccatcctgaaggtgctggtggaagctggggcccagctggacgtgcaggacggcgtctcttgtaccccattacagttggctttgcggagccgaaagcaagggatcatgtccttccttgaggggaaagaacctagcgttgccacattggggggttccaagccaggggctgaaatggaaatttag

SEQ ID NO: 108248 - DNA, 1008 bp, Artificial Sequence
  Description of Artificial Sequence: Synthetic coding sequence
atggctgaggggggctcacccgacggacgggccgggcctgggtctgctggcaggaatttgaaagaatggcttcgggaacaattttgcgaccacccactcgagcattgcgaggatacacgtttgcacgacgctgcctatgtaggagacttgcagacactgcggtctttgttgcaggaagagtcgtatcgctcaaggattaacgagaaatccgtttggtgttgtggctggttaccctgtactcccttgaggatagccgcaacggctggacacggttcctgtgtcgacttccttattcgaaaaggagcagaggtagatctagtcgacgttaaggggcagacagcgttgtatgtagccgtcgtgaatggtcatcttgaatccactcaaattctactggaggctggagccgatccgaatggatccagacatcaccgtagtaccccagtataccacgccagccgagtgggcagagccgacatcctgaaggcgctgataagatacggcgcggatgtagacgtgaaccatcacctcactcccgacgtacagccccgattttcccgacgactgacatctctggtcgtgtgtccactctatatttcggcagcttatcataacttgcagtgctttcggcttctgctccttgctggcgcgaacccagatttcaattgcaatgggccagtgaatacccagggcttttatcgggggtcccctgggtgtgtcatggacgccgttctgcgacacggctgtgaagcagcttttgttagcctcttggtggaatttggcgcaaatctgaatttggttaagtgggagagccttggtcccgaatctagggggagaaggaaggtggatccagaagcactgcaggtttttaaggaggccaggtctgttcccagaaccctcttatgtctgtgtagggtagcagtgcggagagccctgggcaagcaccgcctccacctgattccctctttgcccctgccagatccaataaagaagtttttgctgcacgaatag

SEQ ID NO: 108249 - DNA, 909 bp, Artificial Sequence
  Description of Artificial Sequence: Synthetic coding sequence
atgctgcagctgaccggcgagaacgagaaaaactgcgaagtgtcagagaggattcggcgctccgggccatggaaagagatcagcttcggcgattatatatgtcatacctttcagggagattgctgggccgatagatctccgcttcacgaagctgctgcacagggccgcctactggctctcaaaacgttgattgctcagggcgtgaacgtgaatctcgtgactattaatcgagtctctagcctccacgaagcttgtctggggggtcacgtcgcttgcgccaaggctctgcttgagaacggagcccacgttaatggcgtgaccgtccacggagcaacccccctgtttaacgcctgttgttccgggagcgccgcatgcgtgaatgtgctcctggagtttggagcgaaggctcaattggaagtccacttagcctctccgatccatgaagcagtaaaacgagggcaccgcgaatgtatggagattctgctggccaacaacgtgaacatcgaccatgaagtgccccagctcggaacaccactatacgtcgcgtgcacgtatcaaagagtggattgcgttaaaaagctgctagagctaggcgcaagcgtggaccacggtcaatggttagacacgcccctgcacgctgccgcacgacagtcaaatgttgaagttatccacctgctcaccgactacggagcaaatctgaagagaaggaacgcgcaagggaagtccgctctggacttggctgcccctaaaagcagtgtggagcaggcactgctcctgcgcgaagggcctcccgctttgtctcaactgtgcaggctctgcgttcggaaatgcttagggcgggcttgccaccaagcgatccacaaactccatctgccagaacctctcgagaggttcctgctgtaccagtag

SEQ ID NO: 108250 - DNA, 972 bp, Artificial Sequence
  Description of Artificial Sequence: Synthetic coding sequence
atggaagacggccctgtgttttacgggttcaaaaacattttcatcaccatgtttgccacatttttctttttcaagctactgataaaggtgttcctggccctcctgacgcacttttatatagtaaagggcaataggaaggaggctgcccgaattgcagaagagatttatggcggcatttccgattgttgggcagacagatcacctctgcatgaggccgcagcccaaggtaggcttctcgcactgaagactctcatcgcgcagggggttaacgtgaacttagtgactatcaaccgtgtgagcagtcttcacgaagcatgcctgggaggccatgttgcctgcgctaaagctcttttggagaacggcgcacatgtaaacggcgtgaccgtacacggtgcgacacctttatttaacgcttgctgctcgggttcagcagcgtgcgtcaatgtccttcttgaatttggtgctaaggcccagctggaggtgcatctggctagtcctatacacgaggctgtgaaaagaggccacagagaatgcatggaaatccttctcgccaacaacgtaaatattgatcatgaagtgcctcagttaggaacccctctctacgtcgcttgtacttaccagcgtgttgactgcgtgaaaaaattactcgaactgggcgcctcagtggaccatgggcagtggctggatacaccccttcacgccgcagctagacaatcaaatgtggaggtcatccacctgctaaccgattacggggctaatttgaagcgtaggaatgctcaagggaagtccgctctcgacttggcagctcccaagagctccgtggagcaggccctactgctcagggaaggccccccagcactttcccaactgtgccgtctgtgcgtcaggaagtgtcttggaagagcctgccatcaggcaatccataaactacatctgccagaacccctggagcgctttctcctttaccagtag

SEQ ID NO: 108251 - DNA, 909 bp, Artificial Sequence
  Description of Artificial Sequence: Synthetic coding sequence
atgctccagcttacaggcgagaacgagaaaaattgcgaagtatcagaacgcattcgccgatccggtccttggaaggaaattagtttcggggattatatctgtcacactttccaaggcgattgttgggccgatcgatctccactgcacgaagccgctgcccagggtagactcttagccttgaagacgctgatcgcgcagggcgtgaatgtcaacctggtgacaattaatcgcgtgagttccttgcatgaagcatgtttgggcgggcatgttgcatgcgcaaaggcactgttggagaatggagcacatgtcaacggtgtgactgtgcacggggccacccctctgttcaacgcgtgttgttccgggtctgccgcctgcgtcaacgtattgctcgaattcggggccaaggctcagctggaggtccatctggcctctcctatccatgaagcagtgaaaaggggccacagggagtgcatggagatcctgctggccaataatgtcaatatcgaccatgaggtcccccagctaggcacgccgttgtacgttgcatgcacatatcagagagtcgactgtgtcaaaaaactgctggagctgggcgccagcgtggatcacggacagtggctcgacactccactgcacgctgcggctagacaatcaaacgtcgaagtcatacatctgctgaccgattatggagccaacctgaagcggcgcaatgctcagggaaagagcgctttagatttagctgcccccaaaagcagtgtggaacaggctctgctcctgcgggagggtcctcctgctctgagccaattatgcaggctctgcgtgcgaaaatgcctcggtcgcgcttgccaccaggcaatacacaagctgcacctgcccgaaccactcgaaagatttcttctctatcaatag

SEQ ID NO: 108252 - DNA, 921 bp, Artificial Sequence
  Description of Artificial Sequence: Synthetic coding sequence
atggaggatggacccgtattttatgggttcaagaatatttttatcactatgttcgcaactttttttttttttaaactgctcattaaagtctttctggcactgttgacgcatttctatatagtcaagggaaaccgcaaggaagccgcccgcattgctgaagagatttatggaggcatcagtgactgctgggccgaccgctctccactgcacgaagcggccgcccaagggaggctccttgctctaaagactttgatcgcgcaggcatgcttgggtggacatgtggcttgcgccaaagcactacttgagaatggggcccacgtcaacggggtcaccgttcatggtgccacaccattattcaatgcctgctgttcaggttctgctgcttgtgtgaacgtgctcttggaatttggcgcgaaggctcagcttgaggtgcatttggccagcccaatacatgaagcagtaaagcgcggtcaccgtgaatgcatggaaatcctgcttgccaacaacgtgaatatcgatcacgaagtgccacaactgggaacccccctttacgtggcctgcacataccagagggtggactgcgttaagaagcttctagagctcggagcaagcgtggatcacggccagtggctggacactcctctccacgccgctgctcgccaaagtaacgttgaagttatacatctcctgacggactacggcgctaatctgaaacgacggaatgcacagggaaagtctgccctagatctggcagcacccaaatcttccgtggagcaggctttactgctccgggaaggtcccccagccttgagtcaactgtgtcggctgtgcgtccggaaatgtcttggacgggcttgccatcaggcaatccacaaactgcacttaccagaaccactcgaacgttttctgctgtaccagtag

SEQ ID NO: 108253 - DNA, 1764 bp, Artificial Sequence
  Description of Artificial Sequence: Synthetic coding sequence
atgacacggttctcctacgccgaatacttctctctgtttcatagttgcagcgccccatcccgctctaccgcccccccggagtcgtctcccgctcgcgcacctatgggattattccagggggtgatgcagaagtacagctcttccttgttcaagacctctcaacttgctcctgccgacccactcataaaggccatcaaagacggcgacgaagaggcactaaaaaccatgatcaaagaagggaaaaacctggctgagcccaacaaggagggatggctgccgctgcacgaggccgcatactatggtcaggtgggatgtctcaaagttctccagagggcttacccgggcacgatagatcagagaactctgcaagaggagacagctgtctaccttgccacttgcagaggccatctggactgtctgctgtctctactgcaggcaggtgctgagcctgatatctcaaataaaagcagggagacccctctgtataaagcatgcgagaggaaaaatgcggaggctgttaagatcttagtccagcataacgccgatacaaaccaccggtgtaaccgcggttggacagccctgcacgaatctgtgtcacggaacgacttagaagtgatgcagatcctggtctccggcggggccaaagtggaatcaaagaacgcatatggtatcactccgctcttcgtggccgcccagagcggccagttggaggctctgcggtttctcgccaagtacggggccgacattaatacccaagcctcagacaatgcaagcgctctttatgaggcatgcaagaatgagcacgaagaagttgtggaatttcttttgtcccagggagccgatgccaacaaaaccaataaggatgggctgctaccgcttcacatagcatctaaaaaaggcaactaccgaattgtgcagatgcttctgcccgtcacaagccggaccaggatcagacggtcaggggtgtcccctctgcatctggctgccgagaggaaccatgacgaagtcttggaagccctgttaagcgctcgctttgacgtgaacactccgttggctcctgagcgagctcgtctttacgaggaccgccgttcgtccgctttgtattttgccgtcgtgaacaacaatgtgtacgctaccgaactcttgctgcaacacggcgccgaccctaaccgcgatgtaatttcccccctcctggtagcgattaggcacggctgccttagaactatgcaactccttctcgaccacggcgctaacatcgatgcttacattgccactcatcccacggcttttccggccactattatgtttgccatgaagtgtttatccttgctgaagtttctaatggaccttggctgcgacggcgagccatgcttttcttgtttatacggaaacggaccccacccccctgcacctcagccaagcagtcgcttcaacgatgcgccagccgccgataaggagccatccgtggtgcagttttgtgaatttgtaagtgctcctgaagtgtcacggtgggctggccctataattgatgtgctgctggattacgttggcaatgtgcagctctgttcccgactaaaggaacacatagactcattcgaagactgggccgtgattaaggagaaagctgagcccccaagaccactggcccatctgtgcaggttgcgcgtacgtaaggccatcggcaagtaccgcatcaagcttctggataccttgcctttgccagggcgcctgatacgatatttgaagtacgagaatacccagtag

SEQ ID NO: 108254 - DNA, 1812 bp, Artificial Sequence
  Description of Artificial Sequence: Synthetic coding sequence
atggctattgaacagtctctcgctgataagacacgtggaccgacaactgcagaggcgactgccagcgcctgcaccaaccgtcagccagcacatttctacccctggacacgctcaacagctccaccagaatcttctccagccagggctcctatgggactttttcagggtgtgatgcagaagtacagttcctccctgttcaaaaccagccagctggcgcctgcagatccgctcatcaaggccattaaagatggtgacgaagaagcgctgaagactatgatcaaggaaggaaaaaacctggctgagcccaacaaggagggctggctaccacttcacgaggccgcctactatgggcaagtgggatgtctgaaagtccttcagcgggcataccctggtaccattgatcagagaacacttcaggaggaaaccgctgtctatctagcaacttgtcgcgggcacctggactgcctactcagcttgctccaggctggcgcagagcccgacatcagcaacaagtccagagagacgcccttatacaaggcttgtgagcggaaaaatgccgaggcggtgaaaattctggtccagcataatgctgatacaaatcaccgatgtaatcgggggtggactgcgttgcacgaaagtgttagtcgaaatgacctcgaagtgatgcagatcttagtgtcaggcggcgccaaggtggagagcaagaatgcgtatggaataacccccttgttcgtggctgcccaaagtggccaactcgaggccctccgatttctggccaagtacggagcggatattaatactcaggcctcagataatgcatccgccttgtatgaagcctgcaagaacgagcacgaggaggtggtcgagtttttgctgagccagggtgctgacgccaataaaaccaacaaggacgggctgctcccactgcatattgcctccaagaaaggtaattatcgcattgtgcagatgctcctgcccgtgaccagccgcactaggatcaggcgctcaggagtctcccctttacacctagccgcagaacgtaatcatgatgaggtgcttgaggccctgctatccgcccgttttgacgtgaacaccccacttgccccggaaagggcgcgcctttatgaggaccgtcgctcatccgccctgtatttcgcggtggttaataataacgtgtacgcgaccgagctactcttgcagcacggcgcagatccaaacagagacgtgatctctccgctcctcgtcgccattagacacggctgcttgcgaacgatgcagctgctcctcgatcacggcgcgaatatcgacgcctatattgccactcaccctactgcctttcccgccaccataatgttcgctatgaagtgtctgtctctactgaaatttttgatggacctgggctgcgatggagagccgtgcttctcatgtctttacggcaacgggccgcatcctccggctccccagcctagcagcagattcaacgacgctccagctgccgataaggagccctctgtcgtccagttttgtgaattcgtctccgcacctgaggtatccaggtgggccggccccattatcgacgtgctgctggattacgtcggcaacgtccagttgtgtagccgtcttaaggagcatatcgactctttcgaagattgggcagtcataaaagaaaaagcagaaccacccaggcctctggcacacctgtgcagactccgagtccgcaaagctatcggtaaataccggatcaagctccttgacacattgcccttgccagggcgtttaatcaggtatctgaagtacgagaatacacaatag

SEQ ID NO: 108255 - DNA, 1470 bp, Artificial Sequence
  Description of Artificial Sequence: Synthetic coding sequence
atgcggccagccgacccactcattaaagcgattaaggacggggatgaggaagctctgaagacaatgattaaggaggggaagaatcttgcggagcctaacaaggaggggtggcttccgctacacgaggccgcttattacgggcaggtgggctgcctgaaggttttgcagcgcgcgtaccctggcacaatcgaccaaagaaccctgcaagaggagaccgcagtatatttggcaacttgtcgcggtcacctggactgtctactgagcttgctgcaggcaggcgccgaaccggacatctccaataagtctcgggagactcccctttataaagcctgtgaaaggaagaatgccgaggcagtgaaaattctggtgcaacacaatgccgatactaaccatcgctgtaaccgggggtggacagccttgcatgagtctgtctctcggaatgacctcgaagtgatgcaaattttagtatccggaggagccaaagtcgagtctaagaatgcttatggtatcacgcccctcttcgtggcagctcagtcaggccagctggaagctctacgcttcctagcaaaatatggagcagacataaatacacaggcttcagataatgcttccgccctttatgaagcttgcaaaaatgagcacgaggaggtggtcgaatttctgttgtcccagggagctgacgcaaataaaactaacaaggacgggctgttgccactgcatatcgccagcaaaaagggaaattatcgcatcgtccagatgctcttgcctgtgacttcacgcaccaggatccggcgctctggagtctctcctctacatttggctgccgagcggaatcatgacgaggtcctggaagccctgcttagtgcgcgctttgacgtgaatacaccgctggcccctgagcgagccagactgtatgaggatagacgctcgtctgccctgtatttcgctgtggtaaacaataacgtttatgctactgagctgttgctgcagcacggcgcagaccccaaccgggacgtcataagcccactgttggtcgccatcagacacggatgcctaagaaccatgcaactgctgctggaccatggcgcaaacattgacgcctatatcgcaacacatcccacggcattccctgccaccattatgttcgccatgaaatgtctgtccctcttaaaatttctaatggatctcggttgtgacggcgagccctgcttctcttgtctgtatgggaatggcccccaccctccagctccgcagccttcttcaagatttaatgacgctcctgctgccgataaggaaccttctgtcgttcagttctgtgaatttgtgtcagctcctgaggtgagcaggtgggcaggcccaataatcgacgtactccttgactatgtcggcaacgtgcagttatgttctcgccttaaagagcatattgactcctttgaggactgggttctggagggtttcgtcaagtattag

SEQ ID NO: 108256 - DNA, 1908 bp, Artificial Sequence
  Description of Artificial Sequence: Synthetic coding sequence
atggccactcaaatctcaacccgcggttcacaatgcacgatcggccaggaagagtattctctgtatagcagcctgagcgaggatgaactagtgcagatggctatcgagcagtcgttggctgacaaaaccaggggacctacaacggcagaggctacagccagcgcatgtactaacagacaaccagcacacttctatccctggacacgatcgactgccccaccggagtcaagtccagccagagccccaatgggtctgttccaaggcgttatgcagaagtacagctctagccttttcaagacctcccagcttgcccccgcagacccgctcatcaaggccattaaggacggagatgaggaggctctgaaaacaatgatcaaagagggtaagaatctcgccgagccaaataaggaaggctggttgccgctgcacgaggcagcatattacgggcaggtgggatgtttgaaggtgcttcagcgggcctatcccggaaccatcgaccagcgcaccctccaagaggagaccgccgtttatcttgctacatgtagaggtcatttagattgcttgctttccctgctgcaagcaggagccgagcccgatattagtaataaatctcgcgaaacccctttgtacaaagcctgcgagcgcaagaatgcggaggccgtaaagattctcgtccaacacaatgcggatactaatcaccgatgtaaccgaggctggaccgctctccatgagtcagtaagtcgtaatgacctggaagttatgcaaatcctcgtgagcggtggcgcaaaagtggaatcgaagaatgcctatggtatcacccccctgtttgtggccgcccagtctggacagctcgaggctcttcgtttcctggcgaaatacggagcagatatcaatactcaggccagtgacaatgcatccgccctctacgaagcctgcaaaaatgaacatgaagaagtcgtggaattcctcttgtctcaaggagccgatgccaacaagaccaataaggacggcttattgccccttcacattgcaagcaagaagggaaactatcgcattgtgcagatgctgctgccggtgacaagtaggacccggatcaggagatcaggtgtctctcccctccacctcgccgccgagcgaaatcacgacgaggtgcttgaggctctgcttagcgcgcgtttcgacgtaaacactccgctggcgcctgagcgcgcccgactatacgaggaccgcaggtccagcgctttatattttgccgttgttaataataacgtgtacgcaaccgaactgctgcttcagcacggcgccgatccaaaccgcgacgtgattagccctctgctcgtggctatcagacacggatgtctgaggactatgcaacttttacttgatcatggagcaaacatcgacgcctatattgcaactcaccctacggcctttcctgctactatcatgttcgctatgaagtgtctctcattgcttaaatttttaatggatctcgggtgtgacggcgaaccttgcttctcttgcctgtatggaaatggccctcacccgccggcccctcaaccctctagtcgcttcaacgacgcacctgccgctgataaggagccctcggtggttcagttttgtgagtttgtttctgccccggaggtctcaaggtgggccggacctattatcgatgtgctgctagattatgtaggaaacgtgcaactttgctctcggctgaaggaacacatcgatagttttgaagactgggccgtgattaaggagaaggccgaaccaccccgaccgctggctcacctttgccgtctcagggtgcgcaaagctatcgggaagtacaggattaagctgctggatacactcccattgcctgggcggctcatccggtacttaaaatacgaaaacacccaatag

SEQ ID NO: 108257 - DNA, 1557 bp, Artificial Sequence
  Description of Artificial Sequence: Synthetic coding sequence
atggacttcaccgaggcctacgccgatacttgtagcacagtggggctggcggcgagagagggaaatgtgaaggtattaaggaagcttctgaagaaaggtagatccgtcgatgtggccgacaacaggggatggatgccgatccatgaggctgcatatcacaattccgtcgaatgtttacagatgctcataaacgccgatagttccgagaactatattaagatgaagacattcgagggcttctgtgccttgcatctggcggccagtcagggacattggaagatagttcagattttgcttgaggccggggcagacccaaacgccaccacactggaggaaactacccccctgttcctcgccgtagagaacggtcagattgacgtgcttcgactgctcctgcagcatggcgctaatgtcaatggctcacactctatgtgtggttggaacagcctccaccaggcttccttccaggaaaacgctgagattattaagctcctgttgcgcaaaggcgctaacaaggagtgccaggatgatttcggaatcacaccactgtttgttgccgctcagtacgggaaactggagtctctgagcattttaataagttccggcgcgaacgtcaactgccaggccctagacaaggcaacccctctgtttattgcggcacaggagggccacacaaaatgcgtggaactactgttgagttctggcgctgatccagatctttactgcaatgaggactcctggcagctacccattcacgctgcggcacagatgggacacactaagatcttggacctcctgatccccctgactaacagggcatgtgacactggtctgaataaagtctcgccagtctattctgccgttttcggcggacacgaggattgcctggagatcctcctgcgtaacggatattctccggatgcccaggcttgcctcgttttcgggttcagcagcccagtgtgtatggcctttcagaaagactgtgagttctttggcattgtgaatattctgcttaagtatggagcccaaattaacgaacttcacctggcttactgtctcaaatatgagaagttctcaattttcagatactttctgaggaagggctgctctctgggcccctggaatcatatctatgagtttgtgaaccatgccatcaaggcccaggccaagtataaagagtggctcccacacctgctagtggctggctttgatccgttaattttactctgcaatagctggatagatagtgtgtcgatagacaccctgatcttcactctggaattcactaattggaaaacacttgcccccgccgtggagcggatgctctctgcacgtgcatcgaatgcctggattctgcagcagcatatcgcgaccgtcccaagtcttactcacctctgccgattagagatccgctcctctctcaagagcgaacggctgagaagtgacagttatattagtcagctgcctctgccacgatctttgcataactatcttctttacgaggatgtgttgcggatgtacgaagtccctgaactcgctgcaatccaggatgggtag

SEQ ID NO: 108258 - DNA, 1671 bp, Artificial Sequence
  Description of Artificial Sequence: Synthetic coding sequence
atggcaatgatgcctctggtcctgcatcaccccgaacgacaggctgagctcgggtcaggactgcgtgatggggggggcgccgctctgagacctcccggcagactggtaaagcagatggacttcacggaggcatatgcagacacttgttctactgtgggcctggcggctcgggagggaaatgtaaaggtgttgcggaaacttctcaaaaagggcagatccgtggacgtggccgataatagaggctggatgcctatccacgaagctgcctaccacaatagcgtggagtgtctgcaaatgcttatcaacgccgattccagcgaaaattacattaaaatgaagactttcgagggattttgcgcgctgcatcttgccgcttcgcagggccactggaagattgtacagattctactagaagcaggcgcggacccgaatgccactactcttgaagagacaacacccctgttccttgctgtggaaaatgggcagatagacgttctccgtctgcttctccagcatggtgcaaacgtcaatgggtctcacagtatgtgtggctggaactcactgcatcaggcatcatttcaggaaaatgccgaaatcatcaagcttctgcttcgaaaaggggcgaataaggagtgccaggatgactttggtatcaccccccttttcgtcgcagcgcagtacggaaaactggagagccttagtatacttatttcctccggggctaacgtaaattgtcaggctctggacaaggccaccccccttttcattgctgctcaggaaggacacaccaaatgcgtggagctgctcctgtcatctggagcagatccagacctgtattgtaatgaggacagctggcagttgcccattcatgcagccgcccagatggggcacaccaaaatccttgacctgctcattccacttacaaacagagcatgtgataccgggttgaacaaggtgtccccagtctactcggctgtgttcggtgggcacgaggattgtttggagattctgttgcgaaacggctactccccagatgcacaggcgtgcctagtcttcgggttctcctcaccagtctgtatggcttttcagaaagactgcgagttttttggcattgtgaatatattactgaaatatggggcccagataaacgaactgcatcttgcctattgcttgaaatacgagaagtttagtatcttccgatatttcctccgtaaaggatgtagtctcggcccgtggaaccatatctacgaatttgtgaaccatgcaattaaagcacaggccaaatataaagaatggttgccccacctcctggtcgccggatttgatccacttattttactgtgtaacagctggatcgattcagtaagcatagatactctcattttcaccctcgaattcactaattggaaaacgcttgctccggctgtggagagaatgctgagcgccagggctagcaacgcctggattctgcagcagcatatcgctacagtgccatccttgacgcacctgtgcaggcttgaaattcggtcttctctgaaaagtgagagactccggtctgatagttatatttcgcagctgccccttcctcgatctcttcacaactacctcctctatgaggatgtactgcggatgtatgaagttccagagcttgccgccatacaggatggctag

SEQ ID NO: 108259 - DNA, 1338 bp, Artificial Sequence
  Description of Artificial Sequence: Synthetic coding sequence
atgaagaccttcgagggcttctgcgcgctccatcttgccgccagccaaggacactggaaaattgtgcaaatcctgctggaagccggtgcagaccctaacgctaccacgctcgaggagaccactcccctgttcttggcggtcgaaaatgggcaaatcgatgttctacggcttctcttgcagcacggtgccaacgtgaatggctcacactctatgtgtggttggaactcacttcatcaggcttcttttcaagagaacgcagagataatcaagttactgttacggaaaggtgctaataaggagtgtcaggacgatttcggaatcacgcccctgttcgtggctgctcagtatggaaaactggagtccctttctatcctgatttcaagcggagcaaacgtcaattgccaggccctagacaaagccacacccctcttcatcgctgcacaagaaggacatactaagtgcgtagaattgctgttgtcctccggcgccgaccccgatctgtactgcaatgaggatagttggcagcttccgatccacgccgcggctcaaatgggacacactaagattctcgatctgctgatcccactcacgaacagggcgtgtgataccggcctgaacaaagtgagtcctgtgtactccgctgtgttcggaggacacgaggactgtcttgagatactcctgcggaatggttattcccccgacgctcaggcatgcctcgtctttggattttccagccccgtctgcatggctttccagaaggactgcgaattttttgggattgttaacatcctgcttaaatatggcgcacagataaacgagctgcacctcgcctactgcctgaagtatgagaagttctcgatctttcgctacttcctgcgcaaaggttgttcactcggaccatggaaccacatatacgagttcgtgaaccacgccatcaaggcccaggccaaatataaagagtggttgcctcatctcctggtggctgggttcgatcccctgatactattatgcaatagctggatcgattccgttagtattgatacgctcatctttactctagaattcactaactggaagacccttgcacccgccgtggagaggatgttatccgccagagcatccaacgcctggattctccagcagcacattgcaaccgtcccgtccctgactcacctttgccgactggaaattaggtcctccctgaaaagcgagagacttcgctcggatagctatatatcccaattacctctgccaagaagcctgcacaattacttgctgtatgaggatgtcctacggatgtatgaggtgccggagctggctgccattcaggacggctag

SEQ ID NO: 108260 - DNA, 1662 bp, Artificial Sequence
  Description of Artificial Sequence: Synthetic coding sequence
atgccattggtgttacaccatccggagaggcaagctgaattgggtagcgggctgagggacggagggggggccgctttgcgcccccccggccgcctggtcaagcaaatggacttcacagaggcctacgcagatacatgcagtactgtgggcttggctgcaagagaaggcaacgtcaaggttctacgaaaacttcttaagaaaggacgctcggttgatgtggcagataaccgcggttggatgccaatccatgaggcagcctaccataattctgtggagtgtctgcaaatgttgattaacgccgatagctccgaaaattatatcaagatgaaaaccttcgaaggtttctgtgcactgcaccttgcggcgagccaggggcattggaaaatcgtacagatacttttagaagccggggccgatccgaacgcaacgactttggaagaaaccactcccctgttcctcgcggtggaaaacgggcaaatcgatgtcttgcgcctgttattgcagcatggtgctaacgtcaacgggtcacactccatgtgtggctggaattccctccaccaggcttcatttcaagaaaacgccgaaatcataaagctcctcctgagaaagggtgcaaacaaagagtgccaagatgatttcgggattacgccattgttcgtggccgcacagtatggcaagctggagtctctgtcaatcttgattagttcaggcgcaaacgtgaactgtcaggctctggacaaggcaacaccacttttcattgcagcacaggagggtcataccaaatgcgtggagctgttactgtcttctggcgctgaccccgacctgtattgtaatgaagattcttggcaactgccaatccatgccgctgcacagatgggccacactaagatcttggatcttttaattcccctcaccaatagagcgtgcgacactgggttgaataaagttagcccagtgtattctgccgtgtttggaggtcacgaggactgcttggagattctcttaaggaacggatactcacccgatgcccaggcatgcctggtgtttggtttctcttcacctgtgtgcatggcgttccagaaggattgcgaatttttcggaatcgtgaatattcttcttaagtacggtgcccagatcaatgaactacacctggcatactgcttgaagtatgagaagtttagcatcttcaggtattttctacgaaaaggctgcagcctcggtccatggaatcacatctacgaatttgttaaccacgctatcaaggcccaggctaagtacaaagaatggcttccacatctactggtcgctggattcgacccactgatccttttatgtaacagttggatcgacagtgtcagcatcgacactctgatattcaccttagagtttaccaattggaagaccctcgctcccgcagttgagcggatgctgtccgcgagggcatcaaacgcctggattttgcagcagcacattgccactgtgccatcgctcacccatctgtgtcgtctggagatccgcagctcattaaagtcagagaggctccgatctgattcttacatcagccaactcccattaccacgttctttacataactacctcctatacgaagacgttctcagaatgtacgaagtgcctgagcttgccgctatccaggatggctag

SEQ ID NO: 108261 - DNA, 1338 bp, Artificial Sequence
  Description of Artificial Sequence: Synthetic coding sequence
atgaagacatttgagggcttttgcgccctgcatcttgccgcctcccaagggcactggaagatcgtacaaatattgctggaggccggagccgatcctaatgctaccacgctggaggaaactacaccgctgttcttggctgtcgaaaatggacagattgatgttctaagactgctcctccagcatggggccaacgtcaacggctcacacagcatgtgtggttggaatagcctgcatcaagcctcttttcaggagaacgccgagatcatcaagctactgctcagaaagggcgctaataaggagtgccaggacgattttggtattacccctctgttcgtagcagcccagtatgggaagttggaatccctgtctatcctgatatctagtggtgctaacgtgaattgtcaagcgctcgataaggctaccccccttttcatagcagcacaagaaggtcacaccaagtgtgtggagttgctcctttctagtggcgctgacccggatttgtattgtaacgaggacagctggcagttacccatccacgccgcggctcaaatgggacataccaaaattcttgatctactgatcccgttgaccaatagggcatgtgataccggtttaaacaaggtctcaccagtgtactccgcagtgtttggaggacacgaagattgcctcgagattctgctacgcaacggctacagtcctgatgcacaggcttgcttggtatttggcttcagctctcctgtgtgtatggcctttcaaaaggattgcgagttttttggaatcgttaacatcctgcttaagtacggcgcccagataaatgagctgcacttggcatactgcctcaagtacgagaaatttagcatcttccggtactttctgcggaaagggtgcagtctgggcccttggaaccatatctacgaatttgtcaaccatgctattaaagcacaggccaaatataaagagtggttgcctcacctactggtggcgggatttgacccactcatcctgctatgcaattcttggatcgactcagtttcaattgacacactgattttcacgctggaattcacaaactggaaaactctggccccagccgtagagcgaatgcttagtgctagggcatccaacgcatggattctgcaacagcatatagccaccgttcctagtttgacccatctttgtagattggagattcgttcgtctctgaaaagcgaaaggctacgaagcgattcttacatctcgcagttgcctctcccacgtagtctgcacaactatttgctgtacgaggacgtgctccgaatgtacgaggttcctgagctcgcagctatccaggacgggtag

SEQ ID NO: 108262 - DNA, 1314 bp, Artificial Sequence
  Description of Artificial Sequence: Synthetic coding sequence
atggatttcaccgaggcctacgctgatacttgctcaacagtggggctcgctgctagggaagggaacgtgaaggtcttgcgaaaactcctcaagaaagggcgctctgtggatgtggctgataatcggggatggatgcccatacatgaggctgcctatcataactcagtggaatgcctacagatgctcatcaatgccgattccagcgaaaattatataaagatgaagacctttgagggattctgcgcactgcacctggccgcaagccagggacattggaagattgtgcaaatattactggaagctggggcagaccctaacgctacaactctggaggagacaactcccctttttcttggcgccaatgttaactgccaggcattagataaggctacccctctctttattgccgcccaggagggtcacacaaaatgtgtcgaattgctactcagcagtggcgctgaccccgacctttattgcaacgaagactcctggcaactgcctatccacgctgcggcacagatgggtcacacaaaaattctggatttgctgatcccactcacaaatcgcgcgtgtgacacaggccttaataaagttagccccgtctattcagcagttttcgggggccatgaggattgtctcgagattcttctcaggaatgggtactccccagatgcacaggcgtgtctggtctttggtttttcttctccagtctgcatggcattccagaaagagtggtcttgcgagtttttcgggatcgtcaacatcctgctaaagtacggtgctcagattaacgaactccacctggcttattgtcttaaatatgagaagttctccatcttccgctactttcttcggaaaggctgctctctcggaccttggaaccacatctacgaattcgtgaaccatgctatcaaggcccaggcaaagtataaagagtggctgccccatctgttagttgcaggttttgatcctctgattctgctgtgtaactcctggattgacagtgtgtccatcgataccctcatctttactctggaatttaccaattggaaaacgctggcccctgcggtggagcgcatgctctctgcgcgagcaagcaatgcctggatcctgcagcagcacattgccacagttccgtctctgacacatctgtgcaggcttgagatccggtcatcgttgaaaagcgaacggctgcgatccgattcttacatctcccagctgcctcttcccagatccttgcacaactacctgctgtatgaggacgtactgagaatgtacgaggtgcctgagctcgcggcaatccaggatgggtag

SEQ ID NO: 108263 - DNA, 1281 bp, Artificial Sequence
  Description of Artificial Sequence: Synthetic coding sequence
atggacggtacgaccgcccccgtaactaagtccggcgccgccaagctggtgaagaggaacttcttggaggccttgaaatctaacgactttggaaaattgaaagctattctgattcagagacagatcgacgtggataccgtctttgaggttgaggatgagaacatggtcctggcctcgtacaagcagggttattggctcccctcctataaactgaagtcaagctgggcaactgggttacatctgagcgtgctattcggccatgttgagtgcctgttagtattgctggaccataacgccacaattaattgccgacctaacggaaagaccccactgcatgtggcctgcgaaatggctaacgttgattgcgtgaagatcctgtgtgatcgaggcgcaaagctgaactgctattctttaagcggccacaccgctctccacttttgcacgactccgtcaagtatcctttgcgccaaacaattagtgtggcgtggggccaacgttaatatgaagacaaataaccaggacgaagagacccccctccatactgctgcgcactttgggctgagtgagctcgtagcgttttacgtcgagcatggggcaatcgtcgacagtgtgaacgcccacatggagactcccctggcaattgcagcctactgggccctgagattcaaggagcaggaatacagtacagagcaccatttggtctgccggatgctactggactataaagccgaagtaaatgccagagacgatgacttcaaatcccccttgcacaaagcggcctggaactgcgaccacgtccttatgcatatgatgctggaagccggagctgaagctaatcttatggacattaatggatgtgccgctatccaatacgtgctcaaggtgacaagtgtccgccccgctgcccagccagaaatttgctatcagctgttgctgaatcacggggccgcccggatttaccctcctcagtttcataaggtgatacaggcatgtcactcctgtccaaaggccatcgaggtcgtggtcaacgcctacgaacacatcagatggaataccaagtggcggcgtgctattcccgacgatgacttggagaagtactgggacttctatcatagtttgttcaccgtctgttgtaacagcccccgtactctcatgcatctgtctaggtgcgcgataagacgcaccctgcataatcggtgccatagagccatccctcttctgagtctgcctctatctttgaagaagtacctactactcgaaccagaaggaatcatttattag

SEQ ID NO: 108264 - DNA, 1050 bp, Artificial Sequence
  Description of Artificial Sequence: Synthetic coding sequence
atggatgggactaccgcccccgtgaccaagagtggagctgccaaactggtgaagcggaatttcctggaggcactgaaatccaacgacttcggcaagctgaaggcaatcctgatccaacggcagatcgatgttgataccgtgtttgaggttgaagatgagaatatggttctggccagctataaacaggggtactggctgccctcatacaagctaaagagctcatgggctaccgggcttcacctgtcggtgctcttcgggcacgtggagtgtctgttggtgcttttggatcacaatgccaccattaactgtcgacctaacggaaagacccccctgcatgtggcatgcgagatggccaacgtcgattgcgtgaaaattctgtgcgacaggggagctaagttgaattgctactccttgtcaggccacactgctttgcacttctgtaccactccaagcagcattttatgtgctaaacaactggtgtggaggggggcaaacgttaatatgaagaccaacaaccaggatgaagaaaccccacttcacacagctgctcacttcggtttgtctgagttagtggccttctatgtcgagcacggagccatcgtagattcagtgaacgcccatatggagacaccactggcaatagccgcttactgggcgcttcggtttaaggagcaagagtacagtaccgagcaccacctagtgtgccggatgctgctggactacaaggccgaagtgaacgccagggatgatgactttaagtctccgctgcataaagccgcctggaactgcgaccatgttctgatgcatatgatgctggaggccggcgccgaggcaaatctcatggacatcaacgggtgtgctgccatccagtacgttctgaaagtgacctctgtaaggcccgctgcacaacccgagatttgttaccagctgctgctcaaccacggtgccgccagaatctaccctcctcagttccacaaggtaagactgtgtccagtggtcagccgactgagaaagatccagatggccgctctgtccgagatcagtaaatag

SEQ ID NO: 108265 - DNA, 3747 bp, Artificial Sequence
  Description of Artificial Sequence: Synthetic coding sequence
atgggtaaagaccaggaactgctggaagccgctcgaacagggaacgtggctctggtggagaagctgctgagtggccggaagggggggattcttggtggtggcagcgggcctttgccgttgagcaacctgctctcaatctggagagggcccaatgtcaattgcaccgacagcagtggttataccgcacttcatcatgccgcactcaacgggcacaaggacatcgtgctcaagctgctacagtatgaagcctctaccaatgtggctgacaacaagggttacttcccaattcatcttgccgcttggaagggcgacgtggaaatcgtgaaaatcctcatccaccatgggccgagccactcaagagtgaacgagcagaacaatgaaaatgaaactgcgttgcactgcgctgcacagtacggccacagcgaagtcgtcgcggtgttgctggaagagctgacggacccaaccatccgtaactctaaattggaaactccgcttgatctggccgccctgtacggccggcttcgtgtcgtgaaaatgataatatctgcccaccccaatctcatgtcttgtaatacacgcaaacatacacctttgcacctggcagccagaaatgggcataaagccgtggtgcaggtgctcctggaggccggcatggacgtatcctgtcagaccgaaaagggctcagcactgcacgaagctgctttattcggcaaagtcgacgtggtcagggtcctgttggagacaggtattgatgccaacatcaaggactcgctgggtagaactgttcttgatatcctgaaagaacatccatctcaaaagtcgctgcagatcgctacactgctgcaggaatacctggaaggagtggggcggtccacagtgttggaggagccagtgcaagaggatgccactcaggagacacatatatcaagccctgtcgagtctccttcccagaagacgaaatctgagacagtgacgggggaattgagtaagctcctggacgagataaagctatgccaagaaaaggactatagttttgaggacctatgtcacactatcagtgaccactacctagacaacttgagcaagatttctgaagaagaactggggaagaatggtagccagtccgtgagaacaagttcgaccatcaatttgagtcctggcgaggtggaggaagaagatgacgatgaaaatacctgcgggccatcaggtctttgggaagccctgacaccctgcaatggatgccgtaacctgggcttcccaatgctagcacaggagagttatccgaagaagcgcaattataccatggaaatcgtgccgtccgcttccctggataccttcccaagtgaaaatgaaaattttctctgcgaccttatggataccgcagtcaccaagaagccctgtagcctcgagatagcacgtgctcctagcccacgcacagacaacgctagtgaagtggccgtgacaacccccggtacctctaatcaccggaacagtagtaccgggcctactcctgactgttcaccccccagtcccgatacagctctgaagaacatcgtgaaggtgattcgaccccaacctaaacagcggacaagcattgtatctagcttagactttcatcgtatgaaccataatcaagaatactttgagattaacacgtcaaccgggtgcacttccttcacagcttcgccacccgcgagtccacccacctcctcggtgggcaccactgaggttaagaacgaaggcacgaatcataccgacgacctctctcgccaggacgataatgatccgcctaaggagtatgaccctgggcagttcgccggactgcttcacggttcaagccccgcctgcgagagcccagagaaccccttccacttgtacggcaagcgagagcagtgtgaaaaaggacaggacgaggtgtctcttgcgaattctccactcccattcaaacagtcacccatagaaaacaattcggagcccttggtgaagaaaataaaacctaaggttgtgtcacggaccattttccataaaaagagcaatcagctggagaatcacacaattgtcggtacaagatccacacggtccggaagccggaacggagaccagtgggtgatgaatgctggggggtttgtggagcgcgcctgtacgttaggccgcatcaggagcctgcctaaggccctgattgatatgcacctgtccaagtctgtgtccaagagcgatagcgacctgatagcatacccctccaacgaaaaaacgagtcgagttaattggagcgagtctagcacggccgaacactctagtaaaggcaactccgagcgaactccctcatttacgtcagagtgggaagaaattgataagatcatgagtagtatagatgtgggcattaataacgagctgaaagagatgaacggggaaaccactcggcctcgttgccctgtccaaacagtggggcagtggctcgaatctatcggcctgccacagtatgaaaatcacctgatggctaacgggttcgacaacgtacaattcatgggaagcaatgtgatggaagaccaagatctgctcgagattgggatccttaatagcgggcaccgtcagcgtattctccaggccattcaactgttgccaaaaatgcgcccaataggtcatgatggctaccaccccacttctgtggctgagtggctcgactctatcgagttgggcgactatacgaaggcctttcttatcaatggctatacctccatggacctgctcaaaaaaatctgggaagtggagctaataaatgttctgaaaatcaatctcatcgggcaccgaaagcgcattcttgcgtctttaggcgatagactgcatgacgatccaccgcagaaaccccccagatctatcactcttagagagccttcgggtaaccacacgcccccccaacttagcccttccttgagccagtccacatacactactggaggttccttggacgtcccccacattataatgcagggggacgcccggagacgccgcaatgaaaattacttcgacgacattcctcggagtaagctggagcgtcaaatggcgcagactggagattggggcgaaccttcaattacgctcagacctcccaatgaagcaacagctagcacacccgtacagtattggcagcatcaccccgagaagctgatcttccagtcctgcgattacaaagccttctacctgggctctatgttgattaaggagctgagagggaccgaaagcacccaagacgcctgcgccaagatgcgggtgatgtgcgtgaagtccactgaacagatgaagaaggtcccgaccattatactctcggtttcctacaaaggggtcaagttcatagatgcgacaaacaaaaatattattgccgagcatgagattaggaatatttcctgcgccgctcaagatccagaagacttatctaccttcgcctacatcacaaaagacttaaaatcaaaccatcactattgccacgtgtttactgcgttcgatgtaaacctggcctatgaaatcatccttactttgggtcaggcattcgaagtcgcctaccagctggcactccaggctcgtaagggagggcactctagtactttgcccgaaagcttcgaaaacaagccgtcaaaacccataccaaaaccaagggttagtattaggaaatcggtagacctgctgcacgctagccatacagggcaagagccgtcggagaggcatactgaggaggccctgcgtaaattttag

SEQ ID NO: 108266 - DNA, 1353 bp, Artificial Sequence
  Description of Artificial Sequence: Synthetic coding sequence
atgatgtggcagtgccatctgtctgcccaggattaccgctattatccggtggacggctactctctgcttaaacgtttccctttacatccactcacgggaccgcgctgccccgtacagacagtgggccagtggctagagtctattggtctccctcaatatgagaaccacctgatggctaatggcttcgataacgtccagtttatgggtagtaatgtgatggaggatcaggatcttctggaaatcgggattctgaactcaggtcataggcagcgaattttacaggccatccagctcctgccaaagatgcgtcccatcggacatgacggttatcatccaacttcagtggctgagtggttggactctattgaactaggcgattatacaaaggccttcctcattaacggttataccagcatggacctgctgaagaaaatctgggaggtcgaacttatcaacgtgctgaaaataaatctgattggccacagaaaaagaatattggcatcattgggagatagactccacgatgacccacctcagaagccccctaggtcaataaccctgcgctcctcagtgtgcgaaatttggaccaaccaaaacgcggggtttccgttctccgcaatccaccaggtgcataacactggcgactggggcgagcctagtataacccttcgacctcccaacgaggcaacagcgtccaccccggtgcagtactggcagcaccatccagagaaattaatttttcaatcctgcgactataaagccttctacctgggatccatgcttattaaagaactgagaggcacagagtcaacacaggatgcctgtgcaaaaatgagggccaacattcaaaaatcaacggagcaaatgaaaaaggtgcctactataatattatccgtgtcatataaaggggttaaatttattgacgcgacaaataagaacattattgcagagcatgaaatacgcaacatcagttgcgctgcccaggaccccgaagacctgagcaccttcgcatatattactaaagatctaaagtcaaaccaccactactgccacgtgtttacagctttcgacgtgaatcttgcatatgagatcattctgacgctggggcaggctttcgaagtcgcataccagctggctctgcaggcccgaaagggaggtcattcatccactctgcctgagagcttcgagaacaagccatcgaagccaattcccaagcctagagtatcaatccgtaaaagcgttcagattgatcctagtgagcagaagaccctcgccaatcttccttggatagtggagccaggacaagaagccaagcgggggatcaataccaaatatgaaacgacgatcttctag

SEQ ID NO: 108267 - DNA, 765 bp, Artificial Sequence
  Description of Artificial Sequence: Synthetic coding sequence
atgcaaggcgatgccagacgcaggaggaacgagaactactttgatgacataccacgctctaagctggagcgacagatggctcagaccggcgattggggagagccgtccatcacccttcgccctcccaacgaggccaccgccagtaccccagtacagtattggcagcatcatccggagaaactgatatttcaatcatgcgattacaaggccttttatctgggcagcatgctgataaaagagctccgagggactgagagcacccaggacgcatgtgcaaagatgcgggcgaattgtcagaagtccaccgagcagatgaagaaagtcccgactatcatcctgtctgtgtcctataagggagttaaattcatagatgccaccaacaaaaatataattgcggagcacgaaatccgaaatatctcctgtgccgcgcaagatcctgaggatctatcgactttcgcttacattactaaagacctgaaatccaatcaccactactgtcacgtgttcacggcttttgacgttaatttggcctacgagatcatactaaccctggggcaggcttttgaggtggcctatcaactggccctccaggcgcgcaagggcggtcattcctcaaccttgcctgagtcttttgaaaataagccctccaagcccatccccaaacctagggtgtccatccgaaaaagtgtggacctgctccatgcctctcatactggccaggagccgtcggagcgccatacagaagaggcactgaggaagttctag

SEQ ID NO: 108268 - DNA, 1053 bp, Artificial Sequence
  Description of Artificial Sequence: Synthetic coding sequence
gtcctcttccaggggagcaacgtgatggaagaccaggatcttcttgaaatcggtatcctgaatagcggccaccggcagcggatccttcaagctatacagctgctccccaagatgaggcctattgggcatgacggatatcaccctacttcggtcgccgagtggttggatagcatcgaattaggggactacaccaaggcctttctcattaatggatatacaagcatggaccttctcaagaagatatgggaggtggaactcattaatcagtcatcggtgtgtgaaatctggactaatcagaatgctggattccccttctcagccatccatcaggttcacaacactggggattggggggaaccgagtatcaccttaagaccccccaacgaagctacggcctccaccccagtgcaatactggcaacatcatcctgaaaaacttatctttcagtcgtgtgactataaggccttttacctgggcagcatgttgataaaagagctacgcgggactgagtcaacccaggacgcctgcgccaagatgcgtgccaacatccagaaatccaccgaacagatgaagaaggtgccaacaataatcctcagcgttagttataaaggtgtaaagttcatcgatgcaacgaataagaatatcattgccgagcatgaaatacggaatatctcatgtgccgcacaggatccagaagatctatctaccttcgcatacattaccaaagacttaaaaagtaaccaccactactgccacgtgttcacagcctttgacgtgaacctcgcctatgaaatcatcctgaccctggggcaggcgttcgaggtcgcctatcagctggcactccaggcccgcaagggcggtcacagctccaccctacctgagtccttcgagaacaagccgtcaaaacctattcctaagccaagggtttctatccgcaagagcgtgatagacccatctgagcagaaaacgcttgcaaacctgccctggatagttgaacccggacaagaagctaaacgaggcatcaatacaaagtatgaaactaccattttctag

SEQ ID NO: 108269 - DNA, 2292 bp, Artificial Sequence
  Description of Artificial Sequence: Synthetic coding sequence
tcattccaggagtcctacccgaagaagcgtaactataccatggaaatcgtgccttctgcgtccctggatacatttccgtccgagaatgaaaactttctgtgtgatctcatggacaccgctgtcacaaagaaaccatgctccttagaaatcgcgcgggcaccttctcctcgtactgataacgctagtgaggtcgctgttaccactccgggtaccagcaatcacagaaatagctcgactggccctacacctgattgtagccctccatcacccgacacagctctgaaaaacattgtgaaagtcattaggcctcagcctaaacaacgaacgtctatcgtgtcctctttagatttccaccggatgaatcacaaccaggagtacttcgaaattaacactagcactggctgcacatcctttactgcttcgcccccggcttctcctccaacatcaagtgtgggcactaccgaggtcaaaaatgagggtaccaaccacaccgacgacctcagtcggcaggacgacaacgaccccccaaaggaatacgaccctggccagttcgccggtttactgcatggctcaagtcctgcttgcgaatctcccgagaatccctttcacctctatggtaagagagagcagtgcgaaaaaggtcaggacgaggtgtctctggctaacagtccgctcccctttaagcaaagtcctattgagaacaactctgaacctctggtcaaaaagatcaagccaaaagttgtgtcccgaacgatctttcataagaaaagcaatcaactcgagaaccatacaatcgtgggaactcgctcaaccagaagtggttcaagaaatggggatcagtgggtgatgaacgctggaggatttgtcgaacgggcttgcacactgggccgtattcggtctttaccgaaggccctcattgatatgcatctgtccaaatccgtttccaaaagtgactccgatctcatagcctatccctctaacgagaagacatcccgagtcaattggtctgaatcttccacggcagagcacagctcaaagggcaactcagagaggaccccatccttcacctccgagtgggaggaaatcgataaaattatgtcatcaatcgacgtcggcattaacaacgagctgaaggagatgaatgggccccggtgtcccgtgcagacagtgggccagtggctggagtctatcggattgcctcagtacgaaaatcatctgatggccaacgggttcgataacgtacaatttatggggtcaaatgtgatggaagatcaggacctgctggagatcgggatcctgaacagcggacaccgccagagaatcttgcaggcaatccagctccttccaaaaatgaggccaataggacacgacgggtaccacccaacgtccgttgcagagtggctagacagtattgagctcggagattataccaaggcctttttgatcaacggctacactagcatggacctcttaaagaaaatctgggaggttgaattgataaatgtactaaagatcaatctcattggacatcggaagagaattttagcttccttaggggatagattgcacgacgaccccccacagaaaccccccaggagcatcaccctccgcacgggggattggggggagccatccataacactccgaccccctaatgaagcaacagccagcaccccagtccaatattggcagcaccacccggagaagcttatctttcaaagctgtgactataaggccttctatctggggagcatgctcattaaagagctacgcgggaccgagtcaactcaggatgcttgcgcaaagatgagagtcatgtgcgtgaagagtacggagcagatgaagaaggtccccaccataattttatccgtcagctataaaggtgtgaaatttatagacgccacaaataagaacattatcgctgaacacgagattagaaacatctcatgcgctgctcaggatccagaggatcttagcacattcgcgtatataactaaagacctcaagagtaatcatcattattgccatgtgtttaccgcgttcgatgtgaatctggcctacgagatcattctgaccctggggcaagcattcgaggtcgcttatcaactagcactccaggctcgcaaagggggccattcaagtactttgcctgagagctttgaaaataagccatctaagcctatccctaagcctcgggtttctattcgtaagtccgttgatttgctgcatgcgtcacacaccggccaggagcctagtgaaaggcatactgaggaagctcttaggaagttttag

SEQ ID NO: 108270 - DNA, 1281 bp, Artificial Sequence
  Description of Artificial Sequence: Synthetic coding sequence
atgatgtggcagtgtcacttgtcggcccaagactatagatattacccagttgacggatatagcctgttgaaaagatttccgctccaccctcttacaggccctaggtgcccggtgcagaccgtcggtcagtggctagagagcattggactgcctcaatacgaaaaccatctgatggccaatggtttcgacaatgtccagtttatgggctccaatgtgatggaagaccaggatttactggaaataggaatcctcaactccggacatcgtcaacgtatactacaagcaatacagctcctgccaaagatgcggcctataggtcacgatgggtatcatccgacatccgtggctgaatggctagactcaatagagctcggcgattatacgaaggcctttctgatcaatggctacaccagcatggatctgttaaaaaaaatatgggaagtcgagttgattaatgtgctcaagattaatctaatcggtcaccggaaaaggatactggcaagtttgggggataggttacatgacgacccaccacagaagcctccccggtccattacactacgtacaggagactggggcgagccatccatcacactcagaccccccaatgaagcaaccgcaagcacgcccgtgcagtactggcaacatcatcctgagaaactcatattccagagctgtgactacaaagcattctaccttgggagcatgctgatcaaagaactccggggcaccgagtctacccaagatgcatgcgcaaaaatgcgggccaactgtcaaaaaagtaccgaacagatgaaaaaggtgccaactattatcctgtctgtcagctacaagggggtcaagttcatagacgctacaaacaagaacatcatcgcagaacatgaaatccgcaatatctcgtgcgctgcgcaagaccccgaagatctgtctacgttcgcatacataacaaaggatctcaaatctaatcaccactattgccatgtctttaccgccttcgatgtgaatctcgcatacgagatcattctgacccttggacaagcctttgaggtagcttaccaactggccctccaggcccggaagggagggcattccagcacactcccagaatcttttgaaaacaagccgagtaaacccattcctaagcctcgtgtttctatacgcaagagcgtccaaattgacccctctgaacagaagacacttgctaacctgccgtggatcgtagagccagggcaagaagccaagagggggatcaataccaagtatgagactaccattttttag

SEQ ID NO: 108271 - DNA, 1383 bp, Artificial Sequence
  Description of Artificial Sequence: Synthetic coding sequence
atgatgtggcagtgccacctttctgcccaggattatcgttactatccagtggatggctattcgctgctgaagagattcccactccatcccctgactggacctaggtgccccgttcagacagtaggacagtggttggaatccattgggctgccacagtatgaaaaccatctgatggccaatgggttcgacaacgttcaattcatggggagcaatgttatggaggaccaagacctccttgagattggcatccttaactccggacatcggcaacgcatccttcaggccattcagcttctacctaagatgcgtcctatagggcatgatgggtaccatccaacctcggtggcagaatggctcgacagtatcgaactgggggattacacaaaggccttccttattaatggctacacatcaatggacctgctgaaaaagatctgggaagtggagttgattaatgtccttaaaatcaaccttatcggacaccgtaagcggattcttgcatctcttggcgacaggttgcacgatgacccgcctcaaaaaccacctaggtccataaccctgcgcgagccttcaggaaatcacaccccaccacagttaagtccgtctttgtcgcagagtacctacaccacaggaggcagccttgacgtgcctcatattattatgcaaggcgatgcaaggagacggagaaatgaaaactactttgatgacatcccaaggagtaaattagagcggcagatggcgcagacaggcgattggggcgagccctcaatcacactgcggccaccaaatgaggcaacggcttcaacaccagtgcagtattggcaacaccacccggaaaaactcatctttcagtcctgcgactataaagccttttatctaggaagtatgttgatcaaagaactgagagggactgagtcgactcaagacgcctgcgccaagatgagggcaaactgtcaaaaaagcaccgagcaaatgaagaaagtccccacgatcatactaagcgtaagttataaaggggtgaaatttattgacgccacaaataaaaacattatcgcagaacacgaaataaggaacattagctgcgcagcgcaggatcctgaggatctatcgacattcgcctacatcactaaggatcttaagtcaaaccatcattattgccacgtatttaccgcctttgacgtcaacctcgcgtatgagatcattctcacgctgggtcaggccttcgaagtcgcctatcaactggcactacaggctcggaagggcggtcatagcagcaccctcccagaatccttcgagaacaagccctccaaaccgatacctaagccccgtgtatcaattaggaagagcgtgccattctgctttaaagcagatcgccctatctag

SEQ ID NO: 108272 - DNA, 2295 bp, Artificial Sequence
  Description of Artificial Sequence: Synthetic coding sequence
atgctcgcccaagaatcttatcccaaaaagagaaactacactatggagatcgtgccctccgcatccctggatacatttccttcagagaacgaaaactttctttgcgatttgatggacaccgctgtaaccaagaagccctgcagtctcgagatcgcccgcgctccatccccacgcactgacaatgcctcagaggttgcggtgaccacgcccggaaccagcaatcaccgcaactcctctacaggtcccacacccgattgttcccccccaagtcccgacacagctttgaaaaacatcgtcaaggtaatcaggcctcaaccaaaacaaaggacgtctattgtgtcttctttggattttcataggatgaaccacaatcaggagtatttcgaaataaacacttccactggctgtacttcgtttactgcatccccgcccgcctctccccccaccagctcagtaggtacaactgaggtcaaaaacgagggcacaaaccacacagacgatctcagtaggcaggatgataacgaccctccaaaggaatacgaccccgggcagttcgccggactgctgcatggatcttcccctgcatgcgagagtccagaaaatccatttcatctatatggcaaacgggagcagtgcgagaaaggtcaagatgaggtttcactggccaatagcccgttacccttcaaacagtctcccatcgagaacaattctgaacctttagttaaaaagataaagcccaaagtagtgtcacggaccatcttccacaaaaagagcaatcagcttgaaaaccataccatcgtgggtacacggtcaaccaggtccggatcaaggaacggcgatcagtgggtcatgaacgccggaggcttcgttgaaagggcatgcacattggggaggatccgttctttgcctaaggcccttattgacatgcatctttctaagtctgtcagtaagtctgacagcgacttgattgcctatccatccaatgaaaaaacaagcagggttaactggtccgaatcttcgactgccgaacacagcagtaaaggcaattctgagcggacaccttcgttcacctctgaatgggaggagattgacaaaataatgagctccattgacgtgggaattaacaacgagttgaaggagatgaacggtccacggtgccccgttcagacagtaggacaatggctggagagtattgggctgccccaatacgaaaatcatttaatggctaacggattcgataacgtgcagttcatggggagtaatgtcatggaagaccaggacctgctggagatagggattttgaatagtggccacaggcagcgcatactccaggccatacaactgttgcctaagatgcgtcctattggacacgatggctatcaccccacttcagttgcggaatggctggattcgattgaattgggtgactacaccaaggcattcctgattaatggctatacgagcatggacttgcttaagaaaatttgggaggtggaactcattaatgtactaaaaattaacctgataggccatagaaaacgaatcttggcctctcttggagacagacttcatgatgacccacctcagaaacccccgaggtcaataactctgagaacaggagactggggtgagccctcaattacattgcgtcctccaaacgaagccacagcttcaactcctgttcagtactggcagcatcacccggaaaagcttattttccaatcatgcgactacaaggctttctacctgggaagtatgctgataaaagagctgcgaggaacggagagtactcaggacgcctgcgccaaaatgagagccaactgccagaagtccacagagcagatgaaaaaagtgcccaccatcatcctgtcggtgtcgtataagggagtcaaattcatcgatgccaccaataaaaatattatagccgaacacgagatacggaatatttcttgcgccgcccaggacccggaagacctatctactttcgcttacattaccaaggatctcaaatcgaaccaccattattgccatgtgttcacagcattcgacgtgaatctcgcttacgagataatcttaacactaggtcaggcgttcgaggtggcttatcagcttgccctccaggcgcggaagggtggccattcttcaaccctgcccgaaagcttcgagaataaaccgtctaaacccatccctaagccccgagtgtctatcagaaagagcgtggaccttctacacgcatcccacacgggccaggaacctagtgagcgccacaccgaggaggctctccggaaattttag

SEQ ID NO: 108273 - DNA, 3747 bp, Artificial Sequence
  Description of Artificial Sequence: Synthetic coding sequence
atgggcaaggaccaagagctgctcgaagctgcgagaaccggtaacgtggctctagtggaaaaactcctgagcggtagaaaaggggggattcttgggggtggttcgggcccactgccactgagcaacctgctctcaatttggaggggcccaaatgtgaactgcacagactcctccggctacaccgctttacaccatgccgcccttaacggccataaagatatcgtactcaaactattacagtacgaggccagtaccaatgtggccgataacaagggttacttccctattcacctcgccgcctggaagggagatgtggagattgtcaagatcctaatccatcacgggccatcccacagcagggtgaatgagcagaataacgagaatgaaaccgccctacattgtgcggcacagtacggacactccgaggttgtggcggtccttcttgaggagctgacagatcccaccatcaggaacagcaagctggagactcccctggacctggctgcgctgtatggacgactgcgcgtggttaaaatgataatttcagcccacccgaacctgatgtcttgtaatacccgcaagcacacaccactgcacttggccgccagaaacggtcataaagccgtggttcaggtgttactggaggccggcatggatgtgagctgtcagaccgagaagggttcggccctccatgaggccgctttgttcggcaaggtggacgtagtccgggtacttctcgagacagggatagacgctaatataaaggattctctcgggagaacagttctggacatactcaaagagcatccttcccagaagagcttgcaaatagcaacattgctgcaggagtatcttgagggagtggggcgcagtaccgtactggaggaaccagtgcaggaagacgcaacccaagaaactcacatctcctcacctgtggagtctccttctcagaaaacgaaaagcgaaaccgttaccggcgagctgtcaaagctgctggatgaaattaagctatgccaagaaaaggattatagttttgaggatctatgtcacacaattagcgaccattacctagataatctttccaaaatttcggaggaggagctcggaaagaacgggtctcagagcgtgcgaacgagttcgacgatcaacctctctcccggcgaggtcgaggaagaggatgacgatgagaatacttgtggcccaagtggcctgtgggaggccttgacaccctgcaacggatgccgaaatctcggatttcccatgttagcacaggaatcatatcccaagaagcggaattacactatggagatcgtgccttctgctagtctcgacacttttcccagcgagaacgaaaatttcctttgtgacctgatggacacagctgtcacaaagaagccatgcagcctggagattgccagggctcctagccctcgaacggacaacgcaagtgaagtagccgtgacgacaccagggactagtaaccacaggaacagcagcactgggccaacccccgattgcagcccacccagtcctgataccgctctaaaaaacatcgttaaggttattagaccgcagcccaaacagcggacctccatagtgtccagcctggacttccatcggatgaatcataatcaggaatattttgagattaacacatcaacaggttgtaccagtttcactgcatccccccccgctagcccgccaacttctagcgtgggaactactgaggtaaagaatgaaggtaccaatcacacagatgatctaagcaggcaggacgacaacgacccaccaaaagaatacgatcctggccagttcgccgggttacttcatggctcttcccctgcatgtgaaagtcctgagaaccccttccacttgtatggaaagcgggaacaatgcgagaaaggacaggacgaggtgagtctcgcaaattctccgctgccattcaaacagtcacccatagagaataactcggagcccttggtgaaaaaaatcaagccgaaggtagtgtctcgtacgatcttccacaaaaagagtaaccagctggaaaaccacaccattgttggcacacggtcaactaggtcaggtagccgaaacggggatcaatgggtgatgaacgcaggaggcttcgtcgaaagagcatgcactctgggaagaatcaggtcactacctaaagctttgattgatatgcaccttagtaaatctgtctctaaatccgacagcgatcttatcgcatacccaagcaatgaaaagacatcccgcgtaaattggagtgaatctagcacggccgaacactcaagcaagggcaacagcgagcggacacccagcttcactagtgagtgggaagaaattgacaagattatgtcttccatcgacgtaggtatcaataacgagcttaaggagatgaatggtgagactacaagaccgagatgtcccgtacagacggtgggacaatggttagagtctatcgggttgccacaatacgaaaaccacctcatggctaacggattcgataacgtgcagttcatggggtctaacgtcatggaggaccaagatttgctcgagataggaattcttaattccggtcatagacagcgcatccttcaggctattcagttgctgcccaaaatgaggcctatcgggcacgacggctaccaccccaccagtgtggcagaatggcttgacagcatcgaactcggagattacacgaaggcttttcttatcaatggttacactagcatggatctgctcaagaaaatttgggaagtggaattaatcaatgttttaaaaatcaatttgatcggtcatcggaagagaatcctcgcaagtctcggcgacaggctacatgacgatccacctcagaaacctcctagatctataaccttgagagagccaagtgggaaccatactccaccccagctgtccccctctctcagccagagcacgtataccacaggggggtctttggacgtgccgcatatcatcatgcagggggacgcaaggagaaggcgcaatgaaaattacttcgacgacatcccacggtctaagttagaaaggcagatggctcagacaggcgactggggcgagccttctataaccctacgcccgcccaacgaagcaaccgcttccactcccgtccagtactggcaacaccaccctgagaagctcatcttccagtcttgtgattacaaggctttttatctcgggagcatgttgattaaggagctgcgcggcacggaaagcactcaggacgcatgtgctaagatgagagctaactgtcagaaaagtactgagcagatgaagaaggttccaactattatcctctcggtgtcatataagggcgtaaagtttattgacgcaaccaacaaaaacataattgcagagcacgagattcgtaatatcagctgcgccgcccaggatcctgaggacctgtctacctttgcgtacatcaccaaagatctgaagtccaatcaccactattgtcatgtctttacggcctttgatgtgaatctcgcttacgagattatcttaacgctgggacaagcttttgaggtcgcctaccagctcgctctgcaggcaaggaaggggggccactcctccactctgcccgaatccttcgagaataaaccgtccaaacctattcctaagcctcgcgtgagtatcagaaaatccgttgacctgctccatgcaagccacacaggacaggagccttccgagaggcacactgaagaagcacttaggaagttctag

SEQ ID NO: 108274 - DNA, 1074 bp, Artificial Sequence
  Description of Artificial Sequence: Synthetic coding sequence
atggccaatggtttcgataacgtccagttcatgggcagtaatgtaatggaggaccaggacctgctcgagattggcatactgaactccggacatcggcagcggatcctgcaagctatccagctgctgcctaaaatgagacctattggtcatgatggctatcaccctacctcagtggcagaatggctggactcaatcgagttgggggattacaccaaagcttttctgatcaatggttacacctcaatggatttgctcaaaaagatctgggaagtggagttgatcaatcagtcttcagtttgtgagatctggactaaccagaatgctgggttcccgttctccgccattcaccaggtgcataataccggcgactggggcgaaccttccatcaccctacgcccaccgaatgaagccactgcaagcacccctgtgcagtactggcagcaccacccagagaagctgatctttcagtcttgcgactacaaagcgttttatctaggctccatgctgatcaaagaattgcggggcacggaaagcacacaggacgcctgtgccaaaatgagagccaattgccagaaaagtacagaacagatgaagaaggtgccaactatcatattatcagtgtcatacaagggcgttaagtttatcgacgcaactaacaaaaatattatcgccgagcacgagattaggaacatatcatgtgctgctcaggacccagaggacctttcaaccttcgcttacataacaaaggatttaaaatcaaaccatcattactgccacgttttcaccgcattcgacgtgaacctggcatatgaaatcatcctgacattaggccaagcctttgaggtggcgtaccagctggcccttcaggcccgtaaaggaggtcattctagcaccctccccgaaagcttcgagaacaaaccttctaagccaatccccaaacctagggtcagcatccgcaaaagcgtgatcgacccttctgagcagaagacattagccaacctcccttggattgtggagcccggacaggaagctaaacgtggtatcaataccaagtacgagacgaccatcttctag

SEQ ID NO: 108275 - DNA, 1533 bp, Artificial Sequence
  Description of Artificial Sequence: Synthetic coding sequence
atgatgtggcaatgccatttatccgctcaggactaccgttattatcctgtggatggctatagcctgctgaaaagatttcccctgcacccgctcactggaccacggtgtcccgtccagaccgtgggccagtggctcgaatccattggcctgcctcaatacgaaaaccatctgatggccaatggttttgacaacgtacagtttatggggtctaacgtaatggaagaccaggatcttctcgagatcggtattctcaattccggacataggcagcggattttacaggcaatccagctcctgcctaaaatgcgcccaattgggcacgatggctaccatcctacctctgtggctgagtggctcgacagtatagaactcggagattacacaaaagccttcctgatcaatggatacacctccatggacctactcaaaaagatttgggaggtggaacttataaacgttctgaagattaatctcattggtcaccgaaaacgaattttggcttctctcggggaccgactccacgatgaccctccccagaaacctccccggagcatcacactgcgtgagccgagtggaaaccatacccccccccagcttagcccgagtctatcacagagcacttataccactgggggctccctggacgtgccccatattattatgcagggcgacgccaggagacgcagaaacgaaaactacttcgacgatattccacgctcaaagctggaacgacagatggcacagtcctccgtgtgtgagatttggactaaccagaatgctgggttcccgttctccgcaatccaccaggtgcacaatacaggcgactggggggagccttcgataactttgcgtcctcctaacgaggcgactgcctctacgcctgtgcagtattggcagcatcaccccgagaaattgatctttcagagttgcgactacaaggcattttatctcggaagcatgctcattaaggagctgaggggaactgagagcactcaggacgcctgcgctaaaatgcgcgccaactgtcaaaagagcaccgagcagatgaaaaaggtgccaacaataattctttctgtgagctataagggagtcaagtttatagacgctacaaataagaacatcatcgccgagcatgaaatcaggaacatctcttgcgctgcacaggacccagaagatctatccacattcgcgtatatcactaaagatcttaagtcgaatcaccattactgccacgttttcactgcattcgacgtgaatctggcctatgagattatcctcaccctcggccaggctttcgaagtcgcctaccagcttgcactgcaggctcgaaaaggaggccactcctccaccctgccagaatctttcgagaacaagccaagtaagccaattccgaagcctcgcgtgagcattcggaagagtgttcagattgacccaagcgagcagaagactctggcaaaccttccgtggatcgtagagcccggccaggaggcgaagcgcggtatcaacacaaaatatgagacgaccattttctag

SEQ ID NO: 108276 - DNA, 1245 bp, Artificial Sequence
  Description of Artificial Sequence: Synthetic coding sequence
atgatgtggcagtgtcaccttagcgcccaggactatcgatattacccagttgatgggtatagcttgttgaaacggttccctctccaccccctgacgggcccccggtgtccagttcaaacggtgggtcagtggctggagtctattggcctgcctcaatacgagaatcacctgatggcaaatggcttcgacaacgtccagttcatgggatcaaacgttatggaagaccaggacctcctagaaataggtatcctgaactccggccataggcagcggatcttacaagccattcagctgcttcccaagatgcgcccgataggacacgacggttaccaccccacttctgttgcggaatggcttgactctattgagctcggagactacacaaaagcatttctcataaacggctatacctccatggatttgttaaaaaagatctgggaggtggagcttatcaacgtcttaaagataaatttaattgggcatcggaagcggatcctcgctagtctgggggataggcttcacgacgaccctcctcaaaagcctccacggagcattacactgagaacaggagactggggagagccctctatcaccttaagacctcccaatgaggcgacagcttccactccggtacagtactggcaacaccacccagaaaagctcatcttccagtcatgcgattataaggcattttatctgggatcaatgctaattaaagagctccggggaactgagtccactcaggatgcctgcgccaaaatgcgggctaattgccaaaagtccactgagcagatgaagaaggtgccaaccattatccttagcgtgtcgtataaaggggtgaaatttatcgatgcaaccaataagaatatcatcgccgagcacgaaatccgcaatatttcctgcgcagcccaagacccagaggatctcagcacctttgcctatattacgaaggatttgaaatctaaccatcactattgtcatgtgtttaccgcttttgacgtcaacctggcttacgaaattattctcactctggggcaagcattcgaagttgcataccagcttgctctgcaggctcggaagggaggccattcctcaacgctgcctgaatcttttgagaataaaccctctaagcctataccaaaaccgcgagtgtctattcgaaagtccgtggatctgttgcacgcaagccatacaggccaggagccaagcgagaggcacactgaggaagcgcttagaaagttttag

SEQ ID NO: 108277 - DNA, 1353 bp, Artificial Sequence
  Description of Artificial Sequence: Synthetic coding sequence
atgatgtggcagtgccacctgtctgcacaagattaccgctactatcctgtagacggttactctctcctgaagcgattccccctgcatccattgacaggacccagatgcccagttcagactgtgggccagtggctggagagcatcggcttgccccagtacgaaaatcatctcatggctaatggcttcgataacgtgcagttcatggggagcaacgtgatggaagatcaagacctgctggagattgggattcttaactccggacaccgtcagcgcatcttgcaggccatacaactactgcctaagatgagacccatcggccacgatgggtaccaccccaccagtgtcgcagaatggctcgatagtatcgagctgggagactacacaaaggcgtttttgatcaacggctacacgtcgatggaccttcttaagaagatatgggaggttgaacttatcaatgttctgaagatcaatctcatcgggcatcggaaaaggatcctggcatccctgggtgaccgcctgcacgacgaccctccacagaaacctcctcggtcaatcacgctgcgctcatctgtgtgtgagatttggaccaaccaaaatgccgggtttccgttcagtgcaattcaccaggtgcataacaccggcgattggggagagccaagtatcaccctccgccctccaaacgaggccaccgcttctacaccggtgcaatattggcaacaccacccggagaaactcatatttcaatcctgcgattacaaggccttctatctaggttccatgttgataaaggaacttcgagggactgagtctacccaggacgcttgcgctaaaatgcgggccaactgccagaaaagcacagaacagatgaaaaaggtgcccaccatcatcctgtctgtgtcatacaaaggggtcaagtttatagatgccaccaataagaacattatcgcagagcacgaaatccgcaacataagctgcgcagcacaggatccagaggacttgtcaactttcgcctacatcacaaaggacctgaaaagtaaccatcactattgccatgtgtttaccgcattcgacgtgaatctcgcatatgaaataatcctcactctgggccaggcgttcgaggttgcttaccagctggcattgcaggccaggaagggtggccattccagcaccctgccagagtcttttgagaataaaccaagcaaacccataccaaagccaagggtgtccatacgcaaaagtgtgcaaattgacccatcagagcagaagactctcgcgaatcttccctggatcgtagagcccgggcaagaggccaagcgcgggattaacaccaagtacgagaccaccattttttag

SEQ ID NO: 108278 - DNA, 1185 bp, Artificial Sequence
  Description of Artificial Sequence: Synthetic coding sequence
atgggacctcgttgccccgtgcagaccgtggggcaatggctggaaagtatcgggctgccccagtacgagaatcacctgatggccaatggatttgataacgtgcagttcatgggcagtaacgtcatggaggatcaggacctgctcgaaatcggtattctaaactctggccaccggcagcgaatactgcaagccatccagctgctccccaaaatgaggcctattgggcatgatggctatcacccaacgtctgtcgctgagtggttagacagcatcgaactaggggactatacaaaagcttttctcattaatggctacacatccatggatctgctgaagaagatttgggaggtagaactgatcaacgttctcaagattaatcttattggacatagaaagaggattctagctagcctgggagatagactgcacgatgatccaccccagaagccaccccgttccattactctgcgtactggcgactggggcgagccgtcgattacccttagaccacccaacgaggccacggcatcaacgccagtccagtactggcaacatcatccagagaagctcattttccagtcgtgtgactataaagccttctatctggggagtatgctcattaaggaactgagagggaccgagtcaactcaggacgcctgtgctaaaatgcgagccaactgccagaagtctactgaacagatgaagaaagtgccgacgattattctcagcgtgtcctataaaggagtgaagttcattgatgctactaacaagaatatcatcgccgaacatgagatccgtaatatatcctgcgcggctcaggatccagaagaccttagcaccttcgcatacatcactaaggacctgaaatctaaccatcattattgccatgtcttcaccgcctttgacgttaacctggcctatgaaattattctgactttagggcaagcattcgaagtggcatatcagctggcactgcaagcccggaagggtggccactctagcacccttcccgaatcttttgaaaacaaaccgtctaagcccattcccaagcctagggtctccatccgtaaaagcgttatcgacccaagtgaacagaaaacgttggccaacctgccgtggatcgtggagcccggacaggaggcaaagcgaggcatcaacacaaagtacgagaccactattttctag

SEQ ID NO: 108279 - DNA, 1254 bp, Artificial Sequence
  Description of Artificial Sequence: Synthetic coding sequence
atgtctactcgctaccatcaagctgcttcagactcctacctggagttgctgaaggaagctactaagagggatctgaacttgagcgacgaagatggcatgacacctaccctgttggctgcctaccatgggaatctggaggcgctggaaattatttgcagtcgtggaggcgatcccgatcgatgtgatatttggggcaacactccgttacattttgcagcttctaacggtcacgcacattgtgtctctttcctcgtcaacttcggggccaacatctttgcattggataacgatctgcaaactcccttagacgccgctgcaagtcgtgagcagaatgagtgcgtagctctccttgacaaggcagccaccgcccagaatattatgaacccaaaaaaggtgacacgactgaaggagcaggctcagaaaaacgctagaagacagataaaagaatgcgagagactgcaggagaagcaccagaataagatggcacacacatactctaaggaagaaagtggtactctcagtagtagtaaaggtactttctcacgctcaagtccatcgaatgcgagcgctcccgggaccttcggatcattgagcaagggcattaaggacacatttaaaattaaatttaagaagaacaaagacacagccgaacaggttggtaaagaaggacgctccggccagcggaacgtgatggaagtatttcgtgaggaagaggaggactcattttccggcgactttaaggagaagctgcagttgagcgctgaggaagatgggtcagtccaccatgagagcatcctgaacagaccagggctgggctctattgtgttccggagaaacaggatttcctctcctgaagacatttccgacagcaaaagggagtttggattcaagttgccttccgagttgctgcagagacagggggctagtgaggccgatgaaggcgctgctgatgaagagggagaggagaatggccttaaagatgatttgccatgggacgatgacgaggtagaatgggaagaagatgtggtcgacgcaacaccactagaagtctttttgctctcacagcacctggaagagttcctgcctatcttcaaaagagaacagattgatttggaagcactcctgctctgctctgacgaagacctacagagtatccagatgcaactcggccctaggaagaaagtgctcaacgctatcaatagacgaaagcaagtgctccaacagccagggcagctggtggatacatcattatag

SEQ ID NO: 108280 - DNA, 7992 bp, Artificial Sequence
  Description of Artificial Sequence: Synthetic coding sequence
atgcccaagggcgggtgccctaaagccccacagcaggaggaattgcctctctcctctgacatggttgagaaacaaacaggaaagaaggataaggacaaagtttccctgactaagacccctaaattggagcggggcgatggcggcaaggaggttcgagagagggcctccaagcgcaagttgcccttcacagccggagcaaacggggaacaaaaggattccgatactgaaaaacagggcccggaaagaaaaagaatcaaaaaggagcccgtgacaagaaaagcaggactgctctttgggatgggtctgagtggtatcagggccggataccctctgtccgagcgccagcaagtggctttgctcatgcagatgacagccgaagagtcggctaactccccagtggatactactcctaagcacccgtctcagtcgaccgtttgtcaaaaaggaacccccaattcagcaagcaaaacaaaagacaaggtcaataagaggaacgaaagaggggagactcgccttcatcgtgcagctatcaggggtgatgcgaggcggataaaagagctgatttctgaaggagctgatgtgaatgtaaaggacttcgccggttggactgcactgcatgaagcatgtaatagagggtattatgacgtcgccaaacagctgctggctgctggagccgaagtgaatacgaagggacttgacgacgatacccctttacacgacgctgccaacaatggccactataaagtagtaaaactgctcctccggtatggagggaatccacagcagtcaaatagaaagggcgaaacccctctgaaggtcgctaatagtcctactatggtgaacttgctcttgggcaaagggacatacacctcgagcgaagagtccagcaccgagtcatctgaggaggaggacgcaccttcgttcgctccctcaagcagcgtcgacggaaacaacactgatagcgagtttgaaaagggactgaaacacaaggccaagaatcccgagccccagaaggcaaccgcaccggtgaaggacgagtatgaattcgatgaggacgacgagcaggacagagtccctcctgttgacgacaaacatctgctaaagaaagattacagaaaggagacgaaatcaaactcgtttatctccattccgaaaatggaggtgaagtcctacactaagaacaatacaatagcacccaagaaggcgagccacagaatcctctctgataccagtgacgaagaagatgcctctgtgacggtgggcactggagagaaactgcgattgagcgctcataccattctgcccggctcgaagacacgtgagccgtcaaacgccaaacagcagaaggagaagaataaagtgaaaaagaagcgcaagaaggaaaccaaaggccgtgaggtgagatttggcaaacggagcgataaattctgtagctctgagagcgagagtgaaagttcggagagtggcgaagatgaccgggattccctcggcagcagcggatgtctgaagggttcgcccctcgttctgaaggatccaagcctcttcagttccctgtccgccagctccacctctagccatgggtcttctgccgcacagaagcagaaccccagtcacactgaccagcataccaaacactggaggaccgataactggaagacaatctcttcgcccgcttggtctgaggttagtagtctgagtgatagtacacgtaccaggctgacctccgagtccgattatagttcggaaggctccagcgtcgaatcgctgaaaccagttcgcaaacgacaagaacacaggaagcgagctagcctgtcagagaagaagtcccctttcttaagtagtgctgagggggcagtccctaaactcgacaaggagggaaaagtggtcaagaagcacaaaaccaagcacaagcacaagaacaaagagaaagggcagtgctccattagtcaggagctcaagcttaaatctttcacctatgagtacgaagactcaaagcagaaatctgataaagctatcttacttgaaaacgatctgtcaacagagaacaaactgaaagtgctgaagcacgaccgggatcactttaaaaaggaggagaaactcagtaagatgaagctcgaggagaaagaatggctcttcaaagatgagaaatccctcaagcgcatcaaagacactaacaaagatatcagtcggagttttcgcgaagagaaagacagatccaacaaagcggagaaggagagatctctcaaagagaagagccctaaagaggagaagcttcgactttacaaggaggagcggaagaaaaagtccaaagatagacctagtaagcttgagaaaaagaacgacctcaaggaggataagatcagtaaggagaaggagaagattttcaaggaagacaaggagaaacttaaaaaagaaaaagtctatagggaagactccgcctttgacgagtactgtaacaaaaatcagtttttggagaatgaggataccaagttctccctgtccgacgatcagcgagacaggtggttctcagacctctccgacagcagtttcgactttaaaggagaggactcttgggattctcccgtgacagactatagggacatgaagtcagacagcgtggccaaactgatcttagagacagttaaagaggattccaaagaaagaagacgcgactcaagggcccgcgagaaacgcgactaccgggaaccgttcttccgcaaaaaggatcgcgactatttggacaagaactccgagaagcgcaaggagcaaactgagaagcataagagtgtgcccgggtatctgagtgaaaaggacaagaaacgcagagagtctgccgaggcgggccgcgatcgaaaggacgcgttagagtcgtgcaaggagaggagagacgggagagcaaagcctgaggaggcccaccgagaagagcttaaagaatgcggatgtgagagtggctttaaagacaagtccgacggcgacttcggcaagggcttagagccgtgggagcggcaccatcccgctcgggaaaaggagaaaaaagacgggcccgacaaagagcgaaaggaaaagaccaagccggaaaggtacaaagagaagtctagtgacaaagataaatccgagaagtccattttagagaaatgtcagaaagataaggagttcgataaatgtttcaaggagaaaaaagatactaaggagaagcacaaggatacgcatgggaaggacaaggagaggaaagctagtcttgatcaagggaaagagaagaaggagaaggcgtttccagggataattagtgaagacttctccgagaagaaggatgacaagaaagggaaggagaagtcgtggtacatcgccgacatatttacagacgaaagtgaggatgatagggactcatgcatggggagtggattcaaaatgggggaggcatctgatctgcccagaacagacggtttgcaagaaaaagaagaaggtcgagaagcctacgcctctgacaggcaccgcaagagttctgacaagcagcaccctgagaggcaaaaagataaagaacccagagaccgccgaaaagaccgtggcgccgcagatgcagggcgcgataaaaaagaaaaggtgtttgaaaaacacaaggagaagaaagacaaggagtccacagagaagtacaaggaccgaaaggacagggcgtccgtggacagcacacaggataaaaagaacaaacagaaactgccagagaaggccgagaagaagcatgcggccgaggacaaagccaagagcaagcacaaagaaaagagtgacaaagagcatagcaaggagaggaagagtagcaggtccgccgacgcagaaaaaagcctgttagagaagttggaggaagaggccttgcacgaatacagggaggattccaatgacaagatctcggaggtctcctcagatagcttcacggaccgggggcaggaaccagggctcaccgcctttttggaggtgtctttcaccgaaccccccggcgacgacaaacctcgcgagtctgcttgtttgcctgagaaactgaaggaaaaggagcgccacaggcattcgagtagttcatcaaaaaagtcacacgacagagagcgcgcgaagaaggagaaggctgaaaagaaagagaagggcgaggactataaggagggtggatctcggaaggatagcggacagtacgagaaggattttctcgaggctgacgcttatggcgtctcttataacatgaaggccgatatagaagacgagttggacaagaccattgaactgtttagcaccgaaaagaaagataagaacgacagtgagagagagccttcaaaaaagattgagaaggaattaaagccatacggttcatcggcgataaacatacttaaagagaagaaaaaaagggagaagcaccgtgaaaaatggagagacgagaaggaaagacaccgtgacaggcatgcagacggcctcctaaggcaccatagggacgaactcctcaggcaccacagagacgaacagaaacccgccactcgcgacaaagattcacccccccgagtgctgaaggacaaaagtagagacgagggcccccgcctaggggatgccaaactgaaggaaaagttcaaggatggagcagagaaggagaagggagaccccgtcaagatgagcaatggaaatgataaagtggctccaagtaaagaccctggaaagaaagacgcgaggccacgcgagaagctcctcggcgacggtgaccttatgatgacttcgtttgagcggatgctgagccagaaagatttggagatcgaagaacgccacaagagacacaaagagagaatgaaacagatggaaaagcttcggcacagaagcggggatcccaaactgaaggaaaaagctaagccagcagatgatggccggaagaagggactggatattccggctaaaaaaccccccggtctcgaccctccctttaaagataagaaactgaaagagagcactcccataccccccgctgctgaaaataagctgcatcccgcatccggagcagattctaaggattggctagcaggaccacacatgaaagaagtgctcccagccagtcccagacctgatcagagtaggcctactggggtccctacgccaacctccgtcctgtcatgcccgtcatatgaagaggtgatgcatacaccacggaccccttcttgcagtgccgacgactacgccgatctcgtgttcgactgcgcagacagtcagcatagcactcccgtgccaaccgcacccactagtgcttgttcgccatccttctttgaccggttttccgtggcatctagcggtctctctgagaatgcgagccaggctcccgcacgcccactgtccacaaatctctataggagcgtgagcgtggatatccgcagaactcccgaggaggagttctccgtcggcgacaagctttttcggcagcaatcggtgcctgcagcttcctcctacgacagtcccatgcccccaagcatggaggaccgtgcccctctgccaccggttccagcagaaaaatttgcttgtcttagcccgggctactatagcccggattatgggctcccaagtcctaaggtggacgccctccactgtccccctgccgccgttgtgacggtgaccccctcaccggagggtgtattttctagcctgcaggctaagccatctcccagccctagagctgagctcttggtcccgtcacttgaaggcgccctcccccccgatttagacacctctgaggatcaacaagcaaccgcagctattatccctccagagccaagttatctcgagcctttggatgagggtcctttttctgctgtgatcactgaagagcctgtcgagtgggcccaccccagtgagcaagctttagctagcagcctgattggtggcacctcagagaacccagtctcctggccggtgggctcagacttactcctgaagagtccccagcgatttcctgagtctcccaagaggttttgccctgcagatcctcttcactccgcggctccagggccgttctcagctagcgaagcgccctacccagcccctcctgcgtcgcctgctccttacgctctacctgtggctgagcccggccttgaagacgttaaggacggtgtcgatgctgtgccggcggcaatcagcacctcagaggccgccccatatgccccgccttccgggttggaatctttcttctccaattgtaagtcgttacccgaagctccactggacgtggccccggagccggcttgcgtggctgctgtggcccaggtagaggcactagggcctctcgaaaattcgtttctcgatggaagtagaggactgtcacatctaggccaggtggaacccgttccttgggccgatgctttcgccggccctgaagatgacctggacttgggtcccttcagcctccccgaactgcccctgcagactaaagatgctgcagacggagaagcagagccagtcgaggagtcattggcgccccccgaggagatgcctcctggcgccccaggcgtgattaacggcggagacgtgagtacagtcgtggccgaggaaccaccggctctgcctcctgaccaagcatccaccagactacccgccgagctcgagcctgagccctctggggagcctaagcttgatgtggccctagaagccgcggtcgaggccgagacggtccccgaggaacgcgcgagaggtgatcctgattcaagcgtcgagcctgccccggttccaccagaacagcggccattaggttccggggaccaaggtgctgaggctgagggtccccctgctgcctccttgtgtgcccctgatggccctgctcccaataccgtggcacaggcccaggcagccgacggagcgggccccgaggatgacacagaagcctccagggccgcagcacccgctgaaggcccccctggtggaatacagcccgaggctgctgagcctaaacccaccgccgaggcgccaaaggcacctcgcgtcgaagaaattccacagaggatgacccgaaacagagctcaaatgctggcaaatcagtcaaagcagggtccccctccgagtgagaaggaatgcgctccaactccagcccctgtgaccagagctaaggctaggggcagcgaagatgacgatgcacaggcacagcaccctcgcaagaggaggtttcagcggagtactcaacaacttcaacagcagttgaacacctcgacgcagcagacccgcgaggtcatccaacagacacttgccgcgatcgtggacgccataaagctggatgctattgagccctatcactcagacagggccaacccctactttgaatacctgcagatccgcaagaaaatagaggaaaagcggaaaatcctctgctgtattaccccacaagcgccccagtgctacgcagagtatgttacatacaccggctcttacctgctggacggaaaacccttatctaaactccacatacctgtgattgccccacctcccagcctggcagaacccttgaaagagctctttaggcagcaggaagcagtgcgcggaaagctgaggctccagcattcaatcgagagggagaaacttattgtgtcatgtgagcaagaaatcttacgggttcactgccgagctgctaggaccatcgctaaccaagccgtccctttttcagcatgtaccatgttgcttgactctgaggtctacaatatgcctctggagtcacagggggacgaaaacaagtccgtgagggaccgctttaacgctagacaattcattagctggctccaggatgttgacgacaaatacgataggatgaagacatgtcttctgatgagacaacaacacgaagcagcagcgctgaatgcagttcaacggatggaatggcagctgaaggttcaagaactcgaccccgcggggcataagtctctgtgcgtgaacgaggtcccttcattttatgtccccatggtagatgttaacgacgattttgtgttgttacccgcttag

SEQ ID NO: 108281 - DNA, 1836 bp, Artificial Sequence
  Description of Artificial Sequence: Synthetic coding sequence
agcattcccaagatggaggtcaagagctacacaaagaacaacaccattgccccgaagaaggcctcacatcggattctaagtgacacatctgatgaagaagatgcgtccgtgacggtgggtacgggagagaagctgagactatccgcccacaccattttaccaggctctaagacgcgtgaaccgtcaaacgcaaaacagcagaaagaaaagaataaggtgaaaaaaaagcgcaaaaaggaaacaaaggggagagaagtgcggtttggaaagcgatccgacaaattctgttcctcagagtccgagagcgaatctagtgagtcaggtgaggatgaccgagattctctcggctcatctgggtgcttaaagggctctcctttggtcctaaaggaccccagcctgttttcttccttatcagccagctccacctcaagtcatggctctagcgcagcacagaagcagaacccctcccacacagaccagcacacaaagcactggcggacggataattggaagactatatcaagccctgcttggagtgaagttagctccctctccgatagtaccaggacccggctgacctcagagtcagactacagctccgaaggatcttcagtggagagcttgaagcccgttcggaaacggcaggaacacaggaagagggccagtctgtccgagaagaaatctcccttcttgtctagtgcggagggggccgtccctaaactcgacaaagaggggaaagtagtgaagaaacacaaaaccaaacacaaacataagaacaaagaaaaaggtcagtgctcaatatcgcaggaactaaagctcaaaagcttcacgtatgaatatgaggattctaagcagaaatccgataaggccatcctgctggaaaatgacctgagtacagaaaataagcttaaggtgctgaagcacgaccgtgatcactttaagaaagaggaaaagctcagcaaaatgaagctggaggagaaggaatggttgtttaaggacgagaaaagccttaaacgtattaaggacacaaataaagatatttctcgcagctttagagaagagaaagataggtccaataaagccgagaaggagcgctccctcaaagaaaagagcccgaaagaggagaaactgagactttataaggaggaaaggaaaaaaaaatctaaggaccgtccatctaaactggagaagaagaatgaccttaaggaggacaagatttccaaggaaaaggagaaaatctttaaggaagacaaggaaaagttaaagaaggaaaaagtgtatagggaagatagcgcttttgatgaatactgtaataagaatcagttcctggaaaacgaagatactaaattctcactctcggacgaccagcgcgaccgctggtttagtgatctttcagactcctctttcgatttcaagggggaggattcctgggatagccctgtgacagactacagagacatgaaatccgattcagtggccaagttgattctggaaaccgtgaaggaggactccaaagagcggagaagggatagccgcgctcgcgaaaaaagagattaccgtgaacccttttttcgcaaaaaggatagggactacctcgataaaaactcagagaagcggaaggagcagaccgagaagcacaagagcgttcccggctacctgtctgagaaacatgagcggagaaggcggagaatggctccaattcggaagggtcggcgccgtcagaaccagaaggacacaaagagaaatccggtcaccaggacgaaggtgaggaaccagtcctggaagaatgttagacgaaccaagaacttgatcaacgttcttaagcgtaaaaagtag

SEQ ID NO: 108282 - DNA, 7992 bp, Artificial Sequence
  Description of Artificial Sequence: Synthetic coding sequence
atgcccaaaggcgggtgccctaaggcaccacagcaagaagaactccctctgagcagcgatatggttgagaaacagaccggcaaaaaagataaggacaaagtatctcttacaaaaacgcctaaactcgagaggggagatggaggaaaggaggtacgcgagagggcttccaagcgcaagttgccattcacagctggggcaaatggggaacaaaaagacagcgacacagagaagcaggggcctgagcgcaagaggataaagaaggaacctgtcacgcgcaaagctgggctgttatttggaatggggctttcaggcattcgcgcgggatacccccttagcgaaagacagcaggtggccttgctgatgcaaatgacagctgaggagagcgccaacagccccgtggatacaacgccgaaacatccttctcaaagcaccgtgtgccaaaaagggacgcctaatagcgcttcgaaaaccaaagataaggtcaataaacggaacgaacggggcgagacacgactgcacagggctgccatcagaggagacgctaggcgcattaaagaactgatctccgaaggagccgacgtcaatgtcaaggacttcgccggttggaccgcgctccatgaagcctgcaatcgtgggtattacgatgttgctaaacagctgctcgctgccggtgctgaggtgaataccaaagggctagacgatgacacgccactccatgacgcggctaacaatgggcactacaaagtagtcaagctgctgctgaggtacggcggaaaccctcagcagtctaaccgcaaaggtgaaactcccctgaaggttgccaacagcccaactatggtcaacctcctgcttggaaaaggaacatacacttcctccgaagaatcctcaactgaaagtagcgaagaggaagacgccccgtcattcgcaccctctagctccgtcgatggtaataatacggactctgaatttgaaaagggattaaagcacaaggcgaagaaccccgagccccagaaggctacagcacccgtgaaggatgaatatgagttcgacgaggatgatgaacaggaccgggtcccaccggttgacgacaagcacttgctcaagaaggattacagaaaagaaacaaagtccaatagttttatctctatccctaagatggaagttaagtcatacactaaaaataacacaattgctccaaaaaaggcatctcataggattttgtccgatacgagcgatgaggaggatgcttccgttacggtggggacgggcgaaaaactgaggctgagtgcccacactattctgccaggatcaaaaacaagggagccttcaaatgccaagcagcaaaaagaaaaaaacaaagtgaagaagaagcggaaaaaagaaactaagggccgggaagtgcgttttggaaagagatccgataaattttgttcttctgagtccgagtcggagtccagtgaaagtggcgaggacgatcgggattccctgggctccagcggatgtctgaagggaagcccactggtgctcaaggacccctctctgttctcctcgctcagtgcgagctctactagctcccacgggtccagcgctgctcaaaaacagaatccttcacacactgatcagcataccaagcattggaggacggacaactggaagacgatttccagccccgcatggagtgaggtttccagcctcagcgactctacccgcacaagactgacatctgagtctgactactcatcagagggttctagtgttgagtcattgaaacccgtccgtaaacggcaggagcaccggaagcgcgcctctcttagcgaaaagaagagcccattcctgtccagcgctgaaggggccgtaccaaaactcgataaggagggcaaggtggtcaaaaaacacaaaacgaaacataagcataaaaacaaggagaaaggccagtgctccatttcacaggagctgaagcttaaaagtttcacctacgaatacgaggacagtaagcagaaaagcgataaagccatcttattagaaaacgatctctcaacagagaacaagcttaaggtgttgaagcacgatagagaccacttcaaaaaggaggagaagctctcgaagatgaagttggaggagaaagagtggctgttcaaggatgagaagagcctgaagcgcatcaaggacacaaacaaggatatttcacgttccttcagagaagagaaggaccgtagtaataaggccgaaaaagaacgttcactcaaggagaaatcccccaaagaggagaagctaagactgtataaagaggagaggaagaagaaaagcaaagaccgccccagcaagcttgagaagaagaatgaccttaaagaagacaagattagcaaggagaaggagaaaatctttaaggaggacaaggagaagcttaagaaggaaaaagtatacagagaggactccgcattcgatgaatactgtaataagaaccagtttttggaaaatgaggacacaaaattctcactgagcgacgaccagcgggaccggtggttcagcgacttgtcagactctagttttgatttcaagggcgaggactcatgggactctcccgttaccgattatagagacatgaagtctgacagcgtcgcaaagctcatccttgaaacagtgaaggaggattccaaggaaaggcggagagactctcgtgcccgcgaaaaaagggattaccgagagccattctttcggaaaaaggacagggattacctagacaagaatagtgagaaaaggaaggaacagacagaaaaacataaatccgttccaggttatttatctgagaaggataagaaacgcagggaatccgccgaggctggtcgagatcgcaaggatgctctcgagagctgtaaagagcggcgagacggacgtgccaaacctgaagaagcccatcgagaggagttgaaagagtgtggctgtgagagtgggttcaaggataagtccgacggtgatttcggtaaggggctggaaccctgggaacgccaccatccagcccgggaaaaagagaagaaggatggccctgataaagaacgaaaggagaaaacaaaacctgagagatataaggaaaaatcatctgataaggacaagtccgaaaagtctattctggagaaatgccagaaagacaaagagtttgacaaatgtttcaaggaaaaaaaggacacaaaagagaaacataaagacactcacggaaaagataaggagcggaaagcctccctggatcaggggaaagagaaaaaagaaaaagcatttcctggaattatatccgaagacttctctgagaaaaaggatgacaagaagggtaaggagaaatcctggtatatcgctgacatcttcactgatgagtctgaagatgaccgggactcgtgcatggggtcggggttcaaaatgggtgaggccagtgacctgcccaggacagatgggctgcaggaaaaggaagagggccgggaggcctatgcctccgatcgccatcggaagagttctgataagcagcacccagaaaggcagaaagacaaggaacctcgggataggaggaaagaccgaggcgccgccgatgcgggtagggacaaaaaggaaaaggtatttgaaaagcacaaggagaagaaggataaagagagcactgaaaaatataaagatcgaaaggacagggcttcagtggatagcacacaagataaaaaaaacaagcagaagctgccagagaaagcggagaagaaacatgcagcagaggacaaagccaaatccaagcataaggaaaaatccgataaggagcactccaaggaacggaagtcatctaggagcgccgatgccgaaaagtctctgctcgaaaaactggaagaggaggccctgcatgagtatcgggaggacagcaatgacaagatcagcgaagtcagttccgattcctttacagaccgtggccaggagcccgggttgaccgcctttttggaagtaagtttcacggagccaccaggcgacgacaaaccgcgagaaagtgcctgcctgcctgagaaactaaaggagaaggaacgacatagacactcgtcttcttcgtcgaagaagtcccacgaccgagagagagctaagaaggagaaagcagagaagaaagaaaagggggaggactacaaagaggggggctcccgcaaagattcaggacagtacgagaaagattttctggaggccgacgcatatggcgtgtcatataacatgaaagctgacatcgaggatgaacttgacaaaactatcgagctgttcagcacagaaaagaaggataagaatgacagtgaacgtgaaccgtctaaaaaaatcgagaaggagctcaagccctacggttcttccgccattaacatactaaaagaaaagaaaaagagagagaaacatagagaaaagtggcgcgacgaaaaggagcggcatagggatagacacgcggatggtctgctgcgtcatcaccgagatgaactactccgtcatcacagggacgaacagaaaccggcgaccagggataaagactctcctccccgggttctgaaggataagtctcgcgatgaagggccgaggctcggggatgcaaagctcaaggaaaaattcaaagatggtgccgaaaaagaaaaaggcgatcctgtgaaaatgtcaaacggcaatgataaagtcgcaccaagcaaagaccccggcaagaaagacgcaagaccccgggagaaactactaggagacggggatctcatgatgacttccttcgagcggatgttaagccaaaaggacctggaaatagaggagagacataaacggcataaggaacggatgaaacagatggaaaaactgcgccaccgaagtggggatccaaagctgaaggagaaagccaagccagcagatgatggtcgaaagaaagggttagacatcccagcaaagaagcccccgggcctagacccccctttcaaggacaaaaaattaaaagagagcactcctatcccccccgccgctgagaacaagctgcaccccgcctccggtgctgattcgaaggattggttagctggtcctcacatgaaggaggtgctgccagcttccccccgtccagatcagtctagacctactggcgtgcctactcctacttcagtgctctcttgtccgtcgtatgaagaagtgatgcacacacctcgcacgccctcatgcagcgcagacgactatgctgacctcgtgtttgattgtgctgacagtcagcatagcaccccagtgcctactgcgccaacttccgcctgttctcccagtttctttgatcgcttttcagttgcttctagtgggctttctgaaaatgcaagccaggcccctgcacggcccctgagcaccaacctctatcgttctgtcagcgttgatattaggaggacacccgaagaggaattctccgttggagacaagctgtttcggcagcaaagcgtaccagctgcctcctcttacgattccccaatgcctccaagtatggaggatcgggcacccttacctccagtccccgctgagaagtttgcttgcctctctcctggttattattctccagactatgggttgcctagtcccaaggtggacgcgctccactgccctcctgcagccgtggtgacagtgacacccagccctgagggtgtattcagcagcctgcaggcgaagccaagccctagcccacgagcagaactgctcgtcccatcgttggaaggggcacttcctccggacctcgacacctctgaagatcagcaggccacagccgcaattatccctcccgaaccaagttacctagaaccgctggacgagggacctttcagcgcagtgataacagaggaaccagtagaatgggcccacccatccgagcaggctctggcttcttccttaatcgggggaacctccgagaacccggtttcctggccagttggaagtgatctcctgctcaagagcccacagcgcttccctgagtcaccaaagcggttctgccccgcagacccactgcatagcgcagctcctgggccattctcagctagcgaagctccctatccagccccccctgctagccccgctccctatgctctgcctgtcgctgaacccgggctcgaggacgtgaaagatggcgtggatgctgtgccggcagctataagtacgagtgaagccgcaccttacgcccccccgagcggcctggagagctttttttctaactgcaaaagcttgccggaagctcctctcgacgtcgcaccggagccagcctgtgtggcggcggttgcccaggttgaggcgctcgggccgttggagaacagctttctcgacggaagccgcggtctctcacatttaggtcaagtagagcctgtcccttgggcggacgccttcgccggccccgaggacgacctcgacctcgggccatttagccttcccgagctgccactccagacaaaagacgcagccgatggagaggctgagcccgtcgaagaaagcttagccccacctgaagagatgccccctggggctccaggcgtgatcaatggaggcgatgtatctactgtggttgccgaggagcctccagccttgcctcccgaccaggcctccactaggctgcccgcagaattggagcccgaaccatcaggggagcccaaactggatgttgctctggaagccgccgtggaggccgagacagtgccggaggaaagggcccgcggagatccggactcatccgtggagcccgcacctgtgcctcctgagcagagacctctgggatcgggagatcagggcgcagaagccgagggccctcccgccgcttcgctgtgtgctccagacggaccagcaccgaacacagtggcgcaagctcaggccgccgatggtgccgggcccgaagacgataccgaagctagccgggcagccgcacctgccgaggggcctcccggaggcatccagccagaagccgctgaacctaagccaactgccgaggcacctaaagcacctcgggtggaggaaattcctcaacgtatgacacgcaatcgggcgcagatgctggctaaccaaagcaaacagggcccgccgccctccgaaaaagaatgtgctccaacaccggccccagtcacgagagcaaaggcccgaggcagcgaagacgacgatgcccaagcccagcaccccagaaaacgcaggttccagagaagcactcagcagctccagcaacagttgaatacttctacccaacagacccgggaggtgatccagcaaactcttgcagctatcgtcgacgctattaagctggatgcgattgagccctatcatagtgacagagctaacccctatttcgagtacttgcaaataaggaaaaagatcgaagagaaacgaaaaatcctctgctgtatcacaccacaagcaccgcagtgctacgcagagtacgtgacctataccgggtcatatttactcgacggcaagcctctctcaaagctccacatccccgtgatcgcaccccctccttccctagccgaaccactgaaagaactgttccgccagcaagaagccgtgaggggtaaactccgtttgcagcatagtatagagagggaaaaactcatcgtgtcttgtgagcaggaaatccttagggtgcattgccgagccgccaggacaattgcaaaccaggccgtccccttcagtgcctgtacaatgctgctggactccgaggtgtacaacatgccactagaaagccagggtgacgagaataagtcagtcagagacaggttcaatgcccgccagtttatatcctggttgcaggatgtggacgataagtatgatcggatgaaaacatgcctgctgatgcggcagcagcatgaggcggccgccctgaatgcggtacaacgaatggaatggcaactaaaggtgcaagaactggaccctgccgggcataaatccctctgcgttaatgaagtgcccagcttctacgttccaatggtggacgtaaatgatgatttcgttctgttgcctgcctag

SEQ ID NO: 108283 - DNA, 1317 bp, Artificial Sequence
  Description of Artificial Sequence: Synthetic coding sequence
agcgcgggccgagtgaatgaagacagagtccggagccggactatgcccaagggcgggtgtccaaaggccccccagcaggaggagttgcctctaagtagtgatatggtggagaagcaaactgggaagaaggataaggacaaggtttcattgactaagacccctaaactcgagcggggggacgggggcaaggaggtaagggagagagcctccaagcgaaaactgccctttaccgccggagcaaatggagagcagaaagattcagacacggagaagcagggccctgagcgaaagcggatcaagaaagaaccagtgacacggaaggcgggcttgctgtttggtatgggactctccggcatccgcgcaggctatcccctgtccgaacggcaacaggtggccctgttgatgcagatgactgcagaggagtccgcaaattctcccgttgatacaactccaaaacatccatcccaaagcacagtgtgtcagaagggaacacctaacagcgcttccaaaaccaaagataaggtgaataaacgcaatgaaagaggcgaaactcggctccatcgggctgcaatccgaggtgacgccagacggattaaggagctgatttctgagggagctgatgtaaacgtgaaggacttcgccggctggacagctctccacgaagcgtgcaatcgcggttattacgacgtcgctaagcagctgctggccgcaggggctgaagtcaatacaaagggtctggatgacgacacccctctccatgacgctgcgaacaacggccattacaaagtcgttaagctccttcttcgatacggcggcaaccctcagcagtccaatcgcaaaggcgaaacaccactgaaagtagctaattccccaaccatggttaacctgctactaggaaagggaacctacacctcatccgaggagtcgtcaaccgagagcagcgaagaggaagatgcgcctagctttgcaccatcctcttccgtcgatggaaacaatacagacagcgaattcgaaaagggactgaaacacaaggcaaagaaccccgagccgcagaaggcaaccgccccagttaaggatgaatacgaatttgacgaggatgatgagcaagacagggtcccgccggtggatgacaagcacctgcttaagaaagactatcgaaaagaaactaagagcaacagcttcatcagcattcccaaaatggagaaggtgactttgaagatcacaagactgcaccaacggaagaggcccattgttagctgccaaacccgcaggacaagacggaccagagtctccccctgggggcaggagcggtcatag

SEQ ID NO: 108284 - DNA, 6189 bp, Artificial Sequence
  Description of Artificial Sequence: Synthetic coding sequence
atgcccaaaagcggctttacaaagccgatccaaagcgagaattcagacagcgattcaaatatggtggaaaagccatacgggagaaaaagcaaggataaaatcgcttcctatagcaaaacccccaaaatcgaaagaagcgacgtctccaaagaaatgaaggagaagtcctcaatgaaaagaaaactgccgttcactatctccccttctcgtaacgaggagagggactcggataccgattcagacccaggacacaccagcgagaactggggggagagactgatcagttcctatcggacctattctgagaaggagggacccgaaaagaagaagactaaaaaggaggctggcaataagaaaagcacgcccgtgtcaattctgttcggatacccgctttcggaacggaaacagatggctctgttaatgcaaatgaccgcccgcgacaactccccagacagcacccccaaccacccttcacagaccacaccagcccagaagaagacacctagctcaagctcccgccagaaggataaggtcaacaaaagaaacgaaaggggggagacaccccttcatatggcagcaataaggggtgacgtcaaacaggttaaggagcttattagcctgggcgccaacgtgaatgttaaagattttgccgggtggactcccctgcatgaagcttgcaatgtgggttactatgacgtggcgaaaatcctgattgcagctggtgctgacgtgaatacccagggattggacgacgatactccgttgcatgactctgccagctcaggccatcgcgatattgtgaaattgctgttacggcacggtggaaaccctttccaagcgaataagcatggggagcgccctgttgacgtggccgaaacagaggaattggaactgctactgaagagagaggtcccactgagtgatgatgatgagtcgtacacagattcggaggaggcccagagtgtcaatccgtctagtgtggacgaaaacatcgacagtgagaccgaaaaggactcgttaatctgcgagagcaagcagattctgccttccaagactcccctgcctagcgctctagatgagtacgagttcaaggatgatgacgacgaggagatcaataaaatgatcgatgacagacacattctgcgtaaagagcagcgcaaggagaatgaacccgaagccgaaaagacccatctgttcgcgaagcaagagaaagctttctaccccaaatcttttaaatccaaaaagcagaagccgagcagagtgctgtattcgtccacagaatcatctgatgaggaggctctccaaaataagaagataagtacatcctgctctgtgatccccgaaacgtcgaactccgatatgcagacaaaaaaagagtacgtggtgtctggagagcataaacaaaaaggtaaagtgaaaagaaaattaaaaaatcagaacaagaacaaagaaaaccaggaattgaaacaggaaaaggaaggcaaggagaataccaggatcactaatctcacagtgaataccggcctggattgcagtgaaaagacccgtgaggaggggaatttcagaaagtctttttcacccaaggatgacacatcacttcacctcttccacatttccacaggtaaatcccccaagcactcttgcggcctgtccgagaagcagagcacccctctgaaacaagaacataccaagacgtgtctctctcccgggtccagcgagatgtccttgcaacccgatcttgtgagatacgataatactgaaagtgaatttctccctgaatcttcttctgttaaatcttgtaaacacaaagagaagtcaaaacaccagaaggacttccacttggagttcggagagaagagcaacgccaagatcaaggacgaagaccatagcccaactttcgagaacagcgattgcactcttaagaagatggacaaggaggggaagaccctcaagaaacacaaattaaagcataaagaaagagagaaggaaaaacataagaaggagattgagggggaaaaggaaaagtacaagaccaaggactctgcgaaggagctccagagatccgtggagttcgaccgagagttctggaaggagaattttttcaaatctgatgagaccgaggacttattcctcaacatggaacacgagagcctgacactggagaaaaaatcgaagctagaaaaaaatatcaaagacgacaagagcacaaaggaaaagcacgtgagcaaagaaagaaacttcaaagaggagagagataaaataaaaaaagaaagcgaaaaaagctttcgcgaggaaaaaatcaaagatctcaaggaagaaagagaaaatattcctacggacaaagactcagagttcaccagcctgggtatgtcagcaatcgaagaatccattgggctgcacctcgtagaaaaagagatagatatcgaaaaacaggagaaacacattaaggaaagcaaagaaaagcctgagaaacgaagccagattaaggagaaggacattgaaaagatggagcgcaagaccttcgagaaagagaagaaaatcaaacacgaacataagtccgagaaagacaagttggatctgtctgaatgtgtcgacaagatcaaggagaaggacaagctgtactctcaccacacagaaaagtgccacaaggaaggggagaagtctaagaatacggctgcaatcaagaaaactgacgaccgagagaagtcaagggaaaaaatggacagaaaacacgataaagaaaagcccgaaaaggaacgacatttagcagagtccaaagaaaagcacctgatggaaaagaaaaataaacaatccgacaatagcgagtactccaagagcgaaaaaggtaagaacaaggagaaagacagggaacttgataagaaagagaagtcgcgagacaaggaatccatcaacatcaccaacagtaagcacatccaagaggagaagaagtcttcaatcgtcgatggcaacaaggcccagcacgagaagcccttgtctctgaaggaaaaaacaaaggatgaacccctgaaaacccccgacgggaaggagaaggacaaaaaagataaggacatagatcgctacaaagaacgggataagcacaaggacaaaatccagatcaactccctgctcaagctgaagagcgaggctgataagcccaagcccaagtcaagtcctgcaagcaaggatacgcgccctaaggagaaacgcctggtgaatgacgaccttatgcagaccagcttcgagagaatgctgagcctaaaggacctggagatcgaacagtggcacaaaaagcacaaggagaaaattaagcagaaagaaaaagagaggctcaggaaccggaattgcttggaattgaaaattaaggataaagagaagacaaaacacacacccacagagtcaaaaaataaggagctcactagaagcaaatcaagcgaagtgaccgacgcatatacgaaggaaaaacagcctaaggacgcagtctcaaatcgttcccagtcggtcgacacgaaaaacgtgatgacattaggcaagtcatctttcgtgtcagataactcccttaataggtccccacggtccgaaaatgagaagccagggttgtcatcccgttccgtctctatgatctctgtagcctcatcagaagactcatgccacacaactgtcaccactccgcggccccccgtggaatacgattcagatttcatgcttgagtcatctgaatcccaaatgtcatttagccagtctccattcctgtccattgccaagagtccagctttgcacgagagagagctagactccttggcggacttgcccgaaaggataaaacctccgtacgccaatcggctgagcacgtcacacttgcgttcatccagcgtcgaagacgtcaagctaatcatcagtgaaggccggcccaccatcgaggtgcggcgttgcagcatgccttcagtgatctgcgaacacaccaagcaattccaaactatcagtgaagagtccaaccagggttccttactgaccgtgcccggggacactagcccgtctcccaagccagaggtgttctctaacgtcccggaacgtgacctttcaaacgtctccaacatccacagctcatttgccaccagcccaacaggcgccagcaattctaaatacgtatcggcagatcgtaacctgatcaagaacacagcccccgttaatacagtgatggacagtcccgtgcatctggagccttcatctcaagtaggggttatacagaataagtcgtgggagatgcccgtggatcgccttgaaaccctcagtacgcgggactttatctgccctaatagcaacattccggaccaggaaagcagtctccagagtttctgtaactccgagaacaaagtgctgaaggagaatgccgactttctttcccttcggcagacagagttaccaggaaatagttgcgcccaagaccccgcgagcttcatgccaccacaacaaccatgttcattccctagtcagtcactaagcgacgcagaaagcatctccaagcacatgtcgttgtcttatgtcgccaatcaggaacctggaattctgcagcagaagaacgccgtccagattataagcagtgccctcgatactgacaatgaaagcacaaaagatacagagaatacattcgtgctgggcgatgtgcagaagacagacgcgttcgttccagtgtatagcgacagcactattcaagaggcctcccctaattttgagaaagcctacacgctgccagtcttaccctcagaaaaggacttcaacgggtccgacgcatccactcagttgaacacccactatgcattctccaagctgacttataaatcttcctccggccacgaggtcgaaaactcgaccactgacactcaggtgatttctcacgagaaggagaataagctggagtctctcgtccttactcacctgtcaaggtgtgactccgacctgtgcgagatgaatgcaggaatgcccaagggtaacctgaacgaacaggatccaaaacactgtcctgagtcagaaaaatgcctgctgtccattgaagacgaggagagccaacaatcgatcctatcttcactggagaatcacagtcaacagtccacccaacccgagatgcacaagtacggacaactggtgaaagttgaactcgaggaaaacgccgaggatgataaaaccgaaaaccagatcccccagaggatgaccagaaacaaagctaatacaatggccaatcaatctaaacagattttggcttcctgtaccctcttgagtgagaaggacagtgagtcctcctctccccgcggcagaatccgtcttactgaggatgatgatcctcagatccaccacccccggaagcgaaaggtgagtagggtgccccaacccgtgcaggtttcgccaagcctcttacaggctaaagaaaagacccagcagagccttgccgcaattgtggattccctgaagcttgacgagatccaaccttactctagcgaaagagccaacccatacttcgaatacctgcatatccgtaaaaaaatagaagaaaaaaggaaacttctctgttctgtgattcctcaggcaccacagtactacgacgagtatgttaccttcaatggttcatatctgttggacgggaatccactcagcaagatttgcattcctaccataaccccacctccgtcactatctgaccctttaaaagaacttttccggcagcaggaagtggtcaggatgaaattgcggctccagcactcaatcgaaagagagaagctgatcgtcagcaatgaacaggaggtgttacgcgtccactaccgggctgccagaactcttgctaaccagaccctgccatttagtgcgtgtactgtgttgctcgatgccgaggtatataacgtgccactggattctcaaagcgacgattctaaaactagcgtgcgagaccggttcaatgcacggcagtttatgagttggttgcaggacgtagacgacaaattcgacaaactcaagacttgtctgctaatgcggcaacaacacgaagcagctgccctgaacgccgtgcaacggctggagtggcagttgaagctgcaagagctggaccctgccacgtataagagcatctcaatatatgagatccaagaattctatgtgcctttggtggatgtcaacgatgacttcgagctgaccccgatatag

SEQ ID NO: 108285 - DNA, 1317 bp, Artificial Sequence
  Description of Artificial Sequence: Synthetic coding sequence
atggtaaatgtacctgaactcctactcggacagtcaccgagtcggaacgacaccaagattatcaattcagaagaagcacagagcgtgaacccgagttcagtcgacgaaaacatcgattccgaaactgagaaggattctttgatatgtgaaagcaaacagatcctgcctagcaaaacgccgctcccttccgccctggatgagtatgaattcaaagatgacgatgacgaagaaatcaataagatgatcgatgatcgacacattctgagaaaggagcaaagaaaagaaaatgagcctgaggctgaaaagactcatttatttgctaagcaggaaaaagccttctaccctaagtcctttaagtccaagaaacagaaaccctcccgtgttctttattcgtctacggaaagtagcgacgaggaggcactgcagaacaaaaaaatttccacttcttgctccgttattcctgaaacaagcaactcagacatgcagacaaagaaagaatacgtggtgtccggagagcataagcagaagggtaaagtgaagagaaaactaaagaaccagaataagaataaagaaaaccaggaactgaaacaggagaaggagggaaaggagaatacacgcattacaaacttaacagtgaatactgggctcgactgttcagagaaaactcgagaagaaggcaactttcgaaagtcattctcccctaaggatgacacaagccttcatctcttccatatttcaaccggaaagtcccctaagcactcgtgcggccttagcgagaagcagagcacccctctgaagcaggaacacacaaaaacgtgtttatctccaggctcttctgaaatgtcactccagcctgaccttgtccgctacgacaacaccgaatctgaatttttacccgaatcctcctcagtgaagagctgtaagcataaggaaaagagcaagcatcagaaagacttccaccttgagttcggagaaaaatctaatgcgaaaatcaaagacgaagaccactctccgaccttcgaaaatagtgattgtactctaaagaagatggacaaagaaggcaagacacttaaaaagcacaagcttaaacataaagaacgcgaaaaagaaaagcataaaaaggagatcgaaggtgagaaggagaagtataagactaaggatagcgccaaggagctgcaacgatctgtcgaatttgatcgggagttctggaaagagaattttttcaagagcgacgaaaccgaggatctcttcctcaatatggagcatgaatccttaaccctggagaaaattaagattggtaaaaagcatcagcggtag

SEQ ID NO: 108286 - DNA, 6120 bp, Artificial Sequence
  Description of Artificial Sequence: Synthetic coding sequence
atgcctaaaagcggatttacaaagccaattcaatctgagaatagcgactcggactctaacatggtggagaagccctatggcagaaaatcaaaggacaaaattgcatcctattctaagacacctaaaatcgaaaggtccgacgtgagcaaggaaatgaaggagaaaagttcaatgaagcgcaaacttccatttacaatctcgccttcaagaaacgaagagcgggacagcgacaccgaaaaggaaggacccgagaagaaaaagactaaaaaagaagctggcaataaaaaaagcacaccagtgagtatcttattcggctaccctttatctgaacgcaaacagatggccctccttatgcaaatgaccgcgagggataactccccggatagtaccccgaatcatccctctcagacaacccccgcgcagaagaaaacgccttcttcatcaagcagacagaaagacaaggtgaacaaaaggaatgaacggggagaaacccctctgcacatggcagctattaggggcgatgtcaagcaggtcaaagaactgataagtttgggcgctaatgtgaacgtgaaggattttgctgggtggacccctttgcatgaagcctgtaacgtcggatattatgacgtggctaagattttgatcgccgctggcgccgacgtcaatacccagggtctcgacgacgatacccccctccatgactctgccagctcggggcatcgagacattgtgaagctgttgttgaggcatgggggaaatccctttcaagctaataagcatggtgagaggcctgtcgacgtcgctgagaccgaagaactggagctcctgttaaaaagagaagtgccactgagcgacgacgatgagtcgtatactgattctgaggaggctcagtccgtgaatccttctagcgtggatgaaaatattgactctgaaaccgaaaaggactcccttatctgtgagagcaaacagatcctgccctctaaaacaccactcccaagcgcactcgacgaatatgagttcaaggatgacgatgatgaagaaattaataagatgatcgacgacagacatatccttagaaaagagcaacggaaggaaaacgaaccagaggcagagaaaacccatctgtttgccaagcaggaaaaagccttttaccctaaatcttttaagtccaaaaagcagaaaccatctagagtcttgtattctagcaccgagtcttccgatgaagaggctctccagaataaaaagataagcacatcttgtagtgtaatccccgaaacaagcaactcggacatgcagaccaagaaagagtatgttgtgtcaggtgaacacaagcagaagggaaaagttaagaggaagttaaagaaccagaacaaaaataaagagaatcaggaactcaaacaagaaaaagaagggaaagaaaacacccgcatcactaaccttaccgtgaatacgggtctggattgcagcgagaaaacaagggaagaggggaattttcgaaaatcatttagtccaaaggatgatacgtcactgcacctcttccacatctcgaccggaaagagcccaaaacactcctgtggactatccgaaaagcagagcacccctctcaaacaagagcacacaaaaacatgcctgtcgccagggagctcagaaatgtcactccagcccgacctggtccggtacgacaacacagaatccgaatttctgcctgaatcctctagtgtcaaatcttgcaaacacaaagaaaagtctaagcatcagaaggacttccatcttgagttcggagaaaagagtaacgcaaagatcaaagacgaggatcattcacccacttttgagaattccgactgtactctaaaaaagatggacaaggaggggaagacgctgaagaagcacaagttaaagcacaaagaaagggaaaaggagaagcataagaaggaaatagaaggcgagaaggaaaaatacaaaactaaggactctgccaaggagctccagcgctccgtggagtttgatagagaattttggaaagaaaacttctttaaaagtgacgaaaccgaagacctgttcttaaacatggagcacgagtcactcaccttggagaagaagtcaaagctggaaaagaatatcaaagatgacaagagtacaaaggagaagcacgtgagcaaggaacgcaacttcaaagaggagagagacaaaataaagaaagagtccgagaaaagctttcgggaagaaaagattaaagacctgaaagaggaacgcgaaaacatccctaccgataaagactctgaattcaccagtctcgggatgagcgctattgaggagagcattggcctgcatctggtcgagaaagaaattgatattgaaaaacaggaaaagcacataaaagaatccaaagaaaagcctgaaaagcgctctcagatcaaagagaaagacattgaaaagatggaacgaaaaacctttgagaaggaaaaaaagattaagcatgagcacaaaagcgaaaaagacaagttagacctaagcgagtgcgtcgacaaaattaaggagaaggacaaattgtatagccaccacaccgagaaatgccataaagagggcgaaaaaagtaaaaacaccgctgccattaagaagacggacgatcgggaaaaaagcagggagaagatggataggaagcatgataaggaaaagccagagaaggaacggcatctcgccgaatcaaaggaaaaacatcttatggagaagaaaaacaaacagtccgacaacagtgagtacagcaaatccgagaagggcaaaaataaggaaaaggatagggaattggataaaaaagagaaatcacgcgacaaagagtccattaatattaccaactccaagcatattcaggaagagaagaagtcctcaatagttgatggcaacaaggctcagcacgagaaacctctcagcctgaaagagaagacaaaggatgaacccctgaaaacacccgacgggaaggagaaggacaaaaaggataaagatatcgatcgttacaaagagcgcgataagcacaaggacaagattcaaatcaacagtctgctcaaactgaaatccgaggccgataaaccgaagcctaagtcttcacctgcttctaaggacactcggcccaaggagaaacgccttgttaatgatgatctaatgcagacatccttcgagagaatgctgtccctcaaagatctggagatcgagcagtggcataagaaacacaaagagaagatcaagcaaaaggaaaaggagaggctacgaaacagaaactgtttagagttgaagatcaaggacaaggaaaagaccaaacacactcccacggagtcaaagaataaggagttgactagatctaaatcctctgaagtgactgacgcctacactaaagaaaagcaacccaaagatgccgtcagtaatcggagccaaagcgttgacaccaaaaacgtcatgaccttggggaagagttcctttgtttcagacaatagcctcaacaggagtccacggtccgaaaacgaaaaacccggcctgtcctctaggtctgtgtccatgatcagtgtggctagttcagaagatagctgccacaccaccgttactaccccgcgcccgcccgtggagtacgactctgattttatgcttgagtcctccgaatcccaaatgtctttctcacagagtccattcttaagcatcgccaaaagccccgccttgcatgaaagggagctcgacagccttgctgacctgccagagcggattaagcccccttacgcgaatagactgtccactagtcacctgcgctcaagttccgttgaggatgtcaaattaatcatcagcgaggggaggcctacaatcgaagtacgcaggtgctccatgccctccgtgatctgtgagcacaccaagcagttccaaacaatttccgaagaatccaatcaaggaagcctgctcaccgtgcctggtgatacctcaccatctccgaagccagaagtcttcagtaatgtccctgagcgcgacctctcgaacgtgagcaacatacactcttcattcgccactagtccgaccggtgcttcgaacagcaaatacgtgtctgccgatcgtaacctgattaagaacacggcaccagttaatactgtgatggactcacctgtgcatcttgagccgagtagccaggtgggtgtcatacagaacaaatcatgggaaatgccagttgaccgcttggagacattgagtacaagagacttcatttgcccgaattctaacattcctgatcaggagagctcgcttcagagtttttgcaactcagagaataaggtgttgaaggagaatgccgacttcttgtctctacgccagactgagctccccggaaatagttgtgcccaagatccggccagctttatgccgccccagcagccttgctcctttcctagccagagcctctcagacgctgagtctatttctaagcatatgtccttgagctacgtggctaaccaggaacccggcatccttcagcagaagaatgccgtccagattatcagttccgcactggacaccgacaatgagtctaccaaagacacagaaaacactttcgttctgggggacgtgcagaagacagacgcctttgtccctgtctattccgattccacaatccaggaggcatctcctaatttcgagaaggcctatacattgccagtgctgcctagcgaaaaagatttcaatgggtccgatgcctctacccaactgaacacgcattacgcatttagcaagctcacctataagagttcatctggtcacgaagtcgagaatagtactactgacactcaggttatttctcacgaaaaagaaaacaaactggagtcactcgtgctgactcatttgtcccgatgtgatagtgatctgtgcgagatgaatgccggtatgcctaagggcaacctgaacgagcaggatccgaaacactgccccgagagtgaaaagtgccttcttagcatcgaagacgaggaatcacagcaaagcatcctgtctagtcttgaaaaccattcccaacagagcactcagcccgaaatgcacaaatatggacaattggtgaaagtagagctggaagagaatgcggaggatgataaaacagagaaccagatcccacagcgcatgactcgtaataaagccaacacaatggccaatcagagtaagcagatcttggcttcctgcacactgctctccgagaaagatagtgaatcatccagcccacgagggagaattagactgacagaggacgatgacccacagatccaccatccacgtaagcgtaaggtgagcagggtgccgcagccagttcaagtcagccccagcctgctccaggccaaggaaaagacacaacaatctttggctgctatcgtagatagcttaaaattagacgaaatccaaccttactcctccgagcgcgcaaatccgtactttgagtatctccacatccgaaagaagatcgaggaaaaaagaaaactgctatgcagtgtgattccacaggcacctcagtattacgacgagtacgttactttcaatggctcgtacctgctggatggaaatcctctgtccaaaatctgtatccccactattacacctcctccttcgctgagtgatccactcaaggagctcttccggcaacaggaggtggtgagaatgaagctcagactccagcactccatcgaacgggaaaagcttatcgttagtaacgagcaggaagtactgagagttcactatagggctgccagaactcttgctaaccagactctgcccttcagtgcctgcacagtgctgctggatgccgaagtatataatgttcctctggactcccagagcgatgattctaaaacttccgtgcgcgatcgctttaatgcacgccaattcatgtcctggctccaggacgtggacgacaaattcgacaagctgaagacatgtttactgatgcgtcagcagcacgaagccgccgccctgaatgctgtccaaaggctggagtggcaactgaagctccaggaactcgatcccgccacatacaagtctatctcaatctatgaaattcaggagttctatgtccccttagtcgatgtgaatgacgattttgagttaactcctatctag

SEQ ID NO: 108287 - DNA, 372 bp, Artificial Sequence
  Description of Artificial Sequence: Synthetic coding sequence
accgaggatctctttcttaatatggaacacgaatcactcaccctcgagaaaaagagtaagttggaaaaaaatatcaaagacgataagtctaccaaggagaagcatgtgagcaaagagagaaacttcaaggaggagcgagataagatcaagaaggagtctgagaagtccttcagagagggcatgtctgctatcgaagagagcatcggcctccacttggttgagaaagaaatcgatattgagaaacaggaaaaacacataaaggagtccaaggagaaacctgagaaaaggagtcagattaaagagaaagatatcgagaagatggaacgaaagacatttgagaagggcacatcgtacattagaattacacagtag

SEQ ID NO: 108288 - DNA, 993 bp, Artificial Sequence
  Description of Artificial Sequence: Synthetic coding sequence
atgccgaaatctggttttaccaagcccatccaatccgagaattccgattccgatagtaacatggtggagaaaccttatggaaggaagagtaaagataaaattgccagttactcaaaaacaccgaaaattgagcgcagtgacgtttcaaaggagatgaaagaaaaatcttcaatgaaaaggaagctgcccttcactatatcgccctcgaggaatgaggagcgcgactccgacacagattcggatcccggacacacatcagagaactggggcgagcgcttgatcagctcttatcggacctacagtgaaaaggaggggccagaaaagaaaaagaccaagaaagaggcaggcaataagaagagtacacccgtatccatcttattcggctaccccttgtccgagcgcaaacagatggcactgctcatgcagatgacagcacgcgataacagccctgactccactccaaaccatccatcgcagacaacccccgcccaaaaaaagacgccgagcagttcttcaaggcagaaggacaaagttaataagcgtaacgaacgcggagaaaccccactgcatatggccgcaattcgtggcgatgtgaagcaagtcaaagagcttatctctctgggcgctaatgtgaatgtcaaagacttcgccggttggactcccctgcacgaggcttgtaacgttggctattatgacgtcgccaaaattcttatcgctgccggagctgatgtaaacacccagggcctcgatgatgatacacctttacacgattccgcaagctccggccacagagacattgtcaaactcttgcttaggcacggcggcaatccgttccaagccaataaacacggagaacgccctgtggatgtggccgaaactgaagaactggagctactgctcaaacgggaagtgccgttatcggatgacgatgaaagctatacagggtccagctaccagttcgctgggaatgccaaactgagtggggcctcctag

SEQ ID NO: 108289 - DNA, 1116 bp, Artificial Sequence
  Description of Artificial Sequence: Synthetic coding sequence
atgcctaagagtggctttactaaacccatccagtctgagaatagcgatagcgactccaatatggtggagaagccttatggacgcaaatccaaagacaagatcgcttcttactccaaaacacccaagatcgagcgctcagacgtctctaaagagatgaaggagaagagcagcatgaagagaaagctgccgttcaccatctcgccgagtcgcaatgaggaacgggactctgacactgagaaggagggcccggagaagaagaagacaaaaaaggaggctgggaataaaaaatcaacccccgtgagcatcttgttcggatatccactctctgagcgcaagcagatggctctgctgatgcaaatgacggcccgagataactctccagacagcacacctaatcacccaagtcaaacgactcccgcacagaagaaaacaccttcctcctcatcacggcagaaggacaaggttaataaacggaatgaaagaggtgagacacctctacacatggccgctatcagaggtgatgtcaaacaagtgaaagaactgatttctctcggggcaaacgtgaatgtaaaagacttcgcggggtggactcctctccatgaagcctgtaacgtgggatactacgacgtggccaagatccttatcgctgccggggcagatgttaacacacagggtctggacgacgacaccccacttcacgacagtgcgagttcaggtcacagagacatcgtcaaactgctgttgcgacacggtggtaacccttttcaggccaataagcatggagagaggcctgtggatgtcgctgagactgaggaactggagctcctactgaaaagagaagtgcctctcagtgatgacgatgaatcatacacagattcagaagaggctcagagcgtcaatccttcatctgttgacgagaatatcgactctgaaaccgagaaagattctttgatatgtgagagcaaacaaattctgccaagtaaaactccacttcccagcgccttggatgagtatgagttcaaggatgacgatgacgaagagatcaataagatgatagacgatcgacacatcctgcgcaaggaacaacggaagaagaaacgtaaagagaagaagtag

SEQ ID NO: 108290 - DNA, 984 bp, Artificial Sequence
  Description of Artificial Sequence: Synthetic coding sequence
atggctaaggccccgagctgggccggcgtgggtgccctggcttacaaggcaccagaagctctttggcctgccgaggctgtaatggacggaacgatggaggattcggaagctgtgcaacgcgcgactgctttgatcgagcagcgcttggcccaggaggaagagaacgaaaaacttagaggagacgcgagacaaaaattgcccatggacctgttggtgcttgaggacgagaagcaccacggcgctcagtcagctgccctccagaaagtcaaaggccaggaacgcgttaggaagacttcgcttgacttgcgacgggaaatcattgatgtgggcggtattcaaaatctgatagagctgcgtaaaaagagaaaacagaaaaagcgagacgccctggcagcaagtcatgagccccccccagaacccgaggaaatcacaggccctgtggatgaggaaacatttctaaaggcagccgtagagggaaagatgaaggtaattgagaaattccttgccgatggtggatcagcagacacgtgcgaccagttccgcaggactgcattacaccgcgcttccttggaagggcatatggaaattttggagaaactattagataacggcgcaacggtcgatttccaggaccggctggattgtaccgctatgcattgggcgtgccgaggcgggcaccttgaggtagtaaagctgctgcagagccatggggccgataccaacgtaagggataaggagggcgatactgccctgcacgatgccgtgcggctcaatagatataaaattataaagctactgctgctgcatggtgcagatatgatgacgaagaatcttgcaggaaagaccccaactgacctcgtccaactgtggcaggccgatacaaggcacgcactagagcaccctgagccgggagccgagcacaacggcctggaagggcctaacgatagcggccgcgaaacccctcagcccgtgcctgcccaatag

SEQ ID NO: 108291 - DNA, 1083 bp, Artificial Sequence
  Description of Artificial Sequence: Synthetic coding sequence
atggccaaagcgccgagctgggccggagtgggtgctctggcctataaagcgccagaagccctctggcccgctgaagctgttatggacgggacaatggaggatagcgaagctgtgcagcgggcgaccgcactgatagagcaacgactagcccaagaggaagaaaacgagaagctgcggggagatgctagacagaagttacccatggatctgctggtgctggaagatgagaaacatcacggggcacagagtgctgccctgcagaaagtgaaggggcaagaaagagtgaggaagactagcctggacctgaggagagaaatcatcgacgtgggcgggatacagaacctgattgagttaagaaaaaagcgtaagcagaagaagagagatgcgctggctgcaagtcacgaaccaccccctgaaccagaggagatcaccggtccggtggatgaggagacattcttaaaggctgccgtggagggaaagatgaaagttatcgagaagtttctcgctgacggcggatctgccgatacatgtgaccagtttagacggacggcgctgcaccgcgcctccctcgaaggtcatatggagatactagagaagctcctcgacaacggtgcaactgtagattttcaggataggctcgactgcacagctatgcattgggcctgtaggggtggacatttagaagtggttaagctcctacagtctcacggtgcagacacaaacgtgagggacaaactgctgtcaacaccgttgcacgttgctgttcgcacaggccaggtggagattgttgagcattttttgtcattgggactggaaatcaacgctagggatcgcgaaggggatactgccctccacgacgctgtgcggcttaatcgatataagatcattaagttgctcctgctccatggtgcagacatgatgacaaagaatttagccggtaaaaccccaaccgatttggttcagctatggcaagctgacaccagacacgctctggaacatcccgagcccggcgccgaacacaacggcctagagggacctaatgactctggaagagagaccccgcagccagtcccagcgcagtag

SEQ ID NO: 108292 - DNA, 1002 bp, Artificial Sequence
  Description of Artificial Sequence: Synthetic coding sequence
atggatggcaccatggaagacagtgaggccgtacaacgcgccaccgccctgattgaacaaagattggcccaggaggaggaaaacgagaagctgagaggcgatgctagacagaagcttccaatggacctccttgtgttagaggatgaaaagcaccacggtgctcagtccgcagcacttcaaaaagtgaagggccaggagcgcgtgcggaagacatcactggatttgcgaagagaaattattgacgttgggggaattcagaatcttatcgagctccgaaaaaagagaaagcaaaaaaaacgggacgccctggctgcctcacatgaaccgcctcccgagcctgaggagattaccgggcctgtggacgaagagacattcctgaaggcagccgtagagggaaaaatgaaggtcattgagaagttcctcgccgatggtggttcagctgacacctgtgaccaatttagaagaacagctctgcaccgggcctctcttgaggggcacatggagatactagaaaagttgctggacaacggcgcaacagtcgacttccaggatagattggattgtaccgctatgcattgggcctgccgaggaggccacctggaagtggttaagctcttacagtcacacggggctgataccaacgtgcgggacaaactcctgtcaactcccctgcacgtggcagtcaggacaggacaagttgagatcgttgaacattttctctccctgggactggagattaacgccagggaccgggagggcgacacagcactgcatgatgctgtccgtttgaacaggtataaaataattaagctcttgctcttacacggagccgacatgatgacgaagaatcttgcaggcaaaactcccactgatctggtccagctctggcaagccgacacccgccacgccttggaacatcctgaaccgggtgccgaacataacggactcgaaggacctaacgattcaggacgagagacgccccagcctgtacctgcgcaatag

SEQ ID NO: 108293 - DNA, 903 bp, Artificial Sequence
  Description of Artificial Sequence: Synthetic coding sequence
atggacggtaccatggaggactctgaagccgtacagagggctacggccctgatcgagcagcgactggcccaggaagaagaaaatgagaaactgagaggggacgctcggcaaaaacttcccatggatctcctggtcctggaggatgaaaagcatcacggggcacagtccgctgcactgcagaaagtgaaggggcaggaacgcgttcgcaagaccagcctagacctccggcgagagatcattgacgtcggtgggattcagaatctcatcgaactacgtaagaagcgcaagcagaaaaagcgggacgccctggctgcatcccatgagcccccccctgaacctgaggagataactgggcccgtggatgaggaaaccttcctgaaggcagcagtcgaaggaaagatgaaggttatcgaaaagttcctggccgatgggggctcagcggacacttgcgaccagtttagaaggacagccctgcaccgcgccagtctggagggtcacatggagattctggagaagctactggacaacggcgctactgtggattttcaggaccggctggattgtacagctatgcactgggcctgcagaggcggccacctggaggtggtcaagcttttgcagagtcacggagcggacaccaacgttcgcgataaggagggagacacggccttacacgatgctgttcgtctgaacaggtacaagattatcaagctattgctgctccacggcgccgacatgatgaccaagaatcttgccggcaagacaccaacagatctggtgcaactctggcaggcagatacacgtcacgcactcgagcatccagagccaggagccgaacacaacgggttggagggccctaacgacagcggccgcgaaacaccccaacctgttccggctcagtag

SEQ ID NO: 108294 - DNA, 918 bp, Artificial Sequence
  Description of Artificial Sequence: Synthetic coding sequence
atggactttatttcgattcagcagctggtgagcggagaaagggtcgaaggaaaagttctcggatttgggcacggcgtacctgacccgggcgcgtggccatctgattggcgacgcgggccgcaggaagcggttgctagagagaaattgaagctcgaggaagaaaaaaagaaaaaattagaaaggtttaattcgacgagattcaatcttgacaacctcgcggacctggaaaacctggtgcagcggagaaagaaaagactgaggcaccgcgtcccccctagaaagccagagccactggttaagccccaaagccaggctcaggtcgagcctgtaggcctggaaatgtttctgaaggccgcagcagagaatcaggagtatctcattgacaaatatctgaccgatggaggagaccccaacgctcatgataaattgcatcgcaccgctctccactgggcctgccttaaggggcacagccagttggtcaataagctcctggtcgctggcgcaactgtagatgcaagggatttattggaccggacccccgtattctgggcgtgcagaggaggccacctggtgatactgaagcagcttctgaaccagggggcccgcgtaaatgccagagacaagatcggctccactccgctacatgtcgcagtgaggacaagacatccagactgcctcgagcaccttatcgagtgcggcgctcatctcaacgctcaggacaaagaaggagatactgctctgcacgaagcagttaggcatggttcatataaggctatgaaactactcctgctgtacggggcggaactcggcgtgcggaacgctgcatccgttacacctgtgcagcttgccagagactggcagagggggatccgagaagctctgcaggcccacgtagcccatccccggactaggtgctag

SEQ ID NO: 108295 - DNA, 792 bp, Artificial Sequence
  Description of Artificial Sequence: Synthetic coding sequence
atggatttcatcagcattcagcagcttgtgagcggagagagggttgagggcaaagtgctggggtttggccacggtgtcccagatcctggcgcttggccttccgattggaggagaggaccccaggaagcagtggcacgcgaaaaactgaaactagaggaggaaaaaaaaaagaaattggagcgcttcaacagtacacggttcaacctggataatctagccgaccttgagaatctggtgcaaaggagaaagaagcgtttgaggcacagggttcctcccagaaagccagaacctctggttaaactccatagaaccgccttgcactgggcctgtttgaaaggccacagtcaactcgttaacaagttgttagtagcaggcgcaaccgtggatgcacgggacctcctggacagaacccctgtgttctgggcctgccgtggcgggcacctggttattttaaagcagctgttgaatcaaggtgccagggtgaatgctagggataagatcggcagcactccactgcatgtagctgtgcggacccggcatcccgactgccttgagcacctgatcgaatgtggcgcccacctgaacgcacaggacaaggagggagatacagcccttcacgaggctgtgaggcatgggtcatataaggccatgaaactgttactcctgtacggggctgaattgggagtaagaaatgccgcctccgtcaccccagttcagcttgcccgcgactggcagcgcgggatcagagaggcacttcaggcacatgttgcccatccacgaactagatgctag

SEQ ID NO: 108296 - DNA, 918 bp, Artificial Sequence
  Description of Artificial Sequence: Synthetic coding sequence
atggatttcatttctattcagcaactggtgtccggcgagcgagttgagggaaaagtgctgggttttgggcacggggttccagatccgggcgcctggccgtccgactggcgaagaggaccccaagaagccgtggcgagagagaagctgaagctcgaggaagaaaagaaaaagaaactggagaggttcaacagtacacgtttcaacctcgataacctggctgatttggagaacctggtgcagagacgtaaaaagcggctgagacaccgggtccccccccggaaacctgaacccttggtaaagccacagtcgcaggcgcaagtcgaaccagtggggctcgaaatgtttctcaaggccgccgctgagaaccaggagtacctgattgataagtatctaacggatggcggcgatccgaatgcccacgataagttacaccggactgccctgcactgggcttgtctgaagggccatagccagctggtgaacaagctcctggtcgccggtgccaccgtcgacgcgagggacctactagatagaactcctgtgttttgggcctgcagaggaggacacctggtaattcttaagcagctactaaaccagggcgcaagggttaacgcacgggataagattggatccaccccgcttcatgtggctgtgagaacccggcatcccgattgcttggaacacctgattgagtgcggcgcccacctaaacgcccaagacaaagagggggatactgccctgcatgaggctgtgcgtcacggatcttataaggcgatgaagctacttctactttacggtgctgagctcggggtccgaaacgcagcttcggtgaccccagtgcagctggcccgcgactggcagcgtgggatcagggaggcactgcaggcccacgttgctcatccgagaacccgctgttag

SEQ ID NO: 108297 - DNA, 3804 bp, Artificial Sequence
  Description of Artificial Sequence: Synthetic coding sequence
atgaaccacatgtttcatatcaagcgccattctatctcagctggaacagatgcatataaaaagactaagcccatccagaacctattccaaaagccactctacgaccattgtagcgctaacaactacaaatcgatggaacctgagctggagaatgttcggagcagtcccccacggggagatcgcaccagcaaagtgagcctgaaggaagagttgcagcaggacatgcaaaggttcaagaacgaaataggaatgctcaaggtcgaatttcaggcactagagaaggaaaaggtgcaactgcaaaaagaggtggaggaagaaaggaaaaagcacagaaacaatgaaatggaagtcagcgcaaatattcacgatggtgccacagacgacgccgaggatgatgacgatgacgatggcttaattcagaagagaaagagcggcgaaactgatcaccagcaattcccacggaaggagaacaaggagtatgcttccagtggcccagccctgcaaatgaaggaagtgaaaagtactgagaaagaaaagcgcacttccaaagaatctgtcaattctcccgtttttggaaaagcctccctcctcaccggagggctgctacaggtggacgatgactctagtctctcagagatcgacgaggacgaaggcagacccactaagaagacttctaacgagaagaataaagtgaaaaatcagatacagtcgatggatgacgtagacgatctgactcaatcctccgaaacagccagtgaggattgcgagttgccacacagctcttataagaactttatgttactgatagagcaattagggatggagtgtaaagactcagtcagcctgctcaagatccaggatgcggctctcagttgcgagcggctcctggagctgaagaaaaatcattgcgaactgctcacggtgaaaattaagaaaatggaagataaggtgaacgtgctgcagcgggaattgtccgagaccaaggagatcaagagtcagttagagcaccagaaggtcgaatgggagagggagctttgctcactgcgattcagtctgaaccaggaggaagaaaagcgtcggaacgctgacactctgtacgaaaagatccgcgagcagctccggcgcaaagaagagcaatatagaaaggaggttgaggtgaagcagcagctggaactcagcctccagactctggagatggagctgaggaccgtcaaaagtaatttgaatcaggtggtgcaggagaggaatgacgcccagcggcagttgtcaagggagcagaacgcgagaatgctccaggacggtatcctgactaaccacctctctaagcagaaggagattgagatggcccagaagaaaatgaattctgaaaacagccactcccatgaagaagagaaagatctttcccacaagaattctatgctccaggaggagatcgcgatgttgcgcttggagatcgatactatcaaaaatcaaaaccaggagaaggaaaaaaaatgttttgaggacctaaagattgtgaaggaaaaaaacgaagacttgcagaagacaattaagcaaaacgaagaaactttgacccaaacaatctcccagtataacgggcgcttgtcagtgctgaccgccgagaatgccatgctcaactccaagctggagaacgagaagcagagtaaggaacggctcgaggcggaggtggaatcctaccactccaggcttgccgcggccatacacgatcgtgatcagagcgaaacttctaaacgcgagctagagttggcctttcaaagagcccgggatgagtgctcgagactgcaggacaagatgaatttcgatgtttcaaacctcaaagacaacaacgagatcctctcacagcaacttttcaagactgagtctaaattgaactcgctggagatcgagttccatcacacccgggatgccctgcgagagaagacgctaggtcttgagcgagtccagaaagatctgagccaaactcagtgtcaaatgaaagaaatggagcagaagtaccagaacgagcaggtgaaagtgaataagtatatcggcaaacaggagtccgtggaggagcggctttcgcagctccagagtgagaacatgctcctgaggcagcagctagatgacgcccacaataaggcagataacaaagaaaagacggttattaacatccaagatcaattccacgccatcgtgcagaagctacaggccgagagtgaaaaacagtccctgctgctggaagagcgtaataaggaactgattagcgagtgtaatcacctgaaagaacggcagtatcagtacgaaaatgagaaagccgagagggaggtagtggtcagacagctgcagcaggaactcgccgacaccctgaagaagcaatccatgtctgaggcttcgctggaggttacgtcacgataccgaatcaaccttgaggacgaaactcaagatctcaaaaagaaattaggacagatccggaatcaactccaggaggcacaggatcggcataccgaggccgtacggtgcgctgaaaagatgcaggaccacaaacagaagctcgagaaggacaacgcgaagctaaaggtgaccgtaaagaaacagatggacaaaattgaagaactgcaaaagaatctactcaacgctaatttgtctgaagatgagaaagagcagctgaaaaagctgatggagctgaaacagtcgctcgagtgtaaccttgatcaggagatgaagaagaacgtggaactggaaagggagataacaggattcaaaaatcttctaaaaatgacaagaaaaaaacttaacgagtacgagaatggggagtttagttttcacggcgacctgaaaacaagccagttcgagatggatatccagatcaataaactgaagcacaagatagacgatctcaccgccgagttagagactgctggtagtaaatgcctgcacctggatacaaaaaatcaaatactccaagaggaattgcttagcatgaaaacagtgcaaaaaaagtgcgagaagctccagaagaacaaaaagaagctcgagcaggaagtcataaacttacgcagccacattgaaagaaacatggtggagctgggccaggtgaaacagtacaaacaggaaattgaggagcgagcccgtcaggagatcgccgaaaagctgaaggaagtgaacctttttttacaggcccaggcagcttctcaagagaatctagagcagttccgggagaataactttgcaagcatgaaaagccagatggaactccgcattaaagatttagagagcgagctgtccaagatcaagacctcccaggaggactttaataagaccgaacttgagaagtataagcagttataccttgaagagctgaaggtccgaaagtccctaagttccaaactgacaaaaaccaacgagagactagccgaggtcaacaccaaacttctagtggaaaaacaacagagtagaagtctctttaccactctgacgacacggcccgtgatggaacccccatgcgtcgggaacttgaacaactccctggacttaaataggaagctgattccccgcgaaaacctagtgataagtacatctaatccaagagcctcaaacaacagcatggagaactacttatccaagatgcagcaagaactggaaaaaaacataactcgagagctcaaagaggcagctgccgaattagagagtggaagcattgcgagccctctcggttctactgatgagagcaatctcaaccaggatcttgtgtggaaggccagccgggaatacgtccaggttttgaaaaaaaattacatgatctag

SEQ ID NO: 108298 - DNA, 5133 bp, Artificial Sequence
  Description of Artificial Sequence: Synthetic coding sequence
atgaaaaaaatcttcagcaaaaagggagagtctccccttggcagtttcgccaggagacagaggagctcagccggtggcggtggggaaccgggagaaggggcgtacagtcaacccgggtatcatgtaagagaccgagacttgggcaagattcacaaggctgcttccgcaggcaacgtggccaaggtgcagcagatactgctgctgcggaaaaatggcttaaacgatcgcgataagatgaatcgaacggccctacacctggcatgtgccaatggccatcccgaggtggttactctcctcgtagaccgcaagtgtcagttgaacgtgtgtgacaatgagaacaggactgccctgatgaaggcagttcagtgccaggaagaaaaatgcgctaccatcctgctcgaacatggcgccgaccccaaccttgctgacgtgcatgggaatactgccctgcactacgcggtgtacaacgaagatatatctgtcgcaactaaactgctgctgtacgacgcgaatatcgaggctaaaaacaaggatgacctcacacccttactcctggccgtgagtggcaaaaagcaacaaatggtggagtttctcatcaaaaaaaaggctaacgtaaatgccgtggacaagctagaatcttcccaccagttaatcagtgagtataaggaggagagaattccaaaacattccagtcagaatagcaatagcgttgacgaatcttcggaagatagcctgagccgactatctggcaagccaggggtggatgactcttggccaacttccgacgacgaagatctgaatttcgacacaaaaaacgtccctaagccgtcactggccaaattgatgaccgcctcccagcagagtcgaaaaaacctggaagctacatatgggacagtacgcaccggtaacagaacactgttcgaggatcgcgattcagacagccaggacgaggtggtagtggaatccctaccaaccacatctattaaagtccagtgcttttcacatcccacataccagtctccagatctgttgcccaagcctagccacaaatccctcgctaaccctggcttgatgaaggaggaaccaacaaagcctggtattgcgaaaaaagaaaatggtatcgacattatcgagtcagcacctttggaacagaccaacaacgacaatcttacttacgtagatgaggtgcacaaaaacaacagaagcgatatgatgagcgcactgggattgggccaggaggaggacattgaaagtccatgggatagcgagtcaatcagcgagaacttcccgcagaagtatgtcgatcctctagccggggccgctgacggcaaagaaaagaacataggcaacgaacaggccgaggatgtgttttatattccgagctgcatgtcggggagcaggaattttaaaatggccaaactggaggataccagaaatgtggggatgcccgtggcccatatggagagcccagaacgttaccttcacctgaaacctaccatcgagatgaaggattccgtccccaacaaagctggaggcatgaaggacgtccaaacttccaaagctgccgaacacgatctcgaggtggctagcgaagaagagcaggagagggagggctctgagaataatcaaccacaggtggaagaagagcgaaaaaagcatagaaacaatgaaatggaggtgagtgccaacatacacgatggggccacagacgatgccgaggacgacgacgacgacgacggactgatccagaagagaaagtccggcgaaacagaccatcaacagtttccacggaaagaaaataaagaatacgcgagtagtggccctgctctacaaatgaaggaggtgaagagcactgagaaagagaaaaggactagcaaagagtccgtcaattccccagttttcgggaaggcctccctattgaccggaggtcttctgcaagtcgatgacgattcctctctgagcgaaatcgatgaggatgaaggccgaccaacaaagaaaaccagcaacgaaaaaaacaaagtcaagaatcagatccagagtatggacgatgtcgacgacctgacccagagttccgagactgcctcagaggactgtgaactgcctcactcttcctacaagaatttcatgctattgattgaacagcttggtatggaatgcaaggattcagtgtccctgcttaaaatccaagacgccgccctgtcttgcgagagactgctggagctaaagaagaaccactgcgagctccttacagtgaaaataaaaaagatggaagacaaggtaaatgtcctgcagagagagctgtcggaaaccaaggaaatcaaatcccaactggagcaccagaaagtcgaatgggaaagagaactttgttctttacgcttctccctgaaccaagaggaagaaaaacgtagaaatgctgacacactatacgagaaaatccgggagcaacttcgacgtaaagaggaacagtaccgcaaggaggtggaggtcaagcaacaactggagctttcactgcaaacactggagatggaactcaggactgtgaaatccaaccttaaccaagtggtgcaagagcgcaacgatgctcagcgtcaactgtcaagggagcagaatgctcgcatgcttcaggacggtatcctaaccaaccacctgagcaagcagaaggagattgagatggctcaaaaaaagatgaactccgagaacagccattcacacgaagaggagaaagacctgtctcataaaaacagcatgcttcaggaagagatcgccatgcttaggctcgaaatagacacaataaaaaatcagaatcaggaaaaggagaagaaatgtttcgaagacttaaaaatcgttaaagagaaaaatgaggacctccagaaaaccatcaagcaaaacgaagagacactgacgcagaccatttcccaatacaacggtcggctttctgtactcaccgccgaaaacgccatgctgaactcaaagcttgaaaatgaaaaacaatccaaggaaaggctggaggcagaagtggagagttaccacagccgtcttgcggctgccatccatgatagagaccagagtgaaacctcgaaacgagaactcgagctagccttccagagagcaagggacgagtgttcgcgcctgcaagacaagatgaactttgacgtgtctaatctgaaggacaacaatgagatcctgtcccagcagctatttaaaactgagtctaagctgaattcattagaaatcgaattccaccataccagggatgcactgcgtgagaaaactctgggcctggagcgcgtgcaaaaagatttgtcccagacccagtgtcagatgaaagaaatggaacagaagtatcagaatgaacaggtcaaagtgaataaatacataggtaagcaggaaagtgtagaggagaggctctcacagctccaaagcgaaaacatgctgctgcggcagcaactggacgatgcgcacaacaaagcggacaacaaagagaaaactgtgatcaacatccaggaccaattccacgctatcgtccagaaactgcaagcggaatccgaaaagcagtccttactgctagaagagcggaacaaagagctgatctcggaatgcaatcatctaaaggagcgtcaatatcagtatgagaacgagaaagcagagagggaagtggttgttcgacagttgcaacaggagctcgccgacaccttaaaaaaacagtcaatgtcggaggctagcctagaagtcacgtctagatatcgaatcaatctggaggacgagactcaagacttgaagaagaaactgggacaaataagaaatcagctgcaggaggctcaggaccgtcacactgaagctgttagatgtgctgagaaaatgcaggatcataagcagaaactggaaaaggacaacgcaaaactgaaagtgaccgtcaaaaagcaaatggataaaattgaagaactccagaaaaatctactgaatgctaacctgtccgaggacgagaaggagcaactaaagaagcttatggaacttaaacagagcctcgagtgcaaccttgaccaggagatgaagaaaaacgttgaactggaacgggaaattacaggatttaaaaacttattgaaaatgacccgcaagaagttgaatgagtacgagaatggtgaattttcattccacggcgatctaaaaacaagccagtttgagatggatattcaaatcaacaaactgaagcataagatcgatgacctgactgccgaactggagacagcgggatccaaatgccttcacctggatactaagaatcagatccttcaggaagaactgttaagtatgaagaccgttcagaaaaaatgtgagaaactgcagaaaaataagaaaaaactggaacaggaagtgatcaatctcaggtctcacattgaaaggaatatggtcgagttgggacaggtgaaacagtacaagcaagagattgaagaacgtgcaaggcaggagatcgccgagaagctgaaagaggtaaacctattcttgcaggcccaggcagccagtcaagagaacttggaacagtttcgagagaacaactttgcctctatgaagagtcagatggaattacgcatcaaggacctggaatctgagctttccaagatcaagacaagtcaggaagatttcaataagaccgaattggaaaaatacaagcagttgtacctggaagaactcaaagtaaggaagtctctttcgtctaagcttaccaagactaacgaacgcctggccgaggtgaatactaagttgttagttgaaaagcaacaaagtcggtctctcttcaccacattgaccacccgacccgtcatggagcctccttgtgtgggtaatctgaacaatagcttggatcttaatcgcaaactgattccacgggaaaacctagtcattagcacttcgaacccccgtgcaagcaataacagcatggagaattacctgtctaaaatgcagcaagaactggaaaaaaatatcaccagagagctcaaagaagctgcagctgagctcgagagcgggtctattgcgagcccacttggcagcactgatgaatcaaacttgaaccaggacttagtctggaaagcatctagggagtatgtccaggtgctcaaaaagaattatatgatttag

SEQ ID NO: 108299 - DNA, 5181 bp, Artificial Sequence
  Description of Artificial Sequence: Synthetic coding sequence
atgaagaagatcttttcgaagaagggcgagtcacctctggggagctttgccaggcgacagaggagctccgcgggcgggggaggcgagcccggggaaggggcctactcccagcccggctaccacgtgcgggaccgtgaccttgggaaaatccacaaggctgcaagcgccgggaacgttgccaaagttcagcagatcctcctcctgcggaaaaatgggctgaatgatcgcgacaaaatgaatcgcacagctttgcacctggcatgtgccaatggccaccccgaggtggtcacgctactggttgatagaaagtgccagttgaacgtgtgcgacaatgagaatcggaccgccttgatgaaagcagtccagtgtcaggaagaaaagtgtgccacaatcctgttggaacacggggctgatcccaatctcgctgatgtgcacgggaacactgccctgcattacgctgtgtacaacgaagacatatccgtggcaacaaagctcctcctgtacgatgccaacatagaggctaagaacaaagacgatttgacgccattgttgttggcggtatctgggaaaaagcagcagatggtggagtttctaatcaagaaaaaagctaacgtaaatgcagtggacaagcttgaatcctcccatcagctcatctctgaatacaaggaggagagaattcctaagcactcttcacagaactccaacagcgttgatgaatcatctgaggactccctgagttctctgttttattttatcttttttgaaacgaagagttgtacggtagcgcaggccggcgtactgcagcacgatctctcaagccttcagtcgctgctcccaggttttacacagtttttctgtttgcacctccccagtagctgggaccacaggctcagtggaaaacccggcgtggatgatagctggccaactagtgacgacgaagacctcaacttcgacactaaaaacgtacccaagccctcactagctaagctgatgactgccagccagcagtccaggaagaatctggaggccacatacggtaccgtgcggacaggaaatagaactctctttgaggatagggactccgactcacaggatgaagtggtcgtcgaaagcctacctactacgtccatcaaggtgcagtgtttctcccaccccacatatcagagcccagatttactgccaaaaccctcacacaagtccctggcaaatccaggcctgatgaaggaggaacctacaaagccgggaatcgccaagaaggaaaacggcatcgatatcattgaaagtgctccgcttgagcagacgaacaatgataacctgacctatgtcgacgaggttcataagaacaacagatccgatatgatgagcgctctgggactgggccaggaagaagatattgagagtccttgggatagtgagagcatttcagagaacttcccccagaaatacgtggatcccctcgccggcgctgcagatgggaaagagaagaacatcggcaatgagcaggctgaagagtctcctgaacgatatttacatcttaagccaactatcgagatgaaagacagcgtgcctaacaaagcaggagggatgaaagatgtgcagacgtctaaggctgccgaacacgaccttgaggtggccagtgaagaagagcaagaaagagagggatcagagaacaaccaaccgcaggtggaggaagagagaaagaaacatagaaacaatgagatggaggtcagtgcgaacatccacgatggcgctactgacgacgccgaggacgatgatgacgatgacggtctgatacaaaagaggaagagtggggaaactgatcaccagcagttcccaagaaaggaaaacaaagaatacgcctcttccggtccggctctccagatgaaggaggttaaatcaacggaaaaggagaagagaacctccaaggaatctgtcaacagcccagtgtttgggaaagccagcctcctaacaggcggattgctgcaggtggacgatgactcctcattgagtgaaatcgatgaggatgaggggagacccaccaagaagacaagcaacgaaaagaacaaggtgaagaatcagatacaatctatggatgatgtggatgacctgacgcagagctccgagaccgccagcgaagattgtgaactgccacactcaagttacaagaattttatgcttttaattgagcagctgggtatggagtgcaaagactccgtctccctgctcaaaattcaggacgcagcgcttagctgtgagcgtctacttgagctcaagaagaatcactgcgagctgcttaccgtgaagatcaagaagatggaggataaggtaaacgtgctgcaacgggagctctccgaaacaaaggaaatcaaatctcagctcgagcatcagaaggttgagtgggaacgcgagctctgcagccttcggttcagcttgaaccaggaagaagaaaaacggcgaaacgccgacacactgtatgaaaaaatcagggagcaacttcgtaggaaagaggaacaatatcgcaaggaggtggaggtaaaacagcaacttgaactaagtctccagactttagaaatggaactgcgcacagtcaagagtaatcttaaccaggtggttcaggaaaggaacgacgctcagcggcagctttctagagaacagaatgccaggatgttacaagatggcattcttacaaatcatcttagtaaacagaaagagattgaaatggctcagaagaaaatgaattccgagaacagccatagtcacgaggaagagaaagacctaagtcataagaattccatgctacaagaggagatagctatgctccgtctggaaatagacactatcaaaaaccagaaccaggagaaagagaagaagtgtttcgaagatttgaagattgttaaagaaaaaaacgaagacctgcaaaaaacgattaagcagaacgaagaaacccttacccagacaataagccaatataacggcagactctcagtcctgacggcagaaaacgccatgctgaatagtaagttggagaatgagaaacagtctaaggaaaggcttgaggccgaggttgagtcgtaccactcccggttggccgcggccatacacgacagagaccagtcagaaacctccaagcgggagctggaactggctttccagcgcgcaagagacgaatgctctaggctacaagacaagatgaacttcgacgtgtctaatctcaaagataacaacgagattttgagccagcagctgttcaaaacagaatctaagctgaattcgctcgagatcgagttccaccatacacgtgatgccttgagagagaagactttagggctggaacgggtccagaaggatcttagccaaactcagtgtcagatgaaggagatggagcagaaatatcagaacgagcaagtcaaagttaacaaatacattggaaagcaagagagcgtggaagagagactgtctcagctgcaaagcgagaacatgttgcttagacaacagcttgatgacgcccacaacaaagcagacaacaaggagaaaacggtgataaacatccaagaccagttccacgccatcgtccaaaagttacaggcggaatccgagaagcagtcactgctgctagaggagcgaaacaaagagcttatttccgagtgtaaccacctgaaggaaaggcagtaccagtatgagaacgagaaagcagagagagaggtggttgtgcggcagcttcagcaagagctcgctgatactcttaagaagcaaagcatgtccgaggcctctcttgaggtgacctctcgctaccggattaacctggaggacgaaactcaagatctcaagaaaaagctggggcagattagaaaccaattgcaggaggctcaggatcgccacacggaggctgtgcgatgtgccgagaaaatgcaggatcataaacaaaagctggagaaggataacgccaagcttaaggtgactgtgaagaaacaaatggacaaaatagaagaactgcaaaaaaacctgttaaacgccaatctctccgaagacgagaaagaacagcttaagaagttgatggaactgaagcagagtctagagtgtaatctcgatcaggagatgaaaaaaaacgtcgagctcgagagagaaattaccgggttcaaaaatctgctgaagatgaccagaaaaaaacttaacgagtacgaaaatggagagttttcatttcacggcgacttgaagacctcccaattcgagatggatatccagatcaacaagttgaaacacaagatagacgacctgactgcagagcttgaaacggcaggctccaaatgtttgcacctggacactaagaatcaaattttacaagaggaactcttgagcatgaaaacggttcaaaagaagtgtgaaaaattgcagaaaaataagaaaaagctggagcaggaggtgatcaacttgcgtagtcatattgagagaaacatggtggagctgggccaggtcaagcagtataagcaagagatagaggagagggcgagacaggaaatcgcggaaaaactgaaagaggtgaacttattcctccaggcccaggcagcttcccaggaaaacctggagcagtttcgagagaataattttgcttccatgaagtctcaaatggaacttaggatcaaagatttggagagcgaactctctaaaatcaaaaccagtcaggaagatttcaacaagacagagttggagaagtacaagcagctctacctggaggagttgaaggtgcgaaaatcgctgtcttcgaaactgactaagaccaacgaacgattagctgaagtaaacaccaagctgctcgttgagaagcagcagagccgatcgctgttcacaacactgacgacccgacctgtcatggagcccccatgcgtgggtaacctcaataattctctcgaccttaaccggaaacttatcccacgggaaaacctggttatttcaacgtcaaacccaagggccagcaataattccatggaaaattatttgtccaaaatgcagcaggagctggaaaagaacattacccgggaacttaaggaagccgccgccgagctggagtccgggtcaattgcatccccactcggctccaccgatgaaagtaatctgaatcaggatctcgtgtggaaggcctcccgcgagtacgtgcaggtccttaaaaagaactacatgatctag

SEQ ID NO: 108300 - DNA, 642 bp, Artificial Sequence
  Description of Artificial Sequence: Synthetic coding sequence
taattccgggaaaataatttcgcctcaatgaagtctcagatggaactcagaattaaggatttagaaagcgagctcagtaagattaaaaccagccaggaagacttcaacaagaccgagcttgaaaaatacaaacagctttacctagaagagcttaaagtgcggaagagcctatcaagcaagctgacaaagacgaatgagcgcttagcagaagtgaacactaagctattagtggagaagcagcagagccggagcctcttcaccactctgaccacacggcccgtaatggaaccaccgtgcgtgggaaatttgaacaactcattggacctgaacagaaaactgatccctagagagaacctggtcataagcaccagtaacccccgtgcttctaataatagcatggagaactatctctcaaagatgcaacaagagcttgagaagaacatcaccagggagctgaaggaagctgctgccgaattagaatctggcagcatcgcctcacctctggggtccacagacgagtccaatcttaaccaggatttagtgtggaaggccagcagggaatacggccctagcgatgagacgccacacgactatgtgctgatgactgatcagtgcctgacaagcagaactgatctgcagtag

SEQ ID NO: 108301 - DNA, 3261 bp, Artificial Sequence
  Description of Artificial Sequence: Synthetic coding sequence
atgtcacgtgtatgtattgtcgtgttggaggaggtagaggatgaaagtccagcgttcataagtaagctgcctcaagagaataagagcctccatagcccaccatccggcaatgttctcgtcagatacccaagcctggtccaggccatcttcaacggggatccggacgaggtgcgtgctctcatttttaaaaaggaagacgttaattttcaggacaacgagaaaagaacccctttacatgctgcagcatatctaggtgacgcggagatcatcgaattgctgatcctgagcggcgccagagttaatgcaaaggattcaaaatggttgacacccctccacagggccgtagcctcctgctcagaggaagccgtccaggtgctgctgaagcatagcgcggatgttaacgcccgcgataagaactggcagacgccgctgcacattgccgccgccaacaaagctgtgaaatgcgccgaagctcttgtccctctgctgtcaaatgtgaatgtatcagacagagccggcaggacggccctccaccacgccgccttcagcgggcacggcgaaatggtgaaacttctattgtctaggggagctaatattaacgcgtttgacaagaaggatcggagagccatccactgggcagcatacatgggccatattgaggtcgtgaagctcctggttagtcatggcgcagaagtcacttgcaaggataaaaagtcttatactcctctgcacgcggctgcgtctagcggtatgatctccgtggtgaaatatctccttgacctcggagttgatatgaatgaacctaatgcttatggtaataccccattacatgtggcgtgctataatggccaggacgtcgtcgtaaatgaattgattgattgtggcgccatcgtgaaccagaagaacgaaaaggggttcacgcctctgcattttgctgcagcctccacccatggggctctgtgcctcgagctgctcgtgggaaacggcgccgacgtgaacatgaagtccaaagatggcaaaactcccctacacatgaccgcactgcacggcaggttttccaggagccaaacaattatccaaagtggagcagtgatagactgtgaagacaaaaatggaaacacacccctgcatatcgccgctcggtacggacatgagttactgatcaacaccctcatcacttcgggagccgataccgcaaagcgggggatccacggcatgtttcctctgcacctagctgccctgtccgggtttagcgattgctgtcggaagctgttaagcagcggctttgacattgatacgccagatgacttcggccgcacctgtcttcatgcagccgctgcaggaggaaatctagagtgcctgaatctattgctcaacaccggggctgactttaacaaaaaagacaagtttgggaggtcacctttgcattatgccgccgcgaattgtaactatcagtgtctttttgcattggtcgggagtggcgctagcgttaatgacttggacgagcgaggttgcacacctctgcactatgcagccacctccgacaccgatggaaaatgcttagaataccttttacgcaacgacgctaacccaggcattagggataagcaaggttacaacgcagtccactatagtgcagcatacggccacagactgtgcctacagctcatcgcatcggagacccctttggacgtgctaatggagacatcgggtaccgacatgctgagcgatagcgacaatcgggctactatctctccactccacctggcagcataccatggccatcaccaggccctcgaggttctggtccagtctctgctggacctggacgtgagaaactcatcgggtcgcactcctttggatctggccgcctttaagggacatgtggagtgtgtggacgttctgatcaaccagggcgcctcaattctcgtaaaggattacatcctgaaacggacccctatccacgctgccgcaacgaacggacatagcgagtgcctgcgcctcctgattggcaatgcggagccccagaatgccgttgatatacaggatggaaacggtcagacccccctgatgctatctgtcctgaatggtcacacggattgcgtgtattctctcctcaacaaaggcgctaacgtcgatgcgaaggacaaatggggccggacagcacttcaccgtggagctgtcactggccacgaagaatgcgtcgacgccctgcttcagcatggcgctaagtgtcttttgcgagattctcgcggaagaacacccatccacctttccgccgcatgtggacacatcggagtactgggagccttgttacagagcgccgcaagcatggacgctaatcccgcaactgctgacaaccacggttacacagccctccactgggcttgctataacggtcatgagacctgtgtcgaattattactggagcaagaggtgtttcagaagactgaaggcaatgctttcagccccctgcactgcgcagtgatcaacgacaacgagggggctgccgagatgctaatcgatactctgggggcttcgattgtgaatgcgacagatagtaagggcaggacacccctgcatgccgcggcttttactgaccacgttgagtgtctgcagctactcctgtcccacaatgcgcaagtaaatagtgtcgacagtactggaaagaccccattgatgatggcagccgagaatggtcaaaccaacaccgtagagatgctagtgagttcagccagtgcagagctgaccctgcaggacaacagtaaaaacaccgcgctccatctcgcctgttccaagggacatgaaacttcggcacttctgatcctcgaaaagatcaccgacagaaatctcataaatgctacaaatgctgccctacaaacaccgctgcatgttgccgcacgtaacggcttgaccatggtggtccaggagctgcttgggaaaggcgcttcagttctggctgtggacgagaacggatatactccagcgctcgcttgcgcccccaataaggatgttgcagattgcctggccctgattctcgccacaatgatgccagtaagctcctcttcaccactttcctctctgacttttaacgccattaaccggtatacaaacacgtcaaagacagtttcctttgaagcacttcccattatgcggaacgagccttcaagttactgctcattcaacaacatcggaggagagcaggagtatctgtataccgatgtcgacgagctcaacgactccgactctgagacatactag

SEQ ID NO: 108302 - DNA, 3162 bp, Artificial Sequence
  Description of Artificial Sequence: Synthetic coding sequence
atggcctttcttaagcttcgcgaccagcccagcctggtgcaggccatcttcaacggagaccccgatgaggtccgcgcactgattttcaagaaggaggatgtgaattttcaagataatgagaagcgtacccccctccacgccgcagcctacttgggcgacgctgagataattgaattgctcatcctctcaggcgcaagggtcaatgcaaaagattcaaaatggctcaccccccttcacagggctgtggcctcttgttcagaggaggcagtgcaggtcctgctgaagcactctgccgacgtgaatgcacgcgataaaaattggcagacccccttgcacatagccgctgccaataaagccgtgaagtgtgcagaagccctggttcccctgctgagtaacgttaatgtatctgatagggccggaaggactgccttgcaccacgccgcattttctggacatggagagatggtaaaattgctgctttctcgaggagctaacatcaatgcctttgacaagaaggatcgtcgcgctatccactgggccgcctatatggggcacattgaggtggtaaagctcctcgtatcccacggagcagaggtgacctgcaaggacaaaaagtcgtatactccactgcacgcggctgcaagttcggggatgatttctgtcgtcaaatatttgctggatctcggcgttgacatgaatgaacccaatgcctacgggaacacacccttgcatgtggcgtgttacaacggacaggatgtagtggttaatgagcttatcgactgtggggccatagtaaaccagaaaaacgaaaaaggattcacccctctccacttcgctgccgcgtccacgcatggggcgttgtgcctcgagctgttagtgggcaatggtgccgacgtgaatatgaagtctaaagatggcaagacccctctgcacatgaccgccctccacggaaggttctctagatcccaaactatcattcagtctggagcagtaatcgattgtgaggataagaacggaaatacccctctgcatatagccgcacgctatggacacgaactcttgataaacactctgattacaagtggagctgacactgccaagcggggaatccacggcatgttcccactgcacctagctgctctcagtggcttctccgactgttgccgtaagttgctaagtagtgggttcgacatcgatacccctgatgacttcgggcgcacgtgcctccatgccgccgccgccggtggaaacctggaatgcttaaatctgctgttgaataccggggcagatttcaataaaaaggataagttcggacgatctcccctacactacgcagccgccaattgcaattatcagtgtctgtttgccctggtgggtagcggtgccagcgtgaacgacctcgatgagcggggctgtactccgctccattacgccgccactagtgacactgatggcaaatgcctggagtacctgctgagaaatgacgccaaccccggcatacgagacaaacaaggctacaatgcagttcactattccgccgcctatggtcatcgcctctgcctgcaactaatagcatccgagactcccctggatgtgctcatggagacttccggaaccgacatgcttagcgacagcgacaacagagccaccatctccccactgcacctagctgcttaccatggacatcaccaggctctggaggtgctcgtgcagagcctactcgatctggacgtgcggaactcaagcggtagaacacctcttgatcttgctgcgttcaaagggcatgtcgagtgtgttgatgtgttaattaaccagggcgcaagtattctcgtgaaggattacatattaaaacgcacccccatccacgctgccgcaaccaatggacattccgaatgcttaagactcctcattggcaatgcagaaccacagaatgcagtggacattcaggacggcaacggccaaacgccactaatgctatctgttctgaatggccacaccgactgcgtgtattcactactgaataaaggcgcaaacgttgacgcaaaggataaatgggggcgaactgcgctgcatcgcggggccgtcactgggcatgaggagtgtgtagacgcgctcttgcagcatggtgctaagtgcttactgcgggatagtcgggggcggacacccatacatctgagcgctgcatgcgggcatattggtgtcctgggagcccttttgcagagcgcggcttcaatggacgcgaatccagctaccgctgacaaccatgggtacactgccctgcactgggcctgttacaatggccacgaaacttgcgtagagttgttgttggaacaggaggtatttcagaaaaccgaggggaacgccttctctccacttcattgcgcagtgataaatgacaacgagggcgcagctgagatgctgatcgatacgttgggcgcctctatagttaacgcaaccgattccaaaggcagaacccctctgcacgcagctgcgtttaccgaccacgtggagtgtctgcaactgcttctgtctcacaacgctcaggtcaacagtgtggactcaacaggcaaaactccgctgatgatggccgctgaaaatggccagaccaataccgtcgaaatgttggtctccagcgcaagcgctgagctcacacttcaggacaattccaagaacaccgcgctgcacttggcctgtagcaaaggtcatgaaacatccgcccttctgattctcgagaagatcaccgataggaatctgattaatgctacgaacgctgcattgcaaactcccctgcacgtcgcagcccgtaatggattgactatggtagtgcaggaactcctgggcaaaggggccagcgtattggcagtggatgagaatggttatacccccgcacttgcgtgtgcccccaacaaggatgtcgccgactgtctcgccctgattttggccaccatgatgcctgttagcagttcgagtcctctgagcagtttaacgtttaacgccattaatcgctatacgaacacttctaaaacagttagtttcgaggcccttccgatcatgaggaacgaaccttcatcatattgttccttcaacaacatcggaggcgagcaggagtatctttacaccgatgtcgatgaactaaatgactcggattctgagacctattag

SEQ ID NO: 108303 - DNA, 3162 bp, Artificial Sequence
  Description of Artificial Sequence: Synthetic coding sequence
atggcattcttgaaattgcgggatcagccaagcctggtacaagctatctttaacggggatcctgatgaagtgcgggctctgattttcaaaaaggaggacgtgaactttcaggacaatgaaaaacgcacgcctctgcacgcggctgcttatctgggggacgcagagattatcgaactgctaatattgtctggtgcgcgggtcaacgccaaagacagcaagtggctgacgcctcttcatagggccgtggcttcttgctcagaggaggccgtccaagtgcttctaaagcacagcgcagacgttaacgctcgggataagaactggcaaacccctctgcacatcgcagcagccaacaaagccgtcaaatgcgctgaagcgctggtcccactactgtcaaatgtaaatgtaagcgatagagccgggaggacggcactgcatcacgcagcctttagcggtcatggggaaatggtcaagctgctcctgagtcgcggggccaatattaatgctttcgataagaaagacagacgggccatacattgggctgcatatatgggtcacattgaagtggttaaattgctggtcagtcacggtgctgaagttacttgcaaggacaagaagtcgtatactcccttacacgcagctgcttcctctgggatgatctccgtggtgaaatacctgctcgacttgggagtggatatgaatgagccgaatgcttacggcaatacccctctgcatgttgcctgctataacggccaggatgtagtggtgaacgaactgattgactgtggcgcaatcgtcaatcagaagaatgaaaagggctttacccctctgcacttcgccgcggcaagcacgcacggggcactgtgtttagaattactcgtcggcaacggggccgacgttaacatgaagtcaaaagatgggaagacaccccttcatatgacagcactacatggccgtttttcaagatcccagacaattattcagtccggagccgtgatcgattgcgaagataaaaatggcaacacccccctgcacattgctgccaggtatgggcacgagctgctgattaatacattaattacctctggtgccgatactgcgaagcgggggattcatgggatgttccctctgcatcttgctgcattgagcggcttcagcgactgctgtagaaaacttctgagctcgggattcgatattgatacgccagatgactttggaaggacttgcctgcacgcggccgctgctggcggaaacctcgaatgcttgaacctgcttctgaacaccggcgctgatttcaataagaaggacaaattcggcagatcgcccctgcattacgccgcagccaactgcaactaccagtgtctgtttgcgctcgtgggctctggagcctcagtcaacgatttggacgaaaggggatgcacacctttacactacgccgcgacttccgacaccgacggcaaatgcctcgaatacttgctgaggaatgatgcaaacccaggaatcagggataagcagggatataatgcagtccactacagcgccgcgtacggacaccggctctgccttcagctgatcgcatctgagacccctctcgatgtgctgatggagacctccggcacagacatgctgtccgattcagataaccgggccaccatatcacctctgcacctcgcagcctaccacggtcatcatcaggctctggaagtcctggttcaatcattgctcgatctagatgtgcgaaacagttccggtagaaccccccttgacctggcagccttcaagggtcacgttgagtgtgtggatgtgctaattaatcaaggcgcctctattctggtgaaggactatatcctaaagcgaacgcctatccacgccgctgccaccaacggccattcagagtgcctcagattgttaataggcaatgccgaacctcagaacgctgtcgacatccaggacggtaacgggcagacaccactaatgctctctgttctgaacgggcatacggactgcgtgtacagtttgctgaacaaaggtgctaacgtagacgcgaaagataagtgggggcggactgcgttacaccgcggggcggtcacagggcacgaagagtgcgtggacgctttgctgcagcacggagccaagtgccttctgcgggacagcagagggcggaccccgattcacttatcagcagcatgcggccacattggagtgctgggagcactgctgcagagcgccgcatccatggatgccaatcccgcaacagcagacaaccatgggtataccgctttgcattgggcttgctataatggtcacgagacctgtgtggaactgctgttggagcaggaagtgttccagaagactgagggaaacgccttttctccgttacactgtgcagtgatcaatgacaacgagggtgccgccgagatgctaattgacactctgggggcgtctatcgtgaatgcgactgacagtaagggccgaactcctcttcacgccgccgcttttaccgaccacgtcgaatgcttgcaactcctgttaagtcacaacgctcaggttaacagcgtggactccactgggaaaacacctctcatgatggctgcagagaatggacagacaaacaccgtggaaatgctggtgtcttccgcgtctgcggaattaactctccaggataattccaaaaacactgcgctccatctggcatgctctaagggccatgagacctctgcactcttaatcctggagaagatcactgatcgtaacctaatcaatgccacaaatgcagccctccagacacccctgcatgtggcagcccgtaacggcctcactatggtggtccaggagttgctcggcaaaggtgccagcgttctggctgtggatgagaacggctatactcctgccctcgcatgtgctcccaacaaggacgtagctgactgcctggcccttatacttgccacaatgatgccagtgtcatcgagctctcctctctcctccctgacttttaatgccattaacagatatactaacaccagcaagactgtatccttcgaggccctaccaatcatgcgcaatgaacctagtagctactgttcatttaataacataggaggagagcaagaatatctgtacaccgacgtggacgagctgaatgactccgactctgaaacttattag

SEQ ID NO: 108304 - DNA, 4026 bp, Artificial Sequence
  Description of Artificial Sequence: Synthetic coding sequence
atgaccaagcgcaagaagacgataaacttgaacattcaggatgcacagaagcgaaccgccttgcattgggcctgtgtcaatgggcacgaggaagtagtgaccttcctggtagaccggaagtgccaactagatgtgcttgacggcgagcaccgcacaccgctgatgaaggcactgcagtgccaccaggaagcctgtgcaaacatactcatagacagcggagccgacataaacctcgtggatgtttatgggaacacggccctccattacgccgtgtactcggagattctttccgtggttgccaagctgctttcacacggggccgtaatcgaagtccacaataaggccagtttgacacctctccttcttagcatcacgaagaggagcgagcagatcgtcgagttcctcctgattaaaaatgccaatgctaacgcagtgaacaaatataaatgtaccgccctgatgctggctgtatgccatgggtcctctgagatcgtggggatgctcctgcaacagaatgtggacgtcttcgccgcagacatatgcggggtgactgccgaacattatgcagtgacatgcgggttccaccacattcacgagcaaatcatggaatacatccggaagcttagcaaaaaccatcagaacacgaaccccgagggaacttctgcaggcaccccagatgaagccgcccccctcgccgagaggactcctgatacagctgaatcactggtggagaagacacccgatgaagccgcaccgctcgtggagcgtaccccagatactgcagagtctctcgttgaaaagacgccagatgaagccgcatcactcgtcgagggaacgagtgataaaattcagtgcttggagaaggcgacaagcggtaagttcgagcaatccgccgaggaaacccctcgtgagataacaagtccagctaaggagacgagcgaaaagtttacctggcccgcgaaagggcgcccacggaagatcgcttgggagaaaaaagaggatacacctcgagaaatcatgtcacccgctaaggagactagcgagaagttcacatgggccgccaagggtagacccaggaaaattgcttgggagaaaaaggaaacgccagtaaagacaggctgtgttgccagagtcacgagtaacaaaacgaaagtgctggaaaagggcaggagcaaaatgatcgcatgtcccaccaaggagtccagtactaaggcatccgctaacgatcagaggttcccctcagaaagcaagcaggaggaggatgaggaatattcctgcgattcccgctcattattcgagtccagtgcgaaaatccaggtctgcatacccgagagcatttatcagaaggtgatggaaattaatagggaggtggaagaacctcccaagaagccctccgccttcaaaccagctattgagatgcaaaacagcgttccaaacaaagcctttgaactgaaaaacgagcagacacttagagccgacccaatgtttccaccagagtccaaacagaaggattacgaagaaaattcatgggactcagaaagtctgtgcgagacagtatcacagaaagacgtttgccttcctaaggctacacaccagaaggaaatcgacaagataaatggcaaactcgaggaaagcccgaacaaggacggcctcctcaaagccacctgcggtatgaaagttagcatcccaactaaagcccttgaactcaaagatatgcagacgttcaaggcagaaccacctggcaaaccttcagcgtttgaacccgccacagaaatgcagaagagtgtgccgaacaaagcactggaactgaaaaatgagcagactctgcgcgctgacgagatcctaccttctgagtctaaacaaaaggactacgaagagaacagctgggataccgaatctctctgtgaaacagtctcccagaaagacgtgtgcctgccaaaggcggcccaccaaaaagaaattgataaaattaatggaaagctggagggctcccccgtgaaggacgggttgctgaaggcgaattgtggaatgaaggtctcaattccaaccaaggcactggaactgatggacatgcagaccttcaaggcggagcccccagagaagccttccgcctttgaacccgccatagaaatgcagaaaagcgtcccgaacaaggctctcgaactcaaaaacgagcagacccttcgggcggacgagattctgccctccgaatcaaaacaaaaggactatgaggagtcctcttgggactctgagagtctgtgcgagaccgtgagtcagaaagatgtttgtctcccaaaggcgactcaccaaaaagaaattgataagattaacggaaagctggaggaatcacctgataatgacgggttcctgaaggcaccatgccgaatgaaggtgtccattccaacgaaagcattggaactgatggacatgcagacttttaaagccgagcccccggaaaaaccatccgcatttgagccggcaatcgagatgcagaaaagcgtgcctaacaaggcccttgaactgaagaacgaacagacactgagggccgaccaaatgtttccaagcgagtctaaacaaaagaaggtggaggaaaactcctgggacagcgagtccttgagggaaaccgtgagtcagaaggatgtctgtgtgcccaaagcgactcaccagaaggagatggataagattagtgggaaactggaagactcaacaagtctatcgaaaatactcgatactgtgcatagctgtgagcgcgcccgggaactgcaaaaggaccactgtgagcagcgaaccgggaaaatggaacagatgaagaagaaattttgcgtgctcaaaaaaaagctgagtgaagcaaaggagatcaaaagccaactggagaaccagaaagtgaagtgggagcaagaactgtgttccgtgagactgacgttaaatcaggaagaagagaaaaggagaaacgccgatatattgaatgagaagatccgcgaggagttgggtcggattgaggagcagcacagaaaggaattggaagtgaagcaacagctcgaacaagctctcaggattcaagacattgaactgaaaagcgttgaatccaatcttaatcaggttagccatacccatgagaatgagaactacttactgcacgagaactgtatgcttaaaaaagaaatcgctatgctcaaactggagatcgccaccctcaaacaccagtaccaggagaaagaaaataagtacttcgaggatataaaaatactcaaggagaaaaacgcagagctccaaatgacactgaagcttaaagaggaaagtttgacaaaacgggcctcgcagtacagtggccagctcaaagtccttatcgcggaaaatacaatgctcacctccaagctgaaggaaaagcaagacaaagagatcttagaggcggagatcgaatcacaccatcccaggttagccagtgccgtgcaggatcatgaccagattgtcacttctagaaaaagccaggagcctgcctttcacattgccggcgatgcttgcttgcagcgcaaaatgaacgtcgacgtttccagtaccatatataacaacgaggtcctccaccagccacttagtgaggctcagcggaagtcgaagtccctgaaaatcaatctgaactacgccggagacgccctcagggagaacacgctggtgagcgaacacgctcagagagaccagagagagacgcagtgtcaaatgaaagaggccgagcatatgtatcagaatgagcaggacaacgtcaacaaacataccgagcaacaggaaagtcttgaccagaagctgttccagctgcaaagtaagaacatgtggctccagcagcagctagtgcacgcccataagaaggccgacaataagagcaaaattacgatagatatacactttctggagcgtaagatgcagcatcatctcctgaaagaaaagaatgaggagatcttcaactacaataatcaccttaagaacaggatctaccagtacgaaaaggaaaaagctgaaacagagaattcttag

SEQ ID NO: 108305 - DNA, 360 bp, Artificial Sequence
  Description of Artificial Sequence: Synthetic coding sequence
atgggtacacgcacattgcagtttgagatctccgattctcatgagaaggaagaggaccttctgcataagaaccatcttatgcaagacgagatagccagactccggctggaaatccacaccataaaaaatcagatcttggaaaagaagtacctgaaagatatagaaattattaagagaaagcatgaggacctgcagaaagccctaaaacagaacggtgaaaaatccaccaagacaattgcacattactccgggcagcttacagcgctgacagatgagaatacaatgttgcgctccaagctggagaaagaaaaacagagtcgtcagagactcacgaaatggaatcacacgattgtcgattag

SEQ ID NO: 108306 - DNA, 759 bp, Artificial Sequence
  Description of Artificial Sequence: Synthetic coding sequence
atgtcacaggcggctaaagcctccgccagcgccactgtggcagtcaacccaggtccggatactaaggggaagggagcaccccccgctgggacaagtccgtccccagggaccaccctcgctccaacgacagtcccaatcacctctgccaaagcagcagagctccctccgggcaattatcgactggtggtttttgaattggaaaacttccagggacggcgcgccgagttcagtggcgaatgctccaaccttgccgacagggggttcgatagagtccgtagtataattgtctctgcaggcccctgggtcgctttcgaacagtctaacttccgcggtgagatgttcattcttgaaaagggggagtatcctcgctggaacacttggagcagcagctacaggagtgacaggctcatgtcattcagacccattaagatggacgcacaggagcacaagatctccctgttcgaaggcgctaacttcaagggaaatacgatagagatacaaggcgatgatgctcctagtctctgggtttacggtttctccgatcgggtcggctccgtcaaagtcagctcgggtacctgggtgggctatcagtatccgggctaccggggatatcaatatctgctcgagccgggcgattttaggcactggaatgaatggggagcgtttcagcctcaaatgcagagcctgcgcagactgagggacaagcagtggcacctcgaggggagctttccagtcttagccaccgagccccccaaatag

SEQ ID NO: 108307 - DNA, 627 bp, Artificial Sequence
  Description of Artificial Sequence: Synthetic coding sequence
tgacgggacgaactacgctgcaagatcccagcgggaaggctgagacgcgctgccaggcctcatagaagactcggtccgaccggtaaggaagtccatgccctcaaacgattacgggacagtgccaacgccaatgacgtcgaaactgtgcagcagctgctcgaggacggcgccgacccgtgcgctgcagacgacaagggccggaccgcacttcattttgcctcttgcaacgggaacgatcaaatcgtacagttgcttcttgaccatggggccgatccaaatcagcgtgacggattgggcaacacacccctgcacctcgagtgctccccccaactcgtgcccgccggagcccgtgttgacgccctagatagggccgggaggacacctttacaccttgccaagagtaagctgaatattttacaggaaggccatgcccagtgcctggaagcagtgcggctggaggtcaaacagatcatccatatgcttagggagtatctggagaggttgggccagcacgagcagagagaacgcttggacgacctgtgcactaggctccagatgacatctacaaaagagcaggtggacgaggtaactgacttacttgctagttttacctcgctgtcactctag

SEQ ID NO: 108308 - DNA, 2184 bp, Artificial Sequence
  Description of Artificial Sequence: Synthetic coding sequence
atgtcccaacaggatgctgtggctgctctgtcagagcgactcctggtggccgcttataagggtcagacggagaacgtggtgcagctcatcaacaagggagccagagtagccgtgaccaaacatggaagaacccccctgcaccttgctgccaacaagggacacctgcccgtggtgcagattctgttgaaagctggctgtgacttggacgtgcaggacgatggtgaccagactgccctgcaccgagctacagtagtcggaaatactgagatcatcgccgcactgatccatgaagggtgtgccctcgacaggcaggataaggacgggaataccgcactccacgaagccagctggcacggattctcccagtcagcaaagctcctgattaaggccggggcaaacgtgctcgccaaaaataaggctggtaacacagcgctccatctggcctgtcagaactcccattcacagtcaacccgtgtgttacttctggcggggtcccgggccgacctcaaaaacaatgccggagatacctgtctgcacgtcgctgcccgatataatcacctttcaatcatccgtctgctgctcaccgcattttgttccgttcacgagaagaaccaagccggagacaccgctctgcacgtcgcagccgcccttaaccacaagaaggtagcaaagatcctgctagaagctggagccgacactacaatcgttaacaacgctggccagacccccctggagaccgcacgctaccataataaccccgaagtggccctgctgctcacaaaggcaccccaggttctgaggttcagcagggggcggagccttagaaaaaaacgggaaaggctgaaagaggaacgccgcgcacagtccgtcccacgggatgaagtcgcccagtctaagggaagtgtgtccgccggcgatacaccttcatcagagcaagctgtggccagaaaggaagaggcaagggaggagttcctgtcggcatcccccgagcccagagccaaagatgacagacggcggaaatctcgacccaaggtctcagcgttcagtgaccccacaccaccagccgatcaacaacccgggcatcagaaaaacctacacgcccacaatcatccgaaaaaaagaaacaggcataggtgcagttctccacccccccctcacgagttccgtgcttaccagctgtatactctttaccgcggcaaggatgggaaagttatgcaggctcccataaacggatgcaggtgtgagcctctaattaataaactggaaaaccagcttgaggccaccgtcgaggagattaaggctgagttgggctctgtacaggataagatgaatactaagttgggacagatggaaaataagactcagcatcaaatgagagtgcttgacaaactcatggttgagcggctctccgccgaaaggactgaatgcctcaacagactgcaacagcactccgatacagaaaagcacgagggcgaaaagcgccagattagcctcgtcgatgagctgaagacgtggtgtatgctgaaaattcagaacttggagcagaaactgagcggcgacagtcgggcatgtcgggccaaaagcactccatctacctgtgagtcctccactggagtggaccagctggtagtgactgccggcccggctgccgctagcgactcatcaccccctgtcgttagacctaaggagaaggctctcaattccaccgcaacacagcgattgcagcaggaactgtccagctcagattgtaccggctcacgcctacgcaatgtgaaggtgcagacggccctgctccccatgaatgaagccgctaggtctgaccagcaggcagggccctgcgtgaaccgcggaactcagactaagaagtccggtaaatccggaccgacccgccatcgggctcagcaacccgccgcatcgtcaacatgcggtcagccccctcccgccaccggcagcgagcaaacaggcccccacattcgggatacaagccaggcattagaactgactcagtatttctttgaagctgtttcaacccagatggagaagtggtatgaacgaaaaattgaagaggcccggtcccaggctaaccagaaagcacagcaagataaggcaaccctgaaagagcatatcaaaagcctggaggaggagctggcgaaattaaggactagagtgcagaaggaaaactag

SEQ ID NO: 108309 - DNA, 2079 bp, Artificial Sequence
  Description of Artificial Sequence: Synthetic coding sequence
atgtcccagcaggatgccgttgcagcgctcagtgaacgcctcttggtggctgcttacaagggccagactgaaaatgtggttcagctcatcaacaagggcgcacgggtggcggtcaccaaacacggacgaaccccattgcacctggctgcgaacaagggccatctgcccgttgtacagatcctcctcaaagcaggctgcgacctggatgtccaggacgacggggaccagaccgctttacaccgggcgactgttgtgggtaatacagagatcatagctgccctcatccatgaagggtgtgcacttgataggcaggataaggacggaaataccgctttgcacgaggccagttggcacggatttagtcagtctgctaaattactgataaaagccggcgcgaatgtgctggccaagaacaaagccggcaacacagctttgcatcttgcatgtcaaaactcgcacagccagtctacaagggtcctccttctggccgggagccgggccgatctaaagaacaatgctggtgacacatgcctccatgtagctgcccggtataaccacctctcaattattaggctcctgctgactgctttttgttccgtgcacgaaaagaaccaggcaggggacacagcactgcacgtggcagccgcactgaatcataagaaggtggccaagatcctgctcgaggctggagcagacaccaccattgtgaataacgccggccaaaccccgctcgagactgcgcgataccataataaccctgaagtggccctcctactcactaaagccccccaggggtctgtgtcagctggcgacacaccatccagtgagcaagcagtcgcccggaaggaagaagcccgagaggaatttttgtctgccagcccggagccgagagctaaggacgatcgccgaaggaaatctaggcctaaagtgagtgcgttctccgacccaactccccccgccgatcagcaacccgggcatcagaagaacttgcacgcacataatcatccaaagaaacgcaatcggcaccgatgcagcagtccgccacctccacacgagtttagggcctatcagctgtatacactctatagagggaaggacggcaaagtcatgcaggctccaattaacggctgtcgttgcgagcctttgatcaacaagttggagaaccagcttgaggcaactgtggaggagattaaagccgaactaggatcggtgcaggataagatgaacactaaactcgggcagatggaaaacaagactcagcaccagatgcgagtgttagacaaattgatggtggagagactgtcagctgaacgcaccgagtgcctgaatagactccagcagcactccgacactgaaaaacacgaaggcgagaaaagacagatatcgctggtagatgaattgaaaacctggtgtatgctcaagattcagaacctagagcagaagttatcgggggatagtagagcttgcagggccaagtccacaccctctacatgtgagtcaagcaccggcgtcgatcagctcgtggtgacagccggccccgctgctgcaagtgactcaagcccccccgttgtgcggcccaaggaaaaggctttgaactccaccgccacccaaaggttgcagcaagagcttagtagctccgattgcactgggtcaagacttagaaatgtgaaagtacagaccgctctactgccgatgaacgaagcagcaaggtcagatcaacaggccgggccgtgtgtaaataggggtacccagaccaaaaaatcaggcaaatccggcccaactagacatcgagctcagcagcccgccgccagttctacctgtgggcagccacctccagcaacgggatccgagcagaccgggccacacattagggacaccagccaagccctcgagttaactcaatacttttttgaggccgtgtcaacacagatggagaagtggtatgaaagaaagattgaggaagccagatcccaggctaatcagaaggctcagcaagataaggccacgcttaaagagcacataaagtctttagaagaggagctcgctaagctgcggacaagggttcagaaagagaattag

SEQ ID NO: 108310 - DNA, 2169 bp, Artificial Sequence
  Description of Artificial Sequence: Synthetic coding sequence
atgagccagcaggatgctgtggctgccctgtctgagaggctcctcgtagccgcctacaaaggccagaccgagaacgtggtgcagctgatcaacaagggcgcaagagtggccgttacaaagcatggcaggacccccctgcatcttgcagcaaacaagggacacctgcccgtcgtgcagatactactgaaggctggatgcgatctggatgttcaggacgatggagaccagaccgcactccaccgggctaccgtggtcgggaatacagagattattgctgctttgatccatgaggggtgcgccctcgacagacaggacaaagatggtaacacagctctgcatgaggcaagttggcacggcttctcacaatccgctaagctgcttatcaaagctggggcaaacgttctagctaagaacaaagcaggaaacactgccctacacctcgcgtgccagaattctcattcccagagtacgcgcgtgctcctcctggccggcagtagggccgatctgaagaacaacgccggagacacttgcctccacgtagctgccaggtacaaccacctcagcattattcggctcttattgactgccttctgcagtgtgcatgaaaaaaaccaggctggcgataccgctctgcacgtggcagccgctctgaaccacaaaaaggtcgccaagatcttgctcgaggcgggggctgacaccaccatagtgaacaatgctggccaaacccctcttgagacagcccgctatcacaacaatccagaggtagccttactgctgacaaaagcaccccaggtgctgcggttctccagaggtagaagcctgcggaagaagcgagaaagactgaaagaggagcggcgcgcacaatcagtcccaagggatgaagttgcccagtccaagggctcagtgtctgccggcgacacaccatcttccgaacaggcagtggcaagaaaagaagaggctcgggaagagttcctcagcgcctccccggagcccagagccaaggacgaccggagacgcaaaagtaggcctaaggtttccgctttctccgatcctacccctcctgcagaccagcagccgggccaccaaaagaacctgcacgctcataatcacccgaagaagcggaatagacaccgctgttcctcccccccccctccacacgagttcagggcataccagttgtataccctgtaccgcggaaaggatgggaaggtcatgcaggctccgatcaacggctgtagatgcgaaccccttatcaacaaactggagaaccaactcgaagcaacggttgaagaaataaaggccgagctgggctcggtacaagacaaaatgaatactaaactcggacaaatggagaacaagacccagcatcagatgcgcgtgctcgataagcttatggtagagcgcctgagtgccgagaggacagaatgtctgaatagactgcaacagcacagtgataccgaaaaacacgagggcgagaaaaggcaaatcagtctggtcgacgaactgaagacgtggtgcatgctaaaaatccagaacttggaacaaaaactgtcaggggacagtagagcgtgcagagccaagagtacaccctccacatgcgttgatcagctggttgtgactgcagggcccgccgccgcctcagactctagcccacccgttgtcagaccaaaagaaaaggccctgaatagcaccgccacccaacgccttcaacaggagctgtcgagcagtgattgcactggctctcggctgcgcaatgtgaaggttcagacagccctgctgcccatgaacgaagctgcacgaagcgaccagcaggccgggccgtgcgttaatcggggaacacagacgaaaaaatcgggtaaatctggtcctactaggcacagggcccagcagccggcggcctcatctacatgcggacagcccccaccagccacaggatccgaacaaacgggcccccacattcgcgacacctcgcaggcactggagctgacacaatacttttttgaagcagtctcgacccagatggaaaaatggtacgagcggaagatcgaggaagccaggagtcaggcaaatcagaaggcccagcaagacaaagccacgctcaaggagcatatcaaatctctggaggaagagctggctaagctgagaacacgtgtgcagaaggagaattag

SEQ ID NO: 108311 - DNA, 528 bp, Artificial Sequence
  Description of Artificial Sequence: Synthetic coding sequence
atgtcacagcaggacgccgtggcggctcttagtgaaagacttttggtggccgcttacaagggccaaacagagaatgtggtccagctgatcaacaaaggtgctagagtcgctgtcaccaaacacggcaggacacccctgcatctcgcagccaacaagggacacctccctgtggttcagatcttgctgaaggctggttgcgatctcgatgtgcaggacgacggagatcaaactgctctgcacagagctacagttgtgggcaatacagaaattattgcagcccttattcacgagggctgtgccctagaccgccaggacaaagacggtaatacggcactgcacgaagcatcttggcatggattttctcagtccgccaaactgctgataaaagcaggagcaaatgtgttagcaaaaaacaaagccggaaatacagccctccatctggcctgccagaattcacactcccagtcaactcgggtgctcttactggctggttcccgcgccgacttaaagaacaatgccggtgattag

SEQ ID NO: 108312 - DNA, 243 bp, Artificial Sequence
  Description of Artificial Sequence: Synthetic coding sequence
atgagtcagcaagatgccgtggctgctctgtcagaacggctattagtggcagcctacaagggccaaaccgagaatgtagtgcagttgatcaataagggtgcccgcgtagctgtcaccaaacacgggcgtactccactgcatcttgctgcgaacaaggggcacttacccgtggtacagatactcctcaaggccgggtgcgatctcgacgtccaggatgatggcgaccagacagccctgcactag

SEQ ID NO: 108313 - DNA, 2184 bp, Artificial Sequence
  Description of Artificial Sequence: Synthetic coding sequence
atgagccagcaggacgccgtcgcagcccttagtgagaggctgcttgtagccgcctataaagggcaaaccgaaaacgttgtccagcttatcaataagggtgcacgtgtcgccgtcactaagcacggtcggacccccttgcacttagctgccaataagggacaccttcctgtggtgcagatcctattaaaggccggctgcgacctagatgtgcaggatgatggtgaccaaaccgcccttcaccgtgcgactgtcgttggcaatactgaaatcatcgccgctcttattcacgaagggtgcgcactcgatagacaggataaggatggcaatacagctctacacgaagcatcctggcacggctttagccagtcagccaagctcctgatcaaggctggggccaatgttctggctaaaaacaaagccggcaataccgctctgcacctcgcctgtcagaatagccactcccaaagtactcgggtcttgttactggctggaagccgggccgatctaaagaacaacgctggcgacacctgtctccatgttgcagcccgatacaaccatctgtccattattcggttgctgttgaccgccttctgctctgtgcatgagaaaaaccaggctggggacacagcactgcatgtggctgccgcattgaatcataagaaggtagcgaagatcctgctggaggcaggagccgataccactatcgtgaataacgccggccagacaccgcttgagacagctaggtatcataataatcccgaagtcgcactcctgctgaccaaagcccctcaggtgttgaggttttcaaggggcagatcactgcgcaaaaagcgggagcggctcaaggaggaacgcagggcccagtccgttccaagggacgaggtcgctcagtcaaagggatcagtgtctgcgggggatacccccagctcagagcaggctgtggcaagaaaagaggaggcccgggaagagttcttgtccgcatctcctgagcccagagctaaggacgaccgcaggcggaaaagtcgccccaaagtatctgccttctccgaccccacgcctccagctgaccaacagcccggtcaccagaaaaatctccacgcgcataaccatccaaagaagagaaacagacacaggtgcagctctccccccccccctcacgaattccgcgcttatcaactgtacaccctctatcgcgggaaggatggaaaagttatgcaggcgcccatcaacgggtgccgctgcgaacctcttataaataaattggagaatcagctggaggcgacagtcgaggaaatcaaggccgaactaggctcagtacaggacaaaatgaatacaaagctgggtcagatggaaaacaaaacccagcatcagatgcgggtgctcgacaagctaatggttgaaagactgtcagccgaaagaaccgagtgcctgaacaggctacaacagcactccgatactgagaagcacgaaggggaaaaaagacagatcagcctcgtcgacgagctgaaaacatggtgcatgctcaaaattcaaaacctcgagcagaaactctctggcgatagtagagcctgccgggccaagagcaccccctcaacctgtgagtcaagcacgggcgtggaccaactggtagtaaccgccggacctgcggccgcatcggacagttctcctcccgttgtgagacccaaagagaaagccttaaattcgacagctacccagcgtctgcagcaggaattgtcgagttccgactgcacaggaagccgcctgcgaaatgttaaagtgcagactgcactcctgccaatgaacgaggcagcgcgttcggaccaacaggccggaccgtgcgtaaatcgaggaactcagacaaagaaatcaggtaagagcgggcctactcgacacagggcccagcagcccgctgcttcgagcacatgcgggcaaccccctccagcaactggcagtgagcagactggcccacacattcgggacacgtcccaagctctcgaattaacacagtatttcttcgaggcagtgagcacgcagatggagaagtggtacgaacggaaaatcgaagaggcccgaagccaggccaatcagaaggcgcagcaggacaaggctacactcaaagaacatattaagagcctggaagaagaactcgccaagcttcggacacgcgtgcagaaagagaactag

SEQ ID NO: 108314 - DNA, 357 bp, Artificial Sequence
  Description of Artificial Sequence: Synthetic coding sequence
atgtcacagcaggatgctgtcgcagcgctcagcgaaagactcctggtggcagcgtataaaggccaaaccgagaatgtggtgcaactgattaataagggcgcgcgtgtcgcagtgacaaagcatgggcgtacgcccctgcatcttgctgcaaataaaggccacctgcccgtcgtccagatcctgctcaaagccggctgcgatctggatgtccaagatgatggagaccagaccgccctgcatagggccacagtagttggaaataccgaaataatcgccgccctcattcacgagggctgtgctctggataggcaggataaagatggcaatacagcgttgcatgaagcttcctggcactag

SEQ ID NO: 108315 - DNA, 309 bp, Artificial Sequence
  Description of Artificial Sequence: Synthetic coding sequence
atgtcccaacaggacgccgtagcagcattgagtgaacgcttgctagtcgctgcatataaggggcagactgaaaatgtggtgcaactcataaataagggggcgagagtggcagttaccaagcatggaagaactccactgcaccttgccgccaacaaaggccatttgccggtggtgcagattttattgaaggcaggttgtgatctggacgtgcaggatgacggtgaccagacagccctgcaccgcgccacagtggttggtaatactgagatcatcgccgctctgatccatgagggttgtgccctggactag

SEQ ID NO: 108316 - DNA, 1992 bp, Artificial Sequence
  Description of Artificial Sequence: Synthetic coding sequence
atgagccagcaggatgctgtcgcagctctgtcagagaggttattagtcgctgcttacaaaggccagacagagaatgtcgtgcaattgataaacaagggtgcccgcgttgccgtcacaaagcacggcagaaccccactgcatctggctgccaataagggacacttacccgtcgtccagatcttactcaaggcgggttgtgacctcgacgttcaggatgatggggaccaaaccgccctccatcgcgccactgtggtcggcaatacggagatcatcgctgctttaatccacgagggctgcgctctggatcggcaggacaaagcaggaaacaccgcgttgcatctcgcctgccagaattcacacagccagtcaacccgcgtgcttctgttagctgggtccagggcagatctaaagaataacgcaggagacacttgtctccatgttgccgcccgctataatcacttgtcgatcatcaggttgcttctcaccgcattctgctcagtgcatgagaaaaaccaggccggtgatacagctttacatgtcgctgctgctctcaaccacaagaaggttgcaaaaatcttacttgaagcaggagcagatacaacaatcgttaataacgtgcttcggttttcccgagggaggagcttacgaaaaaagcgcgagcgcctcaaggaagagcggcgagcccagtcggtgcccagagatgaggtggctcagtccaaggggtctgtttccgcaggcgacacaccatctagtgagcaagccgttgccaggaaggaggaggcccgtgaagaattcctgagcgcgtctccggagcctcgggccaaggacgatcggaggagaaaatccaggcccaaagtgtctgcattcagtgatccaacaccacctgctgatcaacagcctgggcatcagaagaaccttcacgctcataatcatcctaaaaagagaaatcgacataggtgctcttcccctcccccgccacatgagttccgggcctaccagctatacactctttaccgcggaaaggacggtaaagtcatgcaggccccaattaatggctgccgctgtgagcccctcatcaacaaactggagaaccaacttgaggccactgtggaagagatcaaagccgaactgggctccgtccaggataagatgaacacaaaactgggtcagatggagaataaaactcagcaccagatgcgggtgctggacaagctcatggttgagaggttaagcgccgagagaaccgagtgcttgaatcgtcttcagcagcattctgacaccgaaaagcatgagggcgaaaagcgccaaataagcctggtggacgagctgaagacctggtgcatgttaaaaattcagaacctagagcagaagcttagcggtgacagtcgcgcctgtcgagcaaagtctaccccctcaacctgcgttgatcagctggtggtcaccgcggggcccgctgcagcttccgacagcagtcccccagttgtgcgccccaaagagaaagccttgaacagtacagctactcagagacttcagcaggaactcagctcttccgactgcaccggaagccgcctgagaaacgtgaaggtccaaaccgcacttctgcccatgaatgaggctgcccgctcagaccagcaggccggcccctgcgttaatagaggcactcagacaaaaaaatctggtaagtctggccccacccgccacagggcccaacagcccgcagcgtctagcacgtgcgggcaacctcctccagccaccgggtccgagcaaacaggcccgcacatcagagataccagtcaagccctggagctgacacagtatttcttcgaggccgtgagtactcagatggagaaatggtacgaaagaaagattgaggaagccagaagtcaagctaatcagaaagcacagcaagacaaggccacgctgaaggagcatattaagagcctggaggaggaattggcaaagcttaggaccagagtgcaaaaggagaattag

SEQ ID NO: 108317 - DNA, 765 bp, Artificial Sequence
  Description of Artificial Sequence: Synthetic coding sequence
atgaataaacttttttcattttggaagcgcaagaatgagactagatcccagggatacaatctgagagagaaggacctgaaaaagctgcatagagctgcctctgtgggcgatttgaaaaagcttaaagagtatcttcagataaagaagtacgacgtgaacatgcaggataaaaaataccgtacccccctgcatctggcctgtgctaacggccacaccgacgtcgtcttgtttctcatcgagcaacaatgtaagattaacgtacgcgattccgagaacaaaagtccgctgattaaggccgttcaatgccaaaatgaggattgcgcgaccattctcctcaacttcggggctgatcccgacttgcgggatatacggtataatacagtgttgcactatgctgtctgtggccagagtctaagtctagttgaaaagttactcgaatacgaggctgacttggaagccaaaaacaaagacgggtacaccccactcttggtagctgttatcaacaacaatccaaagatggtgaaatttctactggagaaaggcgcggacgtcaacgcctccgacaactaccagaggaccgcgctgattctggccgtgagcggagagcccccatgtctggtgaaattactgcttcagcagggtgtggagttgtgttacgagggaatcgtagacagtcagcttagaaatatgtttattagcatggtactgctgcatcgctatccccagtttaccgctagtcacggcaaaaagaagcacgccaagtag

SEQ ID NO: 108318 - DNA, 825 bp, Artificial Sequence
  Description of Artificial Sequence: Synthetic coding sequence
atgaacaagctgttcagtttctggaaaaggaagaacgaaacacgctctcagggctataatctccgggagaaggacctcaagaaactccaccgggcagcttcggttggcgaccttaaaaaattgaaggaatatctccaaataaagaagtacgatgtgaatatgcaggataagaagtattcagtcgtgcagtcttctaggtggcttttaagttacacaacccctctcaatgactttataaggactccactgcatctggcatgcgccaatgggcatacagacgtagtgctgttcctgattgagcagcagtgcaagatcaatgtccgcgatagcgaaaacaaatcccctctcatcaaagccgtgcagtgccaaaacgaagattgcgccacgattctcttgaactttggagcagaccctgatcttcgcgacatcaggtacaacacagttctccattatgcagtttgcggacaatccttatccttggttgagaaactcttagagtacgaagctgacctggaggctaagaacaaggacggctacacccctctgcttgtggccgtaataaataataaccccaagatggtcaaattcctgcttgaaaaaggtgcggatgtgaatgctagcgataactatcagagaaccgctctcattctcgccgttagtggcgagcccccttgtttagttaagcttttgctacagcaaggggtggaattatgctacgaaggcattgtggactctcaactgagaaatatgtttattagcatggtgctgctgcatcgttatccacagttcacagcgtctcacggcaaaaaaaagcacgccaaatag

SEQ ID NO: 108319 - DNA, 606 bp, Artificial Sequence
  Description of Artificial Sequence: Synthetic coding sequence
atgcaggacaagaaatacagaacccctctgcacctggcatgtgctaatgggcacaccgacgtggtcctattcctcatcgaacagcaatgtaaaatcaatgtcagggactccgaaaataagtctcctctgatcaaggccgtgcagtgccagaatgaagactgcgcaaccattctcctgaacttcggagccgatcccgacttgcgcgacataagatacaacaccgtgctgcattacgccgtgtgtggccagtcactgtcacttgtggaaaaactgcttgagtatgaagcagatcttgaggccaagaacaaagatgggtacacgcctttgttagttgccgtgataaataacaacccaaagatggtgaagtttctccttgagaagggcgccgacgtgaatgcttctgacaactatcaacggaccgctctgattctggcggtgtcaggtgagccaccctgcctggtgaaattgcttctacaacagggagtcgagctgtgctatgaggggatcgtggattcccagcttaggaatatgttcatcagtatggttctgctccatcgctatccacagtttacggcgagccatggcaaaaaaaagcacgccaagtag

SEQ ID NO: 108320 - DNA, 942 bp, Artificial Sequence
  Description of Artificial Sequence: Synthetic coding sequence
atggacacctcaacaaacctggatattggggcacaacttatcgttgaggagtgcccttctacctactcactcacaggtatgcctgacatcaaaatagaacatcctctggatccgaattcggaagaggggagcgcgcaaggtgtcgcaatgggaatgaagtttattcttccaaatagattcgatatgaatgtctgttccaggttcgtcaagtcgctgaacgaggaggatagcaagaacatccaggatcaagtgaatagcgatcttgaggtcgcaagcgtgctttttaaggccgagtgtaacatccatacgtctccatctcctggcatccaggtccggcacgtctacacgccatccaccacaaagcactttagtcctatcaaacagtcaactacactcacgaataagcaccggggaaacgaggtcagtaccactccattactggcaaacagcctgagcgtgcatcagctggccgctcagggcgaaatgctttatctggccactagaattgagcaggagaatgtgattaatcacaccgatgaggagggtttcacaccactgatgtgggccgctgcccacgggcaaattgcagtggttgagttcttgctgcagaacggcgcagacccacagttactggggaaagggcgagagtcagctttgtcactggcatgtagcaagggatatactgatatcgttaagatgcttctggactgcggcgtagatgtcaacgagtacgattggaacggtggtactcctctcctgtatgcagttcatgggaatcatgttaagtgtgtgaagatgttactcgagtctggcgctgaccccaccattgagacggactccggatataattccatggacctcgcggtggctttgggttatagaagcgtgcagcaggtgatcgagtcccacctccttaaactcctgcagaacattaaagaatag

SEQ ID NO: 108321 - DNA, 1428 bp, Artificial Sequence
  Description of Artificial Sequence: Synthetic coding sequence
atggctgctagtgccttgaggggactacctgtggcaggcggtggcgagtcatcagaatccgaagacgatggctgggaaatcggctatctagatcggacatcgcagaaactgaagcgcctgctaccgatcgaagagaagaaggagaaattcaagaaagctatgacaattggcgacgtgagtctcgtccaggaattactggattcaggcataagtgtggacagtaattttcagtacgggtggacacctctgatgtacgccgcctccgttgcgaatgccgagctggttcgcgttttactggataggggggctaacgccagcttcgagaaagacaagcagtccatcctgatcacggcgtgctctgctcacggctcagaagagcagattctcaagtgtgtcgagctgctgctgtctcggaatgctgacccgaacgttgcatgccggcgcctgatgacccccattatgtatgcagcccgcgatggccatacccaggtagttgccctgctagtcgcacatggggcggaggtgaatacacaagatgagaacggatataccgcactcacttgggctgcacgacagggccacaagaacattgtgctaaagctgctcgaactgggggccaataagatgttacagaccaaggatgggaaaatgccatctgagattgccaaacggaataaacatcatgaaatctttaacctgctgtcattcactctcaaccctctagagggtaaactgcagcaactcacgaaagaagacaccatctgcaaaatcttgacgactgattcagaccgcgaaaaggatcatatcttttctagctacaccgcattcggagacctggaggtcttcctgcacggcttagggctcgaacacatgaccgacctgcttaaggagagggatatcacactgcgacacctcctgactatgcgcgaggacgagtttacaaagaacggcatcacgtccaaggatcaacagaagatcctcgccgccttaaaggagctgcaggtggaggaaatccagttcggggagctctcggaagagaccaagctggagatttcaggcgacgaattcctcaacttcctgttaaagctgaataaacagtgtggtcatctgatcacagcggtccagaatgttatcacagagctgcccgtgaatagccaaaagatcaccctggagtgggcgtcaccacagaatttcacctctgtgtgtgaggagctggtgaacaatgtcgaagatctctctgagaaggtgtgtaaactcaaggatttgatccagaagctgcagaatgagagggaaaacgacccaactcatatccagctgcgcgaagaagtctccacctggaatagccgcatactcaagagaacagccattaccatttgtggctttggctttctcttgttcatctgcaagttgacctttcagagaaagtag

SEQ ID NO: 108322 - DNA, 1041 bp, Artificial Sequence
  Description of Artificial Sequence: Synthetic coding sequence
atggccatggtctcagagttcctcaaacaggcatggtttattgaaaacgaagagcaggaatatgtgcagacggtgaagtcatccaagggcgggcccggtagcgccgtgtccccttatccaaccttcaatcctagctctgacgtggcggctcttcacaaggctataatggtgaaaggggtggacgaggccactatcatcgatattctcaccaagcgcaacaatgcacaacggcaacagattaaagcagcctacctgcaggagactggcaagcctttagatgagacactcaagaaggcactcaccggccacctggaagaggtggtgttagccttactgaaaaccccagctcaattcgacgccgatgagctgagagctgcgatgaagggattaggcactgatgaggacactctgatcgaaattctggcaagcagaacgaacaaggagattcgggatattaatagagtgtacagagaggagctgaagagagacctggccaaggacattacatccgatactagcggagactttcgcaatgctctgctcagcctggctaagggggatcgatccgaggattttggcgtcaacgaggatctggcggattctgatgcaagggctctctatgaggccggagaaagacggaaagggacagacgtgaacgtttttaacaccatactgacaactagatcctacccacagcttcggagggtttttcagaagtatactaagtactccaagcatgacatgaacaaagtgctagacctagaactgaagggcgacattgaaaagtgcttgaccgcgattgtgaagtgcgcaacaagcaagccagccttcttcgcggagaagctgcatcaggcaatgaagggggtgggaactaggcacaaagctctaattcggataatggtctctcgtagcgagatcgatatgaatgatatcaaggccttctaccagaagatgtatggcatctccctctgccaggcgatcttggacgaaactaaaggcgactacgaaaaaattctcgtggcactatgcggcggaaattag

SEQ ID NO: 108323 - DNA, 1041 bp, Artificial Sequence
  Description of Artificial Sequence: Synthetic coding sequence
atggccatggtatcagaattcttaaagcaggcctggtttatcgaaaacgaggagcaggaatacgtgcagacagtcaagtcctcaaaaggggggccaggaagcgctgtgagtccctaccctaccttcaacccaagttccgatgttgccgccttgcataaggctattatggtcaaaggtgtcgatgaagctaccatcattgatatactcacaaagcgtaacaacgcgcagagacaacagataaaagccgcctacttacaagagacggggaagccattagatgagacactgaagaaggccctgaccgggcacctggaagaggtcgtactggctctcctcaaaacccctgcacagttcgatgcagatgaattaagagccgcgatgaaaggcctgggaactgatgaggatactttaatcgagattctcgcatcccgtacaaataaggagataagagacatcaatcgagtctatagagaggagctgaagcgtgatctcgccaaggatataacaagtgacaccagcggcgattttcgtaatgctcttctgtctctggcgaagggagatcgatccgaagattttggagtcaatgaggacctagcggattctgatgcaagggccctttatgaggcaggagaacggcggaagggcaccgatgtcaatgtcttcaataccatcctgacgacgcggagctatcctcaactccggcgggttttccagaaatatacaaaatactccaaacacgatatgaataaggtgctggatttggaactgaagggcgacatcgagaagtgtcttaccgctatcgtgaagtgcgctacaagcaaaccagcctttttcgctgaaaagcttcatcaggcgatgaagggagtgggcactaggcacaaagccctgattcgcatcatggtgtcacggtctgagattgatatgaatgacatcaaagctttctaccagaaaatgtacggtatatccctatgtcaagccatcctggatgagaccaaaggggactatgaaaaaatcttagttgccctgtgtggcgggaattag

SEQ ID NO: 108324 - DNA, 348 bp, Artificial Sequence
  Description of Artificial Sequence: Synthetic coding sequence
atggccatggtgtcggaattcctcaagcaggcctggtttattgagaacgaggagcaagaatacgtgcaaaccgtgaaaagctctaaaggcggaccaggatctgctgtctccccctaccccacctttaatccctcttcagacgtcgccgctctccacaaagcaatcatggtgaagggcgtggacgaggcaaccatcattgatatcttaaccaagcgcaacaacgcgcaaaggcagcagatcaaggctgcgtacctgcaggagacaggcaaaccgctagatgagactctgaagaaggccttgacaggccaccttgaggaagtagtgttagccctgctaaaaaccccgtag

SEQ ID NO: 108325 - DNA, 615 bp, Artificial Sequence
  Description of Artificial Sequence: Synthetic coding sequence
atgaatctaatccttcggtacacattctccaagatggcaatggtctctgaatttttgaagcaggcctggtttatcgaaaatgaggaacaggaatatgtacagaccgtgaagtccagtaaaggaggcccaggaagcgctgtgtccccatatccaacgtttaacccctcttcagacgtggctgctttacacaaagcaattatggtcaagggcgtggatgaggcaacaattattgatattctcaccaaaaggaataatgcccagagacaacaaataaaggcagcgtatttgcaggaaactggcaaaccattagacgagaccctcaaaaaagcactaacaggacacttggaggaggttgtgctcgcgttgctgaagacccctgcccaatttgatgccgacgaactgcgcgctgccatgaagggcttaggcactgacgaggacacactgatcgagattttggcctccagaacaaataaggagattcgtgacataaatcgggtctaccgcgaagagctgaagagggacctggcaaaggatatcacgtccgatacttcaggtgacttcagaaacgctcttctgtccctcgcgaaaggagaccggtccgaagactttggatag

SEQ ID NO: 108326 - DNA, 975 bp, Artificial Sequence
  Description of Artificial Sequence: Synthetic coding sequence
atgttttgtggcgactacgttcagggaaccatattcccagcacctaacttcaaccctataatggatgctcagatgctgggtggcgccctccagggctttgattgcgacaaggacatgttaatcaacatcctgacccagcgatgtaatgcccagcggatgatgatcgctgaagcttatcagagtatgtacgggcgcgatctaattggtgacatgagggagcagttatctgatcattttaaagacgtgatggccggccttatgtatcctccgccgctttatgatgcccacgagctctggcatgccatgaaaggggtgggcactgatgagaattgtctcattgagattttggcctctcgcacaaacggtgagatttttcagatgagggaagcgtactgcctacagtacagtaataatctgcaggaagatatatactcagaaacctctggccatttccgcgataccctgatgaacctggtccagggcactagggaggaaggatacactgatcccgcaatggccgcacaggatgccatggtgctttgggaggcttgccagcagaagaccggcgagcataagacaatgcttcaaatgattttgtgtaacaagtcataccagcagctcaggctagtgtttcaggaattccagaatatttctggccaggatatggtggacgctataaacgagtgctacgatggctatttccaggagctgctggttgctatcgtgctgtgcgttcgagacaaacctgcgtacttcgcctatcggctttacagcgccatccacgactttggatttcataacaaaaccgtgatccgaatccttatagctcggtccgagattgatcttctaactataaggaaacggtataaggaacgctacggcaagtcgttgtttcacgatatccggaacttcgccagcgggcactacaagaaggcacttttggcgatctgcgcgggagacgcagaagattactag

SEQ ID NO: 108327 - DNA, 975 bp, Artificial Sequence
  Description of Artificial Sequence: Synthetic coding sequence
atgttctgcagtaatctggtacagggtaccattttccccgctcctaactttaaccctatcatggatgcgcagatgttgggcggggccctgcaaggtttcgattgtgataaagacatgctcatcaacatcctcacacagcgatgcaacgcccagcggatgatgatagcggaggcctatcagtcaatgtatgggcgagaccttattggggatatgcgagaacagctaagtgaccactttaaagatgtgatggctgggctgatgtaccctccaccgttatacgacgcgcatgagctctggcatgccatgaagggagttgggaccgacgagaactgcctgatcgaaatcctggccagccggaccaacggagagatctttcagatgcgagaggcttactgtctgcaatactcgaataatctacaagaggacatctacagcgaaacttctggccacttcagggacactctaatgaaccttgtccaggggacacgggaggagggctacacagatccggccatggcagcccaagacgcgatggtattatgggaagcctgtcagcagaaaactggggagcacaagaccatgctgcagatgatactctgcaacaaatcttaccagcaattacgactcgtctttcaggaatttcaaaacatcagcggacaagacatggttgatgcgatcaacgagtgctacgacggctactttcaggaactactggtagctatcgtgctgtgcgttcgggacaagcctgcttactttgcatataggttatacagtgccattcacgattttggcttccacaataagaccgtcattcggattcttatcgcacggtccgaaattgacttgttaacaatccgcaaacggtataaagagcgatacggcaaatcccttttccacgacatccgcaattttgcgtcaggtcattacaaaaaggccctgctggccatatgtgctggtgatgccgaggactactag

SEQ ID NO: 108328 - DNA, 1518 bp, Artificial Sequence
  Description of Artificial Sequence: Synthetic coding sequence
atgtcctatccaggatatcctccccctccaggcggatacccaccagccgcaccaggcggcggcccctggggcggcgccgcttacccccctcccccgtccatgccacctatcggcctggacaacgtggccacttatgccggccagttcaatcaggactacctgagcggaatggccgccaatatgagcggaaccttcgggggggctaacatgcccaacctgtacccaggcgcgccaggggccggctaccctccagtcccccctggggggttcggccagcccccatcagcacagcaaccagtgcccccgtacggaatgtatcccccacccgggggaaaccccccatcaaggatgccaagctatccgccttaccccggggctcccgtgcccggccagcctatgccgcctcctggtcagcagccccctggggcttacccaggtcagccgcctgtgacctacccaggccagcctccagtacccctcccagggcagcaacagcccgtgcccagttatcctggctatccggggtcaggtacggtgacacctgccgtacctcctactcaatttggctcacgaggcacaattaccgacgcccccggattcgatccattgcgagacgccgaggttctcaggaaggccatgaaaggtttcggcaccgatgaacaggcgatcatagattgcctagggagccgaagcaataagcagcgacaacagattctgctttctttcaaaaccgcttatgggaaagacctgatcaaagatctgaaatcagagctatccgggaacttcgagaagacaatcctcgccttgatgaagacgccagtgctgttcgatatatacgaaatcaaggaggctatcaagggggtgggaactgatgaggcatgtctgattgaaattctagctagtagaagcaatgagcacattcgcgagctaaatagagcctacaaggccgaattcaaaaagaccctggaggaggccatccggtccgacaccagcgggcatttccaaaggttactcataagcctgagccagggcaatagagatgagtccactaacgtagatatgagcctggcgcagagagacgctcaggagctctatgcagctggagagaaccgcttaggcacggacgagagcaaattcaatgcagtgttatgctcccgctcgagggcccacctagttgccgtgtttaacgaatatcagaggatgacagggcgtgatatagagaagtctatctgcagggaaatgtcgggggatttggaagagggcatgttagccgtggtgaaatgtcttaaaaacactccggctttttttgccgaacggctgaacaaagctatgcggggcgctgggactaaggacaggaccttaatacgaattatggtgtcaaggagcgaaacagatcttctcgacatccggtctgaatacaagaggatgtacggcaagagtctgtaccacgacatctccggcgatacatccggtgactaccggaagatcctcttaaaaatatgcggcgggaacgattag

SEQ ID NO: 108329 - DNA, 1518 bp, Artificial Sequence
  Description of Artificial Sequence: Synthetic coding sequence
atgtcctatcccggatacccccccccacccggaggataccctcctgcagctcctgggggtggaccctggggaggtgctgcctatcccccacccccgagcatgccacctatagggttggataatgttgccacctatgcagggcagtttaatcaggattatttgtcaggaatggccgctaatatgtcaggtaccttcggaggggcgaatatgcccaacctgtaccctggagccccaggagctggatatccgcccgtgcccccaggaggattcggacaacccccaagtgcccaacaacctgtacccccttacggtatgtatccccctccaggagggaaccctccatcccgaatgccctcctatccaccctacccaggggcgccagtgcccggacaaccgatgccccccccgggtcagcagcctcccggtgcatatcccgggcagcctccagttacgtaccccgggcagccaccagttccactgccaggacagcagcagcccgttccaagttatccggggtaccccggatctggcaccgtcactcccgcagtcccaccaacccagttcggctcaagagggaccatcaccgatgccccaggcttcgacccccttagggatgctgaagttctgagaaaagcgatgaagggcttcggcaccgatgaacaggcgattatcgattgtcttggtagcagatcaaacaagcagcggcaacagattttgttgagctttaaaacggcgtacggtaaggatctcatcaaggatctgaagtctgagctgagcggcaatttcgaaaagacaatattagccctgatgaaaaccccagtccttttcgacatctatgaaattaaggaggccattaagggcgttggtaccgacgaggcctgccttattgagatactggcttctcgaagcaacgagcacatcagggaacttaatagagcctacaaggcagagttcaagaagaccttggaagaggctatacgctcagatactagcggccactttcagcgattgctcataagtctctcacagggaaacagagatgaatctactaatgtggatatgagtttagcgcagcgcgatgcacaggagctctacgccgccggcgagaaccggctcggtacagacgagagcaagttcaatgccgtactctgttcacgaagcagggctcacctggtggcagtgtttaacgagtatcagaggatgaccggtcgggacatcgaaaaaagcatctgtagagaaatgtccggggatcttgaagagggtatgctggcagttgttaaatgcttgaagaatacccctgcctttttcgctgagagactgaacaaggcaatgaggggggctggaactaaggacagaactctcatcaggattatggtcagccgcagcgaaaccgatctgctcgacataaggagtgagtataaaaggatgtatggcaaaagcctttatcacgatatttcgggtgatacatccggggattatcggaaaatcttactgaagatttgtggaggaaacgattag

SEQ ID NO: 108330 - DNA, 489 bp, Artificial Sequence
  Description of Artificial Sequence: Synthetic coding sequence
atgtctttggctcaacgagacgcgcaggaattatacgctgcgggcgaaaaccgccttggaaccgatgagtccaagttcaacgctgtgctttgtagtcgcagtagagcacaccttgtcgcagtgttcaatgagtaccaacgtatgacaggcagagatatcgagaagtcaatatgtagagaaatgagcggcgacctggaagaggggatgctggcagtagtgaagtgcctgaaaaacactcccgccttttttgccgaaagattgaataaagccatgaggggcgctggtacaaaggacagaacattgatcaggataatggtctcccggagtgaaacagacctcctggatatccgctccgagtataagaggatgtacgggaagtcactgtaccacgatatctcttcaattagttgcatgcccgcttcatatggtcatctggaagaggcaacatgcctggcattaaaactgctgcgagtggaggggaatgattag

SEQ ID NO: 108331 - DNA, 1518 bp, Artificial Sequence
  Description of Artificial Sequence: Synthetic coding sequence
atgagttatcccgggtatcctcccccccctggcggctatccgcctgcagccccgggcgggggcccctggggaggtgcagcctatcctccgccgccaagcatgcctcccattggactagataatgtggccacctatgccggacagttcaaccaggattatctctctggtatggccgcgaacatgtccggtacattcggtggcgccaatatgccaaatctctatcctggcgctcccggcgctgggtatcccccagtgccgccgggggggttcggtcagccgcctagcgctcagcagcctgtgcctccatacggtatgtaccccccccctgggggcaacccgccaagccgtatgccaagctacccaccttatcccggcgctccggtgcctggccagcccatgccaccccctggccaacagcctcccggcgcctatccaggccaaccacccgtaacatacccggggcagccacctgttccactgccaggtcagcaacagcccgtaccgtcataccccggctaccccggatccggtactgtgacgccagccgtgcctccaacgcaattcggaagccgcggcaccatcaccgacgctccagggttcgatccgttgcgcgacgccgaggtgctgcgcaaggcgatgaagggattcggaaccgatgagcaggcaatcatcgattgcttgggttcaagatcaaacaagcaacgacagcagatcctgctgtctttcaagaccgcctatggaaaggacctgataaaggacctgaagtctgagttgtccgggaactttgagaaaacaatcctggccctaatgaagactccggtactgttcgacatttacgagataaaagaagcaattaagggagtgggaaccgatgaggcctgtctgattgagatactggcctcccgctctaacgagcatatccgagagctgaaccgagcctacaaggccgagttcaagaaaacactggaggaggctattaggagtgatacatcagggcactttcaaagactgctaataagcctttcccaagggaaccgggacgaaagcactaacgttgacatgtctctcgcccaacgggacgcgcaagagttatacgccgcgggagaaaaccgtctaggtaccgatgagagcaagttcaatgctgtgctttgttcccgttctcgcgcccatcttgtcgcagtgtttaatgaataccagcgcatgaccgggagagatattgagaagtccatctgccgggagatgtccggagatttagaggagggcatgcttgcggtggtcaaatgcttaaagaacacccctgcattttttgccgaacggcttaacaaggccatgcgaggtgccggtactaaagaccggacactcatccgcatcatggtgtcccgcagtgaaacagatttattggacatccggtccgaatacaagaggatgtatggcaagtcactctaccacgacattagtggtgatacttccggcgattatagaaaaattctgctcaaaatctgcggaggaaatgattag

SEQ ID NO: 108332 - DNA, 1518 bp, Artificial Sequence
  Description of Artificial Sequence: Synthetic coding sequence
atgtcctacccagggtacccccccccgccgggcggctatccccccgctgcccccgggggcggcccatgggggggagcggcctaccctcccccacctagcatgcctccgattgggctcgacaacgtagcgacttacgccggacagttcaatcaggattatctgagtggtatggccgccaacatgagtgggactttcggcggagccaacatgcccaacctatacccaggggctccaggggccgggtatccacctgttccccccggcgggttcggtcagcccccttccgcacaacagcccgtgcccccttacgggatgtatcccccaccgggcggtaatccccctagtcggatgccctcttatcccccttatccaggcgccccagttccaggccagcctatgcctccgcctgggcagcagccccccggagcctaccccggtcaacccccagtaacataccccggtcagccgcctgtgcctctccctggccagcagcaacctgtgcccagttatcctgggtaccccggaagcgggactgtgaccccagccgtcccccctacccagttcggctcaagagggaccattacagatgctcccggcttcgaccctctccgggacgccgaggtgctccgtaaagcaatgaaagggtttggaaccgatgagcaggccatcattgattgtttggggagtcgtagtaataaacagcgacagcagattcttctcagtttcaagacagcttatgggaaagacctgatcaaggaccttaagagtgagctgtctggaaatttcgagaagaccattctcgctctcatgaagacacccgtgttgtttgacatatatgagatcaaagaagcaatcaaaggggtgggtacagatgaggcctgcttgatcgagatccttgctagtaggtctaacgagcacatccgcgagctgaatagagcctacaaggcagagtttaaaaagactctggaggaagccatacggagcgacacttccggccattttcagagactcctgatctctctttctcagggcaatagagatgagagcacaaacgtcgatatgagcctggcccagcgtgacgcacaggagctgtatgctgcaggagagaaccgcctggggacagatgaaagcaaattcaatgctgtcctgtgctccaggtcacgggcacatctggtagcagtgttcaacgaatatcagaggatgactggtagagacattgaaaagtcaatatgccgcgagatgtctggagacttagaggagggcatgttggcagttgtcaaatgtctcaaaaataccccagccttcttcgcagaaagactgaataaagccatgcggggagccggcacaaaggatcggaccctgatccgcatcatggtttcacgctccgagaccgatctcctggacattcgttccgagtataaacgcatgtacggcaagtcactctaccatgacatttccggcgatactagcggggattacaggaaaatcttactgaaaatctgcgggggcaacgactag

SEQ ID NO: 108333 - DNA, 1518 bp, Artificial Sequence
  Description of Artificial Sequence: Synthetic coding sequence
atgagctacccgggttaccctcccccacccgggggctatccccccgccgcgccaggcggagggccatggggaggagccgcgtaccctcctcctcccagtatgccgcccatcggcctggataatgtggccacctacgcggggcagtttaatcaggactacctcagcggaatggctgctaatatgtccggcacctttgggggcgccaatatgcccaatttgtacccaggagctcccggagctgggtatcctccagttcctcctggaggattcgggcaaccccccagcgcacaacaacctgttcccccgtatgggatgtacccaccacctggaggaaacccgccctcacgaatgccctcctaccccccttacccaggcgcccccgtccctggacaacccatgccaccccccggccaacaaccgccaggagcctacccgggacagcctccagtaacctaccccggtcaaccccctgttccattacctggccagcaacagccagtccctagttatccagggtatcctggatccggaaccgtcactcccgcagtgccccccacccagtttggctcacggggcaccatcacggatgcgcctgggtttgatccactgagagatgccgaggtgctaagaaaggccatgaaggggttcggtaccgatgaacaggccatcatagattgcctggggtcacggtctaataagcagcgacagcagatcctgctttccttcaaaactgcttatggcaaggacctaattaaggacctcaagtcagagctgagcggtaacttcgagaagactattctggccctgatgaaaacccctgtcctgtttgacatttatgagataaaagaagcaattaagggagttgggaccgacgaggcctgtttaatagagattctagctagtcggtccaacgagcacatccgcgaactaaatcgcgcatacaaagctgagttcaaaaaaaccctggaggaagcaattcggtctgacacatcgggccattttcaaagactactgatctcacttagccaggggaacagagatgaaagcaccaatgtagatatgtctcttgctcagcgcgatgcccaggagctgtatgccgctggagaaaacagactcggcaccgacgaatccaaattcaatgcggtgttatgcagccggtcacgcgctcatctcgtggctgtgttcaacgagtaccagcgcatgactgggagagatattgagaagagcatatgcagagagatgtcaggggacctggaagagggaatgcttgccgttgtgaagtgtcttaaaaacacacccgctttcttcgccgagaggctgaacaaggcaatgcggggagctggaactaaggacaggactctgattcgtatcatggtgtcacggtccgaaacggacctgcttgatattcgcagcgaatataaacgtatgtatggaaagagtctttatcacgatatttccggagatacttccggcgactataggaagatactgctgaaaatttgtggaggaaacgattag

SEQ ID NO: 108334 - DNA, 1239 bp, Artificial Sequence
  Description of Artificial Sequence: Synthetic coding sequence
atgcgaggctcatctacacggaccatcagccgagagtgctggcgcctctgggccgctcctctgtgccccgccgcttgcagcagcctgtgggatgtcagcactccgaggaggaagccgaccctgcaggatgccctcatttctgccataccgtaccccggccaacctcccgtcacatacccaggccagcccccagtgcccttacccggccagcaacaaccagtcccatcatacccgggttaccctgggtccggaacagttactccagccgtaccccctactcagtttggcagtaggggaaccatcacggatgcacccggtttcgaccctctgagagacgccgaagtcttgcgtaaggcaatgaagggttttggaacagacgagcaggcgatcattgactgcctagggagtcggagcaataaacaacgccagcagatcctgttgtccttcaaaaccgcttatggaaaagacctcatcaaggacctgaaatctgaactgagcggcaactttgagaaaacgatcctggctctgatgaaaacgcctgtgttattcgacatttacgagattaaggaggcgattaagggcgtcggcaccgatgaagcatgcctgattgaaatcctggcaagccgaagtaatgagcacataagagaacttaatagggcttataaggcagaattcaaaaagacactggaagaggctattcgatccgacacgtccggccattttcagagacttctcatttcactaagccagggcaacagagacgaatctacaaatgtcgatatgagtctcgcccagcgcgatgcacaggagctctacgcggctggggagaatcgtctcgggaccgacgaaagtaagttcaacgccgtgctgtgctctcggagccgagctcacctggtagctgtttttaatgagtaccagcgaatgacagggcgggacattgaaaagagtatctgccgggaaatgagtggtgacctcgaagagggcatgttggcagtcgtgaaatgtctaaaaaacactccagcctttttcgccgaacgacttaataaagcaatgcgtggggcaggtaccaaagataggaccctgatccgcattatggtgagccgaagtgaaacggacctgctggatattaggagcgagtataagcgtatgtatggaaagtctctttatcatgatattagtggggatactagtggcgattacagaaaaatattgctaaaaatctgtggggggaacgattag

SEQ ID NO: 108335 - DNA, 453 bp, Artificial Sequence
  Description of Artificial Sequence: Synthetic coding sequence
atgagttacccaggctaccctcctccccccggaggctatccacccgcagctcctggtggaggcccgtggggaggcgcagcttatcctccacctccatccatgcctccgatcggactggataacgtcgctacctatgcaggccaattcaatcaggactatttaagcggcatggccgccaacatgtcaggaacatttggaggggctaacatgcctaacttatacccaggggcgcccggagcaggatacccacccgttcctcccgggggatttggtcagccccctagcgcacaacagccagtgccaccatatgggatgtacccgccaccaggaggcaatcccccctcccgcatgccctcttacccaccatatccaggagcacccgtacctggccagccaatgcctccacccggacagcaaccacccggcgcctacccaggtcaaccgcctgtgtag

SEQ ID NO: 108336 - DNA, 1518 bp, Artificial Sequence
  Description of Artificial Sequence: Synthetic coding sequence
atgagttaccctggctatccacctccaccaggcggttatcctccggccgctccaggtggcggcccctggggaggagcagcataccctccacctccaagtatgccacccattggcttggataatgttgctacatacgccggacagttcaatcaagactacttatccggaatggctgcgaatatgtcgggaacattcggtggagccaacatgccgaatctgtacccaggcgcgccgggcgcaggatatccacccgtcccacctggtgggtttggccaaccccccagcgcccagcagccagtgcccccctacggaatgtaccccccccccggtggcaaccctcctagccgcatgcctagttacccaccctacccaggagctccagtgcccggccagccaatgcctcccccggggcagcaacctcctggagcctatcctggtcaacctcctgttacctaccccggccaaccacctgtcccccttcctggacagcagcaaccagtaccaagctacccaggatatccagggagcgggaccgtgactcccgcagtacctcctacccaatttggcagcaggggcacaataactgacgcccccggcttcgacccacttcgagatgccgaagtattgaggaaggctatgaaagggttcggaactgatgagcaagccattatcgattgtctgggatctaggagcaataaacagaggcagcagattttactttctttcaagaccgcctacggcaaggacttaatcaaggacctgaagtccgagctgtccgggaatttcgaaaaaacgattctggccttgatgaaaactccagtgctgttcgatatatatgaaattaaagaggctatcaagggcgtgggcaccgatgaagcatgcctaatcgagatcctggcttctagaagcaatgaacacatcagggaactgaacagggcctacaaagccgagttcaagaaaacactcgaagaagccatccgatccgatactagcgggcacttccagagactgctgatctctctaagccaaggcaatcgggacgagagcactaatgtcgacatgtcattggcccagcgggacgctcaggaactatacgccgctggagaaaaccgacttggtacagacgagagcaagtttaatgcagtgctctgtagccgctcccgggcccaccttgtggccgttttcaacgagtatcagcgcatgaccggccgggacatcgagaagtccatttgtagagagatgagtggagacctcgaagagggcatgctggcagtcgtaaagtgcttaaagaacactccagcattctttgccgagagattgaacaaagccatgcgtggagccggaaccaaagatcggacgctaatccgcattatggtgagtcggtctgaaacagacctgctcgacataagatccgagtacaaaaggatgtatggcaaaagcctttaccacgacatcagtggggacactagtggggactatcgtaagattctcctgaagatatgcggcggtaatgattag

SEQ ID NO: 108337 - DNA, 615 bp, Artificial Sequence
  Description of Artificial Sequence: Synthetic coding sequence
atgtcttaccctggctacccccctccaccgggtggctacccaccagctgcccccggtggaggtccatgggggggagccgcatacccacccccgccgtcgatgcccccaatcgggcttgataacgtggcgacctacgctggtcaattcaaccaggattacttgtccggcatggctgctaacatgtctggaacgttcggtggagccaacatgcccaacctttaccccggggccccaggagccgggtatccccctgtgccccctggtggatttggccagccgccctccgcccagcaacctgtccctccatacgggatgtaccccccacccggaggcaacccacccagccggatgccttcctatcccccctacccaggcgcaccagtccctggccaaccgatgccacctccagggcagcagccaccgggagcttatccaggacaaccaccggtgacctacccaggccagccaccggtcccattgcccggtcagcagcagcctgtgccatcttatcctggatatccaggaagcggtaccgttaccccagcagtgccgccaactcaattcggatcccgcggcaccataacagacgctcccggcttcgatccactccggtag

SEQ ID NO: 108338 - DNA, 447 bp, Artificial Sequence
  Description of Artificial Sequence: Synthetic coding sequence
tgagagaaccgactcggaacagatgagagcaagttcaacgctgtcctgtgtagcagaagccgcgcccacctagtggcggtgtttaacgaataccagcgcatgacgggcagagacattgagaagtctatctgtagggagatgtctggcgacctggaggagggcatgttagctgtcgtcaaatgccttaagaacaccccggcattttttgccgagagattgaataaagccatgaggggagcgggcaccaaggatcggaccctcatccgcatcatggtttcaagaagtgagaccgatctcctggacattagatcagagtataagcggatgtatggcaagagtctatatcatgatatttcaagcatcagttgcatgccagcctcctacgggcacctagaagaagccacatgtctggctttaaagctgctgagggtggaaggaaacgactag

SEQ ID NO: 108339 - DNA, 1518 bp, Artificial Sequence
  Description of Artificial Sequence: Synthetic coding sequence
atgagctatccaggatatcctcccccacctggagggtatccccctgcagctccaggaggaggcccgtggggcggcgcagcttacccgcccccgccatcgatgcctcccattggtctggataatgtggcgacctacgccgggcagttcaaccaggattatctctccgggatggccgcaaacatgtccggcactttcggcggggcaaacatgcctaacttataccccggggcccccggggcaggataccccccagttccaccaggagggtttggacagccgccatccgcacagcagcctgtcccgccatacgggatgtaccccccccccggcggcaacccccctagtcggatgccttcctacccgccttaccccggggcccctgtccctggtcagccaatgcccccaccaggtcagcaaccaccgggggcgtaccccggtcaacctcccgtcacttaccctggtcaaccacctgtgccactgcccgggcagcagcagccggtccctagctaccccggctaccctggaagcggcacagtgacaccagccgtaccgcccacacagttcggttctagaggaaccatcactgatgccccaggttttgatcccctgagggatgcagaggtgctccgaaaggcaatgaaaggtttcgggaccgatgagcaagcgatcatcgattgcctcggctcaaggtccaataagcaacggcagcagatcctgctcagcttcaaaacggcatatggcaaggatttaattaaggacctcaagagcgagctaagcgggaacttcgagaagacgatcctggctctgatgaagacaccagtcctatttgacatctatgagatcaaagaggcgattaaaggggtgggtacggatgaagcctgcctgatagagatcctggcaagtcgcagcaacgaacacataagggaactgaatagggcatataaggctgaattcaaaaagaccttggaggaagcaatccgatccgatacaagcgggcacttccagcgactgctgatctctctgtcacaaggtaatcgcgacgaaagtaccaacgtggacatgagcctggcccagagagacgcccaggaactgtacgccgccggggaaaatcgcctgggcaccgatgaatctaagttcaatgcagttttgtgttccagatcaagggcccacttagtggctgtatttaatgagtatcagcgtatgacaggtagggatattgagaaatctatctgtcgggaaatgtcaggggacctggaggagggaatgctggcagtcgttaagtgtcttaagaatacccccgctttttttgctgagagactgaataaggctatgcgtggagccggtacgaaagacaggacattgatccggattatggtttcccgcagcgaaacagatcttttagatatacgttctgagtataagaggatgtatggcaaatccctgtatcacgatatcagtggcgatacatccggcgactatagaaagatcttgctgaaaatctgtggaggaaacgattag

SEQ ID NO: 108340 - DNA, 1419 bp, Artificial Sequence
  Description of Artificial Sequence: Synthetic coding sequence
atgccacccattggcttagacaacgtcgcaacctatgcaggccaattcaaccaggactacctgtccgggatggctgcgaacatgagtggcaccttcggtggagccaacatgcctaacctctaccccggagctcctggcgctgggtatcctcccgtccctccaggtggcttcggtcagcctcccagcgcgcaacaacccgtgcccccgtacggaatgtaccccccaccaggaggcaaccccccctcaaggatgcctagttacccgccttatccgggcgcccctgtgcctggccagccaatgccacctcccggccagcagccccccggcgcataccccggccagccaccagtcacctatccagggcagcctcccgtgccgctcccaggtcagcagcagccagtcccctcgtatcctggttaccccggtagcggcacagtcaccccagcggttccaccaacccagtttggcagtagaggcactattacagatgcacctggcttcgacccacttagggacgccgaggtgctgcgaaaagccatgaagggattcggaacagacgaacaggcgattattgactgtctggggagccgatctaataaacagcgacagcagatcctcctttctttcaaaaccgcttacggcaaagaccttatcaaagacttgaagtcagaactgtccggtaattttgagaagaccatacttgccctgatgaaaacccctgtcctttttgacatctatgaaattaaagaagctattaagggcgttggcaccgatgaagcgtgtctgatagagattctcgcaagccgtagtaacgaacacatcagggagctgaaccgtgcgtacaaggccgaattcaagaaaactttggaagaggcaatcagatccgacacctcggggcattttcagaggctcctgataagtcttagccaaggaaatcgagacgagagcacaaatgtcgatatgagcctcgcgcagagggatgcccaggaactctatgcagcaggggagaacaggttaggaaccgacgagtcgaagtttaacgccgtcctctgctccagatcccgggcccatctcgttgcagtgttcaatgagtatcagaggatgacgggacgtgatattgagaaatcgatctgcagagagatgagtggggacttagaagagggaatgctggctgtggtgaagtgtctgaagaatacccctgcattctttgctgagagactcaacaaggcgatgagaggtgccggtaccaaagatcgaacactgattcgtataatggtctctcggagcgaaaccgatttactggacataaggtccgagtataaacggatgtatgggaaaagtctgtaccatgatatctccggagatacctctggagactaccgcaaaatcctccttaaaatatgcggcggcaatgactag

SEQ ID NO: 108341 - DNA, 1074 bp, Artificial Sequence
  Description of Artificial Sequence: Synthetic coding sequence
atggggcgacaattagcgggttgtggcgatgccggcaaaaaagccagttttaaaatgtctaccgtgcacgagatcctttgtaagttatcgcttgagggcgaccacagcacgccgcccagtgcttatggatctgtgaaggcgtataccaactttgacgccgagcgagacgctctgaacattgagacagctattaaaaccaagggagttgacgaagtcacaatagtgaacatcctgactaatcgttctaacgcacaacggcaggacatcgcttttgcatatcagcgcaggacaaaaaaggaactggcttccgccctgaaaagcgccctgtccggccatctcgagactgttattcttggactgttgaagacccccgcacagtatgatgcctccgaactgaaagctagcatgaagggactaggcactgacgaagatagcttgattgagattatatgttcacgcaccaaccaggaacttcaagaaatcaacagagtctacaaagagatgtacaaaaccgatctagagaaggacattattagcgacacctctggagatttcagaaaactgatggtggccctggccaaaggccgacgggctgaggatggctctgttatcgattatgagcttatagaccaggacgcccgcgatctgtatgacgctggagttaagaggaaagggacagacgttccaaaatggatctccattatgaccgaacgctccgtgcctcatctccagaaggtcttcgatcgttacaagtcttactccccatacgacatgctcgaatctattcgaaaagaagtcaaaggcgacttggagaacgcatttctcaacctcgtgcagtgtattcaaaataagcccttgtactttgccgataggctgtacgactcaatgaagggtaaaggcacacgcgacaaggtgttgattagaataatggtgtccaggtctgaggtggacatgctgaagattagaagcgagtttaagaggaagtacggtaaaagcctatattactacatccagcaggatacgaagggtgattatcagaaggccttgctgtacttatgtggcggcgacgactag

SEQ ID NO: 108342 - DNA, 1020 bp, Artificial Sequence
  Description of Artificial Sequence: Synthetic coding sequence
atgtccaccgtgcacgagatcctgtgcaagctcagccttgaaggggaccatagtacgccaccctcagcatacggcagcgtaaaggcctacacaaattttgatgccgagagagacgccctaaatattgagactgccattaaaacaaagggcgttgacgaagtgaccatcgtcaatatcctgactaacagaagcaatgcccagagacaggatatcgcatttgcttaccagagacgcacgaagaaggagttggcaagcgccctcaagagcgcgctctctggtcatctggagacagtaattctgggactcctgaagactccagctcagtacgatgctagcgaactcaaagcgtctatgaaagggttgggtaccgatgaggacagcttaatagagataatatgcagtcgcactaaccaggaattgcaagagatcaacagagtatataaagagatgtataaaacagatctggagaaggacatcatcagtgatacaagtggcgattttagaaaactgatggtggctctggccaaggggagaagagccgaagacggcagtgtcattgattatgaactgattgatcaggatgctcgcgatctttacgatgccggagtgaagcgaaaagggacggatgtgccaaagtggatctctattatgaccgaacggtcagtcccccacctgcagaaagtatttgatcgatataagtcctacagcccatatgacatgctggagagcatcagaaaggaggtcaagggggaccttgaaaacgcttttctgaatctcgttcagtgtatccagaataaacctctctactttgcggaccgcctctacgactcaatgaaaggaaaagggacaagggataaagttctgatacgcataatggtcagcagatccgaggtggacatgctgaaaattaggtctgagttcaagagaaagtacggaaagagtttgtactactatatccagcaggacactaaaggcgactatcagaaagcacttctgtatttatgtggcggcgatgattag

SEQ ID NO: 108343 - DNA, 1020 bp, Artificial Sequence
  Description of Artificial Sequence: Synthetic coding sequence
atgagtacggtgcacgagatcctgtgtaagctgagtttggaaggcgatcattccacacctcccagcgcttatgggtctgttaaagcctacacgaacttcgatgccgaaagagatgccctgaacattgaaacagcgataaagacaaagggggtggacgaggtcactattgtaaacatactgacaaaccgctcgaacgctcagcgccaggatatcgccttcgcttatcaacgacgtaccaaaaaggagcttgcatccgcactaaagagcgcactgagcggccatctcgagactgtaattctgggtctgctcaagacccctgcacagtatgatgccagtgagctcaaggcttctatgaaagggctcggtaccgacgaggacagcctcattgaaattatatgcagccgtactaaccaggagctgcaagagatcaaccgagtgtataaagagatgtataaaaccgacctcgagaaggatatcatcagcgatacctcaggcgattttcgaaagctgatggtggcgctcgccaaggggcggcgggctgaggacgggagcgtcattgactacgaattgattgatcaggacgctagggatctgtacgacgccggtgtgaaacggaagggaacagacgtcccaaaatggatttcaattatgaccgagcggtctgttcctcacctgcaaaaagtctttgaccgctacaaaagttatagtccttatgacatgctcgaaagcatccggaaggaggtgaaaggggacctggagaacgcttttctgaatctggttcagtgcatccagaacaagcctctttacttcgcggaccggctctatgactcaatgaaaggcaaagggactcgagacaaggtgctgatccgcataatggtctctcgatccgaggtggacatgttgaaaatcaggagtgagtttaaacgcaagtatggaaagtccctctattattatattcagcaggacaccaagggcgactatcagaaagccctcctctatctgtgtggcggggacgactag

SEQ ID NO: 108344 - DNA, 1020 bp, Artificial Sequence
  Description of Artificial Sequence: Synthetic coding sequence
atgtcaactgtgcatgagattttgtgcaagctctctcttgagggcgaccactcaacacccccgtcagcctatggatctgtaaaggcctatacaaattttgatgcagagcgggacgctctgaacatcgagacagcgatcaagacaaagggagtggacgaggtgactatagtaaacattcttaccaatcgatctaacgcacagagacaggatatcgcattcgcgtatcaaaggcggacaaaaaaagaattagcaagtgctctgaaatccgccctttctgggcacctagaaactgttattttaggcctgttgaagactcctgcccagtacgacgcatccgaactgaaagcatccatgaaggggttgggcacggacgaggactctctaatagagattatttgcagccgcaccaaccaggagctgcaggaaatcaaccgtgtgtataaggagatgtacaagacagacctggagaaggacatcattagtgacactagtggagactttaggaagttgatggtggctctcgctaaggggagacgcgctgaggatggttccgtgatcgattacgagcttatagatcaggatgctagagatctgtatgacgcaggcgtgaaaagaaagggcacagatgtgccaaagtggatctcgatcatgacagaacgaagcgtgccccatctgcagaaagtgtttgatagatataagagctactctccctatgatatgctggaatcaataagaaaagaagtaaaaggcgacctggagaacgctttcctcaatcttgtgcagtgcatccaaaacaaaccactctattttgctgatcggttgtatgacagcatgaagggaaaaggaactcgagataaagttctcatacggatcatggtgtccagaagcgaagtcgacatgctgaagatccggtctgagttcaaacggaaatacggcaaaagcttatattattatatacagcaagacacaaagggcgattaccagaaagctctcctgtacctttgcgggggagatgattag

SEQ ID NO: 108345 - DNA, 246 bp, Artificial Sequence
  Description of Artificial Sequence: Synthetic coding sequence
atgtccaccgtgcacgagatcctctgtaagctcagcctggagggggatcatagcacccccccttccgcatacggctccgtcaaagcatacacaaactttgatgccgagcgtgatgcactgaatattgaaacagctatcaaaacaaagggggtggatgaagtgacaattgttaatatactgacgaatcgaagtaacgcccagaggcaggatatcgctttcgcttatcagagacggacaaaaaaatag

SEQ ID NO: 108346 - DNA, 531 bp, Artificial Sequence
  Description of Artificial Sequence: Synthetic coding sequence
atgtccaccgtccatgaaatactgtgcaaactgtccctggagggtgaccactccactccaccatcagcctatggaagcgtcaaagcttacactaacttcgatgcagaacgcgacgccttgaatatcgaaaccgctatcaaaaccaaaggcgtcgacgaagtaacaattgtaaatatactgaccaacagaagcaatgctcagcgccaggacattgctttcgcctatcaacggaggacaaagaaggaactggcatcagccctgaagtccgccctcagtggccatctggaaacagtcatcctgggcctgttgaagacaccggcccagtacgacgcaagtgagttgaaggcttcaatgaagggactaggaaccgatgaagattcccttatagaaattatatgtagtcgaacgaaccaggaacttcaggagatcaacagggtttataaggagatgtacaaaacagatctcgaaaaggacattatatccgacactagcggcgattttaggaagttgatggtggctctcgctaagtag

SEQ ID NO: 108347 - DNA, 144 bp, Artificial Sequence
  Description of Artificial Sequence: Synthetic coding sequence
atgtctaccgtgcacgaaatactgtgtaaattaagtctcgaaggagaccattcaacaccgccatcagcctacgggagtgtcaaggcctatactaacttcgacgctgaacgggatgccctgaacattgaaaccgctatcaaatag

SEQ ID NO: 108348 - DNA, 405 bp, Artificial Sequence
  Description of Artificial Sequence: Synthetic coding sequence
atgagcacagtgcacgagatactgtgtaagctgagtctcgaaggggatcattcgactccaccatccgcttacggttccgttaaggcctatacaaactttgacgcagagcgggatgcgctaaacatagaaacagctattaagacaaagggggtagacgaggtgacgattgtcaacatattgaccaataggtctaatgcgcagcgccaggatattgctttcgcttaccagaggcgcacaaaaaaggaattagccagcgcactcaagagcgcactctccgggcatttagagacggtgatccttgggctccttaagaccccagcccaatatgacgctagcgaacttaaggcatccatgaagggactcggcactgacgaagattctctgatagaaatcatttgttcgtag

SEQ ID NO: 108349 - DNA, 402 bp, Artificial Sequence
  Description of Artificial Sequence: Synthetic coding sequence
atgtctactgtgcacgagatcctgtgtaaactgagtctcgagggggatcactctactccaccaagcgcttacggatccgtgaaggcctacacaaacttcgatgctgagagagacgctttgaatatcgaaacagctatcaagaccaaaggcgtggatgaggtgaccatcgtaaatatcctgaccaaccggagcaacgcccagagacaggacattgcatttgcgtaccagaggcggaccaagaaggagttggcaagtgcacttaaatccgctctctctggccatctggaaactgtgatactggggctgctgaagacccccgcccagtacgacgccagtgaactgaaagcctcgatgaaggggctgggtaccgatgaggatagcttgatcgagatcatttgttag

SEQ ID NO: 108350 - DNA, 450 bp, Artificial Sequence
  Description of Artificial Sequence: Synthetic coding sequence
atgtccaccgtgcatgagattctttgtaaactttccctggaaggggaccacagcacccctccctctgcgtacggctcagtaaaggcctacaccaacttcgatgccgaacgcgatgccttaaacatcgaaaccgctattaaaacgaagggagtggatgaagttaccatcgtcaatattctgaccaatcgttccaatgcacagcggcaagacattgccttcgcctatcagcggaggactaagaaggaattagcctccgcgctaaaaagcgcgttatccggccaccttgagaccgtcattctgggcctgctgaaaacacccgcgcagtacgacgcttctgaattgaaagcctcaatgaagggcttgggaacagatgaggattcccttattgaaatcatttgcagtcggaccaaccaggagctgcaggaaataaatcgggtgtacaaagagtag

SEQ ID NO: 108351 - DNA, 198 bp, Artificial Sequence
  Description of Artificial Sequence: Synthetic coding sequence
atgtcaacagtgcacgagatactctgcaaactttccttggagggcgaccactccactcccccatctgcctatggatctgtgaaagcctacacaaattttgatgccgaacgagacgcactgaatatagagaccgcgattaagaccaaaggcgtggacgaggtgactatcgtgaacatcctgactaatagatccaattag

SEQ ID NO: 108352 - DNA, 360 bp, Artificial Sequence
  Description of Artificial Sequence: Synthetic coding sequence
atgtcgacagtgcacgagatcctctgtaagctgagtttggaaggggatcacagtacccccccctcagcatacgggtccgtgaaggcctacactaatttcgacgccgagcgggacgcactgaatatcgagaccgcgattaagactaagggcgtggatgaggtcaccatagtgaacatcttgactaaccggagcaacgcacagcgccaggacattgccttcgcctatcagagacgcaccaaaaaagagctcgcgagtgcccttaagagcgctctgtcagggcacttagaaacagtcatcctggggctgctgaaaactcctgctcaatacgacgcctccgagttgaaagcttctatgaaatag

SEQ ID NO: 108353 - DNA, 771 bp, Artificial Sequence
  Description of Artificial Sequence: Synthetic coding sequence
atgtccacggtccacgagatcctttgtaagctctctctagaaggcgatcacagcacccccccatcagcatatggctccgttaaggcttatacaaattttgacgccgaaagggatgcccttaatatcgaaacagccatcaaaaccaagggggtcgacgaagtaaccatcgtcaatatattaaccaaccgctctaacgcgcaaaggcaggacattgcctttgcttatcagcgccggaccaagaaggagctcgccagcgcattaaaaagcgcactgtctggacatctagagactgtgatcttaggactgctaaaaacgcctgcccagtatgacgcctcggagctgaaggcttccatgaagggccttggcacagatgaggacagcctgatcgaaattatatgtagccgaaccaaccaggagctgcaggaaattaacagggtatataaggaaatgtataaaaccgacctcgagaaggacatcatctctgatacatctggagacttcagaaagctaatggtcgcactcgcaaaggggaggcgtgccgaggatggctccgtgattgactatgaacttatcgatcaagatgccagggacctctatgacgccggagtgaaacggaaggggaccgatgtccccaaatggatttcgattatgaccgagcgttccgtgccgcatcttcagaaagtgttcgaccgctacaagagctatagcccgtacgatatgctggagtccattcgtaaagaggtaaaaggagatctggaaaacgccttttag

SEQ ID NO: 108354 - DNA, 360 bp, Artificial Sequence
  Description of Artificial Sequence: Synthetic coding sequence
atgtccacagttcacgagatcttatgtaaattaagtctggagggggatcattctacacctccctccgcgtacggttctgtgaaggcctacaccaattttgatgctgaacgtgatgccctgaacatagaaacggccatcaagaccaagggcgttgatgaagtgactatagttaacattctcaccaatcgttcaaatgcccagcgccaagatattgccttcgcctatcaaaggagaacgaaaaaagaactggcctcagccctcaaatcagccttgtcgggtcaccttgagacggtcatcctcgggcttttgaagacccctgcacagtacgacgcctccgagctgaaggcatccatgaaatag

SEQ ID NO: 108355 - DNA, 531 bp, Artificial Sequence
  Description of Artificial Sequence: Synthetic coding sequence
atgtctaccgtccacgagatcctgtgtaaactgtccttggaaggcgaccattctaccccaccgtccgcatatgggtccgtaaaggcgtatactaatttcgacgccgagcgtgatgccttaaacatcgaaacagccatcaaaactaaaggcgtggatgaagtgaccattgtgaatatcctgaccaacagatctaatgcgcaacggcaggacatcgccttcgcataccagaggaggaccaagaaggaactagcatcggcgctgaagtccgctctgagcggacacctagagacggtgatacttgggctactcaagacccctgcccagtacgacgccagcgaacttaaggcctccatgaaaggccttggtacggatgaagatagccttatcgagattatttgctctaggactaatcaagagctccaggagattaaccgagtttacaaggagatgtataagacggacctggagaaagatattattagcgacacctccggggacttcaggaaattgatggtggccttagccaagtag

SEQ ID NO: 108356 - DNA, 684 bp, Artificial Sequence
  Description of Artificial Sequence: Synthetic coding sequence
atgtctaccgtccacgaaatcctttgcaaacttagtctggaaggggatcacagcacgcccccatcggcatacggaagtgtgaaggcctacactaactttgatgcagagagggatgcactgaacatcgagactgcaattaagactaaaggagtggatgaagtaacaattgtgaacatcctgacaaacagaagcaatgcccagcgccaggatattgcctttgcatatcagcgcagaactaagaaggaactggccagcgctctgaaaagcgccctcagtggccacctcgagacagtgatcttggggctgttgaagaccccggcccagtacgatgcttccgaattaaaagcttccatgaaggggctggggacagatgaggacagtttgatcgagattatttgcagccggacaaatcaggaactacaggaaataaaccgggtttacaaggagatgtacaaaacagacttggagaaagatataatatccgatacttctggagacttcaggaagcttatggttgccctggcaaaagggcggagggcagaggacggaagcgtaatcgactacgaactcatcgaccaggatgccagggacctgtacgatgcaggagtgaagcgaaaaggcactgatgtccccaaatggatttcgatcatgacagagcgcagtgttccacatctccagaagtag

SEQ ID NO: 108357 - DNA, 531 bp, Artificial Sequence
  Description of Artificial Sequence: Synthetic coding sequence
atgtcaaccgtgcacgaaattctgtgcaagttaagcctggagggagatcattccaccccgccctcggcctacggatctgtgaaagcgtatacaaatttcgatgctgagagagacgctctgaacattgagacagctattaagaccaaaggggtggatgaggtgactattgtgaatatcctgaccaacaggtctaacgctcagcggcaggatattgcgttcgcctaccagaggcgtaccaagaaggagctggcctccgccttaaagagcgccctgagtggtcacctggagaccgtaatactcggcctgctcaaaacaccggcacaatacgacgcgtccgagctcaaggcctctatgaaggggttaggcacagacgaggattcccttatcgagattatctgtagtcgtacaaatcaagaactgcaggaaatcaatcgcgtgtataaggagatgtacaagactgacctagaaaaagacattatctccgatacttctggtgactttcggaaactcatggttgctctagctaagtag

SEQ ID NO: 108358 - DNA, 333 bp, Artificial Sequence
  Description of Artificial Sequence: Synthetic coding sequence
atgagcacagtgcacgaaatactgtgcaaactaagcctggaaggagatcattctacgcctcccagtgcctatggatcggtcaaggcttacactaattttgatgccgagcgtgacgcactgaacatcgagactgctataaaaactaagggcgtcgacgaggtcactattgttaatatcctgaccaaccgctcgaatgcacagcggcaagatatcgccttcgcatatcaacggcgcacaaagaaagagctggcttccgcactgaaaagcgcactctccggtcatctggagacagttatccttggactgcttaagacgcctgcgcagtacgactag

SEQ ID NO: 108359 - DNA, 972 bp, Artificial Sequence
  Description of Artificial Sequence: Synthetic coding sequence
atggccagcatctgggttggccatagaggcacagtgcgcgattatccggacttcagcccatcagtggatgctgaagccatccagaaggccatacgcgggattggcaccgacgagaaaatgctgataagcattctgacagaacggtccaacgcccagaggcaattgattgttaaggaataccaagcagcctatgggaaagagctcaaggacgacctgaagggcgacctgtccggccacttcgaacatctgatggtggctctcgttacccctcccgctgtcttcgacgccaagcagctaaaaaagagtatgaagggggctggaacgaacgaggacgcactgatagagatcctgacgactagaacctcccgacaaatgaaagacatctctcaggcttactacaccgtgtacaaaaaatcactgggagacgatatcagtagtgagactagtggagattttagaaaagcgctcctcaccctggcagatggcaggagggacgaaagcctgaaagtggatgagcatcttgccaagcaggatgcccagatactttacaaggccggggagaataggtggggaacggacgaggataagtttactgagattttgtgcctgcgttccttcccccagctcaaactcaccttcgatgagtatcggaacatcagtcaaaaagacatcgtggacagcattaaaggggagctgtcaggtcactttgaagatctattacttgccatagtgaattgcgtgaggaacacgcccgccttcctggccgagcggctgcatagagcactgaaaggtataggcactgatgagttcaccctaaatcggattatggtctcacgttccgagattgatttactcgacatccggactgaatttaagaagcactatggttactctctttactctgcaatcaagagtgacacgtctggtgattatgagataaccctgctgaagatctgcggcggtgacgactag

SEQ ID NO: 108360 - DNA, 405 bp, Artificial Sequence
  Description of Artificial Sequence: Synthetic coding sequence
atggctagcatctgggtgggtcatcgtgggacggtgcgagactaccccgatttcagcccaagtgtggacgctgaagccattcagaaggcgattagaggaatcggaacggatgaaaagatgctgatctcaatcctgacagagcgctccaacgcgcagcgccaacttatcgtcaaagagtaccaggctgcctatggcaaagaactgaaggatgatctgaagggcgatctttcagggcatttcgaacacctgatggtggcgttagtgaccccaccagccgtatttgacgctaaacaacttaaaaaatcaatgaagggcgcaggaacgaacgaggacgcactcatagagatactcactacaagaaccagtagacaaatgaaggacatatcccaagcctactatacttag

SEQ ID NO: 108361 - DNA, 315 bp, Artificial Sequence
  Description of Artificial Sequence: Synthetic coding sequence
atggcctccatttgggtaggacataggggcacggtgagggactatcctgatttctctcctagcgtcgacgctgaggctattcaaaaagctattagaggaatcggtactgacgagaaaatgttaatttctatccttacagaaaggtctaatgcccaaagacagctaatagtgaaagaataccaggccgcctacggaaaggaacttaaagacgatctgaaaggcgacttgtctggccattttgagcacctaatggttgcacttgtaacacctccggcagtgtttgacgccaagcagctgaagaaaagtatgaagtag

SEQ ID NO: 108362 - DNA, 465 bp, Artificial Sequence
  Description of Artificial Sequence: Synthetic coding sequence
atggcatccatttgggtcgggcatagggggaccgtccgggactacccagacttcagtccaagtgtcgatgccgaggcaatccagaaggcaatacgaggcataggaaccgatgagaagatgctgatcagtattctaaccgaacggagtaacgcgcagcggcagctgatcgtaaaggagtatcaggctgcatacggtaaggagctaaaagatgacctcaaaggcgacttgtctgggcactttgagcacctgatggtcgctctcgtgacgccacctgccgttttcgatgccaagcagctgaagaagtccatgaagggggcaggcacaaacgaagatgctctgatcgagattctgactactagaacgagtagacagatgaaggatatcagtcaggcctactatactgtgtataaaaagtcactgggggacgacatttcaagcgagaccagcggagattttaggaagtag

SEQ ID NO: 108363 - DNA, 966 bp, Artificial Sequence
  Description of Artificial Sequence: Synthetic coding sequence
atggcaatggcaacaaagggaggaacagtgaaggcggcaagcggcttcaatgctatggaggatgcgcagaccttgcggaaagcgatgaagggtctcgggacagatgaagatgctattatttcagttctcgcctatagaaatacggcccagcgtcaggaaattcgaaccgcttacaaatccactatcgggcgagatctcatcgatgacttaaaatctgagctgagcggaaatttcgagcaggtaatagtaggcatgatgacgcccactgttctgtatgatgtccaagaactgagaagggccatgaagggcgctggcacagatgaaggttgtctgatcgaaatcctcgcttcacggactcctgaggagatcaggaggatctcgcagacttatcaacagcagtacggtcgaagcctggaggacgatatccgctctgacactagctttatgttccagagggtgctggtgagcctcagcgctggcggacgagatgagggcaactacttagacgacgcactggttcgtcaggacgctcaggacctgtacgaggctggagaaaaaaaatgggggacagatgaagttaaattcctgacggttctgtgcagccgaaatagaaatcatttactgcacgtgttcgacgaatacaagaggatctcccagaaagatattgaacagtcgattaaatcagagacctcggggtcattcgaggacgcccttctggccatagtcaagtgtatgcgcaacaaaagcgcatactttgccgaaaagttgtacaagtctatgaaaggcctgggaaccgacgacaacactctgattagagtgatggtctcacgcgctgagatagatatgcttgacataagagcacatttcaagaggttatatgggaagtctctatattctttcatcaaaggggatacatccggcgattacaggaaggtcctgctagttctttgcggcggggacgattag

SEQ ID NO: 108364 - DNA, 900 bp, Artificial Sequence
  Description of Artificial Sequence: Synthetic coding sequence
atggctatggccacgaaaggaggaaccgttaaagccgcgtcaggattcaatgctatggaggatgcacagacacttagaaaggcaatgaagggattaggaaccgacgaggacgctatcatctccgttttggcctatcgcaatacagcccaacggcaggaaattcggaccgcctacaagagtacaattgggcgtgatctgatcgacgatctgaagtcagaactctctggcaactttgagcagggcgccggcactgacgaagggtgtttgattgagatcctagcctctcgaaccccggaggaaatacgccggattagtcagacctaccaacagcaatacggtcggagtcttgaggacgacatcagaagtgacacatccttcatgttccaacgcgtgcttgtgagcttgagtgccgggggtcgcgacgaggggaactatctggacgatgcactcgtgcgccaagacgcccaggatctgtacgaagccggggaaaagaagtggggcacagacgaggtgaagtttctcaccgtgctgtgcagtcggaatcgcaaccacctgctgcacgtctttgatgagtacaaaagaataagtcagaaagatatcgagcaaagcattaagagtgagacctcgggctcttttgaggatgcactcctggctatcgttaaatgtatgcgaaacaagtccgcctacttcgccgaaaaattatacaaaagcatgaaaggcttaggcacagacgataacacgctgatacgggtgatggtgtccagagccgagatagacatgcttgatatccgagcgcatttcaagcgcctttatggaaaatcactgtattccttcataaagggagacactagcggcgactacagaaaggttctgttggtgttatgtggcggagacgattag

SEQ ID NO: 108365 - DNA, 714 bp, Artificial Sequence
  Description of Artificial Sequence: Synthetic coding sequence
atgatgacccccactgtgctgtatgacgtgcaggagctgcgacgagcgatgaaaggggctggtactgacgagggctgcctgattgagattctggcctctcgcacccctgaggaaataaggagaatttcccagacgtaccagcaacagtacggacgatcattggaggacgatataaggtccgatacctcattcatgttccagagagtgctagtgtcactatctgctggcgggcgcgatgaggggaattatctagatgacgcgctggtgcgccaagacgctcaggatttgtatgaagcgggcgaaaagaagtggggaacggatgaagtcaagttcctgacagtgctgtgcagccggaacaggaatcatcttcttcacgttttcgacgaatataagcgcatatctcaaaaggacattgagcagtccatcaagagcgagacctcaggaagcttcgaggacgctctgctggcaatcgtgaaatgtatgcgtaataagagcgcctactttgccgagaaactctacaagtcaatgaagggactgggcactgacgataacacgcttattagagtcatggtgtctcgagcggagattgatatgctggatatcagagcccactttaagcggctctatgggaagtctttgtactccttcatcaagggcgatacatctggggactacaggaaggttctgctggtgctgtgcgggggggatgactag

SEQ ID NO: 108366 - DNA, 963 bp, Artificial Sequence
  Description of Artificial Sequence: Synthetic coding sequence
atggcacaagtcctgagagggacagtaactgattttccgggtttcgacgagcgggcagatgctgaaactttgcgtaaagccatgaaaggacttggcacagacgaggagagtatcctgacccttctcacaagtagatctaacgcgcagcgacaggaaatctccgcagccttcaagacactctttggtagagaccttctggatgatctaaagagtgagctgaccggtaaatttgaaaaactcatcgtggccctaatgaaaccctctaggctgtatgatgcctatgagctgaaacacgcccttaaaggcgccgggaccaatgaaaaggtgttgactgagatcattgcctcccgcaccccagaagagctgagggccatcaagcaggtgtacgaggaagagtatggttcctctctcgaggacgacgttgtaggggacactagcggctactatcaacgcatgctggtggttctcctccaggcaaatagagatccggatgcaggaattgacgaggcccaagtggagcaggacgcgcaggccttattccaggccggtgaactgaaatggggtaccgacgaagaaaagtttataaccatttttgggacacgtagtgtcagccaccttcgcaaagtctttgataaatacatgactattagtgggtttcaaatcgaggagacgatcgacagagagacatcaggcaacctggagcagctgctcctggccgtggtgaagtctattagaagcattcccgcatacctggccgagaccttgtactatgctatgaagggtgctggcacggacgatcataccctcatacgggtaatggtgtctcgcagtgagatcgatctgttcaatatacgcaaagaatttcgaaagaactttgcaacctcattgtacagtatgataaagggcgacaccagtggtgattacaaaaaagcactgctcctgttatgtggcgaggatgattag

SEQ ID NO: 108367 - DNA, 2022 bp, Artificial Sequence
  Description of Artificial Sequence: Synthetic coding sequence
atggccaaaccggcgcagggtgccaaataccggggcagcatacatgatttcccagggtttgaccccaaccaagacgccgaggcactgtatacagcaatgaagggcttcggatcagacaaggaggccatcctcgacattataacatctcgcagcaataggcagaggcaggaggtgtgccaatcttataaaagtctatacggtaaagatctcatagctgatctaaaatacgaactgactggaaagttcgagaggctgatagtgggattaatgcggcctccagcctactgcgatgccaaggagatcaaggatgccatctccggtattggaacagatgagaagtgtttgatagagattctggcctcaagaaccaacgagcagatgcaccagctggttgcagcctacaaggacgcctatgagagagacttagaggctgatatcattggcgatacctcaggtcactttcagaaaatgctcgtggtgctgcttcagggcacacgcgaggaggacgatgtggtgtccgaggaccttgttcagcaggatgtgcaggacctgtatgaggctggagagctgaagtgggggactgatgaggctcagttcatctatatcctaggaaacagaagtaagcaacatctgagactcgtgttcgatgagtatttgaaaacaacgggcaagccaatcgaggctagcattagaggcgagctttccggagacttcgagaaattaatgctggccgtggttaaatgtatccgtagcaccccagaatatttcgccgaacggctcttcaaggcaatgaagggactcggaacgagggacaatacacttatccggatcatggtgagcagatctgagctggatatgctggacattagagaaatttttcgaaccaagtacgagaaatctctttatagtatgatcaaaaacgatactagcggagaatataagaagaccctgttaaaattgtctggcggggatgatgatgccgctggccaattcttccccgaagcagctcaggtagcataccagatgtgggaactgtccgcagtggcacgtgttgaactcaagggaaccgtcagaccagcaaatgacttcaaccccgacgctgatgctaaggccttgcgtaaagctatgaaaggcctgggaaccgacgaggacactatcatcgacatcattacccaccggagtaacgttcagcgccaacagattcgccaaacattcaaaagccattttggcagagacctcatgaccgaccttaagtcagagatcagtggagacctagctagactaatcctgggcctgatgatgccaccagctcactacgatgcaaaacagctaaaaaaggcaatggaaggagcgggaactgacgagaaagctctgatagagattcttgcaactagaacaaacgcagagattcgggctataaatgaagcctataaggaagattatcacaaatccttggaggatgcactgtcgagtgacaccagtggtcattttagacgcatccttatctctctagccacaggacacagggaagagggaggcgagaacctggaccaggcaagggaggatgcgcaggtagctgcagaaattctggagattgccgacacaccctctggcgacaagacaagtctcgaaacacgcttcatgaccatcttgtgtactagaagttaccctcatctgaggagagtttttcaagagttcatcaagatgaccaattacgacgtggaacacacgatcaagaaggaaatgagtggggacgttcgggatgcttttgttgccatcgttcagtccgtcaaaaataaacccttattcttcgcagacaagttgtataagtctatgaagggggccggaacggatgagaagactctgacccggataatggtctcaagatccgagatagacctgctgaatatacggagagagtttattgaaaagtacgacaagtccctgcatcaggcaatcgagggggatacgagcggtgattttctgaaggccctcttggctttgtgtgggggcgaagactag

SEQ ID NO: 108368 - DNA, 2004 bp, Artificial Sequence
  Description of Artificial Sequence: Synthetic coding sequence
atggctaagcctgctcagggggccaagtacagaggaagcattcacgactttcctgggttcgaccctaatcaggatgccgaagccctctacaccgcaatgaaagggttcgggtccgacaaggaggcaattttagacatcataacaagccgtagcaatcgccagaggcaagaagtttgtcagtcttataaatcgctgtatgggaaggatctaattgctgaccttaaatacgagctgaccggaaagtttgagaggctcatagttgggctcatgcgccccccagcctactgtgatgcgaaagaaattaaagatgccattagcggcattggcaccgatgaaaagtgtctgattgagatccttgcgtctaggaccaatgagcagatgcaccagttagttgccgcctacaaagatgcctacgagcgagatttagaggccgacataatcggcgacacatccggccactttcagaagatgcttgtcgttctcctccaaggaactcgcgaggaagacgacgtcgtctctgaggacctggtccagcaagatgtacaagatctgtatgaagctggcgaactcaaatggggtactgatgaagcccagttcatatacatcttgggaaatcggtcgaaacagcatcttcgattagtgttcgatgagtacctgaaaacaactgggaagccgatcgaggccagcatccggggggaactgtccggagacttcgagaaacttatgctggctgtggtcaagtgtattcggagcactcctgagtactttgctgaaaggctcttcaaagccatgaaaggtctgggtacccgcgacaacacacttatcaggatcatggtttctagatccgagctggatatgcttgacattagggagatcttccgaacaaaatatgagaagagtctttacagcatgattaagaacgatacctcaggtgaatacaaaaagactctcctcaaactctccgggggcgacgatgatgccgcaggccagtttttccctgaagccgcccaggtggcctatcaaatgtgggaactgagcgccgtggctcgggtggaactgaagggcacagtaaggccagccaatgacttcaaccccgatgctgatgctaaggctctgcgaaaggctatgaagggtttggggacagatgaagataccatcatcgatattatcactcaccgctctaatgttcagaggcagcagatccgccagaccttcaaatctcactttggacgcgatttgatgactgacttgaagtccgaaatctcaggcgatctagccaggttgatcctggggcttatgatgcctcccgcccactacgacgctaagcagctgaagaaagccatggaaggggccggaactgacgagaaggcactaattgagattctagccaccaggactaatgcagaaatccgcgccatcaatgaagcgtacaaggaggattaccacaagagtctggaggacgctcttagctccgatacatccggccatttccgccggatcttgattagtttggctaccgggcatcgagaggagggaggtgaaaacctcgatcaagcccgggaggacgcacaggagatagcagacactccatccggcgataaaacaagccttgaaacaaggtttatgacgattttatgtacccgctcgtatccccacctacggagagtttttcaagagttcattaagatgacaaactatgacgtcgaacatacaatcaaaaaggagatgtctggagacgttagggatgccttcgtggccatcgtacagagtgtcaaaaataagccactgttctttgccgacaagctgtacaagagcatgaagggggccgggaccgatgagaagactttaacaagaatcatggttagccgtagcgagatcgacctacttaatatccgccgtgagtttatagagaagtatgacaaaagcctgcatcaggctatcgagggtgacacatcaggggattttctcaaggccttactggctctatgtggcggtgaggactag

SEQ ID NO: 108369 - DNA, 333 bp, Artificial Sequence
  Description of Artificial Sequence: Synthetic coding sequence
atggcgaaacctgctcaaggtgcgaagtacagaggatctattcacgacttccctggatttgatcccaatcaagacgccgaagcattgtacaccgccatgaagggattcggctcggacaaagaagccattctagatatcattacgagccggtcaaatcgtcagcggcaggaggtctgtcagtcctataaatccctgtatggaaaagatctgatagctgaccttaagtacgagttaactggtaagtttgagcggctcattgtcggcctcatgaggccacctgcttactgtgatgccaaggaaattaaggatgcgatctcaggcatcggtacctag

SEQ ID NO: 108370 - DNA, 1926 bp, Artificial Sequence
  Description of Artificial Sequence: Synthetic coding sequence
atgaagggctttggctccgataaagaagcaatcctagatatcattacatccaggtccaatcgacagcggcaggaggtgtgtcagtcgtacaagtctctgtacggaaaagatctgatcgccgacctcaaatacgaactgactggaaaattcgaaagattgatcgtgggacttatgagacctccggcatactgcgacgccaaagaaatcaaggacgcgatttctggcattgggactgatgagaaatgtctcattgagatattagcctcacggacaaacgaacagatgcaccagcttgttgccgcctacaaagatgcctatgagagggatttggaggccgacattatcggcgacacttcagggcatttccaaaagatgcttgtcgtcctcctccagggaaccagggaggaagacgatgttgtgtcggaggatttggtgcagcaggacgttcaggatctttacgaagctggggagctgaagtggggaactgacgaggcccagttcatttacattctgggcaatcgctcgaaacagcacctgagactagtctttgatgaataccttaaaactactggcaagccaatcgaggcctccatccggggcgaactgtcaggagactttgaaaagctcatgttagcggttgttaagtgtatccggtcaacaccagagtacttcgcagagcggctgttcaaggctatgaaaggtctgggcaccagagacaacacactcattagaattatggtctccaggagcgaattagatatgctcgatatcagagagatatttagaaccaagtatgagaaaagtctctacagtatgatcaagaacgataccagtggagagtataagaagacactgctcaagctgtcgggcggggacgatgatgcagctggacagtttttcccggaagctgctcaggttgcataccagatgtgggagttgagcgccgtggcaagggtggaattgaagggcacagtgcgccctgcaaatgacttcaaccccgacgctgatgccaaggcgctgagaaaggccatgaagggactcggcactgacgaggatactatcatcgacattatcacccaccgtagcaatgtgcaacgccagcagatcaggcagacatttaagagccattttggtagagatcttatgacagatctgaagtccgaaatcagtggggacctggcccggcttatcctagggctcatgatgccccctgcccattacgatgcgaaacagctgaagaaagccatggagggtgccgggactgatgagaaggccctgatagagatcctcgccaccaggaccaacgcagaaatcagagctatcaacgaagcctacaaagaagactaccacaagtccctggaagacgctttatctagcgatacctcgggacacttccgccgcatcctgatcagtctagctacaggccaccgggaggagggcggtgaaaatttagaccaagcaagagaggacgctcaggtcgctgctgagatccttgagatcgctgatactccatctggagacaagactagcctggaaacccggttcatgaccatcctctgcactagaagctatcctcatctccgccgagtcttccaggagtttattaagatgaccaactacgatgttgaacacactataaagaaagagatgtcaggcgacgtgagggatgctttcgtagcaatagttcaatccgtcaaaaacaaacccctgtttttcgccgataaattatacaagtccatgaagggagccggcacagatgaaaagaccctgacaagaatcatggtgtcacgctcggaaatcgatttgctcaacatccggcgggagttcatcgaaaagtacgacaagagcctccatcaagcaattgaaggggacacatccggagattttctcaaagcattactggcgctgtgtggcggagaggattag

SEQ ID NO: 108371 - DNA, 1644 bp, Artificial Sequence
  Description of Artificial Sequence: Synthetic coding sequence
atgcaccagcttgtcgcggcgtacaaggacgcctatgaacgagacctggaagccgacataattggcgacaccagtggccattttcagaagatgctggtcgttctgctgcagggtactagggaggaagatgacgtagtttccgaagacctggtccagcaggacgttcaggacctgtatgaggcgggcgagttgaagtggggtactgacgaagcgcagtttatttatattctcgggaacaggagcaaacagcacctgcgcctggtgtttgatgagtacctaaaaaccaccggcaagcccattgaagcctccatccggggcgaactgtctggggattttgaaaaattgatgctggctgtcgttaaatgcattcggtcgacacctgagtattttgctgaaaggctattcaaggccatgaagggattgggtacgagggataataccttaatccgaatcatggtgtcccgctccgagctggatatgttagacatccgtgagatcttccgcactaagtacgaaaaatctttgtatagcatgattaagaacgatacgtcaggggaatacaagaagaccctgttaaaactgtctggcggagacgacgacgccgcaggtcaattttttcctgaagccgcgcaggttgcttatcagatgtgggaactgtctgccgtggcgagagtggagcttaaagggaccgtgcggcctgctaacgacttcaatcccgacgcagatgctaaagctctgagaaaggcaatgaaaggtttgggcaccgacgaggacactattatcgatattattacacacagaagcaatgtacagcggcaacaaatacgccagaccttcaaatcccactttggcagagacctcatgacagacctgaagagcgagatcagcggcgacctcgctaggctgatcctggggttgatgatgcctccagcccactatgacgcaaagcagctaaagaaggccatggagggagccgggacagacgaaaaagcactgattgagattcttgccacaaggacaaatgctgagatacgagccataaatgaggcatacaaggaggattatcacaagtcgttggaggatgccctgagttcagacaccagtggccactttaggagaattctgatatcactcgccactggccaccgagaagagggcggtgagaatctggatcaagccagagaggatgcccaagttgccgccgagatcctggagatagcggataccccatcgggggataagacatccctagagactcggtttatgacgattctgtgcaccaggtcttacccacaccttaggcgcgtgttccaagagtttattaagatgaccaactacgatgtcgaacatacaattaagaaggagatgtccggcgatgtgagggacgcttttgtggcgatagtgcagagcgtgaaaaataaacctttgtttttcgccgacaagctctacaagtctatgaagggagccggcacggatgaaaaaacgctcacccgcataatggtgagtcgctcagagattgacctcctcaacattcgcagggagttcatcgagaagtacgacaagagtctgcaccaagccatcgagggcgacaccagtggggacttcctcaaagcgctcctggctctctgtgggggcgaggattag

SEQ ID NO: 108372 - DNA, 1467 bp, Artificial Sequence
  Description of Artificial Sequence: Synthetic coding sequence
atgagctatccaggctaccccccgactgggtaccctccattccctggctacccacccgcagggcaagaatctagcttcccgccaagtgggcagtatccttatccttccggttttcccccaatgggaggaggcgcctacccacaagtgccgagctcaggctatccaggggcgggcggttatcccgctccaggcgggtatcctgccccaggcggctatcccggcgctcctcagcctggtggcgccccatcctaccctggcgtaccacccggacaggggtttggtgtcccgcctggcggtgcaggattttcaggctatcctcaacccccttcacaaagctacggcgggggaccagcccaagtccctctccctggaggattcccgggggggcagatgcctagccagtacccaggcggtcagcccacctatcctagtcagattaacactgacagtttctcatcgtatcctgtgttctcacccgtgtcactcgattatagcagcgaacccgcaaccgtcacgcaagtgacccagggaacgattcggcctgcagcaaactttgatgctatcagagatgccgagatcctgcgcaaagctatgaagggctttggcaccgatgaacaggccatagtggatgtcgtcgcaaacagatctaatgaccagaggcagaagataaaggccgcttttaagacctcatatgggaaagatctcatcaaagacttaaagagcgagctgtcgggaaacatggaggagttaattctggcactgttcatgccccccacttactacgacgcatggtccttacggaaagccatgcaaggagctgggactcaggaacgcgtgttgatcgagatcctctgtaccagaactaaccaggagataagagagatcgtgagatgttatcaatcagagtttggacgcgacttggaaaaggacattaggtctgacacgtcaggccacttcgaacgcctcctcgtgagtatgtgtcagggtaatagggacgagaaccagtctataaaccatcaaatggcacaggaggatgcccagcgactatatcaagccggtgagggtagacttgggacggacgaatcatgttttaacatgatactagctacgcggtccttccctcaactccgtgccacaatggaggcctactctaggatggcaaaccgtgatctcctgagttctgtgtccagagaattcagtggatatgtggagtcaggattgaagaccatcctgcagtgcgcgttgaacaggcctgcctttttcgcggaacgcctgtactacgctatgaagggagcagggactgacgacagcaccctcgtacgaatagtggtcactcggtccgaaatagatctcgtccagatcaagcagatgttcgcacagatgtaccaaaaaaccctgggaaccatgatcgccggcgacacctccggcgattacagaaggctactgttagctattgtaggccagtag

SEQ ID NO: 108373 - DNA, 1401 bp, Artificial Sequence
  Description of Artificial Sequence: Synthetic coding sequence
atgagctatcctggctacccaccgacgggatacccaccgttccccggttaccctcccgcaggtcaagagtccagttttccaccctctggccaatacccatacccctccggatttccacctatgggagggggcgcttaccctcaggttcccagtagtggctatccaggcgcagggggataccctgccccaggtggttatccagcccccggcggctaccccggcgctccacagccgggcggtgcccccagctacccaggcgttcctcccggccaagggtttggcgtcccccctggcggcgctggtttctccgggtaccctcagccaccttctcagtcctatggtggcgggcctgctcaggtgccactgccgggcggttttcccggaggtcagatgccctctcaatatccgggtggtcagcctacctacccaagccagccagcgaccgtcacacaagtcacccaggggaccatcaggcctgctgcaaactttgatgccattcgagacgcggaaatattgaggaaggctatgaaaggcttcggcactgacgagcaagccatagtggatgttgtggccaatagatctaacgaccaacgccaaaagattaaagctgccttcaaaacttcgtacgggaaagatcttataaaagatctgaaaagcgagctgtcgggcaacatggaggagctcatcttggctctattcatgccaccaacgtactacgacgcttggtccctacgcaaagccatgcagggtgccggcacacaagaacgtgtcctgatcgaaatcctgtgcacccggactaatcaagaaatacgggagattgtgcggtgctatcagtcggaattcggccgagacctggaaaaagacatccgctctgatacaagtggccactttgaaaggctgctcgtgtctatgtgtcaggggaacagggacgagaaccagagcatcaatcaccagatggcacaggaggatgcccagcgtctgtatcaggcgggtgagggaagattgggaaccgacgagagctgcttcaacatgatccttgctactcgcagcttcccacagctgcgagcaaccatggaagcatactcacgcatggctaatcgcgatcttctctccagcgtgtcccgagaattcagcggatatgtagagtccggtctgaaaacgattcttcagtgtgctcttaaccgcccagcttttttcgcagagaggttgtattacgctatgaaaggagctggaaccgacgattctacactggtaagaatcgttgtgacacgctccgagatcgacctcgtccagattaagcagatgtttgcgcagatgtaccagaagaccttgggaacgatgattgctggtgacacatcaggagattatagacggctgctgctggcaattgtggggcaatag

SEQ ID NO: 108374 - DNA, 435 bp, Artificial Sequence
  Description of Artificial Sequence: Synthetic coding sequence
atgtcttatcctggttatccacccacaggctaccctcccttcccggggtacccaccggctggccaagagagcagctttcccccaagcggccagtacccatacccaagcgggtttccgccaatggggggaggggcttatcctcaggtgcctagttcagggtaccctggggccggtggttaccccgcccccgggggttacccggcccctgggggatacccgggcgccccacagcccggtggtgccccctcctatccaggggttcctcctggacagggctttggtgtgccacccggtggcgcaggctttagcgggtacccacagccacccagccaatcttatgggggagggcccgcacaagtgcctcttcccggcggattccccggcggccagatgccctctcaatatcccggcgggcaacctacgtaccctagttag

SEQ ID NO: 108375 - DNA, 1011 bp, Artificial Sequence
  Description of Artificial Sequence: Synthetic coding sequence
atgcccagtcagtaccctggtgggcagcctacctatccttctcaacctgctaccgtcacccaggtcacacaaggcaccatcagacctgccgcaaactttgacgcaattcgggatgccgaaatcttgaggaaggctatgaagggctttggtacagacgagcaagccatcgtagatgtagtagccaatcgctctaatgatcagcggcaaaaaattaaagctgccttcaagacctcctatggcaaagacctcattaaggatctgaagtctgaactgtctggaaatatggaagagctaatcctcgcactgttcatgccccctacgtattacgacgcatggagcttgagaaaagctatgcagggggcggggacccaagaaagagtgttgatcgaaattctctgcactcgtaccaaccaggaaattagggaaattgtcaggtgttaccaaagcgagtttggtagggaccttgaaaaagatattcgctccgatacctcaggacatttcgagcggctccttgtcagcatgtgtcaagggaaccgcgacgagaaccagagtattaaccatcagatggcccaagaggatgcacagcggctttaccaagcaggagaaggtaggctgggcactgatgaatcgtgttttaatatgattctcgccacacgctcctttccccaactgcgcgccaccatggaagcatacagtcgtatggccaaccgggacctcctgagctccgttagcagagaattctccgggtatgtggaatccggattaaagacaatacttcagtgcgccctcaacaggccagccttcttcgccgaaaggctctattacgctatgaaaggcgctggcacggatgactcaactctcgtgcgcatcgttgtgactaggtccgaaatagatttggtacaaattaaacagatgtttgctcagatgtaccagaaaactctggggaccatgatcgcaggggacacttccggagactatcgccgactcctcttggcaattgtgggccagtag

SEQ ID NO: 108376 - DNA, 984 bp, Artificial Sequence
  Description of Artificial Sequence: Synthetic coding sequence
atggcatggtggaagagttggatcgagcaggagggagtgaccgttaagtcttcttctcacttcaacccagacccggatgccgagacactgtataaagctatgaaggggattgggaccaacgaacaagccatcattgacgtcctgacgaaacgatccaacacccagagacaacagatcgctaagtccttcaaggcccaattcggcaaggacctcacagagactttgaagagcgaactgtctgggaagttcgaacgcttgatagtagcactgatgtatccaccgtatcgttatgaagctaaggaactccacgatgccatgaagggactcgggactaaagagggggtgatcatagagatcctcgcctcacgaactaagaaccaactgcgcgaaattatgaaggcatatgaggaagactacgggagcagcctcgaggaggatattcaggccgacacaagcggttatcttgagcgtattttagtgtgccttctccaggggtcccgggatgatgtcagcagcttcgtcgaccccggtctcgctcttcaggacgctcaagatctttatgctgcgggcgagaaaatccgcggtacagatgagatgaagtttatcactattctctgcaccagaagtgccacacacctcctgcgcgtcttcgaggagtacgagaagatagcgaacaaatccattgaagactcaatcaagagcgagacccacggcagcctggaggaggctatgttgaccgtagtgaagtgcacccaaaacctgcactcatatttcgcggaacgtttgtactacgctatgaagggagccggaacacgggatggcactctgataaggaacatcgtgagtagatccgaaatagacttgaacctcattaaatgtcatttcaagaagatgtatggtaagaccctgagttccatgattatggaagatacaagcggcgactacaagaatgccctgctcagtttggtaggatcagatccctag

SEQ ID NO: 108377 - DNA, 831 bp, Artificial Sequence
  Description of Artificial Sequence: Synthetic coding sequence
atggcctggtggaagtcctggatcgaacaggagggcgttacggtgaagtcctccagtcatttcaaccccgatccagatgcagaaaccttgtataaagctatgaagggtattggcgtgggctctcagctgctctctcaccaggctgctgccttcgccttcccaagttccgcacttactagtgtgtccccctgggggcaacaggggcatttgtgctgcaacccggcagggaccaatgagcaagcgataattgatgttttgacaaaacggagcaatactcaacggcaacagattgctaagtctttcaaagcccagtttgggaaggacttaaccgaaacactcaagtcagagctgtctggtaagttcgaaaggttaatcgtcgccctgatgtatccgccctacaggtatgaagctaaggagctgcatgacgccatgaagggctctcgtgacgacgtatcttctttcgtggatcctgggctagccctccaggatgctcaggatctttatgcggccggagaaaagatacgtgggaccgatgagatgaaattcatcaccatcctctgcacaagaagcgccactcatctgttacgagtcaaatgtacccagaacttgcactcctattttgcggagcggctctactacgccatgaaaggcgcggggacacgtgacggaacactgataagaaacattgtgtcccgtagcgaaatcgatcttaacttgatcaaatgccacttcaaaaagatgtatggcaagaccctgagtagtatgatcatggaggacacctcaggcgactacaaaaacgccctgcttagccttgtggggtctgatccctag

SEQ ID NO: 108378 - DNA, 798 bp, Artificial Sequence
  Description of Artificial Sequence: Synthetic coding sequence
atggcctggtggaagagctgggacctcacagagacactgaaatcagagctctccggcaaatttgagcgcttgatcgtcgcgctgatgtatcccccctaccggtatgaggcaaaagaattgcatgacgccatgaaagggctcggcacaaaagagggcgtcatcatcgaaatcctggcttcgagaacaaaaaatcagttaagggaaattatgaaagcctacgaagaagattacgggagctccttagaggaggatatacaagcagacacaagcggctacctggaacggatcctggtatgcttactccaaggctcacgagacgatgtaagttcttttgttgatcccggcttggctctgcaggacgcacaggacctatacgcagctggagagaaaatccgtggcactgatgagatgaagttcataacgatcttgtgtactcggagcgctactcatctcctgagggtcttcgaggaatacgagaaaattgcaaacaagtccatcgaagatagtattaagtccgagacccacggttcattggaagaggcgatgttaaccgtcgttaagtgcacccaaaatttgcactcttatttcgcggagcgactttattatgccatgaagggggccggcacaagagacgggacactaattaggaatatcgttagtcgtagcgagatcgacctgaacttaatcaaatgccatttcaaaaaaatgtatggcaagaccctctccagcatgattatggaggatacctcaggggactacaagaatgctcttctgtccctagtggggtccgatccttag

SEQ ID NO: 108379 - DNA, 426 bp, Artificial Sequence
  Description of Artificial Sequence: Synthetic coding sequence
atggcctggtggaaaagctggatcgaacaggaaggggtaactgtgaagtcttcctcccattttaaccccgaccctgacgctgagaccctgtacaaggccatgaaaggcattggaactaatgagcaggccataatcgacgtcctcacaaaaaggtcaaacacccagcgtcaacaaatagcaaaatccttcaaagcacagtttgggaaggatctgacagaaaccttaaaaagtgagctgtccgggaagtttgagcgtttaatcgtagccttaatgtaccccccgtacagatacgaagccaaggagctccacgacgctatgaaagggttagggaccaaggagggagtgatcatagagatcctggcatccagaaccaaaaaccaactcagggaaatcatgaaagcctatgaggaagggcagcagggctag

SEQ ID NO: 108380 - DNA, 1038 bp, Artificial Sequence
  Description of Artificial Sequence: Synthetic coding sequence
atgtcagtaaccgggggcaagatggctcctagcctgacccaggagattctatctcatctcggactggccagcaaaacagctgcttgggggaccctggggaccttacgaacttttctgaacttcagcgtcgacaaagatgcgcagaggttgctgcgggcaataaccggccagggagttgaccgttcagctattgtcgatgttctgaccaaccgcagtagagagcaaaggcaactaatatcacgaaactttcaggagaggacccagcaagaccttatgaagagcctccaggctgcgttgtccggaaatctcgaaagaatcgtgatggcccttctacaacctaccgcccaatttgatgctcaggagctcagaacagccctgaaggcctcagactctgctgtggacgtcgcgattgagattcttgcaaccagaacccctccccagcttcaagaatgtctcgccgtctataagcacaacttccaagtggaagccgtggacgatatcacttctgaaacaagcgggatcctgcaggacctgctgctggcactcgccaagggcggccgggattcttacagcgggataattgactacaacttggccgaacaggacgtacaggccctccagagagcagagggtccctcccgagaagagacctgggttccagttttcacccagcggaaccccgagcacctgatccgtgttttcgaccagtaccaacggtcgacggggcaggagctcgaagaagctgtgcaaaacaggtttcacggggatgctcaggtcgccttgctgggacttgcttcagtgatcaagaataccccactctatttcgcagacaagctgcaccaggcgctgcaagaaactgaaccaaattatcaggtgctcatccggatcctaatatcacgctgtgagaccgacctcttatccatccgcgctgagtttagaaaaaaatttgggaaatctctgtacagcagcctgcaagatgccgtcaaaggggattgtcaatcagcccttctggccctctgtagagctgaggacatgtag

SEQ ID NO: 108381 - DNA, 1929 bp, Artificial Sequence
  Description of Artificial Sequence: Synthetic coding sequence
atgctgactcgcccgtcccaggtcctccttaacagcctgtcagttgatcctgacgcagaatgcaagtacggcctgtatttccgcgacgggagacgaaaagtggactacattttggtgtaccaccacaaacggcctagcgggaataggactcttgtcagacgtgtgcagcacagtgacacccccagtggggccagaagtgtgaaacaggaccatcctttaccagggaaaggagcctcgttggatgcgggttccggcgagccgcctatggactatcatgaggatgataagcgcttcaggagagaagagtatgagggaaacctgctggaggccggcttggagctagaacgagacgaggataccaagatccatggcgtcggctttgtgaaaatccatgcaccctggaacgtgctctgccgagaggctgaattccttaaactgaaaatgcccacaaagaagatgtatcacatcaacgagacccgtgggttgctcaagaagattaattccgtcctgcagaagattacagatcctattcaacctaaagtggctgagcacagaccacagactatgaaaagactctcttaccctttcagtagggaaaagcaacacctgttcgatctaagcgacaaggacagctttttcgacagcaaaacccgctctacaattgtttatgagatactgaaaagaaccacctgcactaaggcgaagtactcaatgggcatcacttccctgctcgccaatggtgtgtatgctgccgcttaccctctgcatgacggcgactataacggtgagaatgttgaattcaatgacaggaagctgctgtacgaagaatgggcgaggtacggcgtattttacaagtatcagcctatcgacctggtgcggaagtactttggcgagaagatcggactgtactttgcgtggctgggggtgtacacccagatgctgatccctgcctcaattgttggtattattgtgtttctgtatgggtgtgccactatggatgagaatattccaagcatggagatgtgcgaccaaaggcacaatatcactatgtgtcccctatgcgacaagacatgcagctattggaagatgagttccgcatgcgcaaccgcccgtgcatctcacttgtttgacaatccagccaccgttttcttcagcgtattcatggctctgtgggccgcaacctttatggagcactggaaacggaaacaaatgaggttaaactaccgctgggacctcacaggattcgaggaagaggaagatcacccgagggccgaatatgaagcccgagtgctggagaagtcactcaagaaagagagtcgtaataaggaaactgacaaggttaaattaacgtggagggatcgttttcccgcctacttaaccaaccttgtgagcattatttttatgatcgctgtgactttcgcaatagtccttggggtcattatctaccggataagcatggccgcagctctggccatgaattcttcacccagcgtgcgcagcaacatccgggtgacagtgaccgcaactgcagttattatcaacctggttgtgatcattctgctggacgaggtgtacggatgcattgcaaggtggttgacaaaaatcgaagtacccaagacagaaaagtcatttgaggagcgcctgatctttaaggcctttcttttaaagtttgtaaatagctacaccccaattttttacgtggcatttttcaaaggcagatttgtgggcagacccggggactatgtgtacattttccgcagcttcaggatggaagaggtaaccgaaatcctgttcattagtgggtcaccattctgcttggcctatgacttgagtaccccgtgtacctgggagaaacagctccagcacatatgcagtgccaaaagctcccggtttttaagctttttgctggaaacgtttctgttcccatag

SEQ ID NO: 108382 - DNA, 2961 bp, Artificial Sequence
  Description of Artificial Sequence: Synthetic coding sequence
atgagagtgaacgaaaaatacagcactctacctgctgaggaccggtctgtgcacatcatcaatatatgcgctatagaagacataggctaccttccatcagagggaacactgcttaacagtctttcagtcgatccagatgccgagtgcaaatacggcttgtattttagggacgggcgcaggaaggtggattatattttagtttaccatcacaagcgcccctccggtaacaggacattggttagaagagtgcaacattcagatactccctcaggagccaggtccgttaagcaagatcacccactgccaggcaaaggcgcctctcttgacgctggctctggagaacccccgatggattaccatgaagatgacaaaagattcaggcgagaagaatatgagggtaatctcttggaggccgggcttgagttggagcgagatgaggacacaaagatccatggcgtcgggtttgtgaagatccacgctccatggaacgttctgtgtcgagaggccgaattcttgaagttaaaaatgccaacgaaaaagatgtatcatattaatgagacccgaggcctgcttaagaaaatcaattctgtgctgcagaaaataactgatcctatccagcccaaggtcgcggagcacagaccccagacgatgaagaggctgagctacccattcagcagagaaaagcagcacctgttcgatctgtcggacaaagatagctttttcgactccaagacccggagtaccatcgtgtacgaaattctgaagcgtaccacatgcacaaaggcaaagtattccatgggaataacttctctgttggcaaacggtgtgtacgccgctgcctacccactgcatgacggtgactacaacggtgagaatgtagagtttaacgaccgcaaactcctgtacgaggaatgggccaggtatggagtattctataagtaccaacctatcgatttggtaaggaagtacttcggggaaaaaataggtctgtacttcgcttggttgggagtttatactcagatgctcatcccagcttccattgtagggatcatagtgtttctgtatgggtgcgccacaatggacgaaaatattccgtcaatggagatgtgcgaccaacgccataacattactatgtgccctttatgcgacaagacctgttcttactggaagatgtcctcggcctgcgctaccgctagggcttcgcatctctttgacaatcctgccacggtgtttttctctgtgtttatggccctctgggccgccaccttcatggaacactggaagcgcaagcaaatgcggctgaactacaggtgggatctcactggctttgaggaggaggaggaggcagtcaaggaccacccaagggctgaatacgaggcaagggtgctggaaaaatccctgaaaaaagagtctaggaacaaggagaaaagaagacatatccctgaagagtctaccaacaaatggaaacaacgagtaaaaactgccatggcaggcgtcaagctgaccgataaggtcaaactgacttggcgggatagattcccagcctacttaaccaatctagtgtccattatcttcatgatcgccgtgacttttgctattgttctgggtgtgatcatatacaggatttccatggctgccgccctggcaatgaacagctcgccatcagtgagatcaaatatcagagtgacggtgacagctaccgccgtgattatcaaccttgtggttataatcctcttagacgaagtttacggctgcatagcgcgatggctcacaaagatcgaggtgcctaagacagaaaaatcctttgaggagaggttgattttcaaggcttttctgctgaaatttgtgaactcctatacccccatcttctatgttgcgttctttaagggccgattcgttggaaggccgggggattacgtgtatattttccggagttttaggatggaggaatgcgctccgggaggctgtttgatggagttatgtatccaactatcaataattatgctgggcaaacagctgatccagaacaatttatttgagataggaatccccaaaatgaaaaagctcatccgctatctaaagctcaagcagcagagccccccagatcacgaggagtgcgttaagaggaaacagaggtacgaagtggattataaccttgaaccctttgctggcctgacgccagagtacatggagatgatcattcagttcgggttcgtcaccctctttgtggcctcctttccgctcgcccccctgtttgctctgttaaacaacatcattgaaattcgcctggacgctaagaagtttgtcacggagctgagaagaccagttgccgtcagggccaaggatattggaatctggtataacatcttacgcgggattggaaaactcgccgtcatcatcaacgctttcgtgatttcttttaccagtgatttcatccctcggttggtctacctttacatgtattcaaagaatggaaccatgcatgggtttgttaatcatactctctcatctttcaacgtgtcagacttccagaatggcaccgcccccaacgatcctctggatctcgggtacgaagtgcagatttgcagatacaaagactaccgggagcccccatggtccgagaataagtacgacatttcgaaagacttctgggcggtgctggctgccagactcgcctttgtgatagtcttccagaacctagttatgttcatgtcagatttcgttgattgggtgatccctgacatccccaaggacatttcccagcagattcacaaggagaaggtcctgatggttgagctatttatgcgggaggagcaggacaagcagcagctgctggaaacatggatggagaaggaaaggcagaaagatgagcccccatgcaaccatcacaataccaaggcttgccccgactctctcgggagtcctgccccgtcccacgcttatcatggtggagtgctgtag

SEQ ID NO: 108383 - DNA, 2523 bp, Artificial Sequence
  Description of Artificial Sequence: Synthetic coding sequence
atggactaccacgaagatgacaaaaggttcaggagagaggagtacgagggtaacttacttgaggctgggttggagctggagcgggacgaggacactaagattcatggggtcggctttgtgaaaatccatgccccctggaacgtgttatgtagggaggccgagtttttgaagttgaagatgcccactaaaaaaatgtaccacattaatgaaaccagaggcctgctaaagaaaattaacagcgtgctgcagaaaatcacggatcctatccagcctaaagtcgctgaacataggcctcagaccatgaaacgactctcctacccttttagtcgcgaaaaacagcacctgttcgatctgagtgataaagattctttcttcgactcaaagacacgctcaaccatcgtttacgagatcctaaagagaacgacttgtactaaggccaaatactccatgggcattacaagcctgctggcaaatggagtgtatgctgccgcctatccgctgcacgatggcgattataatggagaaaatgtggagttcaatgatcgcaagctgctctacgaagaatgggcgaggtacggggttttctataagtaccagcccatcgacctggtcaggaaatatttcggggagaagataggactctactttgcttggctcggagtttatacgcaaatgcttataccagccagcatcgtcggcataatcgttttcttatatggctgcgcaactatggatgagaatattccttctatggagatgtgtgatcagaggcacaacattaccatgtgtcctttgtgtgataaaacctgctcctattggaagatgagctcagcttgtgctaccgcacgggcttctcacctgtttgataatcccgctactgtgtttttctcagtctttatggccctgtgggccgccacctttatggagcattggaaaagaaagcagatgagattgaattaccgttgggatctcactggtttcgaagaggaggaggaccaccctagggcagagtacgaggcccgcgtcctggagaagagtctcaagaaagagtctcggaataaagaaacggacaaagtgaagcttacatggagagacaggttccctgcgtacctgacgaatttggtgtccatcatttttatgatcgccgtcacctttgcgatcgtgttgggagttattatctaccgcatttccatggccgcagctctggcgatgaactccagcccttcagttcggagcaatataagagtgaccgtgaccgccacagctgttatcattaatttagtggtcattatcctgctggacgaggtttatggctgcatcgcccgatggctaaccaagatcgaggttcccaaaacagagaaaagcttcgaggagaggctgatctttaaggctttcctgctgaaatttgtgaactcatacacccccatattctatgttgccttcttcaaaggtcggttcgtgggccggcccggagattacgtttacatttttcgctcttttaggatggaggaatgtgccccaggggggtgcctcatggaactgtgtatccagctgtccataatcatgcttggcaagcaactgattcagaacaatctgtttgaaataggtatccccaagatgaaaaaactaattcgttatttgaagctcaagcagcagtcacccccagaccacgaagaatgtgtgaagagaaagcaacggtatgaagttgactataacctggagccattcgcgggcttaactcctgagtacatggagatgattattcagtttggatttgtaactttgttcgtagctagctttcccctggccccactgttcgcccttctcaacaacattatagaaataagactggacgctaaaaaatttgtcaccgagttacgccggccagtggctgtcagggccaaagacataggcatctggtacaatatcctcagaggcattggaaaactggcagttattatcaacgcctttgtaatttcttttacaagtgattttattccgcggctcgtttacctgtacatgtatagcaagaatggcaccatgcacggttttgtgaaccacactcttagtagctttaacgtgtccgacttccaaaatggcactgctccgaacgatcctctcgatcttggttacgaggttcaaatatgtcggtataaagattacagggaaccaccatggagtgaaaacaagtacgatatcagcaaggacttttgggctgttctcgctgcccggcttgcgtttgttatcgtgtttcaaaatctcgtcatgttcatgagtgatttcgtggattgggttatcccagacatacccaaagacatttctcagcagatccataaagagaaagtgctgatggtggagctgtttatgagggaggagcaggacaaacaacaactactggaaacctggatggaaaaagagagacagaaggacgagcccccgtgcaatcatcacaacaccaaggcttgtcctgattcccttggttcacctgccccatcacacgcttatcatgggggcgttctctag

SEQ ID NO: 108384 - DNA, 2523 bp, Artificial Sequence
  Description of Artificial Sequence: Synthetic coding sequence
atggattatcacgaggacgataaacggttccgtagagaggaatatgagggcaacctcctggaagcgggattggagctagaaagggatgaggacactaaaatccatggtgtcggctttgtcaaaatccacgctccttggaatgttttatgtagagaggcggaattcctgaagttgaaaatgcctacaaagaaaatgtaccatattaacgagactcgtgggctgctcaagaaaattaatagcgtgctgcagaaaatcactgaccctatccagcctaaagtggccgaacacaggccccagacgatgaagcggctgtcttacccattcagtcgtgagaagcagcatctttttgatctgtccgataaggacagtttctttgattccaaaacgcggagcactatagtttacgagattttgaaaagaacaacctgcaccaaggcaaagtacagcatggggataaccagcctcctggcgaacggtgtttacgctgccgcatacccactacacgacggtgactacaacggcgagaatgtggaatttaacgacagaaagctattgtacgaagaatgggccaggtacggcgtcttttataagtaccagcctattgacctagtcagaaagtatttcggtgaaaagataggtctttacttcgcctggctcggggtatatacccaaatgcttattccagctagcatcgtgggaattattgtgtttctttatggctgtgctaccatggacgagaacattcctagcatggagatgtgcgaccaaaggcataatataacaatgtgcccgctgtgtgacaagacatgtagctattggaaaatgagtagcgcctgcgcaaccgcacgcgcctctcacctattcgacaaccccgctacagtgttctttagcgtgtttatggccctatgggccgcaaccttcatggagcactggaagcggaagcagatgcggctgaattacaggtgggacttgacaggcttcgaggaggaggaggatcacccacgtgccgaatacgaggcgcgggtcctggagaaatcattaaaaaaagaatcacggaacaaagagaccgataaggtcaagcttacatggagagatagattcccagcctacttaacgaatttagtcagtattattttcatgatcgcggtaacgtttgccatcgtgcttggggtgatcatatatcggatttcaatggcagctgccctggctatgaatagctccccttccgttcggtccaatatccgtgtgactgtcacagccactgccgtcattatcaatcttgtagttataattttactggacgaagtttacgggtgcatcgccagatggctcaccaagattgaagtgccaaagaccgagaagtcattcgaggaaagactcatcttcaaagctttcctcctgaagttcgttaacagctacactcccatcttctacgtggctttcttcaaaggtcgctttgtaggtcgacccggggactacgtgtacatcttccgcagtttcagaatggaagaatgcgccccaggaggctgtctgatggagctgtgcatacagttgtctatcataatgctggggaaacagctaatccagaataacttgtttgagattggaattccaaagatgaaaaagctgattagatacttgaaactgaagcagcagtccccacccgaccacgaggagtgcgtaaaaagaaagcagcggtacgaggtggactacaatctcgaaccatttgctggactgactcctgaatacatggaaatgatcatccagttcgggttcgttaccctttttgtagcctcctttcctctggcgcccctcttcgccctactcaacaacatcatcgagataagactcgacgcaaaaaagttcgtgactgaactgagacgcccagttgcagtgcgcgccaaggacattggaatttggtacaatattctacgcgggatcggaaagctggccgttattattaacgccttcgtcatcagtttcacaagcgattttattcctcggctcgtgtacctgtacatgtactccaaaaacgggactatgcacggatttgtcaatcacacactgagcagctttaacgtcagtgattttcagaatggaacagcacctaatgaccctctggatctgggatatgaggtccagatctgtaggtacaaagactacagagagcccccatggagtgagaataaatacgacattagcaaagatttctgggccgtcttggccgctcgactcgccttcgtcatcgtgttccaaaatctcgttatgttcatgtcagattttgtagactgggtcattcctgacatcccaaaagacataagtcagcagattcataaggagaaggttcttatggtggaactgtttatgagggaagagcaagacaaacaacagcttctagagacctggatggagaaggagagacagaaggatgagccaccctgcaatcaccacaacactaaggcttgtcctgactcactcggctctcccgcaccaagtcacgcataccacgggggagttttgtag

SEQ ID NO: 108385 - DNA, 2961 bp, Artificial Sequence
  Description of Artificial Sequence: Synthetic coding sequence
atgcgcgtgaatgagaagtattctacactcccggcggaggaccgctccgttcacatcattaacatctgtgccattgaggatattgggtatctgccatcagagggtacactgctcaactctctctcggtggaccctgatgcagagtgtaagtacggcctgtactttagagacggccgacggaaagttgattatatcctcgtttatcaccacaaacgacctagtggtaaccggaccctggtccgccgcgttcagcactcagatacgccatccggagctagaagcgtcaaacaagatcatcctttgccaggcaagggcgcaagcttggacgccgggtctggtgagcccccaatggactatcacgaagacgataagcgctttcggcgcgaggaatacgaaggcaatctcctggaggctggcctggaactggaaagagatgaggacactaaaatccacggcgtcggctttgtcaaaatccatgcaccctggaacgtgctgtgtagggaagccgaatttctgaagctaaagatgcctacaaagaagatgtatcacatcaatgagacgagggggctcctgaagaaaatcaatagtgtgctgcagaagatcactgaccccatacaaccgaaggtggctgaacaccgccctcagaccatgaagcgcctgagttatcctttctcccgtgaaaagcagcatctttttgacctcagcgataaggatagcttttttgatagtaagacccgctccaccatcgtgtatgaaatcctaaagagaacaacgtgtaccaaagcaaagtattcaatgggtatcaccagtcttctggccaatggtgtgtacgcagccgcctatccgctgcacgacggggactacaacggtgaaaatgtcgaatttaacgatagaaaactgctttatgaggagtgggccaggtacggcgtcttttacaaatatcagccaattgacctggtacgaaagtattttggtgagaaaattgggttgtactttgcctggctaggagtgtacacccagatgcttatccccgcgagtattgtagggatcattgtgtttctgtacggatgcgccacgatggacgagaatataccctccatggaaatgtgcgaccagagacataacatcaccatgtgcccactctgcgacaaaacttgcagttactggaaaatgtcctctgcgtgtgccacagcacgcgccagtcatttatttgataatcccgccactgtctttttctcagtatttatggccctgtgggcggccactttcatggaacattggaaacggaaacaaatgcgcctgaactacagatgggacctgacagggttcgaagaggaggagaaggcccttctcgaccatccacgggcggagtacgaagctagggttctggaaaagagtctgaagaaggagtcacgcaataaagagaaacgcaggcatatcccagaggagagcacgaataagtggaagcagcgagtgaaaactgccatggcaggggtgaaattgacagacaaagtcaagctgacttggcgggaccgcttccccgcctatctcacaaatctggtgtcaattattttcatgatcgccgttacctttgccattgtactcggcgtaatcatctatagaatatccatggccgccgccctggctatgaacagctcaccgagcgtgaggagcaacatccgcgtcaccgtcacggccaccgctgttatcatcaacttggtcgttatcattctgctggatgaagtgtacgggtgcatcgctcgctggcttaccaaaattgaggtcccaaagactgagaaaagttttgaagagcggctaatctttaaagccttcctgcttaaatttgtgaattcatacacccccattttctatgtcgcattttttaaagggcggttcgtggggagaccgggagactacgtctacatcttccggtctttcaggatggaggaatgtgccccgggtgggtgtctgatggagctctgtatccagctgtccatcatcatgctgggcaagcagctcattcagaacaatctgttcgagatagggatacccaagatgaaaaaactgattcggtatctcaagttaaagcaacagtctcccccagatcatgaagagtgcgttaagcggaaacagagatatgaagtggactataacctggaaccctttgccggtcttacccctgagtatatggaaatgattatacagttcggattcgtgaccctgtttgtagccagctttccactcgctcccctgtttgctctactcaacaacataatcgagatccggctggacgcgaagaagttcgttacagaactccgcaggccagtggcagtgcgagcaaaagatattggtatatggtacaacatactccgagggataggcaaactagccgtcattatcaatgcttttgtgatctctttcacaagtgattttatcccaagactcgtgtatctttatatgtatagcaagaacggcacaatgcatgggtttgtcaaccacaccctgagtagttttaacgtgtccgacttccagaacgggaccgcgcccaacgaccctctcgatctgggttatgaggtccagatatgtcggtacaaagactatcgcgaacccccatggagcgagaataagtatgatatctccaaggacttctgggccgtccttgcggctcgtctggctttcgtgatcgtctttcagaacctcgtgatgttcatgtccgactttgtcgactgggttatcccggatattcctaaggacatctcacagcagatccacaaagagaaagtattgatggtggaactgtttatgcgggaagagcaggataagcagcagctcctggagacctggatggaaaaagagcggcaaaaagatgaacccccctgtaatcaccacaacaccaaagcctgtccagattctcttgggtccccagcgccttcacacgcttaccacgggggggtgctgtag

SEQ ID NO: 108386 - DNA, 942 bp, Artificial Sequence
  Description of Artificial Sequence: Synthetic coding sequence
atgcttgatgccgcatcaaaggcgagggaggctcctgaggcagctcccggatgggatgacccgcagggagaagggcggagaggcaggggcgaaggcctgagttgggccgtggggccccatccagaccctggggtgctgatgcagggggaggtttggtcaggacgctttagtcacgctgttatccaatttggatttgtgaccttgttcgtggccagcttccccctggcaccactgttcgcactcctcaacaacatcattgagattcgcctggatgcaaaaaaattcgtgacggaacttcggagacctgtcgcggtccgggccaaagatattggaatctggtataacatcctaagggggatcggaaaattagccgtgatcattaatgcattcgtgatatcattcaccagtgactttatccccaggttggtctacctctacatgtatagtaaaaacgggactatgcacgggttcgtaaaccatacactgtcttcattcaatgtgtctgactttcagaacgggaccgcgcctaatgatcccctcgacctgggctacgaagttcaaatttgcagatataaggattaccgcgaaccaccgtggtccgagaacaaatatgacatttccaaagacttctgggcagtgcttgccgcgcgactggctttcgtgattgtgtttcaaaatctcgtgatgttcatgtctgattttgttgactgggtgatcccagacattcctaaagacattagccagcagatacacaaagagaaagtactgatggtggagctctttatgcgagaggaacaggacaaacagcagctgctagaaacatggatggaaaaagagaggcagaaggacgaacctccctgtaaccatcacaacaccaaagcctgcccggattccctcgggagcccggctccttcgcatgcttaccacggaggtgtactctag

SEQ ID NO: 108387 - DNA, 2235 bp, Artificial Sequence
  Description of Artificial Sequence: Synthetic coding sequence
atgaagaggttaagctacccattttcccgcgaaaagcaacacctattcgatctgagcgataaggactccttttttgactcgaaaacaagatccaccattgtttatgaaatcttgaaacgcacgacatgcactaaagcaaagtattctatgggcattacctctctactcgcaaacggggtgtacgccgctgcttacccgctgcatgacggagattacaacggcgagaatgtggagttcaacgataggaagttgctgtacgaggaatgggccagatatggcgtattctacaagtatcagccaatagatctggttcggaagtattttggagaaaaaattggtctctacttcgcttggctcggagtgtacacccagatgctgatccccgccagcatagttggaattatcgtattcctctacggatgtgccacaatggatgagaatattccttctatggaaatgtgtgatcaaaggcataatattacaatgtgtcctctgtgcgataagacgtgtagctattggaaaatgagtagtgcttgtgctacagcacgggcctcccacctgtttgataatccagccacggtcttctttagtgtgttcatggctctgtgggccgctacttttatggagcattggaaaaggaagcagatgcgtctgaactacagatgggacctgacaggtttcgaggaagaggagaaggcactgctggatcatccacgggcggagtatgaggcacgcgtgctggagaagagcctgaagaaagagtctcgtaataaagaaacagataaggtcaagctcacctggcgggatcggttccctgcctacctgaccaacctggtctcaatcatcttcatgatcgctgtgacctttgcgatcgttctgggcgttatcatttacagaatcagtatggctgccgcattagctatgaatagtagtcctagtgttagaagtaatattagagtaacagttaccgctacagccgtgatcatcaacctcgtggtcattattctcctggatgaggtgtacggctgcatagctcggtggttaacaaagatcgaggtgccgaaaaccgaaaaatcgtttgaggagcgactgatcttcaaagcattcctgctgaaatttgtgaacagttatacaccaattttttatgtggcctttttcaaggggagatttgttggccgacctggggattacgtctacatcttccgcagctttaggatggaggaatgtgcaccaggaggttgccttatggaactatgcatacaactgtctatcattatgctaggaaagcagctcatccagaataacctctttgaaataggaattccgaaaatgaagaagctaattcgctacctcaagctgaaacagcagagcccgcccgaccatgaagagtgcgtgaaacgcaagcagcggtatgaagtcgactacaacctagagccattcgccgggctgactccagagtacatggagatgattatccaatttggcttcgtcacattatttgtggcctcttttcctttagccccactcttcgctctgttaaacaatatcattgagatccgccttgacgctaaaaaatttgtcacagaactgaggcgccctgtggccgtgcgcgccaaggatattggcatttggtataacattctccgcggtattgggaagctagctgtcattatcaacgcctttgtaattagcttcacatccgattttatccccagactggtgtatctatacatgtactccaaaaatggaacgatgcatgggttcgtgaaccacaccctctcctcgttcaatgtgtctgactttcagaacgggactgcccccaatgatcctctggatctgggttatgaagtccagatatgccgctacaaagactatcgtgagccaccttggagcgagaacaaatatgatatttccaaggatttctgggctgtactggcggcaaggttagcatttgtgattgtattccagaacctcgtgatgttcatgagtgatttcgtcgattgggtcattcctgacattcctaaagatatcagccagcagattcacaaggagaaagtactaatggtggagctgtttatgcgcgaggagcaggataaacaacagttactggagacatggatggagaaagagagacagaaagatgagccaccttgtaaccaccacaacacaaaggcgtgccctgactccctaggctcccctgctcccagtcatgcctaccacggtggggtcttgtag

SEQ ID NO: 108388 - DNA, 1983 bp, Artificial Sequence
  Description of Artificial Sequence: Synthetic coding sequence
atgaaggtgaccctctccgccctggacaccagtgaatctagcttcacacccctggtggttatcgaactggcccaagatgtgaaggaagaaacaaaagagtggctgaagaatcgcatcatcgcaaaaaagaaagatggcggtgcccagttgctgtttcgaccactcctgaataagtacgaacaggagaccctggagaatcagaacttgtacctggtcggggcgagcaaaattagaatgctcctgggagccgaagccgtggggctggtcaaggagtgtaacgataacactatgagagctttcacttacagaacccgccagaactttaagggattcgatgataacaatgacgatttcctgacgatggccgaatgtcagtttatcattaagcacgaactggaaaaccttcgagccaaggacgagaagatgataccaggctacccacaggccaaactgtatccgggtaaatctctgctgcgcaggcttcttacaagcgggattgtgatccaggtgttccctcttcacgactcagaagcccttaagaaactagaagacacgtggtacacaagatttgcattgaaatatcagcctattgatagtattaggggctattttggagaaaccattgcactctacttcgggttcttagagtacttcaccttcgcacttatcccaatggccgttatcggcctgccgtactatttgttcgtgtgggaagattacgataagtatgtcatcttcgcgagttttaaccttatctggagcacggtgatcctggagctgtggaagagagggtgtgctaacatgacgtacagatggggcacccttttgatgaagcgcaagttcgaggagccacgccccggattccacggcgtgctggggataaatagtatcaccgggaaagaagagccattgtaccccagttacaagaggcagctccgcatttacctagtctctttgccattcgtgtgtctgtgtctgtatttttcactgtatgttatgatgatatactttgatatggaggtctgggctctgggcttgcatgagaacagcggcagtgagtggacttccgtgctcttgtacgtcccttcaataatttatgccatcgtgatcgagatcatgaacaggctataccggtacgctgctgaattcttgacatcttgggagaatcataggctcgagtctgcatatcagaaccacctcatactaaaagttttggtcttcaactttctcaattgcttcgcctccctgttttacatcgcgtttgtgctcaaagatatgaagctgctcagacagagtctggccacgttactcattacatcacagattctcaaccagattatggaaagtttcctgccctattggctgcaacgcaaacatggtgttcgcgttaagcgcaaggtgcaggcactgaaggctgatattgatgcgacactttatgagcaagtcatcttagaaaaggagatgggcacttaccttggaacatttgatgactatctcgagctctttctgcaattcggctacgtttcactgttctcctgcgtttatcctctcgccgcggcttttgctgttctcaataattttaccgaggtgaatagtgatgctctgaaaatgtgccgagtgtttaagcggccattcagtgaacctagcgctaatatcggggtgtggcagctcgcctttgagacaatgagtgtgatcagtgtggtcacaaactgtgcgcttattggaatgtcccctcaggtcaacgcggttttccccgaatctaaagcagatcttatcctaattgttgtggcagtagagcatgccttgctagctctgaagttcatcctggcgttcgcaatccctgacaaacctcgacacattcagatgaagctggctcgtttggagtttgagagcctggaagccctgaagcagcagcaaatgaaacttgtcacggagaacctgaaagaggagccgatggagtccgggaaagaaaaagcgacctag

SEQ ID NO: 108389 - DNA, 1413 bp, Artificial Sequence
  Description of Artificial Sequence: Synthetic coding sequence
atgaaagttacgctgagcgccttggatacttcagagtcatcatttaccccactggtggtgatagagctggcacaggatgtcaaggaggagacaaaagagtggctgaagaacagaatcatcgcaaagaagaaagacggcggtgcgcaactgctcttccgccctctgctcaacaagtacgaacaagagactttggaaaaccagaacctgtatctggtcggggccagcaagattcgcatgctgctgggagctgaagccgttggcttggtgaaagagtgtaatgacaacaccatgcgtgctttcacttatcgaacaaggcagaatttcaaaggcttcgatgacaacaatgatgattttctgactatggcagaatgccagttcatcattaaacacgaattggaaaatctacgggctaaagacgaaaaaatgatcccaggatatccccaggctaaactctacccgggaaaaagcctgctccgccgactactgacaagcggtatcgtgatccaggtgtttccactgcacgacagcgaggcattgaagaagcttgaagatacctggtatactcggtttgccctgaagtatcagccaattgagaatcatcgacttgaaagcgcctatcaaaaccatctgatactgaaggtcctggtattcaatttcctgaattgcttcgctagtcttttttacatcgcattcgtcctgaaggacatgaaactgctccggcagtctcttgcaacacttctcatcacatctcagattctgaaccaaataatggagagctttttaccttattggcttcagcgcaagcacggagttcgggtcaagcggaaggtgcaagccttgaaggccgacattgatgctaccctctatgaacaagtcattcttgagaaggaaatgggcacgtatctaggaacctttgacgactaccttgagctctttcttcagttcggctacgtaagtctattctcttgcgtctaccccttggcagccgcattcgctgtgctgaacaacttcacggaagtaaatagcgatgccctgaagatgtgtcgggtgtttaagaggccattttctgaaccctcggccaatattggtgtgtggcagctggccttcgaaaccatgtctgtcatcagcgttgttaccaattgtgctctgatcggaatgagtccccaggtcaacgccgtgttccctgaatctaaggctgatcttattctcatcgttgtggcggtggaacacgccctgttggctctcaaatttatcctcgcatttgctatacccgacaagcctcggcacatccagatgaaactcgcgagactggagtttgaaagtctcgaggccctcaagcaacagcagatgaaattagttaccgagaacctcaaggaggagccaatggaatccggcaaagagaaggcaacttag

SEQ ID NO: 108390 - DNA, 423 bp, Artificial Sequence
  Description of Artificial Sequence: Synthetic coding sequence
atgaaagtaactctcagcgcactggatacatccgaatcctctttcacccccctggttgttatcgaactggcacaggatgtgaaggaggaaaccaaggagtggttgaaaaatcgcataatcgccaagaagaaagacgggggcgcccaattgctgttccgccccctgctcaacaaatacgaacaagaaactctggaaaaccaaaatctgtaccttgtgggcgctagcaagattcgcatgctgctcggagccgaagccgtgggtctggtgaaggagtgcaatgataatacaatgcgggcgttcacatacaggacgagacagaatttcaagggttttgacgataataatgacgactttttaactatggccgagtgtcagtttattataaaacacgagttggaaaacctacgtgccaaggatgaatag

SEQ ID NO: 108391 - DNA, 339 bp, Artificial Sequence
  Description of Artificial Sequence: Synthetic coding sequence
atgaaggtgacactctctgcactggacaccagcgaatcatcatttaccccattggtggtgattgagttggctcaggacgtcaaggaggagacaaaggagtggctgaagaataggattattgctaagaagaaagacgggggggctcaactgttgttcagacccctgcttaacaagtacgagcaggagactctggagaaccaaaatctctacctcgtcggagcttctaaaattcggatgctcctcggagcagaagcagttggacttgtgaaagaatgcaatgataacaccatgcgggcttttacctatagaacacgacaaaatttcaaagggtttgactag

SEQ ID NO: 108392 - DNA, 117 bp, Artificial Sequence
  Description of Artificial Sequence: Synthetic coding sequence
atgaaagtgacgctgtcagctctagacacctcagaatctagctttacaccgctggtcgtcatcgagttagcgcaggacgtcaaagaggaaaccaaggaatggttaaaaaaccggtag

SEQ ID NO: 108393 - DNA, 405 bp, Artificial Sequence
  Description of Artificial Sequence: Synthetic coding sequence
atgaaagtgacactgtccgctttggatacatccgagtcatcctttaccccactggtcgtgatagaattggcccaggacgtcaaagaagagacaaaggagtggctgaagaatcggatcatagctaaaaaaaaggacggcggggcacagcttctctttaggcctctgttaaacaagtatgaacaagagactcttgagaaccagaatctgtacctggttggtgcttcaaagatacgtatgttactgggagccgaagcagtcggacttgtcaaggaatgcaatgacaatacaatgcgagccttcacgtatcggacaagacagaactttaaaggattcgatgataataatgatgactttctcactatggccgagtgtcagttcatcatcaagcatgagctcgagaactag

SEQ ID NO: 108394 - DNA, 441 bp, Artificial Sequence
  Description of Artificial Sequence: Synthetic coding sequence
atgaaggtgacactgtcggcccttgacacatcagaatctagcttcacccctctagtagtgatagaactggcgcaggacgtgaaagaagagacgaaagaatggctgaagaatcgcatcatagctaagaaaaaagatggtggcgcccagttactttttaggcctctcctgaacaaatatgaacaggagactctcgagaaccagaatctgtatcttgtcggggcctcgaagatcagaatgctgctgggtgcagaagcagttgggctggtcaaagaatgcaatgacaataccatgagggcgttcacataccggacaagacagaacttcaaaggattcgatgataacaacgacgacttcctgacaatggcggaatgtcaattcatcataaaacacgaacttgaaaatttaagagcgaaggacgagaagatgattcccggctattag

SEQ ID NO: 108395 - DNA, 426 bp, Artificial Sequence
  Description of Artificial Sequence: Synthetic coding sequence
atgaaagtgacgctgtcagcactggatacctctgagtcttcgtttactcccctggtagtgatcgaactggcccaggatgtcaaagaggagaccaaggagtggctaaagaatcgcattatcgcaaagaaaaaagacggaggggcacaactcctcttccggccccttctgaacaaatacgagcaagaaactctcgagaatcaaaacctctatctggttggcgctagtaaaatccgcatgctgctgggcgctgaggcagtggggctggtcaaagaatgcaatgataacactatgcgcgctttcacttacagaaccagacaaaactttaaggggtttgatgataacaacgacgactttctaacaatggctgagtgccaatttatcatcaagcatgagctggaaaacctgcgtgccaaggacgagaagtag

SEQ ID NO: 108396 - DNA, 1785 bp, Artificial Sequence
  Description of Artificial Sequence: Synthetic coding sequence
atgaaagttacgctgagcgctctagacacttctgaatcttcatttactcccctcgtagtgatagagttggctcaggatgtgaaggaggagacaaaggagtggctgaagaataggatcattgcaaagaagaaggacggagacaacaacgatgacttcttgacaatggccgaatgccagttcatcatcaagcacgagctggaaaatctaagggcgaaagacgagaaaatgatacctgggtacccacaagccaagctgtatccagggaagagtttactcaggcgcctcctgacctctggcatagtaatccaggtttttcctctgcacgatagcgaagctctgaaaaaactggaggacacctggtatacccgctttgccctcaagtaccagccgatcgattcgatcaggggatacttcggtgaaaccatcgctctgtacttcggctttctcgagtacttcacctttgccttgatacctatggcagttatcggtctgccttactatctattcgtctgggaagattacgataagtatgtaatatttgcttcctttaatttaatctggtcaaccgtgatcctggagctgtggaaacgcggctgtgctaacatgacgtatcgttggggcactctcctgatgaagcgtaaattcgaggaacctcgcccaggctttcatggtgttctgggaatcaattccattaccggcaaggaggagcctctgtacccctcctataaaaggcaactccgaatctacctcgtatccctgcctttcgtgtgtctgtgcctgtatttcagcctctatgttatgatgatttattttgacatggaagtctgggccctaggcttgcatgagaattcagggtccgagtggacctcagtgctattgtatgtgccaagcattatctacgccatcgtcatcgaaattatgaatagactttaccggtacgctgctgaattccttacgagctgggagaaccatcggttagaatcagcttaccagaatcacctcattcttaaggttctggtgtttaacttcctcaactgttttgcttctttattttatattgcgtttgttctgaaggacatgaaattgctgagacagagcctcgcaaccctgctcataacttcacagatattgaatcagataatggaatcctttcttccctactggctgcagaggaaacatggtgtgagggtgaaaagaaaggtccaggccttgaaagcggatatcgatgcgacactgtatgagcaggtcatattagaaaaggagatgggtacgtatctcgggactttcgacgactacctggagctttttctccaatttggatacgtctccttgtttagttgtgtctaccccttggccgccgctttcgcagtgctaaataacttcacagaggtcaactctgatgcactcaagatgtgccgggtcttcaagcgtcccttctccgagccgtccgctaatattggagtttggcagctcgcattcgaaacaatgagcgtgatctccgtggtcactaactgcgctctgatcggcatgtccccacaggtgaatgctgtgtttcccgagtccaaagcagacctgatcctgattgtggtggccgtcgagcatgcccttctcgcactcaagtttatactggccttcgccatcccagacaagccaagacacatccagatgaagcttgccagattggaatttgaaagcctagaagctctgaagcagcagcagatgaagctggtcaccgagaatcttaaggaggagccaatggaatctgggaaggaaaaggccacctag

SEQ ID NO: 108397 - DNA, 1884 bp, Artificial Sequence
  Description of Artificial Sequence: Synthetic coding sequence
atgaaggtgaccttgagtgctctggacactagtgagtccagctttaccccactggttgtgattgagctggcgcaggatgtcaaagaagagacaaaggaatggctgaaaaatcgcatcatcgcaaagaagaaggatgggggcgcccaactcttgtttcgacctctcctgaacaagtatgaacaagaaacactggaaaatcaaaacctgtaccttgtcggggccagtaaaatccgcatgcttctgggcgcagaagctgtggggttagtgaaggaatgtaacgacaacactatgcgggcttttacatacaggacccggcaaaattttaaaggcttcgacgacaacaacgatgacttcctgacaatggccgaatgccagttcatcattaagcatgagcttgaaaatctgcgcgcaaaagatgaaaaaatgattcctggttacccccaggctaaactatacccaggcaagtcccttctgaggcgattgctgacaagcggaattgtgatacaggtttttcccctccacgacagcgaagctttgaagaagttagaagacacatggtacaccagattcgcactgaagtatcagcctatcgactcaatcagaggctattttggggagaccattgcactctatttcggatttcttgagtacttcacttttgccctaatccccatggccgttatcgggctcccgtattatttgttcgtgtgggaggactatgacaaatatgtgatcttcgccagtttcaatctgatctggtccactgtgatacttgagctttggaaacggggctgtgccaacatgacgtatcggtggggtaccttactgatgaagcggaagttcgaagagccgcgccccggattccacggtgtcctggggataaattctattacaggaaaagaggaaccgttatacccgagctataagcgacagctgcgtatatacctggtttccctgcctttcgtttgcctttgcctgtatttcagtctgtatgtgatgatgatttacttcgacatggaggtgtgggccctgggcctccacgagaactcagggtcagagtggacttcagtcctactctatgttccaagcattatctatgctattgtaatagaaattatgaatcgtctttaccggtatgccgctgaattcctcacttcatgggagaaccaccggcttgaatccgcctaccagaatcacttaatcctgaaagtgttggtgtttaactttctaaattgcttcgcctcactgttctatattgcgttcgtgttgaaggatatgaagcttctgagacagtccttggctactcttttgatcacttcgcagatcctcaaccagattatggaatcctttcttccctactggttacagcgaaaacatggagttcgcgtaaagcgaaaagttcaggctctcaaggctgatatcgacgcaacactttacgaacaggtaatcctggagaaagagatgggcacatatcttggaacctttgatgactatctggaattatttttgcagttcggctatgtctcgctgttttcctgcgtgtaccctctcgccgccgcttttgcggtccttaataacttcacagaggtgaattccgatgcacttaaaatgtgtcgcgtgttcaagagacctttctctgaaccttctgcaaatattggggtatggcaactcgcctttgagacgatgtcagtcatttccgtggtgaccaactgcgcgctcataggaatgagcccccaagtgaatgccgtattcccagagagtaaggctgatttaattctgattgtggtggcagttgaagctgctagctgcaaacttgtaagcctccccagatattcctggagcacaaacagtgtgcccggaaccgtgatcggcccgggagtttag

SEQ ID NO: 108398 - DNA, 1650 bp, Artificial Sequence
  Description of Artificial Sequence: Synthetic coding sequence
atgaaggtgacattgtcagccctggatactagcgagagcagttttactcctctggtggtgatcgaattggctcaggatgtgaaggaagaaacaaaagagtggttaaagaatcgcatcatcgcaaaaaaaaaagacggtgtccggcgtctgctgacttctggcattgtgatccaggtgttcccactgcacgacagtgaagcacttaagaagcttgaagacacctggtacacccgattcgctctaaagtatcagccgattgatagcatcagaggctactttggtgaaacgatagctttatacttcggttttctggaatacttcacttttgccctgattccgatggctgtgatcggactgccctactatctgtttgtttgggaagattacgacaagtatgtgatatttgcaagctttaatctgatctggagtacagtgatactggaactctggaagcgggggtgtgccaatatgacgtaccggtggggtactctgctgatgaaacgcaagttcgaggagccccggcctggttttcacggagtcttagggattaacagcatcacaggcaaggaggaacctctctacccctcctataagaggcagctcaggatttacctggtgtcgctgccctttgtctgcctgtgcctctatttttcgctgtacgtcatgatgatctatttcgatatggaggtttgggctctgggactgcatgaaaattcggggtcagaatggacttcagttttgctatacgtcccatctattatttatgcaatcgtgatcgagatcatgaacaggctctacaggtatgccgcagagtttttaaccagctgggagaatcacaggctggagtcagcgtatcaaaaccacctcatcctgaaggtgctagtgtttaatttcctcaattgctttgcttcattattttatattgcatttgtgttgaaggacatgaagctgttgaggcaaagtctcgccacactcctgatcacatctcagatcctgaatcagattatggaatcttttctcccatactggctgcagaggaaacacggagtacgggtcaaacggaaggtgcaggcactgaaagccgatatagatgccactctctatgagcaagttattcttgagaaagagatgggcacctatctcgggaccttcgatgactacttagagctgtttctgcaatttggctatgtttcgctcttttcatgcgtgtaccctctagcggcggcatttgcagtgctgaacaatttcacagaggtcaactcagacgctcttaaaatgtgccgggtcttcaagaggcctttctcggaaccgagtgccaacataggggtttggcagctggcattcgaaaccatgtcggtcatcagtgtggtaaccaattgcgccctcatcgggatgagtccccaggtgaatgccgtgttcccagagagcaaagccgaccttattctcatcgtggtagctgtagagcacgcgctgcttgcactgaagtttatactcgcgttcgcgatcccagacaagcctcggcatatccagatgaaactggcacgcctggagtttgaaagcctggaggccttgaaacagcagcaaatgaaactcgtgacagaaaaccttaaagaggagccaatggagagcggcaaagagaaggctacctag

SEQ ID NO: 108399 - DNA, 2997 bp, Artificial Sequence
  Description of Artificial Sequence: Synthetic coding sequence
atgccagaagatatccccctgctgccggggtcacccagacggctctcgccacaagccggctccaggggcggtcagggacctaagcatggacaacaatgtttaaagatgccaggacctagagcgccaggcctgcagggcggatctaatagggatcccggccagccgtgcggtggggagagcacccggagcagcagtgtgattaacaactacttggacgccaacgagcccgtctctttagaagcccggctgtctcggatgcactttcacgacagtcagagaaaggtggattacgtgttggcataccactatagaaagcggggcgtgcacttggctcagggcttcccagggcactccctggccatcgtatccaacggcgaaacaggcaaggagcctcacgccgggggtcctggtgatattgagctgggacctctggatgccctagaggaggagcgtaaggaacagcgcgaggagttcgaacacaatctgatggaagccggtctggagctggaaaaggatctggagaacaaatcccagggctccatcttcgtacggatccacgccccctggcaggtccttgccagggaggctgagttcctgaaaatcaaagtgcccacaaagaagatgtatgagataaaggcaggtgggagcatcgccaagaagttctcagctgctctgcagaagttaagttctcacctgcaaccgcgcgtgccggagcattctaacaacaagatgaaaaatctgtcctacccctttagcagggagaaaatgtatctctataacatccaagagaaggacactttcttcgacaatgccacacgatcaaggatcgtacatgagattctaaaacggactgcttgcagcagggcgaataatacgatgggcattaatagcctcattgcaaataacatctatgaggccgcttatcctctgcacgacggagagtacgatagtcctgaagatgatatgaatgatcgtaaactactttaccaggagtgggcccggtacggggtgttctataagttccaaccaatcgacttaatccgcaagtacttcggcgaaaagatcggcctatacttcgcctggctcggtctgtatacatctttcttgattccttcaagcgtaattggcgtgattgtctttctgtacggctgtgcgactatcgaggaagacataccatcaagggaaatgtgcgaccagcagaatgcttttacgatgtgccctctatgcgacaaatcctgcgactactggaacctgtctagcgcctgtgggaccgcccaagcaagccatttattcgacaatcccgccactgtgttctttagtatcttcatggccctctgggccacaatgtttctggagaactggaagaggcttcagatgaggctcggctacttctgggatttgaccggcattgaagaagaagaggagagggctcaggagcactcacgacccgaatacgaaacaaaagtccgagagaaaatgcttaaggagagcaatcagagtgccgtccagaaactggagaccaataccacagagtgtggcgacgaagacgacgaggataaattgacgtggaaagatcggtttcccgggtatctaatgaacttcgcctcaatcctgttcatgatcgcactaacatttagcattgtgtttggagtgatcgtgtacaggatcaccacggcggccgcactgtcgctcaacaaggctacccggtcaaacgttagagttaccgttaccgctaccgccgtcattattaatctggtagtgattctgatcttagatgaaatctacggcgctgtagctaaatggctgacaaagattgaggtccctaaaacagaacaaacttttgaggagcgtctgatactgaaagccttcctgctcaagttcgtcaatgcctacagcccgatcttttatgttgccttttttaaaggcaggtttgttgggcgacccggtagctatgtatatgtgtttgatggatatagaatggaagagtgcgcccctggaggctgcctgatggagctgtgcattcagctcagcataatcatgctcgggaagcagttaattcaaaataatatctttgagataggggtccccaaactgaaaaagctgtttagaaagctgaaggatgagaccgaagctggcgaaacggactccgcccattccaagcatcccgagcagtgggaccttgattatagccttgagccgtacaccggtttgacccccgagtatatggagatgatcatccaattcgggtttgtgactctgttcgtcgcttcattccccctggccccagtgtttgcacttttaaacaatgtaattgaagtgcggttggacgctaagaaatttgttacagaactccggcgccctgatgcagttcggacgaaggatatcggaatctggttcgatattctgtccggcatcggaaaattctccgtgatttccaacgcatttgtgatagctattacttctgattttatcccgcgcctggtgtatcagtatagctacagccacaacggcacccttcacggatttgtcaatcatactttatctttctttaatgtgagccaacttaaagaaggcacacaacccgagaattcccagttcgaccaggaagttcaattctgccggtttaaggattacagagaaccgccctgggccccgaacccttacgagttctctaaacaatactggttcattttgtctgctaggctggccttcgtcataatattccagaatctggtcatgttcctctcagtgctggtggactggatgatccccgacatcccaacagacatttcagatcaaattaagaaagagaaatcattactggtcgacttcttcctcaaggaggaacacgaaaagctgaagctaatggacgagcccgccctaagaagtcctggggggggagaccgcagccggtcccgtgctgccagcagcgcaccaagcgggcagtctcaactgggaagcatgatgtcgtctggttcccagcacactaacgtgtag

SEQ ID NO: 108400 - DNA, 3000 bp, Artificial Sequence
  Description of Artificial Sequence: Synthetic coding sequence
atgccagaagatatcccccttctcccgggaagtcctagacgactgagccctcaggcgggcagtcggggcggccagggtccgaaacatggacagcaatgcctcaagatgcctggacctcgtgctccaggcctacaaggtggcagtaatagagaccctgggcaaccttgcggtggggaatccacgagaagtagctccgtgataaacaactatctggatgccaatgagcctgtgtctctcgaagcaaggctctctaggatgcactttcatgattcccagcgcaaggtcgactacgttcttgcttatcactataggaaaagaggggttcacttggctcagggatttcccggtcacagcctggctatcgtgtccaacggggagacaggaaaagaaccacacgccggcggtccaggggacattgaactgggacctctagacgccttagaagaagaacgaaaggaacagcgcgaagagttcgaacacaatttaatggaggcgggcctcgagttggagaaggatctggaaaataagtctcaaggttccatctttgttcgtattcacgcgccctggcaggtccttgcgcgggaagcggaatttctgaagatcaaggtgcccacaaagaaggaaatgtacgagattaaagccggcggatcgatagcaaagaaattctctgctgctctgcagaagctctcaagtcatctccagcccagggtgcccgagcactctaataataaaatgaagaatctctcttacccattcagccgggaaaagatgtacttgtacaatatccaggagaaggataccttctttgacaacgccactaggtctaggatcgtccatgaaatcctgaagcgaactgcctgtagccgggcaaataatacaatgggcatcaattccctgatcgccaataacatctatgaagccgcttaccccctccacgacggtgagtatgacagccccgaggatgacatgaatgaccgtaagcttttgtatcaggagtgggcacgctatggggtgttctataagttccagcctattgacctgatcagaaagtattttggggagaagattggactatacttcgcctggttgggtctgtatacgagttttctgataccgtcctctgtgatcggcgtcatcgtgttcctgtatggatgcgccacaatcgaggaggatataccctctcgggagatgtgtgatcagcagaacgccttcactatgtgtccactttgcgacaagagttgtgattattggaatcttagttctgcatgcggtaccgcccaggccagccatcttttcgataacccggccaccgtcttcttcagtattttcatggccttatgggccacaatgtttttggaaaactggaagcgattgcaaatgaggttgggctacttttgggatttgaccggcatagaagaagaggaagagcgggctcaagaacactcacgaccagagtacgagactaaggtgagggagaagatgcttaaggagtcaaaccagtcagccgtccaaaaactcgaaacaaataccaccgagtgcggtgatgaggatgatgaggataagctgacttggaaggacaggtttcctggttacctgatgaacttcgccagcattctatttatgatagctctgacattcagcatcgtgttcggtgtaatcgtttatcggataacaaccgcggccgctctgagcttgaataaagccactcgcagcaacgtgagggtcactgtaaccgctacagcagtcatcatcaatcttgtggtgatactgatacttgacgaaatctacggcgcagtcgccaaatggctgacaaaaatcgaagtccccaagactgagcagacgtttgaagaaagactaattctaaaggcattccttctgaaattcgtgaacgcttactcgcctatcttctacgtggctttcttcaaagggaggttcgtggggcggcccggcagttatgtctacgtgttcgacgggtatcgcatggaagagtgcgcaccaggcgggtgtctcatggagctgtgcattcagctgtctattattatgttaggcaagcagctgatccagaataacatcttcgagatcggggtgccaaaactcaaaaaactcttccggaaactgaaggatgagaccgaagccggcgagaccgatagtgcccatagcaagcatcccgaacaatgggatctcgattactccctggaaccttatacagggctcaccccagaatacatggagatgattattcagttcggcttcgtcaccttgtttgtggctagcttccccctggctccagtgttcgctttactcaataatgtgatcgaggtgcggctcgatgcaaaaaaattcgtgacggaactgaggaggccagatgccgtgagaaccaaggacatcggaatatggttcgatatcctgagcggaattggcaagttctctgtcatatcaaacgcctttgtgatagccatcaccagcgatttcatcccccgattagtttatcagtatagctacagccacaatggtaccctgcacggattcgtcaaccatactctgagcttctttaacgtatcccagctgaaggaaggaacacagcctgagaactctcagtttgaccaggaagtgcaattctgtcgctttaaggattaccgagagcctccctgggcccccaacccatacgaattttctaaacaatactggttcatcctgagcgcacgcctggccttcgtgataatattccaaaatttagtaatgtttctgagcgtgctggtcgactggatgatccctgatattccaacagacatctctgatcagataaagaaggaaaaaagcctcttggtggatttttttctgaaggaggaacatgagaaattgaagcttatggatgagcccgccttgcggtctcctggggggggagaccgatcccgctccagagcagcctcgagcgcaccatctggccaaagccagctggggagtatgatgtcctcaggctctcagcacacaaacgtgtag

SEQ ID NO: 108401 - DNA, 3012 bp, Artificial Sequence
  Description of Artificial Sequence: Synthetic coding sequence
atggcaacacccggtcccagggatatcccgctcctccctgggtcgccacgccgcctcagcccccaagcgggttctcggggcggccagggcccaaagcacgggcagcagtgtctcaaaatgcccggaccacgggctccaggcctccagggcggctccaaccgcgatccaggccaaccctgcggcggcgaatccactcgctcgagcagcgtaatcaacaactatctggacgctaatgaaccggtgagtctggaagctcgactatcccgtatgcatttccacgactcacagcggaaggtggattacgtcctggcgtaccactacaggaaacggggtgtgcacctcgcccagggctttcccgggcacagccttgcgattgtcagtaatggcgaaacaggaaaggaaccccatgccggcgggcccggagatattgagctgggcccgctcgatgccctcgaggaggagagaaaggagcagcgggaagagttcgaacacaatctgatggaggctggactggagctggagaaagatctggagaacaaaagtcaaggtagtatttttgtcagaattcacgccccttggcaggtcctggccagagaagctgagttcttaaagataaaggtgcccacaaagaaggagatgtacgaaatcaaggccgggggttcaatcgccaaaaagttctcagctgcactccaaaagctgagcagccacttacagccacgggtccccgagcatagcaataataagatgaagaacttatcttaccctttcagccgggagaagatgtacctctataacatccaggagaaagataccttcttcgacaacgcaacgcgctcccgtatagtgcacgaaattctaaagcggactgcctgcagccgggccaataacaccatggggatcaactccttgatcgcaaacaacatctatgaggccgcgtatcccttgcacgatggggagtacgatagcccggaggacgatatgaatgacagaaagctgctgtaccaggagtgggctaggtatggcgtcttctataaattccaaccaattgaccttatacggaaatactttggcgagaagatcggcttgtactttgcttggctggggctttatacatcctttctgataccatcctccgttattggagtgattgtgttcctttacggctgcgccaccatcgaggaggacatcccatctagagaaatgtgcgatcaacagaacgctttcaccatgtgcccgctttgcgacaagtcgtgtgactactggaacctttcctccgcctgcgggaccgcacaagcatcccatttatttgacaaccctgcaacagtgttcttcagcatcttcatggctctctgggctacaatgtttttagagaactggaagcgcctgcagatgcgcctgggttatttttgggaccttacgggaatcgaagaggaagaggaaagagcacaggagcactctcgccctgagtatgagaccaaagtacgtgagaaaatgctgaaggagtctaatcaaagtgccgtgcaaaaactggagaccaacactactgaatgcggggatgaggacgacgaggacaagctgacctggaaagaccgcttccccggctatttaatgaactttgctagtatcctcttcatgattgcactcacattcagcatcgtcttcggggtcattgtatatcgtatcacgaccgcggccgcactgtcccttaacaaggctacgagatcaaacgtaagggtaactgtgaccgcaactgctgtgataatcaatctggtggttatactgattttagacgaaatctacggagcagtagctaaatggctcactaagattgaagtccctaagacagaacagaccttcgaagaaaggctcattctgaaggcgttcctgcttaagttcgtaaacgcctattcgcccatcttttacgtggctttcttcaaaggacggtttgtcggtcgccctggaagctatgtgtacgtctttgatggctacagaatggaggaatgcgctcccggaggatgcttaatggagctttgtatccagctgtccataatcatgctggggaagcagctgatccaaaataacattttcgaaattggtgtccccaaattaaaaaaacttttcaggaagcttaaggatgagaccgaagccggggagacagattctgcccactctaaacatcccgaacagtgggatctggactacagtctagagccttacacagggttgaccccggaatatatggaaatgatcatccagttcggcttcgtaaccctgtttgtggcttcattccctctggcacccgtcttcgccctgctcaataatgtgattgaagtaagactggatgcgaaaaaattcgtgacagaactgcggcgacctgatgcggtcagaactaaggacataggcatctggttcgatatacttagtggcattggcaaatttagtgtaatcagtaacgcgtttgttatcgctattactagcgactttattcctagactggtgtatcagtactcttactctcacaatgggacactgcacgggttcgtaaaccatacactaagcttctttaacgtgtcccagcttaaagagggcacacaacccgaaaacagccagtttgaccaggaagtacagttctgtaggtttaaggactaccgtgagccaccctgggctcccaatccctacgagttttccaagcagtactggttcatcctgtcagcaagactggcatttgtgatcatatttcagaatcttgttatgtttctctctgtcttggtggactggatgattccagacattcccaccgacatctccgatcagattaagaaggagaaaagcctgttggtggatttctttctcaaggaagaacacgaaaagctcaagttaatggacgagccagctcttcggtctcctggcgggggggatcgtagcagatcaagagccgcttcaagcgctcctagcgggcagtcacagcttggtagtatgatgtcgtccgggtcccagcataccaacgtgtag

SEQ ID NO: 108402 - DNA, 261 bp, Artificial Sequence
  Description of Artificial Sequence: Synthetic coding sequence
atgttcctcagcgtactggtggattggatgatcccagatatccctaccgacatctccgatcagatcaaaaaagagaaatccttgctggtggatttcttcctcaaagaagagcacgaaaaattgaaactcatggatgaacccgccctgcggtcgccagggggcggagaccggtctcgcagcagggcagcttcttcagctccctctggacagtcacaacttggcagtatgatgtcctccggctcccagcacactaatgtttag

SEQ ID NO: 108403 - DNA, 3000 bp, Artificial Sequence
  Description of Artificial Sequence: Synthetic coding sequence
atgcccgaagatattcccctcttaccgggtagtccacgcaggctgagcccccaggcagggtcgaggggagggcagggcccgaagcacgggcagcagtgcctaaaaatgcccggaccccgagccccgggcctgcaaggcggctcgaaccgagaccccgggcagccgtgtggaggagagagcacaaggtcaagctcggtcatcaacaattatcttgacgccaacgaaccagtatccctggaggccaggctttctaggatgcactttcatgattcccagcgcaaagtagactacgttttagcctatcactacagaaagagaggtgtccacttggcccaggggtttcccgggcattcactggccattgtgtcaaatggcgaaaccggaaaggagccacacgccggaggaccgggagacattgagttgggaccactggacgccctggaagaggagcgcaaggaacagagggaggagttcgaacataatctcatggaggctgggctcgaactggagaaggacctcgaaaacaagtctcaggggagtatttttgttcggattcatgccccctggcaggtgctcgcccgcgaagctgagtttttaaaaatcaaagtgcctaccaaaaaggaaatgtacgaaattaaggccggcggtagcatagccaagaaattcagcgccgccctccagaagctgagtagccatctgcagccacgggtccctgaacactcaaacaataagatgaaaaacctatcttacccctttagcagagaaaaaatgtacctgtacaacatccaggaaaaagacactttttttgacaacgcaaccaggtctagaatcgtgcacgagatcttgaaaagaactgcctgtagtagggccaataatacaatgggcataaacagcctgattgctaacaacatctacgaggcggcctatcctctgcatgatggggagtatgattctccggaggacgacatgaatgaccgcaagctgctgtatcaggaatgggcccgatatggcgtgttttacaagtttcagcccattgatcttatccggaaatacttcggcgaaaagatcggtctctacttcgcctggctcggactgtacacaagtttcctaatcccttcaagcgtaatcggggttatcgtcttcctatacggatgtgccacgattgaggaggacattccttctagggagatgtgcgatcagcaaaacgccttcactatgtgcccactgtgtgacaagtcctgtgattactggaacctgagtagtgcgtgtggcaccgcccaggcctcacatcttttcgacaatccggcaaccgtcttctttagcatttttatggcattgtgggccaccatgttcctggaaaactggaagagattgcagatgcggctcggctacttctgggacctgacgggaattgaagaggaggaaccccgagtccaggaacattctcggccagagtacgaaacgaaggtccgcgaaaagatgctcaaggagtccaatcagtcagcggtccagaaactggagaccaacactactgagtgtggagatgaggatgacgaggataagctcacctggaaagataggttcccaggatacctgatgaacttcgctagtatactctttatgatcgcattgactttctcaattgtgtttggagttatcgtgtatcggatcactacggccgctgccctctcactaaataaggcaaccagaagcaacgtacgggtcaccgtaacagcaaccgccgtgatcattaacctggttgtaatccttattcttgatgagatttacggcgctgttgccaaatggctcaccaaaatagaagttcccaaaacggaacagaccttcgaggagcgtctgattcttaaggcttttctgctgaagttcgtaaacgcttactccccaatcttttatgtggctttctttaagggtagatttgtgggcagacccggctcttatgtgtatgtgtttgatggttacagaatggaggaatgtgctcctggagggtgcctcatggagttatgcatacaattgtcaatcatcatgctggggaagcaactgattcagaacaatatcttcgagataggagtacctaaattgaaaaaattgtttcggaagctcaaagatgaaaccgaagctggtgaaacagactcagcgcacagcaaacatcctgagcagtgggacctggattacagtctcgagccgtataccggactgacccctgaatatatggagatgatcatccaattcgggtttgtgacactgttcgtggcgagtttcccgttagcacccgtgtttgcgctgctcaataacgtgatcgaagttagactggacgccaagaagtttgttactgagctgcgtcgccctgacgcagtgagaactaaggatatagggatttggttcgacatcttgtcaggaattggaaaattttcagttattagtaacgcctttgtcattgccatcacgtctgattttattccacggctggtgtaccaatactcttacagccacaatggaacccttcacggatttgtgaatcatactctgtcattctttaacgtgtcccaattgaaagagggcacacaaccagaaaattcacaatttgaccaggaagtgcagttctgcagatttaaagactatagagagccgccctgggcccctaacccctatgaattttctaagcaatactggttcattctgtctgctcgcctcgccttcgtgataatcttccagaacttagttatgttcctctccgtgctcgtagattggatgattcccgacattccaaccgacattagtgaccagatcaagaaggagaaatccctcctcgtcgacttcttcctgaaagaagaacacgaaaagctgaaactgatggacgaacctgcgctgcggagtcccggtggaggagacagatcacggagccgtgctgcctcaagcgccccatctggccagtcccaacttgggagcatgatgagtagcgggtctcaacataccaatgtatag

SEQ ID NO: 108404 - DNA, 2742 bp, Artificial Sequence
  Description of Artificial Sequence: Synthetic coding sequence
atgggcgaccctgatttgttagaggtgttggccgaggaaggggagaaggtcaacaaacatatcgactacagcttccagatgtccgaacaaagcctgtctagccgcgaaaccagctttttgataaacgaggagaccatgcccgccaaaagatttaacctgttcctgcgacgcaggctcatgttccaaaaaaatcagcagtccaaggatagtatctttttccgcgacgggattcgacagattgacttcgtactcagctacgtggatgatgttaaaaaggacgccgagcttaaggccgaaaggcggaaggagttcgaaacaaatttgagaaagaccggattggaacttgagatcgaagacaagagggacagtgaagacggccgtacttacttcgtaaagatacatgccccttgggaggtcctggtgacttatgctgaagttttaggcatcaagatgccgattaaagagtctgatataccacgcccaaagcacacccctattagttacgtactcggcccagttaggctgcctctatcagtaaagtatccccaccctgagtacttcactgcccagttcagccgccatcgacaggaactttttttgattgaagatcaggccaccttcttcccaagctcgtcccgaaaccggatcgtgtactacatccttagccgatgcccctttggcatcgaagatggaaaaaagaggtttggcatcgagaggctcctaaattctaacacctactcctctgcttatccgctacacgatggccaatattggaagccttctgagcccccaaatcccaccaatgagaggtacactctgcaccagaattgggcccgcttcagttacttttataaggaacagcccctggatctcatcaagaattattacggggaaaagatcggcatctattttgtctttctgggcttttacaccgagatgctgttcttcgccgctgtcgttggcttagcttgctttatttacgggcttctctccatggaacacaatacctcctctaccgaaatctgcgaccccgagatcggcggtcagatgatcatgtgtcctttatgtgaccaggtttgtgactactggagattgaactcaacttgtctggctagcaaattcagccatttattcgataatgaatcgactgtgttctttgcgatcttcatggggatctgggtgaccctcttcctggaattttggaagcagcgacaagccagattggagtacgaatgggacctggtggatttcgaggaagaacagcagcagttgcagctgcgccctgaattcgaggccatgtgcaaacatcgcaagctgaacgccgtgaccaaagagatggaaccatatatgccattatatactcggatcccttggtacttcctatcaggggcaacggtcaccctctggatgagcttggtggtgacgtccatggttgcagtgattgtttacagactgtccgtctttgcaacgttcgcctcatttatggaatccgacgccagcctgaaacaggtgaagtctttcctgacccctcagatcaccaccagcctcacaggtagctgccttaactttatagtgatcctcatcctgaacttcttctatgaaaaaatatccgcgtggatcactaagatggagattccgcggacttatcaggagtatgaaagttctcttacactgaagatgtttctctttcaattcgttaatttttatagcagctgcttttacgtcgcctttttcaagggcaagtttgtgggatatccgggcaaatacacttatctgtttaacgagtggaggtctgaggagtgtgaccctggagggtgcctgattgaactgactacgcagttgaccatcatcatgaccgggaagcagatctttgggaacattaaggaggcaatatatcctcttgcactgaattggtggcgaagacgaaaagcaagaaccaacagcgagaagctttatagcaggtgggagcaggaccacgaccttgaaagtttcggacccctcggtttattctacgagtaccttgaaacagtgactcaattcggatttgtgacattattcgtagcctccttccctcttgccccgcttttagcccttattaataacattgtcgagataagggtagacgcctggaagcttaccacacagtataggcgcactgtagcgagtaaagcgcactcgataggggtttggcaggacatcctttacggcatggccgtgctgtcagtggctactaatgccttcattgtggcttttacttccgacataatcccaagactcgtgtactattacgcctactccaccaatgccactcagcccatgaccggctacgttaataattccttgtctgtgtttctgattgccgattttccaaaccacactgccccttctgaaaaaagagactttatcacatgccgctaccgcgactaccgataccccccagacgatgagaataaatatttccataacatgcagttttggcacgtgctcgccgcaaaaatgacattcattatagtgatggaacatgttgtctttctggtgaaatttttacttgcatggatgatccccgatgtgcccaaggatgtggtggagcgcatcaaaagagagaagctgatgacaatcaaaatactgcacgactttgaactgaataaactgaaggaaaacttgggaatcaattccaacgaattcgccaaacatgtgatgattgaggaaaacaaggctcagttggccaagagtacactgtag

SEQ ID NO: 108405 - DNA, 2733 bp, Artificial Sequence
  Description of Artificial Sequence: Synthetic coding sequence
atgaagaaaatgagcaggaatgtgttactccagatggaggaagaagaggacgacgatgacggagacattgtcctggaaaatctcggccagacaattgtcccagatctgggctcccttgagagtcagcacgactttagaaccccagagtttgaagagtttaacggcaaacctgacagtctgtttttcaacgacggacagcggcgcatcgacttcgttttggtctacgaggatgagtcgagaaaggagacaaacaaaaagggcaccaacgagaaacagaggcgaaagaggcaggcttacgaaagtaatctgatttgccacggactgcaattagaggcgacccggtctgtcctggacgacaagctggtttttgtaaaagtgcatgctccttgggaggtgctgtgtacctatgctgagataatgcacattaagttgcctctgaaacctaatgacctgaaaaatcgcagttctgctttcggcaccctgaactggttcactaaagtgctctctgtggatgaatccatcatcaagcccgagcaagagttttttaccgccccattcgagaagaataggatgaatgacttctacattgttgatcgcgacgcatttttcaacccagctacccggtcgcggatcgtgtatttcatcttgtcgcgtgtgaaataccaggttataaacaacgttagcaagttcggaataaatagattggtcaattctgggatctataaggccgctttccctctccatgattgtaaatttcggagacagtccgaggacccctcctgtcctaatgagcgttatctcctttacagggagtgggcccacccccggtccatttacaaaaagcagcccttggatctcataagaaagtattatggggagaagatcggaatctactttgcctggctgggttactacactcagatgctgctgctcgctgccgtggtgggtgttgcctgcttcctgtatggatacttgaatcaggataactgcacctggagtaaggaggtttgccatcccgacattggcggtaagataatcatgtgtccccagtgtgatagactgtgtcccttctggaagcttaacatcacttgcgagtcttcaaaaaaactctgtatcttcgattcattcgggacactcgtttttgctgtttttatgggcgtctgggtcacactctttctggagttttggaaacgtaggcaggctgagctagagtacgaatgggacaccgttgaactgcagcaggaggagcaggctcggccagaatacgaagcaaggtgtacgcatgtggtgataaatgagatcactcaggaggaagagcgaatcccttttacggcctgggggaaatgcatccggattactctgtgcgccagcgcagtgttcttctggattttactgatcatagcttcggtgattggcattattgtctatagactctcagtctttattgtgttctctgccaagctgccaaaaaacatcaacggcacagaccccatacagaaatatctgaccccacaaaccgcaacatcaataaccgcttctatcattagtttcatcattattatgattctgaacaccatttacgagaaggtcgccatcatgatcaccaattttgagctgccaaggactcagactgactatgaaaatagcctaacaatgaagatgtttctgttccagttcgttaactattactctagctgtttttacatcgcttttttcaaagggaaatttgtcggatatcccggagatccagtctattggttgggcaagtatagaaacgaagagtgcgaccctgggggctgcctgctagaactgaccacacagctgacaatcattatggggggaaaggccatctggaacaacatccaggaagtgctgcttccatggataatgaatctgattggccgatttcaccgcgtttccggatctgagaaaattactcccagatgggagcaagactaccacctccagcctatgggaaagctgggcctgttttatgaatatcttgagatgattatccagtttggctttgtcacactgttcgtggccagcttcccgctggctccacttcttgcccttgtgaacaacatcctggagattcgcgtcgatgcatggaagctcaccactcagttcagaaggctggtgcccgagaaggcacaggacataggcgcttggcagcccatcatgcagggtattgctatcttggccgtggtgactaatgccatgatcatcgccttcacctccgacatgattccacgattggtatattactggagtttttctgtacccccgtatggcgatcatactagctacacaatggaaggttatattaataacactctgagtatctttaaggtggcagactttaagaacaaatccaagggaaacccctatagtgacctgggtaaccacactacttgccgctaccgcgacttcaggtaccctcctggacaccctcaagaatataaacacaatatttactattggcacgtcattgctgctaagttggctttcatcatagtgatggagcacgtaatttacagtgtcaaattctttatctcctatgctatccccgatgttagtaaaagaaccaagagtaagatacagagggaaaaatatctgacacaaaagttactgcatgagaatcacctcaaggatatgacaaagaacatgggcgtgatcgccgaaagaatgatcgaggccgttgacaataatcttcgtcccaagtccgaatag

SEQ ID NO: 108406 - DNA, 2790 bp, Artificial Sequence
  Description of Artificial Sequence: Synthetic coding sequence
atgaagaaaatgagccgcaatgtgctgttgcaaatggaagaggaggaggacgacgatgacggagatatcgtgctggagaatctgggccagaccatcgtgccagatttgggctctcttgaatcccaacatgactttagaacccctgagttcgaggagttcaatgggaaacccgacagtctgttctttaacgacggccaaagacgcattgacttcgtgctggtatacgaggacgaaagtcgaaaggagaccaataagaagggcactaatgagaaacagcggcggaagagacaagcgtacgagagtaatcttatctgccatggcctccagttggaagcaaccagatctgtgctcgacgataaactggttttcgtcaaagtgcatgccccatgggaggtcctgtgtacatacgccgagataatgcatattaaattgccactgaaacccaacgacctgaaaaacagatcttccgctttcggcactctcaattggtttactaaggttctcagtgtcgacgagtcaatcatcaagccggagcaggagttcttcactgcaccctttgaaaaaaataggatgaatgatttctacatcgtggatcgagatgctttttttaatcccgctacacggagcagaatcgtctatttcatactttcacgggtgaagtatcaggtgatcaacaacgtgtccaagtttggcataaacaggctcgtgaacagtgggatttacaaagccgcctttcccctgcatgattgcaagttcaggcgccaatccgaggatccgtcctgccctaatgagaggtatctcctgtacagggaatgggcgcaccccaggtcaatttacaagaagcagccactcgacttaatccgcaagtactatggcgaaaaaataggaatttactttgcttggctcggttattacactcagatgctgctgctggccgccgttgtcggggttgcctgtttcctatacggctatctcaatcaggataactgcacctggtccaaagaagtttgccaccccgatatcgggggtaagatcattatgtgtccacagtgcgaccggctctgtcccttttggaagctcaacatcacgtgcgaatcgtccaaaaagttatgcatctttgatagcttcggtactctggtatttgcagttttcatgggagtgtgggtaacgcttttcttagagttctggaagagaagacaggccgagctagagtatgagtgggatactgttgagctacagcaggaagagcaagcgaggcccgaatatgaggctcggtgtactcatgtggttatcaacgagatcacccaagaagaagaaagaattcctttcacggcatggggcaagtgcatccgcatcacgctgtgtgccagcgcggttttcttttggatccttttaattatcgcctctgtgatcggaatcattgtgtaccgcctttcggtgtttatcgtcttcagcgcgaaattacccaaaaacatcaacggtacagatccgatacagaagtacctgacaccccaaacggccacaagtataacagcttcaattattagtttcatcatcataatgatcctcaataccatctacgagaaggtcgctatcatgataacaaattttgaacttcctcggacccaaactgactatgaaaattctctgaccatgaaaatgttcttattccagttcgttaattactattcttcttgcttttatatagcctttttcaaaggcaaatttgtcggctatccaggggatccagtttactggctgggaaagtaccggaacgaagagtgtgatccaggtggctgtctgctggagctcacaacccaattaacaatcatcatgggcgggaaagccatctggaataacatccaggaagtattgctcccatggattatgaatctgatcgggcgctttcatagggtttcagggtccgagaaaatcacaccacgctgggagcaggactaccacttgcaacccatgggcaaacttggacttttttacgagtacctcgagatgatcatccagtttggtttcgtaacactgtttgtggcctcattcccactggcccccctgctggctcttgtgaataacatcctggaaatcagggtggacgcctggaagctgactactcagtttcgaaggctggttcctgagaaggcgcaggacatcggagcttggcagcctattatgcaggggattgcgattctcgccgtggtgactaacgccatgattatcgcctttacctcagatatgatacctaggctggtatactattggtccttctctgtgcccccctatggcgaccacacctcgtacaccatggagggatacattaacaacacattgtcaatattcaaagtggccgacttcaaaaacaagagcaaggggaacccttacagcgatctcggaaaccacacgacttgtagatatagggactttagatatccccccggtcatcctcaggagtacaaacataacatctactattggcacgtgattgcggccaaactggccttcatcatcgtgatggagtacctcgccctgctgccccggctgggccatagcggaatgattttggcacactgcaacctgcgtctccccgtggattgctgtatgtgttatagatttgttgacgagataagacttcttgaacaactgacttccgacttcatcgattcactgtactacattttctcaatcagcatcatttccatttttttttctgtgactttcttcttcttgttgctttcactgggccccacaccttgcttcagcgtatcaaacttcctctcgtag

SEQ ID NO: 108407 - DNA, 2790 bp, Artificial Sequence
  Description of Artificial Sequence: Synthetic coding sequence
atgaaaaaaatgtccagaaacgtgcttctgcagatggaagaagaggaggatgatgacgatggcgatatcgttctggaaaaccttggccagacaattgtccctgatctcggaagcctggaaagtcagcatgacttccgcacacccgagttcgaagagttcaatggcaaacctgattccctgttcttcaacgacgggcagaggagaattgactttgtccttgtttacgaggacgaatcacgcaaagagaccaataagaaggggaccaatgaaaaacagagacgtaagcggcaagcgtacgagagcaatctcatttgtcacggcctccagttggaagccacccgaagcgttttagacgataagcttgtgttcgttaaggttcacgctccctgggaggtgttatgcacctacgcagagatcatgcacattaagcttccactgaaaccaaacgacctgaagaacaggagctccgcctttggcactcttaattggttcacaaaagtcctctccgtggacgaatcaattattaaacctgagcaggagttttttacggcaccgttcgagaagaaccggatgaacgatttttacatcgtggatcgagatgctttctttaatcctgcaacgagaagccggatcgtgtattttatcctctcgcgggtcaagtaccaggttatcaataacgtctcaaagttcgggatcaatagattagtcaattctgggatatacaaggcagctttccccctgcatgactgcaaatttcgacgccagagcgaagatcctagttgtcctaacgaacgctacctcctctacagagaatgggcccacccccggagtatttacaaaaagcaacctctggacctgatccggaaatactacggagagaagattgggatttacttcgcctggctagggtactatacccagatgcttttgctggcagcggtggttggcgtcgcatgctttctgtatggctacctcaatcaggataactgtacttggagtaaagaagtatgccatcctgacattggcggcaaaattataatgtgcccgcagtgtgaccgcttgtgccctttctggaagcttaacatcacttgcgaaagctctaaaaaactgtgcatcttcgatagcttcggaacccttgtgtttgctgtgtttatgggtgtgtgggtgaccttgttcctggaattttggaagagaagacaggcagagctggaatacgaatgggatactgtggaactgcaacaagaggagcaagcccgacctgagtacgaagctcgctgtacccatgtggtgatcaatgagatcactcaggaagaagagagaattccatttacagcatggggcaaatgcattagaataaccctctgcgcgagcgccgtattcttttggatcctcctcataattgcttctgttatcggaattatcgtgtaccgcctgagtgtcttcatcgtattctctgctaaacttccaaaaaatattaatggaacggacccaatccagaagtacctaacccctcagaccgccacctctatcactgcatctataatttcatttattatcatcatgatccttaatacaatctatgaaaaagtggctatcatgatcacgaactttgaactcccacgaactcaaaccgactacgaaaactccctaaccatgaagatgttcctgtttcaattcgtgaattattacagtagttgtttttatatagcattttttaagggcaagtttgtggggtaccctggggatcccgtgtattggttaggaaagtaccgcaacgaagaatgcgatcccggaggctgcctgctggaactcaccacacagctaacaataattatgggcggtaaggccatctggaacaacattcaggaagtgctgctcccatggataatgaatttgattggccgcttccaccgggtgtcaggtagcgagaaaatcactcctcgatgggagcaggactatcacctacagccaatgggcaagttgggactgttctacgagtacctagaaatgattattcaattcggcttcgtcaccctcttcgtagcctcgtttccactggcccccctcctggcactggtaaataacatcctggaaattcgggtcgatgcatggaagctgacgacacagttcaggcggctcgttccggagaaggcccaggatatcggtgcatggcaacctatcatgcagggaattgctattctggctgtggtcacaaacgctatgatcatcgccttcacctctgacatgattcccaggctggtgtactattggagcttctctgttccgccatacggggatcatacttcatatacgatggagggatacattaacaataccctatctatctttaaggtggccgacttcaaaaataagtccaaggggaacccctactcagatttaggcaatcacacaacatgtaggtacagagattttaggtatcctccaggtcatccacaggaatataagcataatatatattattggcacgttatcgctgctaagttagccttcatcattgtaatggaatatcttgctctgcttcctcgcttgggtcactctggtatgatactcgcccattgcaacttgagattgcccgtggattgctgtatgtgttaccgctttgtggacgagatcaggctgttggagcaactgacctctgatttcatagattctctctactatatcttctctatatcaattatctccatatttttttcagtgacttttttcttcttacttctctctcttgggcccaccccttgctttagtgtcagtaacttcctctcttag

SEQ ID NO: 108408 - DNA, 2679 bp, Artificial Sequence
  Description of Artificial Sequence: Synthetic coding sequence
atgttttgcgctgccgttctggaaaacctgggccagacaatcgtaccggacctgggttcccttgaatctcagcacgacttccggacccccgagtttgaggaatttaacggtaagcccgattctctcttttttaacgatggccagcgccgaattgacttcgtcctcgtttacgaggatgagagtaggaaggagaccaacaagaaaggcacaaacgagaagcagcgacggaagcggcaggcctatgagagtaatctcatttgccatggccttcagctggaggcgacccgtagcgtattggacgataagctcgtgtttgtaaaggttcatgctccctgggaagtgctgtgcacctatgcggagattatgcacatcaaactgcccctaaagcctaatgacctgaaaaaccgtagctctgccttcggaaccctaaactggtttaccaaagtgctatctgtagatgagtccatcatcaaaccggaacaggaattctttactgcgcccttcgaaaaaaaccgaatgaacgacttctatatcgtcgatcgagacgccttcttcaatcccgctaccaggtctcggattgtgtacttcatcctgagtcgtgtgaaatatcaggtgatcaacaatgtttcaaagttcggcattaaccggttggtgaattccggtatttataaggccgcatttcccttgcacgattgtaaatttcgcagacagagcgaggatccctcttgccccaatgaacgctacttgctgtatcgtgaatgggcacaccccagaagcatctataaaaaacagccgcttgacctcatccgcaagtactacggcgaaaagattggaatatactttgcctggctgggctactatacacaaatgctgttgctggcagcggtcgtgggggtggcctgctttctttatggttacttaaaccaggataattgtacgtggagcaaagaggtatgtcatcctgacatcgggggtaagattatcatgtgtcctcaatgcgatagattgtgtcctttttggaagcttaacatcacgtgcgaatccagcaaaaaactgtgcatctttgacagcttcggcacattagtgtttgcagtgtttatgggcgtgtgggtgaccctgttcctggaattctggaaacgcagacaagccgaactggagtatgaatgggacactgtcgagctccagcaggaggaacaggcccgcccagagtatgaagcaagatgcactcacgttgttattaacgaaattactcaggaagaggaaagaatccctttcacagcctggggcaagtgtatcagaatcaccctgtgtgcgagcgcggttttcttctggatccttttgatcatagcttctgtgatcggaataattgtgtaccggctgtccgtctttatagttttttcggccaagctgccaaaaaacattaacgggaccgaccctattcaaaagtatcttacacctcagaccgccacttcaattaccgcatccataatcagcttcatcatcataatgatcctgaataccatctacgagaaggtagcaattatgattaccaacttcgaactgcccagaacacagaccgattatgagaattcgctcacaatgaaaatgttcctcttccagttcgtcaactattatagcagctgtttttacatcgccttttttaaaggaaagtttgtggggtaccctggtgatcctgtgtattggctggggaaatataggaacgaagagtgcgatccaggggggtgtctactggagttaaccacccagctaacaatcataatgggaggtaaagccatatggaataacatacaagaggtcctcctgccatggattatgaacctaatcggtcggtttcatcgcgtcagcggaagtgaaaaaattacaccccgctgggagcaggactaccacctccagcccatggggaaactgggtctcttttatgagtacctggagatgattattcagttcggcttcgtcaccctctttgtggcttctttcccgctggctcctttattggccttagtcaacaatattctggaaatccgggtcgacgcctggaaactcaccacccagttcaggcgactagtccctgagaaagcccaggacattggcgcctggcagccaattatgcagggcattgccatcctggccgtcgtcaccaacgccatgatcatcgcatttacgtcagacatgatcccgcggctggtgtattactggagttttagcgtgcctccctacggtgatcatacgagctatacaatggaggggtatattaacaatacattgtcgattttcaaggttgccgacttcaagaataagtccaagggcaatccctattctgaccttgggaaccacacgacttgcagatatcgagattttcggtacccacccggacacccacaggagtataaacataacatctactattggcacgtcatcgcagctaaactcgcattcataattgtcatggagcatgtgatctattcagtcaagtttttcatctcttatgccatcccagacgttagtaagagaaccaagtctaagatccagagagaaaaatacctgacacagaaactactccacgaaaatcacctgaaggatatgaccaaaaatatgggagttatcgctgagcgaatgatcgaagccgtggataataacctgaggcccaaaagtgaatag

SEQ ID NO: 108409 - DNA, 2796 bp, Artificial Sequence
  Description of Artificial Sequence: Synthetic coding sequence
atgaagaagatgtcccggaatgtgctgctccaaatggaggaggaggaggacgacgatgatggagacatcggcgacgtgcctgcatccaggagaccatttctgacccctcacacacatctgccaagcagcctggtccttgagaatttagggcagaccattgtgccagatcttgggagtctagagagccagcatgattttcggacgcctgaattcgaggagttcaacggcaaacctgacagcctcttctttaatgacgggcaacgccgcatagacttcgtgctggtctacgaagatgagtctcgtaaagaaacaaacaagaagggaacaaatgaaaagcagaggaggaaacgacaggcctatgagagtaacttgatttgtcatggactacagttagaggcaacacggagcgtcctcgacgacaaactcgtgttcgtcaaagtccatgccccatgggaggttctgtgtacgtacgcagaaatcatgcacatcaaactaccgctcaagccgaacgacttgaagaaccggtctagcgcctttggcacccttaattggttcactaaagtgcttagtgtcgatgagagtatcatcaaacccgagcaggagtttttcaccgcccccttcgaaaagaacagaatgaacgacttttatatagtggatcgagacgccttcttcaaccccgcgacaaggtcacggattgtgtacttcattctgtcccgggtaaagtaccaggttatcaataatgtctctaaattcggaattaatcgccttgtgaactccggaatttataaagctgccttccctctgcatgattgtaagttccgacgccaatccgaggatccctcatgcccgaacgagcggtacttgctgtatcgggaatgggctcatccccggtctatttacaagaaacagcctctggacctgatacggaagtattatggcgagaagatcgggatttacttcgcatggttaggctattatacccagatgctcctcctggcagctgtggttggagtggcctgtttcctctatggctacctgaaccaagacaattgcacatggagtaaagaagtgtgtcatcccgacatcggaggcaagatcattatgtgcccgcagtgcgaccgattgtgtccattctggaagctcaacattacctgcgaaagttccaagaagctctgcatattcgactccttcgggactctcgtgtttgctgttttcatgggcgtgtgggtgactcttttcctggagttctggaagcgacgtcaggccgagctcgaatatgaatgggatactgtggaactccagcaggaagagcaggcaaggcccgagtatgaggcaagatgcacccatgtggtaataaacgagatcactcaggaagaagagcgaatcccctttacggcttggggcaagtgtatccgcatcaccctttgtgcctcagccgttttcttctggatcctgctgatcattgcttcggttataggaattattgtctaccgcctttcagtgttcattgttttctccgccaagcttcccaagaacattaacggcactgaccctatccagaagtacctgaccccgcagacagccacatccataaccgccagcattatttcttttattatcatcatgatcttgaatacaatttacgagaaggtagctattatgatcaccaactttgaattacctcgtactcagaccgattacgagaattcactgaccatgaaaatgtttctgttccaatttgtgaattactatagttcatgcttctatatagccttttttaaaggcaaatttgtgggatatcctggagaccccgtgtattggctagggaagtaccgcaacgaggagtgcgatccagggggctgtcttctcgaacttaccacccagctcactattattatgggaggtaaagcaatttggaataatatccaggaagtattactgccatggataatgaacttaatcggccgcttccatcgagtttcgggtagcgaaaaaatcacacctcgttgggagcaggattaccatttacagcctatgggaaaattgggtttattctatgagtacttagaaatgatcattcagttcgggtttgtcaccctcttcgtcgcatcattcccattggcccctttgttggccttggtgaacaacattctggaaattcgagtcgatgcctggaagctgaccacacagttcagaaggctcgtgccagagaaggctcaagatatcggggcgtggcaaccaatcatgcaaggcattgctatcctggcagttgttacgaatgccatgattatcgctttcacctccgacatgattcccaggcttgtttactactggagtttctcggttcccccatacggcgaccacacaagctacactatggaagggtacatcaataataccctgtctattttcaaggttgcagatttcaagaacaaatccaaagggaacccatacagtgacttagggaaccacactacctgccgatatcgggactttaggtacccccctggccacccccaagagtacaaacacaacatttattactggcacgtgattgccgccaagctagctttcataattgtcatggaacacgtgatatacagcgtaaaattcttcatttcttacgcaatccccgatgtgtccaagcggaccaagtccaagattcagcgcgaaaaatatttaacgcagaaacttctgcacgaaaatcacctgaaggacatgacgaaaaacatgggcgttatagccgagcggatgatagaggccgtcgacaacaatctgcgcccaaagtcagagtag

SEQ ID NO: 108410 - DNA, 501 bp, Artificial Sequence
  Description of Artificial Sequence: Synthetic coding sequence
atgatgcttcactctgctctcggactgtgcctcctgctcgtgacagtctcgtccaacctggcaatcgctataaaaaaggagaaacgtccaccacagacactttccaggggctggggggacgacattacttgggtccagacgtacgaagagggcctgttttacgcccagaagtctaagaaaccactgatggtgatacatcatctggaggactgccagtactcacaagctcttaaaaaggtgttcgcccagaacgaggaaatacaggagatggcacaaaacaagtttataatgttgaacctcatgcacgagaccaccgataaaaacttgagccctgacggccagtatgtcccacgcattatgttcgtggacccaagcctgacagtgagagcagatatcgctggtcggtattcaaataggttgtacacctatgagcctcgcgatctgccactgctgatcgaaaatatgaaaaaggctcttaggctcatacaatccgagctttag

SEQ ID NO: 108411 - DNA, 453 bp, Artificial Sequence
  Description of Artificial Sequence: Synthetic coding sequence
atgggtgctgcagtttttttcggatgtacatttgtagcctttggacccgctttcgccctgtttcttataactgtggccggggatcccctgcgggtgattatcttggttgcaggaaaggccgacgagggtcttgcatctctctctgaggacgggcgctcccctatctcaatacgccagatggcatacgtgtccgggttgtcctttggaatcatcagcggtgtgttctcagtcattaatattctggctgacgctctgggacctggagtggtggggatccatggcgattcgccatactacttcttaacttcagcttttctgacggctgccatcatactgttacacacattctggggtgtcgtctttttcgacgcttgtgagaggaggaggtactgggccctgggactggtggttggatcgcaccttctcaccagcggccttacctttctaaactag

SEQ ID NO: 108412 - DNA, 744 bp, Artificial Sequence
  Description of Artificial Sequence: Synthetic coding sequence
atgggggcagccgtgttttttgggtgcacatttgtcgcatttggacccgccttcgcactgttcctgattactgtcgccggggatccgttgagagtaattatcctggtggcaggtgcctttttctggctggtctcactcctcctggctagtgtggtgtggtttatacttgtgcatgtaacagaccgaagcgatgctcgcctgcagtatggcctgctgatcttcggcgccgccgtcagcgtactcctccaggaggtgttcagatttgcttattacaagttgctgaaaaaagccgatgagggcttggctagtttatcagaagacggccgttctccgatcagcatccgccagatggcttatgtttcgggattgtcttttggcatcatctccggagtcttcagcgtgattaatatcttagccgatgctttaggccccggagtggtgggaattcatggtgactcaccctattattttcttactagcgcttttctcacagcggcaattattctcctgcacacattttggggtgtggtatttttcgatgcctgcgagagaaggcggtactgggccctgggccttgtcgtaggttcccacctgctgactagtggattgaccttcctgaacccatggtatgaagcctcccttctccccatctacgctgtgaccgtgtcaatgggcctatgggctttcatcacagccggtggaagcctgcgatccatccaaaggagcctgttgtgcaaagactag

SEQ ID NO: 108413 - DNA, 798 bp, Artificial Sequence
  Description of Artificial Sequence: Synthetic coding sequence
atgggagcggctgtgttcttcggatgtaccttcgttgcgttcggccccgcattcgcactgttccttatcaccgtggcaggagatcccttaagggtgataatccttgtcgccggggctttcttttggctagtctctctattgttagccagtgtggtttggtttatcctggtacatgtgaccgatagaagtgatgctaggcttcagtacggactcctgatctttggggcagccgtttccgtcctgctgcaagaggtgttcaggttcgcctactataagttactgaagaaagccgatgaggggctcgccagtctgagcgaggacgggaggtctcctatctccatcaggcaaatggcgtatgtgtcaggcctgtcctttggcatcatctccggggtgttttccgttatcaatatactggccgacgccttgggtcccggcgtcgtggggattcatggcgacagtccttattatttcttgacttctgccttcctcacagccgctattattctgcttcacacgttttggggagtcgtgttcttcgatgcatgtgagcgcaggcggtactgggctttgggcctggtggtggggagtcatctgttgaccagtggactcacttttctcaatccctggtacgaagcatccctgctccccatttacgctgtgactgtgtcaatgggtctgtgggccttcatcactgcaggaggctcactgcgttcaattcaacgctctttattatgccggcgtcaggaagattccagggttatggtttactcggctctaaggatcccaccggaagattag

SEQ ID NO: 108414 - DNA, 588 bp, Artificial Sequence
  Description of Artificial Sequence: Synthetic coding sequence
atgggcgcggcagttttctttggatgcactttcgtagcctttggtccagccttcgccttgttcttgatcactgtggccggggatcccctgagagtaattatacttgtggcaggacgatgcagcgccctgcccacaacctcttgcctaatatccggattgtctttcggtatcatcagcggggttttttcggtgataaacattcttgcggacgctctggggccaggtgtggttggcattcacggtgacagcccttactacttcctaacctccgccttcctgacggctgccatcatactacttcacaccttttggggtgtggtgttctttgacgcttgcgaacggcgccgttattgggcacttggacttgtggtcggttctcatctgctgacgagtggcctaacttttctaaatccatggtacgaggcgtcactgctgccgatttacgccgtcaccgttagcatggggctctgggcatttattacagctggaggaagcctaagaagcatccagcgctctctactttgtagacggcaagaggattctcgggtgatggtctatagcgctctgcgtatcccgcctgaggactag

SEQ ID NO: 108415 - DNA, 774 bp, Artificial Sequence
  Description of Artificial Sequence: Synthetic coding sequence
atgacagccgcggtgttctttggttgtgctttcattgcttttgggccagccttagcactgtatgtgttcaccatcgcaaccgaacccctgcgcattatttttctaatcgctggagcattcttctggctcgtgagcctcctgatctcatctctcgtgtggttcatggcccgcgtgattattgataacaaagatggacccactcagaagtatttgctcatctttggggcctttgtcagcgtttatatccaagagatgtttcgatttgcatattacaaactgctgaagaaggcatccgagggtttgaaatcgatcaacccgggggaaacagcaccatcgatgaggcttttggcttacgtctccggccttgggtttggcataatgagcggagtgttttcttttgtcaacacactcagtgacagtctcggacccggcaccgtaggaattcacggagactcgccacagttctttctttactcagcattcatgacgctggtgatcatccttttacacgttttttggggaatcgtcttctttgatggttgcgaaaagaagaaatggggcatcctgctgattgtgttgctgactcacctgctcgtatccgcccagaccttcataagctcatactacggcattaacttagcatccgccttcattatcctggttttaatgggcacatgggccttcctggctgccggcggatcatgtaggagcctgaagctttgcctgctgtgtcaagacaaaaactttctcttgtataatcagcggtccaggtag

SEQ ID NO: 108416 - DNA, 246 bp, Artificial Sequence
  Description of Artificial Sequence: Synthetic coding sequence
atgaccgctgcagtgttttttggttgcgcgttcatcgccttcggccctgccttagcattgtacgttttcacaatcgccaccgagcctctgcgtatcattttcttaatcgcagggaggagggtggaaacatgtaagaatacagaagctccagattgtgcttctcccagcgggtctctgtcctttttattggtaggagtcagcaccgatttcgtcccatgtctggtgcatgggaagagccattactag

SEQ ID NO: 108417 - DNA, 651 bp, Artificial Sequence
  Description of Artificial Sequence: Synthetic coding sequence
atgactgctgccgtgttttttggctgtgcctttatagcttttggaccagctctcgctttatacgtctttaccattgccaccgaacctctgagaatcattttccttattgcaggagcattcttttggctcgtcagcctgctcataagttccttggtttggtttatggccagagtgataatcgataacaaagacggcccaacccagaaatacctgcttattttcggcgcctttgtcagcgtgtacatccaggagatgtttcggttcgcctactataagctcttgaaaaaggccagcgagggcttgaagtctatcaatcccggagaaacagccccctcaatgcggttgttagcgtatgccttcatgactcttgtaatcattttgttgcatgtgttttgggggatcgtctttttcgatggctgtgaaaagaagaagtggggcattttactcatcgtgctgttgactcatctcctggtgagcgcacaaacattcatctcctcctattacggaattaacctcgcttctgcatttatcatcctggtgctcatgggcacatgggcatttcttgctgcgggaggctcttgccggtcactaaagttgtgcctgctgtgccaggataagaatttcttgctgtataaccagcgcagccggtag

SEQ ID NO: 108418 - DNA, 1695 bp, Artificial Sequence
  Description of Artificial Sequence: Synthetic coding sequence
atggcaaccgccgagagaagggctctgggtatcggcttccagtggctgtccctcgctactctggtgctgatctgtgccggccaggggggtagaagggaggatggtggccccgcctgttacggggggttcgacctctatttcatactcgacaaatcgggatcagtattgcatcactggaacgagatatactactttgtcgagcagctggctcacaaattcatatctcctcagctgcggatgagcttcatagtgttctcaacccgcggcacaacgctgatgaaactgacagaagatcgcgaacaaataagacagggactcgaggagctgcagaaagttctgccaggcggcgacacctacatgcatgaaggattcgaaagagcttcagagcaaatttactacgaaaacaggcagggatataggacagcctccgtgataattgctctgacagacggcgaactccacgaggatttgtttttctattcagagcgcgaagctaacaggtcacgggacctcggagccatcgtgtattgtgtcggcgtcaaagacttcaacgaaactcagctggcccgcatagcagactctaaggatcacgtctttcccgtcaatgatggttttcaggctcttcagggcattattcatagtattttaaaaaagtcatgtattgagatcctcgccgctgagccctccaccatctgcgcaggcgaatcattccaggtagtggtgagaggaaatgggtttaggcacgcccgaaacgtggatagagtactctgttctttcaagataaatgactcggtcaccctgaacgagaagccttttagtgttgaggatacttacctgctgtgcccagcccctattctgaaagaggtgggcatgaaagccgccttacaggtatcaatgaatgacggattgtcctttatcagctcctcagtgataattacgactacccattgcagcgacgggtcaatcttggcaattgctctccttattctctttctactgctggccctagctctgctgtggtggttctggcctctatgttgtacggttatcattaaggaagtgcctccaccccctgctgaggagagtgaagaggaggacgacgacggcctgcccaagaaaaaatggccgacggtggacgcctcttactacggtggccgaggagtgggtggaattaaaagaatggaggtgaggtggggggagaagggctccaccgaagaaggagccaaactggagaaggccaagaacgcgcgtgtgaagatgcccgagcaggaatatgaatttcccgaacctagaaacttaaataacaatatgcgtcgcccatccagccctaggaaatggtattcccccatcaagggcaagttggacgccctctgggttcttcttcggaagggctatgatagagtgtcagtgatgagaccccagccgggtgatacaggcaggtgtatcaatttcactagagtgaaaaataaccagccagccaaatatccactgaataacgcctatcacaccagttcacctcctcctgctcctatttacaccccccctccccccgcccctcactgtcctccacccccaccatctgcccctactccacccataccaagcccaccaagcactttgccgccccccccccaggccccccccccaaaccgagctccacctcccagccggcctcccccgcggcccagcgtctag

SEQ ID NO: 108419 - DNA, 1107 bp, Artificial Sequence
  Description of Artificial Sequence: Synthetic coding sequence
atggccacggccgagaggagagcccttggcattggttttcagtggctgtcacttgcaaccctcgtccttatatgtgccgggcagggtggacgacgggaggacggaggcccagcatgttacggaggcttcgatctgtactttatcctggataaatctggaagtgtactgcaccactggaacgaaatctactacttcgtcgaacagctcgcacacaaatttatttcgccccagctccgcatgtcattcatagtcttttctaccagaggaacaacccttatgaagcttactgaggatcgagagcaaattcggcaagggctggaggagctgcagaaagttctacctggtggtgacacatacatgcacgaaggcttcgagcgggcatcggaacagatatactacgagaaccggcagggttatcggacggccagtgtcatcattgccttaactgacggggagctgcatgaggatctgttcttctatagtgaacgtgaagccaatcggtctcgggatttgggggctattgtgtactgtgtgggtgtaaaggattttaacgagacacaactcgcacggatagccgatagtaaggatcatgtgtttccagtgaacgacggctttcaggcactacaagggataatccacagtatccttaaaaagtcgtgcatagagattctggccgccgagccaagtactatatgcgccggggagtcctttcaggttgttgttaggggaaatgggtttcgccacgcccgcaacgtagacagagtgctctgctcatttaagattaacgattcggttaccttgaacgagaagccttttagcgttgaggacacctacctactgtgcccagcccctattctgaaggaggtcggcatgaaagcggctctacaagtgtctatgaacgacgggctgagcttcattagctcctctgtgatcattactaccactcattgttccgacggtagcattttggccatcgccctactgatcctgtttcttttgttggccctggctttgctttggtggttttggcctctatgctgtaccgtaataatcaaggaggtaccaccaccacctgcggaagagagcgaagaaaataagatcaagtag

SEQ ID NO: 108420 - DNA, 1002 bp, Artificial Sequence
  Description of Artificial Sequence: Synthetic coding sequence
atggctactgccgagaggcgagctctgggcatcggatttcagtggctctctctggctacccttgtgctgatatgtgccggacagggaggacgacgggaagacggcgggccagcatgctatggcggattcgacttgtattttatcttggacaaatccggatctgttctccaccactggaacgagatctactatttcgttgaacagctggcccacaagtttattagtccacagctaaggatgagcttcatagttttcagcaccagaggaactactctgatgaagctcaccgaggacagagagcagatccggcaaggcttggaggagcttcagaaggtactccccggaggagacacatacatgcacgaagggtttgagcgggcttccgagcagatatactatgagaaccgacaaggatataggaccgcaagcgtgataattgcgttaactgatggtgagctgcatgaggaccttttcttttacagtgaaagagaagcaaacaggtcccgtgatctgggtgctatcgtgtactgtgttggcgtgaaggacttcaacgagacccaactggccagaatcgcagatagcaaggatcacgtgttccccgtcaacgatggcttccaggccctgcaaggaataatccacagcatcctcaagaaatcttgtatcgaaattctagctgccgagccctctactatctgtgctggtgagtcgttccaagtcgtggtccgcggcaacgggtttagacacgcgcgaaacgtggacagagtcttgtgttctttcaagatcaacgatagcgtgactctgaatgagaagccgttttccgtggaagatacttatttgctctgtccagcccccatattgaaagaggtgggcatgaaagctgcactccaagtgtccatgaacgatgggctgagttttatctccagctcagtgattatcacaaccacccattgcagccttcataagatagcttccgggccaactacagccgcctgtatggagtag

SEQ ID NO: 108421 - DNA, 969 bp, Artificial Sequence
  Description of Artificial Sequence: Synthetic coding sequence
atggtcgctgagcggagtcccgctaggtcacccgggagctggctcttccctggactctggctgttggtgctaagcggacccggtggcctattgagggcacaggagcagccatcttgccgtcgggcgtttgacttgtacttcgtgctggataaaagtggaagcgtagcgaataactggatagagatttacaatttcgtacaacagctggcagaacgattcgtgtcccctgaaatgagactgtctttcattgtgttctcgtctcaggctactatcatcctacctcttaccggcgatcggggaaagatctctaaggggcttgaggacctgaaacgcgtgtctcctgtcggcgaaacatatatccacgaggggctgaaattggcaaacgaacagatccagaaagccggcgggctcaaaacaagtagcatcattatcgctcttacggacggcaagcttgacgggctcgtgcccagttacgccgagaaagaagccaagattagccgcagcctgggagctagcgtctattgcgtcggggtgctggacttcgagcaggctcaactggaacgaatcgccgacagcaaagaacaagttttccccgttaaaggagggtttcaagccttgaaaggcatcatcaattcaatcctggctcaaagctgcaccgagatcttagaactgcagccctccagcgtgtgtgtcggcgaagaattccagattgttctgagcgggagaggcttcatgttagggtctcgcaacgggtcagtgctgtgtacatatacagtgaacgagacatacaccacctccgtaaagccagtcagcgtacagctgaatagcatgctctgccccgctcctatcctgaacaaggctggcgagtggggactaactgtaacccaggccggagtgaagtggcatgatcttacacattgtacctttggactgagcggctccggggatcctcctacgtccgccagttag

SEQ ID NO: 108422 - DNA, 1470 bp, Artificial Sequence
  Description of Artificial Sequence: Synthetic coding sequence
atggtcgccgagaggagccccgcccgatctcccggctcatggctgttccctgggttgtggttactggttctgtccgggcccggagggctgttgagggctcaggaacagcctagctgccgtcgcgcattcgatctgtactttgtcctggataagagtggaagcgtggccaacaattggattgagatttataacttcgtgcagcagcttgcggagcgcttcgtgtcaccagaaatgcgcctgtcctttatcgtcttttcctcacaagctaccatcatcctgccccttacaggagataggggaaagatctccaagggtctggaagacctcaagagagtgtctcccgtgggcgagacttacatccacgaaggcctgaagcttgccaacgagcagatccaaaaggcaggcgggctgaagacctcatcaataattattgccctcaccgatggaaagcttgacggcctggtaccaagttacgcggagaaagaggctaaaattagtcgcagtttgggcgccagcgtctactgcgtgggagtgctcgatttcgaacaggcacagctcgagagaatcgcagattccaaagagcaagttttcccagtgaagggcggcttccaggctctgaagggaatcattaatagtattcttgcacagagttgcactgagattttggagctgcagccatcgtctgtgtgtgttggagaggagttccagatcgtcctctcgggcaggggatttatgctcggcagtcggaacggtagcgtcctgtgcacctatacagtgaatgagacatataccactagtgtcaagcccgtgtcagttcaattgaacagcatgttatgcccagccccaatactgaacaaggccggtgagaccctggacgtctctgtgagttttaatggggggaaatccgtcatctccggcagtttaatcgtgacagctaccgaatgcagcaatggcatcgcggcgatcatcgtcatcttggtcctgctcttgttgctaggcatcggcctcatgtggtggttttggcccctgtgttgcaaggtggtgattaaggatcccccccctcctccagctccggccccaaaagaagaagaggaggagcctctgccgacaaaaaagtggcctacagtggatgcctcatactacggaggtcggggcgtggggggtattaagaggatggaagtgagatggggcgacaagggctcgacagaggagggtgctaggttagaaaaagctaagaatgcagttgtgaaaattcctgaagagaccgaggagcctatcaggcccaggcccccacgtcccaagccaacccatcaaccacctcaaacaaagtggtacaccccaataaaaggtaggcttgacgcattgtgggcacttcttcgccggcaatatgaccgcgtctcacttatgagaccacaggagggcgacgaggtttgtatatgggaatgcatcgaaaaagaactgactgcatag

SEQ ID NO: 108423 - DNA, 1161 bp, Artificial Sequence
  Description of Artificial Sequence: Synthetic coding sequence
atggtagccgagcggagccccgctcgttccccagggagctggctctttcccggcctatggctgctggttttgtccgggcctggaggactgctgagggcacaggagcagccgtcctgtcggagggccttcgatctgtacttcgtgttagataagtcaggcagcgtggccaacaactggatcgagatctataattttgtgcagcagctcgccgaaaggtttgtgagtcccgaaatgcgtctcagcttcatagtgttctcctcccaagcgactattattcttcctctgactggcgatcggggcaaaatctcaaagggcctcgaagacttgaagcgggtgtctccagtcggggagacctatattcacgaaggtctcaagctggcaaacgaacagattcaaaaagccggaggattaaaaacttccagcattatcattgcgctaaccgacggcaaactcgacgggctggttccgtcctacgctgaaaaggaggcgaagatcagcaggtcactgggggcttcagtgtactgtgtcggcgttctggatttcgagcaggctcaacttgaaagaattgccgactccaaagagcaggttttccccgttaaaggcggattccaagcgctgaagggtataattaatagttccaacgggattgccgccatcattgttattttagttttgcttctcctgcttggcattggcctgatgtggtggttttggcctttgtgctgtaaggtggtgatcaaggaccctccgcctcctcccgcaccagcgcccaaggaggaggaggaggaacctttgccaacaaagaaatggcctaccgtcgacgcaagctattacggtgggcgtggcgtaggcggcatcaaaaggatggaggtgcggtggggcgacaagggatccactgaggagggagctagactggagaaggccaagaatgccgttgtgaaaataccagaggagaccgaagaacccatacgaccccggcccccacgtccaaagccaacccaccagccgcctcaaacaaaatggtatacgcccatcaaaggccggctggatgccttgtgggctctactgaggagacagtatgacagagtatccctgatgagacctcaggagggagatgaagtgtgtatatgggaatgtatagaaaaggagctgaccgcttag

SEQ ID NO: 108424 - DNA, 1467 bp, Artificial Sequence
  Description of Artificial Sequence: Synthetic coding sequence
atggttgcagagagaagccctgctaggtcgccaggctcctggctgttccctgggctatggctgttggtcctcagcggaccaggggggctgcttagagcgcaggaacagccttcttgtcgccgcgccttcgatctttacttcgtgctggacaaatcggggtctgtagccaataattggattgaaatctataacttcgtgcaacagcttgcagagagatttgtgtctcctgaaatgcggctctcctttattgtctttagctctcaggcaaccatcatcttacccttaactggcgatcgaggaaagatttccaagggcctcgaagatctcaagagagtgagccctgtgggcgaaacctatatccacgagggcctgaagttggccaatgaacagatacagaaagcaggcggactcaaaacctcttcaatcataattgcgctaacagatggcaagctggacggcctggtgcccagctatgcagagaaagaagcaaagatatctcgctctttgggagcgtccgtgtattgcgtgggcgtattggactttgagcaggcgcagctcgaacggatcgctgactctaaggaacaggtgttcccagtcaaaggagggttccaggccttaaagggcattatcaacagcattctcgctcagtcttgtacggagatcttagaactgcagcctagtagtgtgtgcgtgggcgaagaatttcagatcgttctcagcgggagaggcttcatgttaggctccagaaacggtagcgtgctgtgcacatacaccgtgaacgagacttataccaccagcgtgaaaccagttagcgtgcagctgaattcaatgctctgccctgcccccatccttaacaaggctggcgagacgctggacgtatcggtaagttttaatggcggcaaaagcgtcatcagtggatctttgatagttacggcaacagaatgctctaatggcatcgctgcgatcatcgtgattctcgtcctgctgctcttgcttggaattggactcatgtggtggttttggcccttgtgctgcaaggtggtcatcaaggacccccccccccctccagcccctgctcctaaggaggaagaagaggaaccgctgcccacaaagaaatggccgactgtcgatgcaagctattacgggggtaggggggtgggaggcattaagcgaatggaagttcgctggggggacaaagggtccactgaggagggtgctaggctagagaaggcaaagaatgctgtagttaagattccggaggaaaccgaggagcccatccgacctcgccctccccgacccaagcccacccaccaaccgcctcaaacgaagtggtacacccccattaaggggagacttgatgccttgtgggccttgctacggagacagtacgatcgcgtaagccttatgagacctcaggagggcgatgagggaagatgtataaacttcagtagagtgccctctcagtag

SEQ ID NO: 108425 - DNA, 2217 bp, Artificial Sequence
  Description of Artificial Sequence: Synthetic coding sequence
atgcgtggacctagcggagctctctggctgctactagcccttagaactgtgctgggaggaatggaggtgcgctggtgcgcaacctccgatccagagcagcacaaatgtggtaacatgagcgaagctttcagagaagccggcatccagccctctctcttatgcgtaagaggtaccagcgccgaccactgtgtgcaactcatcgccgcacaagaggcggacgctatcacactcgatggaggtgccatttatgaggctggtaaggagcacggcttaaaacccgtggtcggagaagtctatgaccaagaagtcggtacttcttattacgccgtggcagtcgtgcggagaagctcgcacgttaccatcgacaccctgaagggagtgaaaagctgccatacaggtatcaaccggaccgtcggatggaatgtccccgtgggataccttgtcgagtccggtaggctctcagtgatggggtgcgatgtgctcaaggcggtgagcgactactttggcggcagttgcgtccccggcgctggcgagaccagctatagtgaaagtctctgccggctttgcagaggagatagcagcggagagggagtgtgtgacaaaagccccctcgaaagatattatgactacagcggggccttcaggtgtctggcggagggagctggcgatgtggcctttgttaaacactccaccgtactggaaaacacagatggtaagaccctgcccagctgggggcaggcactgctgtcacaggattttgaactgttgtgccgtgacggcagccgcgctgatgttacagaatggcgacagtgtcaccttgcccgggtgccggcccatgcggtcgtggtgagagccgataccgacggagggctgatctttaggttactgaacgaaggtcagagattgttctctcatgaagggtcctccttccaaatgttctccagcgaggcctatgggcaaaaggacctgctcttcaaggactcaaccagcgagcttgttcccatcgccactcagacctatgaagcatggttgggccacgagtatctgcatgctatgaaaggtctcctgtgcgatcctaatagactgcctccgtaccttaggtggtgcgtcctctctacccccgagatccagaagtgtggagatatggccgtggcctttcgccgccagcgcctgaaacccgaaattcagtgcgtgtcggccaaatccccgcagcactgcatggagcgcatccaagctgaacaagtcgatgctgtgaccctaagcggagaagacatatacacagcaggcaagacatatggacttgtccctgcagcgggcgagcattacgcccctgaagactcctctaactcttattacgtagttgctgtcgttaggcgcgatagcagccacgcctttaccctggacgaactgagggggaaacgaagctgccacgccggcttcggcagccctgccggctgggatgttcccgtgggggccctgattcaacggggcttcatccggcccaaagattgcgatgtactcaccgcggtatctgaattttttaacgcaagttgcgtacccgttaataacccgaagaactatccaagttctctgtgtgccttgtgcgtaggagacgaacagggaaggaacaaatgtgtggggaattcacaggaaagatattacggatatagaggcgccttcaggtgtcttgtagagaatgccggggacgtggcctttgtacgtcacactacagtcttcgacaacaccaacggtcacaacagcgaaccttgggcagctgaacttcggtctgaagactacgagctattatgtcctaacggggccagggctgaggtctcacagtttgcagcgtgtaatctggcccagatccctcctcacgctgtgatggtgcggccggacaccaacatctttacagtttatggcctcctcgacaaggcacaggacctcttcggagatgaccacaacaaaaatggatttaaaatgtttgatagttctaactaccacggtcaagaccttctgttcaaagatgcaaccgtgagagccgttccagtgggtgagaagacaacataccgcggttggctcggcctcgactacgtagctgcactggaaggcatgtccagccaacagtgttcaggtgctgcggcccctgctccaggggccccgctgttaccgctgctcctacctgcgctggccgccagactgttaccgcctgccctatag

SEQ ID NO: 108426 - DNA, 909 bp, Artificial Sequence
  Description of Artificial Sequence: Synthetic coding sequence
atgcggggcccctcgggggccttgtggctgctactcgctttgagaactgtgttaggaggaatggaagtgagatggtgcgccacaagtgaccctgagcagcacaaatgtgggaatatgtctgaggccttccgagaggctggcattcagccgtcactcctctgtgtgcggggcacttccgccgatcactgtgtgcaactcatagccgcacaggaggctgatgccattacactggacggcggagcaatctatgaagcaggcaaggaacacggcctgaaacctgtggtgggcgaggtgtatgatcaggaagtgggtacaagctattatgcagtggcggtggtccgacgatcctcacatgtcactatcgatacccttaaaggcgtaaagagctgtcacacaggaatcaatagaaccgtgggttggaatgtgccagttggctatttggtggaatctgggagacttagcgtaatgggctgtgacgtgctgaaggcagtgagcgactattttggaggatcctgtgtgccaggtgctggtgaaacttcctattccgaaagcctatgcaggctctgccgtggggattctagcggagaaggcgtatgtgacaagtcccctttagagcgctattatgactacagtggcgcattccgttgtctggctgagggggctggcgatgtagcttttgtcaagcacagtaccgtcctggagaacaccgacgagtccccatctcgtaggcagacttggactcgtagcgaagaggaggaaggcgagtgtcctgcacatgaggaggctcgcagaaccatgcggagcagcgccggccaggcttggaaatgggccccagtgcatcggccacaggacgagtctgacaagggcgaattcgggaaaagagccaagagccgggacatgctgggatag

SEQ ID NO: 108427 - DNA, 1395 bp, Artificial Sequence
  Description of Artificial Sequence: Synthetic coding sequence
atggactttcagcaccgacccggtggaaagaccggaagtggcggagtggctagctctagtgagtcgaatcgggaccggagagaaagactcaggcagctggctctggaaaccatcgatattaataaagacccttattttatgaaaaaccacctaggatcttacgagtgcaaactatgcctcactcttcacaataatgaggggagctacctagctcatacccaggggaagaagcaccagacaaatctcgcaagacgcgcagctaaggaagcgaaagaagcacccgctcagccagctcccgaaaaggtcaaagtggaagtgaaaaaatttgtgaaaattggaagaccggggtataaggtgactaagcagagagactcggagatgggacagcagtcccttctgttccagattgattaccccgagattgctgagggcataatgccccgccaccgcttcatgtccgcatacgaacaacggattgaaccccctgaccgacggtggcagtatttattgatggccgcagagccctatgaaacaatcgcattcaaggtcccctccagagaaattgacaaggctgaaggcaagttttggacccattggaatagggagacaaaacagtttttcctgcagtttcacttcaaaatggaaaaaccacctgcacctccaagcctccccgccggaccccccggcgtgaaaagaccgccccctcctctaatgaatggccttcctcctcgccctcctctgcccgagtctttgccccctccacctccaggaggcctcccattgccccctatgcccccaacaggaccagctcctagcggaccacctggacccccccagcttcccccccccgcccccggcgttcacccaccagccccagttgtgcaccctcctgcaagtggcgttcacccgcctgcccccggagtgcaccctcccgctcccggcgttcaccctcctgcaccgggcgtgcatcctcccacttccggcgtgcatccaccagccccaggtgtccatccaccagcaccaggggtacatcctccagcaccgggggtgcacccacctgccccaggggtccatcctcccgccccaggagtccatccaccaccttctgctggagtccatccacaggctccaggcgtccaccccgccgcccctgccgtccacccccaagctcctggcgttcatccaccagctcctgggatgcacccacaggcccctggcgtgcatccccagccacctggcgtgcatccttcagcacccggggtgcatccccagcccccaggtgtgcacccgagcaacccgggagtccaccctccaaccccaatgccacctatgctccgcccccctctgcctagcgaggggccaggtaatattccccctcctccacctacaaattag

SEQ ID NO: 108428 - DNA, 1437 bp, Artificial Sequence
  Description of Artificial Sequence: Synthetic coding sequence
atgttggggagcttagggttatgggcgttgctacctacagccgtcgaagccccacctaatcggcgcacgtgtgttttttttgaagcccctggggtaagaggaagtactaaaaccctaggcgaactactggatacagggacagaactgccacgagctatccggtgtctttattcccggtgttgttttgggatttggaatctgacacaggaccgggctcaggtggaaatgcaggggtgcagggattcagacgaaccgggctgtgagagccttcactgcgacccttcacctcgcgcacatccttcccccggatccaccctgttcacatgctcttgcggtaccgatttttgtaacgccaattatagccatttgccaccgccgggctctccggggacacccggctcccaaggcccgcaagccgccccgggcgaaagcatctggatggctctggtcctgcttggattgtttctgcttctgctgctcctgttgggatctataatcctggcactgctccagcgcaaaaactacagagttcggggcgaacccgtccccgagcctcgcccagactcaggccgggattggtccgtggagctgcaggaactcccagaactgtgttttagccaggtgatcagagaaggaggccacgctgttgtctgggccgggcagctacaaggcaagctggtggcaatcaaggctttcccccccagatcagtggcccaattccaagctgaacgcgccctgtacgaactcccgggccttcaacatgatcacatcgtgagatttataaccgcctcccgaggcggccccggccggctgctgtcaggccctctgttggtgctggaattgcaccccaaaggctccctgtgtcactacctaactcagtacacctccgattggggctcctctctgaggatggcgctgagcctggctcaaggattagctttcctgcatgaggaacgctggcaaaacggccaatacaagcccggtatcgcacatagggacctttccagtcaaaacgtcttgatccgcgaggatggctcctgcgcaatcggtgacctcgggttggcactcgtcttgcccgggctcactcagcctccagcctggacccctacacaaccccagggtcccgcagccattatggaagatcctgacggcttgcgggagctattggaggattgttgggatgccgatcccgaggcaaggctcactgccgagtgcgtgcagcaaaggttggccgcccttgctcacccccaggaaagtcatccgttccccgagagctgcccccggggctgcccccctctgtgtcctgaggactgcacatcaattccagctcctacaatcctgccctgccgaccacaaagatccgcatgtcatttttccgtacagcagggaccctgctcaaggaatccccagccagcttgcacactcagtcccgtttag

SEQ ID NO: 108429 - DNA, 1437 bp, Artificial Sequence
  Description of Artificial Sequence: Synthetic coding sequence
atgctgggatccttgggactttgggccctactcccaacggccgtcgaggcgccaccaaacaggaggacctgcgtattttttgaagctcccggagtgcggggctctactaaaacattgggggaactgctggatacaggaaccgaactgccgcgggcaattaggtgtctttactcgcggtgttgtttcgggatttggaatttgacacaggatcgcgcgcaggtggagatgcagggatgtcgtgactctgatgagccaggctgcgagtccctgcactgcgaccctagtccgcgcgcccacccctctccaggttccacactgtttacatgctcatgcggtaccgatttctgcaacgccaactatagccacctgccccccccaggcagcccaggcactcctggttcccaaggtcctcaggccgcgccaggtgaaagtatctggatggcactggtgctcctaggcctcttcctcttacttctgctgctcctggggagcatcattttggccctactgcaacgcaaaaactatcgggtgcggggtgaacctgtaccagagcctcggcccgattctgggcgggattggtcggtggagctccaggaactccctgagctctgtttttcacaggtaattcgcgaaggcggacacgccgtggtctgggcagggcagctgcaaggaaagctggtagctatcaaggcctttccgccaaggagtgtggcccagtttcaggcagaacgggcactctatgaactgcctggtcttcaacatgaccatatagtgcggttcatcaccgcatctcgcggaggacctggaaggttattgtctgggcccctgttggtgttagagctgcaccccaagggatctctttgtcactatctgacccaatacacaagtgattggggtagcagcctgagaatggccctgtccctggcacagggccttgcctttttgcatgaggaacgctggcagaacgggcagtataagcctggtattgcacatagagacctgtcctcacagaatgtgctaattagggaggatggttcttgtgccattggcgatcttggtcttgctttggtgttgccaggactcactcaacctcccgcttggacacctacccagcctcaggggccagccgcaattatggaggccggcacccagcggtacatggctcccgaattattggacaagaccctggatctccaggattggggcatggctctgaggcgagcagacatctactccctggccctgctactgtgggagattctgagccgctgccccgatctccgaccggccgtacaccacccatccaattggcccatgcgacagaactgggccatcccactccctctgatgagctacgggccttggcagtgcaggcgcggaggggttccaactagtcaccctcctggggcagcgctcccacagacactgatgggctag

SEQ ID NO: 108430 - DNA, 1722 bp, Artificial Sequence
  Description of Artificial Sequence: Synthetic coding sequence
atgctcggctccctgggcttatgggctctgctccctacagccgtcgaagcccctcccaatcggcggacctgcgtgttcttcgaggcacccggcgttcgagggtctactaaaacactgggcgagctcctagatacagggaccgaactcccgagggccattcgatgcctgtactcacgatgctgttttgggatttggaatctcacccaagaccgcgcccaggtcgagatgcaggggtgcagggattctgacgagcctggatgtgagtccttacattgcgatccttctcctcgagctcatcccagccctggttccacgcttttcacgtgcagctgtggtaccgacttctgcaatgccaactacagccacctgccacccccagggagccccgggacgccaggcagccaaggaccacaggctgcccccggagagtccatttggatggctctggtgctgcttgggctgtttctcctgctcctgcttctactgggctcaattatcctagcactgttgcagcgaaagaactacagggtccgaggcgagcccgtgcctgaacctcggcctgactccggaagagattggtccgttgagctccaagagttaccagaactttgtttctcccaggtgatccgcgagggagggcacgcagtcgtgtgggccggtcagctgcagggcaagttagtagcaatcaaagcattcccccctcggagcgttgcccagttccaggctgagcgggcgctttatgagctgccaggcctccagcatgaccacatcgtcagatttatcaccgccagcagaggcggcccaggacgcctgcttagcggaccgctcctggtactggaactccaccccaaaggatccttatgccattatctcactcagtatacgtccgactggggctctagcctccgcatggccctgtctctggctcaggggctcgcatttctgcacgaggagagatggcaaaatgggcagtacaaaccagggatcgcccacagagacttgagcagtcagaacgtgctaattcgggaagacggcagttgcgccatcggggacctgggcttggcactggtgctacctgggctgacccagcctccagcctggactccgactcagccacagggtcccgccgctatcatggaggcgggaactcagagatatatggcaccagaattgctggataaaacactggatctgcaggactggggtatggcactgcgccgtgcagatatatacagtcttgcactgctactttgggagatcctgagtcgttgcccagatctcagacccgactcttcgccccctccgttccagctggcctacgaggcggaacttggcaatactcctactagcgatgaactgtgggccttagccgtgcaggaacgaagacgcccgtatatcccttctacctggagatgctttgccacagacccagacggcctgcgcgagctgctcgaggactgctgggatgctgatcccgaagccaggctgacagccgagtgcgtccagcagagattagctgcactcgcacaccctcaggaatcccaccccttccctgagtcctgtcccagggggtgcccacccctctgcccagaagactgtacttctatcccggctccgactattttaccatgtaggcctcagaggtctgcttgccatttcagcgtccagcaggggccatgttcaaggaatccccagccggcctgcactctgtctcccgtatag

SEQ ID NO: 108431 - DNA, 1347 bp, Artificial Sequence
  Description of Artificial Sequence: Synthetic coding sequence
atgaaggggttcattgacgatgccaactattcagtcggacttctagatgaggggaccaacctagggaatgtaattgataattatgtgtatgagcatacactaacgggtaagaatgcctttttcgtaggagacctcggcaaaattgtcaagaagcactcccagtggcagaacgtggttgcccagatcaaaccattctatacagtgaaatgtaactccgccccagccgtcttggagatcctggccgctctgggaaccgggtttgcatgttcatcaaagaacgagatggctctcgtgcaggagctgggagtgccgcctgaaaatatcatctacatctcaccttgtaagcaagtgtcccaaatcaagtatgccgccaaagtcggagtgaacattctcacttgtgataacgaaatcgagttaaaaaagatagctaggaatcatcctaatgctaaagtccttctgcacatagccaccgaagacaacattggcggtgaagaagggaatatgaaattcggtactacattgaagaattgccggcacctgctagaatgcgctaaggagttagatgtccagatcatcggggtgaaatttcatgtatccagcgcctgcaaagaatctcaggtatatgtgcatgccttgtccgatgctagatgtgtgtttgacatggcaggcgaaataggctttactatgaacatgctcgacatcggaggaggcttcaccgggacagagtttcagctagaagaggtaaaccacgttatttcccctcttcttgatatatacttccctgaaggaagcggtgtgaaaatcatcagtgaacccggatcctattacgtttcttcggcattcacactggcggtgaacatcatcgccaagaaagtagtggagaatgataagtttccgtctggcgtagagaaaacgggtagtgacgaacccgcatttatgtactacatgaacgatggagtgtacgggtcctttgcctctaagctgtctgaagatctaaatactatccccgaggtccataaaaaatataaagaggatgagccgctcttcacaagcagtctgtggggacctagctgcgatgagctggaccagatcgttgagtcctgcttgcttccggagctaaacgtgggcgactggttaatattcgataatatgggagccgacagtttccacgagccctcagcctttaacgacttccaacggcccgcaatttattatatgatgtccttttccgactggtacgagatgcaggacgccggtattaccagtgactcaatgatgaagaatttcttttttgttccttcttgcattcaattatctcaggaagattccttcagcgccgaagcctag

SEQ ID NO: 108432 - DNA, 1347 bp, Artificial Sequence
  Description of Artificial Sequence: Synthetic coding sequence
atgaagggatttattgacgacgccaattactctgtgggcttattagatgagggcacgaacttggggaacgtgatcgataactatgtgtatgagcacaccctaacgggcaaaaacgcctttttcgtgggggacctgggtaaaattgtcaagaagcattcgcagtggcagaatgtcgttgcccagatcaagcccttctacaccgtgaaatgtaactcggctccagccgttctcgaaatcctcgccgccttgggcactggctttgcctgctcctcaaagaatgagatggctctggtccaggagttgggtgttccaccagagaacattatttacatctctccttgcaaacaggttagccagatcaagtacgccgccaaggtgggagttaatatcttaacctgcgataacgaaatcgagttgaagaaaatagcccggaatcatcctaacgccaaggtactactgcacattgccacagaagacaatataggtggggaggaaggaaacatgaagtttggaacaactttaaagaactgtaggcacctgcttgagtgcgccaaagagcttgacgttcagatcatcggagtaaagttccatgtctcctcggcctgcaaggagagtcaggtgtatgtgcacgctcttagcgacgcccggtgtgtgttcgatatggctggagaaatcgggtttaccatgaacatgctcgatattggggggggatttacaggcactgagttccagttggaagaggtgaatcacgtgataagccctttgcttgatatctacttccctgaagggagcggcgttaagatcatcagcgaacccgggagttattacgtgtcctctgctttcacactcgctgtgaacatcatcgccaagaaagttgtggaaaacgataaattcccctctggcgtggaaaaaacaggaagcgacgaaccggcgtttatgtattatatgaacgacggcgtttatgggtcctttgcctccaaactgtccgaggatttaaacacaatcccagaagttcacaaaaagtacaaagaagacgaacccctgttcacttcaagcctttgggggcctagctgtgacgaactcgatcagatcgtggaatcctgtctcctgcctgagcttaatgtgggcgattggttaatcttcgacaacatgggggctgattcctttcacgaaccttctgcatttaacgactttcaacgaccagccatttattacatgatgagttttagcgactggtatgaaatgcaggatgctggaatcacatccgattcaatgatgaagaacttttttttcgttcccagctgcatacaacttagccaggaggattcattcagtgctgaggcatag

SEQ ID NO: 108433 - DNA, 102 bp, Artificial Sequence
  Description of Artificial Sequence: Synthetic coding sequence
atgaagggctttatcgatgacgctaattatagcgtcggccttctcgacgaagggaccaacctgggaaatgtaattgacaactatgtgtatgaacatacatag

SEQ ID NO: 108434 - DNA, 294 bp, Artificial Sequence
  Description of Artificial Sequence: Synthetic coding sequence
atgaaaggctttattgacgatgctaactactctgtggggctcctggatgagggtactaatctgggcaacgttatcgacaactatgtttatgagcacacattaaccggcaagaatgcattcttcgtcggggacttgggcaaaattgtgaagaagcatagccaatggcagaacgtggtcgcgcagatcaaacccttttacacagtgaaatgcaacagtgctcctgctgtcctggagatactggccgcactggggacgggatttgcctgttcatcaaagaacgaaatggccttatag

SEQ ID NO: 108435 - DNA, 780 bp, Artificial Sequence
  Description of Artificial Sequence: Synthetic coding sequence
atgcgacgggctgtcgcctatatggccattaagatagaagtgcagggccatcagtcctttgcaatcccttctggcacgttctggctctggaggtcacttctcagtcaggacaaggaacatcccagatacttgattcctgagctgtgtaagcagttctatcatctagggtgggtgacagggactggaggcggaattagtctgaagcacggagatgagatctacatcgcaccatccggagtgcaaaaagaacggatccagcccgaagacatgtttgtgtgtgatatcaacgaaaaagatattagcgggccatcaccctccaaaaagctaaaaaaatcacagtgtactcctctgttcatgaacgcctacaccatgaggggggccggagccgtgatccacacgcacagcaaagcagcagtcatggctaccctcctgttccccggacgagagtttaaaattacgcatcaggagatgattaaggggataaaaaaatgtacaagcggaggctattacaggtatgacgatatgctcgtggtcccaataatcgagaacactcccgaggaaaaggatctgaaggatagaatggcgcacgccatgaacgagtacccggactcttgcgctgtcctggtcagaaggcatggtgtgtatgtctggggcgagacctgggaaaaagctaaaactatgtgtgaatgttatgattacctcttcgatatagccgtttcaatgaaaaaggtaggcctggacccctcccagctgcccgtgggagaaaatggcatcgtctag

SEQ ID NO: 108436 - DNA, 729 bp, Artificial Sequence
  Description of Artificial Sequence: Synthetic coding sequence
atgtcaggttgtgatgctcgtgagggggactgctgctcaaggagatgcggggcccaggacaaagagcacccaagatatctcattcctgaattgtgtaaacagttttatcacctggggtgggtcactggtactgggggcggcatctcccttaaacacggtgacgagatctatatcgccccatctggggtacagaaggagagaattcagccggaggacatgtttgtgtgcgatatcaatgaaaaagatatcagcggcccttcacccagtaagaaattgaaaaaaagccagtgtacaccactgttcatgaacgcctataccatgaggggcgccggggcggtcatccatactcattcgaaggccgccgtgatggctaccttgttattcccggggcgcgagtttaagatcactcaccaggagatgatcaaagggattaaaaaatgcacctcaggtgggtattatcggtacgacgacatgctggtcgtaccaatcattgaaaacacgccggaagagaaagacctcaaggaccgaatggctcacgctatgaatgaatacccagatagctgtgctgtgctcgttaggcgtcacggtgtttacgtctggggcgagacttgggaaaaggccaagaccatgtgtgagtgctacgattacctttttgacattgcggtgtccatgaaaaaggtggggctcgacccatcacagctcccagtgggtgagaacggcattgtttag

SEQ ID NO: 108437 - DNA, 234 bp, Artificial Sequence
  Description of Artificial Sequence: Synthetic coding sequence
atgaacctcaggctgtgcgtccaggctctcctgctgctctggctgagtctgacagccgtgtgcggcgggagtcttatgccgcttccggacggcaatggcctggaggacggaaacgtgaggcacttagtacagcctcgtggctcccgcaatggaccgggcccatggcagggcggcaggaggaaatttcgacgtcagagaccccggctatctcataaaggtccaatgccattttag

SEQ ID NO: 108438 - DNA, 369 bp, Artificial Sequence
  Description of Artificial Sequence: Synthetic coding sequence
atgtccgcaacatggtgctcacccgaaggccaaggtatgggccagggaccagggagggaggtcggcggcaattcggctgcatccgggcctgctagtcctataagagatccgtgtctctctgaggcaggactcaaagggccccccagtgcccaccccaggcgactttgtctactacatcgcctggtgtgcttctcggggggcttgacttccattcagctgagccctagaacctgctgcagtcaccagtgggcacagttattcagtccagcttgtttcccacagtggagggcccctgggtgctcactagatgattccaggtctcttactcggatcagaccagtgcatctgcctgggccctcactcgactag

SEQ ID NO: 108439 - DNA, 369 bp, Artificial Sequence
  Description of Artificial Sequence: Synthetic coding sequence
atgagtgctacctggtgctccccggaaggacaggggatgggacagggcccaggaagggaagtcggcggcaactcagctgcctccggacccgcatccccgatacgtgatccttgtctgtccgaggccggactgaaaggccccccctctgctcatccacgccgcctgtgtctgttgcacaggctggtgtgtttttccgggggcctgacatccatccagctttcccctagaacttgttgtagccatcagtgggctcagctgttttccccagcctgtttcccccagtggcgcgcaccagggtgctctctagacgactcccggtccctgacacgaatccgacctgtgcacctccctggaccgagtctggactag

SEQ ID NO: 108440 - DNA, 303 bp, Artificial Sequence
  Description of Artificial Sequence: Synthetic coding sequence
atgaagttgctggcagccactgtcctgctgttgactatttgctccttagagggagcactcgtgcggagacaggccaaggagccatgcgtggagtcactggtctctcagtactttcagacagttaccgattatggcaaggacttgatggaaaaggttaaaagtcccgagctgcaagccgaggcaaagtcctactttgagaagagcaaggaacagctaacaccattgatcaagaaggctggcactgagttggtgaattttctcagctactttgttgagctggggacacagcctgcaactcagtag

SEQ ID NO: 108441 - DNA, 1191 bp, Artificial Sequence
  Description of Artificial Sequence: Synthetic coding sequence
atgttcctgaaggccgtcgtgttgactctggcactggtagccgtcgcgggagcacgggctgaagtgtccgccgaccaggtggctaccgttatgtgggattacttttcccagttatctaacaatgctaaagaggccgtggagcacctgcaaaaaagcgagctgacccagcagttaaacgctctattccaggacaagctgggtgaagtcaacacatatgcaggtgaccttcagaagaagctagttcccttcgctactgaactgcacgaacgacttgcaaaggatagtgagaaacttaaagaggagatcggaaaggaactcgaggaactgagggcgaggcttcttccccacgccaacgaagtgagtcaaaagattggggacaatttgcgggaactccagcagagactcgaaccatacgccgaccagctccgcacacaggtgtctacacaggcggaacagctgcgacggcagctgactccctacgcccaacgaatggagcgagtcctgcgcgaaaacgccgattccctccaggccagtttgcgtcctcacgcagatgaacttaaggctaagattgaccaaaacgtcgaggagctgaagggtcgactgaccccctacgcagacgaatttaaagtcaaaattgaccagacggtcgaagagttgaggcgttccttggctccctatgcccaagacacccaggagaagctgaaccaccagcttgagggcctgacattccaaatgaaaaagaatgcagaggagctgaaggctcgcatttcagcatccgcagaggagcttagacagaggcttgcaccgctggccgaagacgtccgagggaacctgagaggcaacacggaggggctacaaaaaagcctggcagaactgggcggacacctagaccagcaggtagaggaattcaggaggagggttgagccctatggcgagaattttaacaaagctctggtgcagcagatggagcaactccgacagaagctgggccctcatgccggcgatgtggaaggacatctgtcctttctggagaaagatcttcgtgataaggtcaattcttttttcagcacattcaaagaaaaggagagtcaggataagactctgtccctgccagagttagaacagcagcaggaacagcaacaggaacagcagcaggagcaggttcagatgctcgcaccattggagagttag

SEQ ID NO: 108442 - DNA, 1281 bp, Artificial Sequence
  Description of Artificial Sequence: Synthetic coding sequence
atggcaattgcacagctggctactgaatatgtgttttcagatttccttttgaaagagcccaccgagcctaagttcaagggcctgcgcctcgagctggccgtggataagatggttacatgtatcgcagtcggcctgccgctgctgctgatttctttagctttcgcccaagaaatatctattggcactcagatctcttgcttttccccatcaagcttctcctggaggcaggccgccttcgtggatagttactgctgggccgccgtccagcagaaaaactccctgcagtcagagtccggaaaccttcccctgtggctgcacaagtttttcccatatattttgctcttattcgctatcctgctgtacctcccgcccctcttctggcgatttgccgccgccccccatatttgcagtgatttgaagtttatcatggaggaactggataaggtctataatcgggcaattaaagccgctaagagtgcccgggacctcgatatgcgcgacggagcgtgcagcgtccccggtgtcaccgaaaaccttggccaaagcctgtgggaggtgtcagaatcgcacttcaagtacccaatagtcgagcagtatctgaaaactaaaaaaaatagcaacaacctgatcatcaagtacatttcctgcaggcttctaacccttataattattttgttggcttgtatatacctgggatactatttcagcctcagttcattgtcagatgagttcgtgtgtagtataaagtctggaatcctgaggaacgattctacggtgccagatcagtttcaatgtaagcttatcgcagtgggcatcttccagctcctgtctgtgattaacctagtggtctacgtactgctagcaccagtcgtggtttatacactcttcgttccatttcggcagaaaaccgatgttttaaaggtgtacgagatccttcccacctttgacgtgctgcactttaaaagcgagggatataatgacctctccctttataatttgtttctggaagaaaatatcagcgaggttaagtcgtataagtgcctcaaggtcctggaaaatataaaatcttccggccaggggattgatcccatgctgctcctgacaaatctcggaatgataaaaatggacgtagttgacgggaagacgccaatgagtgccgaaatgcgggaagagcagggaaatcagaccgccgagctccaaggtatgaatattgactcagaaaccaaggctaataatggcgagaagaatgcccgtcagagattgctcgattcttcatgctag

SEQ ID NO: 108443 - DNA, 489 bp, Artificial Sequence
  Description of Artificial Sequence: Synthetic coding sequence
atggcgagcatggcagcagtattgacctgggcgttggcacttctctccgccttttcagccacccaagcacggaagggattttgggattacttctcacaaacttctggagacaaaggccgtgtcgagcagatacaccagcagaaaatggccagagaaccggctactctcaaagattcattggagcaggacctgaacaacatgaacaagttcctggaaaagttgcggccacttagcggcagcgaggcccctcgactccctcaagatccagtcggtatgcggcgacaactgcaggaggaactggaggaagtgaaggccaggctgcagccttacatggctgaagcccatgaactcgtcggctggaatctggagggcctgcgacagcagcttaaaccatatacgatggatctgatggagcaggtggccctacgggtgcaagaacttcaggagcagctgagagtggttggtgaagacaccaaggcacagctttag

SEQ ID NO: 108444 - DNA, 1101 bp, Artificial Sequence
  Description of Artificial Sequence: Synthetic coding sequence
atggctagcatggccgccgtcctgacttgggcgttggctctgctgtctgcattctctgctacacaagccagaaaaggcttctgggactacttctctcaaacctccggggacaaaggtcgtgtggaacagattcaccagcagaagatggctcgcgaaccggccaccctcaaggattccctggagcaggatctgaataacatgaacaaattcctggagaagcttagaccgttgtccggctctgaagctccgcgcctgccgcaggacccggtgggcatgaggaggcagctccaggaagagctggaggaagtgaaggccaggctgcagccatacatggccgaggctcatgagctcgtggggtggaacctcgagggattgcgtcagcagctgaaaccttacacgatggatctcatggaacaggtcgccttacgcgttcaggaactgcaggagcagcttagagttgtgggcgaagatacgaaagcccaactgctgggaggtgttgacgaggcatgggccttgttgcaagggctccagagcagagtggtccaccacactggtaggtttaaagaattattccatccgtacgccgaaagtttagtgagcgggattgggcggcacgtgcaggaattacaccgctccgtggccccacacgcgcccgcgagccctgccaggctgagtagatgcgtgcaagtgttatcaaggaaacttactcttaaagcgaaagcgctgcatgcacgtatccagcagaatctggaccagctaagagaagagctttcaagggccttcgccggcactggtacagaggaaggagctggcccagatcctcagatgttgagcgaggaagtccgccagagacttcaagcttttagacaggatacatatcttcagatcgcggctttcaccagagccatcgatcaggagacagaggaggtgcagcagcaactcgccccacccccgcccggacatagcgccttcgcccctgaattccagcagactgacagtggtaaggtgctgtccaagttacaagctagacttgacgatctctgggaggatatcacccattcactccatgaccagggacactctcaccttggcgacccatag

SEQ ID NO: 108445 - DNA, 1074 bp, Artificial Sequence
  Description of Artificial Sequence: Synthetic coding sequence
atgaacccacaaattcgcaatcctatggaaaggatgtatcgggacacattttacgacaactttgaaaatgagcccattctctacggtcggtcttatacctggctatgttacgaagtgaagattaagcgaggaaggagtaacctgttgtgggatacgggcgtcttcagagggcaagtctactttaaacctcagtatcacgccgagatgtgttttttgtcatggttctgtggaaaccagctacctgcctacaaatgcttccagatcacctggtttgtcagttggacgccctgcccagattgcgtggctaagctggcagagttcctcagtgagcaccctaacgtaacactgacgataagtgccgcccggctgtactattattgggaaagggactatcggcgggcgctgtgtcgtttgtcacaggccggggccagagtgacaataatggattatgaggaattcgcgtattgctgggagaacttcgtttataatgagggtcagcaattcatgccttggtataagtttgacgagaattatgcattcctgcatcggacacttaaggagattctccggtacctgatggatcccgatacatttacattcaatttcaataatgatccactagttttgcggaggagacagacctacctctgctacgaggtcgagcgacttgacaacggcacatgggttttaatggaccagcatatgggattcctgtgcaacgagctggaccctgctcagatttacagggtcacatggtttataagctggtccccctgtttttcctggggttgtgcaggcgaagttcgcgcatttctccaggagaatactcatgtgaggctgcgcatctttgcggctcggatctacgactatgatccgctttacaaagaggctcttcaaatgttaagagatgccggagctcaggttagcattatgacctatgacgaatttgagtactgttgggatacgtttgtgtaccggcaggggtgtccttttcaaccctgggatgggctggaggaacatagtcaagcgttgtctggtagattgagggcaatcctccagaatcaaggaaactag

SEQ ID NO: 108446 - DNA, 306 bp, Artificial Sequence
  Description of Artificial Sequence: Synthetic coding sequence
atgaaaccacacttcaggaataccgtggagcggatgtacagggacacatttagttataatttctacaatcggccaattctgagccgccgcaacacggtgtggttatgctacgaagtcaagactaaggggccctctcgacctcgcctagacgctaaaatcttcaggggacaggttccaagatcctttatccgcgcccctttccaggtcttatccagtcccttcggtcagtgtgcccctccccatgggacagcccaagttcagtggcctccgcagctgacggcaggacgggaacaggggagaccttag

SEQ ID NO: 108447 - DNA, 381 bp, Artificial Sequence
  Description of Artificial Sequence: Synthetic coding sequence
atggcatcagccagtacgcagcccgccgccttgtctgcagaacaagcaaaggttgtgctcgccgaagtgattcaggcatttagcgcccctgaaaatgcagtccggatggacgaggcgcgggacaatgcttgcaacgatatggggaagatgctgcagtttgtattaccagtggcaactcagatccagcaggaggtgatcaaagcttacggtttctcttgcgacggagaaggggttctcaagtttgccagactggtgaaaagttatgaagctcaagatccggagatcgccagcctgtctggcaagttaaaggctttatttctccccccaatgacactgcctccgcatggccctgccgcaggaggctctgtggccgcctcctag

SEQ ID NO: 108448 - DNA, 675 bp, Artificial Sequence
  Description of Artificial Sequence: Synthetic coding sequence
atggcacagaaggaagaagctgccgtggctacagaggccgccagtcaaaatggcgaagacttggagaacctggatgatcctgagaaattaaaagagttaatcgaactcccaccgtttgagatcgtcacaggagaaagactacccgctaacttttttaaatttcaattccgaaatgtggaatactcctccggacggaacaaaaccttcctttgctatgtcgtggaggcccaaggaaagggcggtcaggtccaggcttccagagggtacctggaggatgagcacgcagctgcccatgccgaggaagctttcttcaatactatcctgccagcctttgaccctgcgctgaggtataacgtgacctggtacgtctccagcagcccttgtgcagcgtgtgctgacaggatcatcaagacattgtccaaaacaaagaacctccggctgttgattctggtcggcaggctgtttatgtgggaggagccagaaatacaagcggcattaaagaagctaaaggaagccggatgtaaattacggatcatgaagccacaagattttgagtacgtttggcaaaattttgttgagcaggaagaaggtgagtcaaaggcgttccaaccgtgggaggatatccaagagaacttcctgtactatgaggagaaacttgcagacattctgaaatag

SEQ ID NO: 108449 - DNA, 393 bp, Artificial Sequence
  Description of Artificial Sequence: Synthetic coding sequence
atggcccagaaagaggaagccgctgtcgctacggaggcagcctcacagaatggggaagacctcgaaaatctggacgatccggagaaactgaaggagctgatagaacttccgccatttgagatcgtaactggtgaacgccttcctgctaattttttcaaatttcagttcagaaatgtggaatacagttctggtcggaagctgtccagtactccatcctgtcagcctagcactcagccctgcggaacaatgagccctggcatgtgcccccctgcccctgttcagcgggtgctgactgctctttcaaaacctctcgctaggccaagaacttgcgtctgttcattttggtgggtggactccagctgcggccggtcccgcaggtctcgcctgctttag

SEQ ID NO: 108450 - DNA, 600 bp, Artificial Sequence
  Description of Artificial Sequence: Synthetic coding sequence
atggaagctagcccagcctcagggccacgacatcttatggatccccatatattcacttctaattttaataacggtattggcaggcacaagacctacctctgctatgaggtcgaaagactcgacaacggcactagtgtgaaaatggaccagcataggggattcctccacaatcaggcaaagaacctgctgtgtggattttacgggcgacatgcagaactgagatttcttgatctggtcccatctctgcagttggatcctgcccaaatataccgcgtcacgtggtttatcagttggtccccgtgcttttcttggggctgcgctggtgaggtgagggcttttttacaggagaacactcatgtgaggctgagaatttttgccgcacggatttacgattacgatccactgtacaaggaagcactacagatgctgagagatgcgggggcacaagtgagcatcatgacctacgacgaatttaaacactgctgggataccttcgtcgatcatcaaggttgcccgtttcaaccatgggacggcttggatgagcacagccaggccctgagcggtaggcttagagcaattcttcagaaccaggggaattag

SEQ ID NO: 108451 - DNA, 600 bp, Artificial Sequence
  Description of Artificial Sequence: Synthetic coding sequence
atggaggcaagtcccgctagcggtccaaggcacctcatggacccccatattttcacaagcaatttcaataatgggatcgggcggcataaaacgtacttatgctacgaggtcgaaagacttgacaacggtacatctgtaaagatggaccaacacagaggcttcctgcacaaccaggctaaaaacctgctgtgtgggttctatggacgccatgccgagctacgattccttgatctggtgccttccctgcaactggaccccgcccagatctaccgcgtcacctggtttatttcctggtccccctgcttctcttggggttgtgcaggcgaggtccgcgcattcctccaggagaatacccatgtgcggcttaggatatttgccgcacgcatttatgactatgatccattgtataaggaagccctgcaaatgctccgggacgcaggtgcacaggtcagcatcatgacttacgacgaattcaaacactgctgggatacattcgtggaccaccaagggtgtccttttcagccatgggatggtctggatgagcatagtcaggcactgtctggcagattgcgggctattctacaaaaccaagggaactag

SEQ ID NO: 108452 - DNA, 1149 bp, Artificial Sequence
  Description of Artificial Sequence: Synthetic coding sequence
atgaatccgcagatcagaaatcctatggagaggatgtatcgggacacattttatgataattttgaaaatgagcctatactttacggaaggtcttatacttggctgtgttatgaagtcaaaattaagcgaggacgctcaaaccttttgtgggatacaggggtattccggggccaggtgtatttcaaacctcagtaccatgcagagatgtgctttctgagctggttttgcgggaatcagctccctgcttacaagtgctttcaaatcacctggtttgtttcttggaccccttgtcccgactgcgtggccaagttagcagaattcttgtctgaacacccgaacgtcactcttactatttcagctgcccggctctattactactgggagagagactacagaagagcgctttgccggttgagtcaggccggagctagagttacaataatggactacgaagaattcgcttattgctgggaaaatttcgtgtacaatgaaggtcagcagtttatgccctggtacaagtttgatgagaattatgcttttttgcacaggactttgaaggaaatactccggtatcttatggaccctgacaccttcacgttcaattttaacaatgatccccttgtgctcagacgacgacagacttacctctgctatgaggtcgagcgactggataacgggacgtgggtgttgatggatcagcatatgggattcctttgtaacgaggccaagaacttgctctgtggattctatgggcgccacgctgagctgcggttcttagaccttgtcccgtcactccagcttgacccagcccagatttacagagtgacatggtttatctcctggagcccctgttttagttggggatgcgcaggtgaagtacgagcatttctgcaggaaaatacacatgtgcgcctccggatctttgcagcacggatttatgactacgaccccttatataaggaggccctccagatgctccgggacgccggggcccaggtgagtatcatgacctacgatgaatttgaatactgttgggacacatttgtataccggcaggggtgcccatttcaaccatgggacggactggaggagcattcccaagccctcagtggcaggcttagagcaattctgcagaaccagggtaactag

SEQ ID NO: 108453 - DNA, 573 bp, Artificial Sequence
  Description of Artificial Sequence: Synthetic coding sequence
atgaacccacagatcaggaatccgatgaaagccatgtatcctggtactttttacttccaatttaaaaacttgtgggaggctaacgaccgaaatgaaacgtggttgtgtttcacagttgaggggatcaagcgcagatctgtggtgtcctggaagacgggcgtgttccgcaaccaggtggacagtgaaacccactgccacgcggagcggtgtttcctctcctggttttgcgacgatatcctgagtcccaacacaaagtaccaagtgacttggtacactagctggagcccatgcccagattgtgcaggggaggttgctgagttcctcgcaaggcactctaacgttaacctgacaatcttcactgccagactgtactacttccagtatccatgctaccaggagggccttaggagtttgtctcaggaaggagtggccgtggagataatggactacgaggatttcaaatattgctgggagaattttgtgtataacgacaacgagccttttaagccttggaaaggtctgaagactaactttagattactgaagcggaggcttcgggaaagcctgcagtag

SEQ ID NO: 108454 - DNA, 1122 bp, Artificial Sequence
  Description of Artificial Sequence: Synthetic coding sequence
atgaagccccatttccgcaatacagtggagcgtatgtaccgggatacgttcagttataatttctataataggcctattctctcaagaagaaacaccgtgtggctctgctacgaagtgaagactaaggggcccagtagacctaggctggacgccaagatctttcgtggccaggtctactcccagccggagcatcacgcggaaatgtgtttcctcagctggttttgcggcaatcagttgcctgcatacaaatgctttcagatcacctggtttgtttcttggaccccgtgtcctgattgtgttgcaaagctcgccgaattcctagccgaacaccccaatgtcaccctcaccattagcgccgcccgactgtactactactgggagcgggactacagacgagcgctgtgtcgactgtcacaagctggggcaagagtaaagattatggacgatgaagagtttgcgtattgctgggagaacttcgtgtactcagaaggccaaccatttatgccctggtacaagtttgatgacaattacgcgtttctacaccgcaccctgaaagagatcctccgcaaccccatggaagcaatgtacccgcacattttctattttcacttcaagaatcttagaaaggcgtacggaaggaacgagagttggctgtgtttcaccatggaagtagtaaaacaccactccccggtctcatggaagaggggtgttttcaggaaccaggtggatccagaaacacattgtcatgctgagcgttgctttctcagttggttctgtgatgatattctctcaccgaacacaaactacgaggtaacgtggtacacctcctggtctccctgccccgaatgcgccggcgaggtggcagaattcctggcacgccacagcaatgtgaacctaactatctttaccgcccgcctttactacttttgggacacagattatcaggagggcctccggtccctgagtcaggagggcgcgagcgtggagatcatggggtataaagacttcaaatattgttgggagaacttcgtatacaatgacgacgagcctttcaagccatggaaggggctaaagtataattttttgttcctggacagcaaattacaggagatcttagagtag

SEQ ID NO: 108455 - DNA, 1155 bp, Artificial Sequence
  Description of Artificial Sequence: Synthetic coding sequence
atgaaaccgcatttccgaaatacggtagagcgaatgtaccgggacacgttttcttacaacttttacaatcgccccatcctttccagacgtaacaccgtgtggctgtgttatgaggtcaaaactaagggcccatctagaccgccgcttgacgcaaaaatatttcgggggcaggtgtacagtgagctgaagtaccaccccgaaatgcgattttttcactggttcagcaaatggcgcaagcttcatagagaccaagagtacgaagtcacctggtatattagttggtccccttgtactaagtgcacgcgtgatatggctacttttttggctgaggatccgaaagtcactctcaccatatttgtagcgagactgtactatttctgggatccggattatcaagaagctttacgttctctttgtcaaaagcgcgacggtcctagagccaccatgaaaatcatgaattacgacgaattccaacattgttggagcaaatttgtctactcccagagagagttattcgaaccttggaataacctcccgaaatattacatcttgcttcatattatgctgggggagatcttgagacactccatggacccaccaacatttaccttcaatttcaacaatgagccctgggtccgcggaaggcacgagacctacctatgctatgaggtggagagaatgcacaacgacacttgggttcttctgaaccagcgaaggggcttcttatgtaatcaagcccctcataaacatggctttctggaaggacggcacgctgagctctgctttttggacgtgatcccattctggaagttggatcttgatcaggattaccgggtgacctgttttacatcttggagtccttgcttcagctgtgcgcaagaaatggccaaatttattagtaagaacaagcatgtgagtctgtgtatctttacagcccgcatctatgatgaccagggtcgttgccaggaggggctgcggactctggccgaggctggcgccaagatcagcatcatgacatatagtgagttcaaacactgctgggacacattcgtggatcatcagggatgcccttttcagccgtgggatggcctagacgagcatagccaagacctctctggtaggttgcgtgcaatcctgcagaatcaagagaattag

SEQ ID NO: 108456 - DNA, 1155 bp, Artificial Sequence
  Description of Artificial Sequence: Synthetic coding sequence
atgaagcctcattttcgcaataccgtagagcggatgtatagagacacatttagttataatttctacaatagaccaattctgagtaggaggaacactgtgtggctgtgttatgaggttaaaacgaaggggccgagccgccctcccctagatgccaaaatttttagggggcaagtgtactcagaactcaagtaccaccccgagatgcgattcttccactggttctcaaagtggaggaagctacatcgagaccaagagtacgaggtcacgtggtacatttcctggtccccctgtactaagtgtaccagggacatggccacattcctcgctgaggacccaaaggtaacactaaccatctttgtggctcgcttgtactacttctgggaccctgactaccaagaagccctccgctctctgtgccagaaaagggacggaccaagggcaacgatgaagataatgaactacgatgaatttcaacactgttggagtaaatttgtctacagtcagcgggaacttttcgaaccatggaataatttacccaagtattacatccttctccatataatgctcggagagatcctcagacactccatggatccacccacctttaccttcaactttaacaacgagccttgggtccgaggtcgtcacgaaacatacttgtgttacgaagtcgagcgaatgcataacgatacatgggtactgctgaaccagcgacggggtttcctctgcaaccaggcgcctcataaacacggattcctggaagggcgccatgcggagttgtgtttcctggatgtcatccccttctggaagctggacttggaccaggactatagagtcacttgttttacgagctggagcccatgtttctcttgcgcccaggagatggccaaatttataagcaagaacaaacatgtctcactctgtatcttcacagctaggatctacgatgaccagggaagatgtcaggaggggcttcgcaccttagccgaagccggtgccaagatcagcatcatgacttatagtgagtttaaacattgttgggacacctttgtcgatcatcagggctgccccttccaaccttgggatggccttgacgagcactcacaggacctaagtggcaggctaagagctatactgcaaaatcaagagaactag

SEQ ID NO: 108457 - DNA, 549 bp, Artificial Sequence
  Description of Artificial Sequence: Synthetic coding sequence
atggcattgctaacagctgaaacatttaggttgcagtttaacaataagcgcaggctccgtcggccttactacccaaggaaggccctgctgtgttatcaactgactccacagaacggctctaccccaactaggggatactttgagaacaagaagaaatgtcacgccgaaatctgctttattaatgagatcaaatctatgggcctggatgagacccagtgctaccaagtgacgtgttacttgacctggtcgccgtgctcttcctgtgcctgggaactcgtggactttatcaaagcacacgaccatttgaacctgggcattttcgcgtctcgtctgtattatcattggtgcaagccacagcagaaaggcctaaggcttctatgtggaagccaggtgccagttgaggtcatgggatttccaaagtttgccgactgttgggaaaattttgtggaccacgagaaaccgctttcattcaatccgtataaaatgttagaggagctggataaaaattcccgggccatcaaacggcgtctcgaaagaatcaagtcctag

SEQ ID NO: 108458 - DNA, 603 bp, Artificial Sequence
  Description of Artificial Sequence: Synthetic coding sequence
atggcgctcctgacagccgagaccttcaggttgcagttcaacaataaacggagacttcgacggccatactacccaaggaaagctttactgtgctaccagttaactcctcagaatggatctacacctactagggggtactttgagaataaaaagaagtgtcacgctgagatttgcttcattaacgagatcaaatctatgggcctcgacgagacccaatgctatcaagtgacatgttacttgacgtggtcaccttgttcttcctgcgcatgggaactggtggattttatcaaggctcacgaccacctgaatctggggatcttcgctagccgcctatattatcactggtgtaagccacagcagaaggggcttaggctcctgtgcggatcccaggtccctgtcgaagttatgggatttcccaagttcgccgactgctgggagaactttgtggaccatgagaaaccattgtccttcaacccttataaaatgctggaggagctggacaagaatagtagagcaataaaaagacgtcttgaaaggatcaagatcccaggcgtgagggctcaaggccgatacatggatatcctgtgcgatgcggaagtctag

SEQ ID NO: 108459 - DNA, 465 bp, Artificial Sequence
  Description of Artificial Sequence: Synthetic coding sequence
atggcactgttgaccgcagaaacctttagactacagttcaataataaacgtcgactaagaaggccctattatccaagaaaagccctgctttgttatcagttaactccgcaaaatggatcaacccctacccggggttattttgagaacaagaagaagtgccatgctgaaatttgttttattaacgaaattaagtcaatgggccttgatgagacccagtgttaccaggtcacatgctatctgacatggtcaccctgttcctcctgcgcctgggagttggttgatttcatcaaggcccacgaccatctgaacttggggatcttcgcctccaggctgtactaccattggtgcaagccccagcagaaaggtctgcgcctgctgtgcgggtctcaggttccggttgaggtgatggggtttcctaattctagaggcacctgcgccggaagtctgcacggttatatcgtatag

SEQ ID NO: 108460 - DNA, 552 bp, Artificial Sequence
  Description of Artificial Sequence: Synthetic coding sequence
atggcattattgaccgctgagacattccgcctgcagttcaacaataaacgcagactcaggagaccatactacccaagaaaggctctgctgtgttatcagctgactcctcagaatggaagtactccaaccagagggtatttcgaaaataagaagaaatgccacgctgaaatctgcttcataaatgaaatcaaatcaatgggcttggatgagacccaatgttaccaagtcacctgctatttgacgtggagcccgtgtagcagctgcgcctgggaactcgtggactttattaaagcacatgatcatttgaacctgggtattttcgcttccagactgtactaccattggtgcaagccccagcagaaggggctgcggctgttgtgtggaagtcaggtacccgtggaggtcatgggctttccgaaattcgccgactgttgggagaacttcgtagaccatgagaagcctctgtcatttaacccctacaagatgctggaagagctcgacaaaaacagccgggccatcaagcgccggctggaaagaataaaacagtcctag

SEQ ID NO: 108461 - DNA, 1104 bp, Artificial Sequence
  Description of Artificial Sequence: Synthetic coding sequence
atggaaccaatctatgaagagtacctggctaaccacggcacaattgtgaagccctattactggttatctttctcccttgactgcagcaattgcccgtaccacataagaacgggggaggaggccagggtctctctcaccgagttctgccaaatctttgggttcccctacgggacaacattcccccagaccaagcacctcacgttttacgagctgaaaacaagtagtgggtctctggtgcaaaaggggcatgcatccagttgtacaggaaactatatccatccagaatccatgctgtttgaaatgaatggctacctcgattctgctatttataacaatgacagtatcagacatatcatactgtattcaaataattcaccatgtaacgaggcaaatcattgctgtatctcaaagatgtacaattttttgatcacataccctggcataacactgtccatctacttttcccagttataccataccgagatggacttcccggccagcgcctggaatcgcgaagctctgcggtccttggcatctctatggccccgagttgtgctctcccccatttcagggggcatttggcatagcgtgctccactccttcatctccggcgtgtccggctcacacgtctttcagccaattctgaccggaagggccttagcagaccgacacaatgcatatgaaatcaatgctatcacgggcgtgaaaccttacttcaccgatgtgctcctgcaaaccaagaggaaccccaatacgaaagcgcaggaagcattggagtcctaccccctcaataatgcttttccaggacagttcttccagatgcccagtggccaactgcagcccaatctgccacctgatctccgagcccccgtagtctttgtgctggtgccccttagggacctccccccaatgcacatgggacaaaacccgaataaacccaggaatattgtcaggcatctgaatatgcctcagatgtcttttcaggaaaccaaggacttaggacggcttcctaccggccgcagcgtggagatcgtcgagattaccgaacagtttgcctcctctaaggaagccgatgagaagaaaaagaagaaaggtaagaaatag

SEQ ID NO: 108462 - DNA, 252 bp, Artificial Sequence
  Description of Artificial Sequence: Synthetic coding sequence
atgcggttgttccttagtttaccagtgcttgttgttgtgctgtctatcgtgctggaaggcccagcccccgcccaagggacaccagatgtgtcatctgctctggataagttaaaggagtttggcaataccttggaggataaagccagagaactcatcagcagaatcaaacagtctgagctcagtgctaagatgagagaatggttctcggaaacgtttcaaaaagtgaaggagaaactgaagatcgacagctag

SEQ ID NO: 108463 - DNA, 306 bp, Artificial Sequence
  Description of Artificial Sequence: Synthetic coding sequence
atgggtacacgcctattacctgccctatttctagtattactcgtcctcggctttgaggtgcaaggaacacagcagcctcagcaggacgaaatgcctagcccaactttcctcacacaggtgaaggaatcactgtcttcttattgggaaagtgcaaaaacagccgcccaaaacttgtacgaaaagacatatcttccagccgtggatgagaagcttcgggatttgtactcaaagtcgacagcagccatgtcaacttacacaggcattttcaccgaccaggtgctttccgtgctgaaaggggaggaatag

SEQ ID NO: 108464 - DNA, 384 bp, Artificial Sequence
  Description of Artificial Sequence: Synthetic coding sequence
atgagtctccttcgtaaccgcctccaggccctgccagcactgtgtctttgtgtgctggttttagcgtgcataggcgcctgtcagcctgaggcccaagaaggtactctcagccctccgccaaagctcaagatgagccgctggtcactggtgcggggtcgcatgaaagaacttctggagaccgtggtgaacagaactcgcgacggctggcaatggttctggtcgccatccactttccgcggcttcatgcagacttactacgatgaccatctgagagaccttggccctttgaccaaggcatggttcttagaatctaaggactcgctgttgaaaaaaacacattcgctgtgcccaagacttgtgtgcggggacaaagatcaggggtag

SEQ ID NO: 108465 - DNA, 1101 bp, Artificial Sequence
  Description of Artificial Sequence: Synthetic coding sequence
atggcctctatggccgcggtcctgacatgggccctcgcattgttgtctgcattctccgccactcaggcgcgcaaagggttttgggactattttagccagacctcaggcgacaaaggtcgagtggagcaaatccatcagcaaaagatggctcgcgagccggccaccctgaaagacagccttgaacaggacctcaataacatgaacaaattccttgagaaactgcggcctctgtcaggaagcgaagcaccaagattgccacaagacccagtgggtatgcgtaggcagctgcaggaggagctggaggaagtgaaggcaaggctgcaaccgtatatggccgaagcgcacgaactggtgggctggaatctggagggattaagacagcaactgaagccatacacaatggacctgatggagcaggtcgccctgcgtgtgcaggagttgcaagagcagctacgggtggttggggaggatactaaagcacaacttctcgggggtgtcgacgaagcatgggcactgcttcagggtttgcagagccgcgtggtccaccatacagggcgcttcaaagagctattccatccttacgcggagtcgctagtgagcggtataggccggcacgtccaagagctgcaccggagcgttgcccctcatgctcctgcaagtcccgcgagattgagcaggtgcgtacaggtcttgtctaggaagttgacactgaaggctaaagcgctgcacgcaaggattcagcagaatcttgaccagctgcgtgaagagctgtccagagcttttgctggcaccggaactgaagagggggccggcccagatccccagatgctatctgaagaggtcagacaacggctccaagcatttaggcaggacacttatctgcagatcgccgcattcacacgtgctatcgatcaggaaactgaagaagtccaacagcagctggctccaccaccccccgggcacagcgctttcgccccggaattccagcagaccgacagcggtaaggtgctttctaagttgcaggcacgcctcgacgacttatgggaggatataacgcacagtctccacgatcaaggccacagtcatttaggagatccgtag

SEQ ID NO: 108466 - DNA, 354 bp, Artificial Sequence
  Description of Artificial Sequence: Synthetic coding sequence
atgggtacatggggtgctccacaccggaccctgccctgcaggaatcggggcgcaatgcagccacgcgttttactagtggtcgccctgctagccttgttagcatcggcaagagcgtctgaggctgaagatgcttctctcctctccttcatgcaaggatacatgaaacatgctaccaagaccgccaaagatgctctttccagtgttcaggagagccaggtggctcagcaggccaggggctgggttacagatggttttagttctcttaaagattactggtcaaccgtgaaagacaagtttagcgagttctgggacctggatcctgaggtccggccgacttccgctgtcgccgcgtag

SEQ ID NO: 108467 - DNA, 168 bp, Artificial Sequence
  Description of Artificial Sequence: Synthetic coding sequence
atgcagccgagagtcttattagtcgtggctctgctggccctgctggcaagtgccagggcctccgaggccgaagatgccagcctattgtcgttcatgcaaggatatatgaagcacgcaacgaagacggcaaaagatgctttgagcagtgttcaggaatctcaggtgtag

SEQ ID NO: 108468 - DNA, 384 bp, Artificial Sequence
  Description of Artificial Sequence: Synthetic coding sequence
atgagcttactgaggaataggttgcaggccctccccgccctttgtttgtgtgttttggtgctagcctgtatcggcgcctgtcagcctgaggcccaggaaggcaccctgagtcctcccccaaaactgaaaatgagccgatggtccctcgttcgcggacgcatgaaggaactcctggagactgtggtgaataggacccgggatgggtggcagtggttttggagcccgagtaccttcagaggtttcatgcagacgtattatgatgatcacctgcgggacttaggacccctgaccaaagcgtggtttctggaatcaaaggatagtctcctgaagaaaactcactctttgtgcccccgacttgtatgtggggataaagatcagggatag

SEQ ID NO: 108469 - DNA, 384 bp, Artificial Sequence
  Description of Artificial Sequence: Synthetic coding sequence
atgagtctactacgtaaccgcctgcaggccctccctgccctgtgcctgtgcgttctcgttcttgcatgcattggcgcatgtcagccagaagcccaggagggcacgctttccccaccaccaaaactgaagatgtcacgttggtcccttgtgcgcggtagaatgaaagagctgctcgaaacagtggtgaatcgcactagagacggctggcagtggttttggagtccctctacctttcggggattcatgcagacgtactatgatgatcacctccgcgacctgggccctctgaccaaagcttggtttcttgaatccaaggatagcctcctgaaaaagacacattcattatgcccaagactggtgtgtggtgacaaagatcaggggtag

SEQ ID NO: 108470 - DNA, 570 bp, Artificial Sequence
  Description of Artificial Sequence: Synthetic coding sequence
atggtgatgctactgctgctgcttagcgccctcgcagggctgtttggggctgcagaaggccaggcctttcacttagggaagtgcccgaatcctccggtacaggaaaactttgatgtaaataagtatctggggaggtggtacgagatcgaaaaaattccaaccacctttgaaaatggaaggtgcatccaggccaattatagtttaatggaaaatggaaagataaaggttctgaatcaagagctccgggccgacgggactgtgaaccagatcgaaggcgaggccacacctgtgaatctgacagaaccagctaagctggaagtgaaattttcatggttcatgccctcggcaccatactggattcttgctaccgattatgaaaattacgctctggtctactcctgtacgtgcattattcaactgtttcacgttgatttcgcctggattctggccaggaacccgaatctgccaccagaaaccgttgacagtctgaaaaatatcctcacatctaacaatattgacgtcaagaaaatgaccgtaacagaccaggtgaactgccccaagcttagctag

SEQ ID NO: 108471 - DNA, 450 bp, Artificial Sequence
  Description of Artificial Sequence: Synthetic coding sequence
atggtgatgttactcctgctattaagtgccttggccggcttgttcggggccgctgaaggccaggctttccacctcgggaagtgcccaaatccgcctgtgcaggaaaatttcgatgtgaataagtatctcggcagatggtatgagatcgagaaaattccgacgacattcgaaaacgggcggtgcattcaggctaattactccctcatggagaacggcaagatcaaagtcctgaatcaggagctgcgcgctgacggaacagtcaatcaaatcgaaggagaggcaaccccggtcaacctgaccgagcctgccaagctggaagtgaaattctcttggttcatgccatctgccccgtactggatccttgccacggattatgagaattacgctttggtctattcctgcacctgcattatccagctcttccacgtggactttgcctggatcttgtag

SEQ ID NO: 108472 - DNA, 954 bp, Artificial Sequence
  Description of Artificial Sequence: Synthetic coding sequence
atgaaggtgctgtgggccgctcttttggtgacattccttgcaggctgtcaagctaaggtggagcaggctgtggagacagagcctgaaccagagttgagacagcagaccgaatggcagtccgggcagcggtgggagttggccttgggaaggttttgggattacctgcggtgggtgcagaccttaagcgagcaagttcaagaggaactcctgtcctctcaagttacccaggagcttcgggccttaatggatgaaacaatgaaagagcttaaggcctacaagagcgagctcgaggagcagctgacgccagtggccgaggagacacgggcacgactctctaaagagctgcaggcagcacaggcccgactaggagcggacatggaggatgtatgcgggcgcttagtgcaatatagaggtgaggtccaggctatgctcggccagagcacagaggagcttcgagtaagactcgcctcacatttaaggaagctccggaagcgcctcttgcgcgacgccgacgacctgcaaaaaagactagcggtgtatcaagcaggggcgagagaaggcgccgagcgcgggctctcagccatccgtgaacgcctggggccccttgttgagcagggaagggtgcgtgcagccacagtagggtctctggctgggcaaccactgcaggagcgagctcaagcttggggtgagcgtcttcgcgcccgcatggaagaaatgggttctaggacacgggataggcttgatgaagtgaaagagcaggtggcggaagtccgggccaagctcgaagagcaagcacaacagattagactccaggcagaggcattccaggctcggctgaaatcttggttcgaaccattagtggaggacatgcagcggcagtgggccggattggtggagaaggtgcaggcagccgtgggtacatcggctgccccggtgcccagcgacaatcactag

SEQ ID NO: 108473 - DNA, 660 bp, Artificial Sequence
  Description of Artificial Sequence: Synthetic coding sequence
atgaaggtgttatgggccgctctgctcgtcaccttcctggccggatgccaggccaaggtggaacaggccgtggaaacagaacccgagcccgaactccggcaacagactgaatggcagagcgggcagcggtgggagctggcgcttgggcggttctgggattacctcaggtgggtgcagactctgtccgagcaggtgcaggaggagcttctgagctcccaggtgacccaagagctccgggcattgatggacgaaaccatgaaggagctgaaggcttataaaagcgaattggaagagcagttgacacccgtagccgaagaaacccgagcaaggctaagcaaagagctgcaggctgcccaggcacgactcggcgcggatatggaagatgtctgcggcagacttgtgcagtacaggggagaagtccaggcaatgctgggacaatctacagaggaattacgggttagacttgcaagtcacttgcgcaagttgagaaagcgtctcctgcgcgacgctgatgacctgcaaaaacggcttgccgtttatcaagctggggccagagagggggcagagcgggggctgagtgccatacgagagaggctggggccactcgtggaacaggggcgggttagggccgccaccgtggggagtttagcaggacagtag

SEQ ID NO: 108474 - DNA, 867 bp, Artificial Sequence
  Description of Artificial Sequence: Synthetic coding sequence
gaggtaaaagacgttctgcctcaagagcctgtccggtccgcagtgggtggtacaggcatgtcaagtggtgcctctaggaagtcttgggatccgggcaatccctggccccctgattggccaatcacgggcagaaagatgaaagtgctgtgggccgctctgctggtgacattcctggcgggatgccaggcaaaggttgagcaggcagtcgagaccgagcctgaacccgaattgcgtcagcagaccgagtggcaatctggacaaagatgggagctggcactgggtaggttctgggattacctgcggtgggttcaaaccctctccgagcaagtgcaggaagagctgttgtctagtcaagtgacgcaagaactccgcgctcttatggacgaaaccatgaaggaactgaaggcgtacaagtctgaacttgaggagcagctcacaccggtggccgaggaaacgcgggcacgtcttagcaaggagttacaggccgcacaggcccgactgggcgcagatatggaggacgtgtgtggcagactggtgcaatataggggtgaagtgcaagctatgctgggccaatctacggaggagttgagagttagacttgccagtcacttgcgaaaattgcggaagaggctcctgagggacgctgatgacttacagaaacgccttgcggtatatcaagcaggcgcgcgtgaaggggccgagaggggactgtccgccattagggaacggctcgggcccctggtggagcagggccgtgttagagcagctactgtggggtccctggcaggacagccactgcaggagagagctcaggcctggggcgagcggttgagggcacgcatggaagagatgggttcaagaacatag

SEQ ID NO: 108475 - DNA, 651 bp, Artificial Sequence
  Description of Artificial Sequence: Synthetic coding sequence
atgaaggtgctctgggcggctttgctcgtgacatttcttgctggctgccaggcaaaggttgagcaggccgtcgagacagaaccggaacccgaacttagacaacaaactgagtggcaatctggacagagatgggagctcgcattgggacggttctgggattacctccggtgggtgcaaaccctgtccgagcaggtgcaggaagagcttctctcttcccaagtgactcaggaactccgggctcttatggacgaaactatgaaggaattaaaagcttacaaaagcgagcttgaggaacagctcactcccgtggcggaggagactagagcccgcttgtccaaagagctacaggcggcacaagcacgccttggcgcagacatggaggatgtgtgtggaagactcgttcagtatcggggtgaagtacaggctatgctgggacagtcaactgaagaactccgagttagactcgcaagccatctcaggaagctgaggaagagacttttacgcgatgcagatgacctccagaagcgcttggccgtataccaggccggcgctagagagggtgccgaaaggggcctgtcggcaattcgggagcgcctgggaccattagtagagcagggtagggttcgagctgccacagtggggtcactgtag

SEQ ID NO: 108476 - DNA, 10593 bp, Artificial Sequence
  Description of Artificial Sequence: Synthetic coding sequence
atggccaaagaagaagatgaggaaaagaaggcaaaaaaaggcaagaagggcaagaaagcccccgaaccggagaaaccaaagagatccctcaaagggacaagtcggcttttcatgggctttcgagaccggaccccaaaaattagcaagaaaggtcaattccgttccgcctccgcgtttttttggggcctacataccgggccccagaagaccaaacgtaagcgcaaggccagaacggtgcttaagagtacatcaaaacttatgacacagatgcgaatgggtaagaagaaaagagccatgaaggggaagaagccctcattcatggtgatccggtttcccggtagacgcggatatggccggctgcgcccccgtgcacgaagcctaagtaaggctagtaccgccatcaattggctcacaaagaagttcctgctcaaaaaggcggaggaatctggctctgaacaggcgaccgtagacgcctggctgcagaggtcatccagtcgcatggggtctaggaagctgccttttccttcgggcgccgaaattctgaggcccggcgggcgactccgtcgattcccgagatcccggtctatctatgcatccggcgaacctctgggtttcctcccattcgaagacgaagccccatttcatcactcagggtcccgaaaatccttgtacggactcgaagggttccaggacctgggagagtattatgactaccatcgggacggggatgactattacgatcgccagagccttcacaggtacgaggagcaggaaccatacctcgctgggttagggccatatagccctgcctggccgccttacggggaccactattatgggtacccaccagaagatccctacgactactaccacccagactactatggtggaccatttgatcccggttatacctacggttacggttacgatgattatgagcctccctacgctcctccaagcggttatagctctccatatagctatcacgatggatacgagggggaggcccatccctatggctactacctagacccctatgcaccgtatgatgccccatatcccccttatgacctaccataccataccccttacgatgtgccttactttgatccctacggagttcactatactgtcccgtacgccgagggggtgtacggcgggggtgacgaggccatatatcctcccgaggtgccttatttttaccctgaggagtctgccagtgctttcgtatatccctgggtcccacctccaattcccagcccccataacccttacgcccatgctatggacgatatcgcagaattagaggagcctgaggatgctggtgtcgagaggcaggggacaagctttaggttaccatctgccgctttcttcgaacagcaggggatggataaacctgccaggtcaaagttgtcgctgattcgtaaatttcgcctctttccccgacctcaggtgaagctatttggcaaagagaagctcgaagtccccctgccacccagcttggatattcccctgcctctgggcgatgcagacgaggaagaggatgaagaggagctgccaccagtctcagccgtcccttatggccaccccttttggggatttctcacaccccgacagcgtaacctgcagcgcgctctgagcgccttcggcgcacataggggcctgggtttcgggcctgagtttggaaggccagtaccgcgcccagcaacctcattagccaggtttctcaagaaaacgctgagcgaaaaaaagcctattgccaggctcaggggctctcagaaggcgagggctggagggcccgctgtgcgagaggcggcctataagaggttcggctataagctggccggcatggaccctgagaagcccggcacaccaatcgtgctccggagagcacagcctagagctagatccagtaacgatgcccgtcggccgcccgccccccagcccgctccgcgaacactgtcccactggtcagcactgctgagtcctccagtaccgccgagaccccctagctccggacctccccccgctccgcccctctcccccgccctgtcagggctgcctcgacctgcatctccatacggctctctgaggcggcatccacccccctgggccgcgccagcccacgttccacctgctccacaggcatcctggtgggctttcgttgaaccccccgctgtctcacctgaggtccctccggacttgctagcatttccaggccctcgtccctcctttaggggcagccgtcgtcgaggggccgcttttggctttcccggggcatcccctagagcctcaagaagaagggcctggtcccctctggcttccccacagccctcactgcgctcatcccctggcctcggttattgcagccccctggcacccccctcaccccaactgtcattacggacaggcccattccagccaccttttctcccccctgctagacgacctaggagcttgcaggaaagcccggcgccacggagagcggcaggtagactaggcccacccgggtcgcctttgcccgggtcaccacgtcccccaagcccccccctcggtctgtgtcatagcccaagaaggagcagcctcaatctcccttcccggttgccacatacgtggaggagactctctgaaccaccaactcgagcagtgaaacctcaggtgaggctgccatttcatagacctccacgggctggagcttggcgggccccgttagagcacagggagagccccagagaaccagaggactctgaaactccctggaccgttccacctctggctcctagttgggatgttgatatgcctcctacccagagacctccgtcgccttggcccggtggcgctgggtctcgacgcgggttctctcgtccaccacctgtgccagaaaaccctttcctgcagctgctcgggccagtcccgtccccaaccctgcagcccgaggatcccgctgctgacatgacaagggtgttcctgggaaggcatcacgagccaggacccgggcagcttacaaagtcagccgggccaacgcccgagaagcccgaagaagaagctacactgggagacccccagctaccggcagaaacaaaacctcccacacctgcaccacctaaagatgtgacgccacccaaggacataacaccccccaaggacgtactgcccgagcagaagacgctgcgtccttccttgagctaccccttagctgcatgtgatcagactcgtgccacttggcctccttggcaccgctggggcactcttcctcaggctgccgcccccttggctcctatccgggctccagaacctttaccaaaagggggagagcggcgccaagcagccccagggaggtttgccgttgttatgcccagagtccaaaagctctcctctttccagagggtgggcccagccaccctgaagccccaagtgcagcctatacaggaccccaaaccccgagcctgctcgctcaggtggtcatgtctatggctgcgggccgatgcttatggcccctggccccgggtgcacacccacccccaaagctgtcacctagggcctggggctgcgtgtctttcactgagagggtcttgggaggaagtggggccccccagctggaggaacaaaatgcattctatcagaaacctgccgagtatgaggtttagagaacagcacggcgaggatggggtcgaggatatgactcagctggaggacttgcaggagactaccgttctttcaaacttgaagatacgctttgaaaggaacctgatttatacctacatcgggtctattttggttagtgtgaacccctatcaaatgttcggcatttacgggccggaacaggttcagcagtacaacgggcgagctcttggagaaaatcccccacacctgtttgcggttgctaatctcgctttcgccaagatgctcgacgccaagcaaaatcagtgcataattatttccggagagtccggctccggcaagaccgaagccacaaagctcattctgagatacttggccgcaatgaaccagaaaagggaagtgatgcagcaaattaaaatactagaggcaacaccattactggaatctttcgggaatgccaagaccgtcaggaacgacaactctagcagattcgggaagtttgtggaaattttcctcgaaggaggtgtgatatccggagccatcaccagccaatatctgctggaaaaatctcggatcgtattccaggccaagaatgaacgcaattatcatattttctatgaactcttagctgggctgcctgcccagctccgacaggccttctcactgcaagaggcagaaacttattattacctgaatcaaggcggcaactgcgagatagccggaaaaagcgacgcggacgatttcaggaggctcttagctgccatggaggtcctgggtttcagcagtgaagatcaggatagtatcttcaggatcctcgccagtattctccacctcgggaacgtgtattttgaaaaatacgaaacagatgctcaggaagtggctagtgtggtctctgctcgagagatacaggcagtggctgagttgctgcagatttccccggaaggccttcagaaggctattacattcaaggtgacagaaacaatgcgggaaaagatcttcactccattgactgtggagtcagctgtagatgctagggacgctatcgccaaagtgctgtacgccttactgttcagttggctcattacgagggtgaacgcactggtctcacctcggcaggacactctgtcaatcgcgatcctcgacatctatggcttcgaagacctgagttttaacagctttgagcagctctgtataaactacgcgaacgagaatctacagtacctcttcaacaaaatcgtgttccaggaagagcaagaggagtacatcagagagcagatcgactggcaagaaatcacatttgccgacaaccaaccgtgcatcaatctaatctccctgaaaccttatggaattcttagaatcctcgatgaccagtgttgcttcccacaggctactgaccacacgttcttgcaaaaatgtcattatcaccacggggcaaatccactttatagtaagcctaagatgcctcttccagagttcaccatcaagcattacgccggaaaggtaacttatcaggtccacaaatttctggacaagaaccatgaccaggttaggcaggacgtgctggatctgttcgtccgttccaggaccagggtagtggcccatcttttttcttcacacgctcctcaggccgccccccaaaggttggggaaatcctccagtgttactcggctgtacaaagcccacaccgtagccgcaaagtttcagcagtcactgctagatctggtagagaagatggagcggtgcaatccgcttttcatgaggtgtctaaagcccaatcacaaaaaagagcccgggctctttgaacccgacgtcgtgatggctcaactgagatacagcggcgttttagagaccgttagaatcagaaaggaaggtttccccgtgcggctgcctttccagggcttcatcgaccgatactgctgtctggtcgccctcaaacatgatctccctgctaacggagacatgtgtgtgtctgttctttcgcggctatgcaaagttatgccaaacatgtatagggttggcgtgtctaagctgttcctgaaggaacacctgtaccagttgcttgagtccatgcgggagcacgtcttaaaccttgcggccttgacccttcaacgctgcctgcgcggcttctttatcaaacgccgctttcgatctctccggcacaagataattctgcttcaatcgagagcccggggctatttggcaagacagagatatcaacaaatgcggaggtccctggtcaagttccgcagcttagttcacgcttacgtctcccggcgtcggtacttgaagcttagggccgaatggcgttgtcaggtcgagggggccctgctgtgggagcaagaggaactcagtaaacgggaggtggtggccgtgggtcacttggaagtgcctgccgaactggctggcttgttgcaagcagttgccggcctcggtctggcccaggtgccacaggtggcccccgttaggacaccccgactgcaagctgagcctagagttaccctgcctctcgatattaacaactatccgatggccaaatttgtgcagtgccattttaaggagcccgccttcgggatgctcacagtgcccttaaggacccctctgactcaactgccagctgaacaccatgctgaggcggtgtccatttttaagctcatcctgcggtttatgggagatccgcaccttcacggagcccgtgagaacatcttcgggaattatatcgtccagaaagggctcgcggtccctgaactccgggatgagatcctcgctcaactggcaaaccaggtctggcacaaccacaacgcgcataacgccgagcgggggtggttgctcctcgctgcctgtctcagcgggtttgcaccttccccttgcttcaacaagtatctcttaaagttcgtctctgactacgggcggaacggattccaagccgtttgtcagcaccgcctgatgcaggccatgggaagagcccagcagcagggcagcggcgcggcacgcactctgccacccactcagttagagtggacagctacgtacgagaaggctagcatggctctggatgtaggttgttttaatggggaccaattctcctgccctgtgcattcgtggagtactggtgaggaggtggcgggcgacatactaagacatcggggcttagccgatggctggaggggatggactgtagccatgaaaaacggggttcagtgggccgagctggcggggcacgattacgttctcgaccttgtgagtgacctggaattgttgcgagacttccccagacaaaaaagttacttcatcgtggggaccgaaggaccagccgcaagtaggggcggtccgaaagtggttttcggtaactcttgggattcagacgaagacatgagcacccgacctcagccacaagagcatatgcctaaggtactggattccgatggatattcctcccacaatcaagacggtacgaatggcgagaccgaagcccagcggggtacagccacacatcaagaatctgactcactgggcgaaccagctgtgccacacaaaggcctggactgttatctcgatagcctcttcgatccagtgctttcttatggtgatgctgacttagaaaagcccactgctattgcctatcgcatgaagggtggagggcagccaggcgggggcagcagcagcgggacagaagacactcccagacgcccacctgagcctaagccaattccaggcttggacgcatctacattggcactgcaacaggcctttatacataaacaagcagtgctgctggcccgcgagatgacgctgcaagccaccgctctgcaacaacagcctttaagcgccgctctgagatccctccccgccgaaaagccacctgccccagaggctcaacctacttccgtcggaacaggacctcccgcaaagccagtgctgctgagggcgacacccaagcctctggccccagccccactggccaaagcgcctcgtttgcccattaaacctgtggctgcccccgtcctggcccaggatcaggccagccccgagacaacgagcccctccccggagctggtgcgctacagtacactaaacagcgagcattttccccagcctacccagcagataaaaaacattgtccgccagtaccagcagccatttcgcggaggaagacctgaagccctccgcaaagacggaggaaaggtttttatgaaaaggcctgacccacatgaggaagcactaatgatcctgaagggacagatgacccacttggccgctgcccctggaacccaagtgtctagggaggcggtggccttggtgaagccggtgactagcgcccctcggccatcgatggccccaactagcgctctcccttcccggagtctggaacctcccgaggagctgacgcagacgcggttacatagactgataaatccaaatttttacggttatcaggacgcaccatggaaaatttttctccgaaaggaggtgttttaccccaaggacagttattcccaccccgtgcagcttgacctcttgttccgccagattctccatgacaccttgtcagaggcctgcttgagaatttccgaagatgagagacttaggatgaaggctttgtttgcccagaaccagcttgatacccaaaagcccctcgttaccgagtctgtgaagcgtgccgtggtcagtacagcccgggatacctgggaggtatacttttctagaatctttcccgcgactggaagcgtcggcactggagtgcaacttctagcagtcagccacgtgggcattaagctgcttcgtatggtgaagggaggccaggaagccggcggacaactccgcgtccttcgcgcatacagttttgccgacattttgtttgtaactatgccatcccagaatatgttggagtttaatttggcgagtgagaaggtgatcctcttctcagcgcgggctcaccaggtcaaaacactcgtggacgacttcatcttggaacttaaaaaggatagcgattacgtagtcgcagtccgcaacttccttcctgaggatccggccctgttagccttccataagggagatataattcaccttcaacccctggaacccccacgggttgggtactctgcagggtgtgtggtgcgaaggaaagtggtttatctggaggagctccggagacggggtcctgacttcggatggcggttcggtacaatacatggtcgggtgggacggttccctagtgaacttgttcaacctgccgccgcgccagactttctccagctgcccacggagcctggtcgcggccgagcggcagcagtagccgccgcggtagcctccgccgcggcagcccaggaagtcggccggcggcgagagggaccacctgtacgggcaagatctgcagatcacggagaagacgcattagccctcccaccatacacaatgctggaattcgcacagaaatatttccgcgatccccagcgacggccccaggacggcctcagactgaagtctaaggagccgcgcgaaagtaggacgcttgaggacatgctgtgtttcactaaaacacccctgcaggaatctttgattgagctgagtgactccagtctgtcaaagatggctaccgacatgtttctcgccgttatgcgttttatgggggatgcaccgctgaaaggacagtcggacttagacgtactctgcaacctgctgaaactatgtggggatcacgaagtaatgagggacgagtgttactgccaagtggtaaagcagataacagacaacacgtcctccaaacaagactcctgtcaacggggctggagattgttatacatagttaccgcgtaccattcctgttcagaagtactacacccgcaccttaccagatttctgcaggacgtctcacgaactccgggactgccattccagggaatcgctaaggcgtgcgagcaaaatttgcagaagactctccgcttcggaggtcgcctcgagcttcctagctcaattgaattaagggccatgctggcgggcagatcaagcaagcggcagctctttctccttcccggcggactggaaagacacctaaagataaagacatgcaccgtggccctggatgtggtggaggagatttgcgccgaaatggcactaacccgtcccgaagcgtttaatgaatacgtgatctttgttgtgaccaatagagggcagcatgtttgtcccctcagcagacgcgcctacatcctggacgtggccagtgagatggaacaagtggatggtggttacatgttatggtttcggcgagtgctgtgggatcagcctttgaaattcgaaaacgagctgtatgtcacaatgcactacaatcaggtgcttccagattacctgaaaggacttttttcttctgtgcccgcttctcgaccgagcgaacagctcctgcagcaagtgagtaagctggcatccctccagcacagagctaaggaccacttctacctgccaagcgtgagggaagttcaagagtacatcccagcccagctctacagaactacagctgggtccacctggctcaacctggtttctcagcacagacagcagacccaggcactctctccgcatcaggcaagagcccaattcctgggcctcctgtcagccttacccatgtttggatcttctttcttcttcatacagagctgttcgaatatagcggtgcctgcaccttgcatattggcgattaaccacaatggcctgaactttctttcgacagaaacccacgagttgatggtgaagttccccttgaaggagatacaatctacccggacacagcggccaaccgctaactcatcttacccatacgtcgaaattgctcttggagacgtggctgcacagagaacactgcaattgcagttagagcaggggttagagctgtgcagggtggttgccgtgcacgtggaaaaccttctctctgcccacgaaaaacgtctgactctgccaccgtccgagatcacattattgtag

SEQ ID NO: 108477 - DNA, 840 bp, Artificial Sequence
  Description of Artificial Sequence: Synthetic coding sequence
atgtttcgagctccctgtcacagactgagggctcggggtactaggaaagctagagcaggggcctggcgtggatgcacgtttccctgtctggggaaaggaatggagcgacccgcagctcgggaaccacatggccctgacgctctgagacgctttcagggactcctgctggatcgccggggcagactgcacggccaggtactgcgcttgcgcgaagtagcccgtaggctggaacgtctcagacgtcgatcactggtggcaaatgtcgccgggtctagcctgtcggcgacgggcgccctcgccgcaatcgttggtctcagcctgagcccggtaacattgggcacctctctgctggtgtctgcagtcggtctgggtgtggccacggccggtggagccgtgaccatcaccagcgatctgtcccttatcttttgcaactccagggagctaagaagggtgcaggagatcgccgccacatgtcaggatcagatgagagaaatcctgagctgtctggagttcttctgccgatggcaggggtgcggggaccgacagctgttgcaatgtggaaggaacgcttccatcgctctctacaattcagtgtatttcattgtctttttcggaagccggggattcctaattcctaggcgagccgagggtgacacaaaagtgtcccaggctgtgttgaaggcgaagattcagaaattagcggaaagcctggagagttgcaccggggcacttgacgagttaagcgagcagcttgaatctcgggttcagctgtgtaccaagtcatcccgaggtcatgacctgaagataagcgctgatcaacgtgcaggcctgtttttttag

SEQ ID NO: 108478 - DNA, 747 bp, Artificial Sequence
  Description of Artificial Sequence: Synthetic coding sequence
atgggcatggagcggccagcggcccgtgaaccacatggccctgatgcccttcggagatttcaaggcctgcttcttgaccggcgcggtcgcctgcacggccaagtgctgcgattacgagaggtcgcccggagacttgagcggctcaggcgtagaagcctggtggctaacgtcgcaggaagtagtctttccgctactggcgctcttgccgctatcgtcgggttgtctttgtcacctgtgacactaggcaccagcctgctggtttccgccgttgggctcggcgtagccaccgctggcggggcagttacaattaccagtgacctgtcactcattttttgtaactcacgggagttaagacgcgtacaagagatcgctgccacctgtcaggaccagatgagagagatcctgtcctgtctggaatttttttgccgatggcagggttgtggtgatcgccagttactgcagtgcgggagaaatgccagcatcgctctttacaactccgtgtacttcatcgtgttttttgggagccgcggtttcctcataccaagacgcgcagaaggcgatactaaagtctctcaagcagtcctgaaggcaaaaatccagaagctggcagaaagcttggagtcttgcaccggtgcactcgacgagctctccgagcagctcgaatctcgagttcagctctgtactaagagttcccgtggccacgacctgaaaatctccgccgaccagagggccggactgttcttttag

SEQ ID NO: 108479 - DNA, 1245 bp, Artificial Sequence
  Description of Artificial Sequence: Synthetic coding sequence
atgaggttcaaatcacataccgtcgagctacggcgtccctgctcggatatggaaggggccgcacttctgcgggtaagcgtcctgtgcatctggatgagcgcactgttcctgggggtgggtgttcgggccgaggaagcaggagcccgggtacagcagaacgtcccatctggcaccgataccggggacccccagtcaaagccactgggagattgggctgccggcactatggatcctgagagctctatcttcatcgaagacgcgattaaatatttcaaggagaaggtgtctacgcagaatttgctgttgttgctcacagacaacgaggcctggaatgggtttgtggctgcagccgagcttccaagaaacgaggccgacgaattaaggaaagcactggacaatttagcccgccagatgattatgaaagacaagaactggcacgataaaggacaacaatataggaattggtttctgaaagagtttccaagattgaagagcgagctcgaagataacatccggcgactgagggcactggcagacggcgtgcagaaggtgcacaaagggacaacaattgccaatgttgtttcaggctcgctgtcaatcagcagcggtattctgaccctggtgggcatgggcttggcccctttcacagaaggaggttctcttgtactgcttgagcctggcatggaactggggatcactgccgccctgacaggcatcacctcctccaccatggactacggaaagaaatggtggacacaggcccaggctcatgatctcgtgatcaagtccctcgacaagctcaaggaggttagggagttcctcggagaaaacatatcaaatttcctttccttggctggcaacacataccagctgacgagaggcatcggaaaagatataagggcactcagacgggcaagagcaaacctgcagtcagtcccacatgcatccgcatcacggcctcgggtgacggagcccatttcggccgagtccggagagcaagtcgaaagggttaacgaaccgtccatcctggaaatgtcacgaggcgtgaagctcactgatgtcgccccagtgtctttcttcttggtcctcgatgttgtgtacctcgtatatgagtccaaacatttgcacgagggggcgaaatctgagactgccgaggaactgaagaaagtcgcccaggagctggaagaaaagctgaacattctgaacaacaactataaaattctgcaagcggaccaagaactgtag

SEQ ID NO: 108480 - DNA, 834 bp, Artificial Sequence
  Description of Artificial Sequence: Synthetic coding sequence
atgattatgaaggacaaaaactggcacgataagggccagcaatacaggaactggtttcttaaggaattccctagactgaagagcgagctcgaggataatataaggcggcttcgtgccttggccgacggagtacagaaagtgcacaaggggactaccattgcaaatgtagtctccggttccctgtcaatatcttccgggatacttacactcgtcggaatgggcctggctccattcaccgagggaggatcacttgtgttactcgaaccgggcatggagttgggcatcaccgctgctctgacaggcatcacctccagtaccatggattatggaaagaaatggtggactcaagcccaagcccatgatctcgtgatcaaatcccttgataaactcaaggaggtgcgggaattcctgggggagaacataagcaatttcttatcccttgcgggaaacacctaccaactgactcgtggaatcgggaaagacatcagggctttgcgtagggcacgcgctaatctccagtccgtgcctcatgcctcagcttctagaccgcgcgtcacagagcctattagcgctgaatcaggcgagcaggtggagcgtgtgaatgaaccctctatcctcgagatgtcacggggagtcaagctcacagacgtggctcccgtgtctttctttctcgtgctggatgtggtttatctggtgtacgaatcaaagcacctccacgagggcgccaagagcgaaacagccgaggaactcaagaaggttgctcaagaattggaagagaaactcaatattcttaacaataattataagatactgcaggccgaccaggagttgtag

SEQ ID NO: 108481 - DNA, 1197 bp, Artificial Sequence
  Description of Artificial Sequence: Synthetic coding sequence
atggagggcgccgctcttctccgagtgagtgtgctatgcatatggatgtctgccttattcctaggcgtcggggtgagagccgaagaagctggtgctagagtgcagcagaatgtgccatccgggaccgatacaggggatccccagagtaagcctttaggcgactgggctgcgggcaccatggatcccgagtctagtatattcatagaagacgccatcaaatacttcaaggagaaggttagcactcagaacctccttcttttgctcaccgataatgaagcctggaatggcttcgtggccgcggcggaattgcctagaaatgaggcagacgagttgcgtaaagccctggataatcttgcaagacagatgatcatgaaggacaaaaattggcatgacaagggacaacagtatagaaactggtttctcaaagaatttcctcgcttgaagtctgagctcgaggacaatattcgaaggctcagggcgctagctgatggagtgcagaaggtccacaaaggtacaactatagccaacgttgtcagcggttctctttccattagcagtggtatactgactctggtgggcatgggactggctccttttactgaagggggatcccttgtgttactagaaccaggaatggagctcgggataacagctgcactcacaggtataacatcgtccaccatggactatgggaagaaatggtggacgcaggcacaggctcatgacctggtcattaaaagtctggacaagctgaaggaggttagggaattcttgggcgagaacatcagcaattttttgagtctcgctggaaatacgtaccagctcacccggggaatcggtaaagatattcgagccctgagacgcgcaagagccaacctgcaatctgtgccgcacgcctccgccagcagaccgcgagtcaccgagcccatttctgcagagtctggcgagcaagttgaacgagtaaacgaaccatctatcctagagatgtctcggggagtgaaactcaccgacgtggcacctgtgtcgtttttcttggtcctcgacgttgtgtacctggtctacgagtcaaaacatctgcacgagggggccaaatcagaaaccgctgaggaactcaagaaggtcgcccaggagttggaggagaagctcaacatcctcaacaacaactacaaaattctccaggcagatcaagagctatag

SEQ ID NO: 108482 - DNA, 1197 bp, Artificial Sequence
  Description of Artificial Sequence: Synthetic coding sequence
atggagggtgcagccttattacgggtctctgtcctgtgcatttggatgagcgctctttttctcggggtgggtgtcagggctgaggaggctggtgcccgagtacagcagaatgtcccctccggaactgatacaggcgacccacagtccaaacccctaggggactgggcagctggcaccatggaccccgagtcctcaattttcatagaggatgcaatcaaatacttcaaagagaaggtgtccacacaaaatctgctgttgctactcaccgataacgaggcgtggaacgggttcgtcgcagccgccgagctaccccggaacgaagctgatgagctgcggaaagcacttgataacttagcacgccaaatgataatgaaagacaagaactggcatgacaagggtcaacaatatcgcaattggtttctaaaggagtttcctcggcttaaatccgagttggaagacaatataaggaggctcagagctctggcggacggggtacagaaagttcataagggcaccacgattgcaaatgtggtgtccggaagcttatccatcagctcgggaattctgacgctggtggggatggggttggccccatttactgaagggggctccctggtactgctggagcccggaatggagctggggattactgcggctcttactggcatcacatcgagtacaatggactacggaaagaagtggtggacccaagcacaggctcatgatctagtcatcaagagtctggacaagctgaaagaggtgcgtgagttccttggggaaaatataagcaacttcctcagcctagctggcaacacatatcagctaacgagaggcatcgggaaagacattagagctctccggagggccagagcgaacctgcagtccgtaccccacgcttccgcaagtcgacctcgagtcactgagccaatcagtgcagagagtggcgaacaggtcgaaagagttaacgagccgagtattttggagatgtcaagaggggtgaaactgaccgacgtggccccggttagcttcttcttggttctggacgttgtgtacctggtctatgagagcaagcacctgcacgaaggggccaagtcagagaccgctgaggaactgaagaaagtggctcaggagctggaggaaaaactcaacattctcaataataattacaagattctacaagctgaccaagaactgtag

SEQ ID NO: 108483 - DNA, 1197 bp, Artificial Sequence
  Description of Artificial Sequence: Synthetic coding sequence
atggagggggctgccctcctcagggtgtctgtgctgtgtatttggatgagtgctctatttctgggagttggggttagagccgaagaggccggcgcacgtgtacaacagaacgtgccctcaggaacagacacaggggacccccagtcaaagccgcttggagattgggcagccggcactatggatcccgagtccagcattttcatcgaagacgctataaaatactttaaagagaaagtctccacccagaatctgctgctgttgctgacggacaatgaggcctggaacggatttgtcgccgctgccgaattgcctaggaacgaggctgacgagctccggaaagcgctggacaatctggcaaggcagatgattatgaaggacaaaaattggcatgataagggccagcaataccgcaattggttcctgaaggagttcccccgcctgaagtctgagctagaggataatatccggcggcttagagctctcgcagacggagtccagaaggtgcataaagggactacaatcgccaacgtggtgtccggcagcctgtcaatcagttcagggatactgactctggtcggaatggggctggctcctttcacagagggaggctccttagttctgcttgagccaggcatggaacttggcattaccgctgccttaacaggaataaccagctccactatggactacggtaagaaatggtggacacaggcccaggcacacgatctcgttataaagtccctagataagctcaaggaggtccgagaattccttggggaaaatatctcaaatttcctttctctggctggaaacacttatcagctgactcgaggcattggaaaggacatcagggccctgcgcagggcccgggcgaatcttcagtccgtgccacatgcttctgcctccagaccacgcgtgaccgaacccatatccgccgagagtggggaacaggtggaacgcgtcaacgaaccctccattctggaaatgtctcgcggggtaaagctaactgacgtcgctccagtgtcattttttctagtgctggacgtggtgtacctggtctatgaaagcaagcatttacatgaaggagctaagagcgaaaccgccgaagagctcaaaaaggtggcccaagagctcgaggaaaaattgaacatcctcaataataactacaaaatccttcaggctgaccaggagctgtag

SEQ ID NO: 108484 - DNA, 1197 bp, Artificial Sequence
  Description of Artificial Sequence: Synthetic coding sequence
atggaaggtgcagccctccttagagtcagcgtgctgtgtatttggatgtccgccctttttctgggcgtcggagtgagggctgaagaagccggcgcaagggtccagcagaacgttccctctggtaccgataccggagatccccagtcaaagcccctgggagattgggccgccggcaccatggaccccgagagtagcatctttattgaggacgcaattaagtactttaaggagaaagtgtcgactcagaatcttcttctgctactgacagacaacgaagcatggaacggttttgtcgctgctgcggagctgcctagaaacgaggccgacgagctgcgcaaggctctggacaaccttgccagacaaatgatcatgaaagacaagaactggcacgacaaagggcagcagtacaggaactggttcctcaaggaattcccccgcctcaaaagcgagcttgaggacaatattcgtaggcttcgcgctctggccgacggggtgcagaaagttcacaaaggcaccaccattgcaaatgtagtgagcggctccctaagcatttccagtgggatcttaaccctggttggcatgggtttagcaccttttaccgaaggcggaagccttgtgctactcgagcccgggatggagctgggtatcaccgctgctctcacaggtatcacctccagtacaatggattacggaaaaaagtggtggactcaagcccaggcccatgatctggtcattaagtccctggataaacttaaagaggttagggagtttctaggggaaaatatttctaacttcctgtccctggcaggcaacacctatcagctgactagaggaattggaaaggatattagggccctgagacgagctagagccaacctacagagcgttccccacgcttcggcatcaagaccacgagtgacagagcccatctctgctgagtctggggagcaagtggagcgggtcaatgagccaagtatcctggagatgtctagaggcgtgaagctcacagatgtggctccagtgtccttcttcctagtgttagacgtggtgtatctcgtgtacgagagcaagcacctgcatgagggcgcgaaaagtgagaccgccgaagaattgaagaaagtggcccaggagttggaggaaaaactcaatatcctgaacaataattataagatcctgcaggctgaccaggagctctag

SEQ ID NO: 108485 - DNA, 1143 bp, Artificial Sequence
  Description of Artificial Sequence: Synthetic coding sequence
atggaaggtgcggcccttctgagggtgtctgttctgtgcatctgggtacaacagaatgttccctccggcacagatactggcgatccacagagcaaaccactgggcgattgggctgccggaacaatggatccagagtcaagtatcttcatcgaggatgccattaagtattttaaggagaaggtctccacccaaaatctgttactgttgctcactgataacgaggcatggaatggcttcgtggctgctgcggaacttcctaggaatgaagccgatgagcttcgcaaggccttggacaacctcgccagacagatgatcatgaaggataagaattggcatgacaagggacaacaatacaggaattggtttcttaaggagtttccccggttgaagagtgagctcgaggataacatacgcagactgcgcgccttggctgacggtgtgcaaaaagtgcacaagggaacaacaattgcaaatgtcgtgtcaggatccctatccattagctctggtatcttgactttggtggggatggggctcgcgcccttcactgaggggggtagtctagtgctcctggagccagggatggagctggggatcacagccgcgctaactggcatcaccagctcgaccatggactacggaaagaagtggtggacccaggcacaggctcacgatctggtgatcaagtctctcgataagctgaaggaagtccgggagttcttaggcgagaatatctctaacttcctgagcctcgccgggaatacgtatcagctaacgcggggcatcgggaaggacatcagggcccttcgtcgcgcccgcgctaatctgcaatctgtgccccacgcttccgcaagtaggcctcgtgtgacagaaccgatatctgctgagtccggcgagcaggtggagagagtgaacgagccttcgattctggaaatgagtcggggggtcaaacttacggatgttgccccggtgtctttttttctggtgctggatgtcgtgtatctggtttatgagtcgaagcaccttcatgagggagctaaatccgagaccgctgaggaactgaaaaaggttgcacaggaattggaggaaaagctaaacattctgaacaacaactacaagattctgcaggcggaccaggaattatag

SEQ ID NO: 108486 - DNA, 483 bp, Artificial Sequence
  Description of Artificial Sequence: Synthetic coding sequence
atggagggagctgccctgctgagagtaagcgtgttgtgcatctggatgtcggcgctgttcttgggcgttggggtgcgtgccgaggaggctggagctagagtccagcagaacgtcccttccggcaccgacactggcgatcctcagagtaaaccactgggtgattgggccgctggaaccatggatccagagtcatcaatattcattgaggacgcaatcaagtacttcaaggagaaggtgtccactcagaatctgctgctgctgttgacggataacgaggcctggaacggcttcgtggcagccgcggaactgcccaggaatgaggctgacgagctgagaaaggccctcgacaatttggccaggcagatgattatgaaagataagaattggcacgataagggtcagcagtataggaactggttcctgaaggagttccctcgactaaaatctgagctcgaggataatatcagacgtctccgggcatag

SEQ ID NO: 108487 - DNA, 426 bp, Artificial Sequence
  Description of Artificial Sequence: Synthetic coding sequence
atggaaggagctgctctgttgagagtcagcgtgttgtgcatttggatgtcagcgctctttctcggagtaggcgtccgggcagaagaggccggggctcgagtccaacaaaacgtgccatctggaacagatactggcgaccctcagtccaagcctctgggagattgggccgctggcaccatggatccaggcccagctggcagccggggagacagtggagagccttgcactttaaggcctgcttgcaggggacagcggcagcatggcggggcaagcagaatttccgcggaaggacccgccccaatgccaagacggcgcaccccttccacggcccatctgcgcgtcccaaaaaccagccgaaggaacctcctttgtatgcgtgctgtgtcactgctgcgaatgcctttatcaatatctcgcaagaaatag

SEQ ID NO: 108488 - DNA, 357 bp, Artificial Sequence
  Description of Artificial Sequence: Synthetic coding sequence
atgaggtttaagagtcacaccgtggagttaaggagtacgttatctcaaccgttattcagctgttcccggagacgaccatgctctgatatggaaggagccgctttgttacgcgtcagcgtgctgtgcatctggatgtccgctctatttttgggggtgggtgtaagagctgaagaagcaggggcacgcgtccagcagaatgtcccgagcggcacggacactggggatccacagtctaagcccctgggggactgggctgcaggcacgatggatcctgaatcgtcaatcttcatcgaggacgccataaagtactttaaggaaaaagtgagcacacagaacctactccttctgctgacttag

SEQ ID NO: 108489 - DNA, 426 bp, Artificial Sequence
  Description of Artificial Sequence: Synthetic coding sequence
atggagggcgctgccctgctgcgcgtctccgtattgtgcatctggatgtcggcactgtttctcggagtcggtgtgcgcgcagaggaggcgggggccagagttcagcagaacgttccaagcgggacggataccggggatccgcagtcaaaaccattgggcgactgggctgctggcacgatggatccagggcctgccggcagccggggggattccggagaaccatgtacattacgtccggcttgccgagggcaacggcagcacggaggcgcaagccgaatctccgccgaagggcctgcgccaatgccacgtaggcggacaccttcgaccgctcacctgagggtgcccaagaccagcaggcgcaacctgctttgcatgagagccgtgtcgctgctgcggatgccccttagtatatcaaggaaaaagtag

SEQ ID NO: 108490 - DNA, 1014 bp, Artificial Sequence
  Description of Artificial Sequence: Synthetic coding sequence
atgaaccccgaatcatccatttttattgaggattacctgaagtatttccaggaccaggtgtctcgggaaaacttattgcagctgctgacggacgatgaggcttggaacgggttcgtagcagcagccgagttaccacgcgacgaagctgatgagctgcggaaggccctgaacaaactcgcaagccacatggttatgaaagacaaaaatcggcatgataaggaccagcagcaccgccagtggttcttaaaagagtttcctagactaaaacgcgagctggaggatcacattagaaagttgagggccttggcagaagaagtcgaacaggtgcatagaggaaccacaatagccaacgtagtatccaactcagtgggaaccactagcggtatactgactctgctaggattggggctagcgccatttactgagggaattagcttcgtgctcctcgacacgggaatgggactaggagccgccgctgcagtggccggcattacgtgcagtgtggttgaactggtcaataaactgcgggctagagcacaggccaggaacctggaccagagcgggaccaacgtcgccaaggtcatgaaagaatttgtcggcggtaatacgcctaatgtcctcaccctcgtggacaattggtaccaggtgacccaaggaatcggacgcaacataagagctattaggcgcgccagggctaatcctcaactgggggcatacgcgccccctccacacatcatagggcgcatctcggcagaagggggggaacaggtcgaaagggtcgtggagggccctgcccaggccatgagtaggggtacaatgattgtcggggctgcaaccggagggatcctgctgctgctggatgtggttagtctggcttatgaatcgaagcatttactggagggcgcaaagagcgagtccgcagaggagctcaaaaaaagagcacaggagctcgagggcaagcttaacttcctgacaaagattcacgagatgctgcaacccggtcaggaccagtag

SEQ ID NO: 108491 - DNA, 1014 bp, Artificial Sequence
  Description of Artificial Sequence: Synthetic coding sequence
atgaatcctgagagctctatctttattgaagattacttgaagtacttccaggaccaggtcagccgcgagaacctcttgcagctcttaaccgatgacgaagcatggaatgggtttgtggctgcagctgaactccctcgcgatgaggctgacgagctgaggaaagccctcaacaaactcgcctcccatatggtcatgaaggacaagaaccggcacgacaaggaccaacaacaccgacagtggttcctgaaggaattcccccgactgaagcgcgaattagaagaccacatccgcaaactgcgcgcactagctgaggaagtggagcaggtgcataggggtacgaccatcgcaaacgtagtttccaatagcgtgggcacaacgtccggcattctgacccttctgggcctggggcttgcacccttcaccgaggggatttccttcgtgctactggataccggcatgggactgggggcagctgctgcagtggcaggtatcacttgttccgtcgtagaattagttaacaaactgcgtgccagagcgcaggccaggaatctcgaccagagtgggactaatgtcgcaaaggtgatgaaggagtttgtagggggaaacacccctaatgtgctcacacttgttgacaattggtaccaggtgacacagggtataggacgaaacattagagcaatccgcagagcaagggccaatccgcagttaggggcttatgcaccaccccctcacattatcggtaggatctcggctgagggaggggagcaggtcgagagagtcgtggaaggacccgcacaggccatgagcagagggacgatgatcgtaggagcggccacaggcggcatcctgcttttgctcgatgtggtgtcccttgcgtatgagtcaaaacacctgcttgagggcgcaaagtcggagtccgcggaagaactgaagaagcgagcacaagaactggagggcaagctaaattttctcaccaagatccacgaaatgttgcagccaggccaggaccagtag

SEQ ID NO: 108492 - DNA, 1350 bp, Artificial Sequence
  Description of Artificial Sequence: Synthetic coding sequence
atgcatagttggacatgggatccgcattccagcgagcaacttgacctggcacagagtctttcagaggaagaccccttatctagcctgaggggctccatccaacctcaaccaccagctgaagcacctgacaaaggcggatcacaggctaataatgaccccggcggatgggacccaggatgcagctctagccaggtactcggtcgaacccgcggaccctgcttaggcgtccgtgtgagagaagaagaggctgggacacgtgtaaaggaaaacctgcccgtttggactgtcaccggagagctccagggcaaaccactgggaaaccctgccgctggcacaatgaaccccgagtcttccatttttatcgaggattatttgaagtactttcaggatcaggttagcagggagaacctgctacagctgcttactgatgacgaagcatggaacgggttcgttgcagcggccgagttgcctagggacgaggctgacgaattgcgaaaggcgctgaataaactggcctctcacatggtgatgaaggacaaaaatcggcacgacaaagatcaacagcacaggcaatggtttctcaaagagtttcctaggctcaagagggagctcgaagaccatattagaaagctgagggctttagccgaagaggttgaacaagtccacagggggactacaatcgcaaatgtggtgtcgaacagcgtaggcaccacctctggaatactgactctgctgggtctgggattagcacccttcaccgagggtatctccttcgtgctgctcgacacaggaatgggattgggcgctgccgccgccgtggcgggcatcacctgtagtgtggtagagcttgtgaataagttgagggcccgggctcaggcaagaaacttggaccaaagtggcacaaacgtcgccaaggttatgaaggaatttgtcggaggaaatactcccaatgttctaactctcgtggacaattggtaccaggtcacccagggaattggccgcaacatcagagctattcgccgcgcgagggcgaacccccaattaggtgcatacgcccctccccctcacatcataggccggatctcagcagagggaggcgaacaagtggaaagagtggtcgaaggccctgcacaggccatgtccagaggcactatgattgttggcgccgctacagggggaattctgctgttactggacgtggtgagtctggcttacgaatcaaaacacctgcttgagggtgctaagtctgaatctgcagaggaactgaagaagcgcgcacaggagttagagggcaagcttaatttccttaccaagatccacgagatgttacaaccaggccaggaccagtag

SEQ ID NO: 108493 - DNA, 225 bp, Artificial Sequence
  Description of Artificial Sequence: Synthetic coding sequence
atgaacccagagagttcgattttcatcgaagattatctgaaatatttccaggaccaggtgtcaagggagaatctgctccagctgctgaccgacgatgaagcttggaacggcttcgttgcagccgctgagctgccacgcgacgaggccgacgaactcaggaaagctctcaataagctagcctcgcatatggtaatgaaggacaaaaatagacacgataaggactag

SEQ ID NO: 108494 - DNA, 387 bp, Artificial Sequence
  Description of Artificial Sequence: Synthetic coding sequence
atgaatcctgagagctcaatcttcatcgaggattacctaaagtatttccaggatcaagtgtctagggagaacctgttacaattgctgaccgacgacgaggcctggaatggcttcgtcgctgcagctgagctgccacgggacgaagctgatgagctgcgtaaggcactcaataagctcgcatcccatatggtgatgaaagacaagaaccgacacgataaagatcagcagcacagacagtggttccttaaagaattcccacggctaaagagagagctggaggatcacattcggaaactgagagctctggcagaggaggtggaacaagtgcacagaggcaccacaatagcgaacgtggtcagtaacagcgtaggtacaacctccgggtag

SEQ ID NO: 108495 - DNA, 1209 bp, Artificial Sequence
  Description of Artificial Sequence: Synthetic coding sequence
atgggccttggccagggctgggggtgggaggccagctgcttcgcctgcttaattcgcagttgttgccaggtggttacattcacctttccctttggattccaggggatctcccagtcactggagaatgtgtccgggtattatgccgacgctaggctggaagtcgggagtactcagctacgaacagctggaagctgcagccactcattcaagaggagtttcctggagaagaaacgctttaccgaggaggcaaccaagtactttcgggaacgagtgagcccagtgcacctgcagatcctgctgacaaacaatgaagcctggaagcggtttgtgactgcggcggagctgccacgcgatgaggcagatgccctctacgaggccctcaagaaactgcgcacatatgcggccatagaggatgagtatgtgcagcagaaagacgagcagtttcgcgagtggttcctgaaggagtttcctcaggtgaagaggaagatccaggagtctattgaaaagcttcgggccctggctaacggcattgaagaggtccaccgtggctgtactattagcaatgtcgtgtcttcctccacaggggctgcgagtgggatcatgagtctggctggtttggttctcgcaccattcaccgccggaaccagcctggctctcaccgctgccggagtgggactaggtgcggcgagcgccgtgactggcatcaccacctccattgtcgagcatagctacacatcatcagccgaagccgaagccagtcgcctgaccgccacaagcatcgaccgactgaaggtatttaaggaggtaatgcgggatatcacacccaacttattgtcattgttgaataactactacgaagccacccagactatcggttcagagattcgggcgatccgccaggctagagctcgcgctagactccccgtcaccacctggcgaatcagcgctgggagtggaggccaagccgagagaacaatagcaggtacaaccagggctgtgtctagaggcgccaggattctgagcgccaccacgagcggcattttcctggctttggacgtggtcaacttggtgtacgaatcaaagcatcttcatgaaggtgcgaaatcggcctccgctgaggaactaaggcggcaagcacaggagttggaggaaaatctaatggagctcactcaaatataccagcggctgaacccttgtcacacccattag

SEQ ID NO: 108496 - DNA, 609 bp, Artificial Sequence
  Description of Artificial Sequence: Synthetic coding sequence
atgtcccttgcgggtctagtgcttgctcccttcaccgccggcacctctttggccttgacggcagccggtgtgggcctaggggccgcttctgctgttacagggatcactacctctatcgtagaacactcatacacttcctctgctgaagccgaagcatccagactgacagcaactagcatagatcgcctgaaggtgttcaaagaggtgatgcgtgatatcacccctaacctgctcagcctcttgaataactactatgaagccacacagactatcggctccgagatccgcgctattcgccaggcacgggctcgcgcacgcctacccgttaccacttggaggatatcagctgggagcggggggcaggctgagcgaaccattgccggcaccacaagggccgtatcccggggggcacggatcttgagcgcgaccacctcgggcatattcttggccctggacgtggtcaacctggtgtacgagagtaaacatctgcatgagggagccaaaagcgcgagtgcggaagagctgcgccggcaggcccaggagctggaggagaacctcatggagctgactcagatttaccaacgccttaacccctgtcacacacattag

SEQ ID NO: 108497 - DNA, 609 bp, Artificial Sequence
  Description of Artificial Sequence: Synthetic coding sequence
atgtcactggccgggctcgtcctcgccccttttaccgctgggacctcccttgccctcactgccgccggggtcggactaggtgcagccagcgcggtgaccgggatcactactagcatcgtggagcattcctacactagttcagccgaggcagaagcttcaagattgaccgctacctccatcgatcgtctcaaggtcttcaaagaggtgatgagagacattacaccaaacctgctgtccctgctgaataactactacgaggccacgcagacaatcggctctgaaattcgtgccattcgccaggccagagcgagggcccggctgccggttaccacctggagaatatcggccggctccgggggccaggccgagaggaccatcgccggtactaccagagctgtctcccggggagcaagaatcttatccgccactacgtctggcatattcctggccctggatgtggtgaacctggtgtatgagtccaagcacctgcatgaaggggctaagtccgcttctgccgaagagctgcgccgtcaggcccaggagctggaagagaatctgatggaactgacccagatttatcagcgactcaatccctgccatacgcactag

SEQ ID NO: 108498 - DNA, 996 bp, Artificial Sequence
  Description of Artificial Sequence: Synthetic coding sequence
atggacagcgagaaaaaacggttcactgaagaagccactaaatattttagggaaagagtgagccctgtgcaccttcagatcctcttgacaaataatgaagcatggaagcggttcgttacagcggctgaattgccgagggatgaagcagatgctctttacgaggcactgaagaaacttcgtacgtacgccgcgatcgaagacgagtacgttcagcaaaaggatgaacagttcagagagtggttcctaaaggaattcccgcaggtcaagcgcaaaattcaggagagcatcgaaaaactgcgagctctggccaatggtattgaagaagttcatcgcggttgtaccatctcgaacgtcgtctccagttctactggtgccgcgtccggaatcatgtctctggccggtttggtgctcgctcctttcacagccgggacttcactggccctcacagcggccggagtgggactgggggccgcttccgctgtgactggtattaccactagcattgtggaacacagttacacatcatccgcagaagccgaagcaagccgtttaaccgccacttcaatagaccgcctaaaggttttcaaggaggtgatgcgagacattacacccaacctgctgtccctactgaataactattatgaggcgactcagacaattggcagcgaaataagagccatcaggcaggccagggctcgagcacgactcccagtgaccacatggaggatttctgctggatcaggagggcaggccgaacgaacgatcgcagggaccaccagagctgtctccagaggtgccaggatactctcggccactacttccggtatattcctggccctggatgtggtgaatttggtgtatgagagtaagcatctgcacgaaggagcaaaatctgcttccgccgaagaattgagacgtcaggcccaggaattagaagaaaacctcatggagctgactcagatctaccagcgattgaatccttgtcacacacattag

SEQ ID NO: 108499 - DNA, 609 bp, Artificial Sequence
  Description of Artificial Sequence: Synthetic coding sequence
atgtcactcgcaggcctggtgttggctccattcacagcaggtacttcactcgccctcaccgctgccggggtaggcttgggagccgccagtgctgtgactggaatcacaaccagtatcgtggagcacagctataccagttcagccgaggccgaggcatcacggttaacagccacctccatagatcgacttaaggtgttcaaagaagtaatgagggacattactcccaatctgcttagcttgctgaataattattacgaagctacacagaccatagggtctgaaataagggcgatcaggcaagctagggcccgggcaaggctccctgtgacaacttggagaatcagtgctggctccgggggccaggcagagagaacgatagccgggacgactagggccgtgtcccggggggcgaggattctgtctgctaccaccagtggtattttcctcgcgttggacgtggtaaacttagtgtacgaatcaaaacatctccacgaaggggccaaaagtgcaagcgctgaggaactccggagacaggcacaggaactggaagaaaacctcatggagcttacccagatttaccagagacttaacccttgtcacacccattag

SEQ ID NO: 108500 - DNA, 324 bp, Artificial Sequence
  Description of Artificial Sequence: Synthetic coding sequence
atggggtcttgggtccagctcattacttcggttggcacgagcgggctgtttctgggtgtgagagtgcgagaagagggtgcaggcatgcgctgctcaaagaccatccaggccggtcagtggctagacagttcaaaggggcctctggggccttctccgccaccagtgcctaccgcaggctactcaagctccttctgcgtgcattacgtgaacctgctccctggagtcctggtgctgagcgtgacatcccaatacccgcatctttctatggctttatgccagctggctgcccacgattggccgagactcagctgtgtctgtgtgtag

SEQ ID NO: 108501 - DNA, 1044 bp, Artificial Sequence
  Description of Artificial Sequence: Synthetic coding sequence
atgggttcatgggtccagttaatcacttcagtgggcgtacagcaaaaccaccccgggtggaccgtggcaggccaatttcaggagaagaagcgtttcaccgaagaggtcattgagtacttccagaagaaagtgtctcctgtacacctgaagattctcctcacaagcgacgaagcctggaagaggttcgtccgcgtcgctgagctacccagagaggaagcagacgccctatacgaggctctgaagaacttgactccttacgtggccatcgaggataaggacatgcaacagaaggagcagcaatttcgtgagtggttcttgaagtttccccagatcaggtggaagatccaggagtccatcgagcgactgcgggtcatcgcgaatgagattgaaaaggtgcatcggggatgtgtaattgccaacgtggtgtctgggagcacaggcatcctctccgtgattggcgtgatgttggccccattcaccgccggcctcagtttatccattactgcagccggggtcggactgggcatcgcaagcgctacagccgggatagcgtcaagcattgtggagaacacctatacaaggagcgctgaactgaccgcgtcaaggctaacagcaactagtaccgaccagctggaggcactacgagatattttaagagatatcaccccaaatgtgctgagctttgccctcgacttcgacgaggccacaaagatgatcgctaacgatgtacatactcttcgtcgctctaaagctaccgttggccgtccacttattgcatggagatatgtgccaattaatgtagtagagactctcaggacgagaggtgctccaacacggattgtcaggaaggtggccagaaatctcggcaaagcaacgagtggcgtcctcgtcgttcttgatgttgttaacctggtgcaggattcactggatcttcacaagggtgccaaatcggagtccgccgaatccctgaggcaatgggcacaggagcttgaggagaacctgaatgagcttacccacattcatcagtccctcaaggccggttag

SEQ ID NO: 108502 - DNA, 1053 bp, Artificial Sequence
  Description of Artificial Sequence: Synthetic coding sequence
atggagggtgctgcacttcttaagatctttgttgtgtgcatctgggtccagcaaaaccatccagggtggactgtggctggccagtttcaggagaaaaaacgcttcaccgaggaagtcattgaatatttccagaagaaggtgtcccctgtacatctgaagattctgctcacctccgatgaggcttggaagcgcttcgtacgagtggcagaactgccaagggaggaagctgacgccctgtatgaggccttgaagaaccttactccctatgttgcaattgaggacaaagatatgcagcagaaagagcagcagttccgtgagtggttccttaaattccctcagatcaggtggaaaatccaggagtctatcgagcggctaagagttattgcaaatgagattgagaaagtccatcgagggtgtgttatagccaatgtcgtaagcgggagcacaggcatcttatcagttatcggcgttatgctggcacccttcactgccggtttaagcctctcgataacagccgctggagtcggattagggatagcttccgcaactgccgggatagcaagctcgatcgtggaaaacacttataccagaagtgcggagttgactgcttctcgactgactgctacctcaactgatcagcttgaggcacttcgagatatcctgagggatattacccccaatgttctctccttcgccttagacttcgatgaggccacaaagatgatcgccaatgacgtgcatacattgagacgtagcaaagccacagttggcaggcctctaatcgcctggcggtacgtaccaataaacgtcgtggagacgcttaggaccagaggcgctcctactaggatagtgcggaaggtggccaggaatctggggaaagccacatcaggtgtactcgttgtactggacgtggttaatcttgtgcaggattcgttggaccttcacaagggcgctaagtctgaaagcgctgagtcactgaggcagtgggcccaggagttggaggagaacctgaacgaacttactcatatccatcaatccctgaaagccggatag

SEQ ID NO: 108503 - DNA, 393 bp, Artificial Sequence
  Description of Artificial Sequence: Synthetic coding sequence
atggaaggagccgcccttctcaaaatctttgtggtttgcatctgggttcagcagaaccatcccggctggaccgtggccgggcaattccaggagaaaaaaaggttcactgaagaggtcatagaatactttcagaagaaggtgagccccgtacacctgaagattcttcttacatccgacgaagcatggaagaggttcgttcgcgttgctgagctgcccagggaagaagctgacgcgctttatgaggccctgaaaaatttgacaccatacgtggcaattgaagacaaggacatgcaacagaaggagcagcagttccgcgagtggttcctcaaggtgtcttccaatcagatggaggattccggagtccaccggaaggctagttgtcactgcaaatag

SEQ ID NO: 108504 - DNA, 384 bp, Artificial Sequence
  Description of Artificial Sequence: Synthetic coding sequence
atgggtagctgggtgcagcttatcacaagtgtcggggtgcagcagaatcaccctggctggaccgtcgcaggccagttccaggagaaaaagcgtttcaccgaagaagtgatagaatatttccagaagaaagtttctccggtgcacttgaaaatcttactgacctcagacgaggcctggaagcgattcgttagggtggccgagctgccaagagaggaggctgacgctctgtacgaagctctgaagaacttaaccccctatgtggcgattgaagataaagacatgcaacagaaagaacagcaatttcgggagtggttcctaaaggtgtcatctaaccagatggaagactcaggtgtgcacagaaaggcctcgtgccattgcaaatag

SEQ ID NO: 108505 - DNA, 198 bp, Artificial Sequence
  Description of Artificial Sequence: Synthetic coding sequence
atgggtagttgggtccagctgatcacatctgttggggtgcagcagaatcacccaggatggacggtggcaggacaattccaggagaagaagcgatttaccgaggaagtgatagaatacttccaaaagaaggtgtcacctgtgcacctgaagatcctgctgacgagtgatgaagcctggaagcggttcgtgcgagtgtag

SEQ ID NO: 108506 - DNA, 384 bp, Artificial Sequence
  Description of Artificial Sequence: Synthetic coding sequence
atggggtcttgggtgcagctcatcaccagcgttggggtgcagcaaaaccatcccggctggactgtagctgggcagttccaggagaaaaaaagattcactgaggaggtgattgaatactttcaaaaaaaagtgtccccagtacacctaaagattttgttaacatcagacgaagcttggaagagattcgtgagggtagcggagctaccgcgcgaggaggccgacgctctctatgaagcattgaagaacctgacaccctatgtcgctatcgaggacaaagatatgcagcaaaaagagcagcagttccgcgagtggttcctcaaggtctcttcaaatcaaatggaggattccggagtgcatcgcaaggcgagctgccactgcaaatag

SEQ ID NO: 108507 - DNA, 183 bp, Artificial Sequence
  Description of Artificial Sequence: Synthetic coding sequence
atggggagttgggtgcaactcattacaagtgtgggcgtgcaacagaatcatcctggatggactgtcgccggccagttccaggagaaaaagcgctttacagaggaggtgatagagtatttccaaaagaaggttagccccgtgcacctcaagatacttctgacttccgatgaggcttggaaatag

SEQ ID NO: 108508 - DNA, 219 bp, Artificial Sequence
  Description of Artificial Sequence: Synthetic coding sequence
atgggttcatgggtgcagctgattacttcagtgggggtccagcagaatcacccagggtggaccgtggctggtcagtttcaagagaagaagagatttacagaggaggtgatcgaatattttcaaaagaaggtgtcacctgtacacttgaagatccttctgacatctgacgaggcctggaagcgcttcgttagggtggccgagttgccccgcgaagagtag

SEQ ID NO: 108509 - DNA, 213 bp, Artificial Sequence
  Description of Artificial Sequence: Synthetic coding sequence
atgggcagctgggttcagctcatcaccagtgtgggtgtgcagcagaaccaccctggctggactgttgctggacagtttcaggagaagaagagatttacagaagaggtcatcgagtactttcagaaaaaggtgagtcctgtacacctgaaaatcttattgacaagtgatgaggcttggaaacgatttgtccgtgtggcagaactgcctcgatag

SEQ ID NO: 108510 - DNA, 1302 bp, Artificial Sequence
  Description of Artificial Sequence: Synthetic coding sequence
atgccatgcggcaagcaaggcaacctccaggtgcctggctctaaggtgctacctggcctgggagaggggtgtaaggaaatgtggcttcggaaggttatatacggcggagaagtgtggggcaaatcccccgagcccgaattcccaagtcttgtcaacttatgccagtcctggaagattaacaatctgatgtccaccgtgcactctgatgaggcaggtatgctgtcctactttctgttcgaggaactaatgagatgtgataaagactccatgcccgatggcaacctgtctgaggaagaaaagctgtttctctcttactttccgctgcataaattcgagctcgaacagaatatcaaggagctgaataccttggccgatcaagtcgacaccacacatgagttactgacgaagacttccctcgtcgccagttccagtggcgccgtttccggcgtgatgaacatactgggcttagccctggcccctgtgacagcaggtggctcactcatgttatcagctacagggactggattaggcgccgcagctgcaataaccaacatagtgactaatgtcctggaaaatcgctcaaacagtgccgcccgcgataaggcctctcgtctgggaccccttacaacatcccacgaagcatttggtggaattaactggagcgagattgaggctgctggcttctgcgttaataaatgtgtgaaagctatccagggcatcaaagacctgcacgcataccaaatggctaagtcaaatagtggatttatggccatggtgaagaacttcgtggcgaagcgacatatcccgttctggaccgccaggggcgtgcagagggcatttgaaggcacgaccctagcaatgactaatggggcctgggttatgggagcggccggagcagggtttttgcttatgaaggacatgtcctcattcctccaatcatggaaacacttggaggacggtgccagaacagagacagcagaagaacttcgggctcttgctaagaaactggaacaagagctcgatcgtctcactcagcaccacagacatcttcctcagaaagctagccagacttgctcttccagtcgcggccgggcagtgcgagggtcacgcgtggtgaaacctgagggttcaaggtcacctcttccttggcccgtcgtggaacaccaacctagactgggccctggcgtcgccttacgcacccctaagagaaccgtctcagcgcctagaatgttgggccatcaacccgccccccccgctccagctcggaagggacgccaagcacccgggcgacatcgacagtag

SEQ ID NO: 108511 - DNA, 1032 bp, Artificial Sequence
  Description of Artificial Sequence: Synthetic coding sequence
atggataatcaagcggaacgcgagagcgaggccggggtgggccttcaacgggatgaggacgacgcacccctgtgtgaggatgtggaacttcaggatggagacctgagtccggaggagaaaatttttctgagagagttccctcgcctcaaggaagatctgaagggaaacatcgataaactgcgcgccctggctgacgacatcgataaaacccacaagaagtttacaaaagctaatatggtggctacctctactgcggtgattagcggcgtcatgtcgctccttggcctcgcactggctccggcaacgggcgggggctctctgttactcagtactgctggccaaggactcgccactgccgccggagtcacttccatagtgagtggcaccctggagcgaagcaaaaacaaagaggcacaggctcgggctgaggacatcttaccaacgtacgaccaggaggacagggaggacgaagaagaaaaagctgactatgttaccgctgccggtaaaataatttacaacttgcgaaacaccctgaaatatgctaagaagaatgtgagagccttctggaagcttcgcgccaaccctcgtctcgcaaatgcaactaagagactcctgacaacaggtcaggtgtctagccgctctcgggtgcaggttcagaaagccttcgcaggcaccacgcttgctatgaccaagaatgcccgtgtactgggcggcgtgatgagtgctttttcactcggatacgaccttgctacactgagcaaggaatggaagcacctcaaggagggggctcgcacgaagtttgccgaggaattgagggccaaagctctggagttggaaaggaagctgacagaactgacacagctgtataagtcactgcaacagaaagtcagaagtagggcacgcggcgttggcaaagacctgacaggtacttgcgagacagaggcttattggaaagaactccgagaacacgtctggatgtggctctggctctgtgtgtgcctatgtgtgtgcgtatacgtgcagttcacatag

SEQ ID NO: 108512 - DNA, 540 bp, Artificial Sequence
  Description of Artificial Sequence: Synthetic coding sequence
atgtttaaagttattcagcgctcagtgggaccagccagtctcagtctcctgacttttaaggtttacgccgcaccgaagaaagattcccctcccaagaatagcgtaaaggtcgacgagctcagtctttacagtgtacccgaaggccagtccaagtatgtcgaagaggctcggtcccagctggaagagtctatctctcaattgcggcattattgtgaaccatacaccacgtggtgccagacagcaatgacaatctccaaaatgcatttattgttttttcctaggctcggagtcatcggatttgccggtttaatagggctgctactggcgcgcgggtcaaaaataaagaaattagtatacccgcctgggtttatgggtttagctgcttctttgtactacccccagcaggcgatagtgttcgctcaggtgtccggagagcgcctatacgattggggcctgaggggctacatagtgatcgaagatttgtggaaggaaaacttccagaagccgggcaatgtgaagaactcgcccggtacaaagtag

SEQ ID NO: 108513 - DNA, 597 bp, Artificial Sequence
  Description of Artificial Sequence: Synthetic coding sequence
atgtttaaggtgattcagagatcagtgggtccagccagcctgtccctgcttaccttcaaggtatatgccgcccctaagaaggatagccctcctaaaaactcagtaaaggtcgacgaactgtcactatactctgtgcccgaaggccagagcaaatatgtagaggaagccagaagccagctcgaagaatctatttctcagctgaggcactactgtgaaccctatacgacatggtgccaggaaacttattcccagactaagcccaagatgcagagcctcgtccagtggggccttgattcctatgattatctgcagaacgcccctcctggcttctttccaagattgggcgtgatcggatttgccggactcatagggctactactagcacgcggttctaagataaaaaaactggtctatcccccaggattcatgggccttgccgccagcctttattaccctcagcaagcaattgtcttcgcccaggtgagcggggaaagactctatgactgggggttgcgtggatatatcgtcatcgaagacctgtggaaggaaaacttccaaaaacccggaaacgtgaaaaatagtccaggaactaaatag

SEQ ID NO: 108514 - DNA, 537 bp, Artificial Sequence
  Description of Artificial Sequence: Synthetic coding sequence
gtctacgcagcgcctaagaaagatagccctcccaagaacagtgtcaaggtcgacgagttgagtctgtattccgtgcccgagggtcagtccaaatacgtggaggaagcccgctcccagctcgaagagagcatatcccagctgagacattattgcgaaccttataccacatggtgtcaggaaacgtactctcagactaagcctaaaatgcaatcactggtccaatgggggctagattcctacgattatctgcaaaatgcacctccagggttctttcctcggctgggtgtaattggtttcgcagggctcattggattgttgctggcacggggttccaagatcaaaaagctcgtttatcctccaggattcatgggattggccgcctcactttactatccccagcaagctattgtcttcgcccaagttagcggtgagcggctctacgactggggacttaggggctatatagtgatcgaagacctttggaaagagaacttccagaagcccggcaatgtgaagaacagtcctggcaccaaatag

SEQ ID NO: 108515 - DNA, 1332 bp, Artificial Sequence
  Description of Artificial Sequence: Synthetic coding sequence
atggaccggctcggaccttttagcaatgacccttcggataaacctccttgccgaggctgctcctcctacctcatggaaccgtatatcaaatgcgccgaatgcggtcccccgccgttttttctgtgcctccagtgcttcaccagaggttttgaatataaaaaacatcaaagtgatcacacctacgaaattatgacctcggacttcccggtcctggaccccagttggacggctcaggaggagatggcgcttctggaggcagttatggattgcggattcgggaattggcaagacgtagccaaccagatgtgcactaaaacaaaagaagagtgcgagaaacattacatgaagcacttcatcaataatccactctttgcctcaacactgttgaacctgaagcaggcagaggaagcaaagactgctgacacagcgataccattccattctacggatgatcctccccgcccaacgtttgacagccttttgagccgggatatggccggttacatgcccgcccgtgccgatttcatagaggagtttgacaactatgctgagtgggacctgagggacattgatttcgtggaggatgactcggacatcctgcacgctctgaaaatggccgttgtggatatttatcactctagactcaaagaaaggcagaggcggaagaagatcattagggaccacgggctaattaaccttcggaagttccagctcatggaaaggagatatcctaaggaagtacaggatctttacgagactatgcgccgatttgctcggattgtcggacctgtggagcacgacaaattcatcgagtcacacgccctggagtttgagctgagaagggaaattaagagattgcaggagtatcgaacagccggcattaccaatttttgtagcgccaggacatatgatcacttgaagaaaacccgcgaagaggaaagactcaagcgcactatgctgagtgaggtcctccaatacatccaagactccagcgcatgtcagcaatggcttcggcggcaggcggatatcgactctggcctgagtccatcgattcctatggcctccaattctgggagaaggagcgcacctcctctcaatctgacaggattgcccggaaccgaaaagcttaatgaaaaggagaaggagctgtgtcagatggtgagattagttccaggcgcttatcttgaatataaatcagcgctccttaacgaatgtaataagcagggcggccttcgcctggctcaggctcgggcccttattaaaattgatgtgaacaaaacccgaaagatctacgacttcttgatccgggaaggttacatcaccaagggttag

SEQ ID NO: 108516 - DNA, 978 bp, Artificial Sequence
  Description of Artificial Sequence: Synthetic coding sequence
atggtaccacgcgaagcacctgagagcgcacaatgtttgtgccctagcctgactattcctaacgccaaggacgtgctgaggaaacggcacaaacgaaggagcaggcagcaccagcggttcatggcccgaaaagcactcctccaggaacagggcctgctgtctatgcctcctgagcccggctccagtcctctaccaactccttttggcgcagccacagcaacagaagccgcctcctcaggcaagcagtgcctccgcgctggaagtggctctgctccctgcagtcggcgaccagccccagggaaagcgtctggcccattaccctctaagtgcgtagccattgactgtgaaatggtgggtaccggcccccgcggtcgagtcagtgagcttgcgcgatgcagtatagtgtcctatcacggcaacgtcctttacgataagtatataaggcccgagatgccaattgctgactataggacccgatggagtggcattacccgacaacacatgcgaaaagcagtaccctttcaggtggcccagaaggagatcctgaaacttttgaaaggcaaagtggtcgttggacacgccctgcacaatgacttccaggcactcaagtacgtacaccctcgatcccagaccagggacactacgtatgtccccaacttcctcagtgagcctggtctgcacacacgcgcccgcgtctctctcaaggatctggctctccagctgctgcataagaagattcaagttggccaacacgggcattcctcggttgaggacgctactacagccatggagctgtatcggctcgtggaggtgcagtgggagcaacaggaggctagaagtttgtggacctgccccgaagacagggaacccgacagctctaccgacatggaacaatatatggaagaccaatattggccagatgatcttgcacacggtagtcgcggcggcgcccgtgaagcgcaagatcgacgtaactag

SEQ ID NO: 108517 - DNA, 984 bp, Artificial Sequence
  Description of Artificial Sequence: Synthetic coding sequence
atggtgccacgcgaggcccctgaatctgctcaatgtctgtgtcccagcctgaccatcccaaacgcgaaagatgttcttcgaaagagacacaaaaggaggtctaggcagcatcagagatttatggcccgtaaggcacttttgcaggagcagggcctcttgagtatgcctccagagcccggctcatctccattgccaacccccttcggcgctgccaccgccaccgaggcagcttcttctgggaagcagtgcctgcgggctggcagtgggagtgccccttgctcaagaagaccagcccctgggaaggcttctgggccactgcctagtaagtgcgtggcaattgactgtgagatggtagggacagggccacgcggccgggtgtcagaactggcgcgctgctctatcgtttcttatcatgggaacgttctgtacgataaatacatcagacctgaaatgcccattgccgattataggacacggtggagtggcattacacgacagcacatgcgtaaagcggtgcctttccaagttgcccagaaggaaattctgaagctgctaaaagggaaggttgtcgtgggccacgctcttcacaacgattttcaggcgttgaagtacgttcaccccaggagtcagacccgcgacaccacctatgttcctaattttctctctgagccagggctgcatacccgggcccgcgtctccttgaaggacctcgccttgcagctcctgcacaagaagattcaggtaggccagcatggtcactcctctgtggaagatgccacaaccgctatggaattatatagactcgttgaggtgcagtgggaacagcaagaagccaggagcctgtggacatgccccgaagatagagaacccgacagtagtactgacatggagcaatatatggaggaccagtccactcagtactgggcactgaagcagaagagtgagaaacaggatagcgggctcaactccggcgctttcgtgtag

SEQ ID NO: 108518 - DNA, 1515 bp, Artificial Sequence
  Description of Artificial Sequence: Synthetic coding sequence
atgcccactgttgaggaactgtaccgcaactacggtattctcgccgatgcaacagagcaggtgggtcagcataaggatgcgtaccaggtgatcctcgacggggtcaagggcggcaccaaagaaaagagactggccgcccagttcatacctaagttcttcaaacacttcccagaacttgccgacagcgctattaatgcccagctcgatctgtgcgaggacgaagatgtgtcaattagaaggcaagcgatcaaagaactgccccaatttgctacgggcgaaaaccttcctagagttgcagatatcttaactcagcttttgcagactgatgactctgcggaatttaatctggtcaataacgctcttctctccatcttcaagatggatgcaaaaggtacactggggggccttttttcccagattttgcagggtgaagatatcgtgagagagcgagctatcaagtttctgagcaccaagttgaaaaccctccccgatgaggttctgactaaggaggtggaggagttgatattgactgagtcgaagaaggtcctggaggacgtgacaggagaggagttcgttttgttcatgaagatcttgtcgggtctgaagtctctgcaaacagtgagcgggcgtcagcagctggtggaactagtggctgaacaggctgatctggagcagaccttcaatccatccgatccagactgcgtggacaggcttctccagtgtaccagacaagcagtgcccttgttttcgaaaaacgttcatagcacccggtttgtgacctacttttgtgagcaggtcctgcctaatctgggaacactgaccacgcccgtggaggggctggacatacagctcgaggtgctgaagctgctggctgagatgagctctttttgtggggatatggaaaagttggaaacaaatttacgaaagctgtttgataaactgctggagtatatgccattgcccccggaggaggcggaaaacggcgagaacgctggtaatgaagagcctaagttgcagttttcttatgtggaatgcctgttatatagctttcaccagttaggacggaaacttcccgacttcctgactgccaagctcaacgcagaaaagctgaaagactttaaaattcgcctgcagtactttgctaggggcctgcaggtttacatcagacagctgagactcgccctgcagggaaagactggcgaggccctcaagaccgaagaaaataagatcaaggtggttgcacttaagatcactaacaacattaatgtgcttatcaaagatctgttccacataccaccatcctacaagtccaccgtgaccctgtcctggaaacccgttcagaaagtggaaattgggcagaagcgagcctccgaagatacaactagtggcagcccccccaagaagtcatccgccggcccaaagcgcgacgctagacagatttacaacccacccagcgggaagtatagcagtaatctgggcaatttcaattacgagaggagccttcagggaaagtag

SEQ ID NO: 108519 - DNA, 1353 bp, Artificial Sequence
  Description of Artificial Sequence: Synthetic coding sequence
atgccaaccgtggaggaactctatagaaattacggaatcctggccgatgccacagagcaggtgggacagatcaggagacaagccataaaagagctgccacagtttgcgacaggggagaatctgcccagggttgctgatatactgacccagttactgcaaactgatgatagcgcggaatttaatttggtcaacaatgccctcctgtctatctttaaaatggatgctaaaggcaccctcggaggactgtttagccagattctacagggagaagatatagtgagggagcgtgccattaagtttctcagcacaaaattaaaaacactcccggatgaagttctaaccaaggaagttgaggaattaatcttgactgagtccaaaaaggttcttgaagatgtaacgggcgaggagttcgtccttttcatgaaaatactttccgggttgaagtccctccagacagtcagtggaagacagcagctggtggagctcgtcgcagaacaggccgatctcgaacagacgtttaacccctctgatccagattgcgtggatcgactgctacagtgcacccgacaggctgtgcctctgttctctaagaatgttcactcaacgagattcgtgacatatttttgcgagcaagtcctgccgaatctcggaactctcacaaccccagtggaaggcctggatatacaactggaggtacttaagctcctggctgagatgagctccttttgcggcgatatggagaagcttgagactaatcttaggaagctttttgataagctgctggaatacatgcctctgcctcccgaggaggctgagaacggagaaaatgcaggcaacgaggaacccaaactgcagtttagctacgttgaatgtttgctgtattcgtttcaccaacttgggaggaagctgccggacttcctgactgccaaactgaacgctgaaaaactcaaagacttcaagattcgcttacagtacttcgctcgcggcctgcaagtgtacattcgccagctgcgcctagccttacaagggaaaacaggggaggctctcaaaaccgaagaaaataaaatcaaagtagtggcactgaagattaccaacaacattaatgttctcattaaagatctctttcacatccccccgtcatataagtccacagtcacgctgtcgtggaaacctgtgcagaaagtcgagatcggccagaaacgagcaagcgaagacactacttctggcagtcctcctaagaagtcttccgctgggcccaagcgggacgctcgtcagatttacaatcctccctctggcaaatactccagcaatctggggaattttaactacgaacgctccctgcagggcaagtag

SEQ ID NO: 108520 - DNA, 1575 bp, Artificial Sequence
  Description of Artificial Sequence: Synthetic coding sequence
atgcccacggtggaggagctttatcgtaactacggtattctggctgatgctacagagcaggttggtcagcataaggatgcataccaggttatcctggacggggtgaagggtggaactaaggagaagaggctcgctgcccaattcattcccaaattcttcaagcatttcccggaattagctgactccgctataaatgctcaacttgacttgtgtgaagatgaggatgtctcaattcgaagacaggccatcaaggagctaccccagtttgctacgggcgagaatctaccgcgcgtcgctgacatcctgactcagcttcttcaaactgacgactccgcagaatttaacctggttaacaatgctttactctccattttcaaaatggatgccaaaggtactctgggggggctctttagtcagatcctgcagggcgaggatatagtgcgcgagcgggcaattaagttcctctcgactaaactgaaaacactgccagatgaggtgctgaccaaagaggtcgaggaactcattctgacggaatcaaaaaaggtgcttgaagatgtgactggagaagaatttgttctttttatgaaaatactgtcgggtttgaaaagccttcagacagtgtcagggaggcagcaactggtggagctggtagcagagcaagctgacctagagcagacatttaacccctccgacccagactgcgtggatcggctgttacagtgtactagacaggcagtgccgctgttttctaagaacgttcacagcacgcgctttgttacttacttctgcgagcaagtcctccctaatttgggaactctcactacacccgtagaagggttagacattcagctagaagttcttaagttgcttgctgagatgtcaagtttttgcggtgatatggagaaactggagacaaacctgagaaagctctttgataagttactggagtatatgcccctgcccccagaagaagcggaaaacggcgagaatgccgggaacgaagagcctaagctacagtttagctacgtggaatgtcttctttactctttccaccaactcggtaggaagctccccgatttccttacagccaaactaaacgccgagaaactcaaggatttcaaaattagactgcagtatttcgctcgtgggcttcaagtgtacatcaggcagttacggctggccctgcaggggaaaacaggcgaagcgctcaagactgaggagaataagattaaagtggtagcactgaaaatcaccaataatatcaatgtcctgatcaaagaccttttccacattccaccctcatacaagtctacagtgacgctcagttggaagcctgttcagaaggttgaaatcgggcagaagcgcgcttcagaggatacaacctcaggctcacctcctaagaagtcttccgcaggacctaagcgcgatgccaggcagatctacaatccaccgtctgggaagtactcgtcgaacctcggcaatttcaattacgagcaacggggggcgttccgaggatcgcggggtggcagaggttggggaaccagaggtaaccgatcacgggggcgcctgtattag

SEQ ID NO: 108521 - DNA, 1533 bp, Artificial Sequence
  Description of Artificial Sequence: Synthetic coding sequence
atgccaaccgtggaggaactgtaccgaaattacgggattctggccgatgccacagagcaggtgggtcagcataaggatgcctaccaggttatcctggatggggtgaagggaggaactaaagaaaagcgtctcgcagcccaatttatccctaagttttttaagcacttcccagaactagctgactctgccataaatgcccagttggacctctgtgaggacgaggacgtttcaatccgccgccaggccatcaaagagctgcctcagtttgccaccggagagaacctgccccgggtggctgacatcttgactcagctccttcagacagacgattctgccgagttcaacctggtgaataacgcgcttctctctattttcaagatggacgctaaaggtacccttggggggctctttagccaaattttgcagggcgaggacattgtccgggaaagggcgattaagttcctgtccaccaaacttaagacgcttccggacgaggtgctcacaaaagaagtggaggagctgatcctgacggagtcaaagaaagtgctggaggatgtgactggcgaagagttcgtcttattcatgaaaattttatccgggcttaaaagccttcagacagtcagcggtcgccagcagctggtggaactagttgctgaacaagccgacctagagcagacttttaatcctagcgatcctgactgtgtggaccggctactgcagtgtacgcgtcaggctgtacccctttttagtaagaacgtccactcgacccgctttgtgacctacttttgcgagcaggtgcttcccaacctaggcactctgaccacccccgtggaaggactggatatccagttggaggtcctgaagttgctagctgagatgtcctccttctgcggagacatggagaaactggaaaccaacttgcgaaagctctttgataagctcctggagtatatgcctctgcctcctgaggaggccgagaatggagagaacgcaggcaacgaagagccaaagctgcaattcagctatgtcgaatgtctgctctatagcttccaccaactgggacgcaaactgcccgatttcctcacagctaaactgaacgccgagaagctcaaagatttcaaaattcggctgcagtacttcgcccgcggactccaggtctatatcagacagctcaggctggccctgcaaggaaagactggtgaggctctcaagaccgaggagaacaagatcaaggtcgtggccctgaaaatcacaaacaatattaatgtgctaattaaggacctgttccacatcccacctagctataagtccactgtgactctgtcctggaagcctgtgcagaaggtcgagataggacagaaacgggcctccgaagacacaaccagtggatcacctcccaaaaaatccagcgctggcccaaaaagagacgcaaggcagatctataatccaccctccggaaaatacagttcaaatctgggcaacttcaactacggagagcgattccgtctgggtactaggaacatgagagattag

SEQ ID NO: 108522 - DNA, 1089 bp, Artificial Sequence
  Description of Artificial Sequence: Synthetic coding sequence
atgcaggcagagcgcggagccagaggggggcggggacgtcggcccggccgggggcgacctggtggagacaggcacagtgagcgacctggtgcagcagccgcggttgctcggggggggggcgggggcgggggcggtgacggcggagggaggagaggaagaggacgaggacgtggcttcagaggcgccaggggaggacggggcggagggggggccccgagagggagtaggcgagagcctggtggttggggtgcaggggcgtccgcccccgtagaggacgatagcgacgccgagacctacggtgaagaaaacgatgagcagggaaattactcaaagaggaagatcgtgtcaaattgggatcgataccaagacattgagaaagaagtgaacaacgagagtggagaatcacagaggggcaccgacttttctgtcctactgtcttccgccggagactcattctctcagttccgctttgcggaggaaaaggaatgggatagtgaggccagttgtcctaaacagaacagcgcgttttatgttgactctgagttgcttgtgcgtgcgcttcaagagttaccactttgtcttagattgaacgtcgcagcagagctcgtccagggcactgtcccccttgaagttccccaagttaagcctaagagaacggacgacggcaaaggacttggtatgcagctgaagggacccctaggacccgggggcagaggaccgatattcgagctgaaatcagttgcggctgggtgccccgtattactgggcaaggacaatccttcccctggtcctagtagggattcccagaagcccactagcccccttcaaagcgccggtgatcatttagaggaggagctggacctgctcttaaatttggacgcgccaatcaaggaaggcgataatatccttccagatcagacaagtcaggacttgaaatccaaagaggatggggaagtggtgcaggaagaagaggtgtgcgcaaagccaagcgtgacagaggagaaaaacatggaacccgaacaaccttctacgtcaaagaacgtgacggaggaggagctagaggactggttagactcaatgatctcctag

SEQ ID NO: 108523 - DNA, 4125 bp, Artificial Sequence
  Description of Artificial Sequence: Synthetic coding sequence
atgagtagttcctttttcaacccttcgtttgcattcagctcacattttgatcccgacggcgccccattatccgaactgagctggccctcatcccttgccgtcgtggctgtgtccttcagtggtctctttgccgtaatcgtgcttatgctggcctgcttgtgctgtaagaagggcggaatcggattcaaagaattcgagaacgccgaaggtgacgaatacgcagcggacttagcccagggatctcctgctaccgctgcccagaacggccctgacgtgtacgtgttgcccctgaccgaggtcagcctgcctatggctaagcagcccggtcggagcgtgcagcttttaaagagcactgatgttggacgccacagtttgctgtacctgaaggagataggccggggctggttcggcaaagtgtttttgggcgaagtgaactccggtatttcatccgcccaggtggtggtcaaggaactccaggcttccgcctccgttcaggagcagatgcagtttctcgaagaggttcagccgtatcgcgccttaaagcactcaaacctcttgcaatgtcttgcccagtgcgctgaggtgactccatacctgctggtaatggagttctgccctctcggtgacctgaagggatacctgcggtcttgccgagttgctgaatcaatggctcccgaccctagaacccttcagcgtatggcttgtgaggtggcatgtggcgtgctacacctacacaggaataatttcgtccacagcgatctcgctctgagaaactgcttgttaacagcggatcttactgtcaaaataggcgattacggcctagcccactgtaaataccgcgaggactattttgtgactgccgatcagctctgggtgcctctgaggtggatcgcgcccgagctggtggacgaagtacatagtaaccttttggtggtcgaccagacaaaatctgggaacgtatggtccttaggagttacaatttgggagctcttcgagttgggtacacagccctatcctcaacattctgatcagcaggtgctggcctacacagtcagggaacaacagcttaaactccccaagccacagctgcaacttactctctccgatcgttggtatgaggttatgcaattctgttggctgcagccagagcaaaggccaacagcggaggaagtgcacctcctgctctcctacctatgcgctaagggcgccaccgaggcagaggaggaatttgaacgtagatggcgcagtctgcggcccgggggaggaggggtggggccagggccaggtgcggcagggcccatgctgggaggcgtggtggaactggctgccgcttctagttttccacttctggaacagtttgccggtgatggttttcatgcggatggagacgacgtgctgacagtgactgagacctctcgcggacttaactttgagtataagtgggaagcaggccgtggcgcagaggctttccccgctactctgtcccccggtcgcaccgctaggctgcaagagttatgcgccccggatggcgcacctcccggagtggttcccgtcttgagtgcccacagtccctccttgggctctgagtattttattcggctagaagaggccgcccctgcagcgggccatgaccctgactgcgcaggctgcgcaccctcccccccggcgacggcggaccaggatgacgactctgatggcagcaccgctgcgtccctggcaatggagcctctcttgggccatggaccacccgtggatgtcccttgggggcgtggtgaccactatccccgccggtctctggctcgggatcccctctgtccaagtcggtcaccaagcccctcagcaggtcctctgtcactggcagaaggcggcgccgaggatgcagattggggagtcgctgcgttctgccctgcatttttcgaagatcctctcgggacctcacctctcggatcttcaggggctcctcccctgccacttaccggggaggacgaactcgaagaagtaggggcacgccgcgcagcccagcgtggccactggcgatccaacgtcagtgctaacaataactcgggatctcgatgccctgaatcctgggaccctgtctctgctggaggacatgcagaaggatgtcctagcccgaagcagactccacgggcttcccccgaacctggttatcccggcgagcctttgcttggactgcaagccgcctcagcccaggagccaggttgttgccctggactgccgcacttgtgcagcgctcagggcttagcgcccgctccatgcctcgtcaccccaagctggacagagactgcatcttcaggcggagaccaccctcaggcagagcctaagctggccaccgaagccgaaggcaccactggaccacggttgcccctgccctccgtgccctctcccagtcaagagggagcccccctccccagcgaagaagcttctgcccctgacgcccctgacgctttaccagattccccaacacccgctacgggaggtgaggtctccgccatcaagctggcctctgccctgaatggatcctcctcgtctcccgaagtcgaggccccatcctccgaagacgaggatacagccgaggcaaccagtggaatttttaccgatacttccagtgacggcctgcaggcgcgaaggcccgacgttgtccccgcattcaggtctctccagaaacaggtggggactccagactctttggacagccttgacattccatccagcgctagcgatggcgggtatgaggtgttcagcccatcggcaacaggcccaagcgggggacagcctcgggccctagacagtggctatgataccgagaattacgagagtcctgagttcgtcctaaaggaggcccaggagggatgcgagccccaggctttcgctgaacttgcttccgaaggcgaaggccccgggccggagacccggctcagcacatccctgagtggattgaatgaaaagaacccctatcgcgatagcgcgtatttctctgatttagaagcagaggctgaagctactagtgggcccgagaagaaatgtggcggcgaccgcgccccagggccagaactcggactgccttccacaggacagcctagtgagcaggtttgcttgagaccaggtgtgagcggggaggctcaaggttctggacccggcgaggtgctgccccccctgctacagctggaaggcagtagtccagaaccgtcaacctgtccctctggcctggttcctgagccacccgagccacaagggccagccaaggtgcggccaggaccatctccaagttgctcgcagtttttcctgctgacacctgtgcctcttcggtcagaagggaattcctctgagtttcaggggccgcccggcctgctgagcggccctgcacctcagaagaggatgggtggccccggcactcctagggctcctttaaggctggccctccccggcttgccggccgcgttagagggtaggccagaagaggaggaagaagactccgaggatagcgacgaatccgacgaagagctgaggtgttatagcgtgcaggagccctcggaagatagtgaggaagaggcgcctgctgtgccggttgtggtcgccgaatcgcagtcagctcgaaatctgagatctctacttaagatgccaagtctattgtcagagaccttttgcgaggacctcgagcggaaaaagaaggccgtgtccttcttcgatgatgtcacggtgtatctgttcgatcaggaaagccctaccagagagctcggtgagccctttccaggggccaaggagagtccccccacattcttacgaggcagccccgggtccccatcggctccaaaccggccccagcaagccgatggttcaccgaatggctccactgcggaagagggcggggggttcgcatgggacgatgactttcccctgatgactgcgaaggctgcttttgctatggctttggatcccgcggcgcccgcgccagccgcgcccacgcccacccctgctcctttttctaggttcacggtgagccctgcccctacaagcagattttccatcacccacgtcagcgatagtgatgcagaatccaaaaggggccccgaagccggcgccggtggcgagtccaaagaagcttag

SEQ ID NO: 108524 - DNA, 2640 bp, Artificial Sequence
  Description of Artificial Sequence: Synthetic coding sequence
atgagtagctccttctttaatccatccttcgctttttcttctcactttgaccctgacggagcgcccttgtctgaactgtcttggccttcttccttagcagtggtggcagtttccttctccggactcttcgcggtcatcgtgctgatgctggcctgcctgtgttgcaagaaaggcgggataggtttcaaagaatttgagaatgccgagggagatgagtatgcagcggatctggcacaaggctctccggccactgccgcacagaacggtcctgatgtgtacgtactccccctgactgaggtctcgcttccaatggcgaaacagcccggccggtccgtccaattattaaaatccaccgatgtgggcagacacagcctcttatacctcaaagaaatcgggagaggttggttcggcaaagtttttctgggggaagtgaactccgggataagtagtgcacaggtcgtggtgaaagagctgcaggcctccgcatcagtgcaggaacaaatgcagtttctggaagaggtccaaccttacagagctttaaaacattcaaacctgctgcagtgcctggcccagtgtgctgaagtgaccccttatctcctcgtgatggagttttgcccactgggagatctgaaaggatatctgcgaagctgccgggtagctgaaagcatggctccagacccccggaccttacagaggatggcttgtgaggtagcttgtggcgtgctgcatttgcatcgaaacaatttcgtgcattccgatctggcactgcgcaactgccttttgactgcagatctcacggtaaagattggagattacggattagcccactgcaagtatagggaggattactttgtgaccgctgaccagctgtgggtgcccttgcgttggatagctcccgagttggtagatgaggtccactctaacctccttgtagtggaccagacaaagagtggaaacgtctggtctcttggagtgacaatttgggagctgtttgaactgggaactcagccttacccgcaacattcagatcagcaggtgctcgcttataccgtgcgcgaacagcagcttaagctgccaaagccgcagctgcagcttacactgtcagatcggtggtacgaggtgatgcagttctgctggctccagcctgagcaacggcctactgctgaggaggtccacctgctcttgtcttacctgtgcgcgaaaggagctactgaagccgaggaggagtttgagcggagatggcgctcactaagacctggtggggggggcgtaggcccaggccctggcgccgctggacctatgttagggggggttgtggaactggcggccgcatcttccttcccattgctggaacagttcgcaggcgacggcttccacgccgatggggacgacgtgcttacagaactctgtgcacccgacggcgcgccgcctggcgttgttccagtgcttagtgctcacagtcctagtctcggcagtgaatactttattcggctggaggaagctgcacccgctgcagggcatgaccccgattgcgccgggtgtgccccgagccctccagctactgccgatcaggatgatgattcggatggctcgaccgctgcatctcttgcaatggaacctctcttggggcacggtccaccagttgatgtcccctgggggcgcggagatcactatccgcgaagatcactggccagagatcctttgtgtccatctcggtcccccagcccctcagcgggccctctgagtcttgcagagggcggcgccgaagacgccgactggggagtagccgccttctgccccgcctttttcgaggatcctcttggcaccagcccattgggctcctccggcgctcccccactccccttgaccggggaagacgagcttgaagaggtgggcgcccggcgagccgcacagagaggccattggcgatctaatgtttcggccaataataactccggatcgcgctgccctgaaagttgggatcccgtcagcgctggggggcatgccgagggatgcccatcccctaagcagacaccccgggcgagtccagagcctggctaccctggggagcccctgctgggtctacaggccgcctctgcacaggagcccggttgttgcccgggacttcctcacctgtgctccgctcaggggctggcccccgcaccttgtttagtcacacccagctggacggaaacagcatcaagcggaggcgatcatccgcaggccgaacccaaactggcaacagaagccgaaggcactacaggcccccgtctgccgctgccctcagtcccatcgccgtctcaggaaggggccccgttaccatccgaagaggccagcgctccagacgcccctgacgctctgcctgatagtcccacgccggcgacgggcggggaagtgtctgccataaagctggcatccgcactcaacgggagttcctctagcccagaagtagaggccccctcatccgaagatgaagatactgctgaagcgacttctggcatcttcactgacacttcatccgatggactgcaggcccgcagacctgatgtggtgccggccttccgaagtctgcagaaacagtggccacagcgggaagagagtttaccaagactgtgcctattattgcgtcctagaggatag

SEQ ID NO: 108525 - DNA, 3984 bp, Artificial Sequence
  Description of Artificial Sequence: Synthetic coding sequence
taacaccaggtgaaagtgcaaggatgctggggtcgctggcgatggcaggagtttgagaacgctgagggtgacgaatatgccgcggacctagcacagggcagcccagccacggccgctcagaacggtcctgatgtgtatgtgctcccgcttaccgaggtgtcacttcccatggccaagcagcccggccggagcgtccagctactgaagagtacagatgtcggtagacactcactgttatacctgaaagagattggccggggatggttcggtaaggttttcctcggagaagtgaattcggggatcagtagcgcgcaggtcgtggtgaaagagctccaggcgtcagccagtgtacaagaacagatgcagtttctggaagaagttcagccctatagggccctgaagcactccaatctcctgcagtgcctcgcccagtgtgcagaagtaactccgtacctcctggtgatggaattctgcccactcggagatcttaaagggtacttgcggtcttgtcgggtggcagaatcaatggctcccgaccctcggacactgcagcgcatggcgtgcgaggtagcttgtggggtcttacacttgcaccgaaataattttgtgcattccgacctggctctccgcaattgtctccttacagccgacctgaccgtaaaaataggcgactatggcctggcgcattgtaagtacagagaagactatttcgttaccgctgaccagctgtgggtgcccctaaggtggatcgcacccgagctcgtggacgaggtacatagcaatcttcttgtggtggaccagaccaaaagtggcaacgtttggtcgctgggggtgactatttgggaactgttcgagttgggcacacagccctatccacagcacagcgatcagcaagtcctcgcgtacacggtgcgcgagcagcagctgaagttgcccaaaccccagttgcagttaacactgtccgaccggtggtacgaggtgatgcagttttgttggttgcaacccgaacagcgacccaccgcagaggaggtccacctgcttttaagctatctatgcgctaagggagctaccgaagcagaggaagagtttgagagacggtggaggtctctacgccctgggggaggaggtgttggacccggacctggcgctgctggaccaatgctgggaggggtggtggagctggccgccgcctccagcttccctctgctggagcagtttgccggggacggattccacgccgacggcgatgatgtgttgaccgtaacggagacgtccagaggtctgaactttgaatacaaatgggaggccggccgtggggctgaagcctttcctgccacactgtcacctggacgcaccgcgcgattgcaggagctctgtgcccctgatggcgcgcctcctggcgtggtgccagtcctctcagctcactctccaagcctgggctctgaatacttcatccgactcgaggaagctgcgcccgctgctggtcacgatcccgattgcgccggatgtgcaccaagcccgcccgccaccgcagatcaggacgacgactcagatggctctaccgccgcctcgttggcgatggagcctctattgggtcacggtccgcccgtggatgtaccctggggacgtggagatcattacccaaggcgttcactggctcgggatcctttatgtccgtctcggtcaccttctccgtcagccggaccactgagtttggcagaggggggcgccgaagatgcagactggggggttgcagctttctgccccgccttttttgaagaccccttagggacatcaccactcggttcatccggcgccccaccgttacccctcacaggggaagatgagctggaagaggttggagcacgtagggccgctcaacgcgggcactggcggtcaaatgtgagcgctaacaacaattccggatctcgttgtcccgaatcttgggatccagtctcggcgggcggacatgctgaaggctgccctagcccaaagcagaccccaagggcctccccagaacctggctaccctggcgagcctttgctggggttacaggccgccagcgcccaggaaccaggttgttgccccggactgccccacttgtgcagtgcacagggactcgcaccagccccatgcttggtcacgccatcttggaccgagaccgcatcctctggaggggatcatccccaggcagagccaaagctcgctactgaagcagaagggactacagggccacgcctacctctcccaagtgtgccgtccccttctcaggagggagcccctctgccttcggaggaagcatcagctccagatgcgccagatgcgctgccagacagccctactcctgctaccggtggggaggtttcggctatcaaattagcaagcgccttgaatggcagttcatctagtccagaggtggaggccccatcctccgaggacgaggacactgccgaggccacaagtggtatcttcacagacacctcttcggatggtctccaggctaggcggccagatgtggtgccagcctttagaagccttcaaaaacaggtgggcacccccgattctttagactctctcgacatccccagttcagcatctgatggtgggtacgaggtgttctcaccatcagcaactggcccatcaggcggccagcctcgagcgctggactcaggttacgataccgaaaactacgagtctccggaatttgttcttaaggaagcacaggaagggtgcgaaccacaggcatttgcagagttggcctctgaaggggaaggccctggacctgaaacacgtttaagcacctctctatcaggattaaatgaaaagaacccctacagagacagcgcatactttagcgatctggaagcagaggcagaagccaccagtggccctgagaaaaagtgtgggggggaccgcgcccctggcccggagctcggccttccctcgaccggacagccctccgagcaggtgtgcctgaggccaggcgtgtccggagaagcccaaggcagcgggccaggcgaagtgctgcctcctctactacagctggagggcagctcaccagaaccatccacttgcccttcaggtctggtgcccgagccacctgagcctcaggggccagcaaaggtccgccctggaccaagtccctcatgttcccagtttttcctgctgacacctgtccccctcagatcagagggcaattccagcgagttccaagggcccccaggcctactttctggaccagcaccgcagaagagaatgggagggcctggaacaccccgcgcaccgctcagattagctctgcctgggctccctgcggcgttggagggcagacccgaagaggaggaggaagactcagaggattctgacgaatcagacgaggaactacggtgttattctgtacaggagccctcagaagacagtgaggaggaagccccagctgtcccagttgtggttgctgaaagccagtccgcaaggaacttgcgcagccttttgaaaatgcctagcctgctgtccgaaaccttctgcgaagacctggaacggaagaagaaagccgtgtccttcttcgatgacgtgacagtgtatctgttcgatcaagagtctcctacacgggagctcggcgaaccgtttcccggcgcaaaagagtcccctccaaccttcctgcggggaagtccaggttcaccatccgcccccaatcggccacagcaggccgatggtagtccaaacgggagcacggctgaggaaggggggggctttgcttgggatgatgacttccccctaatgacagcgaaggcggctttcgctatggctttggatcctgcggctcctgctcccgcagcgccgacccctacaccggcgcccttctcccgcttcacagtttcccctgctccaacgtcaaggttctccattacccatgtttccgatagcgacgctgagagtaaacgtggccctgaggcaggggcaggtggcgaatctaaagaggcgtag

SEQ ID NO: 108526 - DNA, 417 bp, Artificial Sequence
  Description of Artificial Sequence: Synthetic coding sequence
atggaggaggaggccgagactgaagagcagcagagattctcctaccaacagcggctcaaagcagctgtgcactatacagtgggttgcctttgtgaggaagttgccctcgataaggagatgcaatttagcaaacagacgatcgcagccatttccgaactgacttttagacaatgcgagaattttgcaaaggacctagagatgttcgctagacacgccaagagaaccaccattaacacagaggacgtgaagctcctggcacgcagaagtaactccctactgaagtatattactgacaagagcgaggagattgcgcagatcaacttggaaaggaaggcgcaaaagaagaaaaaaagcgaagacgggtccaagaattcccgacagccggcggaagcgggcgttgtggaatctgagaattag

SEQ ID NO: 108527 - DNA, 495 bp, Artificial Sequence
  Description of Artificial Sequence: Synthetic coding sequence
atggaggaggaagccgaaacagaagaacaacaaaggttcagctaccagcagcgtctgaaggcagcggtacactataccgtgggatgtctttgcgaggaggtggccttggataaggaaatgcagttcagcaagcagacgatcgcagccatatccgaactgacctttcggcagtgcgaaaatttcgccaaggatctggagatgtttgcaaggcacgcaaagagaacaacaatcaacaccgaggacgtgaaacttctggcccggcgatctaacagtctccatatgcaggaagccgccggtatccggaagtcctctttactgaccttcctggcctggtggttcgagtggacgagtcaggccagcgccggaccactcatcggggaagaggcccgggaagtggctaggagacaggagggagctccccctcaacagtccgcccgaagagaccgcatgccttgcagaaattttttctggaaaacattttcaagttgtaagtag

SEQ ID NO: 108528 - DNA, 234 bp, Artificial Sequence
  Description of Artificial Sequence: Synthetic coding sequence
atggaagaagaggctgagacagaggagcagcagagatttagttatcagcagcggcttaaagccgctgtacattacactgtcgggtgcctctgcgaggaggtggcattggacaaagagatgcagttcagcaagcagaccattgcggccatctcagaattgacattcaggcagtgcgagaacttcgcaaaagacctggaaatgtttgcttcaatttgccgcaagaggcaggagtag

SEQ ID NO: 108529 - DNA, 921 bp, Artificial Sequence
  Description of Artificial Sequence: Synthetic coding sequence
atgtcaaacgtcaatctgagcgttagcgacttttggagagttatgatgagagtttgttggctcgtcaggcaggacagcaggcaccagcgcatccggctgccacatctcgaagcagtagtgattggacgtggccctgagacaaagattaccgataaaaaatgtagtcgacagcaggtccaactcaaggcggagtgtaataaggggtatgtcaaggtaaaacaagttggagtcaacccaacctccattgacagcgtggtcatcgggaaggaccaggaagtgaaactgcagcccgggcaggtactgcacatggttaacgaactatacccgtacatcgttgagtttgaagaggaagctaagaaccccgggttagagacacatcgcaaacggaagcggagtggcaattctgatagcattgagagagacgccgcacaggaagcggaggccggcacaggtttagagccaggttctaacagcggccagtgttctgtgcctcttaagaaaggaaaagacgcgccgataaaaaaagaaagcttgggacactggagccagggtctgaaaatcagtatgcaagaccccaaaatgcaggtatacaaagatgaacaagtcgtagtcattaaagacaaataccctaaggcaaggtaccactggctggtgctcccctggacatcaatatctagcctgaaagctgtcgctcgcgaacacctagaactgttgaaacatatgcataccgtcggagagaaagtgattgtcgacttcgctggttcaagcaaactccgatttagactggggtatcatgccatcccaagcatgagccatgtacacctccacgtcattagccaggacttcgattcaccttgtttgaagaacaagaaacattggaattccttcaataccgagtacttcctggaatctcaagagtag

SEQ ID NO: 108530 - DNA, 1014 bp, Artificial Sequence
  Description of Artificial Sequence: Synthetic coding sequence
atgtccaacgttaacttgtcagtgagtgatttctggcgcgtgatgatgcgtgtgtgttggctagtcagacaggattcacgacaccaaaggatccgactcccccatttagaggctgttgtgatcgggcgtgggcctgagacaaagataacagataaaaaatgctctcggcaacaggtccagctgaaggcagaatgtaataagggttacgttaaggttaaacaggtcggcgtgaacccaacctcaattgattcagtggttatcggcaaggatcaggaagtgaagcttcagccgggccaggttttacacatggtgaacgagttgtacccatacattgtcgagttcgaggaagaggctaagaacccgggactcgaaacgcatcgcaaaagaaagagaagtgggaattctgacagcattgagcgggacgccgcccaagaggctgaggccggcaccggcctggagccagggtccaattccggacagtgctccgtccccttgaaaaagggtaaagacgcccccatcaaaaaaaaggtgtacaaggacgaacaggtggtggtgatcaaagacaaataccccaaggcacggtaccattggctagttctgccttggacgtctatctcaagtctcaaagcagtggctagggagcacctggagcttctgaagcatatgcacacggtgggagaaaaggttattgttgatttcgccgggagtagcaaactccgcttccgactgggataccacgccatcccctcaatgtcccacgtgcacctccacgtgataagtcaagactttgactccccttgtttgaaaaataagaaacactggaattcattcaacactgagtactttctggaatcccaagcagtaatcgagatggtgcaggaggccgggcgggttaccgttcgcgacggcatgcctgagctgctgaaactccctctccgatgccatgagtgccagcagctactcccaagtatcccacagctgaaggaacatctgcggaaacactggactcaatag

SEQ ID NO: 108531 - DNA, 1029 bp, Artificial Sequence
  Description of Artificial Sequence: Synthetic coding sequence
atgatgcgggtgtgttggctggttaggcaggatagccggcatcagagaatccgcttaccccacctcgaagccgtggtaattggtcgtgggccagaaactaagataacggacaaaaagtgttctcggcagcaagtgcagctgaaggcggagtgtaataagggctacgtcaaagtgaagcaggtgggggtaaatccgactagcattgattccgtggtgataggaaaggatcaggaggtgaaactgcagcccggtcaggttctgcatatggtaaatgagctctatccatatatcgtcgagttcgaagaggaggctaagaatcctggcctggagacccacaggaagaggaagaggagcgggaattcagacagcattgagagagacgcagcacaggaagccgaagctgggactggactggaaccaggctctaattccggacagtgtagtgttcctctcaagaaagggaaagatgcccctatcaaaaaggaatcactgggccactggagccagggtctgaagatctctatgcaggatcctaagatgcaggtctacaaggacgagcaggtggttgtgatcaaggacaagtacccaaaagctcgttaccactggctggtgctgccctggacttccataagctcgttaaaagccgtggcccgggagcacttagagctgcttaagcacatgcacaccgttggagaaaaagtaatcgttgacttcgccgggtcgtcaaaactgaggtttcgcctcggctatcacgccattcccagtatgtcacacgtgcatctacatgtgatcagccaagatttcgattccccttgtctcaaaaacaagaaacattggaactcatttaataccgagtattttctcgagagccaggctgtcatcgaaatggttcaggaggccggaagagtaactgtccgcgacgggatgccagagctcctaaaattgccattgcgctgccatgaatgtcagcagctactcccaagtatcccacagctgaaggagcatctccggaaacattggacgcagtag

SEQ ID NO: 108532 - DNA, 1071 bp, Artificial Sequence
  Description of Artificial Sequence: Synthetic coding sequence
atgtctaacgtcaacctgtccgtatctgatttttggagagttatgatgagggtgtgttggctcgtccgacaggactcacggcaccaacggatcaggctgccccacctggaagccgtggtgattggcagaggtcctgaaaccaagattacggacaagaaatgcagtcggcagcaggtacagcttaaggccgaatgcaacaaaggatacgtaaaggtgaaacaggtgggcgtcaatcccacttctattgactcagtggtgattggtaaggaccaggaagtgaagctgcagcccggacaggtcctgcatatggttaatgaactgtacccctatatcgtagaatttgaggaagaagctaaaaatccaggattagaaacccacagaaaacggaagagatccggaaactcagactccatcgaacgcgatgcagcccaagaggccgaggccggaacaggattggaaccgggctccaacagcggacagtgctcagttccattaaaaaagggtaaggatgcccccattaaaaaggagtctcttggacactggtcccaagggctgaagatatctatgcaggacccaaagatgcaggtgtataaagacgagcaggtggttgtcataaaagataagtaccccaaggctcgttaccactggttagtccttccctggacttcaatatctagcctgaaagcggtcgcacgggagcatctcgagctgctgaagcatatgcacactgtcggcgaaaaagtgatcgtggactttgcagggtctagcaagctgcgctttagattaggttaccatgcaattccgtcaatgtcccatgtgcatttgcacgtcattagccaagattttgactcgccatgcctgaagaacaagaagcactggaacagcttcaacacagaatacttcctggagtcccaggcagttatcgaaatggttcaggaagcaggccgagtgacggtgcgggatgggatgcctgagcttctcaaattgcccctgcgatgccatgaatgccaacagctgctgccttccatcccacaattgaaagagcacctaagaaagcattggacacagtag

SEQ ID NO: 108533 - DNA, 921 bp, Artificial Sequence
  Description of Artificial Sequence: Synthetic coding sequence
atgagcaacgtgaacttgagcgtgtccgacttctggcgcgtgatgatgcgggtatgttggcttgtgcggcaggacagtcggcaccaaagaattcggctacctcacctcgaggcagtcgtgatcggccgaggaccggaaaccaagatcaccgacaaaaagtgctctaggcagcaagtccagctgaaagctgagtgcaacaaaggttatgtcaaggtgaaacaggtgggtgtaaatcctaccagcatcgactcagtcgttatcggaaaggaccaggaagtgaaactccagcctggtcaggtgctccacatggtcaacgaactgtatccctatatagtggagttcgaggaggaggccaaaaatcccggtttagagacacaccggaagagaaagcgcagtggcaacagcgactcaattgagagggatgcagctcaggaagcagaggccggtaccggactcgagccagggtctaacagcggacaatgctcagtacctttgaagaaaggcaaggatgccccaatcaaaaaggaaagtctcggccactggtcccaaggattgaagatctcaatgcaggatccgaagatgcaggtgtataaagatgagcaggtggtggtcattaaagataagtacccgaaggcccggtatcactggctggtcctgccttggacgtctatttcctcacttaaagccgtggcccgtgaacacctcgagctcctcaagcacatgcataccgtgggcgagaaagttattgtggattttgctggttcatcaaaactccgctttcgcctcggctaccacgccatccctagcatgtcacatgtccacctacacgttatcagccaggacttcgatagtccctgtctgaagaataaaaagcactggaactcttttaatacagaatattttctggagtctcaagaatag

SEQ ID NO: 108534 - DNA, 855 bp, Artificial Sequence
  Description of Artificial Sequence: Synthetic coding sequence
atgtcgaacgtgaatctgagtgttagcgatttctggcgtgtaatgatgcgggtgtgctggctcgtgaggcaagactcaagacaccaacgaataaggctgccacatcttgaagcagtggtgattggcagaggccccgaaacaaagatcaccgataaaaagtgttcgcgacagcaggtccagctgaaagccgagtgtaacaaaggatatgtcaaggtgaagcaagtcggcgtgaatcccacttcaatagacagcgtagtgatcgggaaggaccaggaggtcaagttacagcctgggcaagtgctgcacatggaatcactcggacactggtcgcagggcttgaagatatccatgcaggaccccaagatgcaagtttataaagatgagcaagttgtcgtgatcaaagataagtaccctaaggctagataccattggctggtcctaccttggactagcatcagtagcctgaaggccgtcgcacgggagcatctagagctcctcaaacacatgcacaccgttggtgaaaaggtgatcgtagacttcgccggcagctccaaacttcgctttaggcttggataccatgcaatcccttcaatgtcacacgtgcacctccacgtcataagtcaagactttgactcaccctgcctgaagaacaaaaagcactggaattcctttaatacggagtacttcctggagagtcaggctgtgatcgagatggtgcaggaagcgggacgggttacagtccgggacggcatgcctgagctgttaaagctgcccttaagatgtcatgaatgccagcagcttttacccagcatcccgcagctcaaagaacatcttcgtaagcattggacccagtag

SEQ ID NO: 108535 - DNA, 579 bp, Artificial Sequence
  Description of Artificial Sequence: Synthetic coding sequence
atgatgcgggtgtgttggctggttcgccaggattccagacaccagaggatccgacttccgcatctggaggccgttgttatcggccgcggtccagagacaaaaattactgacaaaaaatgctcccgccagcaagtacagctgaaggccgagtgtaataaggggtacgtcaaagtgaagcaggtcggcgtgaaccccacatctatcgattccgtcgtgattgggaaggatcaagaggtcaaactgcagcccggccaggttctccacatggtgaatgagctctacccttatatcgtggagtttgaggaggaggcgaagaacccggggctggagacccaccgcaagcgtaaacggtctggaaatagtgacagcatcgaacgagacgccgctcaggaggccgaggctggtacagggctggaacctggaagtaactccgggcagtgcagtgtcccccttaaaaaaggcaaggacgctcccatcaagaaggagtcccttggccactggagccagggtctgaagatcagtatgcaggacccaaaaatgcagccctgcacaagctcatgtgaccagccgggattttag

SEQ ID NO: 108536 - DNA, 1029 bp, Artificial Sequence
  Description of Artificial Sequence: Synthetic coding sequence
atgatgcgcgtgtgctggctggtgcggcaggacagcagacatcaacgcattcgactccctcacctggaggccgtggtgattggccgaggaccggagaccaaaataacagacaagaagtgctctcggcagcaagtccaactgaaggcagaatgcaataaggggtatgtgaaggtgaaacaggtcggtgttaacccaacgtcaattgactctgtggtcataggaaaggaccaagaggttaaattacaacccggtcaggttctccacatggtgaacgagctgtatccttatattgttgaattcgaagaggaggcgaaaaatcccggcctggagacgcaccgcaagagaaaacggtcagggaactcagactccatcgagagagatgccgctcaggaagccgaggccgggacaggcctggagcctggctctaactctgggcagtgtagcgtacctctcaagaagggtaaggacgcaccaattaagaaggagagcttgggccactggagccagggtctgaaaatcagtatgcaggatcctaaaatgcaggtgtacaaagacgaacaagttgtggttatcaaggacaagtaccctaaggctcgctaccattggctggtgttgccgtggacctccatcagctctttaaaagccgtggcccgcgagcacctggaattactgaagcacatgcacacagtgggcgaaaaggtaattgtggatttcgccggatcctctaaactcaggttccggctggggtatcacgccataccgtccatgtcacacgtacatctgcacgttatctcccaggattttgacagcccctgtctaaagaataagaaacactggaacagcttcaatacagagtattttctcgaatctcaggccgtgatcgagatggtacaagaggctggaagggtgaccgtgagagatggtatgcctgagctgctaaagctgccacttcggtgtcatgagtgccagcaattgctcccctccatccctcagctgaaagagcacttgcgaaaacattggactcagtag

SEQ ID NO: 108537 - DNA, 909 bp, Artificial Sequence
  Description of Artificial Sequence: Synthetic coding sequence
atgagcaatgtgaatttaagcgtcagcgatttttggagagtgatgatgcgagtctgctggctcgtgagacaagactcacggcatcagcgaatacgccttcctcatctggaagcagtggtaatcggaagagggccagagaccaagattaccgacaagaagtgtagccggcagcaggaattcgaggaggaagccaagaatccgggcttggaaacccacagaaagcgcaagcggtctgggaattcagatagtatagaaagagacgcagctcaggaggcagaggcgggtaccggattggagcctggctccaactcgggacaatgtagcgtcccactgaagaaaggcaaggatgctcctatcaaaaaggaaagtcttggccattggtcccagggactgaagatatctatgcaggatcccaagatgcaggtatacaaagatgaacaagtggtggtgattaaagataaatacccgaaagctcggtatcactggctcgtgctcccctggaccagcatttcaagtctaaaggccgtggcacgcgaacatttggaactcctgaagcacatgcatacggtcggagagaaagttattgtagatttcgcgggtagtagtaaactacgttttcggctcggctaccacgcaatcccctctatgagccatgtccacctgcatgtaatctcgcaggactttgatagcccgtgcttgaaaaacaagaagcactggaatagctttaacactgaatactttctggaatctcaggcagtaatcgagatggtgcaggaagctggtagggtgaccgtccgtgacggtatgcccgagctgctcaaattgccattgcggtgccacgagtgtcagcagctcctgccatctattccacaacttaaggaacatcttcggaagcattggactcaatag

SEQ ID NO: 108538 - DNA, 1029 bp, Artificial Sequence
  Description of Artificial Sequence: Synthetic coding sequence
atgatgcgggtgtgctggttggtgagacaagacagccgacaccaacggattcgcttgccgcatctcgaagccgtcgttatcgggcggggcccagaaactaagattaccgacaagaagtgcagcaggcagcaggttcaactgaaagcagagtgcaacaaaggatacgtaaaagtgaagcaggtgggagttaacccaaccagtatcgactcggttgtgatcgggaaggaccaggaggtgaagctgcaacccggccaggtgctgcacatggtgaatgagctctatccatacatagtggaattcgaagaggaagctaagaaccccggactggagacacacaggaagcggaagcgcagcggcaatagcgattccatcgaacgggacgctgcccaggaagcggaggccggaactggtttggagccagggtcaaactccggccagtgttccgtgcccctgaagaaaggcaaagacgcccctatcaaaaaggagagccttggacactggtctcaagggttgaaaatcagtatgcaggacccaaagatgcaggtctacaaggatgaacaggtggtcgtgattaaggataaataccccaaggcgcgctatcactggctggtgctcccttggacttctatctcatcactgaaagctgtggctcgagagcatttggagctcctgaagcacatgcacactgtgggcgaaaaagtcattgtggattttgcaggatcctccaagctacggtttcggctgggatatcacgccattccttccatgagtcacgtgcacctgcacgtcatatcccaggacttcgactcaccttgcctgaagaataagaagcattggaacagttttaatacggaatacttcctggagagccaggcagtgatagagatggtgcaggaagctgggagggttacagttcgcgatggcatgccagaactgcttaagttgccactgcggtgccatgagtgtcagcagctgctgccctccattcctcaactgaaggagcacctaagaaagcattggacgcaatag

SEQ ID NO: 108539 - DNA, 687 bp, Artificial Sequence
  Description of Artificial Sequence: Synthetic coding sequence
atgtatatcatcgcgcaatgtgtgggcgctattgtcgcaacagctattctctccggaatcaccagctccttgactggcaatagtctcggaaggaatgaccttgcggacggcgtcaactccggccagggcctgggaatcgagattattggcaccctgcagctggttctctgtgtgttggctacaaccgatcggagacgcagggatctgggcgggtctgcacccctggctattggtctcagcgtggccctgggacacttgctagccatcgactataccggatgtgggatcaacccagccaggtcgttcggctcagcagttattacgcataatttcagcaatcattggattttctgggttggaccatttattggtggtgccctggcggttcttatttatgatttcattctcgcgccacggtcttctgatctgacggaccgggtcaaggtatggactagcggccaagtggaggaatacgacctggatgcagatgatattaatagccgtagtttcttgggcacaaaaatctatcagtttacacactcactagaagtggtggaggaggtgaaagaacgcgatccccctgcttctcgtccaagtgaacatgatggcaggtgcgctcgcaaatcaccactggctcctaagctactcactgatagtcccgctcaggttcccgggatactcccctag

SEQ ID NO: 108540 - DNA, 810 bp, Artificial Sequence
  Description of Artificial Sequence: Synthetic coding sequence
atggcatctgagtttaagaagaagttgttctggcgcgctgtggtcgctgagttcttagctaccaccctgtttgtatttatctcaatcggaagcgcactagggtttaagtaccctgtcggcaataaccaaaccgcggtccaggataatgtgaaggtttccttagctttcgggctcagcatagcaactctcgctcagtctgtggggcatatttctggtgctcacttgaacccagctgtgaccctgggcttactgctgtcttgccaaatctctattttccgtgctttaatgtacattattgcccagtgtgttggggctattgtcgccaccgcaatcctctcaggcatcaccagtagcctaaccggaaacagcctcggacgcaatgacctcgccgatggggtgaacagtggtcagggcctgggtattgagattatcgggacactgcagttggtgttgtgcgtgctagcaaccacagacagaagacgcagggacttgggcggcagtgcgccacttgccataggtcttagcgtcgcgctggggcacctattggccatcgactatactggatgcggaattaatcccgcccgcagtttcggctctgcagtaatcacccacaatttcagtaaccactggatcttctgggtggggcccttcatagggggcgctctggcggtgctgatatatgactttatccttgcacctagatcaagcgacttaacggatagagtgaaggtttggacatcaggtcaggtagaagagtatgacctggatgctgacgacatcaactcccgcgtggaaatgaaacccaagtag

SEQ ID NO: 108541 - DNA, 657 bp, Artificial Sequence
  Description of Artificial Sequence: Synthetic coding sequence
atgttttggacctttggatatgaggcggtttctccggccggtcctagccacttattcgcttctctattactgggtgtactgttaacgatcacgttcatgccaggggccagacccttgcccctggtgttggtcccacagaacacactggcctggatgcagctagatgcaaaggcacccgcccaccctcgcccactgcaactgctaggacgagtggggccaggttctcggcaacttgccgacggagtgaactctggtcagggcctcggaattgaaatcatcggcacattgcagctggtgctgtgcgtattggcaacgacagacagacgaagacgggacctgggcggctctgctccgctggccataggcctgtctgtagcccttgggcaccttttggctatcgattataccgggtgcggaatcaaccctgcgagatcatttgggagtgctgtgatcacccacaatttttccaaccattggattttttgggtcggaccgttcatcggtggtgcacttgcagttctgatctacgatttcatcctcgccccccgatcaagcgacctgaccgatagggtcaaggtgtggacttctggtcaggtagaggaatacgatttggacgccgatgacatcaacagtagggtggagatgaaaccgaaatag

SEQ ID NO: 108542 - DNA, 465 bp, Artificial Sequence
  Description of Artificial Sequence: Synthetic coding sequence
atgcagtccggcatgggctggaatgtcctcgacttctggctcgccgatggcgtgaattctgggcagggattgggaatcgagataattggcacactgcagctagtgctctgtgtacttgcaaccactgatcggcgtcgccgcgacctgggagggtctgcccccctggcaattggcctatctgttgctctcggccacttgctggccatcgactacacgggctgtggaattaatcctgctagatcgtttggctctgctgttattacccataatttctcaaatcactggatcttttgggtgggccccttcatcgggggggcccttgcagtcttaatatacgacttcattctggccccacggtcttccgacctcacagaccgagtgaaagtttggacaagcgggcaggtggaagaatatgatttggacgcagacgacatcaacagcagagtcgagatgaaaccgaagtag

SEQ ID NO: 108543 - DNA, 765 bp, Artificial Sequence
  Description of Artificial Sequence: Synthetic coding sequence
atggcttccgaattcaaaaaaaaacttttttggcgcgccgtcgtggctgaatttctcgccactacgctgttcgtattcatcagtattggctcagcactcgggttcaaatatccggtaggcaataaccagacagcagtccaggacaatgttaaggtatctctcgccttcgggctttccatcgctaccctcgcccaatctgttggccatatatcaggagctcatctgaatcctgcagtgacactaggactgctgctgtcttgccagatctcaattgtggccacagcaatcctttctggcattacaagctctctgacggggaactccttgggccggaacgatttggcggacggtgtaaacagtggccaaggactcgggatagagattattggaactctgcaacttgtgctctgcgtgctcgccacaaccgacagacggcggagagacctggggggatctgcccctctggcaattgggctctcggtcgctctcggacacctcttggctattgactacacaggttgtggcattaacccagcccggtccttcgggagtgcggtaataacacataacttctcaaatcactggatcttttgggtgggccccttcatcgggggagcattggccgtcctgatctacgacttcatcctcgctccaaggtcttcggacctcaccgatagggtgaaggtctggacttccgggcaagttgaggagtacgacctagacgccgatgatattaactcccgtgtcgaaatgaaaccaaaatag

SEQ ID NO: 108544 - DNA, 990 bp, Artificial Sequence
  Description of Artificial Sequence: Synthetic coding sequence
atgtgtcaggtgggctgctttctcaaaactccccggttccccatctgggtggtgtgctctgagtctcatttttctatcctcttctctctgcaaccgggattactgcgcgactggagaaccgagaggctctttgatctgtactattatgacgggctggcaaaccagcaagagcagataagacttacaatcgataccactcaaacaatatccgaagacaccgataacgacttggtgccccccctcgagctatgcatcagaactaacataggctccgccctgggtttcaaatatcccgtcgggaataaccaaaccgctgttcaagataacgttaaggtaagcctggcctttgggctgtctatcgcgacgctggctcaatctgtgggccatatttccggagctcacttaaatcctgccgtaacactgggacttctgctgtcctgtcaaatctctattttccgcgctctgatgtacatcatagcacagtgtgtgggcgcgatcgtcgcgaccgctatcctgtccggaatcaccagctcgctgaccggtaattctttgggtcggaatgaccttgccgacggagtgaactccggtcaggggttaggtatcgaaattatcggcacactccagctcgtcctatgtgtgctggcaaccacagaccggcgacgaagagatctggggggatccgctccactcgccatcggactcagcgttgcactgggacacttgctggccattgactatactgggtgcgggataaaccctgcgcgctctttcggaagcgcagtgattacccacaatttcagcaatcactggatattctgggtggggccgtttattgggggggctcttgccgtgctgatctacgactttattttggcgccccggtcatctgatctaaccgatcgagttaaggtttggaccagcggccaggtcgaagaatacgatctcgatgcggacgacatcaattcaagggtcgagatgaagcccaaatag

SEQ ID NO: 108545 - DNA, 561 bp, Artificial Sequence
  Description of Artificial Sequence: Synthetic coding sequence
atgcctggcgccaggccgctacccttggtcttagttccacagaatactctggcctggatgcagttagatgctaaggctcctgcacatcctcgccctcttcagctgttaggccgggttggtccaggatccaggcagctagccgacggcgtcaattcaggacagggtctgggcatcgagatcattggtacactgcagctggtcttatgcgtcctcgccactactgatcggcgccgcagggatctcgggggctctgccccactggcaatcggcttgagtgtggccctcggacatctgctggctattgactacacaggctgtgggattaatcccgccagatcttttggatcagcagttattacacacaacttctccaaccactggattttctgggtggggcccttcataggaggcgccctcgcagtgctgatatatgattttatcctggccccccgctctagtgacctgacggatcgagtcaaggtgtggacgtcaggtcaggttgaggaatacgacctcgatgctgacgacatcaacagtagagtagaaatgaaaccaaagtag

SEQ ID NO: 108546 - DNA, 816 bp, Artificial Sequence
  Description of Artificial Sequence: Synthetic coding sequence
atgagtcccctgctcggactgaggtctgagttgcaagatacttgcacatctctaggattaatgctgtcagtggtgttgctcatggggttggctagagtggtggccaggcagcagctccacaggccagtggctcacgcatttgttttggagttcctggcaacatttcagctgtgctgttgcactcacgagctgcaactcctcagtgagcagcacccagcgcaccccacttggacattgactctagtgtatttcttttcactggtccatggtctgaccctcgtcgggacgtcttcaaacccttgcggcgtcatgatgcagatgatgctggggggcatgtcccctgaaacgggggcagtgcgcctgctagcgcagctagtgtcagcgctttgtagccgctattgcacgagtgctctctggtcactcggactgacacaatatcatgtgagcgaacgctctttcgcgtgtaaaaacccaataagagtggatctgctcaaggctgtgatcaccgaagcagtatgcagcttcctattccattctgccttgctgcatttccaggaggtcaggacaaagttgcgcatccatctgcttgcggcactcattacatttctggtgtacgcaggagggtccctcaccggcgcagtttttaacccagccttagctcttagcctccacttcatgtgctttgacgaagcgttcccccagtttttcattgtgtattggctggctccctctctgggcatcctgctgatgatactaatgtttagtttttttctgccgtggctgcataataatcacacaatcaataagaaagagtag

SEQ ID NO: 108547 - DNA, 888 bp, Artificial Sequence
  Description of Artificial Sequence: Synthetic coding sequence
atggcgggattaaatgtgagcctgtcattttttttcgcgacgtttgcgctttgcgaagccgcacggagggcgtccaaagccttacttccagtaggtgcctatgaggttttcgcccgcgaggcaatgcgcacacttgtagagctggggccctgggccggggattttggtccagatctgctcctcaccttgctgtttctactgttcctggctcacggtgtaaccctggacggtgcctcggctaaccccacagtgtctctgcaggaattcttaatggctgaacagagcttacctggcacattgctcaagcttgcggcccagggtctgggaatgcaagctgcatgtacgctgatgcgtctctgctgggcttgggagctgagcgacttgcacctactgcagtctcttatggctcagtcatgttcttctgcactaaggacaagcgtccctcatggggccctcgtggaagccgcttgtgcgttctgtttccacctcaccttgctgcatcttagacacagtccccccgcgtatagcggaccagcagtggctctgttggtaaccgttaccgcttacactgccggccccttcactagcgctttcttcaatccggctctggctgcgtctgtgacattcgcctgctctggacacactctcctcgagtacgtgcaagtttattggctggggccactgaccggtatggtcctcgccgtactgctgcaccaggggaggcttccacatctgttccagcggaaccttttttatggccagaaaaacaagtaccgggcaccgagagggaagccggcacccgctagtggcgatactcagacacccgcaaagggaagctctgtccgcgagccggggcggtcaggcgtggaaggcccgcatagcagctag

SEQ ID NO: 108548 - DNA, 798 bp, Artificial Sequence
  Description of Artificial Sequence: Synthetic coding sequence
aaccaacccgcacccgcattgtctccgcaggttagctgtaggcatagttccagcggaggtcccggccgctggcaggaatttttgatggccgaacagtctctgcctggcactcttctgaaacttgcggcccagggacttggaatgcaggcagcttgtaccctcatgaggctgtgttgggcgtgggagctgtccgacctccacctactgcaatctctgatggcgcagagctgtagtagtgccttaaggacctcagtccctcacggggcattggtggaggccgcctgtgccttctgttttcatctcaccctacttcatctgaggcatagccctcctgcttactccggccctgctgtcgctctgctggtcactgtcaccgcttataccgccggaccctttaccagcgcctttttcaacccagccctagcagctagtgtcacattcgcctgttcaggacacaccctactcgaatatgttcaagtgtactggctgggtcctctgactgaggagcagcatggagaagtgatggaaccccccctcggtcccaggtccggggactccggtccctggcttcagaggccacgatggagcccccacctgctgctgcacctgctaagtgatacccgtttgcacctaaccgaggtgcctgaaggccagctcggcagctacggtatcctggaggcctttttctcattctgttggctgtatacgggcgaggtgtcaggtgccatgcctcagcccccccttggaggcaaagatcgctcctggggttcactgaggcacctggccttgcggtggtag

SEQ ID NO: 108549 - DNA, 924 bp, Artificial Sequence
  Description of Artificial Sequence: Synthetic coding sequence
atggcagggctgaacgtcagtctctctttttttttcgcaacctttgcgctgtgtgaagcagcacgcagagcctccaaagccctcctacccgtgggcgcatacgaagttttcgccagagaggccgtaggagccgtgcagctgggaccctgctgcctggaaatgcgtactctggtggaactgggtccctgggccggagattttggccccgacctgctgctgacccttcttttcctcctgttcctggcccacggcgtgaccctggatggagcatccgctaacccgaccgtgagcctccaggaattcctgatggctgagcagtccctgcctgggactctgctcaagctcgccgcccaggggttgggcatgcaggcagcttgtactcttatgaggctttgctgggcctgggaactttcagacttgcatctactgcagagcttgatggctcagagctgtagtagcgccctgcggacgagcgtcccacatggagccctagtggaggctgcgtgcgctttctgcttccacttgaccctattgcacttaagacatagtccacctgcttactccggacctgctgtagctctgctggttacagttactgcctacaccgcaggcccctttacatcagccttcttcaaccccgccctcgccgcctcggtcacctttgcctgcagcgggcacaccctgctggagtacgtccaggtttattggcttggtcccttgaccggcatggtcttagccgttctcctccatcaggggcggctgccccacttattccagcgaaacctgttctatggtcaaaagaataagtaccgcgccccccgcgggaagcccgcccccgcttctggagatacccagacccctgctaagggtagctcagtacgagagcccgggcggagcggagtcgaggggccgcatagctcctag

SEQ ID NO: 108550 - DNA, 816 bp, Artificial Sequence
  Description of Artificial Sequence: Synthetic coding sequence
atgtgggagttgcgctccatagccttcagtcgggccgtcttcgccgagttcctggctaccttactgttcgtctttttcggtctgggttcggcactcaactggccccaggctctgccttctgtgttacagattgccatggcctttggactgggaattggcacgctcgtgcaggctctggggcacatctcgggcgcccacatcaaccctgcagtcacagtggcatgtctggtcgggtgtcatgtgtccgttctgcgggccgccttttacgtggccgctcaactgctgggagctgtcgccggagcggccctgcttcatgagatcacccccgctgacattcgcggcgacttggctgtgaatgcacttagcaactcaacaacagcaggccaggccgtgacagtagaactgtttcttacactgcagctggttctgtgtatcttcgcgagcactgacgagagacggggcgagaacccagggacacctgcactgagcattgggtttagcgtggcactgggtcaccttctggggatccattacaccgggtgcagtatgaacccagcgagaagcttagcacctgcggttgttaccggtaagttcgatgaccactgggtcttctggattggtccgctggtgggagcaatcctgggatctctgctatacaattatgtcctcttccctcccgccaaaagtctttccgagcggctggccgtcctgaaaggactcgaacccgatactgattgggaggagcgagaggtgagacggcgtcaaagcgtggagctgcactcacctcagtctttgcctaggggtacaaaggcatag

SEQ ID NO: 108551 - DNA, 879 bp, Artificial Sequence
  Description of Artificial Sequence: Synthetic coding sequence
atggggaggcaaaaagagctggtctccaggtgcggagagatgcttcacattaggtatagattgttacgccaggcattggccgagtgtctgggcacacttatcctcgtgatgttcggatgcggttccgtggctcaggtagtattgtcccggggcacgcatgggggatttttgactattaaccttgcctttggcttcgctgttaccctgggaatcctgattgcaggacaggtgagcggggcgcacctgaaccctgccgtcacttttgccatgtgctttctggccagggaaccgtggattaaactaccaatctacacacttgctcagacactgggtgctttcttgggcgccggaattgtcttcggcttgtattacgacgccatttggcactttgccgataatcaactctttgtttccggtcccaacggcactgccggcatttttgcaacatacccttccggccacctcgatatgatcaacggattttttgaccagtttattggcacagcaagccttattgtttgtgtactggcaattgtggatccatataacaaccccgtacctaggggcctcgaagcatttacggtgggtctggtcgtccttgtaattggcacctccatggggtttaactcagggtacgctgtgaatcccgctcgggatttcgggcctagattgtttacagcccttgccgggtggggttcagccgtctttacaactggtcaacactggtggtgggtgcccatagtgtctccactcctcggaagcatcgcgggcgtgttcgtatatcagctgatgatcggatgtcacttagaacagcctccaccttctaatgaggaggaaaatgttaagctcgcacatgtgaagcacaaggagcagatttag

SEQ ID NO: 108552 - DNA, 840 bp, Artificial Sequence
  Description of Artificial Sequence: Synthetic coding sequence
atgggcagacagaaggaactcgtctcacgctgtggggagatgctgcacatcaggtatcgcctactcaggcaggctttagccgaatgccttggaacccttatcttggtgatgtttgggtgcggctccgtcgcccaggtagtgctgagtcgggggacccacggaggctttctcaccattaacctcgcatttggatttgccgtcaccctcggaatcctgattgctgggcaagtgtctggagcgcacctgaacccagcggtaacatttgccatgtgtttcctggccagagaaccatggatcaaactcccaatttacacactggcacaaacactcggcgcgtttcttggtgccggtatcgtcttcgggctctactacgatgccatttggcattttgccgacaaccagctcttcgtgagcggtcccaacggtacagctggtatttttgcgacatatccatcgggtcacctggatatgataaacggattcttcgaccaggatcggcccgcattggtcgtgggggctcaccgcgtaccaactcccggacttcattgtggctgcctgcgagtccctgctgatgatcgcctgccacccggagcggcaccgacactccagaggggacgggagtgtgaggctggtccatgtgaagcacagggtgccgatctctccggccagggatccccactgcgatgccctggcctggaacacccgctgacagtacagggccccctcccccgcagtccactgcatgatcctccgttccaagccaaagaactgccaatctaccctcacccaactacagcaccttccggcttccctttggacttagcccagattgcaccttag

SEQ ID NO: 108553 - DNA, 972 bp, Artificial Sequence
  Description of Artificial Sequence: Synthetic coding sequence
atgtctgatcggccgaccgccaggcgctggggcaagtgtggtcccttgtgtacccgtgaaaatattatggtcgcatttaagggcgtttggacccaggctttctggaaggccgttacggccgagttcctggctatgcttatcttcgttctgttgagcctgggatctaccattaattggggggggaccgagaagcctctcccagtcgacatggtcttaatcagcctgtgctttgggctgagtatcgccaccatggttcaatgcttcgggcacattagtggcggccatatcaatcctgccgttacagtcgctatggtgtgcacacggaaaataagtatagccaagtccgtgttctatatcgctgcgcagtgtctgggggctattatcggggccgggattctgtatctcgttactccccccagtgtggttgggggactgggtgtgactatggtacacggcaacctgaccgccggccacggcctcttggttgagctgataatcacattccaactcgtgtttactatttttgccagctgtgactccaaaaggacggacgtgaccgggtcaattgccttggcaatcggcttttctgtggctattggccacctgtttgccataaactataccggggcctccatgaacccggctcgcagtttcggccctgctgtaattatgggaaactgggagaatcactggatctactgggttggcccgatcattggagcagtgctggctggaggcctgtacgagtacgtgttttgtcctgatgtggagtttaagaggagattcaaagaagcattcagcaaagccgcccagcagaccaaaggaagctacatggaggtcgaagacaatagaagtcaagtagagacagatgatctcatacttaagcctggcgtcgttcacgtgatcgacgtggaccgcggagaggagaagaaagggaaggatcagtccggagaggtcttaagttccgtgtag

SEQ ID NO: 108554 - DNA, 660 bp, Artificial Sequence
  Description of Artificial Sequence: Synthetic coding sequence
tgcaccttggcaggcgaggggatgagtgaccgccctacggccagacgatggggcaaatgcggcccattgtgtactagagaaaacatcatggttgccttcaagggagtatggacgcaggccttttggaaggctgtgaccgccgagttcctggccatgctcatctttgtactgctaagcctgggatctacaatcaactggggcggtaccgagaaacccctgcccgtagacatggtgctgataagtctgtgctttggactgtccatcgctacaatggttcagtgcttcggacatatctccggaggacacattaaccccgcggtcacagtagccatggtatgcacccgcaaaatctccattgcaaagtctgtattttatattgccgcacagtgcgtgggccctatcatcggagcagtgctggccggcggattatatgaatacgtgttctgccccgatgtggagttcaaacgccgcttcaaggaggcttttagtaaggcggcccagcagacaaagggaagctacatggaggtagaggataatcggtcgcaggttgagaccgatgacctcatcctgaagccaggtgtggtgcacgtgatagacgtcgaccgtggtgaagagaagaaaggaaaggaccaaagtggtgaggttttgtcaagcgtgtag

SEQ ID NO: 108555 - DNA, 912 bp, Artificial Sequence
  Description of Artificial Sequence: Synthetic coding sequence
atgtccgaccgccctactgccaggcggtggggcaagtgtggtcctctgtgcactagggaaaatatcatggtagcattcaaaggagtatggacccaggcattttggaaagctgtcacggccgaattcttggcaatgctaatcttcgtcctgcttagcctgggatcaactataaactggggcgggaccgagaagcctttaccagtggacatggtcctcatctctctgtgctttgggctctctatagcaaccatggtttgtaccagaaagatttccattgccaagtcagtattctatattgccgcccaatgcctcggtgctatcattggagctggaattctctacctcgtcactcccccctccgtggtgggcgggctcggcgtgaccatggtgcacggaaatctaaccgctggacatggactgctggtcgagcttatcattactttccagctcgtgtttactatattcgcttcatgtgactcgaaaagaactgacgtcaccggatccattgcattggcaattggcttctccgttgccatcgggcacctttttgccatcaactatacgggagcttccatgaatccagccaggtcatttgggcctgcggtgattatgggcaactgggaaaaccattggatttactgggtgggacctatcattggagcagtcctagccgggggtctttacgaatatgtgttctgtcctgatgttgagtttaagcgacggtttaaagaagcctttagcaaagccgcacaacaaaccaagggatcatacatggaggtggaggacaatcggtctcaggtggagacagatgatcttattctgaagcccggggtcgtgcacgtgattgacgtcgatcgcggggaagaaaaaaagggtaaagaccagtccggcgaagtgctgagcagcgtctag

SEQ ID NO: 108556 - DNA, 849 bp, Artificial Sequence
  Description of Artificial Sequence: Synthetic coding sequence
atggacgcagtggagcctgggggccggggttgggcctctatgttagcctgcagactctggaaggcaatctcaagagccctgttcgccgagttccttgccacgggattatacgtatttttcggggtcggttccgtcatgcgttggccaactgctctgccttccgtcctgcagattgccatcacttttaatttagtcacagccatggctgtccaagtgacctggaaagcctctggcgcccacgctaacccagctgtcactctggcctttctagtcggctctcatatttcccttccccgtgccgtcgcttatgtcgctgcccaactcgtgggagccacagtgggagctgctctgttatacggcgtcatgccaggtgatataagagagactctaggcattaatgttgtgcggaattcagtgagcaccggacaggccgtggccgtcgagctccttctcaccctccagcttgtattgtgtgtcttcgcctccactgatagtagacaaaccagtgggagccctgccacaatgattggaatctcggtcgcccttggacacctcatcgggatacattttaccggatgttcaatgaacccagctcgctcattcggcccggctatcatcatcgggaaatttactgtacactgggtgttctgggtgggtccacttatgggagcactcttggcatccttaatttacaatttcgtgttgttccccgatactaagacactggctcaaagactggcaattttgacgggtaccgtggaggttggaaccggggccggcgctggggctgaacccttaaaaaaggagagtcagcccgggtctggcgccgttgagatggagagcgtgtag

SEQ ID NO: 108557 - DNA, 1029 bp, Artificial Sequence
  Description of Artificial Sequence: Synthetic coding sequence
atggtgcaggcctcaggtcatcggcggagcactcggggcagtaagatggtatcctggagcgtcatcgccaagattcaggaaatcctccaacgcaagatggtgcgcgagttcctcgccgaattcatgagcacctacgtgatgatggtatttggcctagggagtgtcgctcatatggttttaaacaaaaaatacggatcatacctgggcgtaaacttgggattcgggttcggcgttactatgggagtacacgttgctggccgtatcagcggcgcgcacatgaatgctgccgtgacgtttgcaaattgcgctcttggcagggtcccatggaggaaatttcccgtgtacgtcctcggccaattcctcggatctttcctggccgccgctacaatttactcactgttttacaccgctattcttcatttcagcggaggccagctaatggtgacagggccggtggcgactgccggaatctttgcaacttacctgccagaccatatgacattgtggagggggtttctgaacgaagcatggctaaccgggatgctgcagttgtgtctatttgctattacagaccaggagaacaaccctgcactgccaggcactgaagccctggttattgggattctggtggtgatcattggggtgagcttgggcatgaatacagggtacgcaatcaatcccagccgagatctacccccccggatcttcacatttatcgctggatgggggaagcaggtgttctccaatggggaaaattggtggtgggtgcccgttgttgcacccctgttgggagcctacctgggcgggattatctatttggttttcataggaagcacaatccccagagagcccttaaagctggaagacagcgtggcttacgaggatcatggaattacggtgctgccaaaaatgggttcccatgaaccaaccatttccccactcactccagtctcggtctcgcctgccaacagatcaagcgtccaccccgctcccccccttcacgagagcatggcactggaacacttttag

SEQ ID NO: 108558 - DNA, 651 bp, Artificial Sequence
  Description of Artificial Sequence: Synthetic coding sequence
atggtcctgaataagaaatatgggagctaccttggcgtgaacttgggatttggctttggcgtgactatgggggtgcacgtagccgggcggatctccggggctcatatgaatgccgccgttaccttcgcaaattgtgccctgggcagagtcccctggagaaaattccctgtgtatgtgctgggccagttcttagggagctttttggcggctgccactatttactcccttttttacactgcaattttgcacttctcaggggggcaacttatggttaccgggcctgtggcaacagctgggatcttcgcgacttacctccctgatcacatgaccctgtggcggggttttctgaacgaagcctggttgacgggcatgctccagctttgtctgttcgccatcactgaccaggaaaataaccccgcgctcccaggcaccgaggctctagttatcggcatactcgtagtcattattggagtttcgctcgggatgaacacaggttacgcgatcaacccctctagagacctgcccccaagaattttcaccttcatcgctggatggggtaagcaggtattccgatggcaccatctgccgggcctccattggctacatcatccgactggggctcctgaaatcggtggcttctgtggcgtgtag

SEQ ID NO: 108559 - DNA, 582 bp, Artificial Sequence
  Description of Artificial Sequence: Synthetic coding sequence
atgggctgggctacgtttactgaccagggggaagaggggctcgaacccagtgggccttggaaaacatctcacactagagcgcacatgaatgccgctgtgacctttgccaactgcgccctgggaagggttccatggcgtaagttccctgtctatgtgctgggacagtttctgggctcctttttggctgctgcaacaatctactccctgttctacaccgctatactacatttttccgggggccaactgatggtgaccggacccgtggctacagcaggcatcttcgccacctacctgccagatcatatgaccctctggcgcggctttctaaacgaagcttggctcacagggatgctgcagttgtgccttttcgctataactgatcaggaaaacaaccctgccctgccaggaacagaagcacttgtgatcgggatcctcgtggtcatcatcggcgtctcattgggcatgaatacaggctatgcaattaatccttccagggatctgccacccaggattttcaccttcattgcgggctggggaaaacaggtttttagatactgtccgtgtcccgggcctttcctttag

SEQ ID NO: 108560 - DNA, 771 bp, Artificial Sequence
  Description of Artificial Sequence: Synthetic coding sequence
atgggttcgggccactgtttacggtcaactagggggtccaaaatggtttcatggtccgttatcgccaagatccaagagattctgcagagaaagatggtgagggagtttctggctgagttcatgagtacctacgtgatgatggtgttcggtttgggctccgttgctcacatggttttaaacaagaagtatggcagctatttgggggtaaacctggggtttggttttggggtcaccatgggcgtccacgtggcgggcaggatttcaggcgcccatatgaatgccgcagtaacattcgctaactgtgcccttgggcgggtgccttggcgcaaattcccagtgtacgttctggggcagtttctcggctcctttctggctgccgctacaatctacagtctgttttacactgccattctgcacttcagcggcggccagctcatggtgactgggcccgtggccactgcagggatcttcgctacatacctccctgatcatatgacactctggagaggatttcttaatgaggcttggttaactggcatgctgcagctgtgcttgtttgcaattaccgaccaggagaataatcctgctctgccaggaacagaggccctggtcattgggatcctcgtggtaattattggcgtttcactcggaatgaataccggctacgccatcaaccccagtcgggatctgccacctaggatcttcacattcatagctggttggggtaagcaagtcttccgttattgtccatgccccggaccctttttatag

SEQ ID NO: 108561 - DNA, 1026 bp, Artificial Sequence
  Description of Artificial Sequence: Synthetic coding sequence
atggggagcgggcactgccttcggagtaccagaggcagtaaaatggtgagttggtcagttatcgccaaaatccaggagattttgcagcggaagatggtcagagaatttctagctgagttcatgtccacttatgtcatgatggtttttgggttaggctccgtggctcatatggtgttaaataaaaagtacggtagttatcttggcgttaacctcgggttcggcttcggcgtgacgatgggggttcacgtggctgggcgcattagcggcgcacacatgaatgccgccgtcacatttgccaattgcgcccttggtcgtgttccatggaggaagtttcctgtgtacgtcctaggacaattcctgggatcttttctcgccgcagccaccatctattctctcttttacaccgctatattacatttctctgggggacagctgatggtgaccggcccggtggcgactgctggcatctttgccacatatctgccagatcacatgaccctctggcgcggcttcctgaacgaggcttggctcacaggaatgctgcagctttgtctctttgctattaccgaccaagagaacaatcccgcactgcccggaacagaagcattggtcattgggatacttgtcgtgattataggagtgagcttaggcatgaatacaggctatgcaatcaacccctcgcgagacttgccacccagaatttttacctttatcgccggctgggggaagcaggttttctctaacggagaaaattggtggtgggtccccgtggtggcccccttattgggagcgtatcttggcggcattatttacctggtgttcatcggtagcactattccgagagaacccttaaaactggaagattccgtcgcatatgaggaccacggtataacagtgcttcccaaaatgggcagtcacgaaccgaccatcagccccctcactccagtatccgtgtctcctgccaacagaagtagcgtgcatcctgccccacctctgcatgagagtatggctctagagcacttctag

SEQ ID NO: 108562 - DNA, 513 bp, Artificial Sequence
  Description of Artificial Sequence: Synthetic coding sequence
atgaacgccgctgtcacctttgccaactgtgccctgggaagggtcccgtggcgcaagttccccgtctatgtgctgggacagttccttgggtcgtttctcgctgcagccacgatttactctctgttctataccgcaatcctccactttagcggcggtcagctcatggttaccgggccggtggccaccgccggtatcttcgccacataccttccagatcacatgaccctgtggcgaggcttcctgaatgaggcctggctaactggcatgctacagctatgcctgtttgccataacagaccaggaaaataatccagctctgcccggaactgaagcactggtgattggaattcttgtggtaatcataggcgtctccctcgggatgaatacaggctacgccataaacccttcgcgcgacctccctcccaggatctttacgttcatcgcaggctgggggaagcaggtcttctcgaatggagaaaattggtggtgggttcccgtggtggcacccttgtag

SEQ ID NO: 108563 - DNA, 426 bp, Artificial Sequence
  Description of Artificial Sequence: Synthetic coding sequence
ctattctatactgctatcctgcacttttcaggcggacagcttatggtgacaggacccgtggccactgccgggatcttcgcgacctacctgcctgatcatatgaccttgtggcggggttttctgaatgaggcctggctcaccggaatgctgcagctgtgcctttttgctataacagatcaggagaataatccggcgttacccggcacagaagccctggtgataggaattttagttgtcataatcggcgtgtctctggggatgaacacaggatacgccatcaacccaagtagagatctccctccccgtatattcacgttcatagcaggctgggggaagcaggtattccgctggcatcatctccctggcctccactggctgcaccaccccacaggcgctccggagataggcgggttttgtggtgtgtag

SEQ ID NO: 108564 - DNA, 498 bp, Artificial Sequence
  Description of Artificial Sequence: Synthetic coding sequence
atgaacgcagccgtaaccttcgcaaactgcgccctgggacgggtcccatggagaaaattcccagtctacgtactgggccagtttctgggtagctttcttgcggctgctaccatatactctttgttttataccgcaatcttacatttttctggcggccaattgatggtgactgggccagtagccactgctggcatttttgccacctacctccccgaccacatgacactatggagagggttcctgaacgaggcctggttaactggtatgctacagctgtgcctcttcgccataaccgatcaagagaataaccctgcccttccaggaacggaagctctggtgatcggaatcttggttgtgataatcggagtctcattgggaatgaacaccggatacgccatcaacccatcacgcgatctcccacctaggatctttaccttcatcgcgggttgggggaagcaggtgtttcgttattgcccatgccctgggcccttcctgtag

SEQ ID NO: 108565 - DNA, 774 bp, Artificial Sequence
  Description of Artificial Sequence: Synthetic coding sequence
atggttcaagcgtctggccataggcgatccacacggggatctaaaatggtatcatggagtgtgatcgctaagatccaggaaatacttcagaggaaaatggttcgcgagttcctggcggagtttatgagcacatatgtaatgatggtctttggtctcgggtcagtggcccatatggtcttaaacaaaaagtacggatcatacctgggagtcaacctcggctttggctttggagtgacaatgggcgtgcacgtggctggtcgcatcagtggcgcccacatgaatgcggccgtcacgtttgccaactgtgccctggggagagtgccgtggaggaagtttcctgtatacgtgcttgggcagttcctgggttcctttttagcagcagccacaatctacagcttgttctacaccgcgatcctgcacttcagtggggggcagttgatggtaacagggcccgttgcgaccgcaggtatttttgccacctacttacctgaccatatgactctttggaggggcttcttgaacgaggcttggttgaccgggatgctgcaactgtgtttattcgccatcactgaccaagaaaacaatcctgcgctgcccggcactgaagccctcgtgattggtatcctcgtggttatcatcggagtgtctctgggcatgaatacgggctacgcaatcaacccctcaagggacttgcccccacggatcttcaccttcatcgccggctgggggaaacaagtattccgatactgcccttgcccgggtcccttcctttag

SEQ ID NO: 108566 - DNA, 426 bp, Artificial Sequence
  Description of Artificial Sequence: Synthetic coding sequence
atgaacgctgctgtgaccttcgctaattgtgctctgggccgggtgccttggagaaagttcccagtatatgtgttggggcaattcctggggtcctttctggccgccgcaacaatctactcactattttatagtgtggccgacagggatgcccctgcagtgtcgctgcggcaccacgggcccggggagcagccctctaccgcccggaacaggggcgctggcgaccgccaccctagaggccaccatcgcggcgttccatggcatgagcatagaatttgtcaccagccagtgcccggacccgcacctccacacctgcaccttcattgctggctggggcagacaggcctgcaggtactgccgttacctcgccctattcccctgtccttttccgtgggtcctctttgtgtggagggttggggcgtcatgtag

SEQ ID NO: 108567 - DNA, 1602 bp, Artificial Sequence
  Description of Artificial Sequence: Synthetic coding sequence
atggggtcccgttgccttaatccgcctcctccagctcattccgacacaaccgggaaggactcatttggaaacatccgtggggctgaaaccggtcaaggtgcttcagcttgttctgtcacatctgctcgggtaacttgtggggcgggatccgaaccccattcacatcgaaatccgggcatctccgctcaggtgggtttggcacccagctatggtgcagctaggggccgacgacggccactcgccctacaacaatccccccaagaaagacgacacgtcggctggaattctacgcgcggtctgctgcccgcaagcctgcccggcactgctagcagtcagagcgctagcgccactgcctcagcggctttgcccctcaaagttacaggcccgctggcccgaaatccaactcctccctggactgccgcagcagctctcgctacacgtggccagagacccgagaagggcctattccccggcccagcccccttttcacttggaaaaaggaagcggggccgcggcaggacctgggaacggaggcgccgggtctccattgaaacttcgacatgcttccggcccgggtgtgagcgactaggtgcggctgctggagccaatctgtctcagctggcgtcctcacagaggccactcagagagcgttgggtgctctacactatcattatggctgcagctggcgcgccggatggtatggaagagcccggcatggatactgaggctgaaaccgttgcaactgaagctcccgccaggcctgtcaattgcttggaagccgaagccgccgctggcgccgcggccgaggatagcggagctgcgagggggtccctgcagccagccccagctcaacctccaggcgatccagcagctcaagcctccgtttctaatggcgaagatgccgggggcggtgcagggagagagctcgttgacctgaagataatctggaataaaaccaagcatgacgtcaaattcccattagactctactggatccgagctgaaacagaagattcacagtatcacaggcctgccacctgctatgcagaaagtgatgtacaaggggctcgtgccagaggacaaaacactgagggaaatcaaagtaacctcgggcgccaagatcatggtggtaggatctaccatcaatgatgtcctggccgttaacacacccaaagacgctgctcagcaggatgcaaaggccgaggagaataagaaggaacctctctgccgccaaaagcagcatcgcaaagtactcgacaaagggaagccagaggatgtgatgcccagtgttaagggagctcaggaaagattgccaactgtccctctaagtggcatgtacaacaaaagcggcggcaaagtccgcttgacattcaagttggaacaagaccaactctggatcggaacgaaggagaggactgaaaagttacctatgggatccatcaagaacgttgttagcgaaccgatagaaggccatgaagattaccatatgatggccttccaactcggacccaccgaggcctcctactattgggtgtattgggtgcctacccagtatgttgatgctataaaggacacagtactgggcaaatggcagtacttttag

SEQ ID NO: 108568 - DNA, 9198 bp, Artificial Sequence
  Description of Artificial Sequence: Synthetic coding sequence
atggaagagaaacagcaaatcattctggccaatcaggacggcggcactgtggcgggcgcagctcccacatttttcgtcattctcaagcagcccggcaacggcaagactgatcagggaatattagtcacgaaccaggacgcctgcgcccttgctagcagtgtgtcctctcccgttaagagcaagggcaagatctgcctacccgccgactgcacagttggcggcattacagttaccctcgataacaatagcatgtggaatgagttctaccatagaagcacagaaatgatccttaccaaacaggggcgccggatgttcccttactgtaggtattggattacaggtctcgacagtaacctgaagtatatcctggttatggacatcagtccagtcgacaatcaccgctataaatggaacgggaggtggtgggagccttcagggaaggcagagccccacgtgcttggcagggtgttcatccaccccgagtccccatccacaggacactattggatgcaccaacctgtgagtttttacaagctgaaactgacaaacaataccctggaccaggagggacacattatcctgcatagcatgcaccgatacttacctcgcctgcacctagtgccagctgagaaggctgtggaagtaatccagctcaacggccctggagttcacaccttcacattcccacagaccgagtttttcgccgtgactgcgtaccaaaatattcaaatcacccagttgaagattgactataatccctttgcaaagggattcagggacgacgggctgaacaataaaccccagcgagacggcaaacagaagaacagttcagatcaggagggaaacaacatctcctcctcttctggccacagggtgaggctaactgagggacaaggctccgagatacagcccggagatctcgatccccttagccgaggacatgaaaccagcgggaaaggtcttgaaaagaccagcctgaatattaaacgcgacttcctcgggttcatggacactgactctgccttgtccgaagtgccacaattaaagcaagaaatcagcgaatgcctaattgcatccagcttcgaggatgattcacgggtagcttctcctctcgaccagaacggatcttttaacgttgtgatcaaagaagagcctctggacgattatgattatgagctgggcgagtgtccagagggagtaacagttaagcaggaggagactgacgaagagacggacgtatacagcaatagtgatgacgatccaatcttggaaaaacagctgaagagacacaataaggtcgataaccctgaagccgaccaccttagttccaagtggctccccagcagccccagtggagtcgcgaaggcaaagatgtttaagctcgatactgggaaaatgccagtggtgtaccttgagccatgcgcggtgacgaggtccacagttaagatctccgaactgccggataacatgttgtctaccagccggaaagataagtcttccatgcttgcagagttggaatatttgcccacttacatcgagaactccaacgagactgccttctgcctggggaaagaaagtgagaacggcctgcgtaaacattcacccgaccttagggtggtccagaaatatcctctgctaaaggagccacaatggaaataccctgacatctctgattccatttcaactgagcgcatcctcgacgattccaaggattccgttggagacagcctgtccggcaaggaagatctggggagaaaacgcactacaatgctcaagattgctacagcggcgaaagttgtgaatgcgaatcaaaatgcatcccctaatgtgccgggcaaacggggcagaccgcgtaaacttaagttatgcaaagctgggcgacctccaaagaacaccggaaaatctttgattagcacgaagaacactcctgtgagtccagggtctacatttccagacgtaaaaccagacttagaggatgttgacggagtgctttttgtttctttcgaaagcaaagaagcgctcgatatacatgctgttgatggtaccaccgaggaatccagtagcttgcaggcttcaaccacaaacgactcaggttatcgggctagaatttcacagctggagaaagaattaattgaggacctcaagaccttgcggcataagcaagtcatccatccagggctgcaggaggtgggtttgaagctaaactccgttgatcctaccatgtccattgatctgaaatacctgggagttcagcttccattagcccccgccacgagttttcctttctggaacttgactggtaccaatccagcatctcccgacgccggttttccattcgtttcccggaccggcaagactaacgattttactaagattaagggctggcgaggcaaatttcactctgccagcgccagcagaaatgagggcgggaattccgagagctcgctgaagaaccgctccgccttttgctcagacaaactagacgagtatctggaaaacgaggggaagctcatggaaacctcaatggggttcagtagtaatgcaccgacctcgcccgtagtgtaccagctgcccacaaaatccacaagttacgtccggaccctggattccgttttgaaaaagcagtctactatctccccaagcactagctactccttaaagccccattcagtgcccccggtctcaagaaaagccaagtcacagaataggcaggctacgttctcaggccgtactaaaagttcatataagtcaatattgccatacccagttagtcctaaacagaaatactcacacgtgatcctcggcgacaaggtgactaaaaacagcagcggaattattagcgagaatcaggccaacaatttcgttgtaccgacgctggatgagaatatatttcctaagcagatttcacttagacaggcacagcagcagcagcaacagcagcaggggtctcggcctcccggcctctccaagagccaggtaaagctgatggatctggaggattgcgccttatgggagggtaagccacgaacctacatcaccgaggaacgggcggatgtgagcttaaccacattgttaactgctcaggcatccctgaaaaccaagccaatacacaccattatccgcaagagagcaccaccatgcaataacgacttctgccgactggggtgtgtatgcagctcactggcacttgaaaagaggcaacctgcacattgcaggcgccccgactgtatgttcgggtgcacgtgcctgaaacggaaagtggtgttagtaaagggcggcagtaaaactaagcattttcaacgaaaggccgcccaccgcgacccggtgttttatgacacccttggcgaagaggctcgggaagaagaagaaggcatccgcgaggaagaggagcaactaaaggagaaaaagaagaggaagaagttggaatatacaatctgcgagacggagcccgaacagccggtgcgacattaccccttgtgggttaaggtggagggcgaggtggaccccgagccagtgtacataccgaccccatctgtaattgagcccatgaagccactgctgctgcctcagcccgaagtactaagccctaccgttaaagggaagctcctcacgggaataaagtccccaaggtcatacacaccaaagccaaatcctgtgatccgggaagaagacaaggaccctgtatatctctacttcgagtccatgatgacctgcgcacgggtgcgggtttatgagcgtaaaaaagaggatcagagacagccatcatccagctcgtccccgtccccaagtttccagcagcagacttcttgccatagttccccggagaatcacaacaatgcgaaagagccagatagcgagcaacagccgctaaagcagctcacttgtgacctggaggacgattccgacaaattgcaggaaaagagttggaaatcgtcttgcaacgagggcgagtcatcatctacctcttatatgcaccagcgatcccctggcggcccgaccaagctgattgagatcatttcagactgcaactgggaagaggatcggaacaagatcctctccatcctatctcagcacattaactcaaatatgcctcaaagcctcaaagtcggatcgtttataatcgaacttgcgtcccagcgcaaaagccgcggcgaaaagaacccaccagtgtatagcagcagggtgaaaatatctatgcctagttgtcaggatcaggacgacatggccgaaaagagtggaagcgaaacgccagacggacccttaagccccggcaagatggaggatatctcaccggttcagacagatgcactcgactccgtgcgggagcggctccatggcggtaagggccttccattctacgccgggttgtcccccgctggaaaactggttgcgtacaaacgtaaaccctcatcgtccacctccggtttgattcaggtcgcaagtaacgctaaagtagctgctagtcggaaaccaaggaccctgctaccatccacatccaactccaaaatggcatccagctcaggtacggctaccaataggcccgggaagaacctgaaggcctttgtgcccgccaagagacccatcgcggctcggccatcccccggtggtgtgtttactcagtttgtgatgtcaaaagtgggtgctttacaacagaagataccaggtgtgagcactccccagactctagcgggtacacagaagttctctatccgaccaagcccagtgatggtggtgacccccgtcgtttctagcgagcccgtacaagtttgcagccccgtcacagctgccgtaaccactaccacacctcaggtttttctggaaaacactacagctgtgacccccatgacagcaatctcagacgtcgagactaaggagactacttactcctctggagccacaactactggtgtcgttgaagtgagcgagaccaacacgtccacttccgtgacatccactcagtccacagctaccgtgaacctgacaaagactacaggcattaccacacccgtcgcttctgtcgcgtttcctaaatcgctggttgccagtccgagcacgattactctgcccgtcgcatcgaccgccagtacatctctggtggtggtgaccgctgctgcctcctcatctatggtcacaaccccaacaagttcacttggttccgtcccaattatcctttctggcatcaatgggtcccctcctgtatcccagcgacctgagaatgccgcccagatcccagttgctaccccgcaagtgtcacccaataccgttaaacgcgctggcccccgtctactcctgatccctgtccagcaagggagtcctactctgcgacccgtgagcaacacacagttgcaaggccacagaatggtcctgcagccagtgcgtagcccctccggtatgaatctgttcaggcaccccaacggccagatagtgcagctgctaccactgcatcagctgcgggggagcaatacccagccaaatctgcagccagttatgttccggaaccccggcagtgtgatgggcattcggctccccgctccaagtaaacccagcgaaacccctccaagctctactagttccagcgccttctctgtgatgaatcccgtcatacaagccgtgggttcctcgtccgccgttaacgtcatcacccaggcgcccagcctgctgtccagcggtgcgagctttgtcagtcaagcgggcaccctcaccttacgaataagccctcccgaaccccagagttttgcgtccaagacaggctccgaaacaaagatcacatatagcagcggcgggcagcctgtcgggactgcgagcctgattcccctccagagcgggagctttgcactgctccagctgcctggtcagaagcctgtgccatcttcgattctgcaacacgtggcaagtctgcagatgaagcgggagtcacagaatcccgaccaaaaagatgagaccaactcaataaaaagggaacaggagaccaaaaaggtattacagtcagaaggagaggccgtagacccggaggccaatgttattaagcagaactcgggggctgctacatcagaggagaccttgaacgacagcttagaagaccgtggcgatcatttggacgaagagtgcttacccgaggagggctgtgctaccgtgaaaccctcagagcattcctgcattaccggctcccataccgaccaagattataaggacgtgaatgaggagtatggggcacggaaccggaaaagctccaaggaaaaagttgctgtgctcgaggtgagaacaatcagcgagaaagcttctaataagaccgtacaaaacctgagcaaagtgcagcaccaaaagttgggtgacgttaaggtagagcaacagaagggatttgataacccggaagaaaacagctctgaatttccggtgacgttcaaggaagagtcaaagtttgagctttcagggtctaaggtgatggagcagcagagcaaccttcaacccgaggcaaaggagaaggagtgcggagactcactcgagaaggatagggaacgttggaggaaacatctgaagggccctttaacccggaagtgtgtgggagcttcccaggagtgtaagaaggaggctgatgaacagctcatcaaagagacgaagacctgtcaggaaaacagtgacgttttccaacaggagcaggggatttcagacctgttgggaaaatcaggcatcactgaggatgcccgtgtgcttaagaccgagtgcgattcctggagtcggatcagcaatcccagtgcattctcgattgtgccacgacgggcagccaagtcatcacgaggaaacggccacttccaagggcatctgctgctcccaggtgaacagatccaacctaagcaagagaagaagggcggacgtagtagcgccgacttcaccgtgctggacctggaggaggatgacgaggatgacaatgagaagaccgatgactccatcgatgagatcgtcgatgtagtgagtgattatcaatccgaagaggttgatgacgtcgagaagaataattgtgtggagtatatcgaggatgacgaggaacacgttgacatcgagacagtggaggaactctctgaggaaataaacgtggcccacctgaagactaccgcagcccacactcaaagctttaagcaacccagctgcacacatatatcggcggacgaaaaggctgctgagaggtctcggaaagctccaccaataccactgaaactcaagccagattattggagtgacaaactccagaaggaagccgaggcatttgcttactacagacgcacacatactgccaacgaacgcagaagacggggagagatgagggatttgtttgaaaagctgaaaataacattgggtctcctgcatagttccaaggtgtctaaatccctcatattgacgcgggcgttttccgagattcaaggactgaccgatcaggcggacaaacttattgggcaaaagaacctgctgacacgcaagcggaatatcctaattcggaaggtgtctagcctgtcaggtaagaccgaagaggtggttctgaaaaaactggagtacatctacgccaagcagcaagctctggaggcgcagaaacgtaagaagaaaatgggaagcgatgagttcgacatctcgccgcgcattagcaagcagcaggaaggcagcagcgcctcgtctgtggaccttggtcagatgttcataaataatcgacgcggcaagcccctcatcctgtctcggaaaaaggaccaggccaccgaaaatacatcccctcttaacaccccacatacatccgccaacttggtcatgacaccccagggccagctgctgactctgaaagggcccctctttagtggacccgtcgtggctgtctcgcccgatctgctcgagtccgacctgaaaccccaagtcgccgggagcgccgtggccctgcccgaaaatgacgacttgtttatgatgcctagaattgtcaacgttacaagcctggctacagagggcggcttggtggacatgggaggtagtaagtacccgcatgaagtgcccgacagtaaaccctctgatcacttgaaagatacggtgcgcaacgaggacaacagtctggaggataaggggagaatcagctcacgtggcaaccgggacggccgagtgaccctcggccctacacaggtcttcctcgccaataaagacagcggatatcctcagattgtagacgttagtaatatgcagaaggcacaagagtttttaccaaaaaaaattagtggtgatatgaggggcatccagtacaaatggaaggagtctgaatctcgcggtgaacgggttaagagcaaggattccagtttccataagctgaagatgaaagatttaaaagacagctcaatcgagatggaattacggaaagtgaccagcgccatagaggaggcggcgcttgactcctctgagctccttaccaacatggaggatgaggacgacaccgacgagaccctgacatccttgctgaatgaaattgccttcctgaatcagcaacttaatgatgatagtgttgggcttgccgagctgccctcaagcatggatacagagttccctggcgatgcccgccgagcctttatttccaaagtgccacctggctcccgtgcaacgttccaggtggaacatttgggcacgggcctgaaggagctacctgatgtccagggggagagcgactctattagccctttgctcttgcacctggaggacgatgattttagcgaaaacgagaagcagctagccgagcccgcctctgagcccgatgtgctaaagattgtgattgacagtgaaattaaggatagcctcctaagcaataaaaaggcaattgacggaggcaagaacacatcaggcctcccggccgagcccgagtccgtcagcagcccaccgactctccacatgaaaaccggactggaaaatagcaattccactgatactctgtggaggcctatgcccaagctagccccactcggactgaaagtagccaatccaagcagcgatgccgacggccaatcactgaaagtgatgccatgcctggcgcccattgccgccaaggtgggatctgtgggacataaaatgaatcttacagggaacgatcaagaggggcgagagtctaaagtaatgcctacactcgcgcccgtggtggctaagttagggaactccggagcgtctccatcatcggcgggcaaatag

SEQ ID NO: 108569 - DNA, 888 bp, Artificial Sequence
  Description of Artificial Sequence: Synthetic coding sequence
atgcagcccgaaggagcagaaaaaggtaagagcttcaaacaaagactggtgctgaaatccagtctggctaaagagacgctgtccgagttcttgggcacctttattctgattgtgttgggctgtggctgcgttgcccaggccatcttatcacggggacgcttcgggggggttattaccataaacgtcggctttagtatggccgtggcaatggcaatttacgtggctggcggggtttcagggggtcatatcaacccagcggtatctttagctatgtgcctgttcgggagaatgaagtggtttaaactgccattctacgtcggtgcgcaatttcttggagcattcgtgggcgccgctaccgtattcggaatctattatgatggtctgatgtcctttgccggtgggaaattactgatagtgggtgagaatgccaccgcgcacattttcgccacatatcctgcaccgtacctgtctttagctaatgcatttgccgatcaggtggttgctactatgatcctgctcattatcgttttcgctatttttgacagtagaaacctgggggcacctcgcggcctggaacctattgctatcgggctgctcatcatagttattgcttcaagccttggtcttaacagtggctgcgccatgaacccagcccgcgatctcagcccgcggctatttactgcgctggcaggttggggcttcgaggtgttccgcgcaggcaataacttctggtggattccagtggtgggacccctcgttggtgctgtgatcggcgggcttatctacgtgttggttatcgagatccaccatcccgagcctgatagcgtcttcaaaaccgagcaaagcgaagacaaacctgagaaatatgagctgtctgtgattatgtag

SEQ ID NO: 108570 - DNA, 1992 bp, Artificial Sequence
  Description of Artificial Sequence: Synthetic coding sequence
atgggccggtatcgtataagggtagcgactggcgcatggctgttttcaggcagttacaatcgggttcaactctggctggtgggtacccgtggggaagccgaacttgagcttcagcttaggcctgcccgcggcgaggaagaagaattcgaccatgatgtggccgaggatctgggcttgctgcaatttgttcgtctgcgaaaacaccactggctggttgacgacgcttggttttgtgacagaataactgtccaaggaccaggcgcatgcgcagaagtagcttttccatgctataggtgggtgcagggggaggacatcttgagccttcctgagggcaccgcaagactgcccggcgacaacgcactggatatgttccaaaaacaccgagagaaagaactgaaagaccgacagcaaatctactgctgggctacctggaaggaaggcctgccgctgaccatcgctgcagatagaaaagacgatcttccgccgaacatgcggttccacgaggagaaacggctcgattttgaatggactctaaaggctggggcattggaaatggcgctcaagagagtttatactctgctgtcgagttggaactgtcttgaagacttcgaccagatattctggggacagaagtcagccctggcggaaaaagttcgacagtgctggcaggacgatgaactattctcttaccagttccttaatggcgcaaatcctatgctgctgagacgcagcacctctctgccctcacgcctggtgctccccagtggaatggaggagttgcaggcacagctggaaaaggagctccagaacggctccttatttgaagccgatttcatccttttagacggtattccagccaatgtcattcgtggagagaaacagtacctcgccgcacccctcgtcatgctcaagatggaacccaacggaaagctgcagccaatggtgattcaaatccagccaccgaatccatccagccctacccctaccctgtttcttccctcagacccacctctggcttggctgctggcgaaatcttgggtcagaaactccgatttccagttgcacgaaattcagtaccatctgttgaatactcacttggtagccgaagtgatcgctgtcgcaaccatgcggtgcttgccagggctgcatccgatatttaagtttctaatcccacatatccgatacactatggaaatcaacacccgggcccgaacgcagttgatcagcgacggcggcatattcgataaagctgtgagcaccgggggggggggacacgtacagctcttacgccgggctgctgcccagttaacctattgttctctctgtccacccgacgacttggccgaccgagggctattaggcttacccggagcattgtacgcgcacgatgcactccgcctttgggaaattattgctcgctacgtcgaaggaattgtccacctgttctaccagagggatgatattgtgaaaggcgaccccgaattgcaggcatggtgccgcgagatcaccgaagtgggcctctgccaagcccaagacaggggatttcctgtgtccttccaaagtcagtcacagctgtgtcacttccttaccatgtgtgtgtttacgtgcaccgcccagcatgccgccattaaccagggtcagctggactggtacgcctgggtcccgaacgcaccatgcacaatgagaatgccacctcccacgaccaaggaggatgttacaatggctactgttatggggagcttacccgatgttcggcaggcatgtttgcagatggctatcagctggcacttgagtaggcgccagccggacatggtccccctcggacatcacaaggagaagtatttctccggtcccaagccaaaggcagtgttgaatcagttccggaccgaccttgagaaactggagaaagagatcaccgcccggaacgaacagttggattggccctatgagtacctgaagccctcctgcatcgaaaattcagtcacaatctag

SEQ ID NO: 108571 - DNA, 2106 bp, Artificial Sequence
  Description of Artificial Sequence: Synthetic coding sequence
atggcaacctacaaggttcgggtcgctactgggactgatctgctctctggcacccgtgatagcatttcactgacaatcgttgggacccagggcgagagccataagcagttactcaaccactttggtcgtgacttcgcgaccggagctgtaggacaatacaccgttcagtgccctcaagacctcggagagctgatcataattcgcttacataaggaaagatacgcatttttccccaaggacccctggtactgcaattatgttcagatctgcgcacctaacgggaggatctatcacttccctgcttatcaatggatggatgggtatgaaacgctggcccttcgggaagcgactgggaaaacaacagccgacgactctttgcccgtgctactggagcaccgtaaggaggagatacgggccaaacaggatttctatcattggcgagtatttttacccgggttaccaagttacgtgcatatcccctcataccgcccccctgtacggcgacatagaaatccaaatcgcccggaatggaatgggtacatccctgggttccctatcctcattaatttcaaagctacaaaatttctcaatttgaatctgaggtacagctttctgaagaccgctagtttttttgtgcgtctaggcccgatggcactcgctttcaaggtgcggggattacttgactgtaagcattcctggaagcgcctgaaggatattaggaagatcttcccgggcaagaagagtgtggtttccgagtatgtggccgaacactgggccgaagatacattttttggatatcaatacctgaacggggtgaatcctggcctcatcagaaggtgtacgagaattcccgataagttcccagtgactgacgacatggtggccccgttcctgggcgaagggacctgtctgcaggctgagctagagaaggggaacatctatttggccgactaccgcattatggaaggcattcccacagtggaacttagcggccgaaaacaacatcattgtgcccccctgtgtcttctgcacttcggaccagaaggtaagatgatgccgatcgccatccagctatcccagacccctggccccgactgtccaatttttcttccctccgatagtgaatgggattggctgctcgctaaaacctgggtgcgctatgctgagttttacagtcacgaagccatcgcacacctgctggagacacatctgattgccgaggctttctgtctcgcactgctgaggaatctgcccatgtgccatcctctgtacaaacttctcatcccacataccagatacacagtgcagatcaacagtatcggaagagcagtcctgctcaacgaaggcgggttatccgccaaagggatgagtctgggcgtggaaggctttgccggtgtgatggtgagagccctgtcggagctaacttacgactcactgtatttgccgaacgactttgtggaaaggggagtacaggacctccctgggtactattaccgcgatgatagcctcgccgtctggaatgccctagagaagtatgtcactgagattataacttattactatccctctgacgctgctgtcgagggtgaccccgaactgcaatcctgggtgcaggagatcttcaaggagtgtctgcttggtagggaaagcagcgggtttcctaggtgcctcagaacagttcctgagctaattcgatacgtcacaattgtgatatacacttgcagcgcgaagcatgcggctgtcaacaccggacagatggaattcacagcatggatgcctaattttccggcttcaatgaggaacccgcccattcagaccaagggtctgaccactctagaaactttcatggatactctgccagatgtcaaaacaacatgtatcacacttcttgttttatggactctgtcccgagaaccagacgaccgacgcccattggggcacttcccagacatccacttcgtggaagaagcccccagacgatcaatagaggcattccgacagaggctgaaccagattagtcacgacataagacagcggaataagtgcctgcccataccgtactactacttggacccggtgctaatcgaaaattccatatcaatatag

SEQ ID NO: 108572 - DNA, 1989 bp, Artificial Sequence
  Description of Artificial Sequence: Synthetic coding sequence
atgggtctctaccgcatccgggtttccaccggagctagcctatacgcaggctcgaataatcaggtgcagttgtggttagtcgggcagcatggcgaggccgcgcttggcaaaaggctctggcctgcaagaggtaaagaaacagaactaaaagtagaagttcctgagtacctcgggcctctgttgtttgtgaaactgagaaaacgccatctactgaaggatgacgcgtggttctgtaactggatttctgtccaaggacctggagctggcgacgaagtcaggttcccctgttaccgctgggtggagggcaatggggtacttagcttgccagagggcaccggacgcactgtcggtgaagatcctcaggggctgttccagaaacaccgtgaggaagagctcgaagaacgaaggaaactgtacaggtggggaaattggaaggatggactaatccttaatatggccggcgccaagctgtatgatctgcccgtcgacgaaaggtttcttgaggataaaagagtggatttcgaggtgtccctcgccaagggtctggccgatctggcgattaaagactcactgaacgtccttacctgctggaaggacctcgatgactttaatagaatcttttggtgcggacagtcaaaactggcagagcgtgttcgcgacagctggaaagaagatgccttatttggctaccagttcctcaatggtgccaaccccgtcgtgctgcgtagatccgcccatctccccgcaaggttggtcttcccgcccggcatggaagagctccaggctcaactggaaaaggaactggaggggggaactcttttcgaagctgatttttcactcttggacggaattaaggcaaatgttattctgtgctcacagcaacacttagccgcaccactggtgatgctaaaattgcagcccgacgggaagctgctgcctatggttatccaactccagctcccgcggactggtagccctcctccacccctgttccttccaacagaccctccaatggcctggctccttgccaaatgctgggtgcgaagctccgattttcagcttcacgaacttcaatcccaccttctgcgtggacacctgatggcggaggttatcgtggtagcaaccatgcgctgtctgccctccatacacccgatcttcaaactcatcataccccacctgagatacacccttgaaatcaacgttcgggcgcggaccggcctggtgagcgacatggggatttttgaccagatcatgtccacgggcgggggggggcacgttcagctgcttaagcaggctggagcgtttctcacgtactcgtccttttgcccaccagatgacctggctgatcgcggcctgctgggggttaagtcttctttttatgctcaagacgctctccggctgtgggaaataatctaccggtatgttgaagggatcgtgtctctgcattacaaaaccgacgtggcagtgaaagatgaccccgagttgcaaacttggtgcagagaaatcacggagattggtcttcagggcgcacaggatcggggctttccagtttcgctacaggcacgggaccaagtgtgccatttcgtgacgatgtgcattttcacatgtaccggccagcacgctagtgtacacctgggccagctcgactggtacagttgggtgccgaatgctccctgcactatgagactgcccccaccaaccaccaaggacgctacacttgagaccgttatggctacgttgcctaatttccatcaggcctcgcttcagatgtctatcacctggcagttgggaagaaggcagcccgtaatggttgcagttggccaacacgaggaagaatacttctctggtcccgagcccaaagctgtgctgaagaagtttagagaagaactcgcggcactcgacaaggagatcgaaatcaggaacgctaagctcgatatgccatacgagtatctcaggccttccgtggttgagaatagtgtcgcaatctag

SEQ ID NO: 108573 - DNA, 2055 bp, Artificial Sequence
  Description of Artificial Sequence: Synthetic coding sequence
atgctcaaaaggaacgaaagtcagtggttggcgcagcgccgacggtcagagacgtctctcagtaaaatgggactgtatcggatcagggtttcaaccggtgccagcctatatgctggaagcaacaatcaggtgcaactttggcttgttgggcagcatggagaggcagccttggggaagcggctctggccagcacgcggcaaggaaactgagctcaaagttgaagtgcctgaatacctcgggccattactgtttgtgaagctgcgcaagcgccacctgctaaaggacgacgcttggttttgtaactggatctcagtgcaggggcccggcgcgggggatgaagtgcgattcccttgttaccgatgggtggagggcaacggggttctgagcctaccagaaggtacaggccggactgtgggagaagatccacagggtctgttccagaagcatagggaggaggaactcgaagaaagacggaaactataccggtggggcaattggaaagacgggctgatcctgaatatggcgggagcaaaactgtacgatctgcctgtggatgagagatttctcgaggataaacgagtggacttcgaagtgtctctcgccaaaggtctcgctgatctggccatcaaggattctcttaacgtattaacttgctggaaggaccttgatgatttcaatcgaatcttctggtgcggtcagtccaagctagccgaacgcgttagagatagttggaaggaagacgccctttttggatatcagttcctgaacggggccaatccagttgtgttgcggagaagtgctcatctgccagccaggctggttttcccccccggcatggaagagctgcaggcacaattggagaaagaactggagggaggcactctgttcgaggcggacttttcattgctagacgggatcaaagcgaacgttatcttatgtagccagcagcacttagccgcccccctggtgatgctgaagctgcagcctgacggaaaattactacccatggtaattcaattgcagctcccgcggacaggctctcctcctccccctctctttctcccgaccgaccccccaatggcctggctcctggccaaatgttgggtaagaagcagcgatttccagctgcacgaactgcagagccatctgctccgcggccaccttatggccgaagtgattgtggtcgccacaatgcgttgcctcccgtccatccaccctatctttaagctcattataccacatttaaggtataccctcgaaattaatgtacgggctagaactggactcgtgagtgatatgggtatattcgaccaaatcatgagtacaggtgggggggggcatgtccagcttctgaaacaggctggagccttcttgacctatagcagcttctgcccacccgatgacttagcagataggggactgctgggtgtgaagtccagtttctatgcccaggacgccctgagactatgggagataatttacaggtatgttgagggcatcgtttccctacattacaaaactgacgtggccgtcaaggatgatcctgagctgcagacttggtgtagagagatcaccgagattggcctccaaggagctcaggaccgtggtttcccagtttctttgcaggctcgggatcaggtgtgccatttcgtgaccatgtgcattttcacctgcaccgggcaacatgcttccgtccacctgggtcagctagattggtattcatgggtacccaacgccccctgcacaatgaggttaccgcctccaactacgaaggatgccacgctggaaaccgtgatggccaccttgcctaactttcaccaggcctccctgcaaatgagtatcacctggcagctgggcagacggcagcctgttatggtggccgttggccagcatgaggaagaatatttctctggtccggagcccaaagcagtcctcaagaagtttcgcgaggaattggccgctcttgacaaagaaatcgaaatcaggaacgctaagctggacatgccatacgagtacctacgacccagcgtagttgagaattccgttgcaatttag

SEQ ID NO: 108574 - DNA, 1989 bp, Artificial Sequence
  Description of Artificial Sequence: Synthetic coding sequence
atgggactgtacaggatacgggtatcaaccggagcaagtctttatgctggcagtaataatcaggtgcagctgtggctcgtgggccagcacggcgaagccgccctggggaaaagactgtggccggctaggggcaaggagaccgagctgaaagtagaggtgccggagtacctgggacccctgttgtttgtgaaactaaggaagcgccatctactgaaagacgatgcgtggttctgcaattggataagcgtgcaaggccccggcgctggggatgaggtcagattcccgtgctatcgctgggtggaaggaaacggagtcttatccttgcctgagggaactgggaggacagttggggaggatccacaggggcttttccaaaagcacagagaggaagaattggaggagaggagaaaactctaccgatggggaaactggaaggatggtcttatcctgaacatggcaggcgccaagctgtacgacctaccagtcgacgagcgattcctcgaggacaaaagagtggatttcgaggtatccctcgctaaaggcctcgccgacttagccattaaggacagtctaaacgtgttgacctgctggaaagacctcgacgatttcaaccgcattttttggtgcggacagagcaagttggcggagcgggtcagggacagttggaaggaggatgctcttttcggctaccagttcctgaacggggctaaccccgttgtgcttaggagaagcgcgcacctacccgcccggttagtgtttccacccggcatggaagagctgcaggcccagctggagaaggaactcgagggggggacattgtttgaagcagatttttccttactggacggaatcaaggctaatgtaatactttgctcccagcagcacctcgcagccccacttgtcatgttgaagctgcaacccgacggcaaacttctgccaatggtcatccagttgcaattgcctagaacggggtccccaccccctcccctattccttccgaccgacccccctatggcatggctgctcgctaagtgttgggttcgaagctccgattttcagctccatgaactgcagtctcatttactcagaggccacttgatggccgaagtgatagtggtggcaaccatgagatgcctccccagcatccacccaatctttaagctgattatccctcaccttcgctacactctcgaaatcaatgtacgcgcccggactggtttggtgtccgacatgggaatctttgatcagatcatgagcactggtgggggcgggcatgtgcaacttcttaagcaggctggggcattcctgacatattccagtttttgtccgccggatgatctggcagaccgaggccttttgggcgtgaagagtagcttctatgctcaggatgctttgcgtctgtgggagattatctaccgctacgtggaagggatagttagcttacactacaaaacagatgtggccgtaaaggacgacccagaactccaaacctggtgcagggagatcactgaaattggacttcagggcgcccaagaccgggggttccccgtgtctctgcaggccagggaccaagtttgtcactttgtaactatgtgcattttcacctgcacaggccaacacgccagtgtgcacctgggacagctcgattggtactcatgggttcccaacgccccttgtactatgcgtctccctccccctaccactaaagacgctactctggagaccgtgatggctaccctgcccaactttcaccaggcttcgctccagatgagcattacctggcagcttgggagacgccagccggtcatggtagcagtgggtcaacatgaagaggagtatttcagtggccccgagcccaaggccgtcctcaaaaagtttagggaggagctcgcagcactggataaagagatcgagatcaggaatgcaaaactagacatgccatatgagtatctacggcctagcgtggtggagaattctgttgccatatag

SEQ ID NO: 108575 - DNA, 486 bp, Artificial Sequence
  Description of Artificial Sequence: Synthetic coding sequence
atggaccaggagaccgtgggtaacgtcgtgctcctggccatagtcaccctcatttcagtggtgcagaacggcttctttgctcataaggtcgaacacgagtcaagaacccaaaacgggcgctctttccagaggacgggtactctcgcattcgagagagtttatacggccaaccagaattgtgtcgatgcctacccaactttcttagccgtactgtggtcagccggtctgttatgctcacaggtccccgccgcctttgctggactgatgtacctgttcgtgcggcaaaaatacttcgtgggatatctgggagagagaacgcagtctactccggggtatatcttcggcaagaggatcatcctattccttttccttatgtccgttgctggcatcttcaattattacctgatattcttcttcggcagcgatttcgagaactacataaagactatctctaccacaattagtccacttctgctcatcccatag

SEQ ID NO: 108576 - DNA, 2532 bp, Artificial Sequence
  Description of Artificial Sequence: Synthetic coding sequence
atgccccggggtgcatttagaccctgtctgccagcactttatttcgcctttctaacctgtcccactcctgagcaaagaatgagcgggactcaggcgccggacatccacctgggcgagccagctcgcgggacaggctgcgtgagaggcaagcaaacaagtatccgggtgcaggattgcgggagacgcgaagaggcgagagcggcaagcagagagttacggagagagaaagctcaggaacacccaagggagtcctgggctcatccccagccctaccccgcaccacagccattggcgcttcggccagagacccaaccttgtcccgcatgccgctccagtccccccggcaggttattgttgcgtccagctctccccggccatccctttttactgcctatcatggccgtgtacaggctctgtgtgaccaccggcccttacctgcgagccggaacgttggataatatatccgtcactctggtgggcacatgtggcgaatcacccaagcagaggctcgatcgcatgggccgcgacttcgcacccggtagcgtccagaaatataaagtacgctgcaccgccgagctgggcgagctgttgctgctgcgcgtgcacaaagagaggtacgcattctttcgaaaagacagctggtactgttctaggatatgcgtcaccgagcccgatggttccgtgagtcacttcccctgttatcaatggatcgagggctactgcacagtggaactgcgaccaggaaccgcacgaacaatctgtcaggacagcctgccacttctgcttgaccatcgaacgagggagctgcgagctagacaggaatgttaccgctggaaaatatatgccccaggttttccttgcatggtcgacgttaattcttttcaggagatggaatctgacaaaaagtttgcactgaccaaaaccaccacatgtgttgaccagggggacagttcagggaatagatatctccccggtttccccatgaaaattgacattccttcactgatgtatatggaaccaaatgttcggtactcagctaccaaaaccatctcactactgtttaacgctatccctgcttccttaggcatgaagctccggggattgctggatcgcaagggctcctggaaaaaacttgatgacatgcaaaacatcttttggtgtcataagacgttcactaccaagtatgtgaccgagcactggtgtgaggaccactttttcggttaccagtatcttaatggtgtcaaccccgtgatgctgcactgcatctctagcctaccctcaaagctcccggttacaaacgacatggtggcacctcttctggggcaagacacttgcttacagaccgaactcgagcgcggaaatatctttctcgctgactactggattctcgctgaggcccctactcactgcctgaatggtaggcagcaatatgtggccgcaccactttgtttactatggctgagcccgcagggggcgctggtgccactcgccatccagttatctcagacccccggccctgatagccctatcttcttacctaccgactctgaatgggactggctgctggccaaaacctgggtgcgcaatagcgaattccttgtccacgagaacaacactcacttcctctgtactcatcttctgtgcgaggcattcgcgatggccactttgcggcagctgcccctatgccaccctatctacaagttgcttctgccgcacaccagatatacactgcaggtaaacactattgcccgcgctacactgctgaacccagagggcctggtcgaccaggttacaagtatcggtagacaggggctgatctatctgatgtccaccggactcgcacacttcacgtacactaacttttgcctcccagacagccttagagcaagaggggtcttagccataccaaactatcattatcgagacgacggacttaaaatttgggctgcaattgagtcatttgtcagcgagatcgtagggtactactatccatcggacgcctctgtacagcaggacagcgagttacaagcctggacgggtgagatctttgcgcaagcctttttagggagagaaagctcaggcttcccatcgagactgtgcacccccggcgaaatggtgaaatttctcacagcgatcattttcaattgcagtgcccagcacgccgcggtcaattccggccagcacgactttggcgcttggatgccaaacgccccttcctccatgagacagccccccccccaaacaaagggaacgacaacgttgaagacctatctcgataccctgccagaggttaatattagctgtaataacctgctcttgttttggctggtgtcacaggaacctaaggatcaacggccccttggtacatacccagatgaacacttcacggaggaagctccaagacgctccatagccgcattccagtcccgtctggcacagatctcacgcgatattcaggaaaggaaccaaggactggccctgccctatacatacctggatcccccactcatcgagaattccgtctcaatctag

SEQ ID NO: 108577 - DNA, 2604 bp, Artificial Sequence
  Description of Artificial Sequence: Synthetic coding sequence
atggggagaaatcggagctggggtacactcggttccggcagaacgtctacacctggtcaccaatcaggccccctgacaagaagacgagccgtcagtcagctgtacagacgatacttgctgttctccatctcagctagcgacccttctcttaggagcggtactcaggctcccgatatccacctgggggagccagcccggggcacggggtgcgtgagggggaaacagactagcattagggttcaagactgtggcagacgtgaggaggcacgggccgcctcccgagaactccgcagagagaaagctcaagaacatcccagggaaagctgggcccacccacagccataccctgctccacagccactcgcattacggcctgaaactcagccttgtcctgcatgtagaagttctccaccaggcagactcctgttgaggcccgccctccccggacaccctttcctcttgccgataatggccgtttaccggctatgcgtgacaaccgggccttatctccgggctggcaccctggacaacatttccgtgacgctggtcgggacatgtggcgagtctccaaagcagcgacttgacaggatggggagagatttcgcaccaggatctgtccagaagtataaagtgcgctgcaccgctgagctcggcgagttgttgctcctgagagtgcataaggagcgctacgccttcttccgcaaagattcatggtactgcagtcgcatttgcgtgacagaacccgatggcagcgtgtcgcacttcccttgctaccaatggatagaagggtactgtacggttgagctgcgacccgggaccgctcgaacaatttgtcaagattcgctgcccctgctgctcgaccacagaactcgagaacttagggctagacaggagtgctataggtggaagatttacgcacctggtttcccatgtatggtggatgtgaacagttttcaagagatggaatcagacaagaaatttgctttaactaagacgactacttgtgttgatcaaggtgatagttcggggaatcgctacctgccagggttccctatgaagatagatatcccatccctgatgtatatggagcccaacgtacggtattccgcaacgaaaaccataagtctcctcttcaacgcaatcccagccagcctcggcatgaaacttcgggggctgctggacagaaaaggatcctggaagaagctcgacgacatgcagaacattttctggtgtcacaaaacattcacaacaaaatacgttactgagcactggtgcgaagaccacttttttggttaccaatacctcaatggcgtcaatcctgtgatgttgcactgcatttcctctctgccttccaaattacctgtaacgaacgacatggtcgcgcctctcctgggacaggacacgtgcctccagacagagctcgaacggggtaacattttcctggctgattactggattctggctgaggcccctacacactgcttgaatgggaggcagcagtacgtcgccgcaccgctctgtctgctctggctgagtcctcagggagccttggtgcccctcgccattcagctctctcagactccaggccccgacagccctatcttcctgcccacggattctgagtgggactggctactggctaagacgtgggttagaaattccgaatttcttgtgcacgaaaataacacacatttcctctgtacacacctactatgtgaagcattcgccatggcgacacttcgacagcttccactgtgtcacccaatatataagttactgctccctcatactcggtatacattgcaggtcaatacaattgccagagcaaccctcctgaatcccgagggactcgtggaccaggtcacctctatcggccggcaagggctgatctatctaatgtccaccggcctcgcacacttcacatatacaaatttttgcttacccgacagtttaagagcccggggagtgctggctataccaaactatcattaccgggacgacggactgaaaatctgggctgccatcgaaagctttgtgagcgagatcgtcggatactactatccgtcagatgccagcgttcaacaggacagtgagctccaagcctggaccggagaaatcttcgcccaggcattcctcgggcgcgagtcaagtggttttccctccaggctgtgcacccccggggagatggttaaatttttaactgcaattatattcaactgtagcgcacagcatgctgctgtgaattctggccagcacgatttcggtgcgtggatgcctaatgccccctcgagcatgagacagcctccacctcagactaagggcacaactacactgaaaacgtacctagataccctgcctgaggtaaacatctcatgcaataacctgttacttttctggttagtgtctcaggagcccaaagatcaacgaccccttggaacctacccagacgagcacttcacagaggaagctccgcgacgcagtatagctgctttccagtctcgtttagcacagatatctagagacattcaggaacgaaaccaggggctagcactcccttacacctatctcgaccctcccctcatagaaaattcagtgtccatctag

SEQ ID NO: 108578 - DNA, 2136 bp, Artificial Sequence
  Description of Artificial Sequence: Synthetic coding sequence
atggccgtataccgcttgtgtgtgaccacaggcccatatctgagagcaggcacactggacaatatcagtgtgacactcgtcggcacatgtggggagtccccaaagcagcgcttagaccggatggggcgggattttgcacctggcagtgtgcagaaatacaaggttcgttgcaccgcagaactgggggaattgctgttgctgagagtgcataaagaacgttacgccttttttagaaaagatagctggtactgtagccgcatttgtgtgactgagcctgatggcagcgtgtctcatttcccttgctatcaatggatcgaaggctactgtacagtggagcttcggcctggtacagccagaacaatatgccaggacagcctgccattattgttagatcacagaacccgggagttgagagcccgtcaagagtgctatcgttggaagatttacgctcctggcttcccctgtatggttgacgtgaacagttttcaggaaatggaatcagacaagaagtttgctttgacaaagacaactacatgtgttgatcagggtgattccagcgggaatagatatttgcccggattcccaatgaaaatcgatatccctagcctgatgtatatggagcccaatgtgcgctattccgctacaaagactatttctctgctgttcaatgctatccccgcgagtctcgggatgaaactgcgcggtctcttggatcggaagggcagctggaaaaagttagatgacatgcagaacatcttctggtgccacaagactttcacaacaaagtacgttactgagcactggtgtgaagatcacttctttgggtaccagtatctgaatggcgttaaccctgtgatgctgcactgtatctctagccttccgagtaagttgcctgttacaaacgatatggtagctcctttgttaggacaggatacctgcctccagaccgagctggaaaggggcaatattttcctggccgactattggatcttggcggaggctcctacccattgtttaaatgggcggcaacagtatgttgcggcccctctgtgcctgctctggctcagccctcagggcgccttagtacctctcgccatccagctgagccagacgcctgggcccgattcgcctatctttcttcctaccgattccgagtgggactggctgctagctaagacctgggtccgaaattcagaatttctcgtccacgaaaataatactcacttcctttgcactcatctgctctgcgaagcattcgctatggccactctcaggcagcttcccctctgtcacccaatttacaaactgttactgccccacacccgctatacgttgcaggtcaatactattgccagggcaacacttctgaacccagaaggacttgtcgaccaagtgacgtccatcggtagacaaggcctgatttacctaatgagcacaggattggcccactttacatatacgaacttctgcctcccggacagcctgcgtgcacggggggttttggcaatccctaactaccactacagagatgacggcctcaagatatgggccgcaattgagagttttgtatccgaaattgtgggatactactacccaagcgacgcttccgtgcagcaggattcagaactgcaggcttggactggggaaatttttgctcaagctttcttgggtcgtgaatctagtggtttcccttcccgattatgcactcctggggagatggtgaagttcctgactgccattatattcaattgcagtgcacagcacgccgcagtgaactcaggacagcacgatttcggtgcctggatgcctaatgccccctcaagcatgaggcagccccctccccagacgaaaggcacgactactctgaagacatacctcgacacacttcccgaagtgaacatttcctgtaacaacctgcttctgttctggctggtgtcgcaggagcctaaagatcagcgaccactgggaacttatccagacgagcacttcactgaggaagctccacgcaggagtattgctgcctttcagtcccggttagcccagatctcccgcgatatacaggagagaaaccaaggtctagcgctgccgtatacctacctggaccctcccctgatagagaacagcgtgagcatttag

SEQ ID NO: 108579 - DNA, 759 bp, Artificial Sequence
  Description of Artificial Sequence: Synthetic coding sequence
atggaacctcagtcaatgaaggggcagaagagaccatttggggggccttggcgtcttaaggtcctgggagggcctccctggcttaggcggaccctcccaaagctgggcagaccgaaggaagcacctgtggcacgcatgtctactcagagcacacatccactgaaacccgaggccccaaggctccccccagggatccccgagtctccgtcttgccaacggaggcacacccttcccgcaagcgagtttaggtgcttgacacccgaggatgccgtgtccgcattcgagattgaacgcgaggccttcatctcagttctgggagtgtgtcctctctaccttgatgaaattcggcactttttaacattgtgtccagagctgtcgttaggatggttcgaggaagggtgcctcgtggcatttatcattggcagcctgtgggataaagagcggcttatgcaagagtccctcacactgcatcggagcggagggcacatagcacatttgcacgtgttagctgtacacagagcttttcggcagcaggggcgcggtccaatattgctgtggcggtacttgcatcacctgggttcacagcctgcagtcaggcgggcggctctaatgtgcgaagatgcgctggtaccattctatgaaaggttcagtttccatgctgtcgggccatgcgctattaccgtagggtcactgaccttcatggaactgcactgctccctgaggggccacccatttctgcgacggaatagtggttgttag

SEQ ID NO: 108580 - DNA, 624 bp, Artificial Sequence
  Description of Artificial Sequence: Synthetic coding sequence
atgagcacccagagtacacacccactcaaacctgaggcccctagactaccgccagggatcccagaatcaccatcctgtcagcggcggcacacactgcccgccagcgagttcaggtgcctgacgcctgaggacgcagtgtcagcttttgagatcgagagggaagcattcatctccgtgctcggagtttgtccactctacctggatgaaatccgacactttctcactttgtgccctgaactgagtctgggctggttcgaggaaggatgcttagtggcattcataataggttctttatgggataaagagcgtcttatgcaggaatccctcaccctgcacaggtctggtgggcacattgcccacctgcacgtgttagctgtgcatagggccttccgccaacagggtaggggacctatcctgctctggcggtacctgcaccacctcggctcccagcctgccgtgaggagagcagccctgatgtgtgaagacgcactggtccccttctacgaacgcttctcctttcacgccgtgggaccatgcgccataaccgtgggaagcctgaccttcatggaactgcactgctctctaagaggccacccctttttacgacgtaactctggttgttag

SEQ ID NO: 108581 - DNA, 1536 bp, Artificial Sequence
  Description of Artificial Sequence: Synthetic coding sequence
atggtgcttctggctgccgctgtttgcacaaaagcagggaaggctatcgttagtagacagtttgttgaaatgacacggacacgtattgaaggactgctggctgccttccccaaattgatgaataccgggaagcaacacacctttgtggagaccgaaagtgtacggtacgtttatcagcctatggaaaaactgtatatggtgctaattactaccaaaaactctaatattttggaagatctggaaaccttacggctgttcagtagagtcataccagagtactgtcgtgccctcgaagagaatgagattagcgaacactgtttcgatctgatatttgccttcgacgaaattgtggctttgggatatcgggagaatgtgaacctggcccagattagaacttttacagaaatggacagtcatgaggaaaaggtcttccgcgccgtgcgagaaactcaggaacgcgaggccaaggccgagatgaggcgcaaagcaaaagagctgcagcaggcgagaagggacgcagagcgtcagggtaaaaaagcaccagggtttggcggatttggctcatccgcggtctctggggggtccacagctgctatgattactgagaccataattgagacagataagcccaaggtggcacccgcacctgcacgaccttctgggcctagtaaagccctgaagctaggggcgaaaggtaaggaggtggacaatttcgtagataaactcaaatctgagggagagaccatcatgagtagcagtatgggcaaacggacatctgaagccacgaagatgcacgctccacctattaatatggagtccgtccacatgaagattgaagaaaaaatcacactcacttgtggacgcgacggcggactccagaacatggagctgcacggcatgatcatgctgcgaatttccgacgataaatacggacggatcaggctccatgtggaaaatgaggataagaaaggcgttcagttacaaacccaccctaacgttgacaagaagctcttcactgcggagagcctgattggcttaaaaaaccctgagaagagcttccccgtgaactccgacgtgggtgttctcaagtggcggctgcaaaccactgaagaatcatttatccccctgactatcaattgctggccctcagaaagtgggaatggatgcgatgtgaacattgagtatgaactccaggaagacaacctggaacttaatgatgtagttattacaatccccctgccatcaggagtgggggccccagtaatcggggaaattgatggcgaatatcgtcatgactcacgccgtaacaccctggagtggtgtctgcctgtcatcgacgccaaaaacaagtcagggagcctcgagtttagtatagcaggacagccgaacgacttctttccggtgcaggtttcattcgtgagcaaaaaaaactattgtaatattcaggttaccaaagtgacccaggtcgacggaaactcgcccgttagatttagtaccgagaccactttccttgtcgataaatatgaaatactgtag

SEQ ID NO: 108582 - DNA, 1659 bp, Artificial Sequence
  Description of Artificial Sequence: Synthetic coding sequence
atggccgagtgcaatctggtcgcaatcttgattagtagcattgacaaccctcttgacaagaatttggataacgggggcaatagctgtctggactttcggcctctaaattctttctcccaaccacaggtgctgctggctgctgcagtatgcaccaaggccgggaaggccatcgtatccagacagttcgtggagatgacccggacccgaatagagggactgctagccgcattccctaaactaatgaataccgggaaacaacacacattcgtggaaacagagtctgtgaggtatgtgtaccagccgatggagaaattgtacatggttctcatcactactaagaacagtaacattctagaggatctggaaacactgcgccttttctcacgggtcatacctgaatactgcagggctctggaggaaaatgagattagcgaacactgcttcgacctaatctttgcatttgatgaaatcgtagcactgggctacagagaaaacgtgaatctggcacagattcggacatttacggaaatggactctcacgaggaaaaggtttttagggctgttcgagagacacaggaacgggaggccaaggccgaaatgcggcgtaaagccaaggagctgcagcaagcacgacgggacgctgaaagacagggcaaaaaggcccccggatttggtggcttcggctcgagcgcggtttcaggtggttccactgctgctatgattaccgagaccattatcgaaacagataaacctaaggttgcgcctgcccctgccaggccatccggtccctctaaagctctgaagctcggtgccaaggggaaggaggtcgataactttgttgataaacttaagtcggagggcgaaacaatcatgtcttcaagcatggggaaacggaccagcgaggctactaaaatgcatgcaccaccaattaatatggagtctgtgcatatgaagattgaggagaagatcaccctgacctgtggaagggatggcggcctgcagaacatggagctgcatgggatgattatgctacggataagcgacgataagtatgggcgcatccgactgcacgtggaaaatgaagataagaaaggggtgcagctgcagacccatcctaatgtagataaaaagctgttcaccgctgaaagtctgattgggttgaaaaacccagaaaaatcctttccagttaattctgacgttggcgtgctaaagtggcgcctccaaacgacagaggaatctttcatccccctgaccattaactgctggccttccgaatctggcaacggctgcgatgttaatatcgaatacgagctacaggaggacaatctggagttaaatgacgtagtcatcacaatccccctcccttctggcgtaggcgctccagtgattggggagatcgacggagagtacaggcatgacagtcgaaggaacacattggagtggtgtctgccggttatagacgccaagaataagtcgggcagtctggaattttctatcgccgggcagcctaacgactttttccctgtgcaggtgtctttcgtcagcaagaaaaattattgtaatatccaggtcaccaaggtgacccaggtggacggcaattctcccgtgcgcttcagtaccgaaacaacatttctagtggataaatatgagatcttatag

SEQ ID NO: 108583 - DNA, 1272 bp, Artificial Sequence
  Description of Artificial Sequence: Synthetic coding sequence
atgattccagagtactgccgggcactggaggagaacgagatctccgagcattgctttgacctgatcttcgcgttcgatgagattgtggccctcggatatagagaaaacgtcaacctcgcccagattcgcacctttacagagatggattcccatgaggaaaaagtgtttcgcgcagtgcgcgagacacaggagcgagaagccaaggccgagatgagacgaaaggcgaaggaactgcagcaggctcgccgggatgccgaaaggcagggaaagaaagcccccggctttgggggcttcggctcatctgctgtctccggcggctctaccgcagcaatgatcaccgaaaccatcatcgaaaccgataaacccaaagtggcgccagcccctgcaagacccagcggaccttctaaagctctgaaattgggagctaaggggaaggaagtagataactttgtcgacaagctgaagtccgagggagaaaccattatgagcagtagcatgggtaaacgcacctctgaagcgaccaaaatgcatgcacctccaattaacatggagtccgtccacatgaagatagaggagaaaatcacccttacatgtgggagagatggcggattgcagaacatggagctgcacggcatgataatgcttagaatctccgatgacaagtatggacggatcaggctgcacgtggagaatgaagataagaagggcgtgcagttgcagacacatccaaacgtcgacaagaaacttttcaccgcggaaagtctcatagggctgaagaatcccgagaagagtttccctgtcaattccgatgtgggcgttttgaaatggagactgcagacaactgaagaaagcttcatacccctgacgatcaactgctggccatctgagagcggcaacggatgtgacgtaaatatcgagtacgagctgcaggaggataaccttgagctgaacgatgtggtgattaccattccactgccttctggggtgggcgcacctgtcatcggcgaaatcgatggggagtatagacacgactctaggcggaacaccctggagtggtgtttgccagttattgacgccaaaaacaaaagcggatccttagagttctctatcgccggacagcctaatgacttctttcccgtgcaggtttcattcgttagcaagaagaactactgtaatatccaggtgactaaggtgacacaggtggacggcaattctcccgtcaggttctctaccgaaaccacgtttttggtggataagtacgagattctctag

SEQ ID NO: 108584 - DNA, 570 bp, Artificial Sequence
  Description of Artificial Sequence: Synthetic coding sequence
atggtcttgctggctgccgccgtgtgcacaaaggcaggcaaagccatcgtgagtcggcaattcgtggagatgactcggactaggatagagggactattggcagccttccctaaactcatgaatacaggcaagcagcacaccttcgtcgagaccgagagtgtacgatatgtgtaccagcctatggagaagctgtatatggtgttaatcactacaaaaaattctaatatcttagaagacctggagacacttcgtctcttctcaagagtaatacccgaatattgtcgggctctggaggagaacgagatcagcgagcattgtttcgatctcatctttgcgtttgatgagattgtggccctaggttatcgcgaaaacgtcaaccttgctcagatccggacatttacggagatggacagccacgaggaaaaagtgttccgagctgtgcgggaaacccaggagcgggaagccaaagccgagatgcggagaaaggccaaggagctgcaacaggcacagagcgtgggcatcacaggaatgtctcaccacgcccagctgttactgtattttaatccttag

SEQ ID NO: 108585 - DNA, 2223 bp, Artificial Sequence
  Description of Artificial Sequence: Synthetic coding sequence
atgaccgtgaagctggatttcgaagagtgcctgaaagacagtcccaggtttcgcgcttccatcgaactcgtcgaagctgaagtgagtgagttagaaactagacttgagaaactcctgaaacttggcacaggtcttcttgaatctggccgtcactatctggccgcatctcgcgctttcgtggtcgggatttgtgacttagctcgccttgggcctccggaacccatgatggcagagtgtctcgaaaaatttacagtaagtctgaaccacaagcttgattcccatgcagaattgctcgacgcaacacagcatacgctacagcagcagatccagactttagtaaaggagggtctgaggggatttcgggaggctcgccgggatttttggcgcggggcggagtccctcgaggctgcactgacccataatgctgaggtgcccagacggcgcgcccaagaagctgaggaagccggggccgcccttaggaccgctcgggccgggtataggggcagagcactggactatgccctccagataaatgtgattgaggataagaggaagttcgacatcatggagtttgttctgaggttggttgaggctcaagccacacacttccagcagggccatgaggagctatcccgactgtcccagtacaggaaggaactaggcgctcagctccatcagttagtgctcaattctgcacgggagaagcgcgacatggagcagcgccacgtgctcctgaaacagaaagagctgggcggggaggaacctgagccttctttacgtgaaggaccaggagggctggtaatggaaggccaccttttcaaacgcgcttcgaatgcattcaagacctggtccagaagatggttcacgattcagtccaaccagctcgtctatcagaagaagtataaagaccctgtaactgtagtagttgacgatctccggctgtgtacagtgaaactatgcccagactctgaacgcaggttttgctttgaagtggtcagtacttcgaagagctgcctgctccaagccgactctgagaggctgctccaactatgggtgtcagcggtgcagagcagtatcgcaagcgctttttcccaggccaggctggatgattccccaagaggtcctggtcagggatccggccacctggccatcggcagcgctgcgaccttgggatctggcggcatggcacggggccgggagcctggaggcgtgggacacgtggtggcccaagtccagtccgtcgacggtaacgcacagtgctgcgactgtcgcgagcctgcgcccgaatgggcaagcataaatctcggcgtgaccctgtgcatccaatgctctggtattcacaggtctcttggggtacacttctccaaagtaaggtctcttacccttgactcttgggagcccgagttagtgaaattgatgtgcgaactcggtaatgtcataatcaatcaaatctatgaggctagggttgaggccatggccgtcaagaagcctggaccctcctgttccagacaagaaaaagaagcctggattcatgcgaaatatgtcgagaagaagtttctcaccaagcttcccgaaattcgcggacggcgaggagggcggggcagaccccgaggccaaccaccagtgccaccaaaacccagcatccggcccagacctgggagtcttagatccaagcctgaaccccctagcgaagatttgggtagcctgcatcccggagcattgctctttcgtgcgtcaggtcatcccccttcactcccgacgatggctgacgctctggcacatggcgctgatgttaactgggtgaacgggggccaggataatgcaaccccgctcattcaggccactgccgcaaactcgcttctggcctgcgagtttctcctgcaaaacggggctaatgtgaaccaagcagacagcgccggccggggacctttacaccacgccactatccttgggcacaccggactcgcctgcctctttctcaaaagaggcgccgatcttggcgctcgagatagcgagggcagggacccactgactattgctatggagacagctaatgcggatatcgtcacccttcttcgtctcgcaaagatgagagaagcagaagccgcacagggtcaggctggagatgagacatatctggacattttccgagatttctcccttatggcgtcggatgacccagaaaagctgagcagaaggtctcacgatctacacaccctctag

SEQ ID NO: 108586 - DNA, 2337 bp, Artificial Sequence
  Description of Artificial Sequence: Synthetic coding sequence
atgaagatgacggtagattttgaggagtgcctaaaggatagtccacgattcagagcggctctagaggaggttgagggagatgtagcagagctggagttgaaactggacaaactggtcaagctgtgcatcgcaatgatcgacacaggtaaagccttttgtgtggccaacaagcagtttatgaatggtattagggatttggctcagtatagctccaatgatgctgttgtagaaacgagcctcactaagttcagcgactcgctccaggagatgatcaacttccacactatcttattcgaccagacccaacgttcgattaaggcacagctgcaaaattttgttaaggaagatctccgcaagttcaaggacgcaaagaaacagtttgagaaggttagcgaggaaaaggagaatgctttggtgaaaaacgcgcaggtccaacgcaataagcagcacgaagtggaggaggcaactaacattcttaccgccacacgcaagtgctttcgtcacattgctctagactatgtcctccagattaacgttcttcaatctaagcggcggtcagaaatcctgaagtccatgctaagttttatgtatgctcacttggccttctttcatcagggatacgacttattttccgaactcggaccctatatgaaggatctgggagcccagctggacagactcgtcgttgacgccgccaaagagaaacgcgagatggaacagaagcattccaccatccaacaaaaggattttagctcagatgactccaaactggaatataacgtagatgcagcaaatggtattgtcatggaaggctacttattcaaaagggcttctaacgcgtttaagacttggaaccgcaggtggttcagcatccagaacaatcagttagtgtatcagaaaaaatttaaagacaatccgactgtcgttgtagaggacctcaggctgtgtaccgtgaaacactgcgaggatattgaacgcaggttctgttttgaggtcgtgagtcctactaaaagttgtatgctgcaggccgattccgagaaactgaggcaggcctggattaaggccgtgcaaacctcaattgcaacagcctatcgggaaaagggtgacgagtccgagaagctcgacaagaaatcctccccgagcaccggcagcctggacagtggaaatgagtcaaaagagaagcttctcaagggtgaatccgcactgcagcgggttcagtgtattcccgggaatgcctcgtgttgtgattgtggccttgccgatccgcgctgggcttccatcaacctggggataacgctgtgtattgaatgctccggaatccacaggagcctgggtgtccacttcagtaaggtgagaagcctgaccctggatacttgggaacctgagctgcttaagctcatgtgcgaacttggaaatgatgtcattaaccgcgtgtatgaggctaatgtcgaaaagatgggaatcaaaaagccacaacctggacagcgacaggagaaggaggcctacataagggctaaatacgttgagcgtaaatttgtcgataaatacagcatctcgttgtctccacccgagcaacagaaaaagttcgtcagtaaaagctcagaagagaaacggcttagcattagtaaatttggcccaggcgaccaggtgagagcctctgctcagtcctctgtacgtagcaacgatagtggcatccagcaatctagtgatgacggtagggagtcactcccttcgaccgtgtccgctaactcattatacgagccagagggcgagagacaggactctagcatgttcctcgattcaaaacacctcaacccaggcctgcaattgtatagggcgagttatgagaaaaatctacctaagatggcagaggccctcgcacatggggcagatgtgaattgggccaattctgaggagaacaaggccacccccctgattcaggcagttctcggggggagcctcgtcacatgcgaattccttctgcaaaacggggctaacgtgaatcagcgcgatgtccagggaaggggtcctctgcatcatgccactgtattagggcataccgggcaggtatgcctatttctgaagagaggagccaaccaacacgcgaccgatgaagagggcaaagatcccttgtcaatcgctgttgaagcagccaacgctgacattgtgacccttctgaggttggcgcgtatgaatgaagaaatgagagaatcagaaggattgtacggccaacctggggacgagacataccaggatatcttccgggatttttctcagatggcgtctaacaatccggagaaactcaaccggtttcaacaggacagtcaaaagttttag

SEQ ID NO: 108587 - DNA, 3618 bp, Artificial Sequence
  Description of Artificial Sequence: Synthetic coding sequence
atgactaaaaaagaagaaccgccccccagccgggtccccagggccgtgcgtgtcgcctcccttctttctgagggcgaagaactgagcggagatgatcaaggagatgaagaagaagatgaccatgcgtatgaaggtgtacctaatggggggtggcacacaagtagtctctccttgtctctgccctccactattgctgctcctcatcctatggatggccctcctggcgggagcacaccagtgactcccgtgattaaggctgggtggctggacaagaacccgccacagggatcatacatttaccagaagcgctgggtgcggttggatacagaccacctgaggtacttcgattcaaacaaggacgcctatagcaaacgatttatctcagtggcctgcatatcccacgtcgctgctatcggagatcagaaatttgaggttatcacaaataacagaacttttgccttccgagcggaatctgatgttgaacgcaaagaatggatgcaggccctgcagcaggcaatggccgagcagcgcgcaagggccaggctttctagcgcctacctgctaggggtgccgggtagcgaacagcctgatagagcagggtcgctagagctgcgagggttcaagaacaagctatatgttgccgtggtgggggataaggtgcagttgtacaaaaacctagaggaataccacctgggcattgggatcactttcatcgacatgtcagttggaaatgttaaagaagtagacagacggagttttgacctgactactccttacaggatattcagtttttccgcagatagcgagctcgaaaaggagcagtggcttgaagcaatgcaaggtgctattgcggaggcactgagcacgagcgaggtggccgagcggatttgggctgccgcccccaacagattttgtgctgattgtggagccccccagcccgattgggcctctattaatttatgtgtggtaatttgtaagagatgtgccggcgaacaccggggcttgggcgcgggcgtatcaaaggttagaagtctgaaaatggatagaaaggtgtggacggaaaccctcattgagctgtttctgcagctgggcaacggcgcaggcaaccgattctgggcagccaacgttccaccctccgaggctttacagccttcaagctccccatctacacggaggtgtcatcttgaggcaaaatacagggaagggaagtatagacgataccacccactgttcggcaaccaggaggagctggacaaggctctctgcgcagccgtcaccactacagacctcgctgagactcaggctctgctggggtgtggcgccggaatcaactgcttctcaggcgatccggaagctccaacacccctcgccctggcagaacaggccggtcagaccctgcagatggaattccttcgaaacaatagaaccacagaagtgcccaggcttgattccatgaaaccattggagaaacactattcagtcgttctgcccaccgtttctcatagtggatttttatataaaactgcttcagcaggaaaactgctacaagatagacgtgctagagaggaatttagccggcgctggtgtgttctgggtgacggggtgctatcctactttgaaaacgaacgtgcagtcactcctaatggggagattcgggcttccgagatcgtctgtctcgccgtccctccacccgatacccatggctttgagcacacctttgaggtgtatactgagggtgagcggctctacttgttcggtctcgaatctgctgaacaggctcacgaatgggtgaaatgcatcgccaaagcatttgttccccccctggcggaagacctgctggcgagggattttgagagactgggcagactcccgtataaggccggcttgtccctgcaacgggctcaggaagggtggtttagtctaagtgggagcgaactccgcgccgtgttccccgagggcccatgtgaagaacccctgcaactgcgcaagctgcaagagttatccatacagggcgacagcgaaaaccaagtcctggtcctggtggagcgccgacggaccctttatatccagggcgaacgtcgtttagactttatgggctggctgggggcaatacagaaggctgcggccagcatgggcgatacactgtctgaacagcagctcggtgacagcgatatcccagttattgtctaccggtgtgtcgattatatcacgcaatgcgggctaacctctgaaggaatctacaggaagtgcgggcagacctccaaaacacagaggctcctggagagcttacgacaagatgctcgttcagtgcacctgaaggaaggcgagcagcatgtcgacgatgtgagctctgctttaaagaggttccttagggacctgcctgacgggctctttacccgcgcacagcggttgacttggctggaggctagcgaaattgaggatgaggaggaaaaagtgagccgctatcgagagctgctcgtcagactgccgccggtgaaccgcgcaacggttaaagccctgatatcccacttgtactgcgtccagtgtttctcagatactaaccagatgaacgtgcacaacttagccatagtgttcggtcccacactgttccagacagacgggcaagactataaggctggacgggtggtggaagacctgatcaaccactatgtggtggtgttttctgttgatgaggaagaactccgaaagcagcgggaagaaattacggcaatcgtcaagatgagagtagctggaaccgctagcggtacgcagcatgccggcgacttcatctgcacagtgtacttagaggaaaaaaaggcggaaacagaacagcatattaaagtaccggcaagcatgacggcagaagaactcaccctagaaatactggatcggaggaatgttgggatcagggaaaaagattattggacatgctttgaggtgaacgaaagagaggaggccgagcgccctttgcatttcgctgaaaaggtgctgccaatcctacacggccttggtacagatagccaccttgtcgtcaaaaagcatcaggccatggaagccatgttgttgtacctagccagtcgagtgggggacacaaaacatgggatgatgaagttcagagaggatcgctcactcctcggtctgggtcttcctagcggcggatttcatgatcggtattttatcctgaattcatcttgtctccgcctctataaagaggtgagaagtcagagaccctggtccggcgcccctgaaacttctcataggcccgagaaggaatggccaattaaatccttgaaggtttacctgggtgtaaaaaaaaaactgagacccccgacgtgctgggggtttacagtggtccacgagactgagaaacacgaaaagcagcagtggtatctgtgttgtgacacacaaatggagctgcgcgaatggttcgccacatttctctttgtgcagcacgacggccttgtgtggcctagtgagccgtctcgggtcagcagggcagtgcccgaggtaagactaggctccgtgagcctgatcccacttcgaggctcagagaacgaaatgagacggagtgtggctgcatttaccgccgatccactctccctgctgaggaacgtatag

SEQ ID NO: 108588 - DNA, 1884 bp, Artificial Sequence
  Description of Artificial Sequence: Synthetic coding sequence
aaatgttgggccgtatgggtgggggcagtctggactgaaggtgcttggcagccacgggtcggagttatttgcggtttaaaaggtcgcatgaccctttccggcagcaggggccaggaggaaccccctccatcacgcgtgcccagagccgtgagagtggcttcactactcagcgaaggcgaggagttaagcggggatgatcagggagacgaggaggaggacgaccatgcctacgagggcgttcccaatggcggctggcatacctcttcactgtccctgtctctgccatcaactatcgccgccccccacccaatggatggaccccccggcggctccactcctgtgactccagttataaaagctggctggctggacaaaaacccaccacagggcagctacatatatcagaaaagatgggtgcgcctagatactgaccatctccggtattttgatagtaacaaagacgcctacagtaagagattcatctccgtggcctgcatcagtcacgtagctgctattggggatcaaaaattcgaggtgatcactaacaacaggacatttgccttcagggccgaaagcgatgtcgagcgcaaggagtggatgcaggcactccagcaggcaatggccgaacagagagcccgcgctaggctttcttctgcttacttgctgggagtgccgggcagtgaacagcctgaccgagcaggctccttagaactgcggggattcaaaaacaaactgtacgtggctgtagtcggcgacaaagtgcagctctataagaatttggaagagtatcacctgggaattggcatcacctttatcgacatgagcgtggggaatgtgaaggaagttgataggcgctctttcgatctgactaccccctatagaattttttctttttccgccgactccgagctggaaaaggagcagtggctggaagcaatgcagggtgctatcgccgaagccctgtccacctcggaagtcgctgagcgcatttgggctgcagccccaaatcgcttctgcgccgattgtggtgccccacaaccagactgggcaagtatcaacctatgcgtcgtgatttgcaagagatgtgcaggggagcaccgtggcctgggtgccggggttagcaaggtgcggagtttaaaaatggatagaaaagtctggacagaaaccctgatcgagctgttcctgcagctgggtaacggtgccggaaatcgattctgggctgcaaatgtacccccgtctgaggcactacagccatcttcatccccgagcacgagacggtgccacctcgaagcgaagtacagggagggcaaatatagacgatatcatccgctgtttggcaaccaagaggaattagataaagcattgtgcgctgctgtgacaactacggacctcgctgagacacaggctttgctgggatgcggagccggaattaactgtttctccggagatccggaggcccctacacccctggcactggcggagcaagccggccagaccctgcagatggaattccttagaaacaatagaactaccgaagttccccgtctagatagtatgaagccgctggaaaagcactattctgtggtccttcctacagttagccacagcggcttcttgtataagaccgcttctgcgggaaagctcctccaggataggcgcgcccgcgaggaattcagcaggagatggtgtgttctgggtgatggagtgttaagctatttcgagaacgaacgcgccgtcactcccaacggagagattcgggccagcgaaatagtgtgcctggccgtcccaccccccgatacacacggcttcgaacacacattcgaagtatataccgaaggcgagcgcctgtacctttgggccggcgagtgcggggccggatcttag

SEQ ID NO: 108589 - DNA, 4320 bp, Artificial Sequence
  Description of Artificial Sequence: Synthetic coding sequence
atggccgaggccggcgacgctgctttgagcgtggcggagtggttgagagcgcttcaccttgaacagtatactggcctctttgaacagcacggactcgtgtgggctactgaatgtcagggcctatccgacacccggctcatggacatgggcatgttgctgcccgggcatagacggcggatcctggcaggactgcttagagcccatacctcacctgcgcccgcccccagacccactccacgccccgtccctatgaagagacacatttttcggtcacctcccgtaccggcgacccctcctgaacccttgccaacaactacagaagatgagggacttccagctgctcctccaataccccctagacgctcatgcttacccccaacttgcttcactacgcccagtacggccgcacctgatccagtgcttccacccctgcctgctaagagacacctcgccgaactaagcgtcccccctgtgcctccaagaactgggcctccacgcctcctggtctccttacctacaaaggaagaggagagtctcctcccctctctgtctagccctccacaaccccagagtgaagaacctcttagtactttgccccaaggtcccccacaacctccttctccacccccctgtccgcctgaaatcccgccaaagcctgtccgcctctttccggagttcgatgacagcgactatgatgaagtgcccgaggagggtccaggtgctcctgctcgcgtgatgaccaaaaaggaagagcctcctccaagccgtgttcctcgggccgtgcgtgtagcgtcacttctttctgaaggtgaggagctgagtggcgatgatcagggcgatgaagaggaggatgaccatgcatacgagggagttcccaacggaggctggcatacgagtagcctgtcacttagcctgcccagcacaatagcagcaccacaccctatggacgggccaccaggcggcagcactcccgtgacaccggtgatcaaggcgggctggctggacaaaaacccgcctcaaggatcttatatttatcagaagcgatgggtaagattggatactgaccacctgcgctactttgattcaaataaggacgcctacagcaaaaggttcattagcgtggcctgtatctctcatgtggccgctatcggagatcagaagtttgaggtgatcacgaacaacaggacctttgcgtttcgcgccgagagcgacgttgagcgcaaggagtggatgcaggcactccagcaggccatggcagaacagcgggcgcgcgcgaggcttagtagtgcttacttactcggggtcccaggatccgagcagcccgatagggcagggagcttggaactgcgaggattcaagaataaactttacgtagccgtggtgggggataaagtacagttgtataagaatctggaggaatatcacctcggcatcggtattacattcatcgacatgtccgttggcaacgttaaggaggttgacagacgctccttcgaccttaccaccccctatcggatcttctccttctccgcggattcggagctagagaaggagcagtggttggaggcaatgcagggggcgattgctgaggccttgtccacgtccgaagtcgcggagaggatctgggccgcagcccctaatcgattttgcgccgattgtggcgccccccagcctgactgggcctccataaacctatgcgttgtcatctgcaagcgttgcgccggagaacaccgaggacttggggctggtgtgagcaaagtcagaagtctgaagatggaccgaaaagtttggaccgagacattgatcgaactttttctgcagcttggaaacggggctggcaatagattctgggccgcaaatgtgccgccttccgaggcattgcagccatcttcatcaccgagcacgcgtaggtgccatctggaagcaaaataccgcgaggggaaatacagaagataccatccattgtttggcaaccaagaggagctggataaggccctatgcgccgccgtgaccacgacagacctcgccgagactcaggcactgctaggatgcggggcagggattaattgcttttctggggatcccgaggccccaacccctttggcactcgcagagcaggccggacaaaccctccagatggagttcctgcgaaacaatcgaactacggaggttccccgtctagattcaatgaagcccttggaaaaacattattccgtggtgttacccaccgtttcgcactctggctttttgtacaaaacagcctccgctggaaagttactccaggaccgccgggcccgggaagagtttagcaggcgctggtgcgtgcttggtgacggggtgcttagctactttgaaaatgagcgggcggttacacctaatggcgaaattcgggctagtgaaatcgtgtgcttggcggtccccccacccgatacccatggttttgaacacaccttcgaagtgtacacagaaggcgagcgcctctatctatttggcctggagtcggccgagcaggctcacgaatgggtcaagtgtatcgcaaaggcttttgtgcctcccttggccgaggaccttctcgcaagggatttcgagcggctcgggcgattgccatataaagccggcttgagcttgcagagggctcaggaggggtggttcagcctgtcaggtagtgagttacgagccgtcttcccggaaggtccttgtgaggagcccctccaattacgtaaacttcaggagctctctatacagggggatagtgaaaatcaggtcctggtgcttgtggaaaggaggcggaccttgtacattcagggcgagagacggctggattttatgggttggctgggagcaatccagaaggccgccgcttccatgggggataccctgagcgagcagcaactcggcgatagcgatatccctgtaatagtgtacagatgtgtcgactatatcactcagtgtggccttacatctgaaggcatctatcgcaagtgtgggcagacatcaaagacccagagactgctggagtcattgagacaagatgcaaggtcagtgcatctcaaagaaggcgaacagcacgtggatgacgtgagttcagccctcaagcggtttttgcgggacctgccggacgggttgttcactcgcgcacagcggcttacctggctcgaggcctctgaaatcgaagatgaagaggagaaagtatcccgttaccgggagcttctggtgcggcttcctcccgtgaaccgagccactgtgaaagctctgatatcccacctgtattgtgtacaatgttttagcgacaccaaccagatgaatgtccacaacctggccatcgttttcggtcctactctgtttcagacagacggccaagattacaaggcaggacgggtcgtcgaggatttaatcaatcattacgtagttgtattttccgtggacgaagaagaacttagaaaacagagggaggagattaccgccattgtgaagatgagagtggccggtacagctagcggcactcagcacgccggcgactttatctgcaccgtgtaccttgaagagaagaaggccgaaactgaacaacacatcaaggtacccgcctcaatgactgctgaggagcttacactggagatcctggaccgcaggaacgtgggaattagagagaaagactactggacatgcttcgaggttaacgagcgagaggaggctgaacggcctctccactttgccgagaaagtactcccaatcttgcacggcctgggcacagacagccaccttgttgtcaagaaacaccaagccatggaggctatgctactgtatttagcttcgagagtcggagacacgaaacacgggatgatgaaattccgcgaggatagaagtctgcttggcctgggactacccagcggtggctttcacgaccgatatttcatcttgaattcctcatgtctgcggctgtacaaggaagtccggtcacaccgaccggaaaaagagtggcctattaaatcactgaaggtctacctgggcgtgaagaagaaactccgtcctcccacctgctggggcttcactgtggtgcacgagacagagaagcacgagaagcagcagtggtatctgtgctgcgacacccagatggaactcagagaatggtttgccacctttctcttcgtgcaacacgacgggttggtgtggcctagtgagccttcgagggttagcagagcagtgccagaagtgcgacttggtagtgtatctctgattccgctgagggggagcgagaatgaaatgagaagatctgtggccgcgttcaccgctgacccgctgagcttgctccgcaatgtatag

SEQ ID NO: 108590 - DNA, 3633 bp, Artificial Sequence
  Description of Artificial Sequence: Synthetic coding sequence
atgacactgtcagggagcaggggacaggaagagccgcccccttcacgggtgccaagggccgtacgcgtggcttctttactgtccgaaggagaagaactgtccggagatgaccagggagacgaggaggaggacgatcacgcatatgaaggggtgcccaacggtggatggcataccagctcgcttagtctctcactgccctcgacgatcgctgcaccacacccgatggacggacctcctggtggtagtactcctgtgacacccgtgatcaaggcaggctggctggacaaaaatcccccccagggttcctacatataccagaaacgttgggtgcgattggatacggaccacttacggtactttgattctaataaggatgcctacagcaagcggttcatttcagtcgcctgtatctcacatgtggctgccattggtgatcaaaagtttgaggtaatcactaacaatagaaccttcgcgtttagagccgagtctgacgtggagaggaaggagtggatgcaggccctgcagcaggccatggcggagcagcgagccagggcccggctgagttcggcctacttgctgggcgtgcccggttctgaacagccggatcgtgctggctcgctggagctgcgtggcttcaagaataaattatatgtggcggtagtaggtgataaagttcagctctataaaaatctggaggagtaccacctgggaattggaataactttcatcgacatgtctgttgggaatgtgaaagaagtagatcggcgatcctttgatctgaccacaccctatcgaatcttcagtttctctgcagacagtgaactggagaaagagcagtggctcgaggcaatgcagggggccatcgcggaagctctctccacctctgaagtggcagaaagaatctgggcagcggcacctaatcggttctgtgctgactgcggagcgccacagccggactgggcctccatcaacctgtgtgtggtgatttgcaaacgctgtgccggcgagcacagaggcctgggggccggggtaagcaaggttagaagtcttaaaatggaccgaaaggtgtggactgaaacccttatagaactgttcctgcagttgggtaatggagccggcaatcgattttgggccgcaaatgtgccacccagcgaggcgctccaaccttcatcttcaccttccactaggagatgccacctcgaagccaaatatcgcgaaggcaaataccggcgctaccatcctctgtttggtaaccaggaagagcttgacaaggcactgtgcgcagcagtgaccaccaccgatcttgccgagactcaagcactgctcggatgcggggctgggatcaattgtttcagtggggacccagaagctccgacccctctggccctggcggagcaagccggacagactctgcagatggagttcctgcggaataacagaacgactgaggtcccaagactggactctatgaaacccttggaaaagcactattccgttgttctgccaaccgtgtctcactctggattcctctataagaccgccagcgccggtaagctgttgcaggaccggcgggcccgagaggaattcagcaggcgctggtgtgtgctgggcgacggggtcctaagctattttgaaaatgaaagggccgtcacccccaacggagaaataagagcaagcgaaatcgtctgtcttgcagttcccccacctgatacacacggattcgagcacacatttgaagtgtatacggaaggtgagaggctgtacctcttcggcctcgagagtgctgaacaagctcacgagtgggtgaaatgcatagcaaaagctttcgtgccgcccctggctgaggaccttttagccagggactttgaaagactggggaggctgccatacaaggccggcctatctctgcagcgggcgcaggagggctggttctcgctgtccggttcagaactccgggcagtgttccctgaagggccttgtgaagaaccactccagttgcgcaagctgcaggagcttagcattcaaggtgactctgaaaaccaggtcctcgtcctagtagaacggagacgcaccctctatattcagggggagaggaggcttgattttatgggctggctcggggcgatacagaaagctgccgcgtcaatgggcgacactctcagcgaacagcagctcggcgatagcgatattcccgtgatcgtgtaccgatgcgtagactatattactcagtgcggactgactagcgaaggcatctacagaaaatgcggccaaacgagcaagacgcagcgcctgctcgagtctctgaggcaggacgcgagaagcgtgcatctcaaagagggagaacaacatgtggacgacgtgtccagcgctttgaagcgattcctacgggatctgccagacgggctcttcacgagggcccaaagactgacttggctggaggctagcgagatcgaggacgaggaggaaaaagtgtcccggtatcgggaattgttggtgaggctgcctcccgtgaaccgagccacagttaaagctttaatatcccacctgtactgcgtccagtgcttctcagatacaaatcagatgaatgtccataacctcgccattgtattcggccctacactttttcaaacagatggacaagactacaaggccggccgtgtggttgaagaccttatcaatcattacgtggtggtgttttctgtggacgaagaggagctgaggaagcagcgcgaggagattaccgcaattgtgaagatgcgggttgcaggtacagcatctggcacacagcacgctggggatttcatttgcacagtgtacctggaggagaagaaggccgaaaccgaacagcacatcaaagttcctgctagcatgacggccgaagaactcacacttgagatcttagatcgccgtaacgtcggaattagagagaaggactattggacctgcttcgaagtcaacgaacgcgaagaggccgagaggccccttcatttcgccgagaaggtcctgccaatcttacatgggctggggacagatagccacctggtggtgaagaagcatcaggcaatggaggctatgctgctctacctggcgtcacgcgttggcgacactaagcacggtatgatgaagttccgggaggatcgctcattactagggctgggactcccatccggtggatttcatgaccggtacttcatcctcaatagcagctgtctgagattgtacaaagaggtgcggagccagcggccgtggtcgggcgccccggagacatctcatagacccgaaaaggaatggccaatcaagtctctaaaagtgtatctgggcgtgaaaaaaaagctgcggccgccgacttgttggggctttacagtggtgcacgagacagagaaacatgaaaagcaacagtggtatctgtgctgtgacacccagatggaactgcgggaatggtttgccacatttctgttcgtgcagcacgatggtctcgtatggcctagcgaacctagtagggtcagtcgcgccgtgccagaggtgcgccttggtagcgtcagcctcatcccacttagggggtctgagaatgaaatgagaaggagcgtggcggcctttactgccgaccccctatcgcttctacgcaatgtttag

SEQ ID NO: 108591 - DNA, 4353 bp, Artificial Sequence
  Description of Artificial Sequence: Synthetic coding sequence
atggccgaagcgggcgatgctgctctgtccgttgccgagtggctgcgggctctgcatctggagcagtacacgggcctgtttgaacaacacggcttagtgtgggcgacggaatgtcaaggactgtccgacacacggcttatggatatgggcatgctcttaccagggcatcggcgtcggatacttgctgggctgctaagggcccatacctctccggcccccgctcccaggccaacaccaagacctgttccaatgaagaggcatatcttcagatcaccgccagtgcctgcaacaccccccgagcccctgcccacaacgactgaggacgagggcttgccagctgcaccacctatccccccacgtcgaagttgtttgccccccacatgcttcactacgcctagcacagcagcccctgaccccgtactccctccactgcccgcaaagcgccaccttgctgaactttcagtgccaccagttcccccccggacgggccccccccgactgctggtgagtttacccactaaggaggaggaaagtttgctcccgtcactgtccagtcccccccagccccagagtgaggaacccctctccactttgccccagggacctccccagccccccagtccgcccccatgcccccccgagataccacccaagcccgtgaggctgttccccgaattcgacgatagtgattacgacgaggtcccagaagagggcccaggcgcccccgcacgagtgatgaccaaaaaggaggagccacctcccagtcgagtgcccagggccgttagagtcgctagcttattaagcgagggagaagagttgtcaggggatgaccagggagatgaggaggaagatgatcatgcttatgaaggggttcccaatggcgggtggcatacttcgagtctatctttgtctcttccatctactatagcagcaccacatccaatggacgggccacccggaggctccaccccagtgacaccggtgattaaagccgggtggttagataagaatccccctcaggggagctacatttaccaaaaacgatgggttaggctcgacactgatcacttacgatatttcgatagcaacaaagacgcctatagtaagaggttcatctccgttgcttgtatctcccacgtcgccgcaatcggtgaccagaaatttgaagttattactaacaatcggactttcgcatttagagcagagagtgacgtagagagaaaagagtggatgcaggctctgcagcaagctatggctgagcaaagggcccgagccagactgtctagcgcctacttgctgggtgtcccaggctctgagcagcccgatagggcgggctcactagaactgaggggatttaaaaataagctttacgttgcagtcgtgggagacaaggtgcagctgtataaaaacctggaggagtatcacttagggattggcataacgttcatcgatatgtctgttgggaacgtaaaagaggtagatcgcaggagcttcgacttaacaacaccctacaggatctttagcttcagtgcggattccgagctcgagaaggagcagtggctggaggcaatgcagggagccattgcagaggctctgtccacttcagaggtggctgaaagaatttgggctgctgcacctaataggttctgtgctgattgtggggctccgcagccagactgggcctccatcaatctgtgtgtggtaatttgtaaaaggtgcgccggtgagcatcggggtctgggagctggtgtgtccaaggtccgttctttgaaaatggatcgcaaggtgtggacagaaacattaatcgaattgtttctacaattggggaatggcgctggaaatagattctgggctgccaatgtgccacctagcgaagcgctacagccctcttctagcccaagtacgaggcgctgtcatcttgaggctaaataccgggagggcaaatacaggagataccaccctttatttgggaaccaggaagagctcgataaagccctatgcgctgcagtcaccactaccgatctcgccgagacacaggctctattgggctgtggcgccggcattaattgtttttccggtgatccagaagcgccgacccccctcgccttagcagaacaggcaggccagacccttcaaatggagttcttacggaataatagaaccacggaagtacccaggctggacagcatgaaaccactggagaaacattacagtgtggtacttccaacggtttcccactccggcttcctctacaaaaccgcttccgccgggaaattgctccaggatagaagggccagggaagaattcagtcggcgctggtgtgtgctaggtgatggggtcttgtcctactttgagaatgagagagccgtcactcccaatggcgagattagagctagtgagattgtgtgtctggctgttcctccgcccgatacccacgggtttgaacatacctttgaggtgtatacagagggagagaggctgtacctgttcggactagaatcagcagagcaggcgcacgagtgggtgaaatgcattgccaaagccttcgtgcctcctctggccgaggacctgctggctcgtgacttcgaacggctcggaaggcttccctataaagctggtctgtccttgcagcgggcccaggagggctggttttccttgtcaggatcagagttaagagcagtctttcctgagggaccctgtgaggaacctctccagctacgcaaactgcaggagctgtccattcagggagactcagaaaaccaagtactggtgctggtcgagcgtcgccggacactgtatattcagggcgaaagacggctcgattttatgggttggctaggagcgatccagaaggcggcagccagcatgggggacactctgagtgagcagcagctgggggactccgatattccagtaatcgtgtataggtgcgtagattatatcacgcagtgcggactcacctccgagggaatttacaggaagtgcggtcagaccagcaaaacccagcgattgctggaatcactcaggcaggatgcacgaagtgttcacctcaaagaaggcgagcagcatgtggatgacgtgagcagtgctctgaagcgatttcttagagatctccctgatggtctgtttaccagggctcagaggttaacctggctcgaggccagtgaaatcgaggatgaggaggaaaaagtctcccgatatcgggaactgctggtcagactccctccagtgaaccgtgccacagtgaaggctctgataagccacttgtattgtgtccagtgctttagcgacactaatcaaatgaacgtccacaatttggccattgtatttggccccaccctgtttcaaactgacggccaggactataaggccggaagggtagttgaagatctgatcaatcattatgtggtggttttctctgtggacgaggaggaactcagaaagcagcgagaggaaatcaccgcaatcgtgaaaatgcgcgtggccggcactgctagcgggacccaacatgccggcgactttatctgtacagtttatttggaagaaaaaaaagcggaaaccgagcagcatataaaggttcctgcctcaatgactgcagaggagttaaccctggaaatcctggaccggcgcaacgtcggcatccgggagaaagactactggacatgcttcgaggtgaacgaacgggaagaagccgagagaccactgcactttgctgagaaggtgttgccgattctccatgggctgggcacagacagccatctggttgtcaagaaacaccaagcaatggaagcaatgctcctttacctcgctagccgtgtaggcgacaccaaacacggcatgatgaaatttcgtgaagacaggagcctgttgggccttggacttccctccggaggtttccacgaccgatacttcatactcaattcctcgtgcctcagactgtataaagaagtccggtctcagaggccgtggtccggcgcccctgaaactagccatcggccagagaaagagtggccaattaagagcttaaaggtgtacctgggagtcaaaaaaaagctgcgacctccaacctgttgggggttcaccgtggtgcatgaaacagaaaagcatgaaaaacagcagtggtacctgtgctgtgacacccagatggagctgagggaatggtttgcaacatttttgtttgttcagcacgatggcctggtctggcctagcgagccgagtagggtgtctagagccgtccctgaggtacggctcgggagcgtgagtcttatcccgctccgaggctcagagaacgaaatgagaagaagtgtggcagcttttacagcggatccactgtccctgctccgaaatgtttag

SEQ ID NO: 108592 - DNA, 3402 bp, Artificial Sequence
  Description of Artificial Sequence: Synthetic coding sequence
atgacaaagaaagaagagcctcctcccagtcgagttccaagagccgtacgggtagcctccctcctgtctgagggtgaagagctgtccggtgatgaccagggggacgaagaagaggatgaccacgcatacgaaggagtacccaacggagggtggcacacaagctctctgtccttatctctacccagcacaattgcagctccacacccaatggacgggccgccgggagggagtacgcccgtgacacccgtgattaaggctggttggctagacaaaaaccccccgcagggaagctacatttatcaaaagagatgggtgagattggacaccgaccaccttcgttactttgatagcaataaagatgcctatagcaagaggtttatttccgtcgcctgcataagccatgttgctgccattggagaccagaagttcgaggttattaccaacaacagaacattcgcattcagagcagagtccgatgtcgaacgtaaggagtggatgcaggccctgcagcaagcgatggccgaacagcgtgcaagggcgagactcagtagtgcgtacctgttaggggtcccggggagcgaacaacccgaccgtgccggtagtctggaactaagggggtttaaaaacaaactgtacgtagcagtggtcggcgataaagttcaactctacaaaaacctagaggaatatcacctgggcattggaatcacattcattgacatgtccgttggtaacgtgaaggaagtggatagacgtagttttgacctgactaccccgtatcggatctttagtttttccgcagatagtgagctggagaaggaacagtggctggaggccatgcagggagctatcgcggaagctcttagcacctccgaagtcgccgagcgcatttgggccgcagctccaaatcgtttttgcgccgactgtggcgcaccacagcctgattgggcctctattaacctatgcgtggtgatctgcaagcgctgcgccggcgagcatagaggacttggagctggcgtgtccaaggtgcgttctcttaaaatggatcgtaaagtgtggactgaaaccctcattgaagcactgtgcgcagcagtcaccactaccgaccttgcagagacgcaggctttgctcggatgcggcgctggcatcaattgtttcagtggtgaccccgaagcccctacaccattggcactcgcagagcaagccggtcagacactgcaaatggagttcttgcgaaataatcgcactacggaggtgccccgattagactccatgaagccccttgaaaagcactattcagtggttctgccaactgtgagtcacagtggctttctatataagaccgctagtgctggaaaactgcttcaggatagacgggcacgggaggaattttcccgccgctggtgcgtgcttggagatggggtcttgagttacttcgaaaacgagcgtgccgtgactccaaacggagaaatcagagccagcgagatcgtttgcttagccgtgcccccacccgatacgcatggcttcgagcacacattcgaggtatacaccgaaggagagcgactgtacttatttggcctggagagcgctgagcaggcacacgagtgggtcaaatgtatagccaaggccttcgtgccccctctggccgaggatctgctggctcgggacttcgaacgtttaggccgactcccctataaagccggattgagtttacagagagcacaggaaggctggtttagcctgtcgggcagcgaacttcgcgcagtgttccccgagggaccatgcgaggaacccctgcagctgcgtaaactgcaggagttgtcaatacagggagactcagagaaccaggtactcgtcctggtggagaggcggcgcactctgtacatccagggggaaagaaggcttgacttcatgggttggctgggcgccatccagaaagcagccgcctctatgggcgacactctcagcgaacagcagctgggagatagcgacatacctgtgatcgtgtatagatgtgtcgactatatcactcagtgtggcctgacatctgagggtatctatagaaagtgtggccagacatccaagacacaaagattgctggaatccctgagacaggacgcccgctcagtgcacttaaaagagggcgagcagcacgttgatgacgtcagttccgcactgaagcgatttttgcgggatctcccggacggactgtttaccagggcccagagactcacttggctggaggcatccgagattgaagacgaggaagaaaaagtgagccggtatcgggaactcctggtcagactgccaccggttaatagggctactgtgaaggctcttatttctcatctgtattgcgtccaatgcttctctgatactaaccagatgaatgtccataaccttgccatcgtcttcgggcccaccttgttccagaccgatggacaggattacaaggccggccgcgtggtggaggatctgattaatcactacgttgtcgtgttctctgtggatgaggaggaactcaggaagcaaagggaagaaatcaccgcgatcgtgaaaatgagggttgcaggaaccgcttctggtactcagcatgccggcgacttcatctgcactgtctatctcgaggaaaagaaggcggagaccgagcagcatatcaaagtgcccgcttcaatgaccgccgaagaactgactctggagatcctggaccgacgcaacgttggaataagagagaaggattactggacctgcttcgaagttaatgaacgtgaggaggcagaaagacctttgcattttgccgagaaagtgctgcccatacttcacggtttgggtacagacagtcacctggttgtgaaaaaacatcaggccatggaagctatgctgctgtatcttgcctcccgcgttggagatactaagcatggcatgatgaagtttagggaagatcgcagcctgcttgggctgggtctgccgtctggcggatttcacgaccgctacttcatcctcaacagcagctgtctacgcctctacaaagaagtgcgcagccatagacccgagaaggagtggccaatcaagtctctcaaggtctatctgggcgttaagaaaaaactcagacccccaacatgctggggcttcaccgttgtccacgaaacagaaaaacacgaaaagcagcagtggtatctttgctgtgacacacagatggaactgagagagtggtttgctacatttttgttcgtccagcacgacggattagtgtggccaagcgagccatcgagggtgagtcgcgcagtgccggaggtgaggctcggaagtgtgagcctaattccactgcgcggaagtgaaaacgaaatgcggcggagcgtcgccgccttcactgccgaccccctctccctgttgaggaatgtctag

SEQ ID NO: 108593 - DNA, 4320 bp, Artificial Sequence
  Description of Artificial Sequence: Synthetic coding sequence
atggctgaagctggcgacgcagcactgtccgtcgcagaatggctgcgtgctctgcaccttgagcagtacacaggattgtttgagcaacatgggttagtgtgggctactgagtgccaggggttgtccgacacacgcttgatggatatgggaatgctgctgcccgggcatagacgccgcatcctggccggcctgctgcgcgctcatacttctccagccccagcacctcgccctacacctcggcccgtacctatgaagaggcacatcttcaggtctccccctgtgcctgccactcctcccgagccactgccaacaactaccgaggacgaaggccttcctgcagcccctcctattcctcctcggagaagttgtctccccccaacttgctttaccacacctagcacagctgccccggacccagtgctccctcccctgcctgctaaaaggcacctggctgagctatctgtgcctccagtccctccccgcacggggcctccgcgcctcctggtcagcctgccaacaaaggaggaagagtcgctcctgccgagtctctctagcccaccgcagccccagtcagaggagccactgtctactctgccccagggcccaccccaaccgcctagcccaccgccatgtccaccggaaatcccccctaagcccgtacgcctcttcccagagtttgatgatagtgattacgacgaagtccctgaggaggggccaggcgcccctgccagagtgatgacgaaaaaagaagagccgccaccgagtcgcgtaccccgtgctgtgagggtggcctctctgttgtccgagggcgaggaactctccggtgatgatcagggagacgaagaagaggacgatcatgcgtatgagggggtcccaaatggcggttggcacacgagctccctttccctgtccctcccatccaccatcgccgcgccccatccaatggacggaccccccgggggatcgacaccagtgactccagtgattaaagcaggatggctagacaagaatcccccccagggatcttacatctatcagaaaaggtgggtcagattagatacagaccatttgcgctacttcgattccaacaaggatgcatattcaaagagattcatctccgtcgcctgcatcagccacgtggccgctatcggtgaccaaaaatttgaagtcatcacaaataatcgcacctttgcattccgcgccgagagcgatgtggaaaggaaagaatggatgcaggctctccaacaggctatggcagagcagcgagctagggccaggctgtcttcagcctatctactaggcgtccccgggtctgagcaacccgatagagccgggagtctcgaactgcgtggcttcaagaacaagttgtacgtcgcggtagtgggcgacaaagtgcaactttacaagaatctcgaggaataccacctgggaattggaatcacgttcatcgatatgagtgtgggcaacgtgaaggaggtggatagacgctcttttgatctgaccaccccttatcggatcttttcatttagcgctgatagcgaactggagaaggaacagtggctggaagccatgcagggcgctatcgctgaggcacttagtacaagcgaggtcgccgaacgaatctgggccgccgctcctaaccggttttgtgctgactgtggcgctccacagcccgactgggccagtatcaacctgtgcgttgtgatctgcaagaggtgcgcgggggagcacagaggattaggggcgggtgttagtaaagttcgctcactgaaaatggatcggaaggtttggacagaaaccctgatcgagcttttcctccagttgggcaatggggcggggaaccgtttctgggcagctaatgtgcctccctccgaggcgctgcaaccctcgtccagcccgtccacccggcgctgtcatctcgaggctaagtaccgggaggggaagtacagaaggtaccatcctctgttcggcaatcaagaggaattagacaaggcactgtgcgctgcagtgacaacaacagacctcgcggagacccaggccttactgggctgcggcgccggaatcaattgtttcagtggggacccagaggcccccactcccctcgccctggccgagcaggccggacaaactttgcagatggaattcctgcggaacaaccgaactacagaagttcctcgtctcgactccatgaaacctctcgagaaacactactccgtggtgctgcctacagtttctcactctggattcctgtataagaccgctagcgccggaaagttactgcaggacaggcgggcgcgcgaagaattcagccggcgttggtgcgtgcttggagatggagtactctcttatttcgaaaacgaaagggccgtgactcctaacggagaaatccgggcgagtgaaattgtgtgtcttgccgtgccacccccagacacacacgggttcgagcacactttcgaagtctatacagaaggggagagactgtaccttttcggactggagtcggccgagcaggcacatgaatgggtaaagtgcatcgcaaaagccttcgtgccacctctggcagaagatttactagcccgcgacttcgagaggctcggtaggctcccttataaagccgggctgtcgctccaacgagctcaggaggggtggttctccctgtctggatctgagcttcgggctgtgttccctgagggcccttgcgaagagccgctgcaattacgcaagttgcaagaactgagtatccagggagattcggagaaccaggtgctggtcctagttgaacggcgcaggacgctgtacattcaaggggagaggcgcctggatttcatgggctggctgggggctatccagaaggcagcagcctccatgggagatacattatcagagcagcagctgggcgactcggatatacctgtgattgtctatagatgcgtcgattatataacccagtgcggcttgacatcagaagggatctaccgcaaatgcggccagaccagcaagactcagagactgctggagtccctcagacaggacgcccggagcgtgcacctcaaagaaggagagcagcatgtcgacgacgtcagttccgcactcaagaggttcctcagagatttacctgatggtttgttcacccgcgctcagcggctgacttggttagaggccagcgaaatagaagatgaagaagaaaaggtttcacggtatagggaactgttggttcggttgcctcccgtaaatagggccaccgtgaaggccttgatctctcacctatactgtgtgcagtgcttcagcgatacaaatcaaatgaacgtgcacaatctggccattgtattcggccccactcttttccagactgacggccaggattacaaagccggcagggtcgtcgaggatctgatcaaccattacgtggttgtgttctctgtggatgaggaggaacttaggaaacaaagagaagagataaccgcaatcgttaaaatgcgagttgctggaacagctagcggaacccagcacgcaggcgactttatctgcacagtgtatcttgaggaaaagaaggccgagacagagcagcatatcaaggttcccgcttccatgaccgccgaagaacttaccctcgagatcttggacagacgcaacgttgggattagagaaaaagactattggacatgctttgaggtgaacgagcgggaggaggcggagcggcctcttcattttgccgaaaaggtcttgcctatcttgcatggattaggcactgacagtcacctggtagttaaaaagcatcaagctatggaagccatgctgctatatctcgcctccagggtgggcgacacaaagcacggtatgatgaaatttagggaggacagaagcctgctggggttgggactgcccagtggcggattccatgacaggtacttcattcttaacagctcgtgcttgaggctgtataaggaggtcagatcacaccgccctgaaaaggaatggcctattaaatccctgaaggtgtatctgggggtcaaaaagaagctgcgccccccaacatgttggggttttacagtggtccacgaaaccgaaaaacacgaaaaacagcagtggtacctgtgctgtgacacacaaatggaattgcgggagtggtttgcaacttttctgttcgtccaacacgacgggcttgtgtggccaagtgagcctagccgagtctctcgcgctgtgcctgaagtgcggctgggctccgtgtcccttatccccttacggggttccgagaacgagatgcgccgatccgttgccgcctttaccgccgaccctctgtctcttctcagaaatgtgtag

SEQ ID NO: 108594 - DNA, 5115 bp, Artificial Sequence
  Description of Artificial Sequence: Synthetic coding sequence
atgtcaagcgtatccgaggtcaacgtagatataaaggattttttgatgtcgataaacctggaacagtaccttctacactttcatgaatcgggctttactactgtcaaagactgtgccgcaattaatgacagcctgttgcaaaagataggtatctcccccactggccatcgtcgccgcatcttgaagcagctgcagatcattctgagcaagatgcaggacattcctatttatgcaaacgtgcacaagacaaagaagaatgacgacccttcaaaagactaccacgtgccgtcctccgaccaaaatatttgcatcgagttgagtaatagtggaagcgtccagactagttctccacctcaattggagacggtcaggaagaaccttgaggattcagacgcttctgtggagagaagccagtacccacagagtgacgacaagctgagtcctcccaagagagatttcccaacagccgaagagccgcacttgaacctcgggtccttaaatgattctttgttcggcagcgacaacataaaaatcgagtctctcattacaaaaaaaactgtagaccatacagttgaggagcagcagacggagaaggtcaaattgataacagagaacctttctaagttaccgaacgccgatagtgagtgcttgagctttgtgggatgtagcacaagcgggaccaacagcggcaatggaactaatggtctcctggaaggatctccaccaagcccatttttcaagttccagggtgagatgatcgtcaatgacctgtacgtgccttcatctccaatcctggcaccagtgagatcacgctctaaactcgtctcccggcccagcagaagcttcctattacggcacagacccgttcctgagatccccggctccaccaagggtgtctccggctcgtactttcgtgaacgccggaacgtcgccacgtcgacggagaagtctgtagcatggcagaactccaacgaggaaaacagtagcagcattttcccgtacggtgaaacctttctgttccaaaggcttgaaaattccaaaaagagaagcatcaagaacgaattcctgacccagggagaggctctaaaaggggaggcagctaccgcaaccaactcattcatcatcaagtcttctatctacgacaaccggaaagagaagatttcagaggataaggtcgaagatatttggatccccagagaggacaaaaacaattttcttattgacactgcttctgagtcagagtattcgacagtggaggaatgttttcagagtctgagaaggaaaaactctaaagcaagtaaatccagaactcagaaggccctgatcttggacagcgtcaacaggcactcttacccgctcagttccacttcgggcaatgcagattcgagtgcagtatcatcccaggctatctctccctatgcctgcttttatggtgcctccgctaaaaaggttaagtctggatggctggacaagttgtcacctcaaggaaaacggatgtttcaaaagcgctgggtgaaattcgacggtctgtctatttcctactataacaatgagaaggaaatgtactccaaggggatcataccactttccgctatcagcaccgtccgagtacagggcgataataagtttgaggtggtaacgactcaacgcaccttcgtgtttagggtggaaaaagaggaggaacggaatgattggatttccatcctcctgaacgcgctaaagagccagtcgcttacaagtcagagccaagctgttgtcacccccgaaaaatgtggctatcttgaactgcgtggctacaaagccaagatcttcaccgtcttatccggcaatagcgtgtggctgtgcaaaaacgagcaagatttcaagagcggattagggatcactattatacctatgaatgtggcaaatgtaaagcaagtcgatcgtacggtgaaacagtccttcgagattatcactccttaccggtcgttttcctttactgcggagacagaaaaagagaagcaggactggatagaggctgtgcagcagtccatcgcagaaacgctttctgactacgaggtggctgaaaagatttggtttaacgagagcaaccgttcttgtgcggattgcaaggcccctgacccagattgggctagtatcaacctctgcgtcgtcatttgcaagaagtgtgccggccagcacagaagcttggggcccaaggacagtaaggtaagaagtctgaagatggacgctagcatttggtcaaatgaattgatcgagctgttcattgtaatcggtaacaagagagctaatgatttttgggccggcaacctccagaaagacgaagagctacatatggatagccccgtggagaaacggaaaaattttattacacagaagtataaggagggtaagtttcgcaaaacactcctggccagcttaaccaaagaggaactgaacaaagccctgtgtgccgcggtggtgaaaccagacgtgctggagacaatggcactgctgttcagtggagcagacgtgatgtgtgccaccggggacccagtgcacagtacaccttacctgctggcaaagaaggctgggcagagtttacagatggagtttttgtatcacaacaagttctctgactttccgcaacacgacattcactcagaaggggtcctttcccaggaatcaagccagagcacattcttgtgtgacttcttgtaccaggcgccatctgccgccagtaagctgagttcagaaaaaaagttgttagaggaaacaaacaagaagtggtgtgtgcttgagggaggcttcctctcttactatgagaacgacaaatcaaccaccccaaatgggaccattaacatcaatgaggtcatttgtttggcgatccacaaagaggatttttatctgaatactgggccaatttttatcttcgaaatttaccttcctagcgagcgggtctttctttttggagcagagacctcccaggctcagcggaagtggaccgaagctattgcgaaacattttgtccctctgttcgccgagaatctgactgaggccgactatgatcttatcggacaattgttctacaaggactgccacgctcttgaccagtggaggaagggatggttcgctatggataagagcagcctccatttctgcctgcagatgcaggaagtccaaggggatcggatgcacctgcgaagacttcaggaacttactatcagcacaatggttcaaaatggagagaaactggacgtcctcttactagttgagaaaggtcgcacactgtacatccatgggcataccaagttagactttaccgtgtggcacaccgctatcgaaaaagctgcaggtaccgacggcaacgccctgcaggaccagcaattatctaagaacgatgtgcctatcatcgtgaactcctgtatcgcgtttgtcactcagtatgggctgggttgcaaatacatataccagaagaatggggatcctctgcatatttcagagttgctggagagtttcaagaaggatgcaaggagctttaaattaagggcaggcaagcaccagcttgaggatgtgactgcagtactgaagtcttttctcagtgatatcgatgacgccttgctgacaaaggagctttatccctattggatctcagcactagatacccaggacgataaggaacggatcaagaagtacggggcctttatccgaagcctccctggtgttaacagagccacacttgcggcaatcattgaacacctatatagagtgcagaagtgctccgagataaatcatatgaacgcgcacaatctggccttagtcttctccagctgcttatttcagactaaggggcagacatctgaagaggtgaatgttatcgaagatcttattaataactacgtggaaatttttgaagtgaaagaggaccaggtgaaacagatggatattgaaaattcttttatcaccaagtggaaagacacccaggtgagtcaagctggtgacctgctgatcgaggtatacgttgagaggaaggagcccgactgctccattatcatcagaatatcccccgtcatggaagccgaggagctgacaaatgacattcttgccatcaagaatatcatccccactaagggcgacatctgggccactttcgaagtgattgagaatgaggagttggagagaccactgcattacaaggagaacgtcctcgagcaagtgttgcggtggtcttcactggctgagccaggctcggcctacctggtggtaaaaaggtttcttacagccgataccatcaaacattgttccgatcgcagcacactgggttctattaaggaaggaattctgaagatcaaagaggagccgtccaaaatactttccggcaacaagttccaggatagatatttcgtcttaagagacggatttctgttcctgtacaaagatgttaaaagtagcaagcatgataagatgttctcgctgagtagtatgaagttttacaggggcgtgaagaaaaagatgaaaccgccgaccagctgggggctgaccgcttactccgaaaaacatcattggcacctttgctgtgatagttctagaacccagactgagtggatgacaagcatatttatcgcgcagcatgaatatgatatctggcctccagctggtaaagaacgcaaacgatcaatcacaaagaaccccaaaattggtggcctgcccctgatccctattcagcacgagggcaacgccacactcgcccgcaagaacatagagagcgctcgcgccgagctggagagactacgactgagcgaaaaatgcgacaaggaaagcgtcgactcgtctttgaaggaacgggctagcatggtagcccactgtttggagcacaaagatgataagcttcgcaacaggcctcgcaagcaccggagttttaattgtttggaagatactgaacctgaggcgcccctggggcaacccaagggtcacaagggcttgaaaactttgcgtaaaacggaggatagaaattccaaggccaccctcgactccgaccataagctgccctcccgggtcatcgaggagctcaatgtagttcttcagaggagtagaacccttccaaaagagctacaggacgaacaaatacttaagtag

SEQ ID NO: 108595 - DNA, 144 bp, Artificial Sequence
  Description of Artificial Sequence: Synthetic coding sequence
atgagcagcgtcagcgaagtgaatgtggatattaaagatttcctgatgtccatcaacctcgaacagtatctgcttcactttcacgagagcgggtttactacggtgaaggactgcgcagctatcaacgactcactgctgcagtag

SEQ ID NO: 108596 - DNA, 3399 bp, Artificial Sequence
  Description of Artificial Sequence: Synthetic coding sequence
atgcgaagtagcgcctcacggctgagtagctttagcagcagagattccctgtggaacaggatgcctgaccagataagcgtctcagagtttattgctgagaccaccgaggattacaattcccccactacctcatcctttactaccaggctgcataactgcagaaacacagtgacacttctggaggaagcattagaccaggatcgaaccgccctccaaaaggtgaaaaaatctgttaaggcaatatacaacagcggtcaggaccacgtgcagaatgaggaaaactatgcccaggttctggataaattcggctcgaactttttgtcacgagacaatcccgacctaggtaccgctttcgtcaagtttagtactctgaccaaagaactcagtacactgctcaaaaacctgttacagggattgtcgcacaacgttatatttacccttgactctctgcttaagggagacctgaagggggtgaagggggatttaaagaagccttttgacaaggcctggaaagactacgaaaccaagtttaccaaaatcgaaaaggagaagcgagaacacgcgaagcagcatgggatgattcgtacagagataacaggtgccgaaatcgctgaggaaatggaaaaggagagacgactttttcagcttcagatgtgcgagtacctaattaaggtgaatgaaattaaaaccaaaaagggcgtggacctgctccagaacctgattaagtattatcacgcacagtgcaactttttccaagacggattgaaaactgcggacaagctgaagcagtacattgagaagcttgccgcagacctgtacaatattaaacagacccaggatgaggaaaaaaagcagctgaccgccctgcgcgaccttatcaagtccagccttcagcttgatcagaaggaggcccggcaggatagtcagtcacgacaaggcgggtattcaatgcatcagctacaaggcaataaggagtacggaagcgaaaagaaagggtatctgctgaagaagagtgatggtatacggaaggtgtggcagcgcagaaaatgttctgtgaaaaatggaattctgaccataagccatgccacttccaacaggcagccggctaagctgaacctcttgacatgccaagtaaaaccaaatgctgaagacaaaaaaagctttgatttgattagccataatagaacctatcactttcaggctgaagacgagcaggattatgtggcctggatctccgttctgacaaactccaaggaagaagctctgactatggctttccgaggggagcagtctgcaggcgaaaatagtctggaagacctcacaaaagccattatcgaggatgtgcagcgcctccccggcaacgatatctgttgcgactgtgggagctcagagcctacatggctgtccaccaacctggggattttaacatgcatcgagtgctcgggcatccacagggaaatgggcgttcatatctcccgaatccagagcttagaactcgacaagctgggaacctctgagctgctgttggcgaaaaacgttgggaataactcttttaacgatatcatggaggccaaccttccttccccctcccccaagccgaccccttcatccgacatgaccgtgaggaaggaatacatcacagctaagtacgtagaccacagattcagccgtaaaacctgttcaacctcctctgccaaattgaacgagctgcttgaggcaattaagtcgcgggaccttctggccctgattcaggtctatgccgagggagtggagctgatggaacctttgctggagcctggacaagagctaggcgagactgccctccatttggctgtgcgaacagctgaccagacttcactccacctcgtcgactttctcgtacagaactgcggcaatctggacaaacaaaccgcccttggaaatacagtcctgcactactgtagcatgtacagcaagcctgagtgcctcaagcttttgctgcgtagcaaaccaactgtggacattgtgaatcaggctggggaaactgcgctcgacatcgctaaaagactgaaagcaactcagtgcgaggatctgttatctcaggctaaatctggcaaatttaaccctcacgtgcacgtggaatatgaatggaatttgaggcaagaggaaattgacgagagtgacgatgacctcgacgataaaccctcacccatcaaaaaggaacgcagtcccagacctcagagcttttgccatagttcaagtatctccccccaggacaagttagcactgccagggttctctaccccccgcgacaaacagaggctctcatacggggcatttacaaaccagatttttgtctcaaccagcacagatagccctacttctcctacaacggaggccccacccttacctccacggaatgcggggaaaggacccacaggtccaccgtctacactgcccctgagcacacaaaccagcagcggtagttctaccctgtcgaagaagcgccctccaccacctccacccggccataagcgcaccctgagtgatcctcccagccctctgccgcatggaccgcccaataaaggagccgttccatggggcaatgacggcgggccatcctcctctagcaagactactaacaagtttgaggggcttagccagcagtcgagtacctctagtgccaagacagccctggggccaagggtactgccaaaactcccgcaaaaggtcgctctgcggaagactgaccaccttagcctggacaaggcaacaatccccccagaaatttttcagaagtcaagccagctggccgaactgccccagaagcccccaccaggtgatcttccaccaaagcccacagagctcgcgccaaagccccaaatcggcgatctaccgcccaaacccggtgagctgcccccgaaacctcaactgggcgacctgcctccgaaaccacagctgtctgatctaccccccaaacctcagatgaaagatctgcctcccaagccccagctgggggatctcctggccaaaagccaaaccggcgacgtaagtccaaaggctcagcagcctagtgaggtgaccctcaaaagtcatccacttgacctgtctcccaatgtacagagccgggacgccatccagaagcaagcgtcggaggacagtaacgatctaacacccaccctcccagagactccagtccctctaccgcggaagattaacaccggaaagaataaagtccgtagggtcaagacaatctacgactgccaggccgacaatgatgacgaactaacttttattgaaggtgaagtaattattgtgactggcgaggaagatcaagagtggtggattggccacatcgagggacagcctgaaagaaagggcgtgtttcctgtctcattcgtgcatattttgagcgattag

SEQ ID NO: 108597 - DNA, 3390 bp, Artificial Sequence
  Description of Artificial Sequence: Synthetic coding sequence
atgcgctcttcggcttccaggttaagctctttttcatcacgtgacagtttatggaatcgaatgcccgatcagatttcagtgtccgagtttatcgcagagactaccgaggattacaattctccaacaacctccagctttaccaccaggcttcacaattgtagaaacaccgtcactctgttagaagaggccttagaccaggaccggaccgccctgcagaaggttaagaaaagcgtcaaggcaatttacaactccggccaggaccacgtccagaatgaggagaactacgcccaggtgttggataagttcgggagtaattttctgtcaagggacaatccagatctcggcacggccttcgtaaagttcagcacattgaccaaggaactgagtacgcttctgaagaacttactgcagggcctgagtcataatgttatcttcaccctggacagcctgctgaagggagatctgaagggagtcaagggggatttgaagaaacctttcgacaaagcttggaaagactacgagactaagttcacaaaaattgagaaagagaaacgggaacacgcaaaacagcacggaatgatacgaacagagatcacaggtgccgagattgccgaggaaatggaaaaggaacgaagactattccaattgcagatgtgcgagtaccttattaaagtaaacgagattaaaaccaaaaaaggagtcgacctgctgcaaaacctgatcaagtactatcatgcacagtgcaacttctttcaagacggactgaagacagctgacaagcttaaacagtacattgagaagctggccgcggacctctacaatattaagcagacccaggacgaagaaaagaaacagctcactgccttaagggaccttataaagagcagcctacaacttgaccagaaagaagacagccagtcccggcagggaggatacagtatgcatcaattacaggggaacaaagagtacgggagtgagaagaaaggctatctcctgaaaaagtctgatggcattcgcaaagtctggcagcgtaggaaatgctcagtgaagaacggtattctcacaatttcacacgccacgtctaacagacagcccgcgaaactgaacctgctgacatgccaggtcaagcctaacgcggaagacaaaaaatccttcgacttaatctcccacaataggacgtaccacttccaagctgaggatgagcaagactacgttgcttggatttcagtgcttaccaatagcaaagaggaggctctcacaatggcgtttcggggtgagcagtctgctggagagaactccttggaagaccttactaaagccataattgaggacgtgcaacgtttaccaggaaacgacatatgttgcgactgtggttccagtgaacccacgtggctatctacgaatcttgggatactcacttgtatcgaatgttctgggattcacagagaaatgggagtccatatctctcggatacaaagcttggaactcgataaactcgggacttcagagttactgctggcaaagaacgttggaaataactctttcaacgacattatggaggctaatctaccatcaccaagtccaaagccaacccccagctctgatatgactgtgaggaaggagtacattactgcaaaatacgttgaccatagattctctagaaaaacttgttcgacaagctcagccaagcttaacgaactcctggaggcaatcaagtcacgggatctgttagcacttatccaggtatacgccgagggcgtggagctgatggagcctctgttggaaccaggccaagagctaggggaaactgctctccacctggcagtaaggaccgctgaccagacttctttgcatcttgtggattttctggtgcagaattgcgggaatctagacaaacagaccgctcttgggaatacggtactacattattgttcaatgtatagcaaacctgagtgcctgaaactcttgctccgctctaaaccgaccgtggatatcgtcaaccaggccggagaaaccgctctcgacattgccaaacggctcaaagcaacacagtgtgaggatcttctctctcaagccaagtccggcaagtttaacccacatgtgcacgtcgaatacgagtggaacctgaggcaggaggaaattgatgaatcagatgacgaccttgacgataagccaagccccattaagaaggagcgctctccaaggccacagagcttctgccatagtagcagcatttccccccaggacaagttagctctgcctggtttttcgactcctagagataaacagcgcctgtcctatggcgcgttcaccaaccagatatttgtgagtacatccaccgactccccaacatcacctaccaccgaagcaccccccctcccccctcgaaatgccgggaaggggcccaccgggccccccagcaccctgccactgtctacccagacgagttctggatcctctaccctgagcaaaaagcggccacctccacctccccccggacacaagcgaactctctcagatcctcctagccccctcccacatggtccacctaacaagggagcagttccctggggtaacgatggcggaccctctagcagctctaagacaaccaataagttcgagggtctatcccagcagagcagtacatcttctgctaagacggcattgggcccccgcgtcctccctaagctcccacagaaggtggctctcaggaaaacagatcacctaagtctggacaaggcaaccattcccccagaaattttccagaaaagctcgcaattagcagagctcccccaaaaaccgcctccaggtgacctgccacccaaacccaccgagcttgctcctaagccccagatcggcgacctgccacctaaacctggcgagctgcctcctaaacctcagcttggtgacttgcctcctaagccccagctatcggacctgcctcccaaaccacagatgaaggatttgcccccaaagccccaacttggcgatcttctggctaagtcacaaacaggagacgtgtctcccaaggctcagcagccttccgaagtgaccctcaagagtcatcctcttgacctctcacctaacgtgcagtcacgagacgcgattcagaaacaggcctctgaggacagcaacgacctgactcctacactgccagagaccccagtacccctgcccaggaagatcaatacggggaaaaacaaagtgaggagagtcaaaacaatctacgattgccaggccgataatgacgatgaactcacctttatagagggggaggtcatcatagttactggtgaggaagaccaggagtggtggatcgggcacatcgaaggtcaaccggagcgcaagggcgttttccctgtgtcgtttgtccacatcctatccgattag

SEQ ID NO: 108598 - DNA, 3390 bp, Artificial Sequence
  Description of Artificial Sequence: Synthetic coding sequence
atgcggtcctccgcatctcgactttcgtcatttagcagccgcgactcgctatggaatcggatgcccgaccagatctctgtgtctgagtttatcgctgagacaaccgaggattacaactcaccaaccacttctagctttactaccaggcttcacaactgtcgaaatacggtgacactgctggaagaagccctggatcaggatagaacagcattgcagaaggtcaaaaagtctgtcaaggccatctacaactcggggcaggatcatgtgcagaatgaagagaactatgctcaggtcctcgacaaatttggttcaaattttcttagcagagacaatcccgaccttgggaccgccttcgtgaaattttctacactgaccaaggagttgtccaccttactcaagaaccttttacagggattgtcacacaacgtcatttttactttagactccttattaaaaggtgacctgaagggcgtgaagggcgatctaaagaaaccattcgacaaggcatggaaagattacgaaacaaaattcacgaagatcgaaaaagagaagcgtgagcatgctaagcaacacggcatgatccgcacagagatcaccggagcagagatcgccgaagagatggagaaagaacgccgactcttccaactccagatgtgcgagtaccttattaaggtcaatgagatcaagactaagaagggcgtggacctacttcagaacctgataaaatactaccacgcccagtgcaatttcttccaggatgggcttaagaccgcagataaactgaagcagtacatagagaagcttgcagccgacctttacaacataaagcagactcaggatgaggagaagaaacaactgactgcccttagggatttaatcaagtcctccttgcagctggaccagaaggaggactcccaatctcgtcaaggaggctatagtatgcaccagttgcagggcaacaaagagtatggttctgaaaagaagggttacctgctgaaaaagagcgatggcatccgtaaggtgtggcagaggagaaaatgctcggtgaagaacggtatactcaccatatcgcacgctaccagtaacaggcaacctgccaagttgaatcttcttacatgtcaggtcaaacctaatgctgaggataagaaaagtttcgatcttatttcccacaacagaacataccactttcaagctgaggatgaacaagactatgtggcttggatcagcgtccttacgaacagcaaggaggaggccctcacgatggcctttaggggagagcagtccgctggtgaaaattcactggaggatctgacgaaagccatcattgaggacgttcagagattaccaggcaacgatatatgctgtgattgtggctcctcagagcccacatggctgtccacaaacctgggtatcttgacttgcatcgaatgtagtggcatacatagggagatgggggtacacatctctagaatccaatccttggagttggacaagcttggtacatctgagctgcttttagcaaagaatgtgggcaataactctttcaacgacattatggaagccaaccttccctctccttccccgaaaccaacaccctcttctgatatgactgttaggaaagagtacatcaccgcgaagtatgttgaccacagattctcccgcaaaacatgtagtacgtcctccgccaaactgaacgagctcctggaagcaatcaaatcacgagatctgctagccctgatccaggtgtatgcggagggtgtagagctcatggagcccctgcttgaacccggccaggagctaggcgaaacggcactgcacctggccgtgagaaccgctgaccaaacgtcactgcaccttgttgattttctagtccaaaactgtggtaatctggacaagcagaccgctcttggtaatactgtgctccactattgttccatgtattccaagcccgaatgtctgaagctgcttctgaggagtaaaccaacagtcgacattgtgaaccaagctggggaaacagccctggatatcgcaaagaggctcaaggcgacacagtgcgaagacctgttaagccaagcaaagtccggaaaattcaatcctcacgtccatgtcgagtacgaatggaatctgcgccaggaagaaatcgacgaatctgacgacgatctggatgataaaccctccccaattaagaaggaacgtagtcctcgacctcagtccttctgtcactcaagctctatttcaccacaggacaaattagcactgccaggcttcagcactcctcgggacaagcagcgcctgtcttacggagccttcactaatcaaatctttgtgtctacgagcactgattctcctacctcccccacaaccgaggcaccccctctcccacctaggaatgcagggaaggggccaaccgggccccctagcacattgccactgtcaacccagacctcatccgggtctagcactctatccaaaaagcgccctcctcctcctcctccaggtcataaaagaaccttatctgaccctccttcaccactacctcatggcccgccaaataaaggagctgtgccttggggtaacgatggggggccaagttcaagctctaaaactaccaacaagttcgagggactgtcgcaacaatcatcaacttcatccgctaaaaccgccctggggccccgtgtactgcccaagttgcctcagaaagtcgcactgcgcaaaactgaccatctgagtcttgacaaggccactattccacctgaaatttttcagaagtcaagccaactggccgagctaccccaaaaaccaccaccaggagatctaccacccaagcccacggagctggcacccaagccacagataggggatttacctccaaagccgggcgaactgcctcccaaaccacaactaggcgatctacctcccaaacctcagttgtcagacctcccccctaaaccacagatgaaggacctgccgccaaagcctcagcttggagacttgttggcaaagtctcaaactggtgatgtaagccctaaggctcaacagccttccgaggtcaccctaaagtcgcaccccctggacttgtcccctaatgtacagtcgagggatgcaatccagaaacaggcatcggaagactctaacgacttaacgcctacgttaccagaaacgcccgtccccctgccgagaaagatcaatacaggcaaaaataaggtcagaagggtgaagacaatctacgactgtcaggcagataacgatgatgagctgacatttattgagggggaggtcatcattgtgaccggagaggaagatcaggagtggtggatcggtcatattgagggccagcccgaacgtaagggcgtgttccccgtaagctttgttcacatactttctgactag

SEQ ID NO: 108599 - DNA, 1065 bp, Artificial Sequence
  Description of Artificial Sequence: Synthetic coding sequence
atgtctttgcgggggtcactgtcccggctactccagaccagagtgcattcaattctgaaaaagtctgtccatagtgtggcagttataggtgcaccctttagccaggggcaaaaacgaaaaggggtagaacatggaccggctgccattcgcgaggcaggactgatgaaacgactatcatctttaggatgtcacctcaaggatttcggggatctctcattcacccctgtgccaaaagatgatctgtacaataatctgatagtaaatcctaggtccgtaggcctggcaaaccaggaactggcggaggtagttagccgagccgtctctgacgggtacagttgcgtaactctgggaggggatcactcactggccattggaactatctcaggccacgcacgccattgccccgacctctgtgtggtctgggtggatgcgcatgcagacattaacacccctttgaccacctcttctggcaatctgcatggtcagccggtttcctttttattaagagagttgcaggacaaggtccctcagcttccagggttcagctggatcaagccttgtatcagctctgcgtcaatcgtatacattggactgcgggacgtcgaccctcccgaacattttattctaaagaactatgatatccagtacttcagtatgcgcgatattgatcgactcggtatccagaaggtcatggagagaacgtttgacctactgatcgggaagcgtcaacggccgatccacttgagttttgatatcgacgcgtttgatccaactctggctcccgccaccggcacaccagttgtgggaggcctaacatatagagagggtatgtatatcgccgaggagattcacaatacaggcctgttgtctgctctcgacttagtcgaagtgaatccccagctcgcaacgagcgaagaggaggctaagacaacagctaacctggccgtggacgttatcgcaagctctttcggacagactcgcgaagggggccatatcgtatacgaccagcttccaaccccatcttctcctgacgagtctgagaaccaggcaagagttcgaatatag

SEQ ID NO: 108600 - DNA, 207 bp, Artificial Sequence
  Description of Artificial Sequence: Synthetic coding sequence
atgaagctgaatgaaaaattttccgagggttggcggaaacccaatgcctcctggaagtcaagttgcagcaagaacagctcggatcgcgataaactctctcttccacataagaagctggagaggggctcgtggagggtgtggcagcctcggagcaccctgtgtcgtaccctggacaagactgaggaagagcgagcaaaaagagaatag

SEQ ID NO: 108601 - DNA, 429 bp, Artificial Sequence
  Description of Artificial Sequence: Synthetic coding sequence
atgaaactgaatgaaaagttctccgaggggtggaggaaacccaatgcgagctggaaaagctcttgctctaaaaacagctctgacagagacaaactttctttgccacacaagaaactggagcgaggctcctggagagtgtggcagcctcggtctacattatgcaggaccctggataaaaccgaagaagagagggccaaacgcgaagaattggaacgcatcctggaggagaataatcgtaaaatcgccgaggcccaggctaagctggctgaggagcagctgaggattgtcgaagagcagcgaaaaatccacgaggagagaatgaagctcgagcaggagagacaacgccagcaaaaagaggagcagaaaatcatattgggcaagggcaagtctagacccaaattgtcattctctctcaagacccaagattag

SEQ ID NO: 108602 - DNA, 822 bp, Artificial Sequence
  Description of Artificial Sequence: Synthetic coding sequence
atggggcgcagtaggtctcgctctagttcgcgcagcaagcacacaaagtcttctaagcataacaaaaagagaagtaggtcaagatcccggagcagagataaagagagagtaaggaagcggtctaaaagccgggagtcaaaacgcaataggcggcgcgagagcagatcacggagtcgttcaacaaacacagcagtgtccagaagggagcgggaccgcgagcgagcgagttctcctcccgaccgcatcgatatttttggtaggaccgtatccaagcggagctctctggatgaaaagcagaaaagggaggaagaggagaagaaggctgagtttgagcgtcagaggaaaatcagacagcaggagattgaggaaaagctgatcgaggaagagaccgcacgcagggtggaagagctggtggctaagcgggtagaggaggagctggaaaagcggaaggacgaaattgagcgcgaggttctgcgtcgagtcgaggaagcgaaacgcatcatggagaaacagttgctcgaagagctagaacgacagagacaggcggagctggccgctcaaaaggcccgtgaagaagaggaacgggctaaacgtgaggaactggagagaatactggaggagaacaataggaaaatagctgaggcacaagccaagctcgcagaagaacagcttagaatagtggaagagcagagaaaaatccacgaagagagaatgaagcttgagcaggagagacagagacaacaaaaggaggaacagaagatcatcctgggcaaggggaagtctcgccccaagctgtctttttctctcaagacacaggactag

SEQ ID NO: 108603 - DNA, 672 bp, Artificial Sequence
  Description of Artificial Sequence: Synthetic coding sequence
atggggcgttcaaggtcaaggagtagtagcagatctaaacatacgaagagctctaaacacaacaaaaagcgtgcatccagcccgcccgatcgcatcgatatcttcggtaggactgtatcaaagaggtcaagtcttgatgagaagcagaagcgcgaagaagaagagaagaaggccgagttcgaacggcaacgcaagatacggcagcaagagattgaagagaagctgattgaggaagaaacagccaggagggtagaagagttagtggccaaaagggttgaagaggagctggaaaaacgtaaagacgaaattgagcgggaggtgttaaggcgagttgaagaagctaaaaggatcatggagaaacagctgctggaagaactagagcggcagcggcaggcagagctcgctgcccaaaaagcgcgagaggtgactctgggacggctggaaagtcgagatagcccttggcagaacttccagtgttgggtcttgcccccagcccagttcaggaagcgctggaacacagattatctcattcctttctcttccaagctgaacatcgccgcgaaagttaatttcctagcatattctgaggttctgacggacaacctcaaggttggtagtttttacaagacatattctagaattctctttgatttgatggaactggccatctag

SEQ ID NO: 108604 - DNA, 495 bp, Artificial Sequence
  Description of Artificial Sequence: Synthetic coding sequence
atgcctgatactatgctcccagcctgtttcctcggcctgttagccttttctagcgcttgctactttcagaattgtccacgtggggggaaaagagctatgtctgacttggaactgcggcagtgcctgccatgcggcccaggaggtaaggggagatgctttggaccaagcatctgctgcgctgatgagcttggatgctttgtggggaccgccgaggccctgaggtgccaggaagagaattacttgcccagcccctgccagtctgggcagaaggcatgtggatccggaggaagatgcgcagcctttggcgtatgttgcaacgatgagagctgcgtcactgagcctgagtgtcgcgagggctttcaccgaagagccagggcttctgataggtctaacgctacgcagctggacggaccggctggagcgctccttcttcgcttggtacaacttgctggtgcgccagagccattcgaacctgcccagcccgatgcatactag

SEQ ID NO: 108605 - DNA, 1257 bp, Artificial Sequence
  Description of Artificial Sequence: Synthetic coding sequence
atgcgtctatccgcaggacccgacgccggaccaagcggcaacagttccccttggtggcctctggcaaccggggccgggaacacttccagggaagccgaggctctgggcgaaggcaacggaccccccagagacgtcagaaacgaagagctcgccaagctcgagatcgcagtgctggctgttacattcgccgtggccgtgctaggcaactcaagcgtcttattggctcttcatcggactcccaggaaaactagccgaatgcacttgttcattcgccacctgtctttagctgacttagcagtcgcttttttccaggtgctgcctcagatgtgctgggacattacatacaggtttaggggaccggactggctgtgcagggtcgttaagcaccttcaggtgtttgggatgttcgcatcagcatacatgctggtagtgatgaccgccgatagatatatcgctgtctgccaccccctgaaaacacttcagcagcctgcgcgaaggagccggctgatgatcgccgcagcctgggttctttctttcgtgttgtcaacaccccagtactttgtcttctccatgattgaggtgaataacgtgacaaaggcccgcgactgctgggccacgtttatccagccttggggcagccgcgcatacgtcacgtggatgaccggtggaatctttgtggctcccgtggtgattcttggtacatgttatggcttcatttgctacaatatttggtgcaatgtacgggggaagaccgcttcgcgacagtctaaaggtgcagagcaggccggagttgccttccaaaaaggcttcctactggcgccctgcgtttcttctgtgaagagcatcagccgggccaagattcgtactgtgaagatgaccttcgtgatcgtgacagcctacatagtctgttgggctcctttttttataatacagatgtggtcagtgtgggaccctatgtctgtctggacggaatcagagaatcctacaattaccatcaccgcgctgctgggttccctcaatagctgttgtaatccatggatttacatgttctttagcggacatttgctccaggattgcgttcagtcatttccatgctgtcagaacatgaaggagaagtttaataaggaggatacagactccatgtcacgcaggcaaacattctatagcaacaatcgctcccctactaatagcaccggcatgtggaaggacagccctaagtctagtaaaagtatcaagtttattccggtctccacatag

SEQ ID NO: 108606 - DNA, 1275 bp, Artificial Sequence
  Description of Artificial Sequence: Synthetic coding sequence
atggattctggccccctgtgggacgcgaaccccacaccgaggggtacactgtccgccccgaatgcgactactccatggctgggacgggacgaagagctcgctaaagtcgagatcggggtcctggcaaccgtgttggtcctggccaccggaggcaatttggctgtactcctgaccttgggacaactgggtagaaagcggtcacggatgcatctgtttgtgttgcacttggcattgactgatctagccgttgcactattccaagtgctaccccagctgctctgggacattacttaccggttccaggggcccgacctgctgtgcagagcagtcaaatatttgcaggtgcttagtatgtttgctagtacgtacatgcttctggcaatgaccttggaccggtacctggccgtgtgccacccgctcagatctttgcagcagcccgggcagagcacatacttattaattgccgcgccttggttactggcagccatattcagtctaccacaggttttcatattctccctgagggaagttattcaggggagtggggtcctcgattgttgggctgacttcggattcccatgggggccacgggcctaccttacctggacaaccctggcaatctttgttttgcccgttaccatgttgactgcttgttatagtctcatttgccacgaaatctgtaagaacctgaaagttaaaacccaggcttggcgagtgggcggaggggggtggcggacatgggacaggcccagcccgtccacgttagccgccactacgcgggggttgccgtcccgagtgagttccattaatactatctctcgcgctaagatcaggactgtgaaaatgaccttcgttattgtattagcctatattgcctgttgggctccttttttctctgttcaaatgtggtcagtgtgggacaaaaatgcgccagacgaggactcaacgaacgttgcgttcacaatctccatgctgttggggaatttaaacagttgttgcaacccatggatctacatgggttttaacagtcatctgttgcccaggccccttcgtcacctagcatgttgcggtggtcctcagcctaggatgaggcggaggttgtctgatggtagtttgagctctcgccatacaaccctcctcacaagatcatcatgtcctgcaactttaagcctgtcgctcagcttaacacttagcggcagaccccgtccagaggaatcacctagagacctagaactggccgacggcgagggcaccgccgaaactattattttctag

SEQ ID NO: 108607 - DNA, 1116 bp, Artificial Sequence
  Description of Artificial Sequence: Synthetic coding sequence
atgttgatggcttccaccacatctgccgtaccgggacacccttctctgccttctctccccagtaacagttcacaagaacgacccctagacacacgcgatccactgctagcgagggccgaactagccctgctatccattgtttttgtggctgtcgctctcagtaatggactcgtgttggctgcccttgcccggcgcggcaggagaggccactgggctcctatacatgtatttatcggtcatctctgcttggccgatttggccgtggcactttttcaggtcctgccccaactcgcctggaaagctacggacaggttccgcgggcccgatgctctctgtcgggcagtcaaataccttcaaatggtgggtatgtatgccagctcatacatgattctggccatgactttggataggcaccgggctatttgtcgacctatgctcgcctatcgacacggttccggggcgcactggaaccgccctgtactggtggcgtgggcattcagcttgttgctgagtctacctcagctctttattttcgctcagcgcaatgttgaaggcggtagcggcgtgacggactgctgggcgtgctttgcggagccatggggacgacgaacttatgttacatggatcgcgcttatggtctttgttgcgcctactctggggattgccgcgtgccaagtactcatcttccgggagattcatgcctccctggtgccaggtccatccgagaggccaggcggcaggcgccggggacgtaggaccgggagtccaggcgaaggcgctcatgtcagcgccgccgtggctaagacggtgcgcatgaccctggtaatcgtggttgtatatgtcctatgttgggctccattctttctggtgcaactgtgggctgcctgggatcctgaagcgccactcgaaggtgcaccctttgtgctccttatgctgttagcatccctgaattcgtgcaccaacccctggatatatgcctccttcagtagctccgttagttctgagcttcggagtctcttgtgctgcgcccgcggacggacaccaccctcactcgggccacaggacgaatcctgtactacagcttcgtcatccttagcaaaagacacgtccagttag

SEQ ID NO: 108608 - DNA, 1116 bp, Artificial Sequence
  Description of Artificial Sequence: Synthetic coding sequence
atgctgatggctagtacaacatccgccgttcccggccacccttctctgcctagtctaccatcgaattcatcacaagagcgtccactggacacccgcgaccccctgttagccagagccgagttggctctcctgtccattgtgttcgtggccgtggctctgtccaacggcctcgtgctggcagccctggcacggcgcggtaggcggggacattgggctccgatacacgtttttatcggccatctctgcctggctgatttagccgtggctcttttccaggtcctgccgcagttggcttggaaggctacagacagatttagaggtcctgatgccttgtgtcgcgctgtgaaatacctgcagatggtaggaatgtatgcctccagctatatgatattagcgatgacgctcgatcgacatcgcgctatctgccggcctatgctcgcttatcgccacgggagtggcgcacattggaatcggccagtgttggttgcctgggccttctcactcctcctatcacttccacagcttttcatttttgctcagaggaacgtcgaaggcggttccggggtgaccgattgctgggcttgctttgcggagccctggggtcggcgcacgtacgtcacatggatcgcgctgatggtgtttgtggcaccaaccctggggatcgccgcatgtcaagtcctgatttttcgcgagatccacgcaagtctcgtgcccgggcccagtgagcggcccggcggtcggagacgtggcagacggacgggtagtcctggggaaggcgcccacgtgtctgctgcagtggctaaaacagttcggatgacattggtcatcgtcgtggtttatgtcttgtgctgggctccattcttcctcgtccagctgtgggcggcttgggaccccgaagcgccccttgagggcgccccctttgtgctcctgatgctgcttgcgagtctgaactcttgtaccaatccctggatttatgcttcattctcctccagcgtgtcaagcgagcttcgcagcctcctttgttgcgcgagaggcagaacgccccccagcctgggccctcaagacgaaagctgtactactgccagttctagcctggccaaagacacctcatcttag

SEQ ID NO: 108609 - DNA, 930 bp, Artificial Sequence
  Description of Artificial Sequence: Synthetic coding sequence
atgctcatggcatccacaacaagcgctgtgcccggccatccttctttgcccagcctgcccagcaattcaagtcaggaaagacccctggacacgcgggacccccttctggcgagggcagaactcgcattactctctattgtgttcgtcgcggttgcattgtcgaatggtcttgtgctggcagctcttgcgagaagggggcgcagaggtcactgggctccaatccacgtgtttattggccatctttgcctggccgacctggctgtggcgctgttccaagtgctccctcaactggcatggaaagctaccgataggtttagaggaccggacgccctgtgtcgcgctgtcaaatacctccagatggtaggtatgtacgccagctcatacatgatcctggcaatgactctggatcgtcacagagcgatttgcaggccgatgctcgcttaccggcacggtagtggcgctcattggaatcgccctgttctcgtcgcctgggctttctccctactgttatcgctgccccaactctttatttttgcccagcgtaatgtagaaggcggctcaggcgtgactgattgttgggcctgctttgctgagccctgggggcggcggacatatgttacttggattgcactgatggttttcgtggctcccacactcgggatcgccgcctgtcaggtgttgatcttccgcgagattcacgcatctctcgtccctggccccagcgagcggccggggggtagacgtcgggggaggaggaccggatctccaggcgaaggcgctcacgtaagtgccgccgtcgcaaaaactgtgcgaatgaccctggtcatcgtggttgtttacgttctttgttgggcaccattttttctggtccagctatgggcggcctgggacccggaagcacctctggaagggggatgttctaggggatag

SEQ ID NO: 108610 - DNA, 1005 bp, Artificial Sequence
  Description of Artificial Sequence: Synthetic coding sequence
atgggcagaagatcttccgatacggaagaggagtcccgcagcaagcgaaagaagaagcaccgccgaagaagctcctctagcagtagctccgacagccggacctactcccggaaaaaggggggtcgtaagtcacgatctaagtctaggagctggtctcgggatcttcaaccccggtctcactcctacgacaggcggaggcggcacagatcctccagctcaagttcctatggaagcaggaggaagagaagtaggagccgatctagagggaggggtaagagctatagagtgcagcggtcaaggtccaagagccggacgcggcggtcgagatcgaggccacgacttaggtcacattcccggtctagtgagcgatccagtcaccggagaacgaggagccgttctagggaccgggagcgacgcaaggggagggacaaggagaagagggagaaggagaaagataagggcaaggataaggagctgcacaacattaagcgcggtgagagcggaaacataaaggccggcctggaacatctgccacctgccgagcaggccaaggcccgcctgcagcttgtcctagaggccgccgctaaagcggacgaagccctaaaagctaaagagaggaatgaagaagaagcgaagaggaggaaagaggaagaccaagcaactctcgtggaacaggtgaaaagagtgaaggagatcgaggctattgagtcggactcattcgtgcagcaaaccttcagatctagcaaggaagtgaagaaatctgtagagccttccgaggtgaaacaggcaactagcaccagcgggccggcatcagccgtcgccgaccccccatccaccgagaaagaaatcgatcccactagcatacctactgccattaaataccaagacgataactccctggcacatccgaatctgttcattgagaaggccgacgctgaggaaaaatggtttaagcgactgatcgcgctgcggcaggagcggctcatggggagcccagtggcttag

SEQ ID NO: 108611 - DNA, 831 bp, Artificial Sequence
  Description of Artificial Sequence: Synthetic coding sequence
atgggaagaagatcttccgacacagaagaggagtcccgctcaaagcggaaaaaaaaacaccgacggaggagctcaagcagctcatctagtgactcacgaacatactcaaggaaaaagggcggacggaaaagtcgctccaagtctaggtcctggagcagagacctgcagcctaggtctcactcttacgacaggcgtcggaggcacagatcgagttcttccagcagttatggctctcgaagaaaacgctctcgaagtcgcagcagaggacgcggcaaaagttatcgcgtccaacgcagccggagcaagagccggacgcgcagagaatccgggaacatcaaggccgggctggagcacctgccccctgcagaacaggctaaggctaggctgcagcttgtgcttgaagcagcagccaaagcagatgaggcattaaaggcgaaggaacgaaacgaggaggaggccaaacgtagaaaagaagaggatcaggcaaccctggtcgaacaggtaaagcgcgttaaagagattgaagccatcgagtcagactcctttgtgcagcaaacctttagatcttcgaaagaagtgaagaaatccgttgagccatctgaagttaagcaagccacttctacctcaggtccagcttccgcagtcgccgaccctcccagcacagagaaagagattgacccaacttctatccctacagcaataaaatatcaggatgataacagcctagcccatccaaacctgttcattgagaaagccgatgctgaggagaagtggttcaagagactgatcgcattgagacaagagagactgatgggcagtccagtcgcctag

SEQ ID NO: 108612 - DNA, 831 bp, Artificial Sequence
  Description of Artificial Sequence: Synthetic coding sequence
atggggaggcggagcagtgacaccgaggaagaatcacggtctaaacgaaagaaaaaacacagacggcggagctcttcttcatcctcctcagattcccgaacttatagcaggaagaaaggaggccgcaaatctaggtctaagtctcgcagctggagccgcgatctgcagccccgtagtcactcctacgaccggcggcggaggcaccggtcttccagtagttctagttacggcagtcggagaaaacgatctcgcagcaggtcccgagggagagggaagagttatagggtccaacgatcccggagtaaatcacgcacacggcgggagagtggaaatattaaagcaggtttagagcacttacctcccgcagagcaggccaaggctcgcttgcagctggtgctggaagccgctgccaaggctgacgaagctctcaaggcaaaagagaggaatgaggaagaagccaagcgtcgtaaggaggaagaccaggccactctggtagaacaagtgaagcgggtgaaggagattgaggccatcgagagtgatagctttgtgcagcagacattccgcagctccaaggaggtgaagaagagcgtagaacccagcgaagtgaagcaggctacctccaccagcggtcctgcttctgccgtagccgatcccccctccacagaaaaagaaattgatccaaccagtattccaaccgctataaagtaccaggacgacaacagtctggctcatccaaatttgttcattgaaaaagcagacgctgaggagaaatggtttaaacgcctgatcgcactgaggcaggaaaggcttatggggtcccccgtggcctag

SEQ ID NO: 108613 - DNA, 612 bp, Artificial Sequence
  Description of Artificial Sequence: Synthetic coding sequence
atggggagaagatcctccgatacggaggaagagtccaggagtaaaagaaagaaaaaacaccggcgtcgaagctcttcaagctcgtctagtgacagccggacctacagtaggaagaagggcggcagaaagagtcgctcaaagagccggagttggtcccgagacctacagcctaggtcccactcctatgaccggcggcgccgacatcggtctagttcttcatcttcctacggatccaggagaaagagaagtcgcagccgatcaaggggccgaggtaaaagctatagggtccagcggtcccgtagtaagtccaggacgagacgctcaaggtcaaggcctcggctgagatcccatagtcggagctctgagagatcatcccaccggcggaccaggtcaaggtcccgcgacagggagcggcggaaaggcagagataaggaaaagcgggagaaggagaaggacaagggcaaggacaaagagctgcacaacataaagcgtggagagagcggtaacatcaaggccgggctggaacacctacctcccgctgagcaggccaaagcaaggttgcagctcgtcttggaagccgccgctaaggcagatgaagccctcaaagcctag

SEQ ID NO: 108614 - DNA, 585 bp, Artificial Sequence
  Description of Artificial Sequence: Synthetic coding sequence
atgggtcggagaagctcggacaccgaggaggaaagcagatcaaagaggaagaaaaagcaccgacgtagaagcagctcgtcatctagctccgactcgaggacttactcccgcaagaaagggggcagaaagtccagaagcaagtcccgcagctggtcacgtgatctccagccgcgctcacacagctacgatcggaggcggaggcatagaagctccagctcttcctcttacggaagcaggcgcaagcgctccagaagtcggagccgggggcgagggaagagttaccgggtccagaggagccggtcgaaatctagaacccgtcgcagccggtcacggccccgtttgaggtcacacagccgcagcagcgagaggtctagccatagaaggacccgttctaggagccgggatagagaacgacgcaagggccgtgacaaagagaagagagagaaggagaaagacaaagggaaggacaaggagcttcacaacatcaagcggggtgagtccggtaacatcaaagcaggcttagagcacctgccgccagccgagcaggcaaaggcaagactgcaactggtccttgaggccgcttag

SEQ ID NO: 108615 - DNA, 1005 bp, Artificial Sequence
  Description of Artificial Sequence: Synthetic coding sequence
atgggtcggcgctcctctgatactgaggaagaatcccgctccaagcgcaagaaaaagcatcgccgccgatcttccagctcctcttcgtcagactccaggacctacagccgcaaaaagggaggtcggaagtcccgttcgaagtctcgctcgtggtctcgggacctacaacccagatcacacagctatgacaggaggcgtaggcatagatctagtagttcatcatcctacggctctcgtaggaagagaagtaggtctaggtctagaggaagggggaagagctacagagttcaacgtagtcgatcgaaaagccgaacccggcggagtcgttcgagaccaagactccggagccactcccgtagtagcgagagaagcagtcataggagaacaagaagccgctccagggatagagaacgtcgcaaaggtagggataaggagaagcgagaaaaggagaaggataaaggcaaagacaaagagctccacaacatcaagagaggcgaatccggcaacatcaaggccggtttagagcatcttccccccgcggaacaggccaaggcgcggttacagctggttttggaggcggcggccaaagccgacgaggccctgaaagctaaggaaagaaatgaagaagaagccaaacgcaggaaggaggaagaccaggcaacgctcgtagaacaagtgaagagggtcaaagaaattgaagccatcgaaagcgactcttttgttcagcagacctttaggtctagcaaggaggtgaaaaagtcagtcgagcctagcgaggtcaaacaggctacgtctacgtccggacctgcctcggctgtcgccgatcctccgtcaacggagaaggagattgaccccacttcgatccccaccgcaattaagtatcaggatgacaattccctcgcccatcccaacctctttatcgagaaggcagacgcagaagaaaaatggttcaaacgcctgatcgccctgagacaggaacggctgatggggtccccagtggcctag

SEQ ID NO: 108616 - DNA, 498 bp, Artificial Sequence
  Description of Artificial Sequence: Synthetic coding sequence
atggggcggcgcagctcggacactgaggaggaatctagatcgaagcggaagaaaaaacaccgcaggcgatcctcgtcctcatcatcttccgatagccgcacctacagtcggaaaaagggtgggcgcaaatctagatccaagtcccgcagctggtcaagggatctgcagccaaggtctcactcatacgaccgacgaagacggcaccggtcctcaagttcctctagctatgggtctaggcggaaaagaagcagaagcaggtcccggggaaggggtaagtcttacagggtgcagagaagtcggtccaaatcccgaactcgccggtcccggagtagaccccggctacggtcccacagccggagctctgagcgcagttcccatcgcaggacacggtcgagaagtcgggatagggagcgacggaagggtcgagacaaagaaaagagagaaaaagaaaaagacaaaggcaaagacaaggagcttcacaacatcaaacgtggctag

SEQ ID NO: 108617 - DNA, 948 bp, Artificial Sequence
  Description of Artificial Sequence: Synthetic coding sequence
atgaggaacaggatggcgcctgaaaatccacagccagacccgttcattaaccggaattactcaaatatgaaagttattccgcctcaagatcctgcgtctcctagctttacactgctgtctaagctcgaatgcagtggcactgtgtccgcatactgctctctgaatcttccaggtagtacagacccacctacctcagcgtctcgagttgcagcgaccacagccattagacggcgccataaggaacgcacttcattcacgcaccagcagtacgaagagctggaagcacttttcagccaaacaatgttccctgatcgcaatttgcaggagaaactggcactgaggctcgatctacctgaatccacagtcaaagtatggttccggaaccgcaggtttaaactgaagaagcaacagcagcagcagtcagcaaaacaacgaaaccagatcttgccttcaaagaaaaatgtccctacatctccgaggacatctccctcaccctatgccttctcaccggtcatctccgatttttattcttctcttccatcacaacctctagacccctctaactgggcctggaatagtacctttacggagtcttcaacctccgactttcagatgcaggacacacagtgggaaaggctagttgcctctgtgcccgcgctgtacagcgacgcctacgacatcttccaaattatcgagctgtacaatttgcctgacgagaacgaaattagttctagcagctttcactgcctctaccagtacttaagtcccactaagtatcaggtgggtggccagggttccagcctcagtattttcgccggacccgcggtgggtctgagcccagctcagacatggcccaatatgacttcgcaagctttcgaggcgtacagtctgacagattcgctggagttccagaagacatctaatatggttgacttaggcttcctctag

SEQ ID NO: 108618 - DNA, 4701 bp, Artificial Sequence
  Description of Artificial Sequence: Synthetic coding sequence
atgactgccgacaaggacaaagataaggataaagagaaggaccgggacagggatagagaccgcgagcgcgagaaaagggataaagcccgggaaagcgaaaactccaggccacgacgctcgtgtaccctcgaagggggggcgaaaaattatgctgaatcagaccattccgaggacgaggacaatgataacaattctgccacagccgaggaaagtaccaagaagaacaagaagaagcctccaaagaagaagtcccggtacgagaggacagacacgggtgaaatcacatcttatattactgaggatgatgtggtatatagacctggggactgtgtctatatcgagagccgccgtccaaatacgccttactttatttgttccatccaggatttcaagctggtgcataatagccaggcctgctgtaggagtcctactccagcactctgcgatccaccggcctgctccctccccgtagcttctcagccccctcagcacctcagcgaggcgggtcgtggacccgtggggagcaagcgagatcatctgctcatgaacgtcaaatggtactacaggcaatccgaagtcccggacagtgtctaccaacatttggtgcaggatagacacaatgagaacgacagcgggagggaactcgtgatcacagatccggtaattaaaaacagggaactcttcatttccgactatgtggatacttatcacgctgccgccctcagagggaaatgcaacataagtcacttttcggacatcttcgctgcacgagagttcaaggctcgcgtcgattcctttttctatatcctcgggtacaatcctgaaaccaggcggctgaactcaacccagggtgagatccgggtcggacccagtcaccaggccaaactgcccgacctgcagccttttccctctccagacggcgacacagtcacgcagcacgaagagctggtctggatgcctggtgtgaacgactgcgatctcttgatgtatttgcgggccgctcgttcaatggcggcttttgcgggaatgtgcgatggcggttctacagaggacggctgtgtagccgctagcagagacgacactaccctgaacgcattgaacaccttgcacgaatccggctatgacgcaggtaaggccctgcagcggttggtgaagaagcccgtccctaaattaatagaaaaatgctggacagaggacgaggtaaagcgatttgttaaaggacttcggcagtatggtaaaaattttttccggataaggaaggaactgcttcccaacaaagagaccggcgaactcatcactttttactattactggaagaagacccccgaagctgccagtagtcgcgctcaccggcgtcacagaagacaggcagtgtttcggcgcattaagacacggaccgcttccacccctgtcaacacacccagtcggccgccctcttcagagtttttagacctgagctccgccagcgaggatgattttgactccgaggactccgagcaggaattaaaagggtacgcctgcaggcactgttttacaacaacatccaaagactggcaccacggagggagggagaacattctgctctgtaccgactgcaggatccacttcaagaaatacggggaactcccccccatcgaaaaaccagtggacccacccccttttatgtttaaaccagtgaaggaggaggacgatggtctgagcgggaaacactctatgcgaacaagaagatcacggggctctatgtcaactctgcggtccgggagaaagaagcagcctgcatcccccgacggcaggaccagtccaattaacgaagacatcaggagctccggaaggaactctccatctgcagcctccacttcatcaaacgactcaaaggctgagactgtaaaaaaatcggccaagaaagtcaaggaggaggcgtcctctcctctgaagagcaataaacgtcagagagaaaaggtggcaagcgatactgaggaggcagaccgcacatcatcaaaaaagaccaagactcaggaaatttcaaggcctaattccccgtcagagggagagggggagtcaagcgatagtcgctccgtgaacgacgagggaagctctgaccctaaggatatagaccaggataatcgctccaccagcccaagtatcccaagtccacaggacaacgagagtgatagcgatagctctgcccagcaacaaatgctgcaggcccagccgcccgctctgcaagcaccaacaggcgtgaccccggccccttcatccgcccctcctggcacaccacagctccccactcccggacccactccttctgcaacggccgtacccccgcaggggagtcctaccgctagccaggccccaaatcagccacaggcgcccacagccccggtccctcacacccatattcagcaggcccccgcgttgcatccacagcgccccccctccccccacccgccccctcacccttctccccaccctcctttgcagccactcaccgggtccgcaggccaaccttccgctcctagccacgcgcaaccaccccttcacgggcagggccctcccggccctcacagtctgcaagccggaccactgctccagcatccgggcccccctcagccctttggcttacccccacaggcaagccagggccaggccccactcgggacctcaccagctgcagcttaccctcatacgagcctccagttgcctgcaagtcaatctgcccttcaaagtcaacagccccctcgggaacagccacttcctcccgctcctttggcaatgccccatataaagcctcccccaacaacccccatccctcagctccctgccccacaggcgcacaagcaccccccgcaccttagcggcccctccccattcagcatgaatgcaaacctgccgcctccaccagccctcaagccactgtcgagcctttctacacaccacccaccttccgctcacccgccccctctgcagctaatgccgcagtcccaaccgttacccagttcccccgcacaaccgcccgggctaacgcagagccaaaaccttccacccccacccgccagccaccctccaactggacttcatcaggtggcacctcagccccctttcgctcagcaccccttcgtgcccggaggacctcctccgattacacccccgacgtgtccctctacctctacacctccagctgggcctggaacgtctgcccagcccccttgcagtggagcagcggcgtccggggggagtatcgccggagggtccagttgtcctctgcctacagtgcagattaaggaggaggcactggatgacgccgaggaaccagagtctcctccacctcctcccagatcaccgtctccagagcccacagtcgttgataccccttcacacgcctcacagtccgcccgtttttataagcatctggatcgaggatacaactcctgtgctcggactgatctgtattttatgccgcttgctgggagcaaattagcaaaaaagcgggaagaggccatcgaaaaggccaaacgcgaagctgaacagaaggcccgggaggaaagggagcgcgagaaagagaaagagaaggaaagggagcgcgagcgcgagcgagagagagaggctgaaagggctgccaaggccagttcatcagcccatgagggaaggctcagtgatcctcagctgtcaggacctggccacatgcgaccttcttttgaacctccacccactactatagcggcggtgcctccttacattggcccagacacacccgcactgcgtaccctgtctgaatacgctcgcccacacgtgatgtcaccgacgaataggaatcaccccttctacatgcctctcaacccaacagatcctctcctcgcttatcatatgcccggcctctataacgttgacccaaccatcagagagcgagaactgagagagcgtgaaatacgggaacgagaaattcgtgaacgcgagctcagagaaagaatgaagccaggatttgaggtgaagccgcccgagttggaccctctacatcccgctgctaatccgatggaacactttgcacggcatagtgctcttacgatacccccaacagctggaccgcacccttttgcatccttccaccctggcctgaaccctctggagcgcgagcgcctggccctggccggcccacagcttaggcctgagatgtcgtatccggaccgcctcgcggcggaacggatccacgcggaacggatggcctccttgactagcgatccattggcacgtctgcaaatgttcaacgtgacgccccatcatcaccagcatagccacatccactctcatctgcatctgcaccagcaggatcctctgcatcagggctcagctggccctgtgcacccattggtcgatcccctgactgccggcccacacctggcacgctttccataccctccaggaaccctgcctaacccacttcttggacagccgccacatgagcacgagatgctgcgccaccccgtttttggaactccttatccaagggatttaccaggggctattcctccgccgatgtccgctgcccaccagctgcaagccatgcacgcccaaagcgctgaactacagaggttagccatggaacagcagtggctccacggtcatccacacatgcatggcggacacctgccctcgcaagaggattactactcccgcctgaagaaagaaggggacaagcagctatag

SEQ ID NO: 108619 - DNA, 3897 bp, Artificial Sequence
  Description of Artificial Sequence: Synthetic coding sequence
atggacgatcccttctcgccgtgtagaagactgaactcaactcagggcgaaatcagggttggcccgtcccaccaggctaagcttcccgatctgcagccatttccaagtccagatggggatacggttacacagcacgaggaactcgtgtggatgcctggggtcaacgactgcgacctcttaatgtacttgcgcgcagctcgttccatggccgcctttgcagggatgtgtgatggaggttccacggaagatggctgcgtggctgcgtctcgcgatgataccacacttaacgccctcaatacgttgcacgaatcaggctacgacgcgggcaaagcgctgcagcggttggtaaagaagcctgtgccaaaactaattgaaaagtgttggaccgaagacgaggtgaagcgctttgttaagggactgagacaatacggaaagaacttcttcagaatcagaaaggagctgttgcccaacaaagagaccggagagcttatcactttctactactattggaagaagactcctgaagccgcatcatctcgagcacacagaaggcaccggcggcaagccgtgtttcgtagaattaagacccgaaccgcttcaacccccgtaaatacgccatcccgccccccatcaagcgagtttctcgatttatccagtgcctccgaagatgacttcgactccgaggacagcgagcaggagctgaaaggatacgcatgcagacactgttttaccacaacctctaaggattggcaccacggaggccgggagaatatcctgctctgcacggattgtcgaatccattttaaaaagtatggagaattgccccctattgagaaacccgtggatccaccccctttcatgttcaaacccgtcaaggaagaggatgacggcctttcaggcaaacatagcatgaggaccaggaggagccgcggctcaatgagcaccctgcggtctggccggaaaaaacaacccgctagtccagatggaagaacaagccctatcaacgaggacatacgatcttccggccgcaacagtccctccgccgcgagcaccagcagcaacgatagcaaggcggaaaccgtgaagaagtcagctaagaaagtcaaggaggaggccagctcccccctcaaatctaacaaacgccagcgggaaaaggtcgcaagtgacacagaggaggcggataggacctcctcaaaaaagacgaagactcaggagatttctcggcccaactctccatctgagggagagggcgaatcatccgactctcgtagcgtgaacgatgagggttcatcggatccaaaagatattgatcaagacaatagaagtacatcacctagcatacccagcccccaagacaacgaaagtgactcagacagctctgctcagcagcagatgttgcaggcacagccaccagctttacaggcccccacaggtgtgacacccgccccctcatccgcaccccctgggaccccccagctgcccacccccgggcccacacccagtgcgacagcagtgcccccccagggaagccctactgcatcacaggccccaaatcagccccaggcgcctactgcaccagtcccccatacacacatccaacaagcccctgccctgcatccgcagcggcctccttcacctcatccacccccccacccatcccctcaccccccgctccaaccactgactggcagtgctggccagcctagcgcacccagccacgcccagccccctctacacggacaaggcccccccggcccccatagcctccaggctgggcctctgttgcaacatccaggcccccctcagccgtttgggcttccgccacaggcgtcacagggccaagctcccctgggaaccagccctgctgccgcgtatccccatacctccttgcagctgccagcatcccagtccgcactgcaaagccagcaaccgcctcgtgaacaaccactgccccccgccccccttgccatgccccacataaagccgcccccaacgactccaatcccgcagctcccagcgccacaagcacataaacaccccccgcacttgtctggtcccagtcctttttctatgaacgccaacttacctccccccccagccctcaaacccctgtcctccctatcaacccatcatccaccttcggcccatcctccccctctccagctcatgccgcaatcccaacccctgccttctagcccggcccagccacccggcctgacacagagccagaacttgcctcctcctcccgccagccatcccccaacgggcctgcatcaggttgcaccgcagccaccattcgcacagcaccctttcgtacccggcggcccgccaccaattaccccccctacatgcccttccacttccacgccaccggcgggtcccgggacctccgcccaaccaccctgttcaggtgctgcagcctctgggggatccattgcagggggctcaagttgcccactgcctacagttcaaatcaaagaagaggccttagacgacgcagaggaaccagaatcaccacccccacctccaagaagcccatctcccgagcccacagtggtggacacaccctcccacgcctctcaatcggcccggttctacaagcaccttgataggggctataatagctgtgcaaggacggacctgtactttatgcccctggctggatcaaaacttgcaaagaaacgggaagaggcaattgaaaaggctaagcgtgaggctgagcaaaaggcaagagaggagcgtgaaagagagaaggagaaggaaaaagagagagagcgagagcgggagcgggagagagaagccgaacgcgctgccaaggcaagcagctcagcccacgagggtcggttatctgaccctcaactctccggacccgggcatatgaggccttccttcgagccacctccaacaaccatcgccgcagtccctccctacatcggcccagacacaccagccctgcggactctatcagaatacgctagaccccacgtcatgagcccaacgaacagaaaccaccccttttacatgcccttgaatcctaccgaccctctgcttgcttaccacatgcctggcctttacaatgtggacccgacgattcgcgagagagaactgagggagcgcgaaatccgtgaacgagaaatccgagagcgagaactgagagaacgtatgaagcctgggttcgaggttaaaccgcctgaactagatccacttcatcccgccgcaaacccaatggagcatttcgctcggcactctgcactgactattcctccaacagctgggccacatccttttgccagctttcaccctggactgaacccattagagagggaaaggctggcactggctgggccacaactgcggcctgagatgagctatccagatagactggcggcagagcgcatacacgccgagaggatggcttcactcacatcggatcctctcgccagactgcagatgttcaatgtgacacctcaccaccaccagcatagtcacatccactcacacctgcatttgcaccagcaggatccactgcatcagggtagtgccggacctgtgcacccgctggtggatcctctgacggcaggtccccatcttgcgagatttccataccctcccggtacactacctaatcccctgctgggtcagcccccgcacgagcacgagatgcttcgtcacccagtcttcggaactccctatcccagagacctcccgggagccatccctcctcccatgtccgccgcacatcagttgcaagcaatgcatgcacagagcgctgaactgcagcgccttgccatggagcagcagtggctccatggccacccccatatgcacggcggccatctgccatcccaggaagactattacagcagactcaagaaagaaggggataagcagttgtag

SEQ ID NO: 108620 - DNA, 4701 bp, Artificial Sequence
  Description of Artificial Sequence: Synthetic coding sequence
atgactgccgataaagataaggacaaagacaaggagaaggatcgggaccgagatagggatcgcgaaagagaaaaaagggacaaagcgcgcgagagcgaaaattcaagaccaagacggtcctgcacgctggaaggaggcgcaaagaactatgctgagagcgatcacagcgaggatgaggataatgacaacaatagcgcaactgcggaggagtcgaccaaaaaaaacaagaagaagccacccaaaaaaaaaagccgctatgagcgaacggacacaggagaaatcactagttatatcactgaagatgacgtggtttaccgcccgggtgactgcgtctatatagagtctcgtaggcctaataccccttactttatttgctctatacaggactttaagctggtccacaattcacaggcatgctgccgctcccccacacccgcgctgtgcgatccaccagcctgcagcctgcctgtggcctcccagccccctcagcatcttagcgaggctggaagggggcccgtcggatctaagcgcgatcacctgctgatgaacgtcaaatggtattatcgacagtctgaggtcccggactccgtttatcaacatcttgtgcaggatagacacaatgaaaacgattctggccgcgaattggtgatcacagacccagttataaagaaccgagagctcttcatcagcgactatgtcgacacatatcacgcagctgccctgaggggcaaatgcaacatttcacacttttccgatatcttcgcagctcgggaattcaaggcccgtgttgattcctttttctacatcctaggctacaatccagagacacggcgcctgaactcaacacagggcgagatcagagtcggtccgtcccatcaggccaagctgcccgacctgcaacctttcccttcacctgacggcgatactgtgactcaacacgaagaactggtctggatgccaggcgttaacgactgtgacctgctaatgtatttacgcgctgctcgcagtatggcggcttttgcagggatgtgcgacggagggtctaccgaggacggatgcgtggccgcctctcgtgatgatacgacattgaatgcccttaacacccttcacgaatcagggtatgatgccgggaaagcattgcagagactggtgaagaaacctgtgcctaagctgatcgagaagtgctggaccgaggacgaggtcaagcggtttgtgaaaggactgaggcaatacggtaaaaatttctttcgaataagaaaagagctgcttcctaacaaagagacaggagaactgattactttctattattattggaagaaaaccccagaggccgcgtcatctcgggctcaccgacgccacaggcgccaggccgtctttaggcgcatcaagacaaggacagcatcaacccctgttaatacgccctctcgaccaccatcttcagagttccttgacttgagctccgcttccgaagacgactttgattctgaggatagtgagcaggaactcaaaggttacgcctgtcgacattgcttcaccaccacatcaaaggattggcatcatggaggccgcgagaacattctgctgtgtaccgattgtcgcatccactttaaaaaatacggagagcttccaccgatcgaaaaaccagttgaccctccaccttttatgttcaaacccgttaaggaggaagacgacgggctctccggtaaacactctatgaggaccaggcggtcacgcggcagcatgagtaccctccgatctggaagaaagaagcagccagcttcccctgatgggaggacttcgcctataaatgaggatatcagatcctccggccgaaacagccccagcgcagcaagcacaagcagcaatgattcaaaggcagaaacggtgaaaaaaagcgccaagaaagtgaaggaagaggcctccagcccactgaaaagcaataaaagacagcgtgaaaaagtagcttcagacacagaggaggctgatcgcactagttctaagaagacgaagacacaagagatctctaggccaaactccccatccgaaggcgaaggcgaatcatctgacagccggagcgtaaacgatgaagggtcgtcagaccccaaggatattgaccaagacaacaggtccaccagcccttcgatacctagccctcaggacaacgaaagcgattccgattcatctgctcagcaacaaatgcttcaggcccagccacccgccctccaggcccccactggagtcacccccgcaccgagcagcgcccctcccggaactcctcagcttcctacaccaggacctactccgtcagcaaccgccgttcctcctcagggttctccaacagccagccaggcacccaatcagcctcaggctcccaccgctcccgtgcctcacacgcatatccagcaggccccagcactgcatcctcaacgccctccctcccctcacccaccaccccatccaagtccacatccgcccttacagcccctgacagggtctgccgggcagccaagtgcccccagtcatgcccaaccacctttacatggacaaggcccccctggcccccatagcttgcaagctgggcctctgctgcagcaccctggccctccccagcccttcggcctccccccccaggccagccagggccaggctcccctcggaacttctcccgctgcggcctacccccacacttctctgcagctccccgccagccaaagtgctctacaatcccagcagccacctagagaacagccgctgcccccagctccacttgccatgcctcatattaagccccctcccaccacccccattccccaactgcccgcaccgcaggcccacaaacatcctccacacctgagcggcccatcccctttcagtatgaatgcaaacctcccccctcctcccgcgctgaaacctctgagctcgctcagcacccaccacccaccttccgctcatccgccccccctgcagctgatgccccagtcccagcccttgcccagttcacccgctcagcctccaggcctgacacagtctcagaatctgccaccgcccccagcaagtcatccccccacagggttacatcaggtcgcgccacagccccctttcgcccaacatccttttgtgcccggtgggccgcccccaataacccctccgacgtgcccgagcacaagcacaccccctgcaggtcccggaactagcgcccaacccccctgtagtggggctgcggcaagtggcggctcaattgctggcgggagttcgtgcccccttccaaccgtacagatcaaggaagaagccctggacgacgccgaagagccagaatccccaccacccccgcccagaagcccttcaccagaacccaccgtagtggacacaccatctcacgcctcccaaagcgcccgtttctacaagcatctggaccggggatacaactcctgcgctcgtacagatctgtacttcatgccacttgctggcagcaaactggccaagaagcgcgaggaggcaattgagaaagccaaacgcgaggccgagcagaaagctcgcgaagaaagggagcgagagaaagagaaagagaaagaaagagagcgtgagcgggaacgcgagcgcgaagccgagcgcgcggccaaagcctccagcagtgcgcatgaaggtcggctgagcgaccctcaactcagtggaccaggccacatgagaccatccttcgagccaccccccacgacaatcgcagccgtcccaccatatataggaccagacacacccgccctgcgaaccttatcggagtatgctcggcctcatgtgatgtctcctaccaacagaaaccacccgttttacatgcccctgaacccgacagacccattactggcttatcatatgcctggcctctataatgttgatccgaccatccgcgagagagaattgagggaacgcgaaatcagagaacgcgagattagagagagggagttgagggagcggatgaagcctggatttgaagtgaaaccccccgagctggacccactccacccagcggctaaccccatggagcacttcgccaggcactctgcactcaccatcccgcctaccgccggaccgcaccccttcgcgtcattccacccgggcctgaatccactggaaagggaaagattggccctggccgggccgcaattgaggcctgagatgtcctatcctgaccgattggccgctgaaagaatccatgcagagaggatggccagcctcactagcgatcctctggcgcgcctgcagatgttcaacgtcactccacatcaccaccagcacagccacattcacagccatctgcacttgcatcagcaggaccccctgcaccagggttctgcgggccctgtgcatccattagtagaccccctgacagccggtcctcatctcgctcggttcccctacccaccaggcacgctgcccaatccgctgttaggacagccaccgcacgaacacgaaatgttacgccatcctgtgttcggtacaccctacccacgggatctgcctggagctattccaccaccgatgtcagctgctcaccaattgcaagccatgcacgcgcaatctgctgaactccagcggctggctatggagcagcaatggctgcacggccatccacacatgcacggggggcaccttccaagccaggaggactattattccagactgaaaaaggagggggataagcagctgtag

SEQ ID NO: 108621 - DNA, 3039 bp, Artificial Sequence
  Description of Artificial Sequence: Synthetic coding sequence
atgttcaaacccgtgaaagaggaggatgacgggctgtctgggaagcattcaatgcggactcgtaggtccaggggatccatgtccacgcttcgctccgggcggaagaaacagcccgcgagtccagacggcagaacttcccccattaacgaggatatccggagttcgggcaggaattccccatccgccgccagtacttcctctaatgattccaaggctgaaacagtcaaaaaatcagccaaaaaggtgaaggaagaagcatcatcacctctaaaaagcaataagagacaaagagagaaggtggccagtgacaccgaggaggccgaccggacaagctcaaaaaagacaaagacccaggaaattagccgacctaactctccaagcgaaggggagggggagagctcggacagtcgatcggtaaatgacgaaggatcgagcgatccaaaggacatagaccaggacaatagaagcacctctccttccattccaagcccgcaggataacgaatccgacagtgactcaagcgcccaacagcagatgctgcaggcacaacctcccgccctccaggcacctacgggcgtcacccccgctccttctagtgccccacctggtactccacagctgcctacaccaggccccacaccaagcgccaccgccgtgccacctcaggggagtccaaccgcatctcaagcccctaatcagcctcaggcaccaacagcccctgttccccacactcacatacagcaggcaccagccctgcatccacagcgacccccaagcccgcacccaccaccccacccatccccccatcctccgctgcaaccacttacggggagcgcaggtcaaccctcggccccaagccatgcccagcctccattgcacgggcagggaccccctggacctcacagtcttcaagccggtcctctgctgcaacatccgggccccccccagccatttggcctaccacctcaggcaagccagggacaggctcccctgggcacctctcctgcagccgcctatccccatacctccctccagctacccgcatcccagagcgctctgcaaagtcagcagccaccacgcgagcagccgctgccacctgcacctcttgcaatgccccatataaagcctccccctaccacgccaattcctcagctcccagctcctcaagctcacaaacaccctccgcatttgtctggccctagtcctttttccatgaatgcgaaccttccccccccgcccgcgctcaaaccacttagttccctaagcactcaccaccccccaagtgctcaccctcctccactgcagttgatgccccagtctcaacccctgcctagtagccccgctcagccccccgggctcacccagtctcagaatttgcctcctcctcccgcgagtcatcccccaactggcctgcatcaggtggccccacagccaccatttgcgcaacatccgttcgttcccggcggacctcctcctataacaccccctacctgcccctctacaagcactccccccgccggccctgggacgtctgctcaacccccttgttcaggcgcagcagcatccggggggagcatcgcaggcgggagctcttgcccactgccaaccgtgcagataaaagaggaagctctagacgacgccgaagaaccagagtccccacctccccctccccgctcaccatctccagaacccactgtggtcgacaccccttcccacgcttcacagagcgcacgtttctataaacaccttgaccgcggctacaacagctgtgcacgaactgatctctatttcatgccgctggccggcagcaaattggctaagaagagagaggaggccattgagaaggcaaagcgtgaagccgagcagaaggccagggaggaacgcgaacgtgaaaaggagaaagaaaaagaacgtgaaagggagagggagcgcgaacgtgaggccgagagggctgcaaaggcctcttctagcgcgcatgaagggagactgtccgatccacagctgtccggcccagggcacatgcgtccatcctttgagccccccccgaccaccatcgccgccgtacctccctatatcgggcctgacacacctgcgctccgtaccctgtcagagtacgctcggcctcacgtgatgagccccaccaatcgcaaccaccccttttacatgccccttaatccaactgatccactcctggcttaccatatgccggggctgtataacgttgatcccacaatcagggaacgcgagttgcgggaaagggaaatcagagaaagggagataagggaacgggagctgagagaaagaatgaaacccggcttcgaagtgaaacctccggagttggaccccctgcaccctgctgcaaacccaatggagcacttcgcacgccattctgccctaacgatcccccctaccgcaggccctcaccccttcgcttcatttcatcctggtctgaatcccctagaacgagagcggctggcccttgctggtccacagcttaggcccgagatgagctaccccgaccgcctcgcagcagaacggatccacgccgaacgaatggctagtctcacaagtgatccactggcacgcctccagatgttcaacgtgacaccccaccaccatcagcactctcacattcactcccacttgcatctgcaccagcaggacccgcttcaccagggatctgccgggcctgtgcaccctctggtggacccccttaccgctggaccgcatctggctcggttcccatatccacctggcactttaccaaacccactcctcggacagcctccacacgaacacgaaatgctgcgccaccctgttttcggcactccatatccgcgagatctgcctggagctatccctcctccgatgtctgctgcccatcaattacaggctatgcacgcccagagtgctgagctgcagagacttgccatggaacagcagtggctccacggccacccccatatgcatggagggcacctccccagccaggaagactactactcccggcttaagaaggaaggcgacaagcaactatag

SEQ ID NO: 108622 - DNA, 1953 bp, Artificial Sequence
  Description of Artificial Sequence: Synthetic coding sequence
atggcatccggtgaacatagcccagggtccggcgctgcacgcaggcccttgcattccgcgcaggcggtcgatgtggcctccgccagtaactttcgggccttcgagctgctgcacctgcacctagatttacgggcagaattcggcccaccaggacctggagcaggcagccggggactgtccggcaccgccgttctcgatctcaggtgtctcgagccagagggcgccgccgagctgagactggattctcacccctgtctggaagtcacagccgccgcactcagaagggagcgccccggctccgaggagccccctgcagagcccgttagcttttatacgcaaccattttcgcactacggccaggccctgtgcgtatcgttcccacagccatgtcgggccgcagagaggctgcaggtactcctaacttaccgcgtgggagagggtcctggggtgtgctggttggcaccggaacaaactgcagggaaaaagaaaccttttgtttacactcagggacaggccgttctgaatcgcgccttcttcccctgttttgatactcctgcagtaaaatataaatactccgcgctgattgaagtccctgacggctttacagcggtgatgtcggctagtacctgggaaaagcggggccccaataagtttttctttcaaatgtgccagcccattccttcatacctaattgcacttgcaataggggatctcgtgagcgccgaagtaggccctcggtctcgggtatgggcagagccatgcctgattgacgccgcgaaggaggaatataatggcgtgatcgaagagttcctggctacaggcgagaaactgttcggaccatatgtgtggggaagatatgacttattgttcatgcctccttcatttccgtttggaggcatggaaaatccctgcctgacctttgtcactccctgcttgctcgctggggatcggtcactggccgacgttattatccacgaaatttctcattcctggtttggcaacctcgtcactaatgccaactggggtgagttctggctgaacgagggtttcactatgtatgcccagaggcgcatcagcacaattctgttcggggcggcctacacctgccttgaggccgccacaggcagagcacttctgcggcagcacatggacatcaccggagaggagaaccccctgaacaaactgagagtgaagatcgagcccggagttgacccagacgacacctacaatgagaccccctacgaaaagggattctgcttcgtgtcctacctggcccatctggtaggggatcaggatcagttcgattcctttctcaaagcctacgttcacgaattcaagttccggtcgatcctcgcagacgacttccttgacttttatctggagtactttcccgaactcaaaaagaagagagtggacattattcccggattcgaattcgaccgttggttaaacactccaggctggcctccctatcttcccgatctgtcccctggggattcccttatgaagcccgcagaggagctggcccaattgtgggccgccgaggaattagacatgaaagccattgaggctgtggctatctcaccctggaaaacctaccagcttgtatactttcttgacaagatccttcagaaatcaccactcccacccggcaatgtgaagaagttgggtgatacctatcctagtatcagcaacgccaggaacgcagagttgcggttgaggtggggtcagatagtgttgaagaatgaccatcaggaggacttttggaaggtaaaagagttccttcacaaccaggggaagcaaaaatacacactgcctctatatcatgcaatgatgggaggctctgaggtggcccaaacacttgcaaaagagacatttgccagcacagcttcacagctgcactcaaacgtagttaactacgtacagcagatagtggctcctaagggttcctag

SEQ ID NO: 108623 - DNA, 1836 bp, Artificial Sequence
  Description of Artificial Sequence: Synthetic coding sequence
atggcctctggcgagcactcaccggggtcgggggcagcaagaaggccactccactccgctcaggccgtggacgtcgcttccgcgtccaacttccgagcctttgagctgttgcaccttcacctcgacctgcgggccgagtttggcccaccgggccctggcgcgggctctaggggactatccggtaccgcggtgcttgacctacgatgcctggagcctgaaggtgctgctgagctgcggctcgacagtcacccttgcctcgaagtcactgcagcagccctgcgtcgagagcggccagggtccgaggagccccccgccgagcctgtgagcttctatacacagcccttttcccactacggacaggccttgtgtgtgtcttttcctcagccctgtagagccgctgaaagactccaggtgctcttgacctatagagtgggggaagggccaggcgtttgctggctcgcccccgagcaaactgccggtaagaaaaagccgttcgtgtacacacaaggtcaggccgtccttaacagagctttctttccctgttttgataccccagccgttaagtataaatactccgcattgatagaggtgcccgatggcttcactgcagttatgagtgcttctacctgggagaagaggggacctaacaagttcttttttcagatgtgccagccaataccttcctatcttatcgctttggctattggagacctcgtctcagctgaggtaggcccccggtacgatctgctatttatgccacccagcttcccgttcgggggcatggaaaacccttgcctcacattcgttactccttgcctgctggcaggggatcggagcttggctgatgtgatcatccatgagatctcacattcctggtttggtaacctggtgaccaatgcaaactggggtgaattctggctcaacgagggctttacaatgtacgcccagcgaagaatttctactattctgtttggagctgcctatacgtgtctggaggctgcgaccgggagagcacttcttcgccagcacatggatattaccggcgaggagaaccctttaaacaagctgagggtgaagatagaacctggcgtggatcccgatgatacatacaatgaaaccccttacgaaaaaggcttctgtttcgtgagttacctcgcccacttggtgggagatcaggatcagtttgatagtttcctgaaagcctacgtgcatgagttcaaattccgatccattctggcagacgacttcctggatttctacttggaatattttccagagctgaagaagaaacgggtagatattatcccgggctttgagtttgataggtggcttaacacacctggatggcccccttaccttccagacctgagtccgggcgattctctcatgaagccggcggaagagctagctcagctgtgggcagccgaggagctagacatgaaggccatcgaagcagtagctatcagtccctggaagacatatcagttggtatattttctggataaaatcctccagaagagcccactccctccgggaaatgtgaaaaaactgggagacacatatccttctattagcaatgcacgcaacgccgagcttagactccggtggggtcagattgttctgaaaaatgaccaccaggaagacttctggaaggtgaaagaattcctccacaatcaaggcaagcagaagtacactctgccactataccatgccatgatggggggttcagaagtggcccagactctcgcaaaggagacgttcgctagtactgcatcccagttacattctaacgtggtcaattacgtccagcagatcgtcgcacccaagggctcatag

SEQ ID NO: 108624 - DNA, 1035 bp, Artificial Sequence
  Description of Artificial Sequence: Synthetic coding sequence
atgacttgttgctcctgtacctcactctccgccctcctcgatttttgggcggaagtctgctggctcgcgcccgagcaaacagccggaaaaaagaaaccttttgtatacacccaaggacaggccgtgcttaaccgggcattcttcccgtgcttcgatacacctgccgtgaagtataagtattcagccttaattgaggtacctgacggatttaccgcagttatgtctgcctcaacatgggaaaaacgaggtcccaataaattcttttttcagatgtgccagcccattccttcatatctcattgccctggcgatcggggatttggtttcagcggaggtgggacctcgatccagggtgtgggctgaaccatgcctgattgatgccgccaaggaggagtacaacggggtgattgaggagttcctagccactggcgagaagttatttggtccatacgtgtggggacggtatgatctgctgttcatgcctccctcctttcccttcggcgggatggagaacccctgcctgacttttgtaaccccttgtctgcttgccggtgacaggtctttggcagacgtaattattcacgaaatctcccactcttggttcggcaatttggtgacaaacgccaattggggcgagttctggctgaatgaaggctttacaatgtatgctcagaggcggatcagcactattctcttcggagcggcgtatacctgtctagaggccgcgaccggtcgagcactcctgagacagcatatggacatcaccggcgaggaaaacccccttaataagttacgcgtgaagatcgagccaggcgtggatccagacgacacgtacaacgagaccccatatgaaaagggcttctgcttcgtctcttacttggcccaccttgtgggagatcaggatcagttcgacagtttcctaaaagcttatgttcacgaatttaagtttagatcaatcctggctgatgacttcctggacttctacctcgagtatttccctgagctgaaaaaaaaaagggttgatatcattccatag

SEQ ID NO: 108625 - DNA, 507 bp, Artificial Sequence
  Description of Artificial Sequence: Synthetic coding sequence
ctgatcgatgccgcaaaggaggaatataacggtgtgatcgaagagttcctggccactggagagaagctgtttggcccatacgtgtgggggagatacgatttactctttatgcccccttcatttcccttcgggggcatggagaacccatgcctaacattcgtgacaccatgccttttggcaggggacagatccttagcagacgtgattattcatgaaatctctcattcatggtttggcaacctagttaccaatgcaaactggggggagttctggctcaacgaaggctttactatgtacgctcagagacggatctcaaccatcctgtttggcgtggacccggatgacacctataacgaaaccccctatgagaaggggttttgcttcgtgtcttacctggcgcatcttgtgggggaccaagatcagttcgactctttcctgaaggcatacgtgcacgagtttaagtttcgttccatcctggctgacgacttcctggacttttatctgtag

SEQ ID NO: 108626 - DNA, 1485 bp, Artificial Sequence
  Description of Artificial Sequence: Synthetic coding sequence
atgagtgccacaagaagcgcgtacatggaagaagagggtgtgttccacttccacatggagcatcccgtgcctgcttatctggtggctctggttgccggcgacctcaagccggctgatatcggcccaaggtcccgcgtctgggctgaaccttgcctgctgccaacggctaccagcaaactttctggcgccgttgaacagtggttatcggccgcagagcgattgtacggtccatacatgtggggtaggtatgacatcgtgtttctgcctcccagttttcccattgtggcgatggaaaacccttgtctgacttttataatctcctctatcctcgaatccgacgaatttctggtgatagatgtcattcatgaagtggcacacagttggtttgggaacgcagtcactaacgccacttgggaagaaatgtggctgagtgaggggctcgctacttacgctcagcggcgcattacgactgagacatatggggctgccttcacgtgcctagagaccgcgttccgactggatgcgctgcatcgacagatgaaactcctcggcgaggattctccggtcagcaagctccaggtgaaactagaaccgggcgtgaaccccagccacttaatgaatctttttacttatgaaaagggctattgtttcgtatattacctgtcccagctgtgcggggacccgcaacggtttgacgattttctgagagcatacgtcgaaaagtacaaattcactagcgtagtggctcaggatttgctcgattcattcctcagttttttcccagaactgaaagagcagagtgtggattgccgggccggccttgaattcgagaggtggctgaatgctacaggaccgccgctggctgaacctgatcttagccaggggtctagcctcactcgccctgttgaggccttattccagctttggacagctgaacccttggatcaggctgccgcctccgccagtgctattgatatttccaaatggagaacctttcagaccgcactattccttgaccgactgctggatggctccccgctccctcaggaggtcgtcatgtccctgtcaaaatgttactcatcactgctggattccatgaatgcagaaattaggataaggtggctgcagattgtggtaaggaacgattattaccccgatctccacagagttaggaggttcctcgaatctcagatgagcagaatgtatacaatccccctttatgaggacttatgcacaggagctttgaagagcttcgccctggaggtcttttatcagacacaagggcggctgcatcccaatctaagaagggcaattcagcagatactgagccagggactgggcagctctaccgagcccgcgtccgagccatccacagagttggggaaggcagaggctgacactgacagcgatgctcaggcgctgttgctcggggacgaagccccttcaagcgcgatctcattgcgcgatgtcaacgtgtccgcatag

SEQ ID NO: 108627 - DNA, 1236 bp, Artificial Sequence
  Description of Artificial Sequence: Synthetic coding sequence
atggaggtcaacccgcccaagcaggagcacctcctggctctcaaggtgatgcggctgacaaagcccaccctcttcacgaatatccccgtgacatgtgaggagaaagacctgccaggtgacctgtttaaccagctgatgagggatgacccctccaccgtgaacggtgccgaggtcctgatgcttggggagatgctgacactccctcagaattttggaaatatcttcttgggcgagacgttctcctcctatatatccgtgcacaacgactcaaatcaggtggttaaggatattctggtaaaggcagatctgcagacatcgagccagagacttaacctcagtgcctcgaatgccgctgtggctgaactgaagccagactgctgtatcgacgacgtgatccatcacgaggtaaaggaaattggaacccatatcctcgtgtgcgctgtgtcctacacaacacaggccggcgagaagatgtatttccggaagttctttaaattccaggtcctgaagccactggacgtgaagaccaaattttataacgctgagaccgatgaggtgtttctggaagctcagatccagaatatgacaacctctcccatgtttatggagaaggtgagcttagagccaagcattatgtacaacgtcaccgagctcaatagtgtctcccaggccggcgagtgtgtcagtacttttggttcccgggcatacctgcagccaatggacacccgccaatacttgtattgccttaagccgaagaacgagttcgccgagaaggctggtatcataaaaggcgttacggtaattggtaaattagatatcgtctggaaaactaacttaggcgaacgtggtagactgcaaacctcccagctgcagaggatggccccaggctatggcgacgtgcggctctccctggaagctatccctgacaccgtgaacttggaagaaccattccacatcacttgtaaaattaccaattgctccgaacggaccatggacctagttttggagatgtgcaacaccaatagcatacattggtgcggaattagcggtaggcaactggggaaactgcacccgagctcgagcctctgcctggccctgacattattgtctagtgtgcagggtttgcaatccataagtgggctccggctcaccgatactttcctcaaacggacctacgagtacgatgatattgctcaggtgtgtgtggtcagttccgctataaaagtagagtcttag

SEQ ID NO: 108628 - DNA, 1365 bp, Artificial Sequence
  Description of Artificial Sequence: Synthetic coding sequence
atgcacgtcggccatctgcggagtaccatcataggggagtctatctctaggcttttcgagtttgccggctatgacgtgctccggctcaaccacgttggcgactggggcacacaattcggaatgttgatcgctcacttgcaggataagttcccagactatctgacagtgtccccacccattggagatctccaggtgttttataaagagagcaagaagagattcgatacagaggaagagtttaaaaaacgcgcttatcagtgtgtggttttactccagggcaagaaccccgacataaccaaagcatggaaattgatctgcgatgtttcaaggcaggagctgaataaaatatatgatgccctggacgtctccctgatcgagcgtggagaatctttctatcaagatcggatgaatgatattgttaaagaatttgaagatcgaggattcgtgcaggtggacgatggccggaagattgtcttcgttcctggatgttcgatacctctcacaattgtgaagtctgatggcggctatacctacgatacgtccgatctagccgccattaagcagaggctgttcgaggagaaggccgacatgattatctacgtggtggacaacggccagtcagtacactttcaaaccattttcgctgccgctcagatgatcggctggtatgatcctaaagtgacccgcgtctttcacgcaggcttcggcgtggtgcttggcgaagacaagaaaaaattcaagacccgctccggagagaccgtgaggctgatggatcttctgggagaaggtctcaagcgttccatggacaagttgaaggagaaagagagagataaagtgttgaccgcagaagagctcaacgctgctcagacgtccgttgcttatgggtgcatcaagtatgccgatctgtctcataaccgtctgaacgactacattttcagcttcgacaaaatgctggatgatagaggaaataccgcggcctacctgctgtacgcttttaccaggataagatcaatagccaggctggctaacatcgatgaggagatgctgcagaaagcagcgagagaaactaagatcctgcttgaccatgagaaggaatggaagctggggagatgcatcctgcggtttcccgaaatcctgcagaagatattagatgacctctttcttcacaccctctgcgattatatctacgagctggcgacagcattcaccgaattttacgatagctgctactgtgtagaaaaggatagacagaccggtaagatcctcaaggtgaatatgtggcggatgctcttatgtgaggccgtggccgccgttatggcaaaagggtttgatatcctaggcataaagccagtgcagcgcatgtag

SEQ ID NO: 108629 - DNA, 618 bp, Artificial Sequence
  Description of Artificial Sequence: Synthetic coding sequence
ttccagagcgtggagtcctctacccgcaagttagatcacatcaatatctgctcaagcaacttccccaagaggagtttcgcactcgttacccaggcgggggttcaatggcacaacctggactctcttcagtcccccccccccgggttcaagcggtttccatgcctaagtctcccatcctcttgggactgcagagaagtcgctgacttccagctgagcgtggactcattacttgagaaggataacgatcattccagacccgatattcaggtgcaagctaagagactggcagaaaagctccgctgtgatacggtggtctcagaaatcagtaccggacagcggaccgttaactttaaaataaatagggagttactgaccaaaaccgtgctgcagcaggtgattgaagacggcagcaaatatggtctgaagtccgagctattctctggactgccgcagaagaagattgtggtggagtttagctcccccaacgtggcgaagaagtttcacgtcggccatttgcggtccaccatcatcggtaacttcatagctaacctgaaagaagctctcggacatcaggtgatacggataaactatctgggcgattggggcatgcagttctag

SEQ ID NO: 108630 - DNA, 1737 bp, Artificial Sequence
  Description of Artificial Sequence: Synthetic coding sequence
atggcttgtggtttcaggcgagccatagcttgccagttgtccagagtcctgaacctccccccggagaacctcattaccagcatcagcgcggtccccatctcgcagaaagaggaagtcgccgactttcagttatctgtggattccctgctggagaaggacaatgaccattctcgtccagatatacaggtgcaggcgaaacgcctcgccgaaaagcttcggtgcgacaccgtggtgtccgagatctctacgggccagaggacggtaaattttaagatcaatcgcgagctcttaactaaaaccgtgctgcagcaagtgattgaggacggttcaaaatacggcctcaagtctgaactgttttctggcttgccacagaaaaagatcgtcgtggaatttagctcacctaatgttgcaaagaagttccatgtggggcacttgagaagcacaatcattggtaacttcatagctaacctgaaggaagcacttggacaccaggtcatcagaataaattacctgggggactgggggatgcagttcggccttctcggcacaggctttcagctgttcggctacgaagaaaagctgcagtccaatccactgcagcatctgttcgaggtttacgttcaagtaaacaaggaggccgcagatgacaagagtgtcgccaaggcagcccaagagttctttcaaaggctggagctgggtgacgtgcaggcccttagcctttggcaaaaatttcgggaccttagcatcgaagaatatatacgtgtttacaagcgattaggcgtgtactttgacgaatattcaggggaaagcttttacagagaaaagtcccaggaagtactcaaactgctagagtcaaagggactgctgttaaagacaattaaaggaacggccgtagtggacctgagcggcaacggggatccgtcctctatctgtacggtgatgcggtctgacggcacctctttgtacgccactagggatttggccgcggcaattgatcggatggacaaatataacttcgacaccatgatctatgtcaccgataagggtcagaaaaagcatttccaacaggtttttcaaatgctgaagataatgggctatgactgggcggagcgttgccagcatgttccgttcggagtggtgcagggtatgaaaacacgtcgcggggatgtgacttttttggaggatgtgttgaatgaaatccaactgcgaatgttgcagaacatggcttccatcaaaaccacgaaggagctgaaaaacccccaggagactgctgagcgggtgggattagccgccttaatcattcaggattttaagggtctcctgttgagcgactataaattctcatgggatcgggtgtttcagagtcggggtgatacgggtgtcttcctacagtatacccacgccaggttacactctctggaagagacgttcggctgcggctatctgaacgatttcaatacggcatgtctacaagagccccagtccgtgagcattttacagcatctccttaggtttgatgaggttttatacaagagcagccaggacttccagccgcgccatatcgttagttaccttcttactctgagtcacctggcggcagtggcacataaaactttgcagattaaggacagtccaccagaggttgccggcgccaggctccatctgttcaaagcggtcaggagcgtgcttgccaatggcatgaagctgctcgggataacaccagtctgtaggatgtag

SEQ ID NO: 108631 - DNA, 621 bp, Artificial Sequence
  Description of Artificial Sequence: Synthetic coding sequence
taatttcagagtgtcgaaagctcaactaggaagctggaccacataaacatctgcagctctaacttcccaaaacgctccttcgccctggtgacacaggcaggtgtccagtggcataatctggattccttgcagtcgccacctccaggatttaagcggtttccttgcctgtctttaccaagctcttgggactgcagggaggttgccgatttccagctgtctgtggacagcttgttagaaaaagataacgatcactctaggcccgatattcaggtgcaggcaaaacggctggcagagaaactgagatgtgacaccgtcgtgagtgaaatcagcacaggccagcggaccgtcaactttaagatcaacagagagttactgactaagaccgtgttgcagcaggtcatagaggatgggtccaagtatggcctgaagtctgaactcttcagcgggctgccacaaaaaaaaatcgtggtggaattctctagccctaatgtggcaaaaaagttccatgtcggccacctgcgatctaccataataggcaactttatagccaatcttaaggaagccctggggcatcaggttatcaggattaactatttgggtgattggggcatgcagttttag

SEQ ID NO: 108632 - DNA, 1482 bp, Artificial Sequence
  Description of Artificial Sequence: Synthetic coding sequence
atgagtgtggatatgaatagccagggatccgatagtaacgaagaggattatgatccaaactgcgaggaggaggaggaggaagaggaggacgatccaggtgacatagaagattattatgtaggcgtggcttctgatgtggaacaacaaggcgccgacgccttcgacccagaagagtatcagtttacatgcctcacatacaaggagtcagaaggagccctgaacgagcacatgacaagcctggcatctgtgctcaaagtgagccacagcgttgccaagttgatactggtgaattttcattggcaggtctcggagatccttgatcggtacaaatccaacagcgcacagctcctcgtagaagcccgggtacagccaaatccatccaaacatgtgccaactagtcatcccccccaccattgcgccgtgtgtatgcaatttgtgagaaaggagaacttattgtcccttgcctgccagcatcagttctgtcggagttgttgggaacagcattgctcagtactggtgaaggacggtgttggcgtgggcgtctcatgcatggctcaggactgtcccctgaggacgccggaagatttcgttttcccactacttcccaacgaggagctgcgggagaagtatcggagatacttgtttcgcgactacgtggagtcccactaccagctgcagctatgcccaggtgcagactgtcccatggtaatcagggtgcaggaacctagagccagacgggtacagtgtaatcgctgtaatgaggtgttttgcttcaagtgcagacaaatgtaccacgcgcctacagattgcgctacgataaggaaatggctgacaaaatgcgccgacgattccgagacagcaaactatatttccgcccacactaaggattgccccaaatgtaacatttgtattgaaaaaaacgggggctgtaatcatatgcagtgtagcaaatgcaagcacgatttttgctggatgtgtcttggggactggaagacccacggctccgaatactatgagtgtagccgatacaaagagaaccccgatatcgtaaatcaatcccagcaagcgcaggcaagggaagccttgaagaagtaccttttctattttgagcggtgggagaaccataacaagtcactacagttggaagcccagacataccagcggattcacgagaaaattcaagaaagggtaatgaataatctggggacatggattgactggcagtacctgcagaacgcagctaagctcctcgccaagtgcaggtacacccttcaatacacttatccatatgcctattacatggagagtggaccgcgaaagaaactctttgaataccagcaagcccagcttgaagccgaaatcgaaaatctcagctggaaggttgagcgcgccgattcctacgacagaggcgacctggagaaccaaatgcacattgcggagcagcggcggcgaacgctgctgaaagacttccacgatacctag

SEQ ID NO: 108633 - DNA, 954 bp, Artificial Sequence
  Description of Artificial Sequence: Synthetic coding sequence
ggcataacaggcgtgagttgtatggcccaggactgtccacttcgcactcctgaggactttgtttttccccttctgcctaatgaggagctgcgggagaagtatcgaagatacctgttcagagattatgtggagtcgcactaccagctgcagctgtgtcctggcgccgactgtccaatggtgataagggtccaggagccccgtgctcggagggtgcaatgcaaccgttgcaacgaagtgttttgcttcaaatgtcgccagatgtatcacgcgccaactgattgtgccacaatcagaaagtggctgaccaaatgcgctgacgactctgagactgcaaactatattagcgcgcatacaaaggactgccccaaatgtaatatatgtattgagaaaaatgggggatgcaatcatatgcagtgcagcaaatgtaagcacgacttttgctggatgtgcctaggggactggaagacccatggatcagagtactacgaatgtagccgctacaaagagaatccagacatcgttaaccaaagccagcaggctcaggcacgagaggctcttaagaaatatctcttttatttcgaaagatgggaaaaccacaataagagcctccagctcgaagctcaaacatatcagcggattcatgagaaaatacaggagagggtcatgaacaacctaggaacctggatcgattggcaatatctccagaatgcagcaaaactattggcaaagtgtcggtacacgctgcaatacacctacccctatgcatactatatggagagcggccccaggaagaagttgttcgagtaccaacaggcccagttggaagctgagattgaaaatctgtcttggaaagtcgagagagccgactcttatgataggggcgacctggagaaccagatgcacatcgccgaacaaagacgccggacccttctgaaggattttcatgacacatag

SEQ ID NO: 108634 - DNA, 1233 bp, Artificial Sequence
  Description of Artificial Sequence: Synthetic coding sequence
agtgtagatatgaacagtcagggatcagattcgaacgaggaagattacgaccctaattgtgaagaagaggaggaagaagaggaagacgatcccggcgatatagaagattattacgtgggagtcgcctccgatgtggaacagcagggggctgacgccttcgatcctgaagagtatcagttcacatgtttgacctataaagaatcagagggggccctgaacgaacatatgacctcacttgcgagcgtgttaaaagtgtcacactccgttgctaagcttatcctggttaactttcactggcaagttagcgagatcctggatcggtacaaatccaactcggctcagttactggttgaggcgcgcgtccagcctaacccatcaaagcacgtacccacatcgcaccccccacatcattgtgctgtgtgcatgcaattcgtaaggaaggagaatctgctgtcactcgcttgccagcaccagttttgtcggagttgttgggagcagcattgtagcgtcctcgtgaaggatggtgttggcgttggtgtgtcttgtatggcccaagactgcccgctgcggactcccgaagactttgtatttcctcttctccctaatgaagagctgcgggagaagtataggcggtatctcttccgcgactatgtggaatctcattaccaattacagctgtgtccaggagctgactgccccatggtgatcagagtccaggaaccccgggcaaggcgagtccagtgcaaccggtgtaacgaggtattctgctttaagtgtcggcagatgtaccacgccccaacagactgtgccaccatccgtaagtggctgactaaatgcgctgacgacagtgagacagcaaattacatttctgcccacacgaaagattgcccgaaatgtaatatctgtatcgaaaagaatggtggctgcaaccatatgcagtgtagcaaatgtaaacacgacttctgttggatgtgcctcggtgactggaaaacacacggttctgagtactacgaatgtagcaggtataaggagaacccagatatcgtgaatcagtcacaacaggctcaggcccgggaggccctgaaaaaatatctgttttacttcgagcgattagaaaacctgtcgtggaaggttgagcgcgccgacagctacgatcggggagacctcgaaaaccaaatgcacattgcagaacagcgcaggaggacattgctgaaagactttcatgatacctag

SEQ ID NO: 108635 - DNA, 1482 bp, Artificial Sequence
  Description of Artificial Sequence: Synthetic coding sequence
atgtcggtcgatatgaatagccagggaagtgacagcaacgaggaagactatgatccaaactgtgaagaagaggaagaggaggaggaggacgaccccggagatattgaggactactatgtcggggtggccagcgatgtggaacagcagggggcagatgctttcgaccccgaggaatatcaattcacttgcctaacctataaggagtctgagggggccttgaacgagcacatgacctcactggcgagcgtgctcaaggtgtctcactcagtggccaagttaattttagtgaatttccattggcaagtcagcgagatcctcgatagatacaagagtaattcggcccaactgctggtggaggctcgggttcagccaaatccgtccaaacacgtgccaacctctcatccaccccatcactgtgctgtctgtatgcaattcgtaaggaaggaaaacctgctgtcactggcttgccagcatcagttttgtagaagctgttgggaacagcactgctcagtgcttgtcaaagacggtgtcggggttggcgtctcctgtatggcacaggactgtccactacgtactcctgaggatttcgttttcccattactgcccaatgaagagctccgggagaaatataggcggtatctgtttcgggattatgtggaaagccactaccagctacaactgtgccccggtgccgactgccctatggtgatcagagtgcaggagccgagagctcgccgggtacagtgtaaccggtgtaacgaagtcttctgcttcaaatgcagacagatgtatcatgctcccactgattgcgccacaatccggaagtggctaacaaagtgtgctgacgatagtgagactgccaattatatctccgctcatactaaggactgcccaaagtgtaacatttgcattgaaaagaatggcggctgtaaccatatgcagtgttctaaatgcaaacatgatttctgctggatgtgtctcggagactggaaaacacacggctccgaatattacgaatgcagtcgctacaaggagaatccagatatagtcaaccaatcacaacaagctcaggcccgggaggcactgaagaaatacctcttttattttgagagatgggaaaatcacaataaaagtctgcagctggaggcacaaacctaccagcgcatacacgagaagattcaggagcgtgttatgaataacctgggaacgtggattgattggcaatacttgcaaaatgctgccaaattgctcgccaagtgccgatacactctgcagtatacctacccatacgcctattacatggagagcggtccccgaaagaagctctttgaatatcagcaggcccagctggaagcggaaatagagaacttgtcttggaaggtggaacgcgcagattcctatgatagaggcgacctggaaaatcaaatgcatatcgccgaacagcgcaggcgcactctcttaaaggacttccatgatacctag

SEQ ID NO: 108636 - DNA, 1584 bp, Artificial Sequence
  Description of Artificial Sequence: Synthetic coding sequence
ctcaggcgggcggccagcggtcccctcgcaccgtctctcccccctcccaggcctccccgtaggcaccagcccagcaatgccaaccgcagatcctgggggggagcggccgcccgcggtgcaggggccagacctgcttccgggcatcagcctgaacctgaacgagagcccggtccccgccgtcccagaccactccctgccagcgcatccgtccgacgcgctccagctagaagagcgatggattcggacgagggctacaactatgagttcgtgaacgaggtaatccaaaacccagcgaccattactcgcattctcctgagccacttcaattgggataaggaaaaactcatggagcggtattttgatgggaatctggagaaactattcgcggaatgtcatgttatcaatccatccaagaaaagccgcactcgccagatgaacacccgcagcagcgcccaggacatgccctgccagatctgctacttaaattatccaaatagttactttacaggactggaatgtgggcacaaattctgcatgcagtgttggtccgaatacttgaccacaaagataatggaggaggggatgggccagacaatttcctgccccgcgcacggctgcgatatcttggtggacgacaacaccgtgatgcgcctgatcactgactcgaaggtgaagctgaagtaccaacaccttattaccaactcttttgtggagtgcaatcggctattgaagtggtgcccagcaccagactgccatcatgttgttaaagtacagtatcccgatgccaagcccgtgcgctgtaaatgcgggcgccagttctgctttaattgtggcgagaattggcacgatccagtgaaatgcaagtggctgaagaagtggattaagaagtgtgacgacgattcagaaacttccaactggattgcagccaacaccaaagagtgtcccaagtgtcatgttaccatagagaaggacggcggctgcaatcacatggtttgcaggaatcagaactgcaaggcagagttctgctgggtctgtctaggaccttgggagccacatggatcagcttggtacaattgtaatcggtacaacgaggatgacgcgaaagccgcccgcgatgctcaggaacggtcgcgcgccgctctgcaacggtatctcttctattgcaaccggtacatgaatcacatgcagagccttcgattcgagcataaactgtacgcgcaggtgaagcagaagatggaggagatgcagcaacacaatatgagctggattgaggtgcaattcttgaaaaaagccgtcgacgtgttgtgccagtgccgggcgactctgatgtatacatatgttttcgccttctacttgaagaaaaacaatcaatctataattttcgagaacaaccaggctgatctggaaaacgcaaccgaagtcctatccggctacctggaacgggacatttctcaagatagtctgcaggacattaagcaaaaggtacaagacaagtataggtattgcgagtcacggcgtcgggtgttactccagcatgttcatgaaggctacgaaaaggacttgtgggaatatatcgaagattag

SEQ ID NO: 108637 - DNA, 1674 bp, Artificial Sequence
  Description of Artificial Sequence: Synthetic coding sequence
atggatagtgacgagggttacaactacgaatttgacgaggatgaggagtgcagcgaggaggactctggcgccgaggaggaagaggacgaagacgacgacgagcccgatgacgatacgctggatttgggagaagtagaattggtggagcccggtttaggggtgggcggcgaacgagatggcctgctctgtggcgaaactggaggggggggagggagtgccctgggccccggcgggggtggaggggggggaggcggcggcgggggagggggtcctggccatgagcaggaggaggactacaggtacgaggttctgacagccgaacagattctgcaacatatggtggagtgtatacgcgaagtcaacgaggttatccagaaccccgctaccatcacccgaatcctcttatcccattttaattgggataaagagaaactcatggagagatactttgacgggaaccttgagaagttgtttgcagaatgtcacgtgataaatcctagtaaaaaatccagaacccgtcagatgaacacgcgctccagcgcacaggatatgccttgtcaaatttgttaccttaactacccaaactcatactttaccgggctcgagtgcggacataagttctgtatgcagtgctggtctgagtatctcactaccaaaataatggaggagggaatgggccaaactatctcgtgtcccgcccacggctgtgatatccttgtggacgataatacggtgatgcggctgatcacagattctaaggtcaagctcaaataccagcaccttatcaccaactcctttgtggagtgcaaccgcctattgaagtggtgccccgcaccagattgccatcacgtcgtgaaggtgcaataccctgacgcaaaaccagttagatgtaagtgcggacgacaattttgttttaattgtggagagaattggcacgaccccgtgaaatgtaaatggctgaaaaaatggataaaaaagtgcgatgatgacagcgaaacttccaactggatcgctgctaacacaaaggagtgtccgaaatgccacgttacaattgaaaaggacggaggctgtaatcacatggtgtgccgcaatcaaaattgcaaagccgagttctgttgggtctgcctgggaccgtgggaaccccatggatccgcatggtacaattgtaatcgctacaacgaagatgatgcaaaggccgctagggacgcacaggagagaagccgggccgccctccagcggtacttattctactgtaatcgttacatgaaccatatgcagtctctaaggtttgagcataagttatacgcgcaggtgaagcagaaaatggaagaaatgcagcaacataatatgtcatggattgaggtccagttcctgaagaaagctgtggatgtgttatgtcagtgcagagccaccctgatgtacacgtatgtcttcgctttttatctgaaaaaaaacaaccagagtattatcttcgagaataaccaggcagacctagagaatgcgacggaagttctttcgggctacctggaaagggacattagtcaggattccttacaggacataaaacaaaaggtgcaggataagtaccggtactgcgaaagtcggagaagagtgttgcttcaacacgtacatgaggggtacgagaaggatttgtgggagtatattgaagactag

SEQ ID NO: 108638 - DNA, 1689 bp, Artificial Sequence
  Description of Artificial Sequence: Synthetic coding sequence
atgtcaaaccagtaccaggaggagggatgttccgagcgccccgagtgcaagagcaagagccctacactgcttagctcatactgtattgacagcatcctggggagacggtctccttgcaagatgcggctcctgggagctgcacagtcccttcccgccccacttacatctagggctgacccggagaaagcagtacaggggagccccaagagttcatctgcccctttcgaagctgaactccaccttcccccgaaattgcggaggctctatggtccaggaggaggcaggctcttgcagggagcagctgcggccgcggccgctgctgctgcagcagctgctgctgcggctaccgcaacagctggcccgagaggagaagccccccctccaccaccccctaccgcccgccctggcgagcggcctgatggcgcaggcgctgctgcagccgcggcggcggctgctgccgcagcatgggacacacttaagatctctcaggccccacaggtctctattagccggtccaagtcataccgagagaacggcgcaccattcgttcctccaccaccggccctggacgaactcgggggaccaggaggcgtgactcatccagaggagcggctgggcgttgccggcggacctggatctgccccagctgctggtgggggaaccggaacagaggatgacgaagaggagctcctggaggacgaggaagacgaggatgaagaggaagagttgctggaagacgatgaagaggagctattggaagatgacgcccgcgccctactcaaagagccgcgtcgctgtcctgtggctgcaaccggcgccgttgccgctgctgcagccgcggctgtggctacggaggggggggagctcagccccaaggaagagctgctgctgcatcccgaagatgctgaaggtaaggatggggaggatagtgtgtgtttatctgcggggtcagactcagaagagggattgctcaagagaaagcagaggcgctaccggaccacctttacctcctatcagttggaggagttagagcgagccttccagaagacccactatccagacgtcttcacacgcgaggagctggccatgcggcttgatctaacagaagcgagagtgcaggtgtggtttcaaaatcggagagcaaagtggaggaaacgcgagaaggctggagcccagacccaccctcccggtctgccctttccagggcccctctcagccacacacccccttagtccctatctagacgcctcaccttttcctccccaccatccagctctcgatagtgcgtggacggcggccgctgcagctgccgccgctgcatttccgtccctaccaccacccccgggatccgcttccctgcccccctcgggtgcacccctgggattaagtactttcctgggagccgctgtctttagacaccccgcatttatttcgcctgccttcggaaggctctttagtaccatggcccccttgacgtctgcttctactgccgcggctctactgcgacaacctacccctgccgtcgagggcgccgtagcctccggagccttggccgacccagctacagccgccgccgaccgtagggcttcttccattgcggcgttgagactcaaagctaaggaacacgctgcgcagctcactcagctaaacattttaccggggaccagcacaggcaaggaggtctgctag

SEQ ID NO: 108639 - DNA, 1032 bp, Artificial Sequence
  Description of Artificial Sequence: Synthetic coding sequence
atgggtgggcctcgcggggcaggatgggttgcagccgggctgctgctgggcgctggtgcctgctactgtatctacagacttaccagaggccggagacggggagacagggagctggggattcgcagcagtaagtcagctggcgcccttgaggagggcaccagcgagggtcagctgtgtggacgcagtgcgcggccacaaacagggggcacttgggagagccaatggtcaaagacatcccagcccgaggatcttaccgatggaagttacgacgacgtgctgaatgccgagcagttgcaaaagctactgtacctgctcgaaagcacggaggaccccgttataatagagcgcgccttaattactctggggaataacgcagccttctctgttaaccaggcgatcatacgcgaactaggtggcatccccatcgtggctaacaagatcaatcacagtaatcagtcaatcaaagagaaggcactgaacgctctgaacaacctctccgtgaatgtcgagaatcagattaagatcaaaatttacatctcccaggtgtgtgaggatgtcttttcaggaccccttaactctgccgtacagctggctggcctgacgctattgacaaacatgactgtcaccaacgaccatcagcatatgctgcactcatatattaccgatctgtttcaggtcctgctcaccggcaatggaaatactaaagtgcaagtgttaaagctactgctgaacctgtcggaaaatcctgcgatgaccgaaggattgctccgcgcccaggtggacagtagtttcctttccctgtacgacagtcacgttgctaaggaaatcctgctccgagttctgaccctattccagaatatcaaaaactgcctcaagatcgagggccatctggccgtgcagccgacatttacagaaggcagccttttttttctgttacatggtgaggaatgcgcccagaaaatccgtgcactggttgaccaccatgacgccgaagtcaaggaaaaagtcgtgaccatcatccccaaaatctag

SEQ ID NO: 108640 - DNA, 855 bp, Artificial Sequence
  Description of Artificial Sequence: Synthetic coding sequence
atgggaggaccccggggagcaggctgggtggccgcaggcctgcttctgggggccggagcttgctattgtatttacagactgactcgtggcaggaggaggggcgaccgtgaattggggatacgctcctctaaaagtgctgaggaccttacagacgggtcttatgatgatgtgctgaatgcagagcagctgcagaagttgctatacctactggaatctacggaggatcccgtgatcatagaaagagctctaattacgctggggaacaacgcagcattttcggtaaatcaggccattatcagagagctgggaggcattcccatcgttgcaaacaaaatcaatcactctaaccagagtattaaagagaaggccttgaatgccctcaataatctttcagtcaacgtggaaaaccagattaagataaaaatatatataagtcaggtatgcgaggacgtcttctcaggcccactgaactccgccgttcagttggccggtctgactctgctcacaaacatgactgtaacaaacgatcaccagcatatgctccactcttacatcaccgatttgttccaggttctccttaccggaaatgggaataccaaagtcgactcgtccttcttgtcgctatacgatagccatgtggcaaaggagatacttttgagggtgttaaccctatttcagaacattaaaaattgcctaaaaattgaaggccatctggccgtgcagccaacgttcacagaaggtagccttttctttctactccatggtgaggagtgcgcccagaagattcgagccctcgtcgatcaccacgacgcggaagtcaaggaaaaggtggttacaattataccaaagatttag

SEQ ID NO: 108641 - DNA, 855 bp, Artificial Sequence
  Description of Artificial Sequence: Synthetic coding sequence
atggggggtcctaggggcgccggctgggttgccgccggactgctcttgggagccggggcgtgctactgtatatacaggctgacccggggacgaagaagaggggaccgggagctgggtatccggagctcgaagtctgcgggtgctttggaagaaggcaccagcgaaggacagttgtgcggcaggtccgcccgtcctcagactggcggcacctgggaatctcagtggtctaagacctctcagccggaggatcttactgatggtagttacgatgacgttctcaacgctgagcagctccaaaagctcctgtatctcctggaatctacggaggaccccgtcataattgaacgagccctgatcacgctgggcaacaacgctgcattctccgttaaccaagccatcattcgcgagttaggagggattcctatcgtcgctaacaagataaaccactctaaccagtccatcaaggaaaaggctttgaacgcgcttaataatttatcagtcaacgtggagaaccagattaagattaaggtgcaggtcctgaaattgctgctgaatctgtccgaaaaccctgccatgactgaaggactgcttcgagcccaggtagactcttcctttttatccctctatgattcccacgtcgctaaggagattctgctacgcgtgctgaccttgtttcaaaatatcaaaaattgcctcaaaattgaaggccaccttgccgtgcaacctaccttcaccgaaggatctttgttctttctcctgcacggcgaagaatgtgcccagaaaattagagccctggttgatcaccacgacgccgaagtgaaggagaaggtggttaccattatccctaagatctag

SEQ ID NO: 108642 - DNA, 927 bp, Artificial Sequence
  Description of Artificial Sequence: Synthetic coding sequence
atgggaggcccaaggggcgcgggttgggttgctgcggggctactcctcggtgctggagcatgttactgcatctaccggcttacgcgcggcagacggaggggtgacagagagttgggaatccggtccagcaagtccgcggaagatctgactgacggttcctatgacgacgtgttaaacgccgagcagctgcagaagctgctttaccttttggagtctactgaggacccggtcatcatcgagagagctctgataaccttggggaacaacgctgctttttctgtgaaccaggcgattattagagaactcgggggcatccccattgtcgctaacaagattaaccattcaaaccagtccatcaaagagaaggcactgaacgcacttaataacttgagcgtgaatgttgagaaccaaattaaaattaagatctacatctcacaggtgtgtgaggatgtgttctcaggaccccttaacagcgctgtgcagctcgcgggcctcacactgctgaccaacatgaccgtcactaatgatcatcagcacatgctccatagctacattaccgacctcttccaggtactcctgaccgggaatgggaacactaaggtccaggtgcttaaattgctgctgaatttgtctgagaaccccgctatgaccgagggactgctgagggctcaggtcgatagttcctttttgagcctttacgactcccatgtggccaaggagattctcctcagagtgctgacattgtttcagaacattaaaaattgcctaaagatcgaggggcacctagcagtgcagcctacgtttactgaggggtccctgtttttcctactgcacggtgaggagtgtgcccaaaagatccgagctctcgtcgatcatcacgacgcagaggtgaaggagaaggtcgtgacgatcatccccaaaatctag

SEQ ID NO: 108643 - DNA, 750 bp, Artificial Sequence
  Description of Artificial Sequence: Synthetic coding sequence
atgggaggaccccggggcgctggttgggtggcagctgggctgctcttgggagcaggtgcttgctactgcatctacaggctgaccagagggaggcgtagaggcgacagagagttgggcataaggagcagcaaatctgcggaagaccttacagacggctcctacgacgatgtgctaaacgctgaacagcttcaaaaactgttgtatctcctcgagtccaccgaagatcccgtaataatagaaagggccttgatcactcttggtaacaatgcagccttctccgtcaatcaagcaatcatacgggagttgggaggcattccgatcgtagctaataaaatcaatcacagtaaccagtcgatcaaggaaaaggctctaaacgccctgaacaatttatccgttaatgtggagaaccagatcaagattaaggtgcaagtcctcaaattgctgctgaacctgtctgaaaatcccgcgatgacggagggtttgttgagggcccaagttgattcaagtttcctctctctgtacgacagccacgtagccaaggagatactcctgagagtattgacgctgttccagaacattaaaaactgtctgaagatcgaaggtcacttggccgtgcagcctacttttactgaaggctccctgttcttcttactccatggggaggaatgtgcacagaaaatccgggcacttgtggatcaccacgacgctgaggtaaaagaaaaagtggtgaccatcatccccaagatctag

SEQ ID NO: 108644 - DNA, 678 bp, Artificial Sequence
  Description of Artificial Sequence: Synthetic coding sequence
atgggaggcccgcgcggtgcaggctgggttgccgcgggcctgctgctcggagctggtgcctgctattgtatatatcgactgacacgtggacgccgacgtggcgatagagagttagggatcaggtcctctaagtccgcagaagacctgaccgacgggtcttacgacgacgtgcttaacgctgagcaattgcagaagttgctgtatttgctcgaatcaaccgaagaccctgtaattatagaaagagctctcatcacgttgggaaacaacgcagctttctccgtaaaccaagctatcattcgcgaactcgggggaattccaatcgtagctaataagattaatcactccaaccagtccatcaaggaaaaagcactgaatgcactgaacaatctctctgtcaatgtcgagaatcagattaaaatcaaggtggactcttctttcctgagcctgtacgatagtcatgtggctaaggaaatactactcagagtgctgaccctatttcagaatataaagaactgcctgaaaattgaaggccacctcgccgtacagccaacattcactgagggctctctcttctttctgctgcacggggaagagtgcgcccagaaaatccgcgcactggtggaccaccacgacgctgaggtgaaggaaaaggtggtgaccatcatccccaaaatatag

SEQ ID NO: 108645 - DNA, 1362 bp, Artificial Sequence
  Description of Artificial Sequence: Synthetic coding sequence
atgggacggacgagggaggctgggtgtgtagctgccggagtggtgatcggtgcgggagcatgttattgtgtgtaccgactcgcctggggccgagatgaaaacgaaaaaatttgggacgaagatgaagagtctacggacacatccgaaataggagttgagactgtgaagggagccaaaaccaatgccggggctggcagtggggccaaactccaaggagactctgaagtgaagcccgaggtctctctcgggttggaggactgcccgggcgtgaaagagaaggcgcacagtggtagtcatagtgggggaggactcgaggcaaaggccaaggctttgttcaataccctgaaggagcaggcctccgcaaaagctgggaagggcgcccgggtgggtaccatcagcggcaatcggactttagccccaagcctcccatgtcctggcggaagaggtggagggtgccacccaactaggtcagggagcagagccggaggccgcgcttcaggtaaatccaagggtaaggcccgctctaaaagcacccgcgcacccgcgacgacatggccggttagaagaggtaaattcaatttcccgtacaagatagacgacattctgtccgctcccgacctgcagaaagttttgaacatcttagaacgtaccaatgacccattcatccaggaggtcgcgctggtcacactaggaaataacgcggcttattcatttaatcagaacgcaattcgggagctcggaggcgtgccgatcattgccaagttaattaagaccaaagacccaattatccgggaaaaaacatacaatgctctgaataatctgagcgtgaacgccgagaatcagggaaagattaagacgtatatatcccaggtctgcgacgataccatggtgtgcagactggactccgcggtccagatggcaggtctgagactcctcaccaacatgacggtgaccaatcattaccagcatcttctgtcatactcctttccagacttctttgcccttctgttcctgggcaaccacttcaccaaaatccagattatgaagctcattatcaactttaccgaaaatcctgccatgacgagagaactggtgagctgcaaagtccctagtgaactgatcagcctcttcaataaggagtgggatcgtgagatacttctgaacatcctcactctgtttgaaaatatcaatgacaatataaaaaatgagggcctggcctcctcacggaaggagttctctaggtcatccttattcttcctattcaaggaatccggggtctgcgtgaagaaaattaaggcactggctaatcacaatgatttggtggtgaaggtgaaggtcttaaaggtcctgaccaagctctag

SEQ ID NO: 108646 - DNA, 477 bp, Artificial Sequence
  Description of Artificial Sequence: Synthetic coding sequence
atggtatgtcgactcgacagcgcagttcagatggccggactgaggctcctgaccaatatgactgttacaaaccactaccagcacctgctttcatactcattcccagacttctttgcgctgttattcctgggcaatcactttactaagattcagatcatgaaactcattatcaacttcactgagaatccagccatgacgagagagctggtctcttgcaaagttcccagtgagctgatttccctatttaacaaagaatgggacagggagatactgttgaacattcttacattgttcgagaacatcaacgacaacatcaagaatgaaggcctggcctcgtccaggaaggaattctcccggagtagccttttttttttatttaaggagagcggggtgtgcgtaaaaaagatcaaagcgttggccaaccataacgacttagttgttaaagtgaaagtgttgaaagttctcacaaaactgtag

SEQ ID NO: 108647 - DNA, 1899 bp, Artificial Sequence
  Description of Artificial Sequence: Synthetic coding sequence
atgagccgggttcgtgatgctggttgcgttgccgcagggatcgttatcggggccggagcctggtattgtgtgtataaatacacccgagggagggatcagaccaagaaacggatggctaaaccgaaaaacagggccgtagctgggactggagcccgcgcacgggctggactgcgcgccggattcactatcgatttggggtcagggtttagtccaccaactccagtaagagcagaagccgaggatcgcgcacaggacgaagcgtcagccctggatactgtgggcgctgaagcggtggccccagcggcatcgtctgctgaggcgcagagtggggctggaagtcaggcgcaggaggccgatggagcaggggtcgggcccaaggccgagtcagttgtgggggctgcaatggcctcagctattgctccacctcctggggtcactgaagcactgggagctgcagaagctccagctatggcaggcgcccccaaggtggccgaagctccaagggaagctgagacctcccgtgccgctgtgcccccaggtacagtggttcccaccgaagcagccgctccaaccgaagtcaccgagggcccaggggtcgcagcaccaaccaaagtcgccgaggctcctggcgtggcgagccccaccgaggccgcagaagcccctgtgccagcaactcccaccggagcagcagccccgaccggagccgctgagagccctgggacctcaggaagtccccgaacagcagtggtgccgggtactagcgctgccaaaaaggccacaccaggagcccacactggagctattcctaaagccactagcgctacaggcgcggttcccaaaggaggcggtaagggggttacgagatccaggaatggagggaagggcaaaggtaaaaaaagcaaggttgaagtggatgaactcggtatgggcttccggcccggagacggagccgctgccgctgcagctgcctcagctaacggtggtcaggcttttctcgcggaggtaccggacagtgaagagggtgagtcgggttggactgacacagagagtgattccgattccgagcctgagactcagagacgtggtcgaggccgcaggccggtggccatgcagaaaagacctttcccctacgaaatcgacgaaatactgggagtgagagatctccggaaggtgctggctctgctccagaagagtgatgaccccttcattcagcaggtcgccctcttaacactgtcgaataacgccaactactcctgcaaccaagagactattcgcaagctcggcggcctacccattatcgccaatatgattaacaaaacagatccacacataaaggaaaaggctctcatggcgatgaacaacctttctgagaactacgagaaccaaggacgcctacaggtctacatgaacaaggttatggatgatattatggcatcgaatcttaactcggccgtgcaggtggttgggctcaagtttctcactaacatgactatcaccaacgattaccagcaccttctcgtcaattcaatcgccaatttttttcgactgttatctcagggcggcggcaagattaaagtcgaaattctgaaaattcttagcaattttgcggagaacccagacatgctaaagaagctgctcagtactcaggtgcccgctagctttagctccttatataacagttatgttgaatccgagattttgatcaacgccctaaccctgtttgaaatcatatacgataatctccgggctgaggtgttcaattaccgggaattcaataaggggtccctcttctacctctgtactaccagcggggtgtgcgtaaaaaagatcagggcactcgcgaatcaccacgacctgctggtgaaggtgaaggtgatcaagcttgtgaacaaattttag

SEQ ID NO: 108648 - DNA, 1899 bp, Artificial Sequence
  Description of Artificial Sequence: Synthetic coding sequence
atgtcacgggtcagggatgcaggatgcgtggccgctggtattgttattggcgccggagcctggtactgcgtttacaagtatacaaggggacgcgaccagacaaagaaaagaatggcgaagcctaagaacagggctgtggcaggcaccggtgcccgcgctagggctggcctgcgcgcaggtttcacaattgacctgggcagtggcttctcgccccccacccctgtgagagctgaggcggaggacagggctcaagatgaagcttcggcgctcgacacagtgggcgcagaggccgttgcacctgctgctagttcagcagaagctcagagcggggccggttcacaggcccaggaggctgacggagccggagtgggccctaaggctgagtccgtcgtcggcgctgccatggcatctgcaattgcccccccgcctggcgtgactgaagccctgggggcggccgaagcacccgcaatggcaggtgccccaaaagtagccgaggctccccgggaggctgagaccagccgggcagccgtgccacccggaacagtggtcccaactgaggctgcagcccccacagaggtgacagagggacccggcgttgccgcccctaccaaggtggcagaagcacctggagtagccagtcctaccgaagccgctgaggcacccgtgccggctacccccaccggtgcagccgcacctacaggtgctgcagaatcacccggaacttctggttcacccaggaccgctgtcgtaccaggaacaagcgcagctaaaaaagccacccctggggcacacaccggagccatccctaaggctacttccgcaactggagccgtacctaagggcggaggaaagggtgtgacacgaagccgcaatggcgggaaagggaaaggtaagaagtccaaggtggaagtggacgaattgggcatgggattccgcccaggcgatggagcagccgctgccgctgcagcctcggcaaatgggggccaagcctttctggcagaagttcctgactccgaggagggagaaagcggttggacagatactgaaagcgatagcgacagtgaaccagaaacacagaggagaggccgggggaggcggcccgtagcaatgcaaaagcggccattcccctacgagattgacgagatcctcggagtgcgcgacttgcgcaaggtactcgctctactgcagaaaagcgacgaccccttcatccaacaggtggcgctcctgaccctctcaaacaacgcgaactactcatgcaatcaggaaacaatcagaaagttggggggtttaccaataatcgccaacatgataaataagaccgatccacacatcaaggagaaagccttaatggcaatgaataacctaagtgagaactatgagaaccagggccgcctccaggtttacatgaataaggtgatggacgacattatggctagcaaccttaattccgcagttcaggtagtaggattaaagttcctcactaacatgacgatcactaacgactaccaacatctcctggtgaactctattgccaacttctttcggctccttagccaagggggcggcaagatcaaagtagaaatcctcaagattctcagcaattttgcagagaatcccgatatgctcaagaagctcctgtccactcaggttcctgcatcattctcttccctctacaatagttatgttgaatctgaaatccttatcaacgctctgacactgttcgaaatcatttatgacaacttgcgagctgaagtgtttaactatcgtgagttcaacaaagggagccttttttatctgtgcacaacttctggggtctgtgttaagaagattcgtgcgctcgcaaaccatcacgacttgctggtgaaggtcaaggtgatcaaattagtgaacaagttctag

SEQ ID NO: 108649 - DNA, 1899 bp, Artificial Sequence
  Description of Artificial Sequence: Synthetic coding sequence
atgtccagggtcagggatgcagggtgtgtggcggccgggatcgttatcggagccggtgcctggtattgtgtatacaagtacactcgcggccgcgaccaaacgaaaaagcgaatggctaagcctaagaatcgcgccgtggctggaacgggcgcacgggctcgcgcgggactgcgcgcgggattcacaatagacttaggcagcggtttctctccccccacacccgtaagagctgaggctgaggaccgggcacaggacgaggctagcgccctggacactgtgggagccgaggctgtcgcacccgctgccagctctgccgaagctcaatcaggagctggcagtcaagcccaagaagcagacggcgccggagtgggccccaaggccgaaagcgttgtcggggccgctatggcctccgcaatcgccccacccccaggggtgacagaggctctaggtgcagccgaggctccagctatggcaggcgctcccaaggtcgccgaggccccccgggaagctgagacgtcgagggccgccgtccccccagggaccgtggtgccaactgaggcagccgctcctaccgaagtcacagaggggccaggcgtggctgcgccgacgaaggtcgctgaagcacctggagtggcctcccctacggaagcagctgaggcacctgtgccagcgacacccacaggagctgctgcaccaacaggtgcggcagaatcgcctggaacatcaggaagcccaaggactgctgtggtccccggaacgagcgctgccaagaaggccactcctggagctcatactggtgctattccaaaagctaccagcgctactggggccgttcctaaaggcggcgggaagggggtcacacggtctcggaatggaggcaaagggaagggtaaaaagtcgaaggttgaggtggatgagttgggcatgggctttaggccaggagatggcgctgccgccgcagcagccgcctccgccaacggtggccaagccttcctggccgaagtacctgacagtgaggaaggggaatccggctggacggatacggaaagcgactcggatagcgaacctgaaacccaacgacgagggaggggcagacgacccgtggccatgcaaaagaggcctttcccgtacgaaatagacgaaattttgggtgtccgggacctacgcaaggtgctagccctgctacagaagtccgatgacccatttatccagcaggttgcattgctgactctgtcaaacaatgccaattattcctgcaatcaggagacgattcgcaagcttggtggtctgcctattatcgcaaatatgatcaataaaaccgacccgcacattaaggagaaagcactgatggcaatgaacaacctttcagagaactatgagaaccaggggcgactacaggtgtatatgaataaggtcatggacgacatcatggcaagtaatctgaactctgccgttcaagtggtgggcctgaagttcctaactaatatgactatcactaatgattaccagcacttgctggtgaattcaatagctaattttttccggttgctgtcacagggagggggaaagatcaaggtcgagattctcaagatcctctctaactttgcggaaaacccagacatgctcaagaaactcctgagcacccaagtgcctgccagtttctcatcgctgtataacagttacgtggagagtgaaatcctgatcaatgccttaacgctgtttgagataatatatgataaccttcgcgccgaagtcttcaactaccgtgaattcaataaaggcagccttttttatctgtgcacgacgtctggcgtttgtgtaaaaaaaatccgggctctggccaaccatcacgatctgctggttaaagtgaaagtgattaagcttgttaataaattctag

SEQ ID NO: 108650 - DNA, 504 bp, Artificial Sequence
  Description of Artificial Sequence: Synthetic coding sequence
atgtctagggtgcgcgacgccggttgcgtagccgccggaattgtgattggcgcgggcgcttggtattgcgtgtataaatacaccaggggcagggaccaaactaaaaagagaatggcaaagcctaagaaccgagctgtagctggaacaggcgcacgtgcccgagcaggcctgagagcgggcttcactatcgaccttggttcgggttttagcccacccacacccgtcagagctgaagctgaagatcgggcccaggatgaggcgtcagcgttggataccgtgggggcggaggcggttgcgccagccgcgtcgagcgcggaggcgcagagcggtgcagggagccaagcgcaggaagctgacggcgccggcgtgggcccaaaagcagagtcggttgtgggagcagctatggcttccgcgatcgctcctcccccaggtgtgacggaggccctgggagccgctgaggctcccgccatggccggtgccccaaaggtggcagaggcaccttag

SEQ ID NO: 108651 - DNA, 189 bp, Artificial Sequence
  Description of Artificial Sequence: Synthetic coding sequence
atgtcacgcgtgagagacgctgggtgtgttgctgcaggtatcgtcattggtgctggtgcctggtactgcgtgtacaagtacacaagagggcgagaccagaccaagaagagaatggctaagccaaagaatcgggccgttgccgggaccggagcccgcgcccgcgctggtctgagggctggctttacatag

SEQ ID NO: 108652 - DNA, 498 bp, Artificial Sequence
  Description of Artificial Sequence: Synthetic coding sequence
atgagccgggtccgcgacgcaggctgcgttgcggctggaatcgtaataggagctggcgcctggtattgcgtatataagtatacacgcggccgtgatcaaactaagaaaaggatggcaaagcccaagaacagggcggtcgcaggcactggagccagagcccgagctggtcttcgtgctgggtttacaattgatctcgggagtggtttctctccacccacacctgtaagagctgaagctgaggaccgcgcccaagatgaagccagcgccctggatacagtgggtgcggaggccgttgcccctgcggcatcctccgcagaggctcagtcaggcgcaggtagccaggcacaggaagctgacggggctggagtgggccccaaagccgaatcagtcgtcggggctgctatggcttccgcaatcgctccaccgcccggcgtgaccgaggcactgggcgccgcagaggcacctgccatggccggggccccaaaggttgccgagtag

SEQ ID NO: 108653 - DNA, 318 bp, Artificial Sequence
  Description of Artificial Sequence: Synthetic coding sequence
atgtcaagggtccgggacgccggctgtgtcgcggctggcatcgtgatcggggctggagcctggtactgtgtgtacaaatacacacgggggagagatcagaccaagaaacgaatggcgaagcccaagaatcgcgccgtggccggcactggcgcccgcgcacgtgctggccttcgggccgggtttacaatagacctgggtagcggtttctccccccctacacccgttagggctgaagctgaagatagagcccaggatgaagccagcgcactcgataccgtgggtgctgaagcggtggcccccgctgctagctctgcatag

SEQ ID NO: 108654 - DNA, 282 bp, Artificial Sequence
  Description of Artificial Sequence: Synthetic coding sequence
atgtccagagtccgcgacgctggatgcgtggctgccggaatcgtgatcggagcaggcgcatggtattgcgtgtataagtacaccagagggcgcgaccagacaaagaaacgaatggctaagcccaagaatagagccgtggccggaaccggagccagggcacgcgccggcctgagagccggcttcaccatcgacctaggtagcgggttttctcctcccacaccagtgagagccgaagccgaagaccgggctcaggatgaggccagtgcactggacaccgtgtag

SEQ ID NO: 108655 - DNA, 1140 bp, Artificial Sequence
  Description of Artificial Sequence: Synthetic coding sequence
atgggctacgctagaaaggttggatgggttaccgctggcctagtcataggcgctggtgcgtgttattgtatatataggctgacgcgcggacgaaaacagaacaaggagaaaatggccgagggtgggagtggagacgtggacgacgcgggcgactgttccggcgcaagatataacgattggagcgacgacgacgacgatagcaacgagtcaaaatcgatcgtgtggtacccaccttgggcgaggattggaacagaggcaggaactcgcgctagggctcgtgcacgtgcacgggccacccgggcccgccgggccgtacagaaacgggccagtcccaacagcgatgacaccgtgctctctccacaggagcttcagaaggtgctgtgtctcgtcgaaatgtctgagaaaccctacatcctcgaagctgccctcatcgcattggggaataacgccgcctatgctttcaacagggacatcattagagacctgggcggactcccaatcgtcgccaagattctgaacacacgcgatccaatagtcaaggaaaaggctctgattgttctcaacaacctaagtgtcaacgccgagaaccagcgtaggctgaaggtgtacatgaatcaagtctgcgacgataccatcacatcaaggctcaattcatcagtccagttggcagggctcagactgctcaccaacatgacagtcactaacgaatatcagcacatgttagccaattcaattagcgacttttttaggctgtttagcgcgggaaacgaggaaactaaactgcaggtcttaaagcttttgctaaatctggctgaaaacccggcgatgacccgggagctgctccgtgcacaggtgcctagttctttgggaagcttatttaataaaaaagagaacaaggaggttattttgaagctgctggttatctttgaaaatataaacgacaactttaagtgggaagagaatgaaccaactcagaatcagtttggcgaaggctcacttttcttctttctcaaggagtttcaagtttgtgcggataaggtgctgggtatcgaatctcaccacgattttttagtcaaagtgaaagtgggtaagttcatggctaagctggctgaacacatgttccctaaatcgcaggagtag

SEQ ID NO: 108656 - DNA, 1140 bp, Artificial Sequence
  Description of Artificial Sequence: Synthetic coding sequence
atgggatatgcaagaaaggtgggttgggtcaccgccggcctggttatcggtgctggggcatgctactgtatttaccggctaactcgcgggagaaagcagaacaaggagaaaatggcagagggaggtagtggagatgtggatgatgccggggattgcagtggggctcgctataacgactggtccgatgacgacgacgattccaacgaatctaagtccatcgtgtggtatcccccttgggccagaatcggtaccgaagctggaacaagggctagagcgagggcccgcgctagggctacgagggcccgaagggctgtccagaaacgtgcaagcccaaacagcgatgatactgtcctgagcccccaggagctgcaaaaagtcctgtgtctggtcgaaatgtctgagaagccatatatattggaagctgcattgattgcgctcggcaacaacgctgcctacgcgttcaaccgagacattattcgagatctaggcggcctccctatcgtggcgaagatattgaacacaagggacccgattgtcaaggaaaaagcactgatagttctgaacaatctgagcgtgaacgccgagaatcagagacgcctcaaggtgtacatgaatcaggtctgtgatgacacaatcacaagcagattgaatagtagtgttcagctcgcaggattgcgccttttgacaaacatgaccgtgaccaacgaataccagcatatgctcgcgaactcgatatccgacttctttagacttttttcggctggtaatgaggagacaaaactgcaggtgctgaagttgctgcttaacctggctgaaaatccagccatgaccagggaattactgagagctcaggtacctagtagtcttggcagtctctttaataaaaaggaaaataaggaggtcattctaaaactgctggtcatcttcgaaaacatcaacgataattttaagtgggaagagaatgaacccacccagaaccagttcggggaaggctccctattcttttttctgaaagagttccaagtttgtgcagataaagtccttgggatagagtcgcaccacgattttctggtgaaggtgaaggttggaaagttcatggctaagctggccgagcacatgttccctaaaagccaagaatag

SEQ ID NO: 108657 - DNA, 2889 bp, Artificial Sequence
  Description of Artificial Sequence: Synthetic coding sequence
atggaagattgcaacgtccatagtgcagcgtccattctggctagcgtgaaggagcaggaagccagatttgaacggctcacaagagccctggagcaagagcggcggcatgtggccctgcagctggagagggctcagcagccagggatggtttccgggggcatgggttctggacaacctcttccgatggcatggcagcagttagtgctgcaagaacagagccccggatcacaagcaagcctggccaccatgcctgaagcccccgacgtccttgaagagactgtcacagtggaggaggacccaggaacccccaccagccacgtgtccatcgttacctctgaggatggtactaccaggagaacggagaccaaagtcacaaagaccgtgaagactgtcaccacacgcacagttcgccaggtcccagtagggccagacgggctcccactgctggacggcgggcccccactcggaccgtttgccgatggcgctctcgaccgacacttcctcctgcgtggtggcgggccagtcgctactctgtcacgcgcctatctgtctagtggcggaggctttcccgaggggccggaaccaagggattctccatcatacgggtcactttctcggggcttgggaatgcggccgccacgtgctggacccttggggccaggtccaggggatggctgcttcaccttgcccggacaccgagaggcctttcccgtcggtcccgaaccgggcccccctggcggtcgtagtctgccagagcgtttccaggccgagccatatggccttgaagacgacacccgttcacttgctgcagacgatgaaggagggcccgaactcgaaccagactatggtactgccacacgccgaagaccagagtgcgggcggggactccacacgcgcgcctacgaagacaccgcggacgatgggggggaactcgctgacgagcgacccgcctttcctatggtcactgccccacttgcacagccagagcggggtagtatgggctcactcgatagactcgtccgccgcagcccttctgtcgattctgcccggaaagaaccccggtggcgcgatcccgagctcccagaggtgctggctatgctgcggcatccggtcgaccctgtcaaagccaacgccgccgcctacttgcagcatttgtgcttcgagaacgagggggtgaagcgtcgtgtgcgacagctgcgcggacttcccctgctggtcgccctgctggatcatcctagggcagaggtgcgtcggcgggcctgcggggccctgcggaacctctcatatggtcgcgacaccgacaacaaagccgctatcagggattgcggaggggtgcccgcgctcgtgcgcctgctgcgcgcagcgcgcgataacgaagtccgcgagctcgtgacggggaccttgtggaacttatcatcatacgagcccctgaagatggtcatcatcgaccatggcctgcagaccctaacacacgaagtaattgtgccacatagtgggtgggaacgtgaacccaacgaagattctaaacctcgagacgctgagtggacaaccgtgtttaaaaacacatcaggctgtctccggaacgtttcctctgacggcgctgaagcacggcgccgcttgcgggagtgcgagggattggtggacgctcttctgcacgccctccaatccgctgtgggaagaaaggacactgacaataagtctgtagaaaactgtgtttgcattatgcggaacctgtcttatcacgttcataaggaagtcccaggtgctgaccgttatcaggaggctgaaccgggacctctagggagtgcagttggaagccagagaaggcgccgcgacgatgcctcttgtttcggaggaaaaaaggcgaaagaggaatggttccatcagggcaaaaaggacggtgaaatggatcggaacttcgataccctcgatttgccaaaacggactgaagctgcgaaagggttcgagctcctataccagccagaagtcgtgcggttatacttgtctctgttgacagaaagtcggaacttcaacaccctggaggccgcagctggcgccctacaaaatctttccgctgggaactggatgtgggccacatatattcgtgccacagtgaggaaagaacggggactgcctgtgctcgttgaactactccagagcgagaccgacaaagtggtccgcgccgtggctattgcactgcgaaatctcagtctcgacaggcggaacaaagacctcatagggagctatgccatggcagagcttgtaagaaatgtgcgcaatgcccaggcacctccacggcccggagcttgcttagaagaggacacagttgtggctgtcttgaataccatccatgagatagtttcagactcactggacaacgctcgatcccttctccaagcgaggggagtaccggcactcgttgccctggtcgcctcttcacaaagtgtcagggaagctaaggctgcctcacatgtgctgcaaaccgtgtggagttataaagagcttcgtggaactttacagaaagacggctggacaaaagcccggttccagtctgctgccgccacagcgaaggggcctaaaggggccctctccccaggggggttcgatgacagcactctccccctggtggacaagagtctcgagggcgagaagacggggtcccgcgatgtcatcccaatggatgctcttgggcctgatgggtatagcaccgtggaccggcgggagagacgacccaggggcgccagtagcgccggagaggcctccgagaaagaaccactgaagcttgaccctagccgcaaggccccccctccaggccccagccggcctgccgtccgactggtggacgccgtcggcgatgcaaaacctcagcccgtagactcttgggtctag

SEQ ID NO: 108658 - DNA, 2700 bp, Artificial Sequence
  Description of Artificial Sequence: Synthetic coding sequence
atgcccgccgagttgcgacaggaacaaagccccgggagccaggcttcccttgccactatgccggaggcacccgacgtgctggaggagacagttaccgttgaggaggacccaggtacaccaacgagccacgtgagcatcgtcacctctgaggatggaaccacaagaaggaccgagactaaggtcaccaagacggttaagactgtcaccacacggaccgttcgccaagtacctgtggggcccgatggactgccattgttggatggtggcccgcccttgggacctttcgcggatggggctctcgaccgacacttcctgcttaggggcgggggcccggtggccacactgagtcgcgcttatctgtcatctggtggcgggttcccagagggccccgagcctcgagactctcctagttatggatctttaagccgtggactcggcatgcgacccccgcgggctgggcccttaggccctggccccggcgatgggtgctttacacttcctggccacagagaggctttcccagtgggtccagagcctgggcctcccggagggaggtcgctgcccgaaagatttcaggcggagccatacggtttggaggacgatacacgatccttggcggccgacgatgagggaggcccagaactcgaacctgactatggcactgctacgaggcggagacccgagtgtgggagaggcctccacacccgtgcatacgaagatactgccgatgacggcggagagctagcagatgaacgacccgcttttcccatggtgaccgctcctctggctcagcctgagcgcgggtcaatggggtcactcgaccgcctcgtgaggagaagtcctagcgtagattccgcaagaaaggagcctagatggcgcgaccccgaactcccagaggtgctggcgatgctgcgccatcccgtcgaccccgtcaaagccaatgctgcggcctatcttcagcacctttgcttcgagaatgaaggtgtgaagcggcgtgtccgacagctgagaggactccctctgctggtagccttactggaccatcccagagccgaggtaagacgtagagcctgcggcgcccttaggaatctctcttatggtcgcgataccgataacaaggccgccatacgggattgtggtggagttcccgccctcgtgagactgttaagggctgccagagacaacgaggtccgggaactggtgacagggaccctgtggaaccttagctcctacgaaccactgaagatggtgattatcgaccacgggctgcagacccttacacatgaggttattgtcccacacagtggttgggagagagagcccaatgaagattcgaaacctcgagacgccgaatggactactgtctttaaaaatacatctgggtgcctcagaaatgtgtcatctgacggcgccgaggcacggcgccgtctgcgggaatgcgaagggctagtcgatgcactgcttcacgccttgcagtcagcagtcgggagaaaggacacagacaacaaaagtgtggagaactgcgtgtgtatcatgcgcaacctttcataccacgtgcataaggaggtcccaggggcagatagatatcaggaggccgagcccgggcctcttggcagtgctgtgggatcccagcgcagaaggagggatgatgcctcctgttttgggggcaagaaggcaaaggaagagtggtttcatcaggggaaaaaggacggtgaaatggacagaaacttcgatacactggatttacctaaacgcacggaggccgccaaggggtttgaactgctgtaccagccggaagttgtgcgtctctacttatccctgctgacagagtcaagaaactttaatacactggaggcggcagctggagcattgcagaacctcagcgctggtaattggatgtgggctacctatatcagagccacggtgcgtaaggagcgaggcctccctgtgttagtggagctgctccaaagtgagactgataaagtggtgcgcgccgtggctattgcgctccgtaacttaagtctagataggagaaacaaagatttaatcggctcctacgcaatggctgagctggtgagaaatgtccgcaatgcccaggcccctcctcggcctggtgcatgtcttgaggaggacacagttgtggcagtgcttaatactattcatgagatcgtatcagatagcctagacaacgcccgctccctacttcaagcccggggagttcctgcccttgtggctctggtcgcctctagccaaagcgtgcgcgaggctaaggcggctagccatgtcctccagactgtgtggtcatataaagaactcagaggaacgctgcagaaagacgggtggactaaggcgcgctttcagtctgcagctgccacagcgaaaggacccaaaggcgctctgagccccggaggcttcgacgactcaacactcccacttgttgataagagcctcgaaggtgagaaaacagggtcacgcgacgttataccgatggatgctctggggccagatgggtatagtacagtagaccgccgggagcgaaggccgagaggggcatcgtcagccggcgaggccagtgaaaaggagccgctcaagttggatccctcccggaaggctcccccacccggaccctcacgacctgcggtacgtctggttgatgcggtgggcgatgctaaaccccagcccgtggattcctgggtatag

SEQ ID NO: 108659 - DNA, 2700 bp, Artificial Sequence
  Description of Artificial Sequence: Synthetic coding sequence
atgcccgctgagctcaggcaggagcagagccccgggagccaggcaagtctggctacaatgccagaggccccagatgtgctcgaagaaacggtgacggtcgaggaagatccaggaacgcccacatcccatgtttcaatagtgaccagcgaagatggcaccacaagaaggaccgagaccaaggtgaccaaaacggttaagactgttaccacgcgaaccgtgcgccaagttcctgtcgggcccgacgggctccccctacttgacggcggccccccactcggtccttttgccgacggtgcgctggatagacacttcctgcttagggggggcggcccggtagcgactctctctagggcatacttgtcatcaggcggaggatttcccgaggggcccgaacctagagactcaccctcttatggctctctgagcagaggtttaggcatgagaccgccgcgtgccggaccgttgggaccaggacccggcgatggctgctttacccttccgggccaccgtgaagcgttccccgtgggaccggaacccgggcctccaggcggtagaagcttgccagagagatttcaggctgagccttatgggttagaagacgatacaaggtctctggctgcggatgacgagggaggacctgagcttgagccggactacggcacggctaccaggcgtaggcctgagtgtgggcggggccttcacacaagggcctatgaagatactgccgatgacggaggcgagcttgctgacgagaggcccgcttttccaatggtaactgcccctctcgcacagccggagaggggatcgatggggtcactggacaggctggtacgccgatctccttctgtagacagtgccagaaaagagcctcgctggagggacccagagctgcccgaggttctggcaatgctgagacatccagtggaccctgtcaaggcgaacgcagccgcttatctccagcacctctgttttgaaaacgagggagtgaagcggcgggtacggcagctgagaggtctgcctctcctggttgccttgcttgaccaccctcgcgcagaagtcagacggcgggcatgtggcgctctacgcaacctgtcctatggcagggatactgataacaaagccgcaatcagagactgcggtggcgttcccgcactcgtacggctgttgcgggccgcgagagataatgaagttcgcgagctcgtgactggaacactgtggaatttatcctcttatgagccccttaagatggtgattatagaccacggcctccagaccctcacacatgaggttattgttccacattctggctgggagagggagccgaatgaggacagcaaaccgcgcgatgccgagtggaccacggtgtttaaaaacacatcaggctgtctgcgcaatgtttcgtcagatggcgcagaggcacggagaagactcagggagtgtgagggtctggtcgacgccctgttgcatgccctacagtctgcagtcggtagaaaagataccgacaataaaagtgtcgagaactgtgtgtgcattatgcgtaatctgtcatatcacgttcacaaggaggtgccaggtgctgacagatatcaagaggcagagccaggtcccctggggtctgctgtgggctcacagcggcggcggagagacgatgcttcatgtttcggggggaagaaggccaaggaggagtggtttcaccaaggcaaaaaggacggtgagatggatagaaatttcgatacgctggacttgcctaagagaacagaggccgccaagggcttcgagttgctttatcagcccgaagtagtgcgtttgtaccttagtctgctgaccgaatcccgcaactttaatacactagaggctgctgctggcgctctgcagaacttgagtgctggtaattggatgtgggcaacttacatccgggctacggttcgtaaggaacggggtctccccgtacttgtcgagcttctgcagtccgagactgacaaagttgttagggcagtagccattgccctgcgaaatctcagcctggatagacgtaacaaggacctgatcggcagttatgcgatggctgaacttgtgagaaatgtgcgcaacgcacaagctcccccaagacctggcgcctgcctggaagaggacactgttgtggcggttttaaacaccattcacgagatcgtttctgactccctcgacaatgcacgatcactcctacaggctaggggggttccagctctggtggcgcttgtagcctcctcccagagtgtacgtgaggccaaggccgctagccatgtgcttcagacagtctggtcatacaaggaactccgtggtaccctgcaaaaggacggctggactaaagcgcgatttcagtcggcagctgctaccgcaaaggggcccaagggcgcgctaagtcccggggggtttgatgatagcacactccctctcgtcgataagtctctcgagggtgagaaaacaggcagccgagacgttattccgatggatgccctggggcctgacgggtattctacagtggaccgcagagagcggcgtccacgcggcgcctccagtgcaggtgaagctagcgaaaaggaaccgctcaagctggacccttcccgaaaggcacccccacctggaccctccaggcccgccgttcgcctggtggacgccgtgggagatgcgaagcctcaacccgtggacagctgggtgtag

SEQ ID NO: 108660 - DNA, 2871 bp, Artificial Sequence
  Description of Artificial Sequence: Synthetic coding sequence
atggaagactgcaacgtgcactctgcagcctcaattctagcaagcgtcaaggagcaagaggctagattcgaaaggctgactcgtgcactggagcaggagaggcgccacgtggccctacaactggagcgggctcaacagcccggcatggtgagtggcggcatgggttctgggcagccccttccgatggcgtggcaacagctggtgttacaggaacagagtcctggatctcaggcgtctctggcgactatgcccgaagcaccggatgtgctggaagagacagtgaccgtcgaggaggaccccggtacgcccacttcgcacgtgtctattgtgacatctgaagacggaactaccagaaggaccgagactaaggtgacaaaaaccgtaaagaccgtaacaactagaaccgtgcggcaggtccctgtgggacctgatgggctccctcttttagacggagggcctcccctcggacccttcgcagacggggcattagacagacattttttgttgagaggagggggacctgtggctactctgtcccgagcctacctgagctcaggaggcggatttcccgaggggccggagcctcgggactctccaagctatggttccctttctcggggtttagggatgcgacccccaagggctggccccttagggcccggccctggtgatggttgctttacccttccagggcaccgggaggcattccccgttgggcccgagcccggcccacctggaggccggtccctgcctgagcgtttccaggcagaaccctatggactcgaggatgacacccgcagcctggcagcagatgatgagggagggcctgagttggaacctgactatggcaccgcaacccgacgccgtcccgaatgcggacggggactacacactagggcttacgaggacactgctgacgacgggggagagcttgctgacgaacgacctgccttccctatggtgaccgccccactggctcagcccgagagggggtccatgggcagcttggatagactcgtgcgacgcagcccgtctgtggatagcgcccggaaggagccacgttggcgggatcccgaactccccgaggtcctcgccatgctgagacaccccgttgatcccgtgaaagcgaatgctgcagcatacttacagcacttgtgttttgaaaatgagggagtgaaaaggagagtgagacaattacgtgggctccctcttctcgtggcactgttggaccacccacgagctgaggtgcgtcgcagagcgtgtggggctctccgaaatctgagctatgggcgagataccgataacaaggcggcaatccgagattgtggcggcgtgcccgctctggtgaggctgcttagagccgccagagacaatgaagtgcgagaattagtaaccggtaccctttggaatctctcctcctatgagcccctcaaaatggtaatcatcgaccacggcctccagaccctcacacacgaagttatcgtgcctcacagcggctgggagagagaacccaatgaagactccaaaccacgcgacgcagagtggaccactgtttttaagaatacttcagggtgcttgaggaatgtttcatctgatggggcagaagccaggcgaagattaagagagtgcgaggggcttgtcgacgccttacttcatgcccttcaatcagcggtaggaaggaaagacaccgataataagagcgtggagaactgcgtctgtattatgaggaacttaagctatcacgtgcacaaggaagtccccggtgctgacaggtatcaagaagctgagccggggccactcggatccgcggtgggctcacagaggcgccgcagagacgatgcgtcatgtttcggaggaaagaaggcgaaaggaaagaaagatggggaaatggatagaaactttgatactttggatctccctaagcgtactgaagcagcgaagggttttgagctcctctatcagcctgaggtcgttcggttgtatcttagcttactgactgaatctcgtaacttcaatactcttgaagcagccgctggagctctccagaacttaagtgccggcaactggatgtgggcgacctacattagagctacagtgcggaaggagaggggcctccccgtcttggtggaacttctacagagtgagactgataaggttgttagagcagtggctattgctctgaggaaccttagccttgaccgccggaataaggatcttataggctcctatgcaatggcagagctggtacggaacgtgcgcaacgcgcaggctccgccgcggccaggagcatgtttagaagaggatacagtggttgccgtgcttaatacgatacatgagatcgtgtccgattcactggataacgcgcgctcactgctccaggcccggggtgtgccggctctggtagccctggtcgcttccagccagagtgtgcgagaagccaaagcagccagtcatgtcctgcaaacagtatggtcctacaaagagctgcgcggcactctgcagaaagatggctggactaaggctagattccaatctgcagccgctaccgctaagggaccaaagggcgcactcagccctggcgggtttgacgattctaccttgccccttgttgataagtctctggaaggcgaaaaaaccggctctcgagacgtaatcccaatggatgccctgggcccagatgggtatagtaccgtcgataggcgggagcgacgtcctaggggcgcttcatcagctggcgaagctagtgagaaagaaccactgaagcttgacccttctaggaaagccccacctcctggaccatcgaggccagccgtgcggctcgtggacgctgtcggggacgcgaaaccccaacctgtcgattcttgggtctag

SEQ ID NO: 108661 - DNA, 2682 bp, Artificial Sequence
  Description of Artificial Sequence: Synthetic coding sequence
atgccggccgagctccgacaggaacaatctccagggtctcaggcttccttggccaccatgcccgaagccccggatgtgctggaagaaacagtcaccgtcgaagaagatcctggaaccccgacgtctcatgtctcaatcgtgacatccgaggatggcactacaaggagaacggagaccaaggtcactaagaccgttaagacggtgacaactagaaccgtgaggcaagtgccagtgggcccggacgggctgcctctcttggacggcgggccgcccctcgggccgttcgctgacggagccctggaccgccatttccttctaagggggggcgggccagtggctacactctccagggcgtatttgagcagcggaggcgggtttccggagggacctgaacctcgtgatagcccatcttacgggtcactgtcacgcggcttgggcatgcgtccccctagagctgggcccctcggtccgggacctggtgacgggtgcttcaccctacccgggcatcgggaggcattccccgtggggcccgagcccggccctcccggaggccgatcacttccagaacgcttccaagccgagccctatgggctggaggatgacacgcggtccttggctgccgatgacgagggagggcctgagcttgagccggactatggaaccgccacaaggaggagacccgaatgtggacgggggttgcacactcgcgcctatgaggatacagctgacgatggaggcgagcttgctgacgagaggcctgcttttcccatggtcactgcacctctggcccaacccgaacgcggtagtatgggcagcctggatagattagtccgaaggtcacccagtgtggattccgcaaggaaagaaccaagatggagggaccctgaactccctgaagtgttagcaatgttgaggcaccctgtcgatcccgtgaaggcaaacgccgcagcgtaccttcagcatctttgttttgagaacgagggcgtcaagcgccgagtacgccagctccgaggactcccactgctagtggccctgctcgaccatcctcgagccgaggttaggcggcgcgcttgcggcgccctacggaatctgtcatatggacgcgacaccgataataaggcagctattcgagactgcggcggcgttccagcattagtgaggctcctgagagctgctcgcgacaatgaggtacgggaacttgttactggcacactttggaaccttagctcatatgaacctcttaagatggtcataatagatcatggtctccagactttaactcacgaggtgatcgtcccccattccggctgggaaagggaacccaatgaagattctaaaccccgcgatgctgagtggaccactgtatttaagaacacttctggctgtcttcgaaacgtgtcttccgacggtgccgaggcacgccgacgactcagggagtgtgagggcctcgtggacgccctgctgcacgcccttcaatccgcagtcggccgaaaagataccgataacaaaagcgtagagaattgcgtatgtattatgcgaaacctttcataccacgtccacaaggaggtgccaggtgctgataggtatcaagaggccgaacctggaccactcggctccgctgttggaagccagaggagacggcgagacgatgcgtcctgcttcggcggtaagaaagccaagggcaagaaagacggcgagatggatcgaaacttcgatacattggacttacccaagcggaccgaagccgccaagggctttgagctcctgtaccagccagaggtggtgaggctctacctctccctgttaactgagtctcgaaactttaataccctggaggcagccgctggggccctgcaaaatttgtctgccggcaattggatgtgggctacgtatattagagctacggtgcgaaaagagcgaggacttcctgtgttagttgagctattgcaatctgaaaccgacaaggtagtgcgagctgtggcgattgcgcttcgaaatttaagcttggaccgtaggaacaaagacctcatcggatcgtatgccatggctgagctagtgcgcaatgtgcgaaacgcacaggcgccaccacgccccggtgcctgtcttgaggaggacaccgtcgtggcagtgttaaacacaattcacgaaatagtgtccgactccctcgacaacgcgagatctctgcttcaagctcgcggggtgcccgcattggtggccctcgtggcaagctctcagtctgtgcgggaagctaaggctgcttcccacgtgctgcagaccgtctggtcatacaaggaattgcgcggaactcttcaaaaggatggatggacgaaggctcgctttcagtctgccgctgccaccgccaagggacccaagggagcgttgtcacctggcggcttcgacgacagtaccctcccactggtggataagtcactagagggtgaaaaaactggaagtcgggatgtgattccaatggatgccctgggtcctgatggatacagtactgttgaccgacgagaacgcaggcctcggggcgcgagtagcgccggggaggccagcgaaaaagagccgctcaaactggatccctcccggaaagcacccccccctggcccatctagaccagcagtacgccttgtggacgctgtaggagacgctaagccccagccagtggactcttgggtgtag

SEQ ID NO: 108662 - DNA, 1131 bp, Artificial Sequence
  Description of Artificial Sequence: Synthetic coding sequence
atggagagttatgatattatcgccaatcagccagtggtcatcgataatggctccggcgtaattaaagctgggtttgctggcgatcaaatacctaaatactgtttccccaactacgtgggacggcctaagcatatgcgcgtcatggcaggcgctctcgagggcgacctttttatcgggccaaaggctgaggagcacaggggtctgctgacaattcgttacccaatggaacacggagttgttagagattggaatgacatggagagaatctggcagtacgtctattcaaaagatcagctacagactttttcagaggagcatcccgtgctgctcactgaagccccattgaacccatccaagaatagggagaaagccgccgaggtcttttttgaaacttttaacgtgccagctcttttcatttccatgcaggccgtcttaagcctctacgctaccggaagaactaccggagtcgtcttggatagcggagacggtgtgacccatgccgtgccaatctacgagggctttgcgatgcctcactcaatcatgagggttgacatcgcaggacgagacgtgtccagatacctgcgtctcctattgagaaaggagggagtggattttcacacatctgccgaatttgaggtggtgcgtaccatcaaggagcgagcatgctacttaagtatcaaccctcagaaggatgaggcgcttgaaacagagaaggtccaatacaccctccccgacggaagcaccctcgacgtcggtccagccaggttcagagcgcccgagttgctttttcagcctgacctggtgggagacgaaagtgaagggttacacgaggtggtagctttcgccatccacaagagtgatatggacctgcgccgcaccttattcgcgaatatcgtgttatctgggggatccacgcttttcaagggctttggggatcgcctgttgtctgaagtgaagaaactcgccccaaaagacataaaaataaagattagcgcccctcaagagaggctatatagtacgtggattggtgggtctatccttgcttctcttgacacgtttaagaagatgtgggtctctaaaaaagagtatgaggaggatggctcacgcgccatccacaggaagactttttag

SEQ ID NO: 108663 - DNA, 1167 bp, Artificial Sequence
  Description of Artificial Sequence: Synthetic coding sequence
atgtccaaagttttcaaaaaaacatcctccaatggaaagctttccatttatttaggcaagagagattttgtggatcatgtggacacagtcgagcctatcgatggtgttgtgttggtggatcctgagtaccttaagtgccggaagctgttcgtaatgcttacatgcgcatttcgatatggaagagacgacctcgaagttattggtctgaccttccggaaggatctttacgttcaaaccctgcaagttgtgccagcagagagctcttccccccagggccccctcaccgtgcttcaggaaaggcttctgcacaagctaggtgacaatgcatatccttttacactgcagatggtgaccaacctgccttgcagcgtgactttacagccggggcccgaggatgctggcaaaccttgcggcatcgactttgaagtgaaatcattctgtgccgagaatccagaggaaacagtgtccaaaagggattacgtgaggttagtggtgcgcaaggtacagtttgctcctccagaggcaggaccaggtccgagtgcgcagacaatcaggcgtttcctcctgagcgcacagccgctgcagctacaggcttggatggaccgggaggtacactatcatggagagcccatctccgttaacgtcagcattaacaactgtacaaacaaggtcatcaagaagataaaaatatccgtggatcagatcacagatgtggtcctctatagcttagataaatataccaagaccgtgttcattcaggagtttactgaaaccgtggccgccaactccagcttcagtcagagcttcgccgtgacaccgattctggcggccagttgccagaagagaggtctcgcacttgatggcaaactgaagcacgaggataccaatctagcctcctccacaattataagacccggcatggataaagaacttctggggatcctcgtctcgtacaaggtgcgtgtcaatctgatggtttcgtgtggcgggatattaggagacctgaccgccagcgacgtgggggtggaacttcctctcgtcctcattcatcccaagccgagtcacgaagccgcttctagcgaggacatcgtgatcgaggagtttacccggaagggggaggaagagagccagaaagctgttgaagccgagggcgatgagggatcttag

SEQ ID NO: 108664 - DNA, 1167 bp, Artificial Sequence
  Description of Artificial Sequence: Synthetic coding sequence
atgagtaaggtgttcaaaaagacgtcatccaacggcaaactttctatctacctggggaagcgtgattttgtcgaccacgtcgacaccgtggaacccatcgacggcgttgtattggttgatcccgaatatctgaagtgccggaagctttttgtcatgttgacttgtgcttttaggtacgggagggatgacctggaggtgattggactcactttcagaaaggatttgtacgtgcagaccctccaagtggttcccgccgaatcttccagcccgcagggcccccttacagtgctccaggagcgactgctgcataagctaggggataacgcctatcccttcacactgcagatggtgacgaaccttccatgttccgtcaccctgcaaccagggcccgaggatgccgggaaaccctgtgggatagatttcgaggtgaagtccttttgcgccgagaatccagaagaaacggtcagtaagcgggattacgtgagactggtggtgcgaaaagtccagtttgctccacccgaagcaggccctggaccttcggctcagaccattcgccgattcttactctccgcgcagcctctccagcttcaggcctggatggacagagaagtccattatcacggcgagccaatttcagttaacgtgagtattaataattgtactaacaaggtcataaaaaagatcaagatttctgtagaccagatcactgatgttgttttgtattcccttgacaagtatactaagacggtcttcatccaagaattcacagagacggtggccgccaatagcagttttagtcagtcatttgcggttaccccgattttggcagcatcctgccagaagaggggcctggctctggatgggaaactgaagcatgaagacacaaatctggcctcttcgacaatcatcagacctggcatggacaaagaactcctggggatcctggtgtcatataaagtgcgcgtgaaccttatggtaagctgtgggggaatcctgggtgatctcacagcctccgacgtgggcgtggagttgccattggtgttaatccaccccaagccgagccacgcatccgcttcaagcgaagatattgtgatcgaagagtttaccaggaagggagaagaggagtcacagaaggcggttgaggccgagggtgacgaaggttcttag

SEQ ID NO: 108665 - DNA, 1080 bp, Artificial Sequence
  Description of Artificial Sequence: Synthetic coding sequence
atgtcaaaagtctttaaaaagacctcaagcaatggaaagctcagcatctatctgggtaagagagatttcgttgatcacgtggatactgtggaaccaatcgatggggtcgtgctcgtcgacccagagtatctaaagtgcaggaagctgtttgtgatgcttacatgtgcattccgctatgggcgagacgacctggaagtgattgggttgacttttaggaaggatctctatgtacaaaccttgcaagttgtgccggcagagtcatcgtcaccccagggacccctcaccgttctgcaggaacgattacttcacaagctcggagacaacgcctatccttttaccttacaaatggtcaccaacctcccttgctctgttacactgcaacccggtcctgaagatgctggtaaaccctgtggcattgactttgaggtgaaaagtttctgcgccgagaatcccgaagaaactgtcagcaagagggattatgtaagactggtggtgcgcaaggtgcagttcgcaccccccgaggccggtcccggtccaagcgcacagactattaggcgcttcctgctgtccgcccagcctcttcaactccaggcttggatggatagagaagtgcattaccacggggagcccatatccgtaaacgttagcatcaacaattgtacgaacaaggttatcaagaagattaaaattagtgtggaccagattacagacgtggtgctatatagtttagacaagtacacaaagaccgtatttattcaggaatttacagaaaccgtggctgctaactccagctttagccagtcttttgccgtgacgcccatcctagcagcctcatgccagaaaaggggcctggccctggacggcaaattgaagcacgaagacacaaatctcgcgagttctacaatcattagaccaggaatggataaggaattgttaggtattctagtgagctataaggtgcgggtcaacttaatggtctcatgtggaggcatcctgggggatctgactgccagcgacgttggcgtggaattgcccctcgtgctgatacatccaaaacccagccacgaagctgctaggtag

SEQ ID NO: 108666 - DNA, 993 bp, Artificial Sequence
  Description of Artificial Sequence: Synthetic coding sequence
atgggggagaaacctggtaccagagtgtttaaaaagtcatcaccaaactgcaaactcaccgtctatttaggcaaaagagatttcgtggatcaccttgataaggtcgaccccgtcgacggggtcgtgctggttgatccagactatctcaaagaccggaaggtgtttgtgacacttacatgtgcgttccggtatggtcgtgaagatcttgacgtactgggtttgagcttcaggaaagacctgttcattgctacttatcaagcattcccacctgtacccaatccaccaagacctccaactcgcctccaggacaggctgctgagaaagctcgggcagcacgctcatccttttttttttaccattcctcagaacttgccctgcagcgtgactttgcaacctggaccagaggacacaggtaaagcgtgcggagtggacttcgaaatccgggccttttgtgctaagagcctggaggagaaaagtcacaagcgaaattctgtgaggctggtgatccgcaaagtacagttcgcccctgagaaacctgggccgcagcctagcgcggagactacacgccatttcctgatgtccgacaggtcgctgcatctagaggcttccttggacaaggaactgtattaccacggtgagcctcttaacgtgaacgtgcatgtgaccaacaattcaacaaaaacggttaaaaagataaaggtcagtgtgcggcagtatgctgatatctgcttgtttagcaccgctcaatacaagtgcccagtggcacagctggagcaagacgatcagagggaaggaggctgtcagcagggcggcgctggcaaccccggcgtactccagggtcagggcgaggctgggggagtgagccgccgggggtgcctgtgcggcgctgccttttgctcctatgcccctcaggcacctaggccccatccacccccacaaaccccagtctcacgcagcggagatcgatgcccttgcggccaccagccccattag

SEQ ID NO: 108667 - DNA, 1245 bp, Artificial Sequence
  Description of Artificial Sequence: Synthetic coding sequence
atggtattaggcaaggtcaagtcactcactattagtttcgactgtcttaatgactctaacgtgcccgtttactcctctggagacaccgtttccggccgcgttaatctagaagtaacgggggaaatccgggttaagagtttaaaaatccacgctagaggccacgctaaagtacgatggaccgaatcgcggaacgcggggagcaacacagcatacacccaaaattatactgaggaagtggagtacttcaaccacaaagatatcctcatcggccatgaacgagacgacgacaacagcgaagaaggttttcacaccattcactccgggcgacacgagtacgccttctcattcgaacttccccaaactcccttggccactagctttgagggtcgccacggttctgtgcgctattgggtgaaggctgaacttcaccgaccctggcttcttccagtaaagctgaagaaagagtttactgtcttcgagcacatcgatataaatactcctagcctgctgagtcctcaggccggaactaaggagaagacattatgttgctggttttgtacttctggcccaattagtttatcagccaagatcgaacggaaggggtacactcccggggaaagcattcaaatttttgccgagatagaaaactgtagtagccgcatggttgtgccaaaagccgccatatatcagacccaggcgttctatgcaaagggcaaaatgaaagaggtcaaacagctagtggcaaacctgagaggggagagcctgtcttcaggcaaaactgagacttggaacgggaagctacttaagattccgccagtgagcccatcaatccttgactgctcaatcattcgcgtggagtacagcctgatggtttacgtggacattccaggggctatggatctgttcctgaacctgcccctggttataggcacgatacccctgcacccgttcggctcccgcacctcatctgtgagctcacagtgctcgatgaacatgaactggctgtcactgtcactaccggagcgcccagaggctcccccctcatatgccgaggtggtgacagaggagcaaagaaggaacaatctggcccctgtctcggcctgcgatgatttcgagcgtgctcttcaaggccctctgtttgcctacatacaagaatttagattccttccacctcctctttattcggagattgacccgaatccagaccagagcgcggacgatcgaccctcgtgtccatcccggtag

SEQ ID NO: 108668 - DNA, 1233 bp, Artificial Sequence
  Description of Artificial Sequence: Synthetic coding sequence
atgggagataagggcacacgggtgttcaagaaggcatcaccaaatggaaaactcacggtgtatctcggcaagagggatttcgtggatcacatcgatctagttgacccagttgacggagttgtcctggtcgatcccgagtacctgaaggagagacgtgtgtatgtcactctgacgtgtgctttccgctacggtcgcgaggacttagatgtcctaggtttgacttttcggaaggacctctttgtggccaacgttcagagcttccccccagccccagaagataagaagcccctgacacgcctgcaggagaggttaatcaagaagttgggagaacatgcttacccattcaccttcgaaattccgcctaatctgccctgttctgtgaccttacagcccggaccggaggatactggcaaggcttgtggcgtggactacgaagtgaaggccttttgtgcggaaaacttagaagaaaagattcacaagagaaattcagtccggctggtgatcaggaaggtacagtacgctccagaacgcccgggccctcaacccacagccgagacaaccagacaatttctgatgtcagataaacctttacaccttgaagccagtctggataaggagatctactatcacggcgaacctatctccgtgaacgtccacgtgactaacaacacaaataagacagtcaaaaagattaaaatcagcgtgcgccagtacgccgacatttgtcttttcaacactgctcagtataaatgtccggtggctatggaggaggcagatgatacagtggctccctcatccactttctgcaaggtgtatactctcacgccgtttttggccaacaacagggagaagcgcggcctggccctggacggtaaactcaaacatgaggacaccaatctggcatcttctacccttttacgtgaaggtgccaaccgtgagatcctgggaatcatcgtgtcttacaaggtgaaagtgaaactcgttgtttctagaggcggagatgtggcggtggagctcccctttactctgatgcaccccaagccgaaggaagagcccccccaccgcgaggtgccagaaaacgaaacgccggtggacacgaacctaatcgagttggataccaacgatgatgacattgttttcgaagacttcgcaaggcagcgcctgaaggggatgaaggatgataaggaggaggaagaggatggcactggttcaccccagctgaacaataggtag

SEQ ID NO: 108669 - DNA, 1257 bp, Artificial Sequence
  Description of Artificial Sequence: Synthetic coding sequence
atgggagacaagggaacccgggtattcaagaaggcaagcccaaacggaaaactcacagtgtatctgggcaagcgggatttcgtggaccacattgacttggtcgaccccgtggacggtgtcgttctcgtcgatccagagtatctgaaggaaagacgggtctacgtaacattgacttgtgcatttcggtacggacgggaagatctggatgtgctcggcctgacttttcgtaaggacctgtttgtggcaaatgtccagtctttcccccccgctcctgaagataaaaagcccttgacacgtcttcaggagagactgatcaagaaactcggtgagcatgcctacccatttacctttgaaatacctcctaatctgccatgttccgtcacactccaacccggccctgaggatactggtaaggcctgtggagtggattacgaggtgaaggctttctgtgccgagaacctggaagagaaaatccacaagaggaacagcgtccgcctcgtgatcagaaaagttcagtatgcaccagagaggcctggcccccaacccaccgccgagactacacgacagtttctcatgtcagataagcccttgcatcttgaggcctccctggacaaagagatctattatcatggggagcctataagtgttaacgtgcacgtgactaacaatacaaacaaaaccgtgaagaagattaaaatcagtgtgcggcaatacgccgatatctgcctgtttaacaccgctcagtacaagtgtccggtcgctatggaggaagcagacgatacagtggcccctagttccacattttgcaaagtttatacactcacaccctttctagccaacaaccgcgaaaagcgaggcttggcgctcgatggaaagctgaaacatgaagatacaaacttggcaagttcaacactgctccgagagggggcgaatcgcgaaatccttggaattatagtgtcctacaaagtgaaggtcaaactggtggtctcccggggaggacttctgcgcgggctgtgcttttctgacgttgctgtggagttgcccttcactctgatgcatcctaagcctaaggaggaacccccacacagggaggtgcctgagaatgagaccccagtggatactaaccttatcgagctcgatacaaacgatgatgacatagtttttgaggatttcgctcgccagcggctgaaggggatgaaggatgacaaagaagaagaggaagatgggacaggctcgccgcagcttaataatcggtag

SEQ ID NO: 108670 - DNA, 1257 bp, Artificial Sequence
  Description of Artificial Sequence: Synthetic coding sequence
atgggggacaaagggaccagagtatttaaaaaagcttccccaaatggcaagctgacagtctacctgggcaagagagactttgttgatcatatcgatctggtcgatccagttgacggcgtggttctggtggatccagagtacctcaaggagcgcagggtctacgtcaccctcacttgtgccttcagatacggccgcgaagatctcgatgtcctaggattaactttcaggaaggatttattcgtggcgaatgtgcaatccttcccaccagcccccgaggataaaaaaccattgactaggctgcaggagcggctaatcaaaaaacttggggagcatgcctatccatttacattcgaaattcctccaaatcttccctgttcagttactctccagccagggcccgaggacaccggaaaagcatgcggtgtggactatgaagtcaaggccttttgcgccgaaaacctggaggagaaaattcataagaggaattctgttcgtctcgtgatacgcaaggtgcaatacgcaccggagcgcccaggccctcagcctacagccgagacaaccagacagttcctgatgtcagacaaacctctccatcttgaagcctctctagacaaggagatctactatcacggagagccaatctccgtgaacgtgcacgtcaccaataatacaaataaaaccgtaaagaagatcaagatcagcgtccgacagtatgccgacatatgtctgttcaataccgcccagtacaaatgcccagtggccatggaggaagccgatgatactgttgctccttccagcacattttgcaaggtgtatactcttaccccttttctggcaaataatagggagaaacgcggcctggctcttgacggtaaactcaagcacgaggacacaaatttggcaagctctacactacttagggagggagcaaatcgcgagatcttaggcatcatagtttcatataaggtgaaagtcaagttggtcgtgtcccgaggcggcctattgggcgacctggctagctctgatgtcgccgttgaactgccttttaccttaatgcatcctaaaccgaaggaggaaccaccacaccgtgaagtgccggaaaatgagaccccagtcgataccaatttaatcgaactggatactaacgacgacgacatagtctttgaagattttgcgagacagcggcttaagggaatgaaggacgataaagaggaggaggaagatggtacaggctcccctcagctgaataatcgctag

SEQ ID NO: 108671 - DNA, 1230 bp, Artificial Sequence
  Description of Artificial Sequence: Synthetic coding sequence
atgggggagaagccagggactagagtgtttaagaagtctagcccaaattgcaagctcacagtctacctgggcaaacgcgatttcgttgatcacctggataaagtggaccctgtagacggcgtggtgttggttgatcccgattacctgaaggaccggaaggtctttgtaacgctgacatgtgcattcagatatggacgtgaggatcttgatgtccttggtctttctttcaggaaagacctcttcatcgctacatatcaggccttccctcccgtgcccaacccccctagaccacccacaaggctgcaggaccgcctgttgcggaaactcggacagcacgctcaccctttcttcttcaccatccctcagaacttaccctgctcagtcactctgcagcccggccccgaggatactggcaaagcatgcggagtggatttcgagatccgggcattctgtgccaaatccttggaagagaaaagccacaagcggaattctgtgcggcttgtcattcggaaggttcagtttgcccccgaaaagcccgggccgcagccgtccgcagagaccacgagacatttcctgatgtccgacaggagtctacatctggaggccagccttgacaaggagttgtattaccacggtgagccactgaacgtaaacgttcacgtgactaataatagcacgaagacagtgaagaaaatcaaggtaagcgtccgccagtatgccgacatttgtcttttttcgacagcccagtacaagtgccctgtcgcacagctggagcaagatgaccaggtgagtcccagtagtacgttctgtaaagtgtacacgatcactcctttactttctgataatcgagaaaagcggggtctggccctggatggcaagttgaagcacgaggacaccaacctggctagctctacaatcgtgaaggagggcgctaataaagaggttcttggaatcctggtgtcgtacagagtcaaggtcaagctcgtcgtaagtcgcggaggagatgtcagcgttgagcttccatttgttctgatgcatccaaagcctcacgatcacattcctctgccccgtcctcagtccgcagcccccgagaccgacgtaccggtcgatactaatctgatcgaatttgacaccaactatgctacagatgatgatattgtcttcgaggattttgcgagattacgcctgaaggggatgaaagacgacgattatgacgaccagctgtgctag

SEQ ID NO: 108672 - DNA, 1185 bp, Artificial Sequence
  Description of Artificial Sequence: Synthetic coding sequence
atgggggaaaaacccgggaccagagtgtttaaaaagtcaagtcccaactgcaaactcacagtttacctgggcaagcgggacttcgtggaccatttagataaagttgacccagtcgtctttgtaactctgacctgcgcttttcgttatggaagggaagacttagacgtcctaggactttcttttaggaaggatctttttatagctacttaccaggctttccctccggtgcctaatccacctagacctcctacgcgcctacaggacaggctgctgcggaaattgggacagcacgctcaccccttcttcttcactataccacagaacctgccctgctcagtgacgcttcagcccgggccagaagatacgggtaaagcttgtggcgtggacttcgaaatacgtgcgttctgcgctaaaagcctggaggaaaaatcacacaagcgaaatagcgtgcggctagttatcaggaaagtgcagttcgctccggaaaagcccgggccccaaccctcagctgagacgactaggcacttcctaatgagtgaccgcagcctacacctggaggcaagcctggacaaagagctctactaccacggggaaccactcaacgtgaatgtccacgtcactaacaactcaaccaagacagtgaagaagattaaagtcagcgtgagacagtatgcggacatctgcctcttttccacggcccaatataaatgccctgtggctcagctagaacaagatgaccaggtctctccatcctccactttttgcaaagtctataccataacacctctgttgtctgataatagggaaaagcgcggcctggccttagacggaaagcttaaacatgaagacactaatctcgcttcatccaccatcgtgaaagagggtgctaacaaggaggtgctcgggatcttagtgtcttatagggtgaaggtgaagttagttgtgagcaggggtggagatgtgagcgttgagctgcctttcgtgttgatgcatcccaaaccccatgaccacatccctctgcccaggcctcaatctgccgcgccagaaaccgatgttccagttgataccaatttaatagagtttgacacaaactatgctacagacgatgacatcgtattcgaagatttcgccagactgcgcctgaagggcatgaaggatgatgactatgatgaccagctatgctag

SEQ ID NO: 108673 - DNA, 1266 bp, Artificial Sequence
  Description of Artificial Sequence: Synthetic coding sequence
atgggggaaaagcccggcaccagagtcttcaaaaaatcctccccaaactgtaaacttactgtttatctgggaaaacgggacttcgtggaccaccttgataaagtcgaccccgtcgacggtgttgtgttagttgatcctgattatttaaaggatagaaaggtgtttgtgaccctgacatgtgcctttcggtacggaagagaggatctggatgtgctggggctgtcttttcgcaaggatctctttatagccacgtatcaagcttttcctcctgtacctaacccgccccggcctccgacacgactgcaggacagactgctgcgaaagctcggccagcatgctcaccctttcttctttacgatccctcagaatctgccgtgttccgtgacactgcaacctggccctgaagacaccggaaaggcatgcggcgtcgattttgagattagagcattctgcgctaaatctctggaggaaaagagtcacaaaagaaacagtgtcaggcttgtgatacggaaggtgcagtttgcgcccgaaaaacctggcccacagccttcagccgaaaccacccgccatttcctgatgtctgatcggagcctacaccttgaggcctccctggacaaggagctgtactaccacggagagccactgaatgttaatgtgcatgtcactaacaactccacaaaaactgttaagaagattaaagtttctgtaagacagtacgctgacatttgcctgttctcaaccgcacagtacaaatgcccggtggctcagttagagcaagacgatcaggtgagtccctcctcaaccttttgtaaagtgtataccataacccccctactttcagacaatagggaaaagagagggctggcgcttgatggtaagctgaaacatgaggacacaaatttggcatctagtacaattgtgaaggagggggccaacaaggaagtgctgggaatcctagtcagctaccgggtgaaggtgaagctggtcgtctcaagaggcggggatgttagtgtcgaactaccatttgtgctgatgcatcccaagccccacgaccatatccctctgcctcgaccccagtcagcccccaccccgactcctcccctgcccgtgcctccagccgcacccgaaacggatgtgccagtcgacactaacctgattgagtttgataccaactacgccacggacgatgacatcgtgtttgaggattttgccaggctgcgcctgaaaggcatgaaggatgatgactatgatgaccagttgtgttag

SEQ ID NO: 108674 - DNA, 1233 bp, Artificial Sequence
  Description of Artificial Sequence: Synthetic coding sequence
gctgccaaccgggcgggtggcggacgcgcccaccacggaggcgagacacgggaccaactgacagtgtacctcggtaagcgggattttgtagaccacctggataaagtggatccagttgacggagtagtgctcgtggaccccgactacctgaaggatcggaaggtgtttgtgaccctgacatgtgctttcagatacggcagggaagacctcgatgtgttggggctgtcattccggaaggacctatttatagcgacataccaggctttccctcctgtacctaacccaccacggccgcctacaagattgcaggatcggctgctgaggaaactcggacagcacgcacatccttttttctttaccattcctcaaaacctgccatgcagtgtcaccctgcaaccagggccagaggacaccggcaaagcttgtggcgtcgatttcgagatccgggctttctgtgcaaagtcgctagaagagaagagtcacaaacgcaattccgtgagattagtcattaggaaagtccagttcgcacccgagaagccgggacctcaaccctctgctgagaccacacgccattttctgatgtccgaccgatcattgcatctcgaagcttctctggataaggagctgtactaccatggtgagccgttgaatgtgaatgtccatgtcacaaataacagtacaaagactgtgaagaaaattaaggtgtccgtgagacaatacgctgacatctgcctgttttctaccgcgcagtacaaatgccccgtcgcgcaactggagcaagatgaccaagtgtccccatcctctacattctgcaaagtgtatacgatcaccccccttttgtccgacaatcgtgagaagcgcggcctggcccttgatgggaagctgaaacacgaggataccaacttggccagttccacaatcgtcaaggaaggggcaaataaggaagtactcggcattctcgtgtcctatcgggtgaaggtgaagctggtcgtgtctcgggggggcgatgtttctgtggagttgcccttcgtgctgatgcatcccaagcctcatgaccacattccccttccaagaccccagtccgcggcccccgagactgatgttccggtggacaccaatctgatcgagtttgacacaaattacgctaccgatgatgatatcgtgttcgaggatttcgcccgcctgcggttgaagggcatgaaggacgatgactatgacgatcagctctgctag

SEQ ID NO: 108675 - DNA, 1047 bp, Artificial Sequence
  Description of Artificial Sequence: Synthetic coding sequence
atggcagccggggtagccgggtggggggtcgaggctgaggaattcgaggacgcgccagacgtggagcccctagagccgacgctttctaacatcattgaacagcggtcattaaagtggattttcgtggggggtaaggggggggtcggaaagaccacatgcagttgtagcctggccgtccagctgtccaagggaagggaaagcgttctcatcatctccacagatcccgcacataatatatccgatgccttcgatcagaaattctctaaagtacccaccaaggtgaaagggtacgacaaccttttcgcaatggagatagaccctagtctgggagtggccgaattgcctgacgagttcttcgaagaagacaacatgctttcgatgggcaagaaaatgatgcaggaagccatgtccgcctttcctggaatcgatgaggccatgtcttatgcagaagtgatgcgcctggtaaagggcatgaatttcagtgtcgtggtctttgatacagcccccacaggtcatactctcaggctgttgaatttccccacgattgtcgaaagaggcttgggtaggctcatgcagattaaaaaccagatttccccgttcatatcccagatgtgcaatatgctgggcttgggggacatgaacgcggatcaacttgcgagcaagctggaggaaactctccccgtcatccgaagcgtgtcagaacagtttaaagaccctgaacagaccacatttatttgtgtgtgcatcgccgagtttctctctttgtacgagacagagcgactcatccaggagctcgctaagtgtaaaatcgacactcacaacatcattgtaaaccagttggtgttcccggacccagagaagccttgtaagatgtgtgaagcacggcacaagattcaggctaaatacctggaccagatggaggacttatatgaagattttcatattgttaagcttcctctactcccacatgaggtaaggggggcggataaagttaacacattctcagccctgttgcttgagccatacaaaccaccttcagcccagtag

SEQ ID NO: 108676 - DNA, 1047 bp, Artificial Sequence
  Description of Artificial Sequence: Synthetic coding sequence
atggcagccggcgtggccggctggggagtggaggccgaagagtttgaagacgcacccgacgtcgaacctctcgaacccacactcagcaatataatcgaacagagaagtctgaaatggattttcgtgggcggcaagggaggtgtcggaaaaaccacctgctcgtgtagtctggccgtgcagctgtccaagggtcgtgaatctgtgctgattatcagtacggacccggcccacaatatatccgacgctttcgaccagaaattttctaaggtacccactaaagtcaaaggatatgataacctgtttgccatggaaatcgatccttctttgggggtggcagaattacccgacgagttcttcgaggaggataacatgctgtccatgggaaagaaaatgatgcaggaagcaatgtctgccttcccagggatcgatgaggcaatgtcctatgctgaagtcatgaggcttgttaagggaatgaactttagtgtcgtcgtcttcgacacagcaccaaccggacacacactgaggctgcttaactttcctacaatagtggagcgaggattgggccgactgatgcagatcaagaaccagatctctcctttcatatctcaaatgtgcaacatgcttggcttgggcgacatgaatgccgatcaattggcttctaaactggaagagacattgcccgttatacgatctgtgtcagaacagttcaaagatcctgagcaaacaacttttatatgcgtgtgtatcgcagagttcctctctctctatgaaactgaacgactcattcaagagctcgcgaaatgtaaaatcgacacacacaacatcatcgttaaccagctggtgtttccggaccctgagaagccttgcaagatgtgcgaagcccgccacaaaattcaagctaaatatcttgatcagatggaagacctctacgaggactttcacatcgtgaaattgccacttctcccacatgaagtgcggggcgcagataaggttaacaccttctccgctttgcttcttgagccttacaagcccccgtccgctcaatag

SEQ ID NO: 108677 - DNA, 1128 bp, Artificial Sequence
  Description of Artificial Sequence: Synthetic coding sequence
atggctgccctcagagatgctgaaattcaaaaagatgttcagacctactacgggcaggttctgaagaggagcgccgacctccaaacgaatgggtgcgtcacaacggcaagacctgtgcccaaacacattagagaggcattgcagaacgttcacgaagaggttgccctgagatattacggttgtgggctcgtgattcccgagcacctggaaaactgctggatcctggatctcggcagtggaagtggacgggactgctatgtgctgtcacaactagtgggtgagaagggacacgttacaggaattgacatgacaaaggggcaggttgaagtcgcagaaaaatatctcgactaccacatggagaaatacggattccaggcttcaaatgtcactttcatccacggctacatagagaagctgggagaggcaggcatcaagaatgagtcgcatgatatcgtggtgagcaattgcgtgataaatctcgtgcctgataaacagcaggtgttacaggaggcttaccgggtcctcaaacatgggggggaactgtacttctcagacgtttatacttccctggaactacccgaggaaattagaacacacaaggtgctttggggcgaatgcttgggaggggccctctattggaaggaattggctgtcctggcacagaagattggcttctgtcctccacgattagtaaccgccaacctaatcacaattcagaataaagagctggagcgtgttattggagattgcagatttgtgagtgccaccttccgtctcttcaagcactccaaaacaggacccacaaagagatgccaagtaatttataatgggggcattaccggccacgagaaggagttgatgttcgatgccaatttcacgttcaaggagggcgaaattgtggaagtagatgaggaaaccgccgcaatactgaagaatagtaggtttgcgcaggactttctgatcaggccaattggggagaaactgccaacctctggcgggtgttccgcattggagctgaaggatatcataacagatccgtttaagttagccgaagaatccgactccatgaagagtaggtgcgtacctgatgccgcaggcgggtgttgcgggacaaaaaaatcatgctag

SEQ ID NO: 108678 - DNA, 816 bp, Artificial Sequence
  Description of Artificial Sequence: Synthetic coding sequence
atggggaacggcggaagatcaggcctccaacaaggaaaaggaaatgtggacggtgtcgcggccactcctaccgctgcttccgcctcttgccagtatcggtgtatcgagtgcaaccaggaggcgaaggaactgtaccgcgactacaaccatggcgtgttgaaaattacaatatgtaagtcctgccagaaaccagtggataaatatatagagtatgacccagtcattattctcatcaacgccattctatgcaaggcgcaggcctacaggcacattctcttcaatacacagattaatattcatgggaagttgtgtatcttctgcctactttgcgaagcctatttgaggtggtggcagctgcaggacagtaatcagaacactgccccggatgacctgatcaggtatgctaaagagtgggatttctaccggatgttcgccattgctgccctcgaacagacagcatacttcatagggatcttcacttttctgtgggttgagagaccaatgactgcaaagaaaaaaccaaacttcatactgctgctcaaggctctgctcctgagctcgtatggaaagttgctcctgatacccgccgtgatatgggagcacgattacacgagcgtgtgtctcaagctgataaaagtctttgtcctcacctcaaacttccaggcaattcgcgttacactgaatatcaatagaaagctgtcctttctggccgtcctgtcaggcctcctactggaaagtatcatggtttacttctttcagagcatggagtgggatgtaggcagcgattatgcgatattcaaaagccaagacttctag

SEQ ID NO: 108679 - DNA, 807 bp, Artificial Sequence
  Description of Artificial Sequence: Synthetic coding sequence
tagggacgctccggactgcagcaggggaaaggcaatgtggacggcgttgccgccactcccactgcagcaagcgcttcctgccaatatagatgtatcgagtgcaatcaagaagccaaagagttgtatagggactataatcacggtgtcctgaagatcaccatttgcaagagctgtcagaaacccgttgataaatacatcgagtacgatccggtgattatcctgatcaacgctattctatgcaaagcccaggcttatcgtcatatcctctttaatactcagattaacatccacggcaagctgtgcattttctgtctgctgtgcgaggcatacttacggtggtggcagctacaggactctaatcagaatacagcccccgacgatctcatcaggtatgccaaggaatgggacttttataggatgtttgcgatcgcagctctggaacaaacagcatatttcatcggcattttcacctttttatgggttgaacgcccgatgaccgccaaaaaaaaaccgaatttcatactgctcttgaaggctcttctcctgtcctcttacggcaagctgctgcttatccctgccgttatctgggaacacgactatactagtgtgtgcctgaaactcatcaaggtttttgtcttaaccagcaactttcaagctatccgggtcaccctgaacattaacagaaagctgagcttcctggccgtgcttagtgggttgttgctggaatccatcatggtgtacttcttccagagcatggaatgggacgtcggaagcgactatgctatttttaaatcccaggacttttag

SEQ ID NO: 108680 - DNA, 2547 bp, Artificial Sequence
  Description of Artificial Sequence: Synthetic coding sequence
atgaactcttcatctgctaacatcacgtacgccagcaggaaaagacgtaagcccgtgcagaagaccgttaagccaatccctgctgagggcattaagagcaatccaagtaaacggcaccgcgataggctgaacacagagctcgataggctggctagccttttaccattccctcaggacgtgattaataaactcgataagcttagcgtattgcgattgagtgtgagctacttaagagctaaatcatttttcgacgtcgctctcaaatcctcccctacagagcgcaacggcgggcaggacaattgtcgggctgcaaacttccgcgaaggcttaaacttgcaagagggcgaattcctcctccaggctctgaacggttttgttctggtagtcacaactgacgccctggtgttttacgccagttccactatccaagactatttgggattccaacagtctgacgtgattcaccaaagtgtgtacgagctgatacatacggaggatcgggcagagttccagagacagctgcactgggccctgaaccctagccagtgtaccgaatctggtcaaggaattgaagaagctacaggcctccctcagacggtggtatgttacaatccagaccagataccccccgaaaattcccccctaatggagagatgttttatttgccgcctcaggtgcctgctggataatagttccggcttccttgccatgaattttcaggggaagctcaagtatctccacggtcagaaaaagaagggcaaggacggatccattcttccaccacaacttgccctgttcgcgatcgccacaccactccagcctcccagcatccttgagattagaactaaaaactttatctttaggacaaaacacaaacttgatttcacgcccatcggatgcgatgctaaggggagaatcgtgctcggctacaccgaagcggagttgtgtactcgcgggtctggatatcagttcatacatgctgctgatatgttgtactgcgcggagagccacatcagaatgattaaaaccggcgagtccggcatgattgtttttagactcctgaccaagaacaatagatggacatgggtacagagcaatgcccgcctactctataaaaatggtcgccctgactatatcatcgtcacccagcgccctctgactgacgaggaggggactgaacacctgagaaagaggaacaccaagctgccctttatgtttaccaccggggaagctgttctgtacgaggccacgaaccccttccctgccatcatggaccccctgcccctgcggacgaaaaatggtacctctggaaaggactctgccactacctccacattgagcaaggattcgctcaacccctcatcattgctagcggccatgatgcagcaggacgagtctatatatctttaccctgcctcctcaaccagtagtacagctcctttcgagaacaacttcttcaatgaatctatgaacgagtgcaggaactggcaggataacacagccccaatgggcaacgataccattctgaaacacgaacagatcgatcagcctcaagacgtgaattccttcgccggcggacatccagggttgttccaggacagtaagaatagcgatctctactcaatcatgaagaacctcggtatagattttgaagatattaggcacatgcaaaacgagaaattctttcggaacgacttcagcggtgaagtagacttcagggatattgacttgactgacgagatcttgacctacgtgcaggattctttgagcaaatctccctttatcccgtctgactatcaacagcaacagagcctagccctgaacagctcatgtatggttcaggaacatctccatttggagcagcagcagcagcatcaccaaaaacaggtggtggttgaacctcagcaacagctgtgtcagaagatgaagcacatgcaggtgaatgggatgtttgaaaactggaacagtaatcagttcgttccctttaactgccctcagcaggatcctcagcagtacaatgtgtttaccgaccttcacgggatctctcaggaatttccttacaagagtgagatggatagtatgccctatacccagaatttcatatcctgtaatcagcccgttctgcctcagcactcaaaatgcacagagctggattaccctatgggatccttcgaaccttccccatatcctaccacctccagtctcgaggatttcgtgacgtgcctgcagctacctgagaatcagaagcacggcctgaaccctcagtccgccatcataaccccgcaaacgtgctacgccggcgctgtctctatgtaccagtgccagcctgagccacagcacacacatgtgggacagatgcagtataaccccgtgctccctggccaacaggcttttctgaacaagtttcagaatggagttttaaacgagacataccctgccgagctgaataatattaacaacacgcaaacgaccacacacctacagcccctgcaccatccgtctgaagccaggccatttcccgatctgacaagcagtggcttcctctag

SEQ ID NO: 108681 - DNA, 2547 bp, Artificial Sequence
  Description of Artificial Sequence: Synthetic coding sequence
atgaattcctcatcagccaacataacctacgcaagcaggaaaaggcggaagcccgttcagaagacggtgaagcctatacctgctgagggtatcaagagcaaccccagtaaaagacatagggaccggttgaatacagagctggatcgtctcgcctctctgctgccatttccacaggatgtcattaacaagttggacaagctgagtgtcctacggctctcggtgagctacttgcgcgccaaatcattctttgacgtggcgctgaagagcagccctaccgagcgtaacggtggacaggacaactgcagagccgcgaacttccgcgaaggtcttaacctgcaagaaggggagttcttactccaggcactgaatggatttgtcctggtggtgactaccgacgctctggtcttctatgcttccagtactatacaggactacctcgggtttcagcagtcagacgtgatacaccagtcagtgtatgagctcattcacaccgaggatagggccgaatttcagcgacagcttcattgggcactcaacccttcacaatgtacagaaagcggccaggggatagaggaagctaccggcctcccgcaaactgtagtgtgctataaccccgatcagattccccctgaaaactcaccactgatggagcgatgctttatttgcaggctgcgatgcctcctcgacaattctagtggatttcttgctatgaactttcagggtaagctgaaatatctccacggccagaaaaagaagggaaaggacggctccatactgcctccgcagctggctctattcgctatcgctacccctttacaacccccatccattttagaaattcgcactaagaactttattttcaggacaaagcataaactggactttactccaattggctgtgacgccaaagggcgaattgtgttgggatataccgaggctgagctctgtacgcggggtagtggttatcagttcattcacgcggctgacatgctgtattgcgctgagtcccatattagaatgatcaaaaccggtgagtccggaatgatcgtctttcggcttctcacaaagaataaccgttggacctgggtgcagagcaacgcgagactgctgtataagaatggacgccccgactacattattgtgacccagaggccactgacagacgaagaggggactgagcacctgcggaagaggaacacaaaactccctttcatgttcacgactggcgaggccgtcctctatgaggcaaccaatccattccctgcaatcatggacccacttccactgagaaccaagaatgggacctctgggaaggactctgccactacaagtaccctgagtaaggattccctgaacccaagcagcctccttgcagccatgatgcagcaggacgaatcaatttatctgtatcccgcaagttcaacttccagcacggccccgtttgagaataactttttcaacgagtcgatgaatgaatgcagaaattggcaggataacactgccccaatgggtaacgataccatcctgaagcatgaacagattgaccagccccaagatgtaaattcctttgctggcggtcaccctggtctctttcaggatagcaagaattcggacctatattccattatgaaaaacttaggaatcgacttcgaggacatacggcacatgcaaaatgagaaattttttcggaatgatttcagcggcgaggtggacttccgtgatattgacctgacagatgaaatcctcacctacgtccaggatagtctcagcaagtctcccttcatacccagcgattatcagcagcaacagtctctggccctaaattccagctgtatggttcaagagcatctgcatcttgagcagcaacaacagcaccaccagaagcaagtcgttgtggagccccaacaacagctatgccagaagatgaaacacatgcaggtgaatggaatgttcgaaaactggaacagcaaccaattcgtgccattcaactgccctcagcaagatccacagcagtacaacgtgtttaccgatctgcacggcatcagccaggagttcccgtataagagcgagatggatagcatgccgtatacgcagaacttcattagttgtaaccagcctgtgctgcctcagcattcgaagtgcaccgaactggactatcccatgggatctttcgagcccagcccttacccaacgacaagtagtctagaggacttcgtgacctgcctgcagctcccagaaaatcagaagcatgggttgaatccacaatcagctatcatcacaccccaaacttgctacgcaggtgctgtatcaatgtatcagtgccagccagagccacaacacacccacgtgggacagatgcagtacaaccccgtgctgccgggccagcaggccttcttaaataagttccaaaacggcgtgctgaacgagacatatcccgccgaattaaacaatattaataacacccagaccacaacacaccttcagcctttgcaccatccttctgaggcaaggcccttcccagatctcacttcctccgggtttctgtag

SEQ ID NO: 108682 - DNA, 993 bp, Artificial Sequence
  Description of Artificial Sequence: Synthetic coding sequence
atggccgacattattgcacggctccgggaagacggcattcagaagcgagttatccaggagggccgaggagaactgcctgactttcaagacggaaccaaggccacttttcactaccggacattgcacagtgacgacgaggggaccgtgctcgacgatagcagagcgagaggaaagccaatggagctgatcattggaaagaaatttaaactgcccgtctgggagaccattgtttgcaccatgagggagggcgagatagcccagttcctttgcgatattaagcatgttgttctgtatcccttggtcgctaaatcactgcgaaatattgcggtcggaaaggatcccttggagggccagcggcattgctgtggcgtggcacagatgagggaacactcttcactggggcatgccgaccttgatgctctccaacaaaaccctcagcctctgatttttcacatggaaatgcttaaggttgagtcccctgggacttatcagcaagacccatgggccatgacagatgaagagaaagctaaagccgttcccctcattcaccaagaggggaatcgtctctaccgggagggtcatgtgaaagaggccgcagctaaatattacgacgcgatagcctgtctgaagaatctgcaaatgaaggagcaacccggatcacctgagtggatccagctcgaccagcagattactcccctgctgttgaattactgccagtgcaagctcgttgtcgaggaatactatgaggtgctggaccactgctcgtctattcttaacaagtacgatgataatgtcaaagcttacttcaaacgtggaaaggctcacgcggcagtgtggaacgcccaggaggcccaggcggacttcgcgaaagtcctggaattagacccagctcttgcccctgtagtaagtcgggagctgcaggcgcttgaagccaggatcaggcagaaggacgaagaggacaaggcccgatttagaggcatctttagccactag

SEQ ID NO: 108683 - DNA, 966 bp, Artificial Sequence
  Description of Artificial Sequence: Synthetic coding sequence
atggatgcagccctcctcctgaatgtggagggtgtcaagaagacgattttacatggcgggactggcgagctcccgaacttcataactggcagccgtgtaatttttcactttagaacaatgaagtgtgacgaggagcgcaccgtcattgatgactcccgccaggtgggacaaccaatgcacatcattattggcaacatgtttaagctcgaggtttgggagatattgcttacaagcatgcgggtgcatgaggtggccgagttctggtgtgatactatcgtggacgctccgtccgactaccagagggaaacttggaatctgtcgaatcacgagaagatgaaggccgtaccggttctgcacggcgagggcaaccggctatttaagctgggccgctatgaggaagctagcagcaagtatcaggaggcaattatttgtctgaggaatttgcaaaccaaagagaagccctgggaagtccagtggctgaagctggaaaaaatgataaataccctgatactgaactactgccaatgccttctgaagaaggaagagtactatgaagtgctcgaacataccagtgacatcctgaggcatcatcctggcatcgtgaaggcttattacgttcgcgcccgagcacatgcagaggtatggaacgaggcagaagcaaaggccgatctgcagaaggtgttagagcttgaaccctccatgcagaaagctgtgcgaagggaacttcgactccttgagaaccgtatggccgaaaagcaggaagaagagcgcctgcgttgtcgtaacatgctcagtcagggggccacacagcctcccgctgagccccccacagagcctccagcgcagtccagcactgagccacccgctgagccccccacagcaccgagcgcagaactttcagctggacctcccgcagagcccgccactgaaccaccaccgagcccaggtcactccctccagcactag

SEQ ID NO: 108684 - DNA, 975 bp, Artificial Sequence
  Description of Artificial Sequence: Synthetic coding sequence
atggacgccgctctgctgcttaatgtcgagggtgtcaagaaaacaattctacacggcggaaccggtgagctgcccaattttataacaggaagccgtcataccggcgtgtatcctatcctgagtaggtcgctgcggcagatggcacagggcaaagacccgacagaatggcacgtgcacacatgtggactagccaatatgtttgcctatcatacactgggttatgaagacctcgacgagctgcagaaggaacctcagcctctcgtgtttgtaatcgaattgctgcaggtggatgccccatccgattatcagcgagagacatggaatctctccaatcacgaaaaaatgaaagcagtacctgtcctccacggagagggaaacaggctgttcaagctgggtcgctatgaggaagcctcctccaaataccaagaggcaattatctgtctaagaaacctgcagacaaaagaaaaaccttgggaggtgcagtggctgaagctggagaaaatgattaacaccctcatcctgaattactgccagtgcctcctgaaaaaagaggagtactatgaagtgctagagcatacgagcgatattctgagacaccaccccgggatcgtaaaggcctattatgtccgggccagggcccatgccgaagtatggaacgaagctgaggctaaagcagatctacagaaagtgttggaactggagccaagcatgcagaaagccgtgaggagggaactgaggctcttggagaacagaatggctgagaagcaggaagaggaacgcttacgctgtcggaatatgttgtcccagggcgccacccaaccccccgctgagccacctacggagccgccagctcagagtagcaccgaacccccagcagaacctcctaccgcgccaagcgcggagctgtctgccggcccacctgctgaacccgccactgagccaccaccttctcctggacattccctgcagcattag

SEQ ID NO: 108685 - DNA, 1155 bp, Artificial Sequence
  Description of Artificial Sequence: Synthetic coding sequence
atggatgcagctctcttactgaacgtcgagggcgttaaaaagaccatcttgcatgggggaacaggcgagctgcccaatttcattactggatcccgggtgatttttcacttccgcaccatgaaatgcgacgaggagcgtactgtgattgacgactcccggcaagtgggccagccaatgcacattatcatcggtaacatgtttaagctcgaagtgtgggagatcctgctgacttcaatgcgcgtacatgaggtggctgagttctggtgtgacaccattcacacaggggtgtatcccatactgtcacggtccctgaggcaaatggcacagggtaaggaccccaccgagtggcacgtgcacacatgtgggcttgcaaatatgttcgcctaccatacccttgggtatgaagatcttgatgagctgcagaaagagcctcaacccctggttttcgttatagagctactccaagtcgacgcaccttctgactatcaaagagagacgtggaacttgtccaaccacgagaaaatgaaggctgtacccgttctccatggggagggcaatcggttgttcaagctggggagatatgaagaggcttcctctaaataccaggaagcaattatttgcctgaggaacctgcagacaaaggaaaagccttgggaggttcagtggcttaaacttgaaaagatgatcaataccctgatactcaactattgccagtgcctgctgaagaaggaagagtattacgaggtcttagagcatacctccgatattctgcggcatcatcctggaattgttaaggcctactacgtgcgcgcccgagcacatgctgaggtgtggaatgaggcagaggctaaggcagacctccagaaggtcctggagctcgagcctagtatgcaaaaggccgtcaggcgggagttacggcttctcgaaaatcgaatggccgagaagcaggaggaggagcgcctgcgctgtagaaatatgctgtcccagggcgccacccagccacctgcagaaccacccacagaaccaccggctcagtcgtcgactgagccacccgccgagccccccaccgcccctagcgccgaattgagcgcagggcccccagcagagcccgccaccgaacctccgccctctcctggtcatagtctccagcattag

SEQ ID NO: 108686 - DNA, 981 bp, Artificial Sequence
  Description of Artificial Sequence: Synthetic coding sequence
atggatgcagctctgctgctgaacgtggagggagttaaaaaaactatcctccatggagggacaggtgaacttccaaactttataactggcagccgcgtgatctttcatttccgcacaatgaaatgcgacgaagagagaaccgtcattgacgacagcagacaggtgggtcagcccatgcacatcatcatcggaaacatgttcaaactggaagtgtgggagattttgctgacctctatgagagtgcatgaagtagccgagttctggtgtgataccattcacacaggcgtttacccaatcctgtctcgctcccttaggcagatggcccagggaaaagaccctacagaatggcatgtacacacctgcggcctcgctaatatgttcgcctaccatacactaggttacgaggacctcgacgagcttcagaaggagcctcagccactcgtcttcgttatagagttgctccaggtagatgctccttccgactaccagcgcgaaacatggaatcttagtaaccatgaaaaaatgaaggcagtccctgtcctccacggtgaaggtaatcgcctgtttaagttagggcggtacgaggaggcttccagtaaataccaggaggctatcatttgtctgcggaaccttcagaccaaagaaaagccatgggaagtccagtggctaaagttggagaagatgatcaacacgctgatcctgaattactgtcagtgtctgctgaagaaagaggaatattatgaagtcctggagcatacctcagacatcctgaggcaccatcctggtattgtcaaggcctactatgttagagcccgtgcccatgctgaagtttggaacgaagctgaggctaaggcggaccttcaaaaggtgcttgagcttgaacccagcatgcagaaggctgtgagacgagaacttagactgttggaaaacgcctggcgccgctctcggagacgcagcggctgtgccgccggtacctgctag

SEQ ID NO: 108687 - DNA, 975 bp, Artificial Sequence
  Description of Artificial Sequence: Synthetic coding sequence
atggatgcagcgctgttattaaacgttgaaggggtgaagaagactattcttcatggagggacaggtgaactgcctaatttcatcacgggttcacggcatactggggtataccccatccttagccgtagcttgaggcagatggcacaggggaaggaccctactgagtggcatgttcacacctgtgggctggccaatatgtttgcataccataccctggggtacgaggatcttgacgaactccagaaagaaccccagcctctggtgtttgttattgaactccttcaggtggacgcaccatccgactatcaacgagagacgtggaatctgtccaatcacgaaaagatgaaggctgtaccagtcctgcatggcgagggaaatcggctgttcaaacttggtcggtatgaagaggcatcttccaaatatcaggaggcgataatttgcctgaggaacctgcagactaaagagaaaccttgggaagtccaatggctgaagctggagaagatgattaacaccctgatcctgaactactgccagtgcctcttgaaaaaagaggaatactacgaggtcttagaacataccagtgatatattgaggcaccatcctggaattgtcaaagcatactatgtgcgagcgagagctcacgccgaggtgtggaacgaggctgaggcaaaagcagatcttcagaaggtcctggaactggaacctagtatgcagaaggctgtgcggcgcgagctgcgcttgctcgaaaacaggatggcagagaagcaagaagaggagaggctgcgctgtaggaacatgcttagtcagggagcaacgcagccaccagctgaacccccaacggagccaccggcccagtcaagtacagagcccccagccgaacctcccacggccccaagtgctgagctttcagccggaccccccgctgagcccgcaaccgaaccccccccaagccctggtcattcactgcagcactag

SEQ ID NO: 108688 - DNA, 1251 bp, Artificial Sequence
  Description of Artificial Sequence: Synthetic coding sequence
atggccgcaaccactgcgaacccagaaatgacctcagatgttccgtcattgggaccggctatcgcgtctggaaacagtggcccaggcatacagggcggcggagcaattgtacagagggccattaaaaggaggcctggcctagacttcgatgacgacggagaaggaaattctaaattcctgcggtgtgatgacgaccagatgagtaacgataaagagcgctttgctcgatctgacgatgaacagtcatccgccgacaaggagcgtctcgctcgcgagaaccacagcgagattgaacgccggagaagaaataagatgaccgcctacatcactgagctaagcgacatggtgccgacctgctcagctcttgctcggaaaccagataagctgactatcctgaggatggccgtgagccatatgaaatccctgaggggaaccgggaatacatctacggacgggagttacaagccttccttccttactgaccaggagctaaaacaccttattcttgaagccgccgacggtttcctgttcatcgtctcttgtgagactggtagagtggtttacgtgagcgactccgtcactccagttctcaaccagccccaatctgaatggtttggctccaccttgtatgaccaggtgcaccctgatgatgtggataaactgcgggaacagttgtcgactagcgagaatgctctgaccggacggattttggaccttaagaccgggaccgtgaaaaaggagggccagcagagtagcatgagaatgtgcatgggatctcggaggagctttatatgccggatgaggtgtggctcctcctcagtggaccccgtgtccgtgaacaggttgagcttcgtccgaaaccggtgcagaaacggactggggagcgtcaaggacggggagcctcacttcgtcgtggtgcactgcaccggttacataaaggcttggccgccagccggtgttagcctgcccgatgatgacccagaggcagggcaggggagtaaattttgcctcgtggccataggtcgactgcaggtgacctcttcgcctaactgtactgacatgtccaatgtctgccaacctaccgaattcatatccaggcacaatattgaggggatcttcacgttcgttgaccataggtgtgtcgcaacagtgggataccaaccacaagagttgctaggaaagaacatcgtcgagttttgccatccggaggaccaacaactgctgcgcgattcttttcagcaggaactgtag

SEQ ID NO: 108689 - DNA, 2223 bp, Artificial Sequence
  Description of Artificial Sequence: Synthetic coding sequence
atgtaccatcattgggtgcagcccttgcccctcgagacactcgatctggaattcaaggtcgaagagcccctctcccggggtttactatctggcgaccaggccggactcaagtatcttctcctcgccttcctgcggctagactttgatgatgacggagagggcaacagtaagtttttgcgttgtgatgatgatcaaatgtccaacgataaggagagattcgctagggagaaccactcagaaattgagagacggcgacggaacaagatgaccgcctatatcaccgagctctccgacatggttccaacgtgtagtgctctggcaagaaaacccgacaagctgaccattctgcggatggccgtgagtcatatgaagagcctgcgagggaccggcaacacaagcaccgatgggtcatacaaaccatcattcttaactgatcaggagctgaagcatctgatcctggaggccgccgatgggttcctcttcattgtctcttgcgagaccgggcgggtggtgtacgtatccgactcagtgactccggtgttaaatcaaccacagagcgagtggtttggtagtactctctatgaccaggtgcatcccgatgatgtggacaaactcagggagcagctgagcacttccgaaaacgctctgaccggcaggatccttgatctcaaaaccggtaccgtaaagaaagaagggcaacagagtagcatgcgaatgtgtatgggatctcgccgcagcttcatctgtaggatgcgatgcggctccagtagcgtcgaccctgtgagcgtgaacaggctatcgtttgtgaggaataggtgtcgaaacggcttaggctccgttaaagatggggagccacacttcgtcgttgtccactgtaccgggtacatcaaagcttggccgcccgctggggtatcacttcctgacgatgaccctgaggctggccaaggaagcaagttttgtctggttgccattgggcggctccaggtgacctcgtcccccaactgcaccgacatgtcgaacgtgtgtcagccaacagagtttatctcccgccataatatcgagggtatcttcacgttcgtggatcaccgatgcgtggccaccgtgggataccagccccaggagctactcgggaaaaatattgtggaattttgtcatcctgaggaccagcagctgttaagagactcatttcaacaggtggtgaagttgaaaggccaggtgctttccgtgatgtttagattccgatcaaaaaatcaggagtggttgtggatgaggacgagctcattcactttccagaacccctatagtgacgaaatcgagtatataatatgcactaatactaacgttaagcccttgacctatcgacaacaacagcagcagaccgaattagatatggttccaggccgcgacgggctagcttcttacaatcacagtcaggtcgtgcagccagttaccactaccggcccagaacattctaaaccactggagaaaagcgatgggcttttcgcccaggaccgggaccctcgctttagtgaaatttaccacaatatcaacgctgatcaatccaagggcatatcctccagcaccgtgcctgccacacagcagctgttctcacagggcaacactttccccccaacccctcgaccagctgaaaactttagaaatagtggtctggctccccccgtgactatcgtgcaaccaagcgcaagtgcaggacagatgctggcccaaatttccaggcacagcaaccctacccaaggcgctactcctacatggacccccacgaccaggagtggcttctccgcccaggtggcaactcaagccaccgccaaaacccgaacttcccagtttggggtgggatcctttcagactccatccagtttctcttctatgtcccttccaggtgctcctacagcctcacccggagccgctgcttacccatcgctaaccaaccggggctctaatttcgctcccgaaacaggccagaccgctggtcagtttcaaaccaggacggccgaaggcgtcggagtttggcctcaatggcaggggcagcagccccatcacagatcatcctcgtccgagcagcacgtgcagcagccacccgcacagcagcccggccaacctgaagtttttcaggagatgctgtcaatgctgggcgatcagtccaactcctacaacaatgaggaattcccagatctaacgatgtttcccccatttagcgaatag

SEQ ID NO: 108690 - DNA, 1251 bp, Artificial Sequence
  Description of Artificial Sequence: Synthetic coding sequence
atggctgctacgaccgcaaaccccgagatgaccagcgatgtgccatccctggggcctgcaatcgcctctgggaacagcgggcccggcattcaaggaggcggagccatcgtccagagggccattaaaaggcgacctggtctcgatttcgatgatgatggtgagggaaacagcaaatttctccggtgtgatgacgaccagatgtctaacgacaaggaacggttcgctagatccgacgatgagcagtcttctgccgataaagagcgcctggcgcgagagaaccactcagaaatcgagcgccgccggaggaacaagatgaccgcgtacatcaccgagctaagcgacatggtccctacatgttccgcgttggcacgcaagcccgacaaactcaccatcctcaggatggccgtgtctcatatgaagtctttgcgcggaacaggaaacacttctaccgatggttcttacaaaccaagctttttgaccgaccaggagctgaagcacctcattttagaagcagccgacggcttcttgttcatcgtctcctgcgagacaggccgcgtagtctacgtttctgattctgtaacccccgtgctcaatcagcctcagtccgagtggttcgggtcaactctgtacgaccaagttcaccccgatgacgttgataagcttcgggaacagctttctacatccgaaaacgccctgacagggcggattttggacttaaagaccggcacagtgaagaaggagggtcaacaatcatcaatgaggatgtgtatgggatctaggcgctccttcatttgccggatgaggtgtggatcttcttctgtggatcctgtatcagttaaccgtctctcattcgtaaggaacaggtgcagaaatggcttggggtctgttaaagatggtgagcctcactttgtcgtcgttcactgtactggttatattaaggcttggccaccagcaggagtgtcattgccagacgacgatcctgaggcaggccagggctccaaattttgcctggtggcaatcggccgcctgcaggtgacatcatccccgaactgtacggatatgagtaacgtctgtcagccaaccgaatttatctcgcggcacaacatcgaagggatctttacgttcgttgatcaccgctgcgtagccacagtgggttaccaacctcaagagctgttgggcaaaaatatcgtggagttttgtcaccctgaagaccagcagctactgagggactccttccaacaagaactgtag

SEQ ID NO: 108691 - DNA, 2325 bp, Artificial Sequence
  Description of Artificial Sequence: Synthetic coding sequence
atggccgccacgactgcaaatcctgaaatgacctctgatgtgccttcactgggaccggccatagccagcggaaatagcggaccagggatccaagggggcggggcaatcgtgcaacgggccattaaaagaaggcccggcttagattttgatgatgatggagaaggtaactcaaaattcctgagatgtgatgacgatcaaatgtctaatgacaaggaaaggtttgcgcgggaaaaccacagtgagatcgagcgccgtcggaggaataagatgacagcgtatatcactgagttatctgacatggtgcctacctgcagcgcgctggcccgtaagccagataagctcacgatcctgcgaatggccgtctcccatatgaagtccctgcgtggtaccggaaatacaagcaccgacgggtcatataagcccagtttcctgaccgaccaggaactgaaacatctgatcctcgaagcagccgacggattcctgttcatcgtgtcgtgtgagacaggaagagtcgtgtatgtaagtgattctgtcacacccgtgctgaatcaaccccaaagcgagtggttcggaagtacattgtacgaccaggtgcacccggacgatgtcgacaaacttcgcgagcagctctctacctccgaaaacgctttgacagggagaatcctcgacctcaaaactggaactgtcaagaaggagggacagcagtcatccatgcgtatgtgcatggggtctaggcgatctttcatttgtcggatgcggtgcggatcttcatctgtcgatccggttagcgtcaatagactcagtttcgtgcggaataggtgccggaacggcctgggttccgtcaaggatggcgaaccccattttgtggtcgtccattgcacggggtacatcaaggcttggcctccagccggagtatcccttccggacgacgatccggaagccgggcagggctcaaagttttgccttgtggccatcggccgtctgcaggtgacgtcaagccctaattgcactgacatgtctaacgtctgtcaacccacagaattcatctcaaggcataacattgaagggatatttacatttgtggaccatcgctgcgtggcaacggtgggttaccagcctcaggaactcctcggtaagaatattgtggaattctgtcatccagaggaccagcaattgctgcgcgattcttttcaacaggtggtcaaattgaaaggccaggtgttgtctgttatgttcaggtttcgtagtaaaaaccaggagtggctttggatgcgaacgagctcttttacattccagaacccctacagtgatgagatcgaatacattatttgtacaaacacaaacgtgaaaaatagcagtcaagagcccaggcctactcttagcaacactattcagagacctcagttggggccaaccgccaacttgcccctggagatgggctcaggacaactcgctcctcggcagcagcagcagcagacagaactcgacatggtgcccgggcgggacgggctggccagctataatcattcccaggtagtgcagccagtaactacgacaggcccagaacactccaagccacttgaaaagtcagatggtctcttcgcccaggacagagaccctagattctctgaaatctatcacaacatcaatgctgaccagagcaaaggtatctcctcgtccaccgtgcccgccacacaacagctgttcagtcaggggaatacatttccacccacgccaaggccagcagagaacttcagaaacagcgggctggcccctcctgttactattgtccagccatcagcttccgcaggacagatgctggcgcagatctcaaggcacagcaaccctacccagggcgcgacacccacctggacccctacaactagatctggtttttcagcccagcaggtcgcaactcaggccacagccaaaacacgcactagccagttcggggtcggctcattccagacgccatcgtccttctcctccatgtctctacccggcgcccccactgcctctccaggcgctgccgcgtatccaagccttactaaccgcggttctaactttgctcctgaaacagggcagaccgcaggccagtttcagaccaggactgccgaaggtgtaggagtctggccccagtggcaaggccagcagcctcaccaccggtctagctcttcagagcagcacgttcagcagccacctgcgcagcaacccggccaaccagaagtctttcaggagatgctgtcgatgctcggtgaccagagcaattcttacaacaatgaagaattcccggatctcaccatgtttccccccttctcagagtag

SEQ ID NO: 108692 - DNA, 2328 bp, Artificial Sequence
  Description of Artificial Sequence: Synthetic coding sequence
atgacatctgacgtaccctcactgggacctgcaattgcatcgggcaatagtggtcccggtatacagggtggtggcgccattgtgcagcgcgccattaagagacggcccgggctggactttgatgacgacggcgaaggcaacagcaagttcctgcggtgcgatgacgatcagatgagcaatgataaggagaggtttgcacgctctgatgacgaacagagcagcgctgacaaagagaggttagccagggagaatcactccgagatcgagcgacggaggcgaaataaaatgacggcgtacatcacagagctttctgacatggtgccaacctgcagtgccctggcacgaaaacccgataagctcacaatactgcgtatggccgtcagccatatgaaatcactcaggggcactggtaacaccagtacagacggatcatataagccttcttttctgaccgatcaggaactaaaacacttaatactagaagctgctgacggattcctgtttatcgtaagctgtgagactggtcgggtcgtctatgtaagcgattccgttactccagtgctgaatcaaccgcagtctgagtggttcggttccaccctgtacgatcaggtccacccggacgacgtcgacaagctgcgcgaacagctgtctacgtccgaaaacgcactgaccggacggattttagacctgaaaacagggacggtgaaaaaagaggggcagcaatcgtccatgaggatgtgtatgggatccagacggagttttatctgccggatgcgatgcggatccagttctgttgacccggtgtcagtcaacaggctctcctttgtgaggaaccgttgtcggaacggactaggcagtgtaaaggacggagagccccactttgttgtggttcactgtactgggtacatcaaggcttggccgccggcagatgacgaccccgaggccgggcagggctccaagttttgcctggtggccataggacgcttgcaggttacaagcagtcccaactgtacggacatgagtaacgtatgccagccaaccgagttcattagcagacacaatattgaagggatctttactttcgtggaccatcgttgcgtggcgaccgttggctatcagccccaggagttattgggtaagaatatcgtggaattctgtcatccagaggaccaacagctgttgagagacagctttcagcaggtggttaagctcaaagggcaggtactcagcgtcatgttccggtttaggtccaagaatcaagagtggctctggatgcggaccagcagctttacctttcagaacccgtatagcgacgaaatcgagtatattatctgcactaatactaatgtaaagaatagctcccaggaaccacgaccgaccctgtccaacactatccaaagaccccagttagggccaaccgctaacctgccactagaaatgggctcaggccagctggcaccgaggcagcagcagcagcagaccgaactagatatggtgccaggcagggatggtctcgcctcttacaaccactcccaggtagtgcaacctgtaactacaacaggacccgaacactctaagcccctagagaaatctgatggcctctttgcacaggaccgcgaccccaggttcagtgaaatataccataacattaatgcggaccagagcaaaggcatcagctcttcgactgtcccagcgacccaacagctcttctcacagggaaacaccttcccacccacaccccggcctgctgagaacttccgcaactcgggactcgctccccctgtgactatcgtgcaaccatccgccagcgccggtcaaatgctcgcacagatctcacgccacagtaatcctacacaaggcgctacaccaacgtggactccaactacacgatctgggttctccgctcagcaggtagcaacacaggcaaccgcaaagacacgtactagccagttcggcgtgggttccttccaaactccctcttccttttcctccatgtcgctgcctggagctcccacggctagtcccggtgccgccgcctacccatcgctgactaacaggggttcgaatttcgctcccgagacaggccagaccgccggacagtttcaaacacggaccgccgagggggtaggcgtctggccccaatggcaaggacagcagcctcaccaccggtcctcttcctctgagcagcacgtgcagcagcctcccgcacagcagcctggtcagcccgaagtcttccaggagatgctgagcatgttaggcgatcagtctaatagttataataacgaagaattccccgacttgaccatgtttccaccattctcagaatag

SEQ ID NO: 108693 - DNA, 1428 bp, Artificial Sequence
  Description of Artificial Sequence: Synthetic coding sequence
atgtccgctaccgccgctgcccgaaagagggggaagcctgccagtggtgcaggagctggagcgggggcaggcaaaaggaggcgcaaagccgacagcgccggggacaggggaaagtccaagggaggtggcaaaatgaatgaggagataagctcagatagtgagtccgaaagtttagccccccggaaaccggaagaggaagaagaggaggagcttgaggagactgcacaagagaaaaagctgaggctggcgaagctctatctcgagcaactgcggcaacaggaggaggaaaaggccgaagccagggcctttgaggaggatcaggtggctggcaggctgaaggaagacgtgcttgaacaacgaggcagattgcagaaactcgtcgcgaaggagattcaggcgcccgcatccgcggatatcagggtgctacggggacatcaactgtccattacgtgtcttgtcgtcacaccggatgacagcgcaatcttctcagccgcaaaggattgctctataatcaaatggagcgtggagtccggtcgcaaactgcacgttattcccagagccaaaaagggagcagaagggaaacctcctggccatagctcacacgtactttgcatggccatttcttccgatgggaagtatctcgcatcaggtgataggtccaaactgatccttatctgggaggcacagtcatgccagcatttgtataccttcacgggtcaccgggacgccgtgagtgggctggctttcagaagggggacacatcagctatactcgacgtctcatgatagatcagttaaggtatggaacgtggctgaaaactcctatgtcgagacgctctttggtcaccaggacgcagtggccgccctagatgcattaagccgggagtgctgcgtgactgcagggggtagggatggcacagtgcgggtttggaaaattccagaggagagtcagctcgtgttttacgggcatcagggatcaatagactgcattcatctgatcaacgaagaacatatggtgtccggagcggacgatggcagcgtcgccctgtggggactgtcaaagaaacgacccctcgccctgcagcgcgaagcccacgggctgcggggcgagcctggcttagaacagccgttctggataagctcagttgcggccctgttaaataccgatctggtcgccacaggatcgcacagcagctgtgtgagactgtggcagtgcggcgagggattcaggcagcttgatctgctttgtgatatcccgctggtaggttttattaactcactcaaattctctagctccggtgatttccttgtcgcaggggtcggccaggagcatagactgggacgttggtggcggattaaagaagctcgcaacagtgtttgtattattccactgcgtagagtgcctgtacctcccgcagcaggtagttag

SEQ ID NO: 108694 - DNA, 2154 bp, Artificial Sequence
  Description of Artificial Sequence: Synthetic coding sequence
atggctacccctgccgccgtaaatcctcccgaaatggcatctgatatacctggatcagtcaccttacctgtagctccaatggctgctacaggccaggtgagaatggccggggccatgcccgctagagggggcaagagaaggtctgggatggactttgacgacgaggatggcgaagggcccagtaaattttcaagggaaaaccacagcgagatcgaacgtcgcagaagaaataagatgactcaatacatcaccgagctttcagacatggtgcctacatgttcggccctcgcgagaaagccagataagctaacaatcctgcggatggctgtgagccatatgaagagtatgcggggtaccggcaacaagtcgaccgatggtgcctataagcccagctttctcaccgagcaggagttgaaacacttaatactcgaggctgccgacggatttctgttcgtggtagctgcggagactggaagggtgatttacgtgagtgatagtgtgactcctgtgcttaaccagcctcagagtgagtggtttggatcgaccttatatgaacaggtgcaccctgatgatgtcgaaaagttacgggagcagttgtgcactagtgagaattctatgaccgggaggattctcgatctcaagacagggactgttaagaaagaagggcaacagtccagcatgaggatgtgcatgggctctcgccgcagttttatctgtagaatgcggtgtggcaacgctcccttggaccatctacccctgaatcgcataaccaccatgagaaagcgcttcaggaatgggctgggccctgttaaggaaggagaggctcagtatgcagtggttcattgcactggctatattaaggcctggccccccgccggtatgacaatcccagaggaagacgcagatgtgggccagggcagcaagtactgtctggtcgcgataggtcgactgcaagttacctcctcgcccgtgtgcatggacatgaatggcatgtcagtacccactgaattcctatctcggcacaacagtgacggaattatcacttttgtggatccccggtgtattagcgttatcgggtaccaaccacaagatctactagggaaggacattctcgagttttgccatccggaggatcagagccatttgagagaaagtttccagcaagtggtgaagctgaagggacaggtgttgtctgtcatgtacagattcagaacaaagaacagagagtggatgcttatcaggacctctagttttacgttccagaatccttatagcgatgaaatcgaatatataatctgtaccaacactaacgtgaagcagttgcagcaacaacaggccgaactagaggtgcaccagagggacgggctctcgagctacgatctgagccaggtgccggtgcccaatctgcctgcaggcgtccacgaagcaggtaaaagcgtggagaaggccgacgccatcttctcacaggaacgggacccacgtttcgctgagatgtttgccgggatctcggcctccgaaaaaaagatgatgtcttccgcctccgctgctggcacacagcagatctattctcaggggtccccctttccctcgggccacagcggcaaggctttttcatctagcgtggtgcatgtccccggcgtgaacgacattcaaagctcaagctccactgggcagaatatgagccagatttcacggcagctgaaccagtcccaggtcgcttggacggggtctcgccctccatttccggggcagcagataccttctcagagtagtaagacccagagtagtcctttcggaattggcacgagccacacctacccggccgaccccagcagctattccccacttagcagtccggctacttccagcccctcgggtaacgcatactctagccttgccaatcgaactccgggttttgcagagtcgggccagagcagtggacagttccaggggaggccttcagaagtatggtctcagtggcaatctcagcatcacgggcagcaaagcggagagcagcacagtcaccaacagcccggacagacagaggtgttccaggacatgcttcctatgcctggagacccaacccagggcactggcaactacaatatcgaggatttcgcggaccttggcatgtttccgcctttctcggaatag

SEQ ID NO: 108695 - DNA, 2118 bp, Artificial Sequence
  Description of Artificial Sequence: Synthetic coding sequence
atggccagcgacatcccaggaagcgtcacacttccagtggctcctatggcagccacagggcaggtgaggatggctggcgctatgcctgctaggggcgggaagcggaggagcggtatggactttgatgacgaggacggcgaaggccccagtaagttctcacgcgaaaaccactcagaaatcgaacgacggcggcgaaacaagatgacccagtatatcactgaactgtcagatatggttccgacctgcagtgctctcgctcgcaagcctgacaagctgaccatacttcgcatggccgtgtcccacatgaagtcgatgagggggacaggaaataagagtacagacggagcatacaaaccaagttttttgaccgaacaggagctgaagcatctgatcttagaagccgccgatggcttcctttttgtagtagccgccgagactggacgggttatctatgtatccgacagcgttaccccagtcctgaatcagccccagtccgaatggtttggaagcacactgtacgagcaggttcaccccgacgacgtggagaaattacgcgagcagctttgcacctccgagaactcaatgacaggtaggatcctcgacttaaagacggggacagtaaaaaaagagggacaacagagctcgatgcgcatgtgtatgggctctcgccgctcattcatatgtagaatgagatgtgggaatgctcctctagatcacctgccattgaaccgtataacgaccatgcggaagcgcttccgcaacgggttgggacctgtcaaggagggggaggcgcagtatgctgtggtgcattgtacgggatacattaaagcatggccgcccgccggaatgaccatacctgaagaggatgctgacgttgggcaggggagcaaatactgtctggtcgctattggccgacttcaggtgacatctagtcccgtctgtatggacatgaacgggatgtctgtgcccactgagtttctctccaggcacaactccgacgggattatcacgttcgtggacccgaggtgcattagcgtgattggctatcagccacaggatctgctcggcaaggatatcctggagttttgccatcccgaagaccagtcgcaccttagagaatcatttcagcaggttgttaaacttaaggggcaagttttaagtgttatgtatcgattccgaactaagaaccgggagtggatgctgatcaggacctcttcctttaccttccaaaacccttatagcgatgagatcgaatatatcatctgtaccaatacaaacgtgaaacagctgcagcagcagcaagccgagcttgaggtgcaccaacgcgacgggctgtcttcgtacgacctctcccaagtgcctgtgcctaatcttccggcgggagtacatgaggctggtaagagcgttgaaaaagccgacgccatcttcagccaggaacgggaccctagattcgctgagatgtttgcaggtattagcgctagtgagaaaaaaatgatgagcagcgctagtgccgccggtacacagcagatatactcccaaggctcaccctttcctagcgggcacagcgggaaggcattctcatcttcggttgttcatgtacctggcgtcaacgatattcagtcttcttccagcaccgggcaaaacatgtcccagatctctcgccagcttaaccagtcccaggtcgcctggaccgggtcgcggccaccgttccctgggcaacagattcctagccaaagtagcaagacccaatcttccccttttggaatcgggaccagccacacataccctgcagatccttcgagctactccccccttagctctccggccacatctagccccagtggtaatgcatacagttcattggctaacaggacaccagggtttgcagaatccgggcaaagttcgggccagtttcagggacgacctagtgaggtgtggtcacagtggcagagccagcatcacggccaacagtcgggcgaacagcattcccaccagcaacccggccagaccgaggtgtttcaagacatgctccctatgcctggtgatccccgtaatgaatggtggtccccgcacagccgccagcacttccgccaaccaatctcctacgcccggatgtag

SEQ ID NO: 108696 - DNA, 2121 bp, Artificial Sequence
  Description of Artificial Sequence: Synthetic coding sequence
atggcctccgatattccaggtagcgtcaccctccccgtcgcaccgatggcggccactgggcaagtacgaatggccggcgcaatgccagcaaggggaggcaagcgcaggagcggcatggacttcgatgatgaggatggggagggcccatccaaattttcacgcgaaaaccattcagaaatcgaacgacgcaggcgcaataagatgacccagtatatcaccgaattgtccgacatggtcccaacttgtagcgccctggctaggaagcccgacaagctcacaatcttgcgcatggccgtgtcgcacatgaagtccatgaggggtacgggaaacaagtccacagacggcgcttataagccctctttccttactgaacaggaactcaagcacctgatccttgaggccgcagatggctttctgtttgtggtcgccgcagagactggaagggtaatttacgtgtctgatagcgtaactcctgtactcaaccagcctcagtctgagtggtttggctcaacactttatgaacaggtgcatccagacgacgtggagaaactacgggagcaactttgcacatcagagaacagcatgacaggacggatcctagacttaaagaccggcacagttaaaaaagagggccagcagagttccatgcgcatgtgtatgggctcccggcgaagttttatctgcaggatgcgctgtgggaacgctccactagatcacctgcccctgaaccgaattactaccatgcgtaagcgattccgcaatgggctcggccctgttaaggagggggaagcacaatatgcggtcgtccactgcacgggatatatcaaggcctggcccccagccggcatgacaattcctgaggaagacgccgatgtcggccaagggtctaagtactgtcttgtggcaattggccggctgcaggtgacaagttctcccgtctgtatggatatgaacggaatgtccgtacccacagaattcctgagcagacataacagtgatgggataatcaccttcgttgatccgcgatgtattagtgtaatcggctaccaaccccaggacttgttaggtaaagatatccttgaattttgtcatccagaagaccaaagccacctgcgtgagagcttccagcaggtagtgaagctgaaaggccaggtcctgagtgtcatgtatcgctttcgcaccaaaaaccgggaatggatgttaatccggacttcttctttcacgttccagaacccttactctgatgagatcgagtatatcatttgcactaatactaatgtgaagcagttgcagcaacagcaggcggaactcgaagtacaccaacgggacggactctcttcatacgacctttcccaagtgccagtgcctaacttgcctgctggggtccatgaggcagggaaatcagtggaaaaggcagacgccatattctcccaggaacgtgacccccggttcgctgagatgttcgctgggattagtgcttctgaaaagaaaatgatgtcctcagccagtgctgctggaactcagcagatatacagccaggggtctcccttcccttccggacactccgggaaagcattcagtagcagcgtggtccatgtgcctggcgtgaatgacatccaatctagcagctcaactggccagaatatgtcacagatcagcaggcagctcaatcagtcacaggtggcctggacaggcagccgccccccatttccaggtcagcagatcccaagtcagagctccaaaactcagagcagcccatttgggattggcacctcccatacttaccctgccgatccatcgtcttatagtccactgtcatctcctgccacatcttcccccagtggcaacgcgtacagtagcctggctaaccggacccctgggtttgcagagtctggccaaagcagtgggcaatttcagggtcggccatcagaggtatggtcacagtggcagagccagcatcacggccagcagtccggcgagcagcacagccatcagcagcctgggcagacagaggtgtttcaggatatgttacctatgcctggagacccaactcagggtactggtaattacaacatcgaggactttgccgacctcggaatgtttcccccgttttccgagtag

SEQ ID NO: 108697 - DNA, 2121 bp, Artificial Sequence
  Description of Artificial Sequence: Synthetic coding sequence
atggctagcgatattcctggtagcgttacattgcccgtcgcgcctatggcggccaccgggcaggtgagaatggcaggcgccatgcctgcccgcgggggaaaacgcaggagcgggatggatttcgatgacgaggatggcgaagggcctagtaagttttcccgcgagaatcattccgaaatcgagcgtagaaggcgaaataaaatgactcagtacataacagaactgagcgacatggtgcctacctgcagcgctctggcccggaaaccggacaaattgacaatactgcgcatggcagtcagccatatgaaaagcatgcgggggaccggaaacaaatctactgacggcgcctataaacctagctttctgacagaacaggagctcaagcacctcatcctggaggctgcagatggatttttattcgtagtagccgctgagacagggagggttatttacgtgtcggactcagtgaccccagttttaaaccagcctcaaagcgaatggttcggctccaccctttatgagcaggtacaccctgacgacgtcgaaaagctgagagagcagctatgcacaagtgaaaattccatgactggcagaatcctggaccttaagaccggcaccgtaaagaaggaaggccagcagagttcaatgaggatgtgtatgggctcaagacgatctttcatatgcagaatgcgttgtggaaacgccccacttgatcatctgccactgaaccgtatcaccaccatgagaaaaagattcagaaatggcctgggccccgtcaaagagggagaggcccaatacgcggtcgtgcattgcacaggctatatcaaggcatggccgcccgccggcatgaccattcccgaggaggacgccgatgtgggtcaaggttccaagtattgcctggtagccatcggccgcttgcaggttacttccagccccgtctgtatggatatgaacggtatgagtgtaccaacagagtttctgagcagacataatagtgacggcatcatcacgttcgtggaccctagatgtatcagtgtgatcggctatcaaccccaagaccttctgggaaaagacatccttgagttttgccacccagaggaccagtctcacctgagggaatccttccagcaagtagtgaaactcaagggccaagttctctcggtgatgtatcgctttcgtactaaaaaccgagaatggatgttaatacggacgagctccttcacctttcagaatccatattccgatgagatcgaatatatcatctgcaccaatactaacgtgaaacagctccaacagcagcaggccgaactagaggtccaccagagagatgggctctcgtcttatgatcttagtcaggtacctgtgccaaacctgccggccggcgtgcacgaggctgggaagtccgtggaaaaggccgacgccattttctcccaggaacgcgatccaagatttgctgaaatgtttgcaggtataagcgcatcagaaaagaaaatgatgagctcagcatctgcagctggaacacaacagatctacagccaggggagtccatttccttcaggacactctgggaaagcgttcagctcctctgtggtccatgtacctggggttaatgacatccagagtagttcaagcaccggtcaaaatatgtcacagatttccagacagctaaaccagagccaggtggcctggaccggatctcgccccccgttcccaggacagcaaattccatcacagtccagtaaaacacagtctagtccttttggaatagggacgtcacacacctacccagctgatccttcttcatattccccactgtccagtcccgccacctctagcccctcaggtaatgcttatagttcgttggccaatcggactcctggttttgcggagtcgggccagtcttccggacagttccagggtcgaccatcagaggtgtggagccagtggcagtctcaacatcatggccagcaatccggggagcagcacagccatcaacagcccggacagacggaagtgttccaggatatgctgcctatgccaggcgaccctacccagggcaccggaaattataatatcgaagactttgcagatttgggaatgttcccgccattctcggagtag

SEQ ID NO: 108698 - DNA, 1701 bp, Artificial Sequence
  Description of Artificial Sequence: Synthetic coding sequence
atggccactcctgccgctgtaaatcctcccgagatggcgtctgatattcctggctctgtgaccctgccggtcgccccgatggcggccacaggacaggtgcgcatggctggggctatgcccgctcggggtgggaaacgccgatccggcatggacttcgatgacgaggatggcgagggaccaagcaaattctctcgagagaaccatagcgaaattgaacggaggcgcaggaacaaaatgactcagtacataactgagttgtccgatatggtgcctacatgctccgcacttgctcgtaagcccgataagctgaccattctgcgcatggcagtctctcatatgaaatccatgcgtgggactggaaataaaagtaccgatggagcctataaaccaagtttcttaaccgagcaggaacttaaacatctgattctcgaagcagccgatggcttcctgtttgtggtggctgcagaaacaggaagggtgatttacgtctcagactctgttacaccagttctgaatcagccccaatccgaatggtttggttcaactctctacgagcaggtgcatcctgacgatgtggaaaaactgagagaacagttatgcacatctgaaaactccatgacggggcggatcttagatctgaagaccggaacagtcaaaaaagaaggacagcagtcgagcatgagaatgtgcatgggctccaggcgtagctttatctgtcgcatgaggtgtggcaatgctcccttggaccacctgcccttgaatcggattaccactatgcgtaagcgctttaggaacggattggggcccgttaaagagggcgaggcccagtacgcggtcgtgcactgcacgggctacataaaagcttggcctccagcaggtatgacaattccagaggaggacgccgatgtcggtcagggcagtaaatattgtctggtagccatcggtaggttgcaggtaactagcagccccgtgtgcatggatatgaatggcatgtccgtgcctacagaattcctctcacgtcacaattcagatgggattatcacattcgtggatcctaggtgtatctccgtgattggctaccaacctcaggatcttttagggaaagacatcctggagttctgtcaccctgaagaccagagtcacctgagagagagttttcagcaggtcgtaaagctgaaggggcaggtgctcagcgtcatgtacagatttcgtactaagaacagagagtggatgttgatcaggacatcctcctttactttccaaaacccctattctgatgaaatcgagtatataatctgtactaatactaacgtgaagcagctgcagcaacagcaggccgagctggaagtgcaccagagagacgggttatcgagctacgatctctcccaggtgccggtcccaaatctgcccgccggggtgcacgaggctggcaaatccgttgaaaaagctgacgctatcttttcacaagagcgcgatcctcgcttcgccgagatgttcgctggcatctctgccagtgagaagaaaatgatgtcatccgcttccgcagccgggactcagcagatttacagccagggatcaccattcccgtcaggccattctggtaaagcgtttagctcctccgtcgttcacgtaccgggcgtgaatgatattcagagcagctcctcaacgggccagaacatgtcccaaatctccggatcctag

SEQ ID NO: 108699 - DNA, 2160 bp, Artificial Sequence
  Description of Artificial Sequence: Synthetic coding sequence
atgcccaggacaatgatccctccgggagaatgcacgtatgcaggacgtaagaggagaaggcctttgcaaaaacagcgcccggctgtgggggccgagaagtccaatcccagtaagcgacaccgggacaggctgaatgccgagctggatcatctggcatccctcctgcctttcccaccggatattatttctaaactggacaaacttagcgtgttgcgcctcagcgtgagctacctgcgtgtgaaatctttttttcaggtggtccaagaacagagcagcagacagcctgccgccggcgcgcctagtccaggagactcatgtcccctggccggatccgcagtacttgaagggcgcctgctcctggaatctctgaacgggttcgcccttgtggtcagcgccgaagggactattttctatgcctccgctactatagtggattacctgggattccatcaaaccgatgtgatgcaccagaacatctacgactacatccatgtggacgatcggcaggacttttgccgccaactgcattgggcaatggacccacctcaggtggtgtttggacagccacctccccttgaaaccggggacgacgccatccttgggcgattgcttagggcccaagaatggggcaccgggacacctactgagtatagcgcctttttgacgcggtgttttatttgccgagtgaggtgtctactcgactcaactagtggatttctcgcacggggaagtcaagcttggcagcttcggctctgctgtccagaaccacttatgacgatgcaattccaaggcaaactaaagtttctgttcggccagaagaaaaaggccccctcaggggcaatgcttccaccaagactctcgctcttttgcattgcagcacccgtcctgctgccttctgctgctgagatgaagatgcgatcagccctgctccgtgccaaaccaagggccgacacggctgcaactgcggacgccaaggtgaaggcaactacaagtctttgcgagagcgaattacacgggaaacctaattactctgctggtcggtccagtcgagaatcaggcgttctcgttcttagggagcagacagatgctgggagatgggcccaggtgcctgcccgtgctccctgcttgtgtctcaggggcggacctgatcttgtcctcgatcccaagggcggatctggcgatagggaggaggagcaacaccggatgctgtcaagagcatctggagtcaccggtaggagagagacaccagggccaacaaagcctcttccatggacggcaggcaagcactccgaagatggcgcgaggccccgactacaaccatctaagaacgacccaccttctctcaggccgatgccgcggggcagctgcctgccatgcccttgtgtccagggcacttttcggaatagtccgatatcacatccacctagcccatctccaagtgcttactcgagtagaacaagtcgcccaatgcgcgacgttggggaggatcaagtgcaccctcccctctgccactttccgcagaggagcttacaacatcagctgccccagccgggggcccagcgctttgccacccggggttatccaatggaggatatgaaactgcagggggttcccatgcccccaggggatttatgtggccctacactcctactggatgtcagcatcaaaatggagaaggactccggatgtgaaggagctgcagacggatgcgtgcccagtcaggtatggctgggagcatccgaccggtcacaccccgccacatttccaacaaggatgcacctgaagacagagccagattcccgccagcaggtgtatatttcccacctgggtcacggggtacgaggcgcccagccgcacggaagggccaccgctggaaggtcacgagagctgacaccgtttcaccctgcccattgtgcttgcctcgagcctactgacggacttccccaaagcgagcctccacatcagctttgtgcccgcggtagaggagaacaatcatgcacctgtagagccgctgaggccgctccagtggttaaacgggagccactggacagcccacagtgggccacccacagtcagggaatggttcctggcatgctcccaaagtcagcactagctacacttgtccccccacaggccagcggctgcacttttctgccttag

SEQ ID NO: 108700 - DNA, 2106 bp, Artificial Sequence
  Description of Artificial Sequence: Synthetic coding sequence
atgcctaggacgatgatcccaccgggggaatgcacatatgccggcagaaagagaagacgtcctctgcagaaacagcggccagccgtcggggcagaaaaatcaaaccccagcaaacgacaccgcgatcgtctgaatgctgagttggaccacctagccagcctgcttcccttccctccagatattatcagcaaactggacaagctgtctgtgctgcggctttccgtgtcatatctgagggtgaagagttttttccaggttgtgcaggaacaaagctctcggcagcccgccgccggtgcccccagtccgggagattcgtgtccactcgcgggaagtgcggtattagagggcagactcctgctggagtcactgaatggtttcgctttagtggttagcgccgagggaacgatattttacgcatccgctactatcgtcgactacctaggtttccaccaaacggatgtgatgcatcagaatatttatgattacattcacgtcgatgaccgccaggacttttgcagacagttgcactgggccatggaccctccccaggtggtcttcggtcagccccccccgctggaaaccggggatgacgctattctcggtaggctgcttagggcccaggagtggggcactggcacacctacagaatattcagcctttttgacacgctgcttcatctgtagagtgcgctgcctgttggacagcacgtccggcttcctgaccatgcaattccagggcaaattgaagtttctttttggccagaaaaagaaggcaccttctggagctatgttgcctcctcggctatctctgttttgcattgcagcccccgtactcctcccaagcgctgcggaaatgaagatgaggtccgcgctgttaagggccaaaccaagggcagacaccgctgccacagccgatgcaaaggttaaagcaactacatctctttgtgagtccgagctccacggcaaacccaactatagcgccggccgcagttccagggagagtggcgtcctggtgctgcgtgagcagactgacgcgggccgatgggcacaagtgccggccagagctccttgtttatgccttaggggcggaccagatctggttcttgaccctaaaggaggctcgggtgaccgcgaggaggaacagcatcggatgctcagtcgggcgtctggtgtaacaggtagaagggagacaccaggaccaacgaagccgttgccttggaccgctggcaaacactcggaagacggggcacggcctcgcctccagccgtccaagaacgatccgccctctttgaggcccatgccccgcggcagctgtttgccctgtccttgtgtgcagggaaccttcaggaactcccccatttctcaccctccatccccctccccgagcgcatattccagcaggaccagtcgtcctatgcgcgatgtgggggaagatcaggtacaccctcccctgtgccattttcctcagaggtcgctgcaacatcaactgcctcaacctggcgcgcagaggttcgctactaggggatacccaatggaagacatgaagctgcagggagtgcctatgccgcccggcgatctctgtgggccgactctcctacttgatgtgagtatcaagatggagaaagactctggctgcgaaggcgcggctgacggatgcgtgcctagtcaggtgtggttgggagcttctgatcgctcccaccccgccacattccccacgcgcatgcacctaaaaacagaacctgactcacgtcaacaggtctacattagccacctggggcatggagtgagaggagctcagccccatggacgcgctaccgctggaaggtcccgggaactcaccccctttcaccccgcccattgcgcctgtcttgaaccaactgacggcctgcctcagagtgaacccccgcaccagctatgtgctcgtgggcgaggggagcaaagttgtacctgtagggctgctgaagccgcgccagtcgtcaaacgggaacccttggattccccccagtgggccactcatagccagggtatggtacccgggatgctgcccaaaagtgcccttgctacactggtccccccgcaggccagtggctgtaccttcctaccttag

SEQ ID NO: 108701 - DNA, 2205 bp, Artificial Sequence
  Description of Artificial Sequence: Synthetic coding sequence
atgtcagggtttgatgacccgggtattttttattccgacagctttggtggagacgcacaggctgatgaaggacaggcgcgaaaaagccagctccaaaggaggttcaaagagtttcttagacaatatagggtgggcaccgatcgaacgggcttcacgtttaagtaccgcgatgagttgaagagacactacaacctgggagaatactggatagaagtcgaaatggaggatctggcatccttcgacgaggacttggccgattatctgtacaaacaaccagccgagcatctacagttacttgaggaggccgctaaagaggtagccgatgaagtgaccaggccacgaccaagtggtgaggaggtgctgcaagacattcaggtgatgctgaaatcagatgcaagcccctctagcatccgcagtctcaagagtgatatgatgtctcatctcgtgaagattccaggcatcattattgcagctagtgctgtcagggcaaaagccactcggatcagtatccagtgccgctcctgtaggaacacactgaccaatatcgccatgcgccccggcctggaggggtacgcattgcctcggaagtgcaatacagatcaggcaggtcggcctaaatgccctctggacccctacttcattatgcctgataagtgcaaatgtgtggacttccagacgctgaagttgcaggagctcccggatgccgttccccacggagaaatgcctaggcatatgcaactgtactgtgaccggtatctatgcgacaaagtcgttcctggcaaccgggtcacgattatgggaatatatagcattaagaagtttggcctgaccacgagtcgcgggagagaccgagttggagtcggtatcagaagctcatatatccgcgtactcggaatccaggtggacacagatgggtctggtcggtcattcgctggggcggtttctccacaagaggaagaggaattcagacggctggcagcattgcctaatgtgtacgaagtaatcagcaaatcgatcgccccctccatctttggaggaaccgacatgaagaaggcaatcgcttgcctcttgttcgggggtagcagaaagcgcctgcccgatgggttaacgcggaggggcgacattaatctgttgatgctgggtgacccagggacggccaagagtcagctgctaaagtttgtggagaaatgtagtccaattggagtttatacctcagggaaaggctctagtgcagccggactgaccgccagtgttatgcgggacccctccagtcggaacttcattatggagggcggagcgatggtgcttgctgacggcggagtggtgtgtatcgatgaatttgacaagatgcgtgaagatgaccgggtggccattcacgaagctatggaacagcagactatcagcattgccaaagccgggatcaccacaacgcttaactcccggtgctcagtgctagccgctgccaattcagtatttggaaggtgggatgagaccaaaggggaggacaacatagacttcatgcccaccattctctcacggtttgatatgatcttcatcgtcaaagacgagcacaatgaagagagggacgtaatgctcgcgaagcatgttataacattacacgtctctgcgttgacacagactcaagcagtggagggcgaaattgacctggccaagttgaaaaaattcatcgcttactgtcgggttaagtgcgggcccagactgtctgcagaggctgcggagaagctgaagaataggtatataatcatgagaagcggagctcgacagcacgagcgggacagtgaccgtaggagctctatccctatcactgtacggcagctcgaagctattgtccgaatcgcggaagccctgtcaaagatgaaactgcagcctttcgccaccgaagctgacgtggaggaagccctgcgactgttccaggtgtcaacacttgacgcagcactgtcgggaaccttaagcggagtagaaggcttcacttcacaggaggaccaggagatgctgagccggatcgagaaacagctgaagcgccgttttgccatcgggagtcaggtgtctgagcattcaatcatcaaagactttaccaagcagaagtaccctgaacacgccatacacaaagtacttcagctgatgcttcggaggggtgaaattcagcatcgcatgcagaggaaggttttgtacagactgaagtag

SEQ ID NO: 108702 - DNA, 1530 bp, Artificial Sequence
  Description of Artificial Sequence: Synthetic coding sequence
atgtctatgggggcccccaggagcttgctgctggccctggccgccggcttggcagtggccaggccacccaacatcgttctgatttttgccgacgacctcggttatggcgacctaggctgttacggccacccctctagcactacgccaaacctggaccagctcgccgccgggggcttgagattcacagatttctacgtcccagtctccctttgtacaccctcccgggctgcattattgactgggagattgcctgtcagaatgggtatgtaccccggagttcttgtgccctcctcacgcggcggtcttccgctcgaggaggttactgtggctgaggtgctcgccgcgaggggatatctgaccggcatggctgggaaatggcacctgggggtggggccagagggcgccttcctacccccacaccaaggctttcatcggttcctaggcattccatacagtcacgatcaggggccttgccagaatctgacctgcttcccccctgccacgccatgcgacggtggatgcgatcaaggactggttcctatccccctgcttgccaacctgtctgtggaagcccaaccaccctggctgccaggcctggaggctcgctacatggcatttgctcacgacttgatggccgatgcccaaagacaggatcgtcctttcttcctctactatgccagtcatcacactcattatccccagtttagcgggcaatctttcgctgaacgtagcggccggggcccttttggggactcgttgatggaactggacgctgcagtcggaactttgatgaccgccatcggagatctgggcttgctcgaagagacgctggtaatcttcaccgcagacaatgggccggagacaatgcggatgtctcggggcggctgctccggtctcctgaggtgtggcaagggcacaacctacgaaggtggcgtccgcgagccagctcttgcgttctggcccgggcacatcgccccaggcgtcactcacgaactggcctcttcactagatctgttacccaccctggcagcccttgcgggggctccactgcctaatgtaacacttgatgggtttgacctatctcccctcctgcttgggactggcaagtctccccgacagtccctgttcttttacccatcctacccagatgaggtcagaggcgtgttcgctgtccgaaccgggaagtataaggcgcacttcttcacacaaggcagtgcccattccgacacgacagccgaccctgcgtgccatgcttccagcagcctgaccgctcacgagcctcccctgctctacgacctctcaaaggaccccggtgagaattacaacttactgggaggtgtggccggggcgaccccggaagtgctccaggccctcaagcagctgcagcttctgaaggcgcaattagacgcggctgtgacttttggcccaagccaggtggctagaggagaggatcccgctctacagatctgctgtcaccccgggtgcaccccaagacctgcgtgttgccactgtcctgacccccatgcctag

SEQ ID NO: 108703 - DNA, 1530 bp, Artificial Sequence
  Description of Artificial Sequence: Synthetic coding sequence
atgagcatgggagctccaaggtcattgctgctggctctggctgctggtctggctgtcgctcggccgcccaacatagtgttgatatttgctgatgatctggggtacggggatctgggctgttatgggcatcctagctccacaacacccaacctcgatcagctggctgctggcgggttgcgattcaccgacttttatgtgccggtaagcctgtgcactccgtcacgcgcagctctgctgactgggaggttgcccgtgcggatgggtatgtaccctggagtgctcgttccctcctctcgtggcggacttcctctggaagaggtaaccgtggccgaggtactggcagcaagaggctacctcaccggtatggctggcaagtggcatctcggggttgggcctgagggcgcattcctgcctcctcaccagggcttccacaggtttctcggtatcccgtattctcacgaccaaggcccttgtcagaatctgacatgttttcccccagcaaccccatgcgatggcggttgtgaccaaggcctagttccaattcctttgctagccaacttgtcagtagaagcccagccgccatggttgccagggctggaagccaggtatatggccttcgcacacgaccttatggcagacgcccagcggcaagaccggccgttctttctgtattacgccagccaccacacacactatccacagttttctggccaatcattcgctgaacggagcggccggggtccatttggagatagtcttatggaactggatgcagctgtaggaaccctaatgaccgctatcggggaccttggactgctggaagagactctggtgatttttacggccgataatgggccagagacgatgaggatgagcagaggggggtgctctggtctcctgcgatgtgggaagggtacaacctacgagggtggagtgcgcgaacccgccttggctttctggcccggccacattgcgccaggagttactcacgaactcgcgtcctctctagatctgctccccaccctggcagcactagccggcgccccattgccaaacgtgacattggatggatttgatctgtcccctctgctcttgggcaccggaaaaagccctcgccagagcctctttttctacccttcatatcctgatgaggtgcgtggtgtcttcgctgtgagaacgggcaagtataaggcacacttttttacccagggctccgcccactctgacaccacagccgatcccgcctgccacgccagctcctcccttaccgcacatgagccacctctgctgtatgatctcagtaaggacccaggtgagaattacaacctgttggggggcgttgccggcgctacccctgaagtcttgcaggcattgaaacagttacagctcctgaaggcgcagctggatgctgctgtgaccttcggcccatcacaggtcgctcgcggtgaggacccagccttgcagatctgttgtcaccctggatgtacaccgcggcctgcatgttgccattgtcctgatccccatgcgtag

SEQ ID NO: 108704 - DNA, 1530 bp, Artificial Sequence
  Description of Artificial Sequence: Synthetic coding sequence
atgagcatgggcgctccacggtcacttctcctggcactggccgccggcttagccgtcgcacgcccaccgaatatcgtcctgatcttcgctgatgacctgggttacggtgatcttggctgttatggacatcctagttcgacaacccctaacttggatcagcttgccgctgggggtttgcgcttcaccgatttctacgtgcccgtaagcctgtgcacccctagcagggccgcactcctaactggtagactgcctgttaggatgggtatgtaccccggcgtcctcgttccctctagtagaggcgggcttccccttgaagaggtgacagtcgccgaggtgctggcagctcgggggtacctgactggcatggctggaaaatggcacctgggggtaggccctgagggcgcctttcttccaccccatcaaggctttcaccgatttctgggcattccatatagccacgaccagggaccttgccagaacctcacctgctttccccctgccacgccatgtgatggcggctgtgaccagggcctcgtgccaatacccctcctggcaaatctgagtgtggaggcccaacctccttggctcccaggcttggaggccagatacatggccttcgctcatgaccttatggcagacgcccagagacaagatagaccattcttcttgtactatgcctcccatcacacgcattacccccagttttccgggcagtcgtttgcagaacggtcaggccgtgggccttttggggattctttgatggaactggatgctgcggtggggactctgatgaccgcaattggcgacctcggcctgttagaggaaaccctggtcatctttaccgctgacaatggtccggagaccatgcgcatgtcacgaggtggctgttctggactgctgcggtgtggaaaagggaccacatatgaaggaggagtgagagaaccagcattagccttttggcctggtcacatcgctcccggcgtgactcacgagctcgcatctagcctcgatcttttgccaactttggccgcactggcaggggccccgttgcctaacgtgaccttggacggtttcgacctgagtccattactcctggggacaggtaagtcccctcggcagagcttgtttttttatccatcatatccagacgaagtcaggggcgtatttgccgtgcgcactggtaaatataaggctcacttcttcacacagggaagcgctcactctgacactaccgctgacccagcatgccacgcctccagcagtctgaccgcccatgagccacctctgctatatgacctgtcaaaagacccgggcgaaaattacaatcttctggggggggtggccggcgctacgccagaggtgcttcaggctctcaagcagctgcagctgttaaaggcccagctggacgccgccgtaactttcggcccaagccaggtggcaaggggtgaggatcctgccttacagatatgctgccacccaggctgtacaccccgccccgcctgctgccattgccccgatcctcatgcatag

SEQ ID NO: 108705 - DNA, 1272 bp, Artificial Sequence
  Description of Artificial Sequence: Synthetic coding sequence
atggggatgtacccgggagtactggttcccagtagtcggggcggcctacctttggaagaggttactgttgccgaagtactcgccgcaagaggctatttgacaggaatggccggaaaatggcatcttggcgttggccccgagggcgccttcttacccccccatcagggctttcacagattcttgggaattccttattcccacgaccagggaccatgccagaacctgacgtgctttccgcccgctactccatgtgatggcggttgtgatcagggcctggtccccattccactgctggccaatcttagcgtggaggcacagccaccttggctacctggcctggaggccagatacatggcctttgcgcatgatcttatggccgacgcgcagcggcaggacaggcccttctttctgtattacgcatcacatcacacccactaccctcagttttcaggtcagagctttgcagagaggtcgggccggggtccgtttggtgactctctgatggaactcgacgcggccgtgggaacactgatgaccgccattggtgacctggggttgttagaggaaacccttgtgatcttcactgctgataatggccccgaaacaatgaggatgtctcgtgggggctgcagtgggctgcttagatgtggaaagggtaccacttatgagggtggtgtgcgcgagcctgctttggccttctggcctgggcacattgcgccaggggtcacacatgagctggccagcagtctcgaccttctgcccactttggccgccctcgcaggcgcccccctacctaacgtcaccctagacggtttcgatctgtctcctctccttcttggaacaggcaagtcaccccgtcagtctcttttcttctatccttcgtatccggacgaggtgagaggggtcttcgccgtccggacaggcaagtataaagcacacttcttcacacagggaagcgctcacagcgatacaactgccgatccagcctgtcatgcctccagttctctgaccgcccacgagccaccgctcctgtacgacctgtccaaggaccctggagaaaactacaaccttcttggcggagttgctggtgcaacgcctgaagtgctgcaggcactgaaacagctgcaactgctgaaagcccagctcgacgcagcagtcacattcggtccatcccaggtggcaaggggagaggaccccgccctgcagatttgctgtcatcccggttgtacaccacgacctgcttgctgccactgtcccgatccacacgcctag

SEQ ID NO: 108706 - DNA, 1524 bp, Artificial Sequence
  Description of Artificial Sequence: Synthetic coding sequence
atgggggctcctcgatctctgttgctggctctggccgccggtctcgctgttgcccggccaccgaatatcgtccttatcttcgctgacgacctcgggtacggggacctgggctgttacggccatccaagtagcactacccctaacctagaccagttagctgcgggtggactacggttcacagatttttacgtgccggtgtccctgtgcactccatctagagctgccctgctaacaggaagactaccggttcgcatgggtatgtaccccggagtgctggtgccaagcagcaggggtggtttgccactggaggaagttactgtggcagaggttttggctgccagaggatacctgactggtatggccggcaaatggcatctgggtgtgggccccgagggagcattcctgccgccacatcaaggttttcatcggttcctggggattccttattcccacgaccaaggcccgtgtcaaaatttaacctgttttccacccgcgaccccctgtgatggggggtgtgatcagggactcgtgccaatccctctgctggccaacctatccgtggaagctcaacccccttggctccccggtctggaagctcgctacatggcgttcgcccatgatttgatggctgacgcgcagcgccaggaccgccccttctttctatactacgccagccaccatactcattacccacagtttagcggacagtcctttgcagaacgctccggaagaggacccttcggggattctctcatggagcttgacgctgcggttggaactctgatgacggccataggcgatctaggacttctcgaagaaaccttggttatctttaccgctgacaatgggccagagactatgcgcatgtccaggggtggctgcagcggtctactgagatgtgggaagggaacaacctacgagggtggcgtgcgggaaccagctcttgccttttggcccggacacatcgctcccggagtcactcacgaactggcttcatctctagatctacttcccaccctcgccgccctggccggggctccattgcccaacgtaaccctggatgggtttgatctgtctcctcttctgttaggtaccggaaaatctccccgacaatccctgtttttttacccatcttatcccgacgaagtgagaggggttttcgccgtcagaacagggaagtataaggcgcacttcttcacacagggaagcgcccattccgacaccaccgccgacccagcttgtcatgcatcgtcctcattgactgcacacgaacccccgctcctctatgacctaagcaaagatcccggagagaactacaacctgcttggcggcgtcgctggggccacccctgaggtgctgcaggctctgaagcagctccagctgctgaaggctcagctcgacgccgctgtgactttcggcccaagccaggtggctcgaggtgaggacccagcgctgcaaatctgctgccaccctggctgcacacctcgccccgcctgttgtcattgcccagacccgcacgcctag

SEQ ID NO: 108707 - DNA, 1524 bp, Artificial Sequence
  Description of Artificial Sequence: Synthetic coding sequence
atgggcgcccctcgttcactactcctggctctggccgctggactggcagtggcaaggccaccaaacatcgtgttaatatttgccgatgatctggggtatggggacctggggtgttatggccatcccagttctactactccaaatctggatcagctggcggccggcggtctgaggttcaccgacttctatgtgcccgtgagcctgtgtaccccttctagggccgcattgctcaccgggcgcctgcccgtacggatgggaatgtacccaggcgtgctggtcccctcctcccgcggagggctgcctctggaagaagtgaccgtggctgaggtgctggcggcacgcgggtatcttacagggatggcaggcaaatggcacttaggtgtcggacccgagggcgcgttcctaccaccccaccagggattccatagattcctgggaataccttacagccacgatcagggcccatgccagaatctaacctgctttcccccagccactccatgtgatggtggctgcgatcaaggcttggtacctattcctctgttggccaacctctcggtggaggctcagcctccatggctgcccgggcttgaggcacgctatatggcttttgctcacgatttgatggcagacgcccaaaggcaagatcgccctttcttcctgtactatgcaagtcatcacacacactatccccagttctcgggccagtctttcgcggagcgcagtgggcgggggccattcggagattctctcatggagctggatgctgctgttggcacactgatgaccgccataggcgacctgggcctgctcgaggaaacacttgttatcttcactgctgacaacgggcctgagactatgaggatgtcccgcggaggctgttcaggactgctgaggtgcggcaagggcactacctacgaggggggcgttagagagcctgcactggctttttggcctggacatattgctcctggcgtcacccacgagctggcctcctccctcgacctcctccctacattggcagctttggccggagcccctttgcctaacgttactcttgacgggttcgatttaagtcccctgttgctgggcacaggcaaatcaccacggcaaagtctgttcttctatccttcatatcctgatgaggtccgaggcgtgttcgccgtcagaacagggaagtacaaggcacacttttttacgcagggtagtgctcactctgatactaccgcagatccggcatgccatgctagctcctccctgactgcacacgagccacctttattatacgatttaagtaaagatcccggcgagaattacaatctgctaggtggtgtggctggcgctactcctgaggttctgcaggccctgaaacagttgcagctcctaaaagcccagctagacgccgccgtaacattcggccctagtcaggtggccaggggggaggaccctgccctgcagatatgctgtcatccaggctgcacgccaagacccgcgtgctgccactgtcctgaccctcatgcatag

SEQ ID NO: 108708 - DNA, 1782 bp, Artificial Sequence
  Description of Artificial Sequence: Synthetic coding sequence
atgcggagcgcggctagaaggggacgcgcagcccccgccgccagggattcactgcctgtactgttgtttctgtgccttctgctaaagacctgtgaacccaagaccgccaatgctttcaaacccaatattcttctgatcatggctgatgacctgggcaccggagatctgggttgctatggcaacaatactctgcggacaccaaacattgaccagcttgccgaggagggagtgcgtctaacccagcatctggcagctgccccgctttgcactcccagccgagctgcgttcctcactggtagacactctttcagaagcggcatggacgcctccaatggttatcgtgcacttcagtggaatgctggttctggcggtttacccgaaaacgaaactacctttgctcgcatactccagcagcatggatatgccactggactgatcggcaagtggcatcagggcgtaaattgtgctagtcgaggcgaccactgccaccaccctttaaaccacggtttcgactacttttatggaatgccattcacactcacaaacgactgcgatccggggagacctccagaggtggacgcagcccttcgtgcacagctctgggggtatacacagttcctagctcttggcattctcaccctggccgctggccaaacctgtggatttttcagtgtttctgcgagagccgtcacaggaatggcaggcgttgggtgtctttttttcatttcctggtatagcagcttcggtttcgtcagacgctggaattgcatccttatgaggaaccacgacgtcacagaacagcccatggtgctcgagaagaccgcctctctgatgctcaaagaggcagtgtcttatatcgaacgtcataaacacggtcccttcctcctgtttctgtcactgctgcacgtgcacattcccctcgtgaccacatctgccttcctaggaaagagtcaacacgggttatatggcgacaatgtggaagagatggattggcttatagggaaggtgctcaatgccatcgaggataacggccttaagaattccacatttacttacttcacgagcgaccatggcggacacctggaggccagggatggacactcgcaactggggggctggaacggaatctacaaggggggtaaggggatgggcggttgggagggagggatcagggttcccggtatctttcactggcctggcgttctgccagccgggcgggtgatcggcgaacctacaagcctgatggatgtatttccaaccgtcgtgcagttggtcggtggggaggtaccgcaggacagagtgattgacggacactcccttgtccctttgctacaaggagcggaggctcgttctgcacacgaatttttatttcactactgcgggcaacacctacatgctgctcgctggcaccaaaaggactccggcagcgtgtggaaagtccactataccactccacagttccatcctgaaggtgctggcgcctgctacggaaggggggtgtgtccctgcagcggagagggtgtgacacatcataggccccctctccttttcgacctgtcccgcgatccttccgaagcacggcccctgacccctgatagtgaacctctgtaccatgccgtcatcgcacgtgtcggggccgctgtgtccgaacataggcagacgctgagtccagtcccccaacagtttagtatgtccaatattctgtggaaaccctggctgcaaccatgctgcggacactttcccttctgctcttgccacgaggatggcgacggtacaccgtag

SEQ ID NO: 108709 - DNA, 1770 bp, Artificial Sequence
  Description of Artificial Sequence: Synthetic coding sequence
atgcttcatctgcaccacagctgcctgtgtttccgttcctggttacctgccatgctggctgttctgttgtctcttgcacccagcgcaagcagcgacatctccgcctcccgccctaacatcctgctcctcatggccgacgatctggggattggtgatataggttgctacggcaacaacacgatgcggacacccaatatagaccgcctggccgaagacggcgtgaaacttactcagcatatctcagccgccagtctctgtacaccttccagggccgccttcctcacggggaggtaccccgtgaggtccggcatggtctcttccatcggctatcgggtccttcaatggactggcgcctccggcggcctccctaccaacgagacgaccttcgccaagatacttaaagagaaaggttacgctaccggcttgataggtaaatggcatctaggcctgaactgcgaatctgcctcagatcattgtcaccacccccttcaccacggatttgatcatttctacggtatgcctttctcactcatgggcgactgtgcccgatgggaactgtccgaaaagagagttaatctggaacagaagctcaactttttgttccaggtgctcgctcttgtcgcactaactctggtcgctggcaaacttacacatcttatccccgtgtcttggatgccagtgatctggtccgcgctgagtgccgtgttattactggcctcatcttatttcgtgggagcactgattgtgcatgcagactgctttctgatgagaaatcacacaattactgagcagccaatgtgctttcagcgcaccaccccactgatcctgcaggaggtggcttcattcctgaaacgaaataaacatggtcctttcctgcttttcgtctctttcttgcacgtgcacattccgctcataactatggagaattttctggggaaatccctgcacggactgtacggggataatgtagaggaaatggactggatggttggaaggatcttagacacattggatgtcgaaggactcagcaatagcaccttgatatactttacctctgatcacggaggctcactggagaaccagctcggaaacacacagtatggtgggtggaacggtatatataagggtggcaagggcatgggcggctgggagggagggatcagggtgccaggcatcttcagatggcctggagtgctgcctgccgggcgcgttataggagaaccaacctccctcatggacgtcttcccaactgtggtgcgtcttgctggaggtgaggttccgcaagatcgggtgattgatggacaggatctgttgccactgctcctcggaaccgctcagcatagtgaccatgagtttctaatgcattactgcgaaaggttcctgcacgccgcacggtggcatcagcgggatcgcggaaccatgtggaaggtgcacttcgtgaccccggtgtttcaacctgagggagctggggcatgttatggacgaaaggtgtgtccatgcttcggagaaaaagttgtgcaccatgaccccccactgctctttgatttatcgagggatccttctgagacccatattcttactcccgcctccgaacccgttttttatcaagtcatggagcgggtgcagcaagcagtgtgggagcaccaacgaacacttagccctgtgcccctccaattggaccgtctgggcaatatctggcggccttggctgcagccttgctgcggccccttccctctttgctggtgtttaagagaagacgacccgcagtag

SEQ ID NO: 108710 - DNA, 537 bp, Artificial Sequence
  Description of Artificial Sequence: Synthetic coding sequence
atgctgcacctgcaccacagctgcctgtgtttccggtcttggctcccagcaatgctagcggtcttgttaagtctggccccttccgccagcagcgacatatccgcttctagaccgaacattctgctgctgatggccgacgacctggggatcggtgacatcggctgttacggcaacaacaccatgagaacgcccaacatcgatcgtttagctgaggacggcgtcaagttgacccagcatatttccgcagcctctctgtgtaccccctcaagagctgcttttctgaccggtcgctaccctgtccgcagcggcatggtctcatccatcggttatagggtattgcagtggactggtgcctccggcgggttgccaacaaatgagaccacctttgcaaagattcttaaggaaaaaggatacgccacaggactcattggcaaatggcacctcggactcaactgtgagtccgcaagtgatcattgccaccatccactacatcacggctttgaccatttctatggtatgcctttcagcctgatgtag

SEQ ID NO: 108711 - DNA, 1635 bp, Artificial Sequence
  Description of Artificial Sequence: Synthetic coding sequence
atgtctggttccagggaaagggataacatgctccacctgcatcattcctggacacccaacatcgatcgattagccgaagacggggtgaaactcactcagcatatttcagccgcttcactctgcacacctagcagggcggctttcctcacaggacggtaccccgtaagaagcggaatggttagtagcatcggctatagggtgctgcaatggaccggggcctctggcggcctccctaccaacgagaccacctttgccaagattctgaaggaaaagggctacgccaccgggctgattggaaagtggcatctgggcctgaactgtgagtccgcgagcgaccactgccaccatcctctccatcacggatttgaccatttctatggtatgcccttcagccttatgggtgactgtgctaggtgggagttgagcgagaaacgagttaacctggagcagaagctgaatttcctcttccaggtcctggctctcgtggcccttacactggttgcagggaaactgactcacctgatccccgtatcttggatgcctgtgatatggtccgccctgagcgcagttcttcttctggcttcttcatacttcgttggagctcttattgtgcacgccgattgctttctaatgaggaatcataccataacagagcagcctatgtgctttcaacgcacaaccccgttgattttacaggaagtggctagctttctcaagaggaacaagcatggcccgttcttactctttgtgtcatttctccacgtgcatatacctctgattactatggaaaactttttgggcaaaagtttacacggcctctacggcgataacgtcgaggagatggactggatggtgggccgcatcctggatacccttgatgtagagggactctccaattctacactgatatactttacaagcgaccacggcggcagcctggagaatcaactgggtaatacccagtacgggggatggaatggaatttataagggaggcaaggggatgggcggatgggagggagggatccgggttccaggtatttttcgctggcctggggtactgccagccggtagggtgattggggaaccaacttctctcatggatgtgttccccaccgtagtgcgcctggcgggcggagaagtccctcaagatcgcgttatcgatgggcaggaccttcttccgctactgttgggaaccgcccaacactccgaccatgaattcctcatgcactactgcgaacgctttttgcatgcagcccgttggcatcagagagaccggggcaccatgtggaaagttcattttgtgacaccagtcttccagcccgaaggcgccggagcatgctacggaagaaaagtatgtccatgttttggagaaaaagtcgtgcatcatgaccctccacttctgtttgacttgtcccgtgatccctccgagacacacattctcactcccgctagcgagcccgttttttatcaggttatggaaagggtacaacaggctgtatgggagcaccagcgtacattgtcaccagttccgctccagctggatcggcttgggaatatctggcgaccctggctgcaaccgtgttgtgggcccttccctctgtgctggtgtctgcgcgaggatgatccacaatag

SEQ ID NO: 108712 - DNA, 1845 bp, Artificial Sequence
  Description of Artificial Sequence: Synthetic coding sequence
atgcggcctgttattaataggtgcgcccccggctccctggacttaatgctgccgcaagctgcgtcagaggggatcgtgttccactcactgcagatctccctgtgcttccggtcatggctgccagcaatgctcgctgtgctgctcagcctggccccatccgccagctctgacattagcgccagccgtccaaacattctcctgctgatggcagatgacctcggtattggcgatataggctgctacggcaacaataccatgaggacacccaatatcgataggttggctgaggatggtgtgaagttgacacagcacatcagcgcagcgtctctttgcaccccttccagggctgctttcctgaccggaaggtatccagtgcgctccggaatggtgtcatcaattggttatagagtcttgcagtggactggtgcgtcagggggcctgcccacaaacgaaaccacatttgctaaaatcctcaaagaaaaaggttacgcgaccggactgatcggcaagtggcacttagggttgaattgtgaaagcgcttccgaccattgtcaccatcccctacaccacggcttcgatcacttctatggtatgccattcagtttaatgggcgactgtgctcgatgggagctttccgaaaaacgagtgaacttggagcagaagcttaacttcctttttcaagtcctggcactagtggccctgaccctggtcgccggaaagctgactcacctgatcccagtatcatggatgccagttatctggtccgcactttccgccgtgctgctgctggccagtagctactttgtgggggctctgatcgttcacgctgactgtttccttatgcggaatcatacaatcaccgagcagcctatgtgtttccagcggaccacacccttgatcctacaagaggttgcatctttcttaaaacggaacaagcacggaccatttctactgtttgtgagctttctgcatgtacacattcctctgatcacaatggaaaattttcttgggaagagtctccacggactttatggggataatgtggaagagatggattggatggtcggacggatcctggacacgctggacgtggagggcctgtcaaactcaacactgatttactttacaagcgatcacggtgggtcacttgagaaccagctcggcaatacacagtacggtggctggaacggcatctataagggagggaaaggtatgggcggttgggagggcggcatcagagttcctgggatctttcgatggcctggggtactgcccgcgggacgggttatcggcgagcctaccagcctcatggatgtgttccctaccgtggtgcgacttgctggaggtgaggtgccccaggatcgggtgatcgacggccaggatttgctacctctcttattaggtactgctcagcatagtgaccatgagtttctgatgcactactgtgaacgctttttacacgccgctaggtggcaccagcgtgaccggggcacgatgtggaaggtgcacttcgtaacaccagttttccagccggagggagcaggggcttgttacggacgcaaagtgtgtccctgcttcggggagaaggtggttcatcatgatcccccgctccttttcgacttaagccgcgatccttcagaaacacatatactgacacccgcatctgaaccggtcttttatcaggtcatggagcgcgtccagcaggcagtgtgggagcatcagcgtacactgtctcctgtacctctgcagctcgatcggcttgggaacatttggcgaccgtggttgcaaccatgttgtgggccttttcctctttgctggtgtctgagagaggatgaccctcagtag

SEQ ID NO: 108713 - DNA, 1773 bp, Artificial Sequence
  Description of Artificial Sequence: Synthetic coding sequence
atgcggccaaggagacctctggtgtttatgtctctcgtttgcgccttgcttaatacatgtcaggctcaccgagtgcacgatgacaaacctaacatagtgttgatcatggtggatgatttaggtattggcgatttagggtgttacggtaacgacaccatgcgcacccctcatattgaccgcttggcccgagaaggcgtgagactgacgcagcacatcagcgccgcctctctgtgttctccctccagatctgctttcctgacaggtcgataccctataaggagtggaatggtatcttctggaaatcgacgcgtgattcagaatctggctgtgcccgctggtttgcctttgaacgagactacgctggctgcgctgttgaaaaagcaaggatacagcactggattgattggcaaatggcaccaggggcttaactgcgacagccggtccgatcagtgccatcacccttacaattatggctttgactactactacggaatgccctttaccctggtagatagttgttggcccgatccatcgaggaacacagaactggcatttgagagccagctgtggctgtgcgtgcagctggtcgcgatcgccatcttgaccctcacatttggtaaactgtctgggtgggtctcggtgccctggctgctgatctttagcatgattctgtttatattcctgctcggctatgcatggttctcatcacatacctccccactctattgggactgtcttcttatgcgaggtcatgagatcaccgagcagccaatgaaagctgagagggctggctccataatggtgaaggaggcgataagctttcttgaacggcacagtaaggagacctttctcttgttcttttcctttttgcacgtacacacccctctgcctacaaccgacgatttcaccggaacatccaaacacggactgtacggcgacaatgtcgaggagatggatagcatggttggtaagatcctggacgccattgacgacttcggcttgcgaaataataccctcgtgtattttacaagtgaccacgggggccacctggaggcaaggcgaggacacgcccaactgggcggatggaacgggatctacaaagggggcaaaggcatggggggatgggagggaggcatacgagtcccggggatcgtgcgttggccgggcaaggttccagcaggcagactgataaaagagccgacaagtttaatggatattctgccaacagtcgcatccgtgagcggcggctcccttccacaggatagggtcattgatgggcgggacctcatgcccctactccagggaaacgtcagacatagcgagcacgagtttctctttcattattgcgggtcctatctccatgcagttagatggatacctaaagatgatagcgggtcagtttggaaggcgcattatgtgacccctgttttccagcccccagcctccggaggctgttatgtgaccagcctgtgtagatgttttggagagcaagtgacttaccacaatccaccactactgttcgacctgtctcgggaccctagtgaatcaacccctctgactccagccactgagcctctgcacgatttcgtgataaaaaaagtggcaaacgctcttaaggagcatcaagagactatcgtgcccgtcacataccagctaagcgagcttaatcaggggaggacctggctcaagccatgctgcggggtgtttcccttttgcctgtgcgacaaggaagaggaggtcagtcagccacgaggccccaatgaaaagcggtag

SEQ ID NO: 108714 - DNA, 1773 bp, Artificial Sequence
  Description of Artificial Sequence: Synthetic coding sequence
atgcgcccacgtcgcccactggtgtttatgagcctggtgtgcgcactgctaaatacctgccaggcccacagggtccatgacgataaaccaaatatcgtgctcataatggtcgacgacctaggcatcggagacttgggttgttacggcaatgacaccatgcgcacgcctcatattgaccgacttgcacgcgagggagtaagactcacccagcacatcagcgccgcctccctgtgcagccctagtagatctgccttcctgaccggacgataccctatacgctctggtatggtaagctcaggaaataggagagtcatccaaaatttggcggttcccgccggattgcccctgaatgaaaccacactcgccgctctgcttaaaaagcagggatacagtacgggtcttataggcaaatggcatcagggcctgaattgtgattctagatcggatcaatgccaccacccttataactatggctttgattactattatggtatgccatttacactcgttgactcatgctggccagatcccagtcgcaataccgaattggccttcgaatcacagctctggctgtgcgtccagcttgtggccattgctatactgacactcacattcggcaaactatctggctgggttagtgtcccttggctgttgattttctcaatgatcttgtttatctttctcctgggctatgcttggtttagttctcacacctcgccattatactgggactgtcttctgatgcggggccatgagattaccgaacaaccaatgaaggccgaaagagccggaagcatcatggttaaggaggcgatttccttcctcgagcggcatagcaaggaaacctttctcctgttttttagcttcctacacgtccacaccccgcttcctaccacagatgacttcactggcacttctaaacatggactctatggtgataacgttgaagaaatggattcaatggtgggtaaaatactagacgccattgacgactttgggttgcgaaacaatacgctcgtttactttacttctgaccacggtggtcacctggaggcgaggcgtgggcatgcccagctgggagggtggaatggaatatacaaagggggcaagggcatgggcggctgggaaggcgggatccgtgtacccgggatcgtccgatggccaggcaaggtacccgcgggcagactgatcaaggaaccaacaagtctgatggatatcctgccaaccgtggcctccgtttcaggcgggtcccttccccaggaccgcgtaatagatggacgagatcttatgcccctgctgcagggtaacgtgcggcactccgagcatgagttcctgttccactattgcggcagttatttgcacgccgtacggtggatccccaaagacgactctggaagtgtgtggaaggcacattacgttacgcccgtcttccaaccccccgcaagtggcgggtgttacgttaccagcctctgtcgctgttttggtgagcaggtcacctaccacaaccccccgttacttttcgatctctcgagggacccatcggagtccacccctctgacacccgccacagagccactgcacgatttcgtaatcaagaaagtggcaaacgcgctgaaggagcatcaagaaaccatcgtccctgtgacttatcagctcagcgagctgaaccaggggagaacatggctgaagccatgttgcggcgtttttcccttctgcctgtgtgataaggaggaggaggtctcacaaccaagaggacccaatgaaaaacggtag

SEQ ID NO: 108715 - DNA, 1773 bp, Artificial Sequence
  Description of Artificial Sequence: Synthetic coding sequence
atgaggcctcgtcggcctttggtgtttatgtcattagtttgtgctctgcttaatacctgtcaggctcatcgggtgcacgatgataagccaaacattgtgcttatcatggtggacgacctgggtatcggtgacctaggttgttatggaaatgatactatgcggactccccatatcgatcgacttgcaagggagggcgtgcggcttacccaacacatatctgcagcctccttgtgctcacccagtcggtcggctttccttacagggaggtatccaataaggagcggcatggtcagcagtgggaaccggcgggtgattcagaatctcgccgtacccgctggcctgcctttgaatgagacaacgttggccgctctgcttaaaaagcagggatactctacaggattgattggaaaatggcaccagggcctcaactgcgatagtagaagcgaccagtgtcatcacccctataattatggctttgattactattacggtatgcctttcaccctggtggactcttgctggcctgacccctcccgtaatactgagctggcttttgaatcgcaactatggctatgtgtgcagctggttgccattgccatcctgaccttgacattcggtaagctctcagggtgggtcagcgttccttggctgctcatattctctatgatcctgtttattttcctgttaggttatgcgtggttttcatcccatacgagtccattgtactgggactgcctgctgatgcgcgggcacgaaattaccgagcaacccatgaaggcagagcgagcagggagcattatggtaaaagaggccatctcgtttctggaacggcatagcaaggagacgtttctcctgttctttagctttcttcacgttcatacccccttgccgaccacagacgattttaccggtactagcaagcatggcctttatggggataacgtggaggaaatggactctatggttggcaagatattggatgcaatagatgatttcggccttcggaacaacacactggtctattttacctccgaccatggtggacacctggaagcaagacggggacatgctcagcttggaggctggaacgggatatataaggggggcaaaggaatgggaggctgggagggcgggatccgggttcctggaatcgtccggtggcccggaaaggttcccgctggacggctgatcaaggaacctacctcactgatggacattctcccaactgttgcgtcagtgagtggaggatcgttgccacaggaccgggtaatcgacggtagagacctgatgccactgctgcaagggaacgtccgacactccgagcacgagttccttttccactattgcgggtcctacttgcacgcagttcggtggatccccaaggacgattcagggtcagtgtggaaggcccattatgtaactccagtcttccaaccgcccgcttccggtgggtgctatgtgacttccctgtgccgttgcttcggcgaacaggtcacctaccacaacccacctcttttattcgacctgtctcgcgacccttccgaaagcacgccgctgaccccagctaccgaacctctgcatgatttcgttataaaaaaggtggcgaacgccctgaaggaacatcaagaaactatcgtgccagtgacctatcagctgtccgaattaaaccaggggcgcacatggctgaaaccatgttgtggcgtttttcccttttgtctgtgcgacaaagaggaggaggtgtctcagcctaggggccctaacgagaagaggtag

SEQ ID NO: 108716 - DNA, 1689 bp, Artificial Sequence
  Description of Artificial Sequence: Synthetic coding sequence
atgactagaaatgccagaccaaacatcgttctacttatggccgatgacctaggagtgggcgacctctgttgctacggcaataactccgtgtctacaccaaatatcgaccgcctggcgtcagagggagttcgtctcacacaacatctggctgctgcctctatgtgcaccccatctagggcggcttttttgaccgggcggtaccctatccgctctggcatggtttctgcatataacctgaatcgggccttcacatggctcggcggatccggtggcctgccaaccaacgaaactacctttgctaagctgctgcagcatcgtggctatcggaccggtctgatcggcaagtggcaccttggcctttcctgcgcatcccggaacgaccactgctaccatcccctgaatcacggtttccactatttttatggcgtgcctttcggacttctatcagactgccaggccagcaaaaccccggaactgcatcgatggctgcgcatcaagctttggatatctaccgtcgctctcgccctggtgccttttcttcttttgatacccaagtttgctaggtggttttccgtgccctggaaagtgatctttgtgtttgcccttctagcctttctcttttttacttcctggtactcatcgtatgggtttacacgaagatggaactgcattttaatgcggaaccacgaaataattcaacagccaatgaaagaagaaaaggtggccagcctgatgttaaaagaagcgctggcgttcatcgagagatataaacgagaacccttcctgttgttctttagtttcctgcatgtccatacaccactgatctcaaagaaaaagttcgttggcagatccaagtacgggcggtatggggacaatgtcgaggagatggactggatggtgggaaaaatactggatgccttggaccaagagagactggccaatcacaccttagtgtactttacttcagacaatggaggccacctggaacctttggatggagccgtgcagctgggaggttggaatggaatttacaagggcggcaagggcatgggtggatgggaaggaggcattcgagtacccggcatcttcaggtggccgagtgtgctcgaagccggtagagtcattaacgaacccacttctcttatggacatttacccaactctgtcctacataggcggtggaatcctcagccaggatcgtgtgattgatggccagaacctgatgcctttgttggaggggcgcgcatcccactccgaccacgagttcctctttcactattgcggcgtgtacctgcacacagtgagatggcaccagaaagactgcgctacggtgtggaaagctcactacgtgactcccaagttctacccggaaggcactggcgcctgctacgggtcaggaatctgctcatgctccggtgatgtgacctatcatgaccctccactactgttcgacatctcccgggacccttcagaggcccttcctcttaatcctgacaacgaaccactgtttgactcggttatcaagaagatggaagctgcaatcagggaacatcggcgcacccttaccccagtcccccagcagttctcagttttcaataccatctggaagccgtggctgcagccctgctgcggaaccttccctttttgcggctgtgataaggaagatgacatcctgccgatggcgccttag

SEQ ID NO: 108717 - DNA, 1710 bp, Artificial Sequence
  Description of Artificial Sequence: Synthetic coding sequence
atgcatacattgactggcttctcgcttgttagcttgctcagttttggttacctgagctgggactgggccaagccatctttcgtggccgatggacccggcgaggccggagaacagcctagcgcagctcccccccagcctccacatattatcttcatcctgacggatgatcagggataccatgacgttggataccatggaagtgatatagagacccctaccttggaccggcttgcagctaaaggggtcaagctcgaaaattattatatccagcctatttgtacgcctagtcggtcgcaactcctcactggtaggtaccagattcacacaggtctccagcactcgattataaggccacaacaacccaactgcttgcccctggaccaagtcaccctaccccagaagctgcaggaggctggctactccactcatatggtgggaaaatggcacctgggattttacagaaaggaatgtctgcctaccagaaggggttttgacacattcctggggtcactgaccgggaacgtggattattacacctatgataactgtgatgggcctggggtgtgtggttttgatttgcatgaaggcgaaaatgtagcctggggcctatccggacaatactctacaatgctgtacgcccagagggctagccatattctcgcctcacattccccccagcggccactgttcctgtacgtggccttccaagcagtacacaccccactgcaatcgccccgggagtatctctatagatatcgcactatgggcaacgtcgcacggagaaaatatgcagcaatggttacctgcatggacgaggccgtccgtaacattacctgggccctgaagcgatacggcttctacaataactctgtgataatttttagctccgataatggagggcagacattctccggagggtctaactggccactccgcggtcgtaaagggacttactgggaaggcggagtgcgcggcttaggctttgtgcactctcctttgctcaaacggaaacagagaacaagtcgggcactcatgcatattacagattggtaccctaccctcgtgggactggcgggcggaaccacatccgctgcagacggcttggatggatatgatgtatggcctgccatttcggaaggcagagcgtcacctagaaccgagattctgcataacattgatcctctttataaccacgcccagcatgggtcactggaaggagggttcggaatttggaataccgcagtgcaggccgcaattcgggtgggggaatggaaactccttaccggagatcctggatacggagattggataccaccccagacattagccacctttccaggttcctggtggaatctcgagcgcatggcttccgtgcgccaggccgtctggctgttcaatatttctgccgatccgtacgaacgcgaggacttagctggacagcggccggatgtcgttagaactctattagctaggctggcagaatacaaccgcaccgccatcccggtgagatatccagctgaaaatcctcgtgctcaccccgacttcaatggaggagcctgggggccttgggcatctgatgaagaggaagaagaggaggaaggccgggcccgctctttcagccgaggccggaggaaaaagaaatgtaaaatttgcaaattgaggtcattctttcgaaaactgaatacacgcttaatgtctcagcgcatctag

SEQ ID NO: 108718 - DNA, 261 bp, Artificial Sequence
  Description of Artificial Sequence: Synthetic coding sequence
atggtaggaaagtggcacctcggcttctatcggaaagagtgccttccaacccgtcgaggtttcgacacattcctcgggagcttgaccggtaatgtagattactacacttacgataactgcgacggacccggagtgtgtggcttcgatctacatgaaggcgaaaacgttgcgtggggattgtctggccaatattctacaatgctttacgctcagcgggcctcccatatcctggctagtcattcgccccagcgtcccctgtag

SEQ ID NO: 108719 - DNA, 1281 bp, Artificial Sequence
  Description of Artificial Sequence: Synthetic coding sequence
atggtcggaaaatggcacttaggattttacagaaaagaatgtctcccaactcgcaggggatttgataccttcctcgggagtctgactggaaacgtggattactatacttatgataattgcgacggcccaggagtttgtggtttcgatctccatgagggtgagaatgtcgcttggggcctgtcgggccagtattccactatgttgtacgcgcagcgagcctcccatattttggcctcccatagcccacagcgaccactgtttctgtatgttgctttccaggccgttcatacaccattacagtcgcctcgagagtatttgtaccgctatagaacgatgggcaatgtcgcccgaagaaaatatgcagccatggtaacttgtatggacgaggccgtccgaaacatcacatgggctctgaagagatacggcttctataacaactccgtgatcattttttcttccgacaatgggggccaaaccttcagcggaggatccaactggcctttgaggggcagaaaaggcacatactgggagggcggcgtacgggggctgggctttgtgcactcacctctcctgaaaaggaagcagaggacgtccagagctctcatgcatattacggactggtatccaaccttagtggggctggcggggggaactacttcagccgccgacggtctcgacgggtacgacgtgtggcctgccatttctgagggtcgggcaagccctagaactgagatcctccacaatatcgaccctctgtataaccatgcccagcatggttcgcttgaagggggttttggcatttggaatactgctgtccaggcagcgatcagggtgggagaatggaaacttctgacgggtgatcctggctatggggactggatcccgcctcaaaccttggccaccttccccggaagttggtggaacctcgaacggatggcctcggtaagacaggcagtgtggctcttcaatatttcagccgatccctacgagagagaagacttggcaggacaacgccccgatgtcgtgaggaccctgctggcccgtttggctgaatataaccggaccgcaattcccgttaggtatcctgccgaaaatcccagggctcatcccgattttaacggcggagcctggggcccttgggccagtgatgaggaggaggaggaggaggaaggcagggccaggagcttcagccgggggaggaggaagaaaaaatgcaaaatctgcaaactgcgctcattctttcggaagttgaacacacgactgatgtcccaacgcatctag

SEQ ID NO: 108720 - DNA, 1800 bp, Artificial Sequence
  Description of Artificial Sequence: Synthetic coding sequence
atggcgccgaggggctgtgcgggacacccaccacctccatcacctcaggcctgcgtgtgtcctggcaagatgctggccatgggggcactggcaggcttttggattctgtgcctgctgacctacgggtatctgtcctggggacaggctttggaagaagaggaggagggcgccttgctggcccaggcaggagagaaactggagccaagcacaacatctacttctcagccacatctgattttcatcctggccgatgatcagggcttccgagatgtgggatatcacggatctgaaataaaaactcccacgttggataaactcgccgccgaaggagtcaagctggaaaactactatgtgcagcccatctgtaccccttctcgtagtcagttcataactgggaagtatcaaatccataccgggctacagcatagcattatacggccaacccaaccaaactgtctgcctctggacaatgccaccctacctcaaaagctgaaggaagtgggctatagcacacatatggtgggaaaatggcacctgggtttttacagaaaggagtgtatgcccacccggcgtggctttgacaccttttttggttcactcctcggaagcggcgactactacactcactacaagtgcgactcaccaggcatgtgtggctacgatttgtatgaaaatgacaatgctgcctgggattacgacaacgggatctatagcacgcagatgtacacccaacgggtacagcagattttggcttctcataaccccactaaaccaatttttttgtatatcgcataccaggccgtacacagcccactgcaagcccctggtcgctacttcgaacattataggtccatcatcaatatcaatcggaggcggtacgccgccatgttgtcctgcctcgatgaggccattaataacgtcacccttgcacttaaaacctacggcttttataacaattcaatcatcatctattcctccgacaatggaggccagcctactgccggcgggtcaaactggcccttgaggggcagcaaaggtacctactgggaaggagggattcgcgctgtggggtttgtacatagtccactgttgaagaataaaggcaccgtatgtaaggaactggtgcatataacagattggtacccaacactaattagtctagctgaaggacagattgatgaagatatccagctcgacggatacgatatctgggagacaatctctgaaggcctgcgctcccccagggtggatatccttcataatatcgaccccatctataccaaagcaaagaatggctcttgggctgcaggctacggaatctggaacacggccattcaatcagccatcagggtgcagcactggaaactcctaaccggcaacccgggctacagtgactgggtgccaccacagtctttcagcaatctgggcccaaatagatggcacaacgagaggattacattgtctaccgggaagtccgtatggctcttcaacataacagctgatccatatgaaagggtggacttgtctaataggtatccaggtatcgtgaaaaagttattacggaggcttagtcagtttaataagaccgcagtgccagtgaggtatcctcccaaagaccctagaagcaacccacgactgaatgggggagtatgggggccttggtacaaggaggagactaagaaaaagaaaccttcgaagaaccaggccgaaaagaagcaaaagaaatccaaaaagaaaaagaagaaacagcaaaaagctgtgagcggatctacttgccatagtggggtaacttgcggctag

SEQ ID NO: 108721 - DNA, 1791 bp, Artificial Sequence
  Description of Artificial Sequence: Synthetic coding sequence
atggccccaaggggatgtgccggccaccccccgcctccctcgcctcaagcttgtgtttgccctggcaaaatgctcgccatgggcgccctggcagggttctggattttatgtctgcttacttatggctatctgtcgtggggtcaggccctagaagaagaagaagagggggccctgttggcccaggcaggcgagaagcttgagccctccactacatcaactagccaaccccacctgattttcattctcgctgatgaccaaggcttccgtgatgtgggctaccacgggagtgagatcaagacgccaacccttgacaagctagctgcggagggggtgaagctggaaaactactacgtgcagccgatatgcacccctagccgctcccaattcatcacgggaaagtatcagatacacacaggccttcaacacagtatcatacgtcccactcagcctaactgtctacccctggacaatgcaaccttaccccagaagctgaaggaggttggttattccacccacatggtgggtaaatggcatctgggattctaccggaaggagtgtatgcccactcgacgcggctttgatactttttttggctctctgttggggagtggtgattactatactcactataaatgtgattcccctggaatgtgcgggtatgatctctacgaaaatgataacgcagcatgggactacgataatggtatttactcgactcagatgtatactcagagggtgcagcagatcctcgcctcccacaatccaaccaaacccatattcctctacattgcatatcaggctgtgcatagtcccctgcaagctccgggtaggtatttcgaacactatcgtagcatcataaatatcaacagacgaagatacgcggcaatgctttcctgcttagacgaagcaatcaacaatgtgaccctcgcactcaagacatatggcttttacaataattctattattatctactcttccgacaacggcggacaacctaccgccgggggctcaaattggccgctgagaggctccaaaggcacttattgggaaggaggcatccgggccgtcggcttcgttcattcaccactgctgaaaaacaaaggcaccgtttgtaaagaactcgtccatattacagactggtacccaacactgataagtctcgcagaggggcagatagacgaagacatccaactggatgggtacgatatctgggagacgatcagtgagggtctacgctccccaagagttgacatcctgcataatatcgaccctatctacaccaaagccaagaatggctcctgggcggcgggctacggcatatggaatactgccatccaatctgccatcagagtgcaacattggaagctcctcaccgggaatcctgggtatagtgactgggtgccaccccagtctttttctaacttagggccaaacagatggcataacgaaagaataactctctcaactgggaagtcagtttggctgttcaatatcactgcggatccatacgaacgcgtagacctctcaaatagataccctggcattgtgaagaagctcctgaggagactgagtcagttcaacaaaactgccgttcctgtgcgctaccctccaaaggaccccagatccaaccctcggctgaacggaggagtatggggcccttggtacaaggaagaaactaaaaagaagaagccgtctaaaaaccaggcggaaaagaagcagaagaagagtaaaaagaaaaaaaaaaagcagcagaaagctgtctccggtaagccagccaatctggcccgctag

SEQ ID NO: 108722 - DNA, 507 bp, Artificial Sequence
  Description of Artificial Sequence: Synthetic coding sequence
atggcaccagggcagcaggctatgggctccggaacattacagtcaagccagccatcagagtgctctacaggcctgctcacgggcaaccctggctattcagattgggtccctccccagtcattttccaatctgggccctaatagatggcacaatgagcggatcaccctcagcactggaaagtcggtgtggttatttaatataaccgccgacccttatgagcgagtggacttaagcaatcggtaccccggcatcgtgaaaaagttgctgagaaggctgtctcaattcaataaaactgccgtgcccgtgcgctaccccccaaaagatcccaggagtaacccgcggctgaacgggggtgtgtggggaccgtggtataaagaggagacaaagaaaaaaaaaccgtccaagaatcaggcagagaagaagcaaaaaaagtcgaaaaaaaaaaagaagaagcagcagaaagccgttagtggttccacgtgccacagtggagtgacatgtggatag

SEQ ID NO: 108723 - DNA, 1611 bp, Artificial Sequence
  Description of Artificial Sequence: Synthetic coding sequence
atgctattgctttgggtttccgtagtggccgcactggccttagcagtgctggctccaggggcaggcgagcagcgcagaagagcagcaaaggccccaaacgtggtgcttgtggtgtccgattccttcgatggacgcctcacattccatcctggcagccaggtagtcaagctgccattcatcaactttatgaagactagaggcacctcattcctgaacgcttacacgaatagtccgatctgctgcccctcccgggctgctatgtggagcggcttatttactcacctgaccgagtcatggaacaatttcaaagggctcgacccgaattacacgacttggatggatgtcatggagagacatggttataggacccagaagttcgggaaactggattatacctcagggcaccatagcatttctaatcgggtggaagcctggactcgcgatgttgctttcctgttacggcaggaaggtcgccccatggttaatttaatcagaaatcgtaccaaggttcgggtcatggagcgggattggcagaacacagataaagctgtcaactggcttcggaaagaggcaataaactacacagaacctttcgtgatctacctcgggctgaacctcccccacccatacccaagcccttccagtggggagaattttggttcttctactttccacacttctttgtactggctggagaaagtcagccacgacgcgatcaagatcccaaaatggtccccgctgtctgagatgcacccagtggactactattcatcttacaccaaaaattgtacaggtcggttcaccaagaaggagataaaaaacattagagctttctactatgcaatgtgtgccgagacagacgcaatgctcggggaaatcattcttgccctgcatcaactggaccttctacagaaaacaatcgtcatctattccagtgatcatggagagctcgcaatggaacatcgccaattttataaaatgtctatgtatgaagcctcagcccatgtgccattgttgatgatggggcccgggataaaggcgggtctgcaagtgtccaatgtggttagcctcgtcgacatatatccgacaatgcttgacatcgccggaataccccttccacagaacctgagtggatatagtctgctgcctctgtccagcgagacatttaagaacgaacataaggtgaagaacctccatccaccctggattctgtcggaattccatgggtgcaatgtgaacgcaagtacatatatgctgcgcacaaatcactggaaatacattgcctacagcgacggagcctctattctgccccagctcttcgatttgtccagcgacccagatgagctgacaaacgtggcagttaaattcccagagatcacctattcccttgaccaaaagctccacagcatcattaattaccccaaagtgtccgcttctgttcatcagtataacaaagagcagtttatcaagtggaagcagtcgatcggtcaaaattactctaacgtgatcgctaaccttcgctggcatcaggactggcagaaagagcccaggaagtatgagaacgctatcgatcaatggctgaagacccacatgaacccaagggcagtatag

SEQ ID NO: 108724 - DNA, 561 bp, Artificial Sequence
  Description of Artificial Sequence: Synthetic coding sequence
atgctgctcctgtgggtgtcagtggtcgccgcactggccctcgccgtactcgcacctggcgccggtgagcaacgacgcagagcagctaaggcccccaacgtggttcttgtcgtgtcagacagcttcgatgggcggttgacctttcaccccggctcacaggtagtgaagctcccgttcattaactttatgaagacgagaggtacttcattcctgaacgcttataccaactctccgatatgttgcccatcacgagccgccatgtggagtggcctgttcactcatcttactgaaagttggaacaatttcaaggggttggaccctaactatacgacctggatggacgtgatggagcgccacggctatcggacccagaaatttggtaagctggactacacatctggtcatcactctatctctaaccgggtggaagcatggactcgggacgtagcattccttctgcgccaggaaggtcggcccatggtgaacttaattcgcaatcgcactaaggtccgtgtaatggaacgggactggcagaacacagataaggcagtcacaggatag

SEQ ID NO: 108725 - DNA, 1275 bp, Artificial Sequence
  Description of Artificial Sequence: Synthetic coding sequence
atgtggggctgttgtgtgtgtggggctctgttcgaagggcagcgtttgcgcttacttagggcccctggggacggactgtccagcccgttcactgtggtttcacgtaagtggcacctcggacatcatggcagctaccacccaaacttccgagggttcgattattattttgggataccgtacagccacgacatgggatgtaccgacacccccggctataatcatcccccctgccccgcctgcccacagggtgacgggcctagtaggaatctgcaacgagattgttacaccgatgttgctctgcctctgtatgagaatctgaacatcgtggagcagccagtgaatctcagttctctggcccagaagtacgcagagaaagctacccagtttatccagagagcatctacaagtgggcgcccttttctgttatatgtggcgcttgctcacatgcacgtccccttacccgtcacgcagctgcccgccgctccccggggcaggtcattgtatggggccgggctgtgggagatggactccctggtagggcaaatcaaggataaggtggaccacaccgtgaaagagaacactttcctgtggttcactggagacaatggcccctgggcccagaaatgcgagctcgcagggtctgtggggcctttcactgggttctggcagaccaggcagggaggcagccctgccaagcagaccacctgggagggggggcatagggtcccggcactggcttattggccggggcgagtacctgtgaacgtgaccagcaccgccctgcttagcgtcctggatatcttccctactgtggtagcccttgcccaggccagcctgccccaggggcggagattcgacggcgtcgacgtgtcagaagtgctctttggacgctcacagccaggtcacagggtgctgtttcatcctaattctggcgctgctggagagtttggggcacttcagacagttagattggagcgctacaaggcgttttacatcacgggtggtgctcgggcttgtgatggcagtacaggaccagagctccagcataagtttcctctgattttcaacctggaggacgataccgcagaagccgtaccattagaacggggaggggccgaataccaggcagtcctgcccgaggttagaaaggtgctggccgacgtgctgcaggacatcgccaacgataacatttcttccgccgactatacccaggaccccagcgtgacaccttgttgtaacccttaccaaatagcctgccgctgccaggctgcatag

SEQ ID NO: 108726 - DNA, 1578 bp, Artificial Sequence
  Description of Artificial Sequence: Synthetic coding sequence
atgggttggctgttcctgaaggtgcttctggccggcgtttcattctccggtttcctctatcctctggtagatttctgtatcagtggcaagaccaggggccagaagcccaacttcgtaattatcttggcagacgacatgggttggggggatctaggagccaattgggctgaaacgaaggacaccgccaacttagacaaaatggcttccgaggggatgcggtttgtcgatttccacgcagcagcctctacatgttctcccagccgggcctcccttcttaccgggcgactgggactaagaaatggggtgactcgaaactttgcggtgacgtctgttgggggtttgcctctcaacgagacaactcttgctgaagtgctgcaacaagctggatatgtgacaggcattattggtaagtggcatttgggccatcacggatcataccatcctaattttcgaggtttcgattactactttgggatcccctattcccatgatatgggctgcacagacacgcctggttacaatcaccctccctgtccagcctgcccgcagggtgacggccccagccgaaacctgcaaagggattgttataccgatgttgccttgcccctctacgagaacctgaacattgtcgaacagcccgtgaacttgtcaagcctggcacagaagtatgctgaaaaggcgacccagttcattcagcgagcgtccacttccgggcgcccctttctcctgtacgttgcattggcacacatgcacgtgcccttgcccgtgacccagctgccagccgcaccaagggggcgctctctgtacggcgctggcctttgggagatggatagtctggtgggacaaattaaagacaaagtcgaccacaccgtgaaggaaaatacctttctttggtttacaggcgataacgggccatgggcacagaaatgcgagctggccggttccgtgggacccttcaccggattttggcagacccgacaaggcggcagccccgcaaaacagacaacctgggagggtggacaccgagtgccggcactcgcttattggccggggcgagttccagtcaacgtcaccagtaccgctttgctcagtgtgctcgacatcttccctactgtcgtggcgttagcccaagcgagtctgccacagggccgccgattcgatggcgtcgacgtttccgaggtcctgtttgggaggtcccagccaggccatcgcgtgctgttccatcccaactctggagccgccggggaatttggcgccctacaaacagtaagactcgagcggtataaagctttctacatcacaggcggggcaagagcttgcgacggctcaactggcccagagctgcaacataagttcccactcatttttaatctagaggatgataccgccgaggccgtcccactggaaagggggggagctgagtaccaggccgtgcttccggaggtgagaaaagtattggctgatgtgcttcaggatatcgcaaatgacaacattagctccgctgattatactcaggatccttctgttaccccttgctgtaacccctaccagatagcctgtcgttgtcaggctgcttag

SEQ ID NO: 108727 - DNA, 747 bp, Artificial Sequence
  Description of Artificial Sequence: Synthetic coding sequence
atgacaaagacctccacctgcatctatcactttcttgtcctgagttggtacaccttcctcaattactacattagtcaggaaggaaaggacgaggtaaaaccaaaaatactggcaaacggagcccgctggaaatatatgacactgctgaatttgctgaagaaccgaaccgccggcttcgatatttatcaaccaggttcattcaggcagctgcttcagaccatattttacggcgtgacctgcctcgatgacgtactcaagaggaccaaaggaggtaaggacatcaagttcctgacggcctttagggatttgctgttcactactctcgcctttccggtcagcacatttgtattcctcgccttttggatacttttcctgtacaaccgagacctgatatatccaaaagtgctggatacagtcattcctgtttggctaaaccacgcaatgcacaccttcatattccccattactctagcggaagtggtgttgcggcctcattcctaccctagtaagaagactggcctgaccctgctggctgctgcctccatcgcatacatttctcgcatcctgtggctgtacttcgaaaccggaacctgggtgtaccccgttttcgcaaagttgagcttactgggtcttgccgcctttttctctctgtcttacgtgtttatcgctagcatatatctattaggtgagaaactcaaccactggaagtggggggatatgcgacagcccagaaagaagcgcaaatag

SEQ ID NO: 108728 - DNA, 609 bp, Artificial Sequence
  Description of Artificial Sequence: Synthetic coding sequence
atggcaaaggtgtctgtattgaacgtggctgtgctcgaaaatccctcacccttccactctccctttaggtttgagatctccttcgaatgttccgaggctttggccgacgatttggaatggaagatcatctacgtgggctctgctgagagcgaagagtttgatcagattctggacagcgtgctggtcggccctgtgcccgcgggccggcatatgtttgtcttccaagccgatgccccaaacccctcgctgatcccagaaaccgacgccgtgggagtgacagtcgtgctgatcacctgtacgtaccacggacaggaattcattcgggtgggctattacgtgaataacgagtatttaaacccggaattgagggagaaccccccaatgaagcctgatttctcccaactgcagcgcaatatactggcgagtaacccgagggtgacccggttccacatcaattgggataacaacatggatagattggaagccatcgagactcaggacccaagccttggctgtgggctgccactgaactgcactcctattaagggattgggattgccaggatgcatccccggtctgctgccggagaactccatggattgcatttag

SEQ ID NO: 108729 - DNA, 1506 bp, Artificial Sequence
  Description of Artificial Sequence: Synthetic coding sequence
atggatactcaggccggaagtgtcgacgaagagaacgggcggcagcttggcgaggttgagctgcagtgcggcatttgcaccaaatggtttacagcagacacttttggaattgatacgtcttcttgcctcccatttatgactaattatagtttccactgcaatgtctgtcatcattccggcaacacgtatttcctgaggaagcaggcgaacttgaaggaaatgtgtctaagtgccttagcaaacctgacctggcaatccagaacccaagacgagcatcccaagacaatgttctccaaggataaggatattatcccgttcatcgataagtattgggagtgtatgacaacgcgccaacgcccaggcaagatgacttggcctaacaacatcgtgaagactatgagcaaggagcgcgacgtatttttagtcaaggaacatccagatccaggatcaaaggaccctgaagaagattacccaaaattcggcttgctcgaccaggatcttagcaacattggtcccgcctatgataaccaaaagcagtcttccgctgtttctacatcaggaaatctcaatggggggatcgccgctggcagtagcggcaaaggacgaggggctaagcgaaagcagcaggacggcggcacaacaggaaccacgaagaaagcccgatctgaccccctattctccgctcagcgacttcctcctcacggctaccctttggagcacccatttaacaaggacggctacagatatatcctggccgagccggatccccatgctcctgatccggagaagcttgaacttgattgctgggccggcaagccaattcccggggacctctatcgcgcttgcctttacgaacgagtgctgcttgccctgcatgatcgagcaccacaacttaaaattagtgacgacaggctcaccgtggtaggagagaaggggtacagcatggtaagggcatcccatggcgtgaggaaaggggcctggtatttcgaaattaccgtagatgaaatgccacctgatactgccgcccggctaggatggtcccaaccgcttggcaaccttcaggcgcccctgggctatgacaaattctcctactcctggaggtcgaaaaaggggacaaaattccatcaatccatcggcaagcattacagcagtggatatggtcagggagatgtgctgggcttctacattaatctacctgaggatacggaaacggcaaaatctctaccagatacctacaaggataaggctctgatcaagttcaagtcgtatctctactttgaggagaaagactttgtggacaaggctgaaaaaagtctgaagcaaacacctcacagcgaggtgtcaatcaatttcggaccctgtttcaaatatccgcctaaagacttgacatatcggcccatgagtgatatggggtggggcgcagtcgtagagcacactctcgccgatgtcctatatcacgtggagacagaggtggacggaagacgttctcccccctgggagccttag

SEQ ID NO: 108730 - DNA, 1887 bp, Artificial Sequence
  Description of Artificial Sequence: Synthetic coding sequence
atggcggccgctggtgccggccccggacaggaggccggtgccggccccggtcccggagcagtggcaaatgcaacaggcgccgaagagggcgagatgaagcctgtcgctgctggggccgccgcccctcccggggagggtatctccgcagccccaactgttgaaccaagctcaggggaggcagaaggcggcgaggctaatctcgtggatgtgagtggaggcctggaaactgaatcttctaacggtaaggatacactggagggagccggggacaccagtgaggtgatggatactcaggctggtagcgtcgatgaggaaaacggaaggcaactgggagaggttgagcttcagtgcggcatttgtaccaaatggttcaccgccgatacctttggcatcgatactagctcttgtctcccattcatgacgaactattcatttcactgcaatgtctgccaccactccggcaatacgtactttttacgtaaacaggcaaatctgaaagaaatgtgcttgtcggccctcgctaacctgacgtggcaatcccgtacacaggacgaacacccaaagactatgttctcaaaagacaaagatattatcccttttatagacaaatactgggagtgtatgacaacccgtcagaggcccggaaagatgacatggcccaacaatatcgtcaagactatgagtaaggagcgggacgtgttcctggtgaaggaacacccagaccctggctccaaagaccctgaggaagattaccctaagttcggccttctggatcaggatctgagcaacatcggccccgcatacgacaatcagaagcagagcagtgcagtgtctacaagtggcaatttgaatggcgggatagcagccgggagctctggaaaggggaggggagccaagagaaagcaacaggacgggggcacaacagggacgactaaaaaggccagaagcgatcctctgtttagcgctcagcggcttcctcctcatgggtatccactggagcatcctttcaataaggatggctatcggtatattctcgccgagcctgatccccatgctccagaccccgagaaacttgagctggactgctgggccggtaagccaatccccggggacctctacagggcatgcctgtacgaacgcgtcctgttagctcttcacgaccgggccccccaacttaagatttctgacgatcggttgacggtcgtgggcgagaagggttacagcatggtcagagcatctcacggggtgaggaagggcgcctggtactttgagatcacagtcgacgagatgcccccagatacagccgcacggctgggctggtcgcagcctctgggcaacctgcaggcccctttagggtacgacaaattttcatactcctggcgctccaaaaaggggaccaaattccatcagtctatcggaaaacattactcctcaggctacggccagggtgacgtcttgggcttctacattaatctccccgaggatacagagaccgctaaatctttaccggacacgtataaagataaggccttaataaagtttaagagttacttgtattttgaagagaaggatttcgtggataaggccgagaaatccctgaagcaaactccccattccgagatcatcttttacaagaacggtgtgaaccagggtgtggcgtacaaggacatcttcgagggggtatactttccagcaatatcactctacaagtcttgtacagtgtccattaattttggtccatgtttcaaataccctcctaaggatttgacgtatcgacccatgtctgacatggggtggggagcagtggtggaacatacactggctgatgtgctgtatcatgtcgaaactgaagtggacggtaggaggtctccaccttgggagccatag

SEQ ID NO: 108731 - DNA, 1605 bp, Artificial Sequence
  Description of Artificial Sequence: Synthetic coding sequence
atggacacgcaggccggaagtgtcgatgaggagaacggtaggcagctgggcgaagtggaactgcagtgcgggatttgcacaaaatggttcactgcagatacattcgggatcgacacctcctcatgcctacctttcatgaccaattatagctttcattgcaatgtctgtcaccactctggaaatacctatttcctccggaaacaagcaaatctgaaagagatgtgcttgtccgctttagctaacctaacctggcagtcacgcacccaggacgagcacccaaagaccatgttctcaaaagataaggacataatcccctttatagataagtactgggagtgcatgacaaccagacagcgtccaggaaagatgacctggccgaacaacatagttaagaccatgtccaaggagcgtgatgtgttcctggtgaaagagcacccggatcccgggtcaaaggacccagaagaagactacccaaaatttggactactggaccaggacctgtcaaacatcggccccgcatatgacaatcagaaacagtctagtgcagtaagcaccagcggcaatctcaatggagggatagcggccggcagcagtgggaaaggtcggggcgccaagcgcaagcagcaggatggcggaacaacggggacaactaagaaagctcgtagtgatcctctgttcagtgcacaacgcctgccacctcacgggtatcctcttgagcatccttttaataaagatggatatcgatacatcctcgctgagcccgatccacatgcaccagatccagagaagcttgagctggattgctgggccgggaaacctatcccaggggacctgtatcgggcttgcctgtacgagcgcgttctgctagcactccatgatcgggctcctcaactgaaaatctctgatgacaggctgactgtggtgggcgagaagggctactcaatggtgagggcttctcacggcgtgcgtaaaggagcttggtatttcgagattaccgtggacgaaatgcccccagataccgccgcacggctgggatggtctcagcccctgggcaacctgcaggcgcctctgggatacgacaaattcagttatagttggcgctctaaaaagggtacgaagttccatcagagtattggtaaacactactcaagcggctatggtcagggcgacgtgctaggcttctacatcaatctgcccgaggacaccgagacagccaaatcactacccgatacctacaaagacaaggccctcattaagtttaaaagttatttgtattttgaagaaaaggattttgtggacaaggcagaaaaaagcctgaagcagacacctcactctgagatcatattttacaagaatggagttaatcagggagtggcctacaaagatattttcgagggcgtatactttcccgcaattagtttgtataagtcctgcacggtctccattaattttggcccatgcttcaagtatcctcctaaggacctgacttacagacctatgagcgacatggggtggggtgccgtcgtggagcacacactcgccgacgtgctataccatgtggaaaccgaggtcgacggacgacgcagccccccctgggagccctag

SEQ ID NO: 108732 - DNA, 1506 bp, Artificial Sequence
  Description of Artificial Sequence: Synthetic coding sequence
atggacactcaggctggtagcgtggacgaagaaaacggcaggcagcttggcgaggtcgagctgcagtgcggcatttgtaccaagtggttcaccgctgacactttcggaatcgatactagttcctgtctcccctttatgacaaattactctttccactgcaatgtgtgccatcactctgggaacacatatttcctgagaaagcaggccaacctgaaggaaatgtgtttgagcgccctagcaaacctcacatggcaaagtcggacacaggacgagcaccccaagacaatgtttagcaaagataaagacatcatcccctttatcgataaatattgggaatgtatgaccacccgccagcgcccggggaaaatgacgtggccaaataatattgtcaagacaatgtccaaagagcgcgatgtgttcctggtcaaggaacatcccgatcccggctcaaaagacccggaagaggactatccaaagtttgggctcctcgatcaggacctcagcaatatcggccccgcttacgacaatcagaagcagtcaagtgccgtgtctactagcggtaatctgaatgggggtattgccgctggaagctctggaaagggcagaggagctaaacgcaaacaacaggacggagggactaccggaaccaccaagaaggcaagaagcgaccccctattttccgcacaaaggctgcccccgcacggatatccattggagcacccatttaataaggatgggtacagatacatcttggcggagccagatccacatgccccggatccagaaaaactggaactggactgctgggccggaaagcccattcccggcgatctgtaccgggcatgtctatatgagcgcgtcctactagcccttcacgatagggccccccagctgaagatatccgatgatagactgaccgtcgtgggcgaaaaaggctacagcatggtgcgggcatcccatggagtgaggaagggagcttggtattttgaaatcacagtcgatgaaatgccccccgatacagccgcgcgcctgggttggagccaacctttggggaacctgcaggctcctctagggtacgataagttcagttattcatggagatctaaaaaggggactaagttccatcagtccattggaaagcattatagttcaggatatgggcaaggagatgtccttggtttttatattaatctccccgaggacacggagacagctaaaagcctacctgacacttacaaggacaaagcactgatcaaattcaagtcttatctttattttgaggaaaaagacttcgtggataaagctgagaaaagtctgaagcagaccccccattctgaagtaagcataaacttcggcccttgttttaaataccctccgaaagatctcacgtataggccaatgagcgatatggggtggggcgcggtggtggaacacactcttgctgacgtgctgtaccatgtcgagactgaagtggatggacggcgcagccctccctgggagccttag

SEQ ID NO: 108733 - DNA, 1470 bp, Artificial Sequence
  Description of Artificial Sequence: Synthetic coding sequence
atgaccaactatagttttcattgtaatgtgtgccatcactcagggaacacctacttccttcgcaagcaagctaatctcaaagaaatgtgcctctcagccttagcaaacctaacatggcagtcccgcacgcaggatgagcatcccaagaccatgttttctaaagataaagacataattcctttcattgataaatactgggagtgcatgaccacacgccaacgcccgggaaagatgacatggcctaataatatcgtaaaaactatgtccaaggagagagacgtttttctggttaaggagcaccctgatccgggatccaaggatcctgaagaggattaccccaagtttgggctgctcgatcaggacttatctaatatcggccctgcatacgataaccagaaacaaagctccgcagttagcacttcaggaaatctgaacggtggcatcgccgctggttcatccgggaaaggcaggggggcgaagagaaaacaacaggatggcggcaccactggaaccaccaagaaggctcgctctgacccgctgttctccgcacagcgcctgccgccccatgggtatcccctcgagcacccgtttaataaggatggatatcgttatattcttgcagagcctgatcctcatgcccccgacccagaaaaactggaactggattgttgggctggcaagcccatccccggggacctgtaccgtgcttgcctctatgagcgagtcctgcttgcattacatgatagggcgcctcagctcaagatttccgacgatagacttactgtggtcggtgaaaagggttatagcatggtgcgggcttctcatggcgtaaggaagggagcttggtatttcgagatcactgtggatgagatgccccccgatacagccgcacgattggggtggtcccagcctctggggaatctccaggccccattgggatacgataaattcagttatagctggaggagcaagaaagggacaaagttccatcaatcgatcggcaagcattattctagcggctacggccagggggatgttttggggttttacataaacctccccgaggacaccgaaaccgcaaagagcctccctgatacctacaaagataaggcactgatcaaattcaaaagctatttgtactttgaggagaaagactttgtggacaaagctgaaaagtccctcaaacaaaccccgcattccgagattatcttctataaaaatggcgtgaatcaaggagtagcttataaggatattttcgaaggggtctatttcccagccatctccttatacaaaagttgcactgtatcgattaattttgggccctgctttaaatatccgcccaaggaccttacgtaccgccccatgagtgacatgggatggggagccgtcgtcgagcacaccttggcagatgtcctctaccatgtggagaccgaggtggacggccgtcgtagtcctccctgggaaccctag

SEQ ID NO: 108734 - DNA, 876 bp, Artificial Sequence
  Description of Artificial Sequence: Synthetic coding sequence
atgaccaaggagtaccaggacctccagcacctcgacaacgaagaaagcgaccaccatcagctgaggaaaggtcctccgcccccacagcctctgctccagcgcctctgttctggccccagactgctgctgctatcgctaggtttatccctactgttgctagttgtagtgtgtgttatcggcagccaaaacagccaattgcaggaggaactgagaggcctgagggagacgttcagcaacttcactgccagtactgaggcacaggtcaagggactatcaacgcagggaggcaatgttggaagaaagatgaagagcctcgagtcccaattagaaaagcagcagaaagatctgtccgaggaccactcctcactgctcctgcacgtcaaacagtttgtttccgacctccgctctttgtcttgccagatggccgctttgcagggtaacggctccgagcgcacctgttgccctgtgaactgggtggagcatgaaagaagctgctactggttcagccgatcagggaaggcttgggctgacgctgacaactactgtcgtctggaagacgcccacttagtggtagttactagttgggaggagcaaaaatttgttcagcatcacatcgggcccgtcaacacatggatgggcctccatgatcagaacggcccctggaagtgggttgacggaacagactacgagaccggtttcaagaactggcggccagaacaacctgatgattggtatggacatggcctgggcggaggggaagattgcgcccatttcacagatgacggaaggtggaacgacgatgtgtgccaacgaccctaccgttgggtgtgcgaaacagaattagacaaagcctcccaggagccccctttgttatag

SEQ ID NO: 108735 - DNA, 759 bp, Artificial Sequence
  Description of Artificial Sequence: Synthetic coding sequence
atgactaaggaataccaggacctgcaacacttagacaacgaggaaagtgaccatcaccaacttagaaaagacagtcagttgcaggaggagctgcgaggcctcagggaaacattttctaacttcaccgcgtctacagaagcacaagttaaggggttatcgacccagggtggaaatgtcggccgaaagatgaaaagtctagaaagtcagctagaaaagcaacagaaggaccttagtgaagatcattcgagtttgctgctccatgtaaagcaattcgtttctgacctgaggtccttgagttgtcagatggccgcacttcagggaaatggttccgaaagaacctgctgtcccgtaaactgggttgagcatgaaaggagctgctactggttctctaggagcggcaaggcttgggcggacgccgacaattactgcaggctcgaagacgcacatcttgtcgtggtgacttcctgggaggaacagaaattcgtgcaacatcatattggtccagtcaacacgtggatgggcttgcacgaccagaacggcccatggaaatgggtagacggtactgattacgagactggcttcaagaactggaggcccgaacagccggatgattggtacggccatggcctgggtggtggggaggattgcgctcactttaccgacgacggtaggtggaatgacgatgtgtgccagaggccgtaccgctgggtttgcgagacagagttggacaaggcctcccaagagccaccgttgctgtag

SEQ ID NO: 108736 - DNA, 759 bp, Artificial Sequence
  Description of Artificial Sequence: Synthetic coding sequence
atgactaaggaataccaagatttacagcacctagacaacgaggagagcgaccatcaccagctgcggaaggacagccagctccaggaggagctcaggggtcttcgggaaacttttagcaattttactgcaagcacagaggcccaagtgaaggggttgtcaactcagggtgggaacgtcggccgcaagatgaagtcattagaatctcagcttgagaagcagcagaaggacctttcggaagatcatagctcgctgctcctgcatgttaagcagtttgtaagtgatctccggagcctctcctgccagatggctgccctccagggtaacggctctgaacggacatgttgccctgttaactgggtggaacacgagcggtcctgctactggttctctcggtccgggaaggcctgggctgacgctgataactattgcagactggaggacgctcatctggttgtcgttacgtcttgggaggagcagaaattcgtgcagcaccatataggtcccgtcaacacctggatggggctgcacgaccaaaacggcccctggaagtgggtggacggcactgactacgaaacggggttcaaaaactggaggcccgaacagcccgacgattggtacggacatgggctcggcggcggggaagactgcgcccacttcacagatgatggcagatggaacgatgatgtttgtcagcggccgtacagatgggtgtgcgaaaccgaactcgataaggcgtcgcaggagcctccgctgctctag

SEQ ID NO: 108737 - DNA, 5679 bp, Artificial Sequence
  Description of Artificial Sequence: Synthetic coding sequence
atggctaatcgacgcgtgggccggggctgttgggaagtcagtcctactgagcgcaggccacctgctggcctcagggggcctgcagccgaagaagaggcgtccagtccaccggtgttaagtttgagccacttctgtaggtctccctttctttgctttggtgatgttctattaggcgcttccagaactctctccttagcgctggataatcccaatgaggaagtggcagaagttaagatctctcacttccctgcggccgacctgggatttagtgtgagtcagcgatgttttgtccttcagcccaaggagaagatagtgatcagcgtgaattggactcctttaaaagaaggacgtgtgagagagataatgacctttcttgtcaacgacgtgcttaaacaccaagcaatcctgttgggtaatgccgaagaacaaaagaagaagaaacggagcctgtgggacaccatcaaaaagaagaaaatctctgccagtacatcccacaatagacgggtatccaacattcaaaacgtcaataaaaccttcagcgtgagtcagaaagttgaccgggtgcggagcccattgcaggcgtgtgaaaacttagcaatgaacgaaggcggtccccctactgaaaacaactcccttatccttgaggagaataagattccaatttcacccatctcaccagcttttaacgagtgtcatggagccacgtgcctccctctatccgttagaaggtccaccacctactcgtctctccatgctagtgagaacagagaactgctgaatgtgcacagcgccaacgtatccaaggtgtcctttaacgaaaaagcagttaccgagacttcatttaactctgtgaatgtgaacggacaacgcggcgaaaactctaaactgtccctaacgcccaactgcagctccacattaaacatcactcaaagccaaattcactttctatcgcccgattcatttgtgaataactcacacggggccaataacgagctcgagctagtgacatgcctgtccagcgatatgtttatgaaggataatagccaacccgtccatttggaaagcaccatcgcccacgagatctatcaaaagattctttcacccgactcatttattaaagataattatggactcaatcaggacctcgagagcgagtccgttaatccgattctctcccccaatcagttcctgaaggacaacatggcctacatgtgcacgtcccagcaaacttgtaaagtcccgcttagcaacgagaattcgcaagtaccacagtcacctgaagactggagaaaaagtgaggtgtcaccaaggatccccgagtgccagggttcgaagtcacctaaggcgatatttgaggagctcgtagaaatgaaaagcaactattattcctttatcaagcagaataatccgaagtttagcgctgtacaggatatttccagtcacagccataacaagcaacctaaaaggcggccaattttgtctgctacagtgactaagagaaaggctacatgtacacgggagaatcagaccgagatcaacaagccaaaggctaaaaggtgcctgaattccgcagtgggtgaacatgaaaaggtcatcaacaaccaaaaagagaaagaggatttccattcttacttacccatcatagaccctatcctgtctaaaagcaaatcctataaaaatgaggttactcccagcagcacaacagcttccgtggcacggaaaagaaagtctgatgggtcaatggaagacgccaacgtgagagtggcaatcacagagcatactgaagtgcgggagattaaacgtattcacttctccccttccgagccaaaaacttctgccgtcaagaagactaaaaatgtgaccactcctatctccaaacggattagcaacagggaaaaactcaacctgaaaaagaagactgacctttccatattccggacaccaataagcaagacaaacaaaagaaccaagcctattatcgctgtggcgcaatctagcttgacctttattaaaccactaaagactgatatccccaggcatcctatgccattcgcagctaagaatatgttctatgacgagaggtggaaggaaaaacaggaacagggtttcacctggtggttaaatttcatcctgactccagatgacttcactgtcaagacgaacatctccgaagtcaacgccgctacccttctcttagggatcgagaaccagcacaagatctctgtgcctcgggccccaacaaaggaagagatgagccttcgcgcatacacggcaaggtgtcggcttaatagactaaggagggcggcgtgcaggctgtttacaagcgagaagatggtgaaggcaataaagaagttggagattgaaattgaagctcggaggctcattgtgcgtaaagaccggcatctctggaaggatgtgggggaacgccagaaggtactgaactggttgctgagctataatccgctgtggctccgtataggccttgaaactacatatggcgagctaatctctctggaggacaactccgatgtaactggtctcgccatgttcatattaaatcgtctgctgtggaaccctgatatcgccgccgagtacagacaccccactgtacctcatttatatagggacggacacgaagaggccctttccaaatttactcttaagaagctactgttactcgtttgcttcttagactacgccaaaattagtagactgatcgaccacgatccgtgtctgttttgtaaagacgcggagtttaaagcaagtaaagaaatactccttgcattctccagggatttcctgtccggggaaggtgatctttcacgtcatctcggattactcggcctccccgtgaaccacgttcagaccccatttgatgagttcgactttgccgtgacaaatttggcagttgaccttcagtgcggtgtgcgactggtgcggaccatggagctcctaacgcaaaactgggacctgtccaaaaaactgaggattccagctatcagcaggcttcaaaaaatgcataatgtggatatagtcctccaggtgctcaaatcccgggggatcgagctgtcagatgaacacgggaataccattttgtctaaagatatcgtagaccgccatcgcgagaagacattgaggttattgtggaaaatcgcatttgcctttcaagtggacatctccctgaacctagatcagttgaaagaggaaatcgcctttctgaaacatactaagagcattaaaaaaaccatttctctactatcatgccacagcgatgaccttatcaacaagaaaaaagggaaacgggactctggaagcttcgagcagtattccgagaatataaaactcctcatggactgggtgaacgccgtctgcgcgttctacaacaagaaagtggagaatttcacagtgtcctttagcgacggccgggtcctgtgttatctgattcatcattatcatccgtgttatgtacctttcgacgcaatctgtcagcggactacgcaaacagttgagtgtacccagacaggtagcgttgtgctgaatagttctagcgagtccgacgattcaagcctcgacatgagccttaaggcttttgaccatgaaaacacaagtgagctctataaagagctgctagagaatgaaaaaaaaaacttccacctggtccgctccgcagttcgggacctgggcgggatccccgccatgataaaccactcggacatgtccaacaccattccagatgagaaggtggtgatcacgtatctgagtttcttgtgcgcacgtctgctggatttgaggaaggaaatcagagccgcaagacttatccagacaacatggcgcaaatacaagttgaaaacagatctcaagcgccaccaggagcgagaaaaagccgcccgaatcattcagctggccgttatcaactttcttgccaagcagagacttagaaagcgtgtgaacgccgccctggttattcagaaatattggaggcgggtgttagctcagcgcaaactgcttatgctgaagaaagaaaagctagagaaagtgcagaacaaagctgccagcctcattcaagcaatgtggagaagatacagagctaagaaatacctgtgcaaggttaaagctgcttgtaagattcaggcttggtatcggtgctggcgggcgcacaaagagtacctggcaattctgaaggcagtaaagatcattcagggatgtttctacactaaattggagcggacaagattcctgaacgtgcgtgcgtctgcgattattatccagaggaagtggcgagccatactgcctgctaagattgcgcacgagcactttctcatgatcaaacggcatcgcgccgcttgtcttatccaggcccactataggggatacaaaggccggcaggtgttcctgcggcaaaagagcgcagccctgattatccagaaatacataagagcgcgcgaggcgggtaagcacgagagaatcaagtatattgaatttaagaagtctactgtgattctccaggctttggtgcgtggatggcttgtgaggaaaagatttctggagcagagggccaagatccggttattgcacttcaccgccgctgcatactaccacctgaacgcagtaagaatccagcgcgcctacaagctatatctcgctgtcaaaaatgcaaataagcaggtgaactcagtgatttgtattcagcgatggttcagagcccgcttgcaggagaaacggtttattcagaagtaccattcaatcaagaagatcgaacacgagggccaagaatgcctgtctcagaggaatagggcggcatccgtgattcaaaaagccgttcggcactttcttttgcgcaagaagcaggagaagtttacctcgggaatcataaaaattcaggcgctgtggagaggttactcctggcgcaaaaagaacgactgtaccaagataaaagccattaggctgagtctccaggtagtgaatcgggagattcgcgaagagaacaagctctacaagagaaccgcactggctctgcattatctgttgacctataaacacctaagtgccattctggaggccctcaagcatttggaagtggtcaccagactttcccccttatgctgtgaaaacatggctcagagcggggcaatcagtaagatattcgtgctcatcagaagctgtaacagatcaatcccatgcatggaggtcatcaggtacgcagtgcaagtgttgctgaatgtgagcaagtatgaaaagaccaccagtgcagtgtacgatgtcgagaactgcatcgatatcctcctggagcttctgcagatctacagggaaaaacctggtaacaaggttgcggataagggcggaagcatattcacaaaaacttgctgcctgctcgccatcttgctcaagaccaccaatagggcttctgacgtgcgctcccgctcaaaggtggtagatcgaatttactccttgtacaagttaacagcgcacaaacacaagatgaatactgagaggatactgtataagcaaaagaaaaacagcagcatttcaatccccttcatccccgagaccccagtccgcacgcggattgtgtcgaggttgaagcccgactgggtactgcgaagggataacatggaagaaataacaaaccccctccaagctatccagatggtcatggatactttgggaatcccctattag

SEQ ID NO: 108738 - DNA, 4170 bp, Artificial Sequence
  Description of Artificial Sequence: Synthetic coding sequence
atggcgaaccgacgggttgggagggggtgttgggaggtatctccaacggagaggcgaccacctgccgggctgagggggcccgcagctgaggaagaagcaagcagtccccctgttctatctctgagccatttctgcagaagccctttcctatgtttcggagatgtgctgctgggggcgtccaggacccttagcttggctttagacaaccctaacgaggaagtggctgaggtcaaaatcagccatttccctgctgcggacctgggattcagcgtctcccagagatgcttcgtcctgcagccaaaagaaaaaatcgtcatcagcgtcaattggactcccctgaaggagggaagggtgagagagatcatgacttttcttgtaaatgatgtgctcaagcaccaggccatactgcttgggaacgccgaggagcagaagaagaaaaaacgctctctatgggacaccattaagaagaaaaagatcagcgccagcacaagccacaatcgccgcgtgtctaacatccaaaatgtaaacaaaactttttcagtttcgcagaaagtggaccgccgataccggcaacaaacctatttcaacaaactcaagaagatcacaaagacagtgcagcagagatattgggccatgaaggaaaggaacatccaattccaaaggtacaataagctcagacatagtgtcatttatatccaagctattttcaggggcaaaaaggcacgtaggcatcttaaaatgatgcatatcgccgccaccctgatccaacgtcgtttcaggactctcatgatgcggcgtaggtttctctctctgaagaagaccgccatccttattcagcggaaatatcgtgcacacctgtgtacaaagcatcacctccagtttctgcaagtgcagaatgccgttatcaagattcagtcttcgtacaggcgatggatgataagaaagaggatgcgcgagatgcacagagccgccacctttattcagtcaacctttcggatgcaccggctccacatgagataccaagccctgaagcaggcttcagtagtgattcagcagcagtaccaggcgaatagagccgctaaactgcagagacagcactatctgcgacaacgccattctgctgtgatactgcaggctgcgttcagggggatgaagacgcggcgtcatcttaagtcaatgcacagcagcgctacactgatccagagcagattcaggtctctcctcgtcagaagacgcttcataagccttaagaaggcgacgatctttgtccagaggaaataccgtgctactatttgcgccaagcacaaactgtatcagttcctccacctcaggaaagcagcgattaccatacagagtagttataggcgccttatggtgaagaaaaagctccaggaaatgcaacgcgctgccgtgctgattcaggccacctttcggatgtaccgaacctacatcaccttccagacctggaaacacgcttctattctcatacagcagcactataggacctaccgcgcagctaagctgcaaagagaaaattatatccggcagtggcacagtgccgtggtgattcaggcagcatataagggcatgaaagcccgacagctcctcagagaaaagcacaaggccagtatcgtcatacagtctacttacaggatgtatcggcagtactgcttttatcagaaactacaatgggcaacaaaaatcatccaggaaaaatatagggcaaataaaaaaaagcagaaagttttccagcacaatgaactcaagaaggagacttgcgtgcaggcaggcttccaagatatgaatatcaagaagcagatccaagaacagcatcaggcggctataataatccagaagcattgtaaagccttcaaaattcgcaagcactacctgcacctccgggccactgtggtctctatccaaagacggtacagaaaactgaccgccgtgcggacccaggctgtgatctgcattcaatcgtattatcgggggtttaaagtccggaaagacatccaaaatatgcatcgcgcagccaccctgatacagtctttctataggatgcacagggccaaagtagactacgagacaaaaaagacggctatagtggtgatacagaactattacagactgtacgttcgtgtgaagactgagaggaagaacttcctcgctgtgcagaaatcagttagaactatccaggctgccttccgaggcatgaaggtgagacagaagctcaaaaatgtgtccgaggaaaagatggcagccattgtgaatcaatccgctttgtgctgttaccgttccaagacacagtatgaggcggtccaaagtgaaggagtgatgattcaagaatggtacaaggcatcagggctcgcctgcagccaggaagccgagtaccacagtcaaagcagagccgctgttaccatccagaaggccttctgtaggatggttacccgcaagctcgaaacccagaaatgcgctgcgctgaggatccagttttttctgcaaatggctgtgtaccggagacggttcgtgcaacaaaagcgggccgcgataacactgcagcactactttcgaacatggcagactcggaagcaattccttctgtaccgcaaagccgccgttgtcctgcagaatcactacagagcttttctttcagctaagcaccagaggcaagtttacctgcagatacgctcctccgtgattatcatccaggcacggtcaaagggatttattcagaaaaggaagttccaggagatcaaaaattccaccattaagattcaggccatgtggcgtagatatagagccaagaagtacctgtgcaaggtgaaggccgcatgcaagatccaggcctggtatagatgctggcgcgcacacaaagaataccttgctattttgaaggcggtcaagattattcagggctgtttttatacgaaactggagagaactaggttcctcaacgtacgcgcctctgctatcataattcagagaaagtggcgcgccatattgcctgctaagattgctcatgaacatttcctgatgatcaaacgccacagagcagcctgcctcattcaggctcactatcgcgggtataagggacgccaggttttcctccgccagaagtctgccgccttgataattcagaaatatatcagggctcgcgaagcaggcaaacacgaaaggatcaagtacatcgagttcaagaaaagcacagtcatcctacaggccctcgttaggggctggctggtcagaaagcgtttccttgagcagagggccaagattaggttactccattttacagcggcggcctactaccacctaaacgcagtgcgaattcagcgcgcctacaagctgtacctggcagtgaaaaatgccaacaagcaggtgaattcagtgatttgcatccagaggtggttcagagccaggctgcaggaaaaaaggtttatacaaaagtaccactccataaagaaaatcgagcacgagggtcaggaatgcctgagccagagaaacagagccgccagcgtaatacagaaagccgtaagacactttctcttacggaagaagcaggagaagttcacttctggtatcatcaagatccaggctctatggaggggatacagctggaggaaaaagaatgactgtactaagatcaaggccatcaggctgtcactacaggtggtgaaccgagaaataagagaggaaaacaaactgtataagaggaccgccttggcattgcactatctgctgacctataagcatctgtcagccattttagaggcgctcaaacacctggaagtcgttacccggctatctccactctgctgcgaaaatatggcgcagtctggagccatttctaagatcttcgtgctgattagaagctgtaataggagcatcccctgcatggaggtgattaggtatgctgtgcaagtcttattgaatgtgtccaagtacgagaagactacttcagcggtttatgatgtggagaactgtatcgatattctactcgaactgcttcagatctaccgtgagaaacccggcaacaaggtcgctgataagggcggatccatcttcactaaaacatgttgcctgcttgcaatcctgttaaaaacgactaatcgggccagtgtgagtatctcccagctgccttttttcaaaataattttcctgtggtcctag

SEQ ID NO: 108739 - DNA, 3429 bp, Artificial Sequence
  Description of Artificial Sequence: Synthetic coding sequence
atgtctctgcgtgcctacactgcgcggtgccgccttaatcgtttacgcagagcagcgtgtcgactgttcacttcagagaagatggttaaggccattaagaagctggagatcgaaattgaagctaggcgacttattgtgagaaaggatagacacctatggaaggacgtcggcgagaggcagaaagtgctgaactggctcctaagctacaacccgctgtggctgagaattggcctcgaaacgacctacggggagctcatcagtctcgaggacaactctgacgtaacgggccttgctatgtttattctgaatagactgctgtggaatcctgatatcgcggcggaatatagacaccctacggttccccacctgtatcgcgacggacatgaagaagcactgtctaagtttactttgaagaaacttctcctgcttgtctgtttcctcgattatgctaaaatctctcgcctaatagatcatgatccctgtctgttttgcaaagatgcggagttcaaagcgtccaaagagattttgttagctttctctagggacttcttgtctggagagggggatctgtcccgccacctgggcctgctgggactgcctgtcaaccatgtacagaccccctttgacgagttcgattttgcggtcaccaacttggctgtcgatttgcagtgtggcgtaaggttggtgcggactatggagctgctgacacagaactgggatctgtctaagaagttgcggattccggcgatttcgaggctccagaagatgcacaatgtcgatatagttttacaggtactgaagtctagaggtattgagctgagcgacgagcacggcaacaccattcttagcaaagatatcgtcgatagacatcgcgagaagaccctccgtctcctctggaagattgccttcgcttttcaagtggacataagcctgaacctcgaccagctcaaggaggaaatcgcgttcctgaagcatactaagtccattaaaaagacaatcagcctgctgtcatgccattccgatgatcttattaacaagaagaagggtaagcgggattctggcagcttcgagcaatatagcgaaaacataaagctgctgatggactgggttaacgccgtatgcgcattctataacaagaaagtggagaatttcaccgtgtccttttcagatgggcgggtgctctgctacctgatccaccattatcacccatgctacgttcctttcgacgctatctgccaacgcacgactcagacggtggaatgtacccagactggcagcgtcgtgcttaattcctctagtgagagcgacgatagctccctggatatgtcacttaaagctttcgatcatgaaaatacctctgaactgtacaaagagcttcttgagaatgaaaaaaagaattttcacctcgtgcgctccgctgtgagggaccttgggggcatccctgccatgataaaccactccgacatgagcaataccatccccgacgagaaagtcgtcattacctatctaagcttcctgtgtgctaggctgttggatctgcggaaggagatccgcgcagcacggcttattcaaaccacttggcggaaatacaagcttaaaacagacctgaaaagacatcaagagcgagagaaagccgctaggatcatccagctcgcagtgattaatttcctcgctaaacagcggctgcggaagagagtgaatgctgctttggtgatccaaaagtactggaggcgagtcctggcccagaggaaactgctgatgctgaaaaaagaaaaacttgagaaagtccaaaacaaagctgcctcactaatccaggctatgtggcgaagatacagggccaagaagtatctgtgtaaggttaaggcggcctgcaagatacaggcctggtatcgatgctggagagcgcataaagagtacctggcaatcttgaaagctgtgaaaattatccagggatgtttctataccaagctcgagagaacccgttttcttaacgtgagagcttctgcgatcattattcagcggaaatggagagccatactgccagccaagattgcgcatgaacatttcctgatgatcaaaaggcacagagcagcttgcctcatccaagcacactacagaggatataaaggacgccaggtattcctccggcagaagagtgcggccttgattattcaaaagtacatcagagcacgcgaggccggcaaacacgagcggatcaaatacatcgagtttaaaaaaagtactgtaatcctacaggcacttgtccgtggctggctagtgcgcaagcgctttctggagcagagggctaaaattcggcttttgcacttcacagctgcagcctattatcaccttaatgctgtgaggattcagcgggcgtataaactctacttggccgttaagaatgcaaataaacaggtgaactcagtgatctgtattcagcgctggttcagggccagactccaggagaaacgtttcatccagaagtaccattctattaagaagatcgagcatgaaggccaggagtgtctgtctcagaggaaccgagctgcttctgttatccaaaaggctgtgagacatttccttctgcgaaagaagcaagaaaaatttactagcggcatcattaagatccaggccctttggcgcggttatagctggagaaagaagaatgactgcacaaagattaaggcaattcgcctaagtctccaagtggtgaaccgcgagatccgggaggaaaacaagctatacaaaagaacagcactagcccttcactatctgctcacatataagcacttatccgccatcctggaagcactcaagcacctcgaagtggtgacccgtctgtcccctctgtgctgtgaaaatatggcccaatccggggctatctctaagattttcgtgctgatccgatcatgcaaccgatctatcccgtgtatggaggtgattaggtatgccgtccaggtgttgcttaatgtgtcaaagtacgagaagacaacaagcgccgtgtacgacgtcgagaattgtatcgacatattgcttgagttactgcagatttaccgtgaaaagcccgggaacaaagtagctgacaaggggggctccattttcacgaagacttgctgcctcctagcaatcctgctgaagactactaatcgggcctcagacgtgcgctccaggagtaaggtggtggacaggatttatagcctatacaagttgaccgcccataaacataaaatgaacacagagagaatcctctataaacagaaaaagaattcaagcatatcaatcccattcatcccggagactcctgtgcgcaccaggattgtgtcacgattgaaaccagactgggtcttacgccgcgataacatggaggagataacaaatccgctgcaggctatccaaatggttatggatacactcggcataccgtattag

SEQ ID NO: 108740 - DNA, 10434 bp, Artificial Sequence
  Description of Artificial Sequence: Synthetic coding sequence
atggccaacagaagggtaggaaggggctgttgggaagtttcccccaccgagcgtcggccccccgcgggcctccggggacctgccgctgaggaagaagcctcttcacctccagtgttatcactgtcacatttttgtcggtccccgtttctctgcttcggtgatgtcctccttggcgcttctagaacactgtctttggcactggacaatcctaacgaggaagttgctgaggtgaaaattagccacttccctgctgccgatctgggattttccgtttcacagcgttgcttcgtgctgcagccgaaggaaaagatagttattagcgtgaattggacaccacttaaagaggggagagttcgagagatcatgaccttcctggttaatgatgtcctgaagcatcaggctattcttctagggaatgctgaagagcagaagaagaagaagcgatccctgtgggataccatcaagaaaaaaaaaatatcagctagtacgtcccataacaggagggtttctaacatccaaaacgtaaataaaaccttttcagtgagtcaaaaagtagatcgggtgaggtcccccctgcaagcctgtgaaaacctcgcaatgaatgagggcggacccccgacggagaacaattcactgatactcgaggagaacaaaatccccatctcacccattagtcctgcttttaatgaatgccatggggccacctgtctgccccttagtgttcgtcggtctacaacttacagctcactacatgcctctgagaatcgcgagttgttaaacgtccatagcgctaatgttagcaaggtctctttcaatgaaaaggccgtaacagaaaccagcttcaactcagtcaatgtgaatggccaacggggggaaaattctaaattatccttaactcccaactgcagcagcaccctgaacattacccagtcacaaattcattttttgtcccccgattctttcgtgaataattcacatggcgctaacaacgagctggagcttgtgacctgcctgtctagcgatatgttcatgaaagataactctcagcccgttcacctcgagtccactattgcccacgaaatttaccagaaaatcctgtctcccgactctttcattaaagacaattatggactgaaccaggatttggaaagcgaatctgttaatcctatactgagccccaatcagttcctcaaggataacatggcatacatgtgcacctcccagcagacatgcaaagtcccattgagcaatgagaacagtcaggtgccccagagccctgaagactggaggaaatctgaagtcagcccccgcatacctgaatgtcaagggtccaaaagccctaaagcgatattcgaagagttggtcgagatgaaatcaaactactattcttttatcaagcagaataaccccaaatttagcgctgtgcaagatataagtagccacagtcataacaagcagccgaagcggcgaccaatcctgtctgccaccgttactaaacggaaggccacctgtacccgcgaaaaccagactgagatcaacaagcccaaagccaaaagatgtctgaacagtgcagtcggagaacacgaaaaagtgatcaataatcagaaggagaaggaggatttccacagctatttgcccatcatagaccccattctctcaaagtccaaaagctacaagaacgaggtcacaccatctagtaccacggccagtgttgctcgcaagaggaagagcgatgggagcatggaagatgctaacgtgagagtcgcaatcaccgagcatactgaggtccgggagatcaaaaggattcatttcagcccctccgagcccaaaacatctgccgtcaagaaaacaaaaaatgtcaccacgcctatcagcaaacgcatctctaaccgcgaaaagctcaacttaaagaaaaaaaccgatctcagcatcttcagaactcccatcagcaaaaccaacaagaggactaagcctatcatagctgtggcccagtcctctctcacattcatcaagccactcaaaactgacataccccgacacccgatgccttttgctgccaagaatatgttttacgacgagagatggaaagagaaacaagaacagggattcacctggtggctgaattttatcttgacgccggacgatttcaccgtgaaaacaaacatcagcgaagtgaacgccgccacacttttgttggggatcgagaatcagcacaagatctccgtacctcgtgcccccacgaaggaggagatgtcactgcgcgcctacactgcgagatgcagattgaaccgcctgagacgcgctgcctgtagactttttacctccgagaaaatggttaaggcgattaaaaaactggagatcgagatcgaggcaaggaggctgatagtgcggaaagacaggcatctgtggaaagatgtcggggagcgccagaaggtgctgaactggctgctgagttataaccctctgtggctgcggatcggccttgaaaccacgtacggagagcttatctcgttagaagacaactctgacgtaactgggctcgccatgtttatactcaataggttgctgtggaatcctgacatcgcagccgagtatcgccaccctacagttccacacctgtatcgggacgggcacgaagaggcactgtctaaatttaccctgaaaaagctgctgctcctagtctgttttctggactacgccaaaatttcacgcctgatagatcacgacccttgtctgttctgcaaagacgccgagtttaaggcctccaaggaaattctgcttgcgttttctagagatttccttagtggcgagggagacttgagtcgacatctagggctgttagggctccctgttaatcatgtgcagactcccttcgacgagtttgattttgccgtgaccaacttggccgtagatttgcaatgtggagtgagattagtacggacgatggagctcctcacgcaaaactgggatctatctaaaaaactgcggataccagccatttccagattacagaagatgcataacgtggacattgtgctacaggtcctcaagtcccggggaatagaactgtccgacgagcatggcaataccattttatcaaaggacattgtcgataggcacagagaaaaaaccctgcgtctgctttggaaaattgcctttgcattccaagtggacatatcactgaatttagaccaattgaaggaggagatcgccttcctgaaacacactaaaagcataaaaaaaacaatttcactgctgtcctgtcatagcgatgacctgatcaacaagaaaaaagggaagagagattccggctctttcgaacagtactccgaaaacatcaaactgctaatggattgggtcaatgccgtctgtgccttttacaacaaaaaggtcgaaaacttcacagttagcttttcagacgggcgggtcttatgctatctcatccatcattatcacccttgctatgttcctttcgacgcaatctgtcagaggaccacccaaactgtggagtgtactcaaacgggatctgtagttcttaatagtagctcagaatccgatgactcatctttagacatgtccttaaaagcatttgaccatgagaataccagcgagttatataaggaactgcttgaaaatgaaaagaaaaacttccatctagtccgctctgccgtgcgcgacctcggtggaattcccgcaatgatcaaccactctgacatgagtaacaccattcccgacgagaaggtcgtgatcacctacttgagctttctgtgcgccagattgttagacctgcgaaaggaaatcagagccgctcgcttaattcagaccacctggcgcaaatataagctcaagacggatctgaaacggcaccaggaacgcgagaaagccgctcggattattcagctggctgtgataaattttctggccaaacagcgcctgcggaaacgggtgaatgcagctctcgtcatccagaagtactggaggcgggtgttagcacaacgcaaactgctcatgctgaagaaggagaagctagagaaggtgcagaacaaggctgcctctctaatacagggatattggcgtcgctactctactagacaacggtttctgaaactgaagtactatagtatcattctccaatcacgcatacgaatgattatcgccgttacctcatataaaagatatctgtgggctaccgtcaccattcaaagacactggcgggcctatctgagacgcaagcaagaccagcaaagatatgaaatgcttaagtccagcacactgattatacagagcatgttcaggaagtggaagcagcgtaaaatgcagagccaagtaaaagccactgtcattcttcaaagggcgtttagagagtggcacctgcgcaagcaggctaaggaggagaattctgccattatcatacaatcttggtaccggatgcataaagagttgcgcaagtacatttacatcagatcctgcgtcgtaatcatccagaaacggttccgctgtttccaggcacagaaactgtataagcgccgcaaggagtctatcctgaccattcagaaatactataaggcttatctaaaagggaaaatcgagcgcactaactacctgcagaaacgggctgcggccatccagttacaagctgctttccgtcgcttgaaggcccacaacttgtgtagacagattagggcggcctgcgtgatccagtcttactggcggatgaggcaggaccgggttcggttcttgaatcttaagaaaaccataatcaagttccaggcgcacgttcgtaagcaccaacaacgtcagaaatataagaagatgaaaaaagcagcagtaattattcagacacatttcagggcctacatttttgcaatgaaggtgttggcaagctaccaaaaaacaaggagcgctgtcattgttttgcagagcgcataccgggggatgcaggctcgcaagatgtatattcatatccttacttccgtaattaaaattcagtcttattatagagcttatgtatctaaaaaagagttcctgagccttaagaatgccactattaaactgcaaagcacggtgaagatgaagcagactcgcaaacagtatctgcacctgcgggctgccgcactgttcatccaacagtgttacagaagtaagaagatcgcggcccaaaagcgggaggagtatatgcaaatgcgtgagtcatgtattaagctccaggcttttgtgaggggatatctggtgagaaaacaaatgcgtttgcagagaaaagccgtgatctccctgcaatcatatttcagaatgaggaaggcccgccagtattatcttaagatgtataaagccataattgtgatccaaaactactaccatgcctataaagcccaggtgaaccagcgcaagaatttcctacaagtaaagaaggctgcgacgtgtttacaggctgcataccgagggtacaaggttaggcagctcatcaagcaacagtcgatcgccgccctgaaaatacagagcgctttccgaggatataacaaaagagtcaagtaccagagcgttctacagtctattattaagattcagcgatggtatcgcgcgtataagactctgcacgatacccggacacatttcctcaaaactaaggccgccgtgatctctcttcaaagcgcctatagagggtggaaagtgagaaaacagatccggcgggagcaccaggcagctctcaagatccaatctgcctttcggatggccaaggctcagaagcagttccgattgtttaaaacggccgccctcgtgatccagcaaaatttccgggcctggaccgctggccgaaagcagtgcatggagtatattgagctcaggcacgccgtgctggtccttcagtccatgtggaaaggcaaaaccctccgtcgacagctccagcggcagcacaagtgcgctatcattatccagtcctactaccggatgcatgtccaacaaaaaaagtggaagatcatgaaaaaagcggccttgctcattcagaagtattatcgggcatattccatcggtagggaacagaatcatctctaccttaaaaccaaagccgcagtggtgactcttcagtccgcttaccgcgggatgaaagtgagaaaaaggataaaggactgtaacaaagcggctgtcaccatacagtcaaagtatagggcatacaagaccaagaaaaaatacgctacttatcgggcatcagccatcattatccagcggtggtaccgtgggataaaaattacgaatcatcagcataaagagtacttgaatctcaaaaagacggccatcaaaattcagtctgtatatcgcggcattagggtcaggaggcatatccagcatatgcatagggcagctacctttatcaaagctatgtttaagatgcaccagagtcggatcagttaccacaccatgagaaaggctgctattgtcatccaagtaagatgtagggcgtattatcagggaaaaatgcagcgggaaaaataccttactattctaaaagccgtaaaggttttacaggcctcctttagaggagtgagagtgaggcgaaccctgcgcaaaatgcaaactgctgcaactctcatccagagcaactaccgccgctaccggcaacagacctatttcaacaagctgaaaaagattaccaagacggtacagcaacgctactgggcgatgaaggagcgaaatattcagtttcagaggtataacaaactcagacattctgtgatttacattcaggccattttcagaggcaaaaaggccagaaggcatctgaaaatgatgcacatcgctgccacattgatccagagacgctttaggaccctgatgatgagaagaaggttccttagcctgaagaagacagcaatactgattcagcgcaagtatagagcccacctgtgtaccaagcaccatttgcagttcctgcaggttcagaacgctgtgataaagatacagtcctcttatcgccggtggatgatccgtaagcgaatgagagaaatgcaccgggctgccacctttattcaatcgaccttccgcatgcaccgtttgcatatgaggtatcaggcgctcaaacaggcctctgttgtgatccagcagcagtatcaagccaacagggcagccaagcttcagaggcagcactacttacggcaaaggcattctgctgtcatcctccaggcagcatttcggggaatgaaaacccgcagacacctcaagtctatgcatagtagcgccactcttatccaatctcgcttcagatctctgctcgtgagacgcaggttcatctcccttaaaaaggccactatttttgttcagaggaagtacagagcaactatctgcgccaagcacaaactctaccaattcttgcacctgcgtaaagcagcgatcaccattcaatctagctacaggcgccttatggtcaagaaaaagctgcaggagatgcagcgcgcagccgtcctgatccaagccacatttcggatgtatcgtacttacattacctttcagacctggaagcacgcctccattctgatccagcagcattacaggacctacagagctgctaagctccaacgtgagaactacatcaggcagtggcacagcgccgtggtcatccaggctgcttacaaaggcatgaaggccaggcagctcctccgtgaaaaacacaaagcctccatcgtcatccagtctacataccgtatgtacaggcaatactgtttttaccagaaactgcagtgggcgactaaaatcatccaagaaaagtatcgcgctaacaaaaaaaagcagaaggtttttcagcacaatgagctgaagaaggagacctgcgtccaggccggcttccaggacatgaatattaagaaacagatacaggaacagcaccaggcggctatcatcattcagaagcattgcaaagcttttaaaatcaggaaacattatctgcacctcagggctactgtcgtgtccatccagaggcggtaccgaaaactgacagcggtgaggacacaagctgtcatctgtattcagtcatactacagggggtttaaggtacgaaaggatatccagaacatgcatcgggccgcaacccttattcagtccttttaccgcatgcaccgcgcgaaggtcgattacgagaccaaaaaaactgcaatagttgtgatccagaattactacaggctttacgtgagagtgaagacggagcgaaagaatttcttagcagtgcaaaagagcgtacgaaccatacaagccgccttccgcggcatgaaggtgcggcaaaagttgaagaatgtgtccgaagaaaaaatggctgccattgttaatcaatctgccctctgctgctaccgcagtaagacacaatacgaggcagtgcagtcagagggggtaatgatccaggagtggtacaaggcctctggcctagcgtgcagccaagaggcagaataccactcccagtctagggcagcagtgactattcaaaaagcattttgcagaatggtgacccggaagctagaaacgcaaaagtgtgcggccctgcgtatccaattttttctacagatggccgtgtatagacggcggtttgtgcagcagaagcgcgccgctataacgttgcagcactattttcgcacttggcagactagaaagcagtttctgttgtatagaaaggctgctgtggtgctccaaaaccattatagggctttcctgtccgccaagcaccaacggcaggtgtacctgcagatccggagtagtgtgattatcatccaggctagaagtaaaggctttatccagaagagaaagtttcaggagataaagaatagcacaatcaaaatccaggcaatgtggcgccgctatagggccaagaagtacctttgcaaggttaaggccgcttgtaaaatccaggcttggtatcgctgctggcgggctcacaaggaatatcttgctatattgaaagcagtgaaaattatccagggctgcttttacaccaaactcgagcggacccggtttctgaacgtgcgtgcgtcagctatcattatacagcgcaaatggagagcaatcctccctgccaagatcgcacatgaacacttccttatgatcaaaagacaccgcgcagcttgcctgatccaagcccattaccgaggctataaaggccggcaggtttttctccgacagaagtccgctgctcttatcattcaaaagtatattcgtgcaagagaggccgggaaacacgaaaggatcaagtatatcgagttcaagaagagtaccgtgatactccaagccttagttaggggctggctcgtgagaaaacggttcctggagcagagagccaagatacggctgctccacttcacagcagccgcctattatcacctaaacgctgtgagaatccaaagggcttacaaattataccttgcagtgaaaaatgcaaacaagcaggtcaatagcgttatctgcatacagcgctggtttcgcgcccggctgcaggagaaaaggttcattcagaagtatcactctattaaaaagattgaacacgaaggccaggagtgcctgtctcagcgcaatagggcagcttccgtgattcagaaggcggtgcggcacttcctgcttaggaaaaagcaggagaagtttacctctggaattatcaagatccaggccctttggagaggttatagctggcgaaagaagaatgactgtacgaagatcaaggcgattagacttagcctccaggtggtgaatagggagatccgtgaggagaacaagctatataagagaacagctcttgctttgcattatctcctgacttataagcatctttctgctatattagaggcacttaaacacctcgaggtcgtgacgcgattatctccactgtgctgtgaaaatatggcccagtctggtgctatcagcaaaatctttgtactgatacggtcttgtaatcggagcatcccttgcatggaggtgataaggtatgctgtgcaagtacttctcaatgtgtctaaatatgagaagactacaagcgcagtgtacgacgttgaaaactgtatcgacatcctgttagagctgctgcaaatctatcgggaaaaacccggaaacaaagtggctgataaggggggatcaattttcacgaagacatgctgcctgctggcaattctcctgaagacgaccaaccgggcgtctgatgtgcggtcccgatcgaaggtcgtggaccgaatttattccctgtacaagctgactgcacacaaacacaaaatgaacacagagagaatcctatataagcagaagaagaactcaagcatctctattccttttatccctgaaacccctgttcggacccgaatcgtgtcacgcttaaagcccgactgggtgttacgcagggataatatggaggaaattacaaatcctctccaggctatccaaatggttatggacacccttggcatcccctattag

SEQ ID NO: 108741 - DNA, 1686 bp, Artificial Sequence
  Description of Artificial Sequence: Synthetic coding sequence
atgtgcggcatatgggcgcttttcggaagtgacgattgtctgagcgtacagtgtttaagcgccatgaaaatcgcccaccggggccctgacgcatttcggtttgagaatgtgaacgggtacaccaattgctgtttcggtttccatagacttgccgttgtggatcctcttttcggaatgcaaccaattcgggtcaaaaagtacccttatctgtggctctgctacaacggcgaaatctataaccataaaaaaatgcagcaacacttcgaattcgagtatcagaccaaagtggatggcgaaatcattcttcatctctatgataagggcgggatcgagcagactatctgcatgctcgatggcgttttcgcctttgtgctgctggacacagctaataagaaggtgttcctgggtagagatacctacggcgtacggcccctcttcaaggcaatgactgaggacggcttcctcgccgtgtgcagcgaggccaaagggcttgtaacacttaaacactctgcaaccccgtttctcaaggtggagccattcctgccggggcattacgaagtgttggatctgaagcccaacggtaaggtggcttccgtagaaatggtcaaatatcaccattgtcgcgatgttcccttacatgccctatacgacaatgtcgaaaagctgtttccaggatttgagatcgagaccgttaagaacaacctccgcatcctttttaataatgctgtgaagaaacggctaatgactgaccgtcggattggctgcctgcttagcggcgggttggactccagtctggtggcagctactctgctgaaacaactgaaggaagcccaggtgcagtacccgttacaaacattcgcgattggcatggaagattctcctgacctcctggctgcacgcaaagtggcggaccacatcggcagtgaacactatgaggtgctcttcaatagcgaggaaggtatccaggccctggacgaggtgatcttcagcctggagacgtatgatataactactgtacgcgcgtctgtgggaatgtatttaatctccaaatatatccggaaaaacacggattcagtcgtcatcttcagcggcgagggatcggatgagctgacccagggttatatttactttcacaaggcccctagcccagagaaggcagaagaggagagcgaaagactgctgcgcgagctctatctcttcgacgtactgagggccgacaggaccactgctgcccacggccttgagctgagagtccctttcttggaccaccggttcagctcctactacctgtcattgccgccagaaatgcgcatacctaaaaacgggatcgagaaacatctactgagggaaacctttgaggatagcaacttgatccccaaagagattctgtggagacctaaggaggcattttcagacggaattacgtcagtcaaaaattcttggtttaagatactacaggagtacgttgaacatcaggtggacgatgctatgatggccaatgcagcccaaaagtttcctttcaacaccccaaagacaaaggagggctattactataggcaggtgtttgagagacactatccgggaagagctgactggctttcccattactggatgcccaagtggatcaacgcaaccgatccatcagctcgtaccctgactcactacaagagcgccgtgaaggcttag

SEQ ID NO: 108742 - DNA, 1686 bp, Artificial Sequence
  Description of Artificial Sequence: Synthetic coding sequence
atgtgtgggatctgggccctgttcggcagtgacgactgtctgagcgttcaatgcctatctgccatgaagatcgcacacaggggtcccgacgctttccgatttgagaatgttaatggatataccaattgttgctttggcttccaccgtctcgctgtagtggaccccctttttgggatgcagcccattcgcgtcaagaaatacccttacctctggctctgctataatggagagatttataatcacaagaaaatgcaacagcatttcgagtttgaataccaaactaaggtggacggcgaaataatactgcatttgtatgataaggggggcatcgaacagactatttgtatgctcgacggcgtgtttgcattcgtactgctggatacggccaataaaaaagtattcctggggcgcgacacatatggagtgagacctctgtttaaggccatgactgaagatggctttttagctgtgtgctccgaggccaaaggtctggttacacttaagcattctgcaacccctttcctaaaagtggaaccatttctgccaggacattatgaagtgctagatttgaaaccaaacgggaaagttgcatctgtggaaatggtgaagtatcaccattgtcgcgatgtgcctctccacgccctttatgataacgtggagaagctgtttccagggttcgagatcgagacagtcaaaaacaatctaaggatattgttcaataacgccgtcaagaagcgtctgatgaccgatcggcgcatcggctgcctcctttctggagggctggatagtagtctggtcgccgcaactttgctgaagcaactgaaagaagcacaagtccagtatcccctacaaactttcgctattggtatggaggactcacctgacctgctggcagctcgaaaagtcgcagatcacataggaagcgagcactatgaagttcttttcaactctgaagaaggcatccaggcgctggacgaggtgattttttccctcgagacgtatgacatcacgactgtgagagcgtccgtgggtatgtacttgattagcaagtatatcagaaagaacaccgattctgtagtgatcttctcaggggaggggtcggacgagttgacccaggggtacatttattttcacaaggccccctctcctgaaaaggccgaggaggaatccgaacgcctgttgagggagctgtacctctttgacgttttgcgggcagaccgaacaaccgccgcgcacggattggagctaagggtgcccttcttagaccaccgcttctcctcttactacctgtctttaccaccagaaatgcggatcccaaagaacggtatcgaaaagcatttgctgcgggaaactttcgaggactcaaacctcattccaaaggagatcctgtggagacctaaggaagccttctcagatggaatcacaagcgtgaagaactcctggtttaaaattctgcaggagtacgtggaacaccaggtggacgacgcaatgatggccaatgccgcccaaaaattcccgttcaacacaccaaagaccaaagaaggttattattatcgtcaggtctttgaacgccactaccccgggcgcgccgactggctgtcgcactattggatgccaaaatggattaacgcgacggaccctagcgcaagaacattgacacattacaagtcagcagtaaaagcatag

SEQ ID NO: 108743 - DNA, 1686 bp, Artificial Sequence
  Description of Artificial Sequence: Synthetic coding sequence
atgtgtggtatttgggccctgttcgggtccgacgattgtctgtcagttcagtgcctgtcagctatgaagattgctcataggggccctgatgccttccggtttgagaacgtcaacgggtacaccaactgttgtttcgggtttcataggcttgcagtggtggatcccctgttcggaatgcagccgattcgagtgaaaaagtatccttatttgtggttgtgctataatggagagatttataaccacaagaaaatgcagcaacactttgaatttgaataccagaccaaagtggacggggaaatcatcctccatctgtacgataagggcggaatcgaacagacaatctgcatgctggatggcgtgttcgcctttgttcttttggatactgcaaataagaaagtgttcctgggccgcgacacttatggcgttcggcctctgttcaaagccatgacagaggatgggttcttagctgtgtgcagcgaagcaaaaggactggtcactctcaaacacagcgcgacaccatttctgaaggttgagcccttccttcccgggcactacgaagtacttgacctgaaacccaatggaaaagtggcctcggtggagatggttaagtatcaccactgccgcgacgtgcctctccacgccctatacgataatgtagaaaagctgttccctggttttgaaattgagacagttaagaacaatctcaggattctttttaataatgctgtgaaaaaaaggctgatgactgatagaagaataggatgccttctctccggtggtctggacagctcccttgtcgctgccaccctgttaaagcagctcaaagaggcccaagtccagtatcccctgcaaaccttcgctatagggatggaagattcacccgatcttctggccgcccgtaaggtggccgaccacatcggaagcgagcactacgaggtcctgtttaactccgaggaggggattcaggcgctcgatgaggtgattttcagcctcgaaacctacgacattacgacggtccgagcctccgtcgggatgtacttgatcagcaaatacatccgcaagaatacagattctgtggttatctttagcggagaagggagtgatgaactgacccaggggtacatatattttcacaaggctccgtctcccgagaaggctgaggaggaaagcgaacgtctgcttcgggagctctacctgttcgacgtcctgagggccgaccgcaccactgctgcccacggtcttgagctgcgtgtgccctttctcgaccatcgattctcttcgtactacctgtccctccctcctgaaatgcgcataccaaaaaatggcatcgagaaacacctgctgcgcgagacattcgaggactccaatctcattccgaaagagatcttatggcgtcccaaagaggcattctctgacggaattacctcagtaaaaaattcttggttcaagattctgcaggagtacgttgaacatcaagtggatgacgccatgatggcgaacgccgcacaaaagttcccattcaacacacccaaaacaaaagaaggttattattatcgacaggtcttcgagcgacactaccctggccgggcagactggctctcccactattggatgccgaaatggattaatgctacggatccatcagcccgtacgctgactcactacaaatcggctgtgaaggcatag

SEQ ID NO: 108744 - DNA, 87 bp, Artificial Sequence
  Description of Artificial Sequence: Synthetic coding sequence
atgtgcggtatttgggccctgtttggcagcgacgattgcctgagcgttcaatgcctgtctgcaatgaaaatcgcacaccgtggttag

SEQ ID NO: 108745 - DNA, 489 bp, Artificial Sequence
  Description of Artificial Sequence: Synthetic coding sequence
atgtgcggaatttgggcgctgttcgggtcggacgactgcctgtccgtccaatgcctgtcagcaatgaagatcgcgcacaggggacccgacgcatttaggttcgagaatgtcaatgggtacactaactgttgtttcggttttcacagactcgccgttgtggaccctctattcggcatgcagccaatccgtgttaagaagtatccctacctctggctctgctataacggggaaatttataatcacaagaaaatgcagcagcacttcgagtttgagtatcagaccaaagtggacggagagattatactgcacctttacgacaagggtggtattgaacagacaatatgcatgctggacggcgtcttcgctttcgtcctgctggataccgctaacaagaaagtctttcttggtcgggacacctacggggttcgtccgttgtttaaagccatgacagaagatgggtttcttgctgtctgcagcgaagcaaaatag

SEQ ID NO: 108746 - DNA, 648 bp, Artificial Sequence
  Description of Artificial Sequence: Synthetic coding sequence
atgtgcgggatctgggccctgtttggctcagatgactgtctgtcagttcaatgcctctctgcaatgaagatcgcgcacagaggacccgacgccttccgattcgaaaatgtaaacggatacaccaactgctgcttcgggttccatcggctggcagtggtagaccccttattcggcatgcagccaatccgcgtgaagaagtacccgtatttgtggctctgttacaacggagagatatacaatcataaaaagatgcagcagcattttgaatttgagtaccagaccaaagtggatggcgaaatcattcttcacctgtatgacaaaggaggaatagaacagactatctgtatgctcgatggtgtgtttgcgtttgttctgctggatactgcaaataagaaagtgttcctagggcgggatacatacggggttcggcctctttttaaagctatgaccgaagatggctttttggccgtgtgtagcgaggccaagggacttgtgacactgaaacatagcgccaccccattcctcaaggttgagccatttctcccaggccactatgaagtgttggacctgaaaccgaatggaaaggtggcgtccgtggaaatggtgaagtatcaccactgccgggatgtccccctacacgcactctag

SEQ ID NO: 108747 - DNA, 360 bp, Artificial Sequence
  Description of Artificial Sequence: Synthetic coding sequence
atgtgcggcatctgggctctgttcggaagcgatgactgtttatctgtgcagtgcctatccgccatgaaaatagctcacagaggcccggacgcattcagatttgagaacgtgaatggctacactaactgttgcttcgggttccaccgactggccgtggtggatcctttgtttggaatgcaaccgattcgcgtcaaaaagtacccatacctgtggctgtgttacaatggtgagatctataaccacaaaaaaatgcagcaacacttcgagttcgagtaccagaccaaagtggacggcgagattatccttcacctatatgacaaaggtggaatagaacaaacaatctgcatgctggacggttag

SEQ ID NO: 108748 - DNA, 102 bp, Artificial Sequence
  Description of Artificial Sequence: Synthetic coding sequence
atgtgtggcatctgggctctgtttgggtccgatgactgtttatcagtgcagtgcctttccgccatgaagatcgcacatcggggcccggatgccttccgatag

SEQ ID NO: 108749 - DNA, 192 bp, Artificial Sequence
  Description of Artificial Sequence: Synthetic coding sequence
atgaaaatcgctcaccgcggtcccgatgcgttccgattcgaaaacgtgaacggatacaccaattgttgctttggcttccacaggttggccgtggtcgatccactattcggtatgcaacctattcgcgtgaagaagtacccttacttgtggctgtgctacaatggagagatttacaaccataaaaaagtgtag

SEQ ID NO: 108750 - DNA, 1437 bp, Artificial Sequence
  Description of Artificial Sequence: Synthetic coding sequence
atgcagcagcacttcgaatttgagtaccaaactaaggtcgacggagagattatccttcacctgtatgacaaagggggtatcgagcaaacaatttgcatgctcgatggtgtgttcgcattcgtgctcctcgacactgccaataaaaaggtgtttctgggacgcgatacttacggcgttagacccctttttaaagccatgacagaggacggattcctcgccgtgtgcagcgaggccaagggtctggtcaccctaaagcactcagctacgccctttttgaaagtcgaacccttcctgcctggacactacgaagtcctcgacctgaagccgaacggcaaggtggccagcgtggagatggtgaaataccaccactgtcgtgatgtccccctgcacgccttgtacgataacgtggaaaagctattcccaggattcgagattgaaaccgtcaaaaataatcttaggattctcttcaataacgctgtaaagaaaagattaatgactgaccggcggatcgggtgcctcctctcaggcggtctcgactctagtctggtggctgccacactgttaaaacaactgaaggaggcgcaagttcaatacccattacagacatttgctatcggaatggaggattctcctgacctgttggccgcccgaaaggtggcggaccacataggatccgaacactacgaggtcctctttaatagcgaagagggcattcaagctctcgacgaagtcatttttagtctcgagacttacgatatcacaacagtgcgggcgagcgtcgggatgtatctgatatctaagtacattaggaagaataccgattctgtggttatcttctcaggcgaaggcagcgacgaactgactcaggggtatatttatttccacaaggcacccagtcccgaaaaggctgaggaagagtctgagaggctgcttcgcgagctctacctcttcgacgtactgagagccgatcgtacaaccgccgctcatggcctagaattgcgtgtcccatttctggatcataggttcagctcatattatttgagccttcctcccgagatgaggatccctaagaacggcattgagaaacatcttctgagggagacatttgaggattcgaacctgataccgaaggaaattctttggcggcccaaggaagcttttagcgacggcattacttctgttaaaaactcatggttcaaaatcctgcaagaatacgtggaacatcaggtggatgacgccatgatggccaacgccgcacaaaagttcccctttaacacaccaaagaccaaggagggatattactacagacaggtgttcgaaagacactaccccggacgcgccgactggctgtcgcattactggatgcctaagtggataaatgccaccgacccaagcgcccgcaccttaacacactacaaatctgctgtgaaagcatag

SEQ ID NO: 108751 - DNA, 1623 bp, Artificial Sequence
  Description of Artificial Sequence: Synthetic coding sequence
atgaaaattgctcaccgtggcccggacgcgtttcggttcgagaacgtcaatgggtatactaactgctgcttcggattccacaggctggcggttgtagaccctttgtttggcatgcagcctatacgggtcaaaaagtacccctatctctggctgtgctacaacggggagatttacaatcataagaagatgcagcaacatttcgagttcgaataccagacgaaagttgatggtgaaatcatcctacatctatacgataagggaggaattgagcaaactatatgtatgctggacggtgtgttcgcttttgtgctgcttgacaccgccaataaaaaggtgttcctggggcgcgacacctacggagtgcggccccttttcaaggcaatgacagaagacggttttctcgccgtgtgctctgaggccaagggtctagtcacactgaaacactcagccaccccatttcttaaagtagagcccttcctgccgggacactatgaggttctggaccttaagcctaacggcaaagtcgcctccgtcgaaatggtaaaataccatcattgtcgcgacgtgcctttacacgccctgtatgataacgtcgaaaaactctttccgggtttcgagatagaaaccgtcaaaaacaacctgcgcattctcttcaataatgctgtgaagaaaagactgatgaccgatcgccggataggatgcctattgagcgggggcctcgactcaagtctggtcgccgccactcttttaaaacaactgaaagaggcacaagttcagtaccctctgcaaacgttcgcaatcgggatggaagattctccagatctgctagcagccaggaaggtagcggatcatatcggctctgagcactacgaggttctcttcaatagcgaggaagggattcaggccttagatgaagttattttctctctagaaacatatgacatcactaccgtgcgggcttctgtcggcatgtatctgatttccaagtacatccgcaagaacactgattcggtcgtgatatttagcggagagggatccgacgaacttacccaaggatacatatattttcacaaggccccaagccctgagaaagccgaggaggagagcgaaagactgctgcgggagctttacctgtttgacgtacttagggcggaccggaccaccgccgctcacggtctcgagctccgcgtgccattcctcgaccacagattcagctcttattatctcagccttccacctgagatgcgtatccccaagaacggtatcgaaaaacacttgcttcgcgaaacttttgaggactctaacctgattcctaaagagatactctggcgccctaaagaggctttttctgacgggatcactagcgtaaagaattcctggttcaagatcctgcaagagtatgtggagcatcaggtggacgacgctatgatggccaacgccgcacagaagtttccttttaacacaccaaaaacgaaggagggctattattaccggcaggtattcgagaggcactatcccggacgagccgattggctcagtcattactggatgcccaaatggataaacgcaaccgatccctccgcccggactctaacccattataagtcggccgtcaaggcgtag

SEQ ID NO: 108752 - DNA, 1437 bp, Artificial Sequence
  Description of Artificial Sequence: Synthetic coding sequence
atgcagcagcatttcgagttcgagtaccaaactaaagtggacggagagattatactgcatctgtatgacaaagggggcatcgagcagaccatctgcatgctcgacggagtctttgcttttgtgctgctggacaccgccaataagaaggttttcctggggcgagacacctatggcgtacgccctttgttcaaagctatgactgaggatggttttctcgcagtttgtagcgaggcaaaaggtctcgtgactctcaagcattctgccactcccttcctcaaggtcgagccattcctgccgggacattatgaagtactcgatctgaaaccaaacggtaaggtcgcaagcgttgaaatggtgaaataccaccattgccgcgatgtgcccctgcatgcgttgtatgataacgttgaaaagctgtttcccggctttgagatagaaactgttaaaaataacttgcgtattctgtttaataacgccgtcaaaaaacggttgatgaccgatcgcagaattggttgtctgctgtctggagggctggactcctccttggtcgcagcaacgttgctgaaacagctcaaagaagcccaggtacagtaccctctgcagacattcgcaattggcatggaggacagtccggacttgctggccgcaagaaaggtcgctgaccacatcgggtcagagcactacgaggtactctttaattctgaggagggaatccaggctctcgacgaggtaattttctctcttgaaacctacgatattacaaccgtgcgtgcctccgtaggtatgtacttgatttcaaagtacatccgcaaaaatacagactctgtcgtaatttttagcggagagggcagtgatgagctgactcagggatatatctatttccataaggccccctcacccgaaaaggccgaggaggagtccgagaggctgttgcgagaactttacttattcgatgttctcagggctgacaggacaactgcggctcatggattggagctgagggtgccgtttctggatcataggtttagctcctattatctgtccctaccgcccgaaatgcgaatccccaagaacggtatcgagaaacacctgttgcgagaaactttcgaagactccaatctgataccaaaggagatcttatggagacctaaggaggccttttcagatggaatcacttctgtcaagaacagttggtttaagattcttcaggagtacgttgagcaccaggtggatgatgccatgatggctaatgctgcgcagaagttcccatttaacacccccaagactaaagaaggctattattatcgccaggttttcgagcgtcattatcctggaagggctgactggttatcccattactggatgccgaaatggatcaacgcaacagatcccagcgctcggacgctgacccactataagtcagcagtcaaggcgtag

SEQ ID NO: 108753 - DNA, 1395 bp, Artificial Sequence
  Description of Artificial Sequence: Synthetic coding sequence
atggctgccagctgtctcgtgctgctagccctttgtttgttgctgccactgcttctactcggggggtggaagcgctggagacggggccgggccgcaaggcacgtggtcgccgtggtgttaggcgatgtgggaaggtctcccagaatgcagtaccacgcactgtccttggcaatgcacggcttttcagtcactctcctcggattctgtaattcaaagcctcacgacgaactcctccagaataatcggatccaaatcgtgggtttgacagaattgcaatccttagctgtcggaccaagagtgttccaatatggggtgaaggtcgtcttgcaagccatgtaccttttgtggaagctgatgtggcgggaacccggggcctatatctttttacagaaccctcccggattgccctcaatcgccgtttgctggtttgtcgggtgtctgtgcggcagtaagctagttatcgattggcataattacggctactccatcatgggcctagtgcatggtcctaaccacccattagttctgcttgccaaatggtatgagaaattttttggccgtcttagccacctgaacttgtgcgtgacgaatgctatgcgagaagatcttgctgacaattggcacatcagggctgttacagtttacgacaagccagcttctttttttaaggaaaccccattagatctccagcacagattgtttatgaaactaggatcgatgcactcacccttcagagcccgttctgagccggaggaccccgtgactgaacggtccgctttcactgagagggatgctggatccggcctggtgactcgactgcgtgaaagacctgctctgctagtatcctctacatcgtggactgaggatgaagatttttcgattctactggctgctctggaaaaatttgagcagctgaccctcgacgggcacaacctgccatcattggtgtgcgttattactggcaagggccccctgcgagaatactattcacgacttatccaccaaaagcactttcaacatatccaggtttgcactccctggctggaagctgaagattacccactcttactcgggagcgctgacttgggcgtgtgcctccacacgtccagttccggcctcgacctacccatgaaagtcgtggatatgtttggatgctgtctgcctgtgtgtgccgttaatttcaaatgcttacacgagttggttaagcacgaagagaatggattggtctttgaagattctgaggaattagccgctcagctgcagatgcttttttcgaacttccccgatcccgccgggaagcttaatcagtttcggaaaaatttacgcgagagtcaacagctgcgctgggacgaaagctgggtgcagactgtgcttcccttggtgatggatacgtag

SEQ ID NO: 108754 - DNA, 1062 bp, Artificial Sequence
  Description of Artificial Sequence: Synthetic coding sequence
atgtacctcctgtggaagctgatgtggcgagagcccggtgcatacatttttctgcagaacccaccaggcctgccatcaatcgctgtgtgctggttcgttgggtgcttgtgcggatctaagcttgtaattgattggcataactatggatacagcatcatggggcttgtccacggtcccaaccaccccctggtgctcctggcgaagtggtacgagaaattcttcggtagacttagccacctaaatctctgcgtgaccaacgccatgagagaagatctggcagacaactggcacattagagctgttactgtctatgacaaaccagcctcattcttcaaggaaacccccctcgatctccaacataggctatttatgaaactcggttctatgcactccccttttcgagctcgctccgaacctgaagatcccgtgaccgaacgctcggcctttacagagagggatgcaggcagtggtctggtgactcggctgcgggaacggcccgcgctcctcgtgtcaagtacctcatggaccgaggacgaagatttcagcatacttctggctgccctggagaaatttgagcagctcaccctggacggccacaatctcccaagccttgtgtgtgtaataacgggaaaaggtcccctccgcgaatattatagtagactaatccaccagaagcacttccagcacatccaagtgtgtaccccttggctcgaggctgaagactacccccttctgttagggagtgccgacctaggcgtgtgcctgcacacctctagctctggcctggacctgcctatgaaagtggtggacatgttcggatgttgcctgcctgtgtgcgcagtgaactttaagtgcctgcatgagctagtaaagcacgaagagaatggactcgtgttcgaggacagcgaggagcttgccgcacagctccagatgttattcagcaacttcccggatcccgctgggaaattgaaccagtttcggaagaacttacgcgaaagccagcagttgaggtgggatgaatcttgggtacagacggttttacctctggttatggatacctag

SEQ ID NO: 108755 - DNA, 1422 bp, Artificial Sequence
  Description of Artificial Sequence: Synthetic coding sequence
atggcacagcttgagggttactacttctctgcggcattatcttgcacgtttcttgtatcctgcctccttttctccgccttcagcagagcccttagggaaccatatatggacgagatttttcatcttcctcaggcccagcgctactgcgaaggccacttcagtttatctcagtgggacccgatgattacaactctgcctggactctatttggtgtctattggtgtgattaagcccgcaatctggatttttggatggagtgaacacgttgtttgttcaatcgggatgttgcgttttgttaatctgctgttttccgtcggtaatttttacctactatacctcctcttttgcaaagtgcaaccaaggaacaaggccgcgtcatcaatccaaagggtcttaagcactctcacgctggctgtgttcccaacactgtatttttttaacttcttatattataccgaggccggttctatgttttttacattgttcgcttatttgatgtgtctctacggaaaccacaagaccagtgccttcttgggattctgcggtttcatgtttagacaaaccaatatcatctgggcagtgttttgtgccggaaatgttatcgcacaaaaactaactgaggcctggaagaccgaactacaaaagaaggaggacagacttccccctataaagggtcccttcgcggagtttagaaagatccttcagttcctgcttgcctactcaatgtcatttaagaacctgtcaatgctgctgctccttacctggccttacatccttctgggctttttattttgcgctttcgttgttgtgaatggaggaatagtaatcggggaccgtagctcacacgaggcctgcctccactttccacagctcttctatttcttttcctttaccttatttttctcatttccccatttgctgtctccaagtaaaataaagacttttctcagtctcgtgtggaagcggcgcatactattttttgtcgttaccctggtgagcgttttcttggtttggaagttcacttacgcccacaagtacctcctggccgacaataggcactatacattttatgtttggaagcgggtcttccaacgctacgagacagtcaagtaccttctggtgcccgcctatatctttgccgggtggtccatcgccgattcactgaagagcaaaagtatattctggaatctcatgttttttatctgcttgttcacagtcattgttccacagaagttactcgagtttcgatacttcattctgccttatgtcatatatcgcctgaacatcccactgccccccaccagtagactgatttgtgagctgagctgttatgccgtggttaacttcatcaccttcttcatcttcttgaacaaaaccttccagtggcctaacagccaggatattcagagattcatgtggtag

SEQ ID NO: 108756 - DNA, 1479 bp, Artificial Sequence
  Description of Artificial Sequence: Synthetic coding sequence
atggcggcaggagagcgatcttggtgtttatgtaagctgcttcgattcttctatagcctgtttttccccggactcatcgtgtgcgggaccttatgtgtctgcctggttatcgttctttgggggatccggctattgctccagagaaagaagaaactggtgtccacctcaaaaaatggaaaaaatcagatggtcattgccttcttccatccgtactgtaacgcaggcgggggaggggagagggtcttgtggtgtgctctgcgcgccctgcagaagaaatacccagaagctgtgtatgtggtgtacacaggcgatgttaacgtgaatggccagcaaatcctggaaggcgcttttcggcggttcaacattcgcctcattcatcctgtgcaattcgtcttcctgcgcaaacggtacctggtcgaggattcactgtatcctcattttaccctgctgggacagtcgttaggatctatcttcctcgggtgggaggcactgatgcagtgtgtccctgatgtgtacatcgacagcatgggctacgcattcaccctacccctttttaagtacattggcggatgccaggttgggagctacgtccactacccaacaattagtaccgacatgcttagtgtggttaagaatcaaaatatagggtttaacaacgctgcatttattacccgcaacccttttctcagcaaggtcaaactgatttactactacttgttcgccttcatctatggccttgtcggctcttgttccgacgtcgtcatggtgaactcttcttggactctgaatcacattttgtctctgtggaaggtggggaattgcacaaacatcgtgtacccgccttgcgacgtgcagacctttctggatataccactgcatgaaaagaagatgacccctggccacctactggtctcggtaggtcagttcagacctgagaagaaccacccactgcagatccgagccttcgctaaactgcttaataaaaagatggtcgagtctccccctagcctcaaactggtactgatcggcggctgccgcaacaaagatgacgagctgagggtgaaccagctcagacgcctgtccgaggacctgggtgttcaggaatatgttgaattcaagattaacattcccttcgatgaattaaagaactacctcagcgaagctacaatcggcctgcacacaatgtggaacgagcacttcggcattggcgtagtagaatgcatggccgccggaacgatcattctggctcataactccggcggacctaagttagacattgtagtccctcatgaaggcgacattacagggtttctcgcagagtccgaagaggactacgccgagactatcgctcatattctgtcaatgtcagcagagaagcgattgcaaattcggaaatctgcccgtgcatccgtgagtcggttcagcgaccaagagttcgaggtaaccttcctctcttctgtcgaaaagctattcaaatag

SEQ ID NO: 108757 - DNA, 111 bp, Artificial Sequence
  Description of Artificial Sequence: Synthetic coding sequence
atggctgccggggagcgtagttggtgtctgtgtaaattgctaaggagttgtggtgtgtatgggagttggcacaattatccttgcactcaattcggaggccccaaagcttag

SEQ ID NO: 108758 - DNA, 1467 bp, Artificial Sequence
  Description of Artificial Sequence: Synthetic coding sequence
atggctgggaagggcagcagcgggcgacggccattgctgttaggcctcctcgtagctgtggccactgtgcatctcgtgatttgtccctacacaaaggttgaggagagttttaacctccaggccacacacgacctcctgtaccattggcaagatctagagcaatatgaccatctggagtttcctggagtggttcctagaacgtttctgggtccagtagttatcgccgtattttctagtcctgctgtgtatgtgctgtccctcctggaaatgtcaaaattttacagccagcttatcgtccgcggcgtactgggcctgggcgtgatctttggtctgtggaccctgcagaaggaggtgcgacgacactttggcgccatggtcgccacaatgttctgttgggtcacggccatgcagttccacctcatgttttactgcactagaacattacccaatgtgcttgcactccccgtggtgcttttggcactcgctgcttggctgagacacgagtgggcaaggtttatttggttatctgcattcgccatcattgtgtttagggtggagttgtgtctatttcttggcttacttctgctgttggccctgggaaatcggaaggtaagcgtggtccgcgcactcaggcatgctgtgcccgcaggcattctctgcttgggcctgacggtggcagtcgactcctacttctggaggcagttgacatggccagagggcaaggtgctttggtacaatacagtgctgaataagtccagcaactggggaacaagtccgttgctttggtatttctattccgcgctacccagaggactgggctgtagcctgttgtttattccccttggactggtagaccgtaggacccatgcacccacagtgctggcgcttggctttatggctttatatagcctactcccccataaggaactgaggtttatcatttatgccttccccatgctcaacatcactgctgcccggggttgctcatatctgctgaacaactataaaaagagctggctctataaggctggttccctgctagtcatcgggcaccttgtcgtaaacgccgcctatagtgccaccgctctatacgtgagtcactttaactacccaggaggcgtcgctatgcaacggctccatcagttggtaccccctcagaccgatgtcctgttgcatatcgacgttgctgctgcccagaccggagtgagtaggtttctgcaagtgaactccgcttggaggtatgacaagagggaggacgtgcagcctggaaccggcatgctggcttacacgcatatactgatggaagctgctcccgggctgctggcactctatagggatacacatagggtgcttgcctcagtggtaggaaccactggcgtttctctaaacctcacccagctgccacctttcaatgtgcacttgcagaccaaactggttttgctcgagcgtctgccccggccctcttag

SEQ ID NO: 108759 - DNA, 987 bp, Artificial Sequence
  Description of Artificial Sequence: Synthetic coding sequence
atgccaccgactcagccgaggccctgtatgtgtcccatttctactacccaggttgcatcacagtgccgtggctgcacgagctggtgccctcctcgccagacttctttctgtacccttacttggcagcccccgagacaggtctgccttgggttttccaagagcactgcaccaggtggcactactcggggaagaatgtgttccagagggcaggcctgctggcacacccacaccagctcatggcgtcgcccttgggcacctggacctctacaagggcacacacccggacccggccaacgccggggcgaccacaggtgtgaatcggagcctgatcctactgcaccactgcagcggcccccagcagacaaagccggagctagtggggaggcccctccagccgttctacggggaacccgacagccgagtgctgctaccgggctgcccggtgcagttataaccactagcttttggcacaactctagtacaatcatgactatacagcgaagtaagtcgaaagattgggctccagctagtgacagacaccagacccggagtcgtgccagctcaaccgcctcagctggcgccttatctaccaaggagcgaggcgctcaggtccttctggcgccccgtgagcctctgccacgcgttatggtggcatcctccgggcttccggcaggagactgtcgccccgaccaggtgcccttcatgaccaaccaggaacagcgcgcgcaccctggcacctgtctccctggagggcatgtgtgcccagcccacccgggtggcgccgtcttttggcagcaccctaccctcgcagcccggggcccactcggggctccaaaaaccgcccctccactcagaggggatcacggggggcccggccgcactccaccaccctggtgccaccactgcaatttctgtatccaccggcatcctatctccatcactgacaagatactgggggacaaacatatccagaaaggaatgaggtag

SEQ ID NO: 108760 - DNA, 2865 bp, Artificial Sequence
  Description of Artificial Sequence: Synthetic coding sequence
atgaacaatcaccagctcgaactggccaagcagctccataaagaaggtcacctgttctactgtacctgtagggttctgacctgcccagggcaggcgaagtccattgcctcagcaccaggcaaatgtcaggactctgcagccctgacctccaccgcatttagcggactagatttcggcttgctcagtgggtatctgcacaagcaggccctcgtcaccgccactcatcctacttgtaccctgctgtttccgtcctgccacgctttcttccctctgcccctgacaccaacactgtataagatgcacaagggatggaaaaattactgttcccagaaaagcctgaacgaagccagcatggatgagtatctggggagccttggtctgttcaggaaactcaccgctaaggacgctagctgcctattcagggcaatctcagagcagctgttctgttctcaggtccaccacttggaaatcaggaaggcatgtgtgtcatacatgcgcgagaatcagcagaccttcgagtcttatgttgaaggatcattcgagaagtacctggagaggcttggggaccctaaagagtcggcaggacagctggaaattcgtgctctgtcactcatttataatcgggactttattttataccgcttcccaggcaaacctccgacctacgtaacagataacgggtatgaggataagatcctgctctgttattccagtagcggccattatgactcagtgtacagcaaacagttccagagttccgccgcagtttgccaggcagttctttacgagatactatacaaagatgtctttgttgtagacgaagaggagctcaagaccgctatcaagctgttcaggagcgggagcaaaaaaaacaggaacaacgccgtgaccgggtctgaagatgcacacactgattacaaatccagcaaccaaaaccggatggaggagtggggtgcctgctacaacgcggagaatatcccagaagggtataataagggaacagaggaaactaagtccccggagaatccctccaaaatgcccttcccctacaaagtacttaaggcgctggacccagaaatatatagaaacgtggaattcgatgtctggctggacagtcgaaaggagctgcagaaatccgattacatggaatacgctggccggcagtattacttgggagataagtgtcaggtttgcctcgaaagtgagggccgttattacaatgctcatattcaggaagtcgggaacgaaaataattcagtaacagtctttatcgaagagctcgccgaaaagcacgtcgtcccactcgctaacttgaagcccgtgacgcaagtgatgtccgttccagcctggaatgccatgccctcccggaaagggcggggctaccagaagatgccaggcggctatgttccagaaattgtaatctccgagatggatatcaagcagcaaaagaagatgtttaaaaagatcaggggcaaggaggtatatatgaccatggcttatgggaaaggcgaccctcttctcccgcctcgcttgcagcactccatgcactacggacatgatcctcctatgcactattctcagacagcgggaaatgtgatgagcaatgagcattttcatcctcaacacccctcacctagacagggtagaggctatgggatgcctaggaattccagcaggttcattaacaggcataatatgcctggacccaaggttgacttttaccccggtccaggaaagcggtgttgtcaaagctacgacaatttcagctaccggtctcgatcatttaggcggagtcatcgccagatgagttgcgtgaataaggagtctcagtacggcttcacacccggcaatggccagatgccccgaggcctcgaagagaccattacattctacgaggtggaggaaggtgacgagaccgcttaccctacgttgcctaaccacggaggccccagcaccatggtgcccgctacctcaggatattgcgtcggccgacggggacactcttccgggaagcagaccctcaatctggaggaaggaaacgggcagagcgaaaatgggcgctatcacgaggagtatctttacagggcagagccggattatgagacatccggcgtctacagtaccacggcatctacagcaaatctgtctctgcaggacagaaaatcctgtagcatgtcacctcaggacacagtgacgagctataactacccccaaaaaatgatgggaaacatagccgccgtcgctgcctcctgtgccaacaacgtgcccgctccagtcctgtccaacggcgcagcagcgaaccaggcgatatctacaacaagcgtcagctctcagaacgctatccaaccattgttcgtgtcaccacctacacacggcaggcccgacacaaaggtgctacagtactacttcaatctgggcctacagtgctactatcactcttactggcattccatggtgtacgtcccccaaatgcagcagcaattacatgtggaaaattatcccgtctacaccgaaccccccctggtagaccagactgtcccccagtgctactccgaggtgaggcgcgaggatggtatacaagctgaggcttcagctaatgatacattcccaaacgcagacagcagcagcgtgccccatggtgccgtctactatcctgtgatgtccgatccctatgggcagcctcccttgccaggattcgatagctgtcttccggtggtgcctgattacagctgtgtccccccatggcatccggttgggaccgcgtatggcggatcgagtcagattcacggcgccattaacccagggcccattggatgcatcgccccttcccctcctgcaagccattacgtccctcagggaatgtag

SEQ ID NO: 108761 - DNA, 498 bp, Artificial Sequence
  Description of Artificial Sequence: Synthetic coding sequence
atgaagtgtgtgttcgttacagtgggtacaacgtcatttgacgacctcatcgcctgcgtgtccgctccggacagcctccagaagattgaatcccttgggtacaaccgcctaatcctgcagattggacggggaacagttgtcccagaaccctttagcactgaatccttcacattagacgtgtacagatataaagattccctgaaggaagacattcagaaagccgacctggtgatcagtcacgcaggagccggcagctgtctggagaccttggagaaaggcaagccattggtggtagtgatcaacgaaaaactgatgaacaaccaccagttggaactggccaagcagctgcataaggaggggcacctgttttactgtacatgcagtacactacctggcttgcttcagagcatggatctaagcacgctcaaatgttaccctcccggccagcctgagaagttctcagctttccttgataaggtagtggggctacagaagtag

SEQ ID NO: 108762 - DNA, 3414 bp, Artificial Sequence
  Description of Artificial Sequence: Synthetic coding sequence
atgaaatgcgtgttcgtgactgtgggcacgacatctttcgatgatttgatagcttgcgtttcagctcctgacagtctgcaaaagatagaatcactcgggtacaacagactcattctgcaaatcggaagaggcactgtggtacctgaaccgttctccacagaatcctttactttagacgtgtacaggtacaaggattcactcaaagaagacatccagaaggccgatcttgtcatctctcatgcgggtgccggatcatgcctcgagacgctggaaaaaggtaaaccattggttgtggtcataaatgaaaaactgatgaataatcaccagttggagctggcaaagcagttgcataaagaggggcatctattttattgtacctgcagagtattgacttgcccagggcaggctaagtctattgctagcgcccctgggaagtgccaggacagcgccgctctcaccagtaccgccttcagtgggctcgacttcgggctgctgagcgggtacctgcacaagcaggcactcgtcacagccacccaccctacgtgtaccctgctattcccttcctgccatgctttcttccctctgcctctgacaccgacactctacaaaatgcacaaaggctggaagaattactgctcacagaagtcactgaacgaagcctcgatggacgaatatctcggttccctcggattattcagaaaactgacagccaaggacgccagttgcctctttcgtgcgatcagcgaacagctcttctgctcgcaagtccaccatctagagataaggaaagcgtgtgtgagttatatgcgagagaaccagcaaacatttgaatcctacgttgaggggtcctttgaaaagtacctcgaacgacttggagaccccaaggagtcagccggccaacttgagatacgtgccctgagccttatatacaatcgggatttcatactctatagattccctggcaagcccccgacgtatgtgacagacaatggttatgaggacaaaatccttctctgttattctagctcagggcactacgacagcgtgtatagtaaacagttccagtccagtgcggcggtctgccaggcagtactgtatgagattctgtacaaggacgtattcgtggtggatgaagaagaactaaagaccgcgatcaagttgttccggagtggtagcaaaaaaaatcgcaacaacgccgtgaccgggagcgaggatgcccatactgattacaaatctagcaaccagaacaggatggaggagtggggggcttgctataacgcagaaaacatcccggagggctacaataagggaactgaagagaccaaatcgcccgaaaatcctagtaagatgccctttccctataaagttttgaaagccctggatcccgaaatctacaggaacgtcgagttcgacgtctggctcgatagtcgaaaggagctccagaaatcggattacatggagtacgcgggtcgtcagtactatctgggcgataagtgtcaagtgtgcctggagtctgaaggaaggtactataatgcccacatccaggaagtgggcaacgaaaacaacagtgtaacagtgttcatcgaggaactggctgaaaagcacgttgtgcctctcgcaaatcttaaaccagtaacacaggttatgtcagtgcccgcctggaatgccatgccatcacgcaaagggcgaggttaccagaagatgcccggaggatacgtgcctgagattgtgatctctgaaatggacatcaaacagcagaagaagatgtttaaaaaaattcgaggaaaagaagtgtacatgaccatggcatacgggaagggggacccgttgttgccccccaggctgcagcattcaatgcactatggccatgaccctcctatgcattattctcagaccgctggcaacgtcatgagcaatgaacacttccatccgcagcacccaagtccccggcagggccgcggatacggaatgccccgcaactctagccgtttcattaaccggcacaacatgcctggtcccaaagtcgacttctatccaggtcctggtaagcgatgttgtcagagttatgacaatttctcttaccgatcgcgtagcttcaggagaagccatcgacagatgtcttgtgtaaacaaagaatcacagtacggtttcacacccggcaacgggcagatgccgcggggcctggaggagacgatcactttctacgaggtagaagaaggagatgagacagcctatcccacactgcctaaccacggcggcccttcgacaatggtcccagccacatctggttattgtgttggccgcaggggccactcgtctggcaaacagaccctgaatctcgaggaaggcaatgggcagtcggagaacggtcgctaccacgaagaatatctgtaccgggctgagcctgattacgaaacgagcggtgtgtacagcactactgcatccactgccaacctgtcgcttcaagacaggaagtcttgcagcatgtccccacaggacacagttacgagttacaactacccccagaaaatgatgggcaacatcgccgctgtggctgcatcctgcgccaacaatgtcccagctccagtgctgagcaacggagccgcagcaaatcaggccatttcaacaacaagcgtgtcatcccaaaatgcaatccaaccgctgttcgttagtcccccaacccacggccgacctgtgattgcgtccccgtcctatccttgtcactccgccataccgcatgccggcgcttcattgcccccaccgcctccacctccaccaccccccccgcctccaccaccgccaccgcctcctccacctccgccacccccaccaccagccctggacgtaggggaaacttccaatctccagcctccaccacctctgcccccaccgccgtactcatgcgatcccagcggctcagatttacctcaggacaccaaagtgttgcagtattactttaacctcggtttgcagtgctattatcacagctattggcactctatggtgtatgtgccacaaatgcagcaacagctccacgtcgaaaactatcctgtgtacaccgaacccccattggtggaccaaaccgtaccgcagtgttattcagaagtgcggagggaggacgggatacaggcagaggcctctgccaacgacactttccccaatgccgatagcagctccgtgccccacggagcagtgtactatcctgtcatgagtgacccttacggacaacctccactgccagggtttgattcttgcctccctgtggtacccgactattcgtgtgtgcccccatggcaccccgtggggaccgcctatgggggatcctcccagatacatggagctattaaccctggccccattgggtgcatcgcaccctctcccccagcatcacattacgttccacagggcatgtag

SEQ ID NO: 108763 - DNA, 651 bp, Artificial Sequence
  Description of Artificial Sequence: Synthetic coding sequence
atggtatgtgttctggtgcttgcggccgcagccggagccgttgccgtcttcctgatactaagaatctgggtggtgctgcgttccatggacgtcacccctcgcgaatctctctccatactcgtcgtcgcaggcagcggcggacacaccactgagattctgcggctgttgggatcactgtcaaacgcctacagcccccgccactacgtgatcgctgacaccgatgagatgtctgccaacaaaataaattcgttcgagctggaccgggccgacagggacccctccaacatgtatacgaagtactacattcatcgaatcccaaggtcccgggaagtgcagcagtcctggccctcgacagtgttcaccacccttcacagcatgtggctctcctttccgcttatccatcgcgtaaaacccgacctcgtactctgcaacggccccggcacttgcgtgcccatctgcgtatctgctttgctgttaggcatcctgggcataaagaaagtcatcatcgtgtacgtggaatccatttgccgcgtggaaaccctttctatgtctggcaagatcctgtttcatctgagcgactactttattgtgcaatggccagctttgaaggagaagtaccccaaaagcgtgtacctgggtagaatagtgtag

SEQ ID NO: 108764 - DNA, 972 bp, Artificial Sequence
  Description of Artificial Sequence: Synthetic coding sequence
atgcctctgctcaaactagttcacggaagcccactggtcttcggtgagaagtttaaactgttcacgctggtgtccgcatgcatcccagtgttccggctggctagaaggagaaagaagattctcttttactgtcacttcccagatctgctccttaccaaacgcgattcttttcttaagcgactgtatcgagccccaatcgactggatagaggagtataccactggaatggctgactgcattctggtgaatagccagtttaccgcggcggttttcaaagaaactttcaaaagtttgagccatatcgacccagatgttctgtaccctagtctcaatgttactagcttcgatagtgtcgtgccagagaagctggacgaccttgtgcccaagggcaagaaattcctcttgctttccataaatcgatatgagcgcaagaagaatctgactctggccctcgaagccttggtccaactcagaggcagactgacctcacaagactgggagagggtccacctcattgttgccggaggctatgatgaacgagtgctcgaaaatgttgagcactaccaagagctcaaaaaaatggtgcagcaatctgacctggggcaatatgtcacttttttgaggtcattttccgataagcagaaaatatcactcctccacagctgtacatgtgtgctatacactccttctaacgagcacttcgggattgttcctttggaagccatgtatatgcaatgccctgtcattgccgttaatagtggcggacctcttgagtcaatcgaccattcagttacagggttcctttgtgagcccgacccagttcacttctcggaagcgattgaaaaattcattagagagccttctctgaaagccaccatgggattagccggcagagcacgcgtgaaagagaagttttcacctgaggcctttacagagcaactgtaccggtacgtaaccaaactactggtctag

SEQ ID NO: 108765 - DNA, 1251 bp, Artificial Sequence
  Description of Artificial Sequence: Synthetic coding sequence
atggctgaagagcagggcagagaacgggactctgtgcccaagccgtcggtgctgttcttgcatcctgatctaggtgtgggcggtgctgagcgactggtcttagacgcagcccttgctctgcaagctcgaggctgctctgtcaagatctggaccgctcattacgatcctggacattgctttgccgaatccagggagcttcccgtgcgatgcgccggagattggctgcctcgtggactgggctggggcggtcgaggagctgctgtgtgcgcttatgtgagaatggtgtttctcgccctgtatgtgctgtttttagctgacgaggagttcgacgtagttgtctgtgaccaagtctcggcctgcatccccgtatttagactggcacgacgtagaaagaagatccttttttattgccattttccagacctgcttctcacaaaacgggactctttcttaaagcgcttgtaccgtgcccccatcgactggatagaagagtacactacagggatggccgactgcattctagttaatagccaatttactgccgctgtcttcaaggagacgtttaagtccctgtcacatatagatcctgacgttttgtacccttccctgaacgtcacctctttcgactcagtggtgccagagaagctggacgatttggttccgaaaggtaaaaagttcctgcttttaagcattaacagatatgagcgcaaaaagaaccttaccttagctctggaagctctggtacagcttcgagggcggctgaccagccaagactgggagcgcgtgcatctaatcgtggccggaggatatgatgaacgggtactcgaaaacgtcgaacactatcaggaattaaagaaaatggtgcagcagtcagacctgggccagtatgtgaccttcctccggagctttagcgacaagcaaaagattagtcttctccattcatgcacttgtgtgctgtacaccccctcaaacgagcacttcggtatagtacctctggaggccatgtacatgcagtgtccagttatcgccgtcaactcagggggtccattggagtccattgatcattcagtaactggttttctgtgcgagccggaccctgttcatttctcagaggctatcgaaaaattcataagagagccttccttaaaggccactatggggctagcgggccgcgctagagtgaaagagaagtttagtcctgaagcctttaccgaacagctatacaggtatgttactaagctgctggtgtag

SEQ ID NO: 108766 - DNA, 1317 bp, Artificial Sequence
  Description of Artificial Sequence: Synthetic coding sequence
atggcagctggcctcagaaaacgcggtcgatcgggctccgcagctcaggccgagggactgtgcaagcagtggctgcagcgtgcgtggcaagagaggcgcctgctattgcgggagccaagatatacactgttagtggctgcctgcctgtgtctggcagaggtgggaattacattctgggtgatacacagggtcgcctatacggagattgactggaaggcatatatggccgaagtggaaggggttattaacggcacttacgactacactcagctgcaaggagacacgggaccgctggtgtaccccgctggcttcgtgtacatcttcatgggtctgtactacgctacgtcccgcgggactgacatacggatggcacagaacatttttgcagtgttatatctggcaacgctgctactcgtgttcctaatttaccatcagacgtgcaaagttccaccgttcgtgttctttttcatgtgctgtgccagttacagggtccattctatcttcgtcctccgtctgtttaacgacccagtcgctatggtgttgctgttcctgagcattaatctccttcttgcacaaaggtggggctggggctgctgttttttctctctggctgtcagtgtgaagatgaacgtacttctcttcgcaccagggctcctcttcttgcttctgactcagttcggtttccgaggcgcactgcccaagttgggcatatgcgcggggctgcaggtggtactcggcctccctttcctcttggaaaatccttctgggtacttgagcaggtcatttgatttgggcaggcagttcctatttcattggactgtgaactggcgcttcctacctgaagctctattcctacacagggccttccaccttgcgctcctgactgcgcacttgaccctgctcctgctgtttgccttatgcagatggcatagaactggagagtcaatactgtcactcctgcgggacccctccaaacgcaaggttcctccccaaccccttacacccaaccagatcgtctccacattgtttaccagtaatttcatagggatttgcttctcccgctcactccactaccagttttacgtttggtattttcacacactgccctaccttttgtgggctatgcctgcaaggtggctgacacacctgctaaggctgctggtgctcggcttaattgagctgagctggaacacttatcctagcacttcttgctcaagtgcagctcttcacatctgtcatgcagtgatcctgttacaattgtggctcggcccccagcccttcccgaaatctactcagcattctaagaaggcccactag

SEQ ID NO: 108767 - DNA, 1149 bp, Artificial Sequence
  Description of Artificial Sequence: Synthetic coding sequence
atggccgcagcgcgcctcgcgagagcagctcctgcagcagccggcgctgcacttcacgcagcaggaggacggctgcctctcccagggggcggtggacaccacctgttaggtcactcgcagggggggatgtaccccgcgggattcgtgtacatattcatgggactgtattatgcgaccagccgcggaaccgatatcaggatggctcagaatatctttgccgtgctgtacctggccactctactactggtttttctcatttatcaccaaacttgcaaggttcccccgttcgttttttttttcatgtgctgtgcctcctatcgtgtgcattctattttcgtgcttcggctctttaacgacccagtggctatggtgctgttgtttctgtccattaacttactgctagcccagagatgggggtggggctgctgcttcttctctctagccgtgtctgtaaaaatgaatgttctgctatttgcaccaggtctgctgttcctgctgttgacccagttcggtttccgcggcgctttgcctaaactgggtatctgtgctggcctacaggttgtgctcggcttgcctttcctgctggagaatcctagtggctatctttcgcgctcattcgacctgggacgccagttcctattccactggactgtgaactggcgcttcctacctgaggcactcttcctccatagagctttccatctcgctctacttaccgcccacctgacactgcttctgctcttcgctctgtgtcgctggcacagaacaggcgagtcgatcctctcactgctacgcgacccaagcaagcggaaggtacctccacagcccttgactccgaatcagattgtcagcacactcttcacttctaacttcatagggatttgcttcagccgttcactgcactatcagttttatgtatggtacttccatacgctgccatacctgctgtgggccatgcctgccagatggctaacacacctactaagacttcttgtgctcggtctgatcgaactaagctggaacacctatcccagcacgagctgttccagcgcggcgctccatatttgccatgccgtgattctactgcagttgtggctgggacctcagcctttcccgaaaagcactcagcattccaagaaggcacactag

SEQ ID NO: 108768 - DNA, 1530 bp, Artificial Sequence
  Description of Artificial Sequence: Synthetic coding sequence
atggagaaatggtaccttatgaccgttgtggtccttattgggctgaccgttagatggactgtaagcctcaattcctattctggcgccgggaaacccccaatgttcggagactacgaggcccaaagacattggcaggaaattaccttcaacttgcccgttaagcagtggtattttaactcctctgacaacaatctccaatactggggcctcgactatccaccactgactgcgtaccactcactgctatgcgcatacgtagctaagttcattaaccccgactggatcgctttgcacacctctaggggctacgaatcccaagctcacaagctgttcatgaggacaactgttctgattgctgacctgctgatttatatcccagcggtcgtcctttattgctgttgccttaaagagatttctaccaaaaagaagattgccaatgccctctgtattctgctttaccccggattaattctaatcgattatggacacttccagaacatttacaattctgtgtctctagggtttgccctctggggcgtgttaggtatcagctgcgactgtgatctattagggagtctcgccttttgtttagccattaattacaaacagatggaattgtaccatgctctaccctttttctgctttttgctgggaaaatgtttcaaaaaaggattaaaggggaagggtttcgtgctgctagtgaaattggcctgtattgtcgtcgcaagctttgtgctttgctggctgccgtttttcactgaacgagagcaaacgctgcaggtactccggagactttttcctgtggacaggggactgttcgaggacaaggtggcgaatatttggtgttcatttaatgtatttctcaagatcaaggatatcctgccgagacacatacagctgattatgagtttctgtagcacattcctttcgctgctacccgcatgcatcaaacttattttacagccatctagcaagggctttaaattcaccctggtctcctgcgccctgtcattttttcttttctcgtttcaagtgcacgagaaaagcatcctgcttgtctctctgccagtctgcctcgttctctccgaaatcccttttatgagtacctggtttctgttagtctcaactttctctatgctcccacttctgcttaaggatgagcttctaatgccaagcgtggttaccaccatggccttttttatagcttgtgtgaccagcttttcaatctttgagaaaacatcagaggaggagctgcagctgaagtcctttagcatctccgtgagaaaatatcttccgtgttttaccttcttgtcccggatcattcagtacctgttcctgatctccgtgataacgatggttctcctaacccttatgacagtgaccttagaccccccacagaagctcccagatttattctcagtgctggtttgcttcgtatcgtgtctgaatttcttgttttttctagtttacttcaacatcatcatcatgtgggatagtaagagcggaaggaaccagaaaaagatttcttag

SEQ ID NO: 108769 - DNA, 1524 bp, Artificial Sequence
  Description of Artificial Sequence: Synthetic coding sequence
atggagaaatggtaccttatgactgttgtggtgcttatcgggctgactgtcaggtggacagtctctctgaatagctactccggcgcaggcaaaccgcctatgttcggcgactatgaggcacagcgccactggcaggaaattactttcaatttaccggtgaaacagtggtactttaacagcagtgacaacaatctccagtactggggcctggattacccaccgttaacggcttatcatagccttttgtgcgcctatgtcgctaagttcattaatccagactggatagctctccatacgtctcggggctatgaaagtcaggcccacaagctgtttatgcggacgaccgttcttattgctgacctgcttatttacattcctgccgtggtcttatattgttgctgcctgaaagaaatttcgaccaaaaaaaaaatcgcaaatgccctgtgcattttactctatccagggttaatattaattgactatggccatttccagtataacagcgtgtccctcggtttcgctctgtggggggtcctgggtataagttgcgattgcgaccttttagggtccttggccttttgtttggccattaactataagcagatggagctttatcacgccctccctttcttctgcttccttttgggtaaatgctttaagaagggcctgaagggcaaaggttttgttttgcttgtgaaactagcctgtattgtggtcgcttcttttgtgctgtgctggctgcctttctttacggagcgggaacagacactgcaagtgctgcggcgcctcttccctgtagatagaggattatttgaggacaaggttgcaaacatttggtgttcgtttaacgtgttcttaaagataaaggacattctgcctcgccacatacagctgatcatgagcttctgcagtacctttctgtctctgctcccggcctgcatcaaactaatattacaacccagctctaagggatttaagttcacactggtgagttgcgccctatcattcttcttgttctccttccaggttcacgagaagtcaatactactggtatcgctgcctgtatgtctggtgctcagtgagataccgtttatgtccacatggttcttgctggtgagcacattctctatgctgccactcctccttaaggatgagctgttaatgccttcggttgttacgacaatggccttcttcatcgcctgtgtgacatcattttccattttcgagaagacgtccgaagaggaactgcagttgaagagtttctccatatcagtgagaaagtacttgccctgttttacgttcctgtctaggattatccagtatctatttctgatcagtgtgataacaatggtcctgctcacactcatgacagtcactctcgacccacctcagaagctccctgacctatttagcgtgttggtgtgctttgtctcctgcctgaactttctgtttttcctggtgtacttcaacattatcattatgtgggactccaaatcaggtaggaatcagaagaagatcagttag

SEQ ID NO: 108770 - DNA, 765 bp, Artificial Sequence
  Description of Artificial Sequence: Synthetic coding sequence
atggaattgtaccacgcgctcccttttttttgctttctccttgggaagtgttttaagaagggtctcaagggcaaagggtttgtccttctagtcaaacttgcatgcattgtggtggcttctttcgtcctgtgctggctgccattttttacagaaagggagcagaccctccaggtgctgagacggctttttcccgtggaccgtggcctgttcgaagataaggtagctaacatatggtgttctttcaacgtgtttttgaaaatcaaggacattctcccccggcatatccagttgatcatgagacctgtttgcctagtcttgtcagaaatcccattcatgagcacatggtttctcctagtgtccacattttcaatgctaccgttgttgttaaaggatgagctgcttatgcccagcgtcgttactaccatggccttctttatcgcctgcgttacgagctttagtattttcgagaagacctcagaggaggaactacagctcaagagtttctctattagtgtgcggaaatatctgccctgttttacgtttttgagtaggattattcagtacctgtttctgatctctgtgattacaatggtgctactaactcttatgacagtgacactggatccaccccagaagttaccagacctgtttagtgtgctggtgtgttttgtgtcctgcctcaacttcctgttctttttggtctactttaacattatcatcatgtgggatagcaagtccggacgcaaccaaaaaaagatctcatag

SEQ ID NO: 108771 - DNA, 1581 bp, Artificial Sequence
  Description of Artificial Sequence: Synthetic coding sequence
atggccgcattgacgatagccaccgggacaggcaactggttctccgccctggctctgggtgtcacgctgttgaagtgcctgctgataccaacctaccatagcacggactttgaggtccaccgcaactggttggccattacccactctctgccaatatcccagtggtactacgaggccacgagcgaatggaccctcgactaccccccttttttcgcctggtttgagtatatcctgagccatgtcgccaagtactttgaccaggagatgctcaacgtgcacaacttgaattactcttcttcaagaaccctgctgtttcagcggttttctgtaatttttatggatgtgctattcgtgtacgccgtgcgggagtgctgtaaatgtattgatggcaagaaggtcgggaaggagctgactgaaaagccaaagtttattttgtcggttctgctcttgtggaactttggtctgctgatcgtggatcatatccattttcagtacaatggtttcctattcggcctgatgttgctgtccattgctaggcttttccaaaaaaggcacatggaaggagccttccttttcgcagtgctgctccatttcaagcatatatatctctacgtggcccccgcttacggtgtatacctcctgcgctcctactgctttacagcaaataaaccagacggatccattagatggaaatccttcagttttgtcagggttatctccctggggttagtggtgtttctagtcagtgcactgagcctgggccccttcctcgctttgaaccagctaccacaagtattttcccggctctttcctttcaaacgcggcctgtgtcacgcatattgggcgcccaatttttgggccctctacaacgccctggacaaggtcctgagtgtgataggtctgaaactgaagttcctggaccccaacaatataccaaaggcttccatgacatccggcctcgtccagcagttccagcataccgtgctgccaagtgtaactcctctcgcaacgctgatctgcactctgatcgcaatcttgccgtctattttctgcttgtggttcaaaccccagggccctcgaggattcctgcggtgcctcacgctgtgcgccctatcctcgttcatgttcggttggcatgtgcacgagaaggccattctcctcgcaatcttaccaatgtcactgttgtccgtgggcaaggcaggtgatgcatcaatcttcctaatccttacgacgacaggacactatagccttttcccactgctgttcaccgctcccgaacttccaatcaaaattttactcatgctgttgttcactatttacagtatatcaagcctgaaaactctgttcaggaaggagaagcctctttttaattggatggagacattttacctgctgggtttaggacctttggaggtgtgctgcgagttcgtttttccattcacatcatggaaagtaaagtatcccttcatacccctacttctgaccagtgtctattgtgccgttggtattacctacgcctggttcaaactgtatgtgtctgttttaatagattcagcaattggaaaaacaaagaaacaatag

SEQ ID NO: 108772 - DNA, 1404 bp, Artificial Sequence
  Description of Artificial Sequence: Synthetic coding sequence
atggctgccctaaccatcgctacagggactggtaactggttcagtgcactagccctgggggtgacactgctaaagtgtcttctcatcccaacataccacagcacagactttgaagttcatagaaactggctggcaatcacacacagtctgcctatatctcagtggtattacgaagcgacttccgagtggacactggattaccctccatttttcgcatggtttgaatatatcctgagccacgttgccaagtatttcgatcaggagatgctgaatgtgcacaatctgaactattccagttcccgtaccctactttttcagcggttctccgtcatcttcatggacgttctgttcgtctacgccgtacgggagtgctgtaaatgcattgacggcaagaaggttggcaaggagctcactgaaaagccaaaatttattttatccgtgcttctactgtggaatttcgggctgttaatcgtggaccatatccattttcaatacaatggcttcctttttggacttatgctcctgtcaatcgcccgtctcttccagaagcgacacatggaaggagccttcctctttgccgtcttattacacttcaaacatatttatctctatgtggcaccggcctatggcgtctatcttctacggagctactgttttaccgcgaataagcctgatggatctattcgttggaaaagcttctcttttgttagagtgatttcactggggctggtagtctttctagtgtcagcactgagtctgggcccctttctggcacttaatcagctgcctcaggtgttctcgcgtctctttccatttaagaggggcctgtgtcacgcgtactgggcgccaaacttctgggccctgtataacgctcttgacaaagttctgtccgtgattgggctcaaactcaaattcctggatccaaataatattcccaaggcgagtatgacatccggtctcgtgcagcaattccaacatacagtgctgcctagtgttaccccgcttgcaactctaatctgcactttgatcgcaatacttcctagcattttctgcctgtggtttaagccacagggtccccgcgggtttctgcgatgcctgacactgtgtgccctcagttccttcatgtttggctggcacgtccatgaaaaagcaatacttctcgccatcttacctatgtcattgttgagtgtgggtaaagccggggacgccagcatctttcttattttgacaactacaggtcattactccctttttccactgctgtttacagctcccgagctacctattaaaattctgctgatgttactcttcacgatttactctatttcgagcctgaaaacgcttttccggcggagcttcacgctagtggctcaagctggagtgcaatggcacgacctgtcatag

SEQ ID NO: 108773 - DNA, 1323 bp, Artificial Sequence
  Description of Artificial Sequence: Synthetic coding sequence
atgatgctggccttcctggtgctttctaccgggatgttctgctccagctctgcctttctaccaagtagcttttgcatgtacaccaccctcattgcaatgacaggatggtatatggataagacatcaatcgccgttttgggtgtggctgcgggtgcaatactggggtggccttttagcgccgctcttgggctgccaattgcttttgacctgctcgtgatgaagcacagatggaagtctttcttccactggagcctaatggccctgatcctgttccttgttcccgttgtcgttattgattcttattactatggcaaactggtcatcgcccctttgaacatcgtgttgtacaatgtcttcaccccacatggtcccgatctgtatggtactgagccatggtatttctacttgatcaatggattccttaactttaatgttgccttcgcactcgctctgcttgtgctcccattaacaagcttaatggagtacctgttgcaacgatttcacgtgcagaatctgggacatccctactggctgaccctcgctccgatgtacatctggttcataatttttttcattcaacctcacaaagaggagcgctttctgtttcccgtgtaccccctaatttgcttgtgtggcgctgtggcactgtccgcgctgcaaaaatgctaccattttgtgttccagagatacaggctggagcactatacagtgaccagtaattggctagcactcggcacagtatttctgttcggactgctatccttctcccggtcagtggcattattcagggggtatcatggcccgctggacctgtaccccgaattctacaggatcgcaacagatccgactattcacacagttccagagggccggcctgtaaatgtgtgcgtggggaaagaatggtacaggttccctagtagtttcctcctccccgacaattggcagctccaattcatcccaagcgagttccgaggccaactgcccaaacctttcgccgagggccctttggcaacacggattgtaccaactgacatgaacgaccaaaatctagaggagccaagcaggtacatcgacataagcaagtgtcattacctagtagatctcgacaccatgcgggaaacccccagggaaccaaaatatagttccaataaagaagagtggatttcgctcgcgtaccgtcccttcctggacgcatcacgaagtagtaaactcctgcgggctttctacgtaccgtttctgagcgaccaatacaccgtatacgttaactacaccatcctaaaaccccggaaggctaaacagatacggaaaaaaagcgggggttag

SEQ ID NO: 108774 - DNA, 2535 bp, Artificial Sequence
  Description of Artificial Sequence: Synthetic coding sequence
atggccccgcgcagactgctgctcgtcggcgaggggaatttcagctttgccgcagctctaagtgaaacactggaccaatccactcagctgacagctacatgtctgcagcgacctgcagagctggcgagagacccactggcatgggagaacctgcagtgtctgcgggaacgtgggatcgacgtcagatttggagtggactgtacccagttagccgacgtgttcgaacttcacgagagagaattcgatcagatctattttattttccctcactgcggtaggaaggccggcgtggctaagaatagagaactgctggccaagttttttcaatcctgcgccgacgtgctggccgaggaaggggaggtgcacgtggccctctgtcgaggccaaggcggcaccccagcagataagcctcagcgggaatggcacaacagttggcaggtggtggcaatggctgctctgggcgggctaattctgtccgacgtctatcctttcagttgtaaagccgtggcaggatacaagtgcaccgggtaccgatctcaggataaaagttttcacgtggaaggggcgctcaatcatatcttcacacgctctctaccctttgaaggcagtcaaccacgaatcttccggatcaaacttggtaaccagtggttctcatttcccgaaccggaagccctcgtgggaaaactgaacaggctggccatggcgtcacggggtgctcgccaacgcctgaaggggtcaggagcatcttccggtgacaccgcaccggcggcagacaaactgcgcgaactcctggggagccgcgaggctgggggggctgaacataggacggaactgtccggaaataaggctggtcaggtctgggcccctgaaggaagcacggctttcaaatgtctgctgagtgccaggttgtgcgcggcgctgctcagcaacatcagcgattgcgatgagacttttaactattgggaaccaactcactatttgatatatggggaggggttccagacatgggagtacagtcctgcgtacgccattagatcctatgcctacctgttgctgcacgcctggccagccgcattccatgcccggatcctgcagactaacaagattctcgtcttttatttcctgagatgtcttttagctttcgtatcttgtatctgcgaactgtatttttacaaagcagtgtgcaagaaattcggattacatgtgtctcgaatgatgcttgcgttcttggtgctgagcacagggatgttttgtagcagctccgcctttctgccttctagcttttgcatgtacacgacacttatcgctatgactggatggtatatggataaaaccagcattgccgttctgggcgttgccgcaggcgccattctaggatggcctttctcagccgctctcggtctgccaatagcattcgacttactggtgatgaagcatcgttggaagtcattttttcactggagcctcatggccctcatcttgttcctggtacccgtcgtggtgatcgatagctactactacggcaaattggtgatcgctcccctcaacatcgtactgtacaacgtctttacgccacacggacccgatttatatggtacggagccctggtatttctatctgatcaacggtttcctgaatttcaatgtggcctttgcactcgctctgctggtcctcccactgacgagcctgatggaatatctcctgcagagatttcatgttcagaacctgggtcacccttactggttaacgctcgccccaatgtatatttggttcattattttcttcatacagccccacaaggaggagcgttttttgtttccagtgtacccactgatctgcctttgcggagcagtagctctctcggctctccagaaatgttaccatttcgtttttcaaagatatagacttgaacattacacagtgacttctaactggctggctctcggtaccgttttcctgttcgggttgctctctttctcacgcagtgtggccctgtttcggggctaccatggaccactggacctgtatccagagttctacagaatcgctaccgaccctaccattcatacagtgcctgagggccgcccggtaaacgtgtgcgtgggaaaggaatggtacagattcccctcttccttcttgcttccagataactggcaactccagttcataccgtccgaatttcggggtcagttgcctaagcctttcgccgaagggccacttgccactcgtatagtgcccacagatatgaatgaccagaaccttgaggaaccgagccgctatattgatatctccaagtgccactatttggttgatctagacaccatgcgcgagacaccccgggagcccaagtatagctcaaacaaggaggaatggatctccctcgcatataggccatttttggacgcttccagaagttctaaactgctgcgagctttctatgttccctttctgagtgatcagtacactgtgtacgtgaactacacaattttgaagcccagaaaggccaaacaaatccgcaaaaaatcgggcggctag

SEQ ID NO: 108775 - DNA, 1344 bp, Artificial Sequence
  Description of Artificial Sequence: Synthetic coding sequence
atgatgctggctttcctcgtgctgtcgacaggtatgttttgtagcagctccgccttcctcccctcttctttttgtatgtatacgaccctgattgctatgactggctggtacatggataagacatctattgcagttctgggcgttgccgccggggcgatcttggggtggcctttttctgccgccttaggtttgccaatcgcatttgacctgttagttatgaaacatcgttggaagtcgttctttcactggtcactgatggcactcatcctgttcttggtgcctgttgtggtcattgattcctattactacgggaagctagtgattgcccctcttaacattgttctttacaatgtttttactcctcacggccctgatctgtacggcacggaaccttggtacttctatctgataaatggctttttaaatttcaatgtcgctttcgccctggctctgctggtgttacctctaacttcgctgatggagtatttgctgcagcgctttcacgtacaaaacttgggccatccctattggctaactctggcaccaatgtatatttggtttatcatattttttatccagcctcacaaggaggagcggttcttgttcccagtctacccattaatctgtctgtgcggtgcagtcgcgctgagcgcgttgcagcattcattcctttactttcagaagtgctaccacttcgtgttccaacggtaccggctggagcattacacggttacaagcaattggctggcgcttggtaccgtgtttcttttcggcctcctttcattttcccgttccgtcgccctttttcgggggtaccacggaccactggatctgtatcccgaattttaccgtatcgctacagatcccaccatacatactgtaccagaggggagacctgtaaacgtgtgcgtgggtaaggagtggtacaggttcccaagtagtttcctgctgcccgacaactggcagctgcagtttattccctcagaatttagggggcagctgccgaagcccttcgcagagggccccctggccacgcgcatcgttcccaccgacatgaacgatcagaatttggaggaaccctctcggtacatcgatatctccaaatgccactatctggtagatttagatactatgagggaaaccccaagggagcctaaatacagctccaacaaagaagagtggatcagcctggcctaccgaccctttcttgacgcttccaggagttcaaaactccttagggccttctacgtcccatttttgtctgatcagtacaccgtctatgtgaactatactattctgaagcctcgtaaggccaagcagattcgcaaaaagagcggagggtag

SEQ ID NO: 108776 - DNA, 1647 bp, Artificial Sequence
  Description of Artificial Sequence: Synthetic coding sequence
atggtgttagcagagttatatgtgtccgatcgcgaggggtctgatgcaaccggtgacgggaccaaggagaagccattcaagaccggcctaaaggctttgatgactgtggggaaagagcccttccctacaatctatgtggactctcagaaggaaaacgaacggtggaatgttataagcaaaagtcaactaaagaatatcaagaaaatgtggcacagagaacagatgaagtcagagagcagagaaaaaaaggaggcggaagacagtttaagacgggagaagaacttggaggaggcaaagaaaatcaccatcaagaacgatcccagccttccggaacccaaatgtgttaaaataggagctcttgagggctatagaggacagcgcgtaaaggtttttggttgggtccaccgactcagacggcagggtaagaaccttatgttcctggtcctgagggatggcacaggctatctgcagtgcgtactggctgatgagctgtgtcagtgttacaacggagtgttgctgtccactgagagcagcgtcgccgtctacggaatgcttaacttaactcccaagggaaagcaggctcccggcgggcatgagctgagttgcgatttttgggaactcatcggccttgcgccggccggaggagcggacaaccttataaatgaggagtctgacgtggatgtgcagcttaataaccgccatatgatgattagaggagaaaacatgtcaaaaatcctgaaggccaggtctatggtaacgaggtgtttccgtgatcatttcttcgaccgtgggtactacgaggttacacctccaacccttgtgcagacacaggtggagggcggtgccacactgtttaaacttgactactttggcgaagaggcattcttgacacagtcatctcagctgtatctggaaacctgtctgccggcactcggagatgtgttctgcattgcccaatcttacagagccgagcagtctcgaacacggcggcatcttgccgagtacacacacgtggaagctgaatgtccattcttaactttcgatgatttactaaacaggctggaggatctagtgtgcgacgtcgtcgacaggattctcaagtcaccagcagggtccatcgtacatgagctgaatcccaactttcagccacccaaaaggccttttaaaagaatgaattactccgacgccattgtttggttgaaagaacatgacgtgaaaaaggaagacggaaccttctacgaatttggagaagatattcctgaagctccagaaaggctgatgaccgatacaattaacgagcccattctcctctgccggtttcccgtggaaatcaaatctttttatatgcaacgctgccctgaagacagcaggctaacagagtcagtggacgtcctcatgcccaatgtgggggagatcgtggggggcagtatgaggatttttgatagtgaggagattctggccggatacaaacgagaaggcattgatccgactccctactactggtataccgaccagaggaagtacggaacctgcccgcacgggggctacggattgggactcgaaagatttctgacctggatcttgaatcggtatcatattagagacgtttgtctgtatcccagatttgtacaacgctgcaccccctag

SEQ ID NO: 108777 - DNA, 765 bp, Artificial Sequence
  Description of Artificial Sequence: Synthetic coding sequence
atgactgtcggcaaagaacccttcccaaccatttacgtggacagccaaaaagagaacgaacgatggaacgtgatcagtaagtctcagttaaaaaatataaaaaagatgtggcaccgagaacagatgaaatccgagtcacgcgaaaaaaaagaagccgaggattctttgcgtcgagagaagaacttggaggaggccaaaaagataactataaagaacgaccccagccttcctgaacccaaatgtgtcaagatcggcgcactcgagggctacagaggccagagagttaaggtgtttggatgggtccacaggttgaggagacagggcaagaacctgatgttccttgtcttaagggacggaactgggtatctccaatgcgtcctggctgacgaactgtgccaatgctataacggtgtactgctgagcacagagtcttctgtggctgtgtatgggatgcttaatctgacccccaaagggaaacaagcacccggtggacacgagctttcctgcgacttctgggagcttattggactggctccagcgggcggcgccgataatcttattaatgaagaaagcgatgtggatgtccagttgaataatcggcacatgatgatccggggcgaaaacatgagcaagatactcaaagccaggtccatggttacacggtgctttcgagaccatttcttcgatagaggatattacgaggtgtccatgcattcctccgcctttgctaagaacatgtttttcgcggtgttgaaacttgaatag

SEQ ID NO: 108778 - DNA, 900 bp, Artificial Sequence
  Description of Artificial Sequence: Synthetic coding sequence
atgtgtgaagactggtgttttagagaccattttttcgatcgcggttactatgaggtcacaccccccaccctggtgcagacccaggtcgagggtggcgctacgctgtttaagctggactactttggcgaggaagcattcctgacacaatccagccagctgtacctggagacctgcctgcctgctctcggcgatgtcttctgcatcgcccagagttaccgggcagagcagtctcggactcgacggcacctggcagaatacactcatgtggaagctgagtgtcctttcctgacattcgatgacctgctgaaccggctcgaagatctcgtgtgcgacgtcgtggatcggatcctgaagtcacccgccggtagcatcgttcacgagttgaaccctaacttccagccaccaaaacggccttttaagcggatgaactactctgacgcgatcgtgtggctcaaggagcacgacgtcaagaaggaggacggcacgttttatgagttcggagaggatattcctgaagcccctgagcggctgatgacggacacaattaacgagcctattctgctgtgtagatttccagtagaaatcaaatcattttatatgcagaggtgccccgaggactctagactgaccgaaagcgtcgacgttttaatgcccaacgtcggagagatcgtgggtggatctatgcgtatattcgacagcgaggagatcctcgccggctacaaaagagaaggaatcgacccaacaccttactactggtacacagaccaacggaaatacggaacctgtcctcacggggggtacgggctagggctggaacggttccttacatggattttgaaccggtaccatatcagagatgtgtgcctgtatcccagatttgtccagcgctgtaccccttag

SEQ ID NO: 108779 - DNA, 525 bp, Artificial Sequence
  Description of Artificial Sequence: Synthetic coding sequence
atggtgctcgcagagctgtacgtgtcagaccgggaagggtctgatgcgacaggcgacggtacaaaggaaaagcctttcaagactggcctgaaggccctgatgaccgtgggcaaggagccctttccaaccatttatgtggacagccagaaggagaacgagaggtggaatgtgatctcaaaaagccagctgaagaatatcaaaaaaatgtggcaccgcgagcagatgaaaagcgagagccgcgaaaagaaggaggccgaagattccctccggcgggaaaagaacctggaggaggccaagaagatcaccattaagaacgatccttcgcttcccgagccaaaatgcgtcaaaataggcgcattagaggggtaccggggacagagagttaaggtgtttgggtgggttcaccgtcttagacgtcaggtgtccgtgctgcagtggagttctctggtgcacggcgaacagtgctgcagcgtgtggaatgccaaatcatacccaaaggggcaagccgggtccaggtggccctag

SEQ ID NO: 108780 - DNA, 1434 bp, Artificial Sequence
  Description of Artificial Sequence: Synthetic coding sequence
atgctgggagtgaggtgcctcctccgttcggtccgcttctgttcgagcgcccctttccccaagcataaaccgagtgccaagctgtccgtgcgcgacgccctcggcgcgcagaacgcttccggcgaacgcatcaagattcaagggtggataagatcggttagatcccaaaaggaagtcctgttcttgcacgtaaacgacggctcttctctggagagcctccaggtcgtggccgacagtggcctcgatagtcgggagttgaactttggatctagcgtcgaggtgcagggccaactaattaaaagtccgtctaagaggcagaacgtcgaattgaaggccgagaaaatcaaagtcattggaaattgcgacgcaaaggatttcccaatcaagtacaaggagcgccaccctctagaatatctgcggcagtatccacacttcagatgcagaactaatgtgctcggtagcatattgagaatccgaagtgaggcaaccgcagctatccattcatttttcaaggattctggctttgttcatatccacacccctattattacatcaaatgactctgaaggagcaggggagcttttccagctggagccaagcggcaagctgaaagttcctgaagaaaacttttttaatgtgcccgcgttcctgacagtcagtggtcagctccacttggaagtgatgtcaggagcctttacacaggtgtttacatttggccctacgttccgcgccgaaaattcccagagtcggcgacatctggcggagttctatatgatcgaggcggaaatatcgtttgtagacagcctgcaggatctgatgcaggtgattgaggagttgtttaaggctaccaccatgatggtgcttagcaaatgcccagaggatgtcgagctctgccacaagttcatcgcaccaggacagaaagaccgcctggagcacatgctgaagaataactttctaatcatctcttataccgaagccgttgaaattctgaaacaagcttctcagaattttaccttcacacccgaatggggggctgatttgcgcacggagcatgagaagtatttggttaagcattgcggtaacatcccggttttcgtaatcaactatccgctaactttaaaacctttctatatgagggacaacgaagacggaccgcagcacactgttgccgccgtggacctgctggtgcccggggttggtgagctatttgggggtggtctgcgcgaggaacggtaccactttcttgaggagcgactggcacgctctggcctgactgaggtataccaatggtacctggacctgcgccggtttgggagcgtaccgcatggagggttcggcatggggttcgagagatacctgcagtgtatacttggagtggataatattaaagatgtgatccctttccccagatttccccattcttgcttattgtag

SEQ ID NO: 108781 - DNA, 942 bp, Artificial Sequence
  Description of Artificial Sequence: Synthetic coding sequence
atggctcaacgcaagaacgcaaaatccagtgggaactcatcatcctccggttccgggtccggcagcacgtccgccggatcctcttccccaggggcgcggagggagacaaagcatggagggcataagaatggtcgcaagggcggcctgtctggtactagctttttcacttggttcatggtgatcgccctgctgggggtgtggactagtgtagcggtggtctggttcgatttagttgactacgaggaggtacttggaaagctggggatatatgatgccgacggagacggcgattttgacgttgatgacgctaaggttttgctgggcctgaaggagcgttctacatctgagcctgctgttcctcctgaagaagccgagcctcatactgaaccagaagagcaggtgccagtggaagctgaaccccagaatatcgaggacgaggccaaggagcagattcaaagcttactgcacgaaatggtgcatgccgagcacgtcgagggcgaggacctgcagcaggaagatggtccaactggtgagccacagcaggaagacgatgagtttctgatggctactgatgttgatgatcggttcgagaccttggagcccgaggtttcgcacgaagagaccgagcacagctaccatgtagaagaaaccgtctcccaggactgcaatcaagatatggaggagatgatgagcgaacaggaaaacccagactcttctgaaccggtggtcgaagacgaaagactgcatcatgatactgatgatgtcacatatcaagtttacgaagaacaggccgtatatgagccactcgaaaatgagggcatagaaattaccgaagtcactgcgcccccggaggacaatccggtggaggatagccaggtcatagttgaagaggtaagcatttttcctgtagaagagcaacaggaggtccctcccgatacatag

SEQ ID NO: 108782 - DNA, 612 bp, Artificial Sequence
  Description of Artificial Sequence: Synthetic coding sequence
atggcccagagaaagaatgcgaagagcagtggtaattcttcctctagcgggagcggaagcgggagcacaagtgcgggctcctcgtccccgggcgcaagaagagagaccaagcacggcggacacaagaatggaaggaaaggcggcctcagtggaacatcatttttcacgtggttcatggtgatcgcgctgctaggggtgtggacctccgtcgccgtcgtttggtttgacctggttgactacgaagaggtgctagccaaagcaaaagattttcggtataacctgagcgaagtcctgcaggggaaactgggaatttacgacgccgatggggacggcgactttgacgtggatgacgctaaagtacttttgggactgacaaaagacggcagtaacgaaaacattgatagcctggaagaggtgcttaacattttggccgaagaatcaagtgattggttctatggctttctgtccttcctttacgatatcatgacacctttcgagatgctggaagaagaggaggaagagagcgaaacagcagatggggtagatggcacaagtcagaacgaaggcgtacagggaaaaacctgtgtcatactcgatttacacaatcagtag

SEQ ID NO: 108783 - DNA, 2277 bp, Artificial Sequence
  Description of Artificial Sequence: Synthetic coding sequence
atggcccaaaggaaaaatgccaagtcttcgggcaacagcagctcgagtggctccggatcgggctccaccagtgctgggtcgtccagcccaggtgctaggagggagaccaaacatgggggacacaagaatggccgcaaaggtggccttagcggaacatcctttttcacatggtttatggtgattgccctgctgggagtttggaccagtgtcgccgtagtatggtttgacctcgtagattacgaagaggtgctggggaagttgggtatctatgatgccgacggtgatggagactttgacgtggacgatgccaaggtcttgctgggcctcaaggaacgcagtacctcggagccggccgttcctcccgaagaagcagagcctcacacagaaccagaagagcaagtcccagtcgaggcagagcctcagaacattgaggacgaagcgaaggagcagatccaaagcctgttgcacgagatggtccacgccgagcacgttgagggggaggacctgcagcaggaggacggaccaactggggagccgcagcaggaggatgacgagttccttatggctactgacgtcgatgacagattcgagactcttgaacccgaggtgagccatgaagagacagagcatagttaccatgtagaagagaccgtttcgcaagactgtaatcaagatatggaggagatgatgtcagagcaagaaaatcccgatagctccgaacccgtggtggaggacgaacggctgcaccatgacactgatgacgtgacctaccaggtttacgaagagcaagcggtctatgaacccttagaaaacgaaggaatcgagattactgaggttactgcccccccagaggacaaccccgtggaagacagccaggtgatcgtggaggaggtgtccatttttccagtggaggagcagcaggaggtgcctccggagactaataggaagacagatgatcctgagcaaaaagcaaaggtgaaaaaaaagaagcccaagctgttaaacaaattcgataaaacgattaaggccgagctcgacgccgccgaaaaactgcggaagcggggcaagattgaggaggccgtcaacgctttcaaggagctcgtcaggaagtatccacagtctcccagagcaaggtatggtaaggctcagtgcgaggacgatctcgccgaaaagcgccgcagtaatgaggtgctgaggggggccatcgaaacgtaccaggaggtggctagcctgcctgacgtgccagcagacctgcttaaactctccctaaaacggcgcagtgaccgccagcagttccttgggcatatgagaggatctctgctgaccctgcagagattagtccagctgtttcctaatgacacctctttgaaaaatgacctcggggtgggatatcttttaatcggagacaacgacaatgctaagaaagtgtacgaagaggtgctttctgtgacacccaatgatggtttcgcaaaggtacactatggctttattttgaaagcccagaacaagattgctgaatctattccctatctgaaggagggaattgagtccggagaccctgggaccgacgacgggaggttctactttcacctcggggatgccatgcagcgagttggcaataaggaagcttataagtggtacgaactcgggcacaagcgcggtcactttgcatcggtttggcagcgctcattgtataatgtgaatggcctaaaggctcagccatggtggacccccaaggaaactggctacacagaacttgtcaagtccttggagcgcaactggaagcttattcgcgacgaaggactggcagtaatggacaaagcgaaagggctgtttctgccagaagatgaaaatttgagagagaaaggggattggagtcaatttaccctttggcaacagggccgcaggaatgagaacgcttgcaaaggagccccgaagacttgtacattactggagaagttcccagaaactaccgggtgtcgccgcggccaaattaaatattccattatgcatcctggcacccacgtgtggccacacactggtccaaccaactgtcggttgcggatgcatctcggtctcgttatccccaaagagggatgcaagattcggtgtgcaaatgaaacgaagacctgggaggaaggtaaggtcctgatctttgacgattcatttgagcatgaagtttggcaggacgcatcctctttccgccttattttcatcgtcgatgtgtggcaccccgagcttaccccccagcagcgtcgctctctccctgccatctag

SEQ ID NO: 108784 - DNA, 678 bp, Artificial Sequence
  Description of Artificial Sequence: Synthetic coding sequence
atggccgaggacaaagagaccaagcatggtggacacaagaacggacggaagggtggtctgtccgggacttcattttttacttggttcatggtcattgcactgctgggtgtttggacatccgtagctgttgtgtggttcgaccttgtggactacgaggaagtcttggctaaggcaaaggacttcaggtataacctctcggaggttctccagggtaaattaggcatttacgatgcagatggcgatggcgatttcgacgtggatgatgccaaagtactgcttgaaggtccaagcggggttgccaaacgcaagacgaaggcaaaagttaaggaactgactaaagaagagctgaaaaaagagaaggaaaagcccgaatctagaaaagaatctaagaacgaagagagaaaaaagggtaaaaaggaggacgtccgcaaggacaagaaaatcgcggatgccgacctgtctaggaaggaatctcccaaaggcaagaaagaccgcgaaaaagagaaagtggacttagagaagagtgccaagacgaaagagaacaggaagaagtctacaaatatgaaagatgtctcttctaagatggctagccgtgataaggacgaccgtaaagaaagccgatcatctacacggtacgcccacctgaccaaggggaatacacagaaacgtaacggatag

SEQ ID NO: 108785 - DNA, 1290 bp, Artificial Sequence
  Description of Artificial Sequence: Synthetic coding sequence
atggcccagcggaagaacgcaaagagtagtggcaactcatcgtccagcggatctgggtccggctccaccagtgccggatcctcctcccccggcgcgagaagagagaccaagcacggtggtcacaagaatgggcggaaaggtgggcttagcggaaccagtttctttacatggtttatggtgatcgcattgctcggagtctggacgagcgtagctgtagtgtggttcgacttggtcgattatgaagaggttttgggcaagctcggcatctatgatgccgatggcgacggggatttcgacgtggacgacgccaaggtgttgcttgggcttaaagagagatcgactagcgagcctgcagtgccgccagaagaggctgagccccatacagagcctgaggaacaggtgcctgttgaagccgagccccagaacattgaagacgaagctaaagaacagatccagagtctacttcatgagatggtccacgctgagcacgtagagggagaagacctccagcaggaagatggtcccacaggtgagccccagcaagaagacgacgagttcctcatggccaccgacgtcgacgaccggtttgagaccttagaacctgaagtgagccatgaagagactgaacattcatatcatgttgaagaaaccgactcctctgaacccgtggtagaagatgaacggcttcatcacgacacagacgacgtcacctaccaggtgtacgaagagcaagccgtatatgaacccctagaaaacgaaggtatcgaaatcactgaggtgacggctccccccgaggataaccccgttgaggactcacaggtaatagtggaggaggtgagcatcttcccagtggaagaacagcaagaagtgcctcctgagacaaatcgcaaaacggacgaccccgaacagaaggccaaagtgaaaaaaaagaagcctaagctgttgaacaagtttgacaagaccattaaggccgagttggatgccgctgagaaactccgcaaacgtggaaagattgaggaggccgtcaacgctttcaaagaactggtgcggaagtacccccaatccccacgagcccgctacggcaaagcccagtgcgaggatgacttggctgagaaaaggagatccaacgaagtgctgcgaggggccatcgaaacctaccaggaggtagcttcgcttcccgatgtgccagccgatttgctcaagttaagccttaagcgaagaagcgaccggcaacagttcctcgggcatatgagagggagcttgctgacactccagagactagtacaatag

SEQ ID NO: 108786 - DNA, 900 bp, Artificial Sequence
  Description of Artificial Sequence: Synthetic coding sequence
atggcagaagataaggagaccaagcacgggggccacaagaatggccgcaaaggtggtcttagcggcactagcttttttacctggttcatggttatcgcactcctgggggtatggacttcagtcgctgtagtgtggttcgacctcgtggactacgaggaggtgcttgccaaggccaaggactttagatataacctgagcgaggttcttcagggaaagctggggatttacgacgccgacggggatggcgatttcgatgttgatgatgccaaggttttgctcgggctgaaggagcgcagcacctccgaaccagcagtcccgccggaggaggcagagcctcacactgagccggaagagcaagttccagtcgaagcagaaccacaaaatatagaggacgaggccaaggaacagatacagtccttgttgcacgagatggtacacgctgagcatgtcgaaggcgaagacttgcagcaggaggacgggcccaccggcgaaccccagcaggaggatgatgagttcctgatggccacagatgttgatgacagattcgaaaccctggagcccgaagtatcccacgaggagactgagcatagctaccatgtagaggagaccgtcagccaggactgtaaccaggatatggaagagatgatgagcgaacaggagaaccctgattcctctgagcccgtcgtagaggacgagcgtctgcatcacgacacggatgacgtgacatatcaggtgtatgaagagcaggcggtgtacgagcccctggaaaacgaggggattgagataaccgaggtcaccgcacccccagaggacaatcccgttgaagactcccaggtaattgtggaagaggtttccatttttccagttgaggagcaacaagaggttcctccagacacatag

SEQ ID NO: 108787 - DNA, 900 bp, Artificial Sequence
  Description of Artificial Sequence: Synthetic coding sequence
atggccgaagacaaagaaacgaaacatggcgggcacaaaaacggacggaaaggtgggctctctgggacatcttttttcacatggtttatggtgatcgccctactcggagtgtggacctcagtcgctgttgtgtggttcgacctcgtcgactacgaggaggtactggccaaggccaaagatttcagatacaacttgagcgaggtgcttcaaggcaagctcggtatttatgacgctgatggggacggtgacttcgatgtggacgatgccaaagtgctactgggtcttaaagagcgaagcaccagtgagcccgctgtccctcccgaggaggcggaaccacacactgagcctgaggagcaagtgccagtcgaggccgagccgcaaaatattgaggatgaggcgaaggagcaaatccagagcttattgcatgagatggtacatgcagaacatgtggagggggaggaccttcagcaagaggatggccccactggggaaccccagcaggaggacgatgagtttttgatggcgactgatgtggatgacagatttgagaccctggagcctgaggtcagtcacgaggagactgagcactcgtaccacgtggaagagaccgtgagccaggactgtaaccaggacatggaggaaatgatgtcagagcaagagaatccagactccagcgaaccagtggttgaggatgaacgtctgcatcacgatacagacgacgtaacttaccaggtgtatgaagaacaggctgtgtatgagcctctagagaatgagggcatcgagatcaccgaggtgacagctcccccagaagataaccccgtcgaggactctcaggtgatcgtggaagaagtaagcatcttcccagtggaagagcaacaggaagtgcccccagacacatag

SEQ ID NO: 108788 - DNA, 897 bp, Artificial Sequence
  Description of Artificial Sequence: Synthetic coding sequence
atggccgaagataaggagaccaagcacggggggcacaagaatggccggaaagggggactgtcgggaacaagcttctttacttggttcatggtgatagctctcctgggcgtgtggaccagtgttgctgtagtttggttcgatttggtggactacgaggaggtgctggccaaagcgaaggactttcgatacaatcttagtgaggtgctgcagggaaagctcggaatttacgatgcggatggggatggagactttgacgttgacgacgctaaggtcctgcttgggttgaaagaacggagtacttctgagcccgctgtgcccccagaagaggcagaaccgcataccgagcccgaggaacaagtgcccgtagaggctgaaccacaaaatatcgaagatgaagcaaaggagcagatacaatccctactgcacgagatggtgcatgccgaacatgtagagggtgaggacctgcagcaggaggacggccccacgggagagccgcaacaggaagatgatgagtttctgatggcgactgacgtcgacgaccgattcgaaaccttggagcctgaagtcagccatgaggaaaccgagcattcttatcacgtggaagaaacagtctcgcaagattgcaaccaggatatggaagagatgatgtctgagcaagaaaaccctgactcctcggaacccgtcgttgaggatgagcggctccaccacgatactgatgatgtcacctaccaggtgtatgaagaacaggtatacgaacctttagaaaacgaagggatcgagattactgaggtgacagccccaccagaggacaatcctgtggaagattcacaggtgatagtggaagaggtgtccattttcccagtggaggaacaacaggaagtgccgcctgacacctag

SEQ ID NO: 108789 - DNA, 813 bp, Artificial Sequence
  Description of Artificial Sequence: Synthetic coding sequence
atggctcagcgtaagaacgctaagtcaagcgggaattcgtcctcttctggatctggcagtggttcaacaagcgcaggatcctcctcacccggagccagacgggaaaccaagcacgggggccataaaaatgggcgaaagggaggcctaagcggcacgtcgttcttcacttggttcatggtaattgcgcttctcggcgtgtggacaagcgtagccgtggtctggtttgaccttgtcgattatgaagaagttctgggaaagttaggtatctacgacgctgacggggatggggactttgacgtagacgatgccaaagtgctgctcggccttaaggagagaagcacaagtgagccagcagtcccacctgaagaggcagaacctcacacagagccagaggaacaagtgcccgttgaagcagagccccagaacattgaggatgaagcgaaggagcagatccagtccttgctacatgagatggtccatgccgaacacgagactgagcactcttatcacgtggaggagaccgtgagtcaagactgcaatcaagacatggaggaaatgatgagcgagcaggagaaccctgattcctccgagcctgtggtagaggacgaaaggctgcatcatgatactgatgacgtgacgtaccaggtgtacgaggagcaggctgtgtatgagccactcgagaatgaaggaatcgaaatcaccgaggtgacagcaccgccggaggacaatccagtggaggacagccaggtaatcgtggaagaagtctccattttccctgtggaggagcagcaggaagtcccgccggacacgtag

SEQ ID NO: 108790 - DNA, 633 bp, Artificial Sequence
  Description of Artificial Sequence: Synthetic coding sequence
atggcagaggacaaggaaactaaacacgggggacacaagaacgggagaaaaggaggcctcagcggcacatctttctttacatggtttatggtcatcgccttgcttggcgtttggacgtctgtggccgtggtttggttcgacctggtggattacgaagaggtgctgggaaaactggggatctacgacgcagacggggacggtgatttcgacgtggatgatgccaaggttctgctggaaggccctagcggggttgccaagcgcaagaccaaagccaaagttaaggagctaaccaaagaagaactcaagaaagagaaagaaaaacccgagtcgcggaaagagtcaaaaaatgaggaaagaaaaaaaggtaagaaggaagacgtgcgtaaggacaagaaaattgcggacgccgatctctctaggaaagagtcgccaaagggcaaaaaggaccgagaaaaggaaaaagtggatctcgagaagagcgcaaagacgaaggagaatcggaagaagtcgactaacatgaaagacgtttctagtaaaatggcctctagggataaagacgacaggaaggaatccaggagctcaacccgctacgcccacctgactaaaggcaatacccagaagagaaacggttag

SEQ ID NO: 108791 - DNA, 771 bp, Artificial Sequence
  Description of Artificial Sequence: Synthetic coding sequence
atggccgaggataaagagacaaaacatggggggcacaagaatgggaggaagggagggctctctggcacaagtttttttacttggtttatggtgatcgccttgctgggcgtctggacctccgtcgctgtcgtttggttcgacctggtcgattatgaggaagtcttagccaaggccaaggatttccgatataacctcagcgaagtattacaaggtaagttgggtatatatgacgcagacggcgacggtgatttcgatgtggacgatgccaaagtgcttctgggcctgaaggagcgcagcacttccgaacctgcagttccaccggaggaggccgaaccacatacagaacctgaagagcaggtgcctgtagaggcagaaccccagaatatcgaagacgaggccaaggagcagatccaaagcctccttcacgagatggtgcatgcagagcacgaaaccgaacatagttatcacgtggaggagaccgtgtcacaagattgtaaccaggacatggaggaaatgatgtcagagcaggaaaatcctgacagcagtgagcctgtggtggaggatgaacggctgcatcacgataccgacgacgtaacctatcaagtctatgaggagcaggcggtttatgaaccactcgagaatgagggaatagagatcacagaggtcacggctccacccgaggacaaccccgtagaggattcacaggttatagtcgaagaagtgtctatttttccagtggaggaacagcaggaggtacctcccgatacgtag

SEQ ID NO: 108792 - DNA, 2190 bp, Artificial Sequence
  Description of Artificial Sequence: Synthetic coding sequence
atggcagaagacaaagagaccaagcacggcggccacaagaacggccggaagggagggttgagcggtacctcattcttcacctggtttatggtaattgcattgctgggcgtgtggacatcagtggctgttgtatggttcgatcttgtcgactacgaagaggttcttggcaagctagggatatatgacgcagatggcgacggcgacttcgacgtagacgatgcaaaggtcctcctgggactcaaggaaagaagcacaagcgaaccagccgtaccacctgaagaggccgagcctcacaccgaacctgaggagcaggtgcccgtagaggcagagccgcaaaatatcgaagatgaagccaaagagcagatccagagcctattgcacgaaatggtacatgccgagcacgtggagggggaagatttacaacaagaggacgggcccacaggagaaccgcaacaggaagatgacgagtttctcatggctaccgacgtggacgaccgcttcgaaacccttgagcctgaagtgtcccatgaagagactgaacattcgtaccatgtggaagagactgtttcccaggactgcaatcaggatatggaggagatgatgtctgagcaggagaatcccgactctagtgaaccagtcgtcgaggacgagcgtctgcatcatgatactgatgacgtgacctaccaggtgtacgaggaacaggccgtctacgagcctcttgaaaatgaaggtatcgagatcacagaggtaacagctccccccgaagacaaccccgtagaagattcacaagtgatcgtcgaagaagtctcaatctttcccgtagaggaacagcaggaggtccctccagagactaacaggaagacagatgacccagaacagaaagccaaagtcaagaagaaaaaacccaagctgttgaataaatttgacaagactattaaggctgagctagatgccgcagagaagctgcggaagcgcggtaagatcgaggaggccgtgaacgcgttcaaagaattggtccgaaagtatccacagtctccccgggcccggtatgggaaggcacagtgcgaggatgatcttgcggaaaaaagaagatctaacgaggtcttacgcggggcaatcgagacctaccaagaggtggcctccctcccagacgtacctgcggatttactaaagctctccttgaagagacggtctgatcggcaacagtttttaggccacatgcgaggcagcctcctaaccttacaacgcctggtgcagttatttccaaacgacactagcctgaagaatgacctgggcgtgggctatcttctgataggagataacgacaacgctaaaaaggtttacgaagaggtgctttctgtgacacctaacgacgggtttgcaaaggtccattacggattcattttgaaggcccaaaataaaatcgcagagagcattccatacctgaaagagggaattgaaagcggggatccaggaacagacgatggtaggttctacttccacctgggcgatgcaatgcaaagagtgggaaataaggaggcctataaatggtatgaactgggccacaaaagaggacattttgccagcgtgtggcagagatctctgtataacgtgaacggactgaaggcccagccctggtggacacccaaggagaccggatatactgaactcgttaaaagcttagagcgcaattggaaacttataagggatgaggggctggccgttatggataaagctaaaggcctcttcctgccagaggatgagaatcttcgagaaaagggcgactggagtcagttcacgctttggcagcaggggcggcgcaatgaaaacgcatgtaaaggcgctcccaaaacatgtacattgctggagaaattcccagaaacgaccggatgtcggagaggacagatcaaatattctatcatgcacccaggcacccacgtgtggcctcatactggccccactaattgccgacttcggatgcacctgggacttgtgatcccaaaggaagggtgtaaaattcggtgtgccaatgagacaaagacgtgggaggaaggaaaagtactaatttttgatgactcattcgaacatgaggtctggcaggatgcatcttctttccggctcatctttattgttgacgtctggcatccggagctgacccctcagcaacgccggagtcttccagcaatctag

SEQ ID NO: 108793 - DNA, 1032 bp, Artificial Sequence
  Description of Artificial Sequence: Synthetic coding sequence
atggggtccccgggtgcttctctgggcatcaaaaaagcattgcagtctgagcaggccactgcccttccggcgagcgcccccgccgtctcacaacctaccgcccctgctccaagctgtttacctaaggccggccaggtgattccgacactcttgcgagaggcaccattctcgtccgttattgctcccaccctactttgcggctttctttttctggcgtgggtcgcagccgaagtgcccgaggaatcgtcccggatggccggaagcggtgcccggagcgaggagggacgccgacaacacgcctttgtaccggagccattcgacggagccaacgttgtgccaaatctatggctgcattctttcgaagttataaacgacctgaatcactgggatcatatcactaaactgcggtttcttaaagaatcattaagaggtgaggcccttggcgtatataatcggctgtctccgcaagaccagggagattatggaactgttaaggaagcactcctaaaagccttcggggtgcctggtgcagctccgagccatctgcctaaggaaatagtttttgccaactcaatgggcaaggggtattatcttaagggcaaaatcggtaaggtgccggtcaggttcttagtagattcaggcgcacaagtgagcgtggttcatcccaacctgtgggaggaggtgacagacggggatctcgacacattgcagccttttgaaaatgtcgtcaaagtggccaatggggcagaaatgaaaatactcggcgtgtgggacaccgccgtctccctcggcaaactcaagctcaaagctcagtttctggttgctaacgcaagtgcagaggaggcaattatcgggaccgatgtcctgcaggatcataatgccatcctggacttcgaacaccgcacatgcactctgaaaggaaagaagtttcgactgctgccagtgggaggatcactggaggatgaatttgatttggagctcatcgaggaagacccatcaagcgaagaggggagacaggaattgagccactag

SEQ ID NO: 108794 - DNA, 960 bp, Artificial Sequence
  Description of Artificial Sequence: Synthetic coding sequence
atgtgttctcttcccgttccccgtgaaccgttgaggcgtgtggctgtcacgggcgggacacacgggaacgagatgtctggggtgtatctcgcacgccactggctgcacgcaccagccgagctacagcgggcctccttcagtgctgtccctgtcttggcgaatccggcggctacctccggatgtaggcgatatgtggatcatgacctgaacaggacatttaccagcagctttcttaattccaggcccactccagatgacccctacgaagtgacacgtgcacgcgagctcaatcagctcctcggcccaaaggcttctgggcaggctttcgatttcgttcttgaccttcataacactacagccaacatgggtacatgtttaatcgccaagagtagccacgaggtcttcgccatgcacctgtgcagacacttgcagcttcagtaccctgagttaagttgtcaagttttcctgtaccagagaagcggagaagaatcttataacttggattcagtggctaaaaacggcctggggctcgaactgggcccccagccccagggcgtgctccgggcagacatattctcaagaatgaggaccttggttgctaccgttttggattttatcgagctgtttaatcagggtactgcattccccgccttcgagatggaggcctacaggcctgtgggtgtagtggattttccacgcaccgaggcgggacatcttgctggtacagtacacccacagttacaagacagagacttccaacctctgcagcccggtgcccctatcttccaaatgttctcaggagaggatctcctgtatgaaggagaaagcacagtatacccggtgtttattaacgaggctgcctattacgagaagggggttgccttcgtccagaccgaaaaatttacattcaccgtccccgccatgcctgccctgactcccgcacccagtccagcttcatag

SEQ ID NO: 108795 - DNA, 1041 bp, Artificial Sequence
  Description of Artificial Sequence: Synthetic coding sequence
atggccagaaagagtaatctgccagtgcttttagttccattcctgctgtgtcaggctctggttcggtgtagttctcctttgccacttgtggtcaatacatggccatttaaaaacgccacagaggctgcatggagggcccttgccagtggtggatctgcattagacgccgttgagtctggctgtgccatgtgcgagcgggaacagtgtgatggctccgtgggcttcggaggcagcccagacgagctcggcgagacaactctggatgctatgatcatggacggaaccacaatggacgttggtgccgttggagatctccggagaatcaagaatgctatcggagttgctagaaaagtgctcgaacatacgacacatactctactggtgggcgagagtgccaccaccttcgcacagtccatggggtttatcaatgaggatctttcgacaaccgcgtcccaggctctgcattctgactggcttgctagaaactgtcagcccaactattggagaaatgtcataccagaccccagcaagtattgtggcccttataaacctcccggcatcctaaagcaggacatccccattcataaagagaccgaagatgacagaggacatgacactatcggaatggtggttatccacaagaccggacatatcgcagctggcaccagtactaatggcattaaattcaaaatacatggacgcgtgggggactcccccatcccaggggccggtgcctacgccgatgacactgctggagctgccgccgccacaggcaacggggatatcttgatgaggttcttgccgagctaccaggcagtggaatacatgcgtcgcggcgaggacccaaccattgcttgtcagaaggtgatctccagaatccagaagcactttcccgagttcttcggcgccgtgatttgcgccaatgtgaccgggtcttatggggccgcctgcaacaaactgtcgacgttcacccagttttcctttatggtgtataactcagaaaagaatcagccaaccgaggaaaaggttgactgcatctag

SEQ ID NO: 108796 - DNA, 573 bp, Artificial Sequence
  Description of Artificial Sequence: Synthetic coding sequence
atggagtcccaacggctggaactgattcggctcatggaaacccaggaggaggatgttgttctcctcaccgcaggcgagcataacaaggcctgttcactgttgggcaagctccgcctggaatgcgctgaccttctggagacaagaggagtggtgttacgggatccaacgcttttcagttttctctgggtggttgacttcccactattcttgcccaaagaagagaaccctagggagttggagagcgctcaccaccccttcaccgcaccgcacccatccgacatacatttactgtacaccgagcccaagaaggaagacgtcaagatgctctctcatctgctgcaggcactggactatggcgcccctccccacggcggtatcgcacttggtcttgacaggcttatctgtctggtgaccggcagccctagcattcgagatgttatcgcctttccaaagagttttcgtggtcacgatttgatgagtaacacccccgactccgtgccccctgaggaacttaagccttaccatattagggtgagcaaacctacagacagcaaggcagagagagcgcattag

SEQ ID NO: 108797 - DNA, 1938 bp, Artificial Sequence
  Description of Artificial Sequence: Synthetic coding sequence
atgtacttcccgtcctggctgagtcaattatatagaggcttatcacggccaataagaaggaccacccaaccaatctggggttctctgtatcgctccctccttcagtccagccagcggcgcatcccagaattcagttcatttgtggtgagaaccaacacatgtggagagttacgatctagccatctcggtcaggaggtgacgctgtgcgggtggatccagtaccgccggcagaacacattcttggtgctgcgcgatttcgatggcttggtccaagtaatcatacctcaggacgagtctgctgcgtcggtcaagaaaatcttgtgcgaggctccagtggagtccgtggtccaggtgtccggcacggtgattagcagaccagcggggcaagagaatccaaaaatgccaacgggagaaatcgagatcaaagtcaaaactgccgagctccttaacgcgtgtaaaaaacttccttttgagatcaaaaacttcgtgaaaaaaacagaagccctgcggctgcagtatagatacttggatttgcgctcgtttcagatgcagtacaaccttaggttacggtctcaaatggtcatgaagatgcgagaatatctgtgtaatctccacggatttgtagatatcgagaccccaacactgtttaagagaacccccggaggagcaaaagaatttctggttccaagtagagagcccggaaagttttatagccttccccaaagcccccagcagtttaaacaactgctaatggttggcggtctggataggtactttcaggtggccagatgttatagagatgaaggatcaagacctgatcggcagcctgagttcacacagatcgacattgaaatgtcattcgtagaccagacaggaatccaatccttgatcgagggcctcctgcagtattcttggcctaacgacaaggatccagtggtcgtgccgtttcctaccatgacttttgcagaagtgctggcaacctacggtaccgacaaacccgatacaaggttcggtatgaagataatcgacatttctgatgtgtttcgcaacacagagattggcttcctacaggatgcactctcaaaacctcatggtaccgtgaaggccatttgtatcccagagggcgctaaatacttgaaacgcaaggacatcgaatctattagaaactttgcagcagatcatttcaaccaggagatcctgcccgtgtttctcaacgcaaaccgtaactggaactctccggttgccaacttcattatggaatctcagcgcctcgagcttataaggttgatggagacccaggaggaagatgttgtgctactcacagcaggtgagcataacaaggcctgctccctgctggggaaactgaggctggagtgcgcagacctgctcgagacacgcggagtcgtcctgcgagatcctacactgttttcattcctgtgggttgtggatttccctctgttcttgccaaaggaagagaatcccagagaactggaatccgctcaccacccattcaccgctccgcatccaagtgatattcatctgctctatactgagcctaaaaaagctcgcagccagcattatgacctggtgttgaatggtaacgaaattggtggaggctctatccggatacataatgctgaattacagcgctatatactggcaacactgctcaaagaagacgtcaaaatgctgtcacatctgcttcaagccctggattacggtgccccccctcacggaggcattgccctgggtctggatcggttaatctgcctggtcaccggaagcccttctattagggatgtaatcgcatttcctaaatcttttagagggcatgatctgatgtccaatacacccgattccgtgccacctgaagagctgaaaccctatcacatcagggtgagcaagccaaccgattcgaaagccgaaagagcccattag

SEQ ID NO: 108798 - DNA, 1143 bp, Artificial Sequence
  Description of Artificial Sequence: Synthetic coding sequence
atgaaagaatacgtgctcctgctgtttctcgcgctctgctcagccaaaccgttcttcagcccctctcacatagctctaaaaaacatgatgctcaaggacatggaggatactgatgacgacgacgatgatgacgacgatgacgacgatgacgatgaggacaattctctgtttcctactcgggagcctcgcagccatttttttcccttcgatctattccctatgtgtcccttcgggtgccaatgttactcccgcgtcgtgcattgctccgacctggggctgacgtccgtgccaacaaacatcccgtttgacaccaggatgctggacttgcagaacaacaagatcaaggaaatcaaggaaaacgatttcaagggactcacctctctctacggcctcatcttgaataacaacaaactgactaagatccaccccaaggctttcctcacgacaaaaaaactgcggcggctgtaccttagtcataaccagctgtccgagatacctttgaaccttcccaagtctctcgctgagttgcgtattcatgaaaacaaggtgaagaaaatccaaaaagatacctttaaaggaatgaatgctctgcatgtccttgagatgagcgccaatcccctggacaacaacggaatcgagcccggcgcatttgaaggagttaccgttttccatatacggattgcagaggctaagttgaccagtgttccgaagggactgccaccaaccctactcgaactccacctggactacaacaagatttccactgttgagctggaagactttaagcgatacaaggagctgcagaggctcggcctgggaaataacaagatcacagacatcgagaatggctcattggccaatatccctcgcgtgagagagatacatctagaaaataataaattaaagaagattccttccggcctcccagagctgaagtatctacagataatcttcctacactccaattctatcgccagggttggagtgaatgatttctgtcccaccgtccccaagatgaagaaatccctctacagcgccatctcattattcaacaaccccgtaaaatactgggaaatgcagcccgctaccttccggtgtgtgctcagtaggatgtcggtgcagctcgggaattttggtatgtag

SEQ ID NO: 108799 - DNA, 732 bp, Artificial Sequence
  Description of Artificial Sequence: Synthetic coding sequence
atgaaagagtatgtgctcctactgtttcttgccctgtgctccgccaagcccttcttcagtccatctcacatcgccctgaaaaatatgatgctgaaggacatggaggataccgacgacgatgacgatgacgacgacgacgacgacgacgatgatgaagataattcacttttcccgactagagaaccccgctcccatttttttccttttgacctctttcctatgtgtccttttgggtgccaatgttattctcgggtggtacactgctcagatctgggattgacctcagttcctacaaacatcccgttcgacacgcggatgctggatctgcagaataataaaataaaggaaattaaggagaatgacttcaaagggctcacatccctttatggactcatcttgaacaataacaagcttaccaagatccaccctaaggcttttctaaccacaaagaagctgagaagactttatctcagccataaccagctttctgagatacctctgaatctacctaagtcactggcagagctgaggatccacgaaaacaaagttaaaaagatacagaaagacacattcaaaggcatgaacgctctgcatgtcctggagatgtccgctaacccactggataataacggcattgagcccggtgcattcgaaggagtcacagtatttcatatccggatcgcagaggcaaaactcactagcgttcctaaggtgaatctgccccagttctag

SEQ ID NO: 108800 - DNA, 243 bp, Artificial Sequence
  Description of Artificial Sequence: Synthetic coding sequence
atgatgctgaaggacatggaggacaccgacgatgatgatgatgacgacgatgacgatgatgatgacgacgaggacaatagtttgtttcccaccagagaaccacgcagccacttctttcctttcgacctgtttcccatgtgcccatttggatgtcagtgctattcccgggttgtccattgctcagatctaggcctgactagtgtgcctacgaacatacctctaatcctggaatgccttatctag

SEQ ID NO: 108801 - DNA, 732 bp, Artificial Sequence
  Description of Artificial Sequence: Synthetic coding sequence
atgaaggagtatgtccttctgctgttcttagctttgtgctctgctaaaccttttttctcccctagccacatcgccctgaaaaacatgatgttgaaagacatggaagatacagacgacgatgacgatgatgacgacgacgacgacgacgatgatgaggataactccctgttccccaccagggagccgaggtctcatttctttccctttgaccttttccccatgtgcccattcggttgccagtgttacagccgggttgtgcactgtagcgatctaggactcacttctgtccccactaatataccatttgatactcggatgctggatctacagaacaataagataaaggagatcaaagaaaatgatttcaaaggcctgaccagtctgtatggacttatcctcaacaataacaaactgacaaaaatccacccaaaggcgtttttaacgacaaaaaaactgcgcagactctacctcagccacaaccagctaagcgaaatccccctgaatcttccaaaaagtttagctgaactgcgaattcatgaaaacaaggtcaagaagattcagaaggacactttcaaaggtatgaacgcattgcacgttcttgaaatgtcagcaaaccctttggacaacaacggaatcgaacccggggcttttgaaggggtaacagtcttccatatccgaatcgcagaggcgaaactcacttctgtcccaaaggacaatttgcctagcttttag

SEQ ID NO: 108802 - DNA, 3885 bp, Artificial Sequence
  Description of Artificial Sequence: Synthetic coding sequence
atggccctggctggcttatgtgcgttgctggcctgttgttggggccctgctgccgtgctggccactgctgcgggcgacgttgatccgtccaaagagctcgagtgcaaacttaaatctatcaccgtgtctgcactgcccttcctgcgcgaaaatgatctgtcaataatgcattcgccttcagcctccgagccaaagctcctgttctcagtgcgcaacgatttcccaggcgaaatggtggtggtggacgatttggaaaacacagagcttccgtatttcgtgttggaaatttccgggaatacagaagacatacctctggtgcgatggcgccaacaatggctggaaaacggtacgctgctgttccatatccaccatcaggacggggcgccttccctcccgggtcaggaccctactgaagagcctcagcatgagagtgctgaagaagaactgagaatactgcacatcagcgtgatgggcggcatgatcgctttgctgctctctattctgtgccttgtcatgatactgtatacccgacgccgttggtgtaagagacgccgcgtgccacagccccagaaaagtgcctccgctgaagccgctaacgagattcactacatacccagcgttctcattggcggacatggacgggagagcctacgaaacgccagagtgcaggggcacaacagctccggcacactgagcataagagaaacaccgatcctcgatgggtatgaatacgatatcaccgacctccgacaccaccttcaaagagaatgtatgaacgggggcgaagattttgcctcgcaagtcacgcgcaccctcgacagcctgcagggatgtaatgaaaagtccgggatggacctcactcctggctcagataacgccaagttgtcattgatgaacaagtataaggataatattattgctacatctcccgttgattccaatcaccagcaggccacattgctgtcacacacttccagctcccagagaaagagaatcaataataaggccagggctggctccgcctttctgaaccctgaaggggactcagggacggaagccgagaacgacccacaattgacattttacaccgacccctccagatccaggaggcggtctcgcgtgggcagcccgagaagcccagtgaacaaaaccaccctaacgctgatctcaataactagttgcgttattggcctcgtgtgttccagtcatgttaattgcccgctggtggttaagattaccctgcatgtgcctgaacatctcattgccgatgggagcaggtttattctcttagagggctcccagctggacgcctccgattggctgaatcctgctcaggtggtgttgttctcacaacagaacagcagtggaccatgggcgatggacctctgtgccaggcggctgttggatccttgtgaacaccagtgcgaccccgagactggcgagtgtctctgttacgagggctacatgaaggacccagtgcacaagcatctgtgcatccgaaacgagtggggtaccaaccaggggccctggccgtatacaatcttccagagggggttcgaccttgtactgggagagcagccgtctgataagatcttccgctttacatacactctgggcgagggcatgtggctgcccttaagcaaatctttcgtcatcccccccgctgagctcgccattaatccttctgccaagtgcaaaaccgatatgaccgtgatggaggacgctgttgaagtcagagaggagctaatgacgagtagctcgttcgattccctcgaggtcttgcttgatagctttggaccagtgcgagactgcagtaaagataatggaggttgtagcaagaatttcagatgcatttcagatcgaaaactagatagcaccggatgcgtatgcccaagcggccttagtccaatgaaagactcatctggatgctatgatcgccacatcggcgtggactgctctgatggtttcaacgggggctgcgagcaactgtgcctccagcagatggcccccttcccagatgaccccaccctgtataacatcctcatgttttgtggatgtatcgaggactataagctgggcgtggatggacgcagctgccagttgatcactgagacgtgccctgagggaagcgactgtggtgaatccagggagcttccaatgaaccaaaccctttttggcgagatgttttttgggtacaataatcactccaaagaggtagccgccggacaggttttgaaaggaacatttcgacaaaacaatttcgcacggggcctggatcagcagctccctgatggtctggtagtggctaccgtgccactggagaaccagtgcctggaagaaatcagtgaacccactcccgacccagattttctgactggcatggtcaatttttcagaggtctccggctatcctgttctgcaacactggaaagtaagatcagtgatgtaccacattaaattaaatcaggtggccataagccaggcgctcagcaacgcgttgcattcactagacggagccacttcgcgggccgacttcgttgctctgttggatcagttcggcaaccactacattcaagaagcgatatacggatttgaggagagttgttctatttggtaccctaataaacaggtacagagaagattgtggctggagtacgaggatatttctaaaggtaatagtccaagtgatgagagcgaagagagggaacgcgaccccaaggtcctgaccttccctgaatacatcacatccctgtcagactccggtaccaagcacatggccgcgggcgtcagaatggagtgtcactccaaaggccgatgtccttcatcctgccctctgtgccatgtaacgtcctcacctgatacaccagctgaacccgtgctgctggaggtgacaaaggcagctcctatttatgagctcgtgaccaacaaccaaacacaaagactgttacaggaagctacaatgtcctccctatggtgcagcggaacaggcgatgtgatcgaagattggtgccgatgtgattccactgcatttggtgccgatggattgcccacttgcgcccctcttcctcagccagtgctgcgattgtcgactgtgcacgagccctctagtacactggtggtcctggagtgggagcactcagagccaccaattggagtgcagattgtagactacttgctgagacaggagaaagtgacggaccgcatggatcatagcaaagttgagacggagactgtgctctcttttgtcgacgacatcatctccggcgcaaaaagtccttgcgccatgcctagtcaggtcccagacaaacagctcactacaattagtctgatcatacgttgcttggaaccggatacgatctatatgttcactctttggggggtggacaacacggggcgaaggtcgaggccttcggatgtcatcgttaagactccttgtccagtggttgacgatgttaaggcccaggaaattgccgataaaatctataatctattcaacgggtacacaagcggcaaggaacagcagacagcatacaacacccttttggacctgggctcacccacgctacacagagtgctataccactacaaccagcactatgagagcttcggggagttcacctggcggtgcgaggacgaacttgggccccgcaaagcgggtttgatacttagccagctgggggatctttcatcgtggtgcaacggcctcctgcaggaacctaagatctcgctgcggcggagttctcttaagtacctgggctgtcgctattccgagattaagccttacggactggactgggcggaacttagccgcgatctgcgtaagacttgtgaggagcagaccttatcaatcccatacaacgactatggagacagcaaagagatttag

SEQ ID NO: 108803 - DNA, 3909 bp, Artificial Sequence
  Description of Artificial Sequence: Synthetic coding sequence
atggcgttggccgggctgtgcgcactactggcttgttgctggggaccggctgctgtactggctactgccgcaggggacgtggacccaagtaaagagctggagtgtaagcttaaatccattacagtctctgctttgccatttcttagagagaacgatttgtcaatcatgcactctccgtccgcctctgagcctaaactcctgtttagcgtgcggaacgactttccaggagaaatggttgtcgtagatgatcttgagaatacagagcttccttatttcgtgctggaaatatctgggaacacagaggacatccccctcgttcgttggcgccagcaatggcttgagaacggtaccctgctgtttcacatccatcaccaagacggtgccccttcgctacctgggcaggaccccaccgaggagccccagcatgagagcgcggaggaggagttaagaatcctgcacattagcgtgatgggaggcatgatcgccctgctgcttagtatcctctgcctagtcatgatcttatacacaagacgccgatggtgcaaaagaaggcgggtccctcaaccacagaaatctgccagcgccgaagctgccaacgagatccactacatcccctcagtccttataggtgggcacgggcgagaatcacttaggaacgcccgtgttcaaggccataattcgtccggaaccctgagcattcgggaaactcccatcctggacggctacgaatacgacatcactgatctgagacatcacttacaacgagagtgtatgaacggaggagaagacttcgcatcacaagtcacaaggactctcgactcactgcaaggatgtaatgagaaatccgggatggatctgacacccggatcggacaacgccaaactgtccctcatgaacaagtacaaggacaatatcatagcaacaagcccggtcgattccaatcaccaacaagccacactgttgagccatactagtagctctcaaagaaagaggatcaacaacaaggctcgtgccgggtccgcattcctcaacccagaaggcgatagcggaaccgaggccgaaaatgacccgcagttgactttctacaccgatccttccagaagccgaaggcggtcacgcgtaggctcccctcggagtcccgtgaataagactaccctaactctgatatccatcaccagctgcgtcatcggtttggtatgcagctcacacgtgaactgtccacttgtggtgaagataaccctgcacgtgccagagcatctgatcgcggatggatcccggtttatactcctcgaaggctcacaacttgacgcttccgactggttgaaccccgcccaggtagtcttattcagtcagcagaacagctccggtccatgggcgatggacttgtgcgctcggaggcttcttgacccctgcgagcaccagtgcgacccagaaacgggccggcgcgaacacagagcagctggagaatgtctgtgttatgaagggtacatgaaggatcccgttcacaagcacctgtgcatacgtaacgagtggggaaccaatcaagggccttggccctataccattttccaacggggatttgacttggtgctgggggaacagccctctgacaaaatctttcggtttacgtatactttaggtgaaggaatgtggcttcccctatccaagtcatttgtgatacctcctgcagagctagccattaatcctagcgcaaaatgtaagactgacatgacagtcatggaagatgccgttgaggtcagagaagagctaatgaccagtagctcatttgactccctcgaggtgcttcttgattccttcggtccggtccgcgactgtagcaaagacaacggtggttgctctaaaaattttcggtgcatttcagaccggaaactggacagcacgggctgcgtatgcccaagtggactgtcaccaatgaaggattcctccggctgttatgataggcacattggcgttgattgttcagatggcttcaatggtggctgcgaacaactctgcctacagcagatggctccttttcctgacgatcccaccttatacaatattctgatgttttgcggatgtatcgaggattacaagctgggggtggatggacgaagctgccaactgatcaccgaaacctgcccggaaggctctgattgtggtgaatcccgcgaactgcctatgaaccagacgctattcggggaaatgttcttcggttacaacaatcacagtaaagaagtcgcagcggggcaggtgttaaagggaacttttcgccagaataatttcgcaagaggacttgaccagcagcttcccgatggactggtggtcgctaccgtcccgcttgaaaaccagtgtctggaggaaattagcgagcctacacctgacccagatttcctgaccgggatggttaatttctccgaagtgtccggctaccctgtgttgcagcactggaaggtgcggtctgtgatgtaccacataaaattaaaccaggttgccatcagtcaagctcttagtaatgctctgcacagtctcgacggagcaacttcacgggctgattttgtggccctcctcgaccagttcggcaatcactacattcaggaagccatctacgggttcgaggagtcctgctcgatatggtaccccaataaacaagtgcagcggcgactttggctggaatacgaagatataagcaaaggcaattcaccaagtgatgagtctgaagaacgcgagagggacccgaaggtcctcactttccctgaatacattacgagcctgagcgactctggcacaaaacatatggctgcaggagtccggatggagtgtcatagcaaagggcgctgtccttcttcatgccccctctgtcatgtaacttcaagccctgatacccctgccgaaccagttttgcttgaggtgaccaaggcagcacctatttatgaactggtgaccaacaatcagacccaaaggctgctccaggaagccacaatgtcttctctgtggtgtagtggtactggcgacgtgatagaggattggtgtcgatgcgactctacggccttcggtgccgacggcttaccaacatgcgcaccgcttccacagcctgtgttgcgtctgagcacagtgcacgagccctccagtacccttgtggtgctggagtgggagcattctgagcctccgattggggtgcaaatagtggactaccttttaagacaggaaaaggtaaccgatagaatggatcacagtaaggtcgaaactgagacagtgctgtcctttgtggacgatattatctccggagcaaagagcccttgtgcaatgccctcacaagtgcctgacaagcagcttactaccataagcctcatcatccgatgccttgaaccagatacaatctatatgttcactttgtggggcgtcgataacacgggaaggcgatctcgtccctccgatgtgattgtgaaaactccttgtccagttgttgatgacgtaaaggcccaagagattgcagacaaaatctacaatctttttaatggctacacatctgggaaggaacagcagaccgcatacaatactctgctggacctggggagcccaacactgcaccgtgttctctatcactataatcaacactacgagtcttttggtgagtttacttggaggtgtgaggacgagctgggaccaaggaaagcagggctgatcctgagccagctcggagacctgtcctcttggtgtaatggtctccttcaggaacctaaaatttcccttaggagaagcagccttaagtatctgggttgtcggtacagtgaaataaagccttacggattagattgggccgagctttcaagagacctgcgtaagacctgcgaagaacagaccctgtctattccctacaacgactacggcgattccaaagaaatttag

SEQ ID NO: 108804 - DNA, 3651 bp, Artificial Sequence
  Description of Artificial Sequence: Synthetic coding sequence
atggctttagcagggctgtgcgctctgctagcctgttgctggggtcctgccgccgtcctggcgaccgctgcaggcgatgtcgacccttctaaggaactagagtgtaagctgaaatccatcaccgtgtcagcactcccttttctgcgggaaaatgacttaagtatcatgcactccccaagcgcaagcgagcctaagctgctattctctgtgcgtaatgactttcccggagagatggtcgtggtggacgatctagagaacactgagctcccgtatttcgtactggagatttccggaaataccgaggatatccctcttgtcagatggagacagcagtggttggaaaacggaacactcctgtttcatattcatcatcaagatggggcaccctcattgcctggtcaagatccgacagaggagcctcagcacgagagcgcggaagaagagttgaggattctccatataagcgtaatgggaggaatgatcgctctgctcctgtcaatcctgtgcctagtgatgatactttatacccgccgcagatggtgcaagcgtcgtcgcgtgccacaacctcaaaaatccgcttcagccgaagcagcaaatgagattcactacatccccagtgtgctaattggcggccacggtcgggaatctttaagaaacgcgcgcgtgcaggggcacaatagctctggaactctgagtataagagagactcccatcttggatgggtacgaatatgacatcacagacttgcgacaccatctacagagagagtgtatgaatgggggcgaggattttgcttctcaggtgactcgaacccttgactccctgcagggttgtaacgaaaaatctggaatggacttgactcccggcagtgacaacgcaaagctgagccttatgaacaaatataaagacaatattattgccacaagcccggtcgacagcaaccaccaacaagctacgcttctgagccacacttctagttcacagagaaagaggatcaataataaagcacgggcaggatccgccttcctgaaccctgagggtgattccgggacagaggcggagaatgatccgcaattgactttctacaccgacccaagtaggtctagacgcagatccagagtggggtctcctagatcacctgtaaacaagaccacgctcacacttatctctatcacgtcctgtgtaatcgggctcgtatgcagctcccacgtgaactgtcctctggtggtcaagattactttacacgtgcctgaacacctcattgctgatggctccagatttattttgctcgagggttctcagctggacgcgtctgactggctcaaccccgcccaggtggtactgttctcccagcaaaactccagtggtccttgggcaatggacctttgcgcaagacgattactagacccctgcgaacaccagtgcgatcccgagacaggagagtgcctgtgctatgagggatacatgaaagaccctgtacacaagcacttgtgcatacggaacgagtggggaacaaatcaaggcccatggccatataccatatttcagcggggatttgacctcgttcttggggaacaacctagcgacaaaattttccggttcacctatacactgggggagggaatgtggctgcccttaagtaagtccttcgtgatccccccagctgagctggctatcaatccaagcgctaagtgtaaaacagatatgaccgtcatggaggacgccgtggaagtgagggaggaacttatgacatcttcatccttcgactccctggaggtgcttctggacagtttcggcccggtaagagattgctccaaagataatgggggatgctctaaaaactttaggtgtatctccgacagaaagctcgactcaaccggatgtgtctgccctagcggcctttcgccgatgaaggacagcagtggatgttacgacaggcatattggggtggattgcagtgacgggttcaacgggggctgcgagcagctctgtctgcagcaaatggctcccttcccggacgatccgacattgtacaatatcctgatgttctgtgggtgtattgaggattataaactgggagttgatggccgctcatgccaattaattaccgagacttgcccagagggaagcgactgcggtgaaagccgagagttgccaatgaaccagaccctgtttggcgaaatgttctttggctataacaatcactcaaaagaggtcgcagcgggccaggttttaaaaggaacatttcgtcagaacaacttcgcaaggggactggaccagcaactcccagatgggctggtcgtggctaccgtgcccctggagaaccaatgcttagaagagattagtgaacctacgcctgatcctgacttcttaactggcatggtcaattttagcgaagtgagcggatatcctgtgttacagcactggaaagtgcgttcagtgatgtatcacattaagctgaaccaagttgccatttctcaggccctttctaatgcgcttcactctctcgatggcgcaacaagccgggccgattttgtggcccttttggaccagtttggaaatcactatatccaggaggcgatttacggcttcgaggaaagctgtagtatttggtatcccaataagcaggtccagcgacgcctttggctggaatatgaggatatctccaagggcaacagtccctctgatgagtccgaagagcgggaacgcgatcccaaagtcctaacatttccggaatacattaccagtctcagtgactctggaaccaagcatatggccgctggagtgagaatggagtgtcattctaagggccgatgtccctcctcctgccctctctgccacgttacatcgtctccagataccccagcggagcccgtgctgctggaagtgactaaagcagcccctatctacgaactggtcaccaataaccagacgcagcgcttactacaggaagccactatgagcagtctgtggtgcagcggtacaggggacgtaatagaggactggtgtcggtgtgactctactgcctttggcgctgacggtttgccaacttgtgctcccctgcctcagcctgtgttgagactgtcaaccgtgcacgaaccgtcatccacactggtggtcttggagtgggagcatagcgagccccccatcggggtgcagatcgttgactatctccttcgccaggagaaagtcactgataggatggaccatagtaaggtcgagactgagactgtactgtcgttcgttgatgatatcatcagcggggccaaatcaccctgtgctatgcctagtcaggtgcctgacaagcaactaactaccatttctttgattatccggtgcctagagccagatacaatctacatgttcactctgtggggcgtggataacaccgggagacgcagcagaccatctgacgtgattgtgaagaccccatgtccggtcgtcgacgacgtgaaagcacaagaaatcgctgataaaatctataaccttttcaacgggtatacaagtgggaaggagcaacagactgcatacaacacgttgctggacttgggctcccccacactgcatagggtgctttaccactacaaccaacactacgagtcatttggtgaattcacctggaggtgcgaggatgaactcgggcctaggtag

SEQ ID NO: 108805 - DNA, 3657 bp, Artificial Sequence
  Description of Artificial Sequence: Synthetic coding sequence
atggcactggcaggcttatgcgcattactggcttgttgctgggggccagcagccgttcttgccaccgccgccggcgacgtagatccatcaaaagagctggagtgcaaacttaaaagcattactgtgagcgctctgcccttcctgcgcgagaatgacttgagtatcatgcactccccctcagccagcgagcccaagctcctgttttccgtgcggaatgacttccccggcgagatggtggtggttgatgatttagaaaataccgaattgccctattttgtgctggagattagcgggaataccgaagacatcccgctggtcagatggaggcagcaatggctggaaaacgggacgttattatttcatattcatcaccaggacggcgcaccttcactgcccggccaggacccgaccgaagagccccagcacgaatctgccgaggaagaactgagaattctccacataagcgtgatgggcgggatgatcgctctattactaagtatcctttgtctcgtgatgattctctacacacggaggagatggtgcaagcgcagacgggtgcctcagccacagaagtctgccagtgccgaagccgccaacgaaattcactatatccccagcgtactcataggcggtcatggcagggagtccttaagaaatgcccgcgtgcaggggcacaattcttccgggaccctctctatacgggaaacacctattttggatggatatgagtacgacattaccgacctgcgccaccatttacagcgcgagtgtatgaatgggggcgaagacttcgctagccaggtaacccgaacactggacagcctacagggctgcaatgaaaagagtgggatggacctgacgcctgggagtgataacgccaaactgtccctcatgaataagtacaaggacaatatcatcgcgacctccccagttgattctaatcaccagcaagccaccctcttgtcacacaccagctccagccaacgcaaacgcatcaacaataaagctcgggctgggtctgctttcctgaatcccgaaggggactccggcactgaggccgaaaacgatcctcagttgacgttttacaccgatcctagtcgaagtcggcggagatcaagggtggggtcccctagaagcccagtcaacaaaactaccctgacgctcatctcaattacctcctgtgttatcgggctagtgtgttcaagccatgtgaactgccccctggtggtgaagattacgctacatgtccccgaacacctcatcgcggatgggtcaaggtttattttgttagagggctctcagctggacgcctcggactggcttaacccggctcaggtggttttattctcgcagcaaaactctagtggcccctgggcaatggacttatgtgcgaggcgcttactcgatccctgcgagcatcagtgcgaccccgagacaggagaatgtctgtgttatgaggggtatatgaaggacccagtacacaagcatctttgcattcgaaatgaatggggcactaatcaaggcccatggccatacacaattttccagaggggtttcgacctggtgctgggagaacagcccagtgataagatttttcgctttacatacacgctgggagagggcatgtggctcccgctgagtaagtcatttgtcattcctcctgctgaactggctatcaatccctcggcaaaatgcaagacagatatgaccgtgatggaagacgccgttgaagttcgggaagagctgatgacttcaagcagctttgattctctggaagtcttacttgacagctttggccctgtgcgggattgctcaaaagacaatggaggatgctccaagaacttccgatgcatttcggatagaaagctcgatagcactggctgcgtctgcccatcgggattgtctccaatgaaagactcctcaggatgctacgatcgccacataggagtggactgttcagacggattcaatggggggtgcgagcagctgtgtctgcaacagatggcaccttttcctgacgacccaaccttgtataacattctcatgttctgcggatgcatcgaggattacaagttgggggtcgatggacgtagttgccagttaatcactgagacctgtcctgagggaagtgattgcggcgaatcccgggagttgcctatgaatcagactctctttggcgagatgttttttggctacaacaaccactccaaggaggtcgccgccgggcaggttcttaaggggacttttcgtcagaataatttcgccagggggctggaccagcagcttcctgacggcctggtagttgccaccgtgccgctggagaatcagtgtctggaagagatttcagagccaacccccgaccccgatttcttgactggaatggtaaacttctcagaggtgagtggctatccagtcctacagcactggaaggtacgaagtgtaatgtatcacattaaattgaaccaggttgcaatatctcaggctctgagtaacgcactccatagcctcgatggtgccacatctcgagcggactttgtggccctgctggatcagttcggaaatcattacatacaggaggcgatctacggctttgaagaatcctgtagtatatggtatcccaataaacaggtgcagaggcgcctatggctcgagtacgaggatatcagtaagggtaactccccctctgatgagtccgaagagcgggaacgagatcctaaggtcctaaccttcccagagtacataaccagcctttcagactccgggaccaagcacatggcagcaggagtgagaatggaatgccactcaaaaggccgctgtccctccagctgtccactttgccacgtgacaagctctcctgatacccccgcagaacccgtactccttgaggtgactaaggccgctcctatttacgagcttgtaaccaataatcagactcagcgccttcttcaggaggctacaatgagttctttgtggtgtagcgggacaggggatgtgatcgaagattggtgtcgctgtgatagcacagccttcggcgccgatggattgcctacatgcgccccgcttccccagcccgttttgcggctgagcaccgtgcatgagccgtccagcactctggtggtcttagagtgggaacatagcgaaccgccaatcggagtgcagattgtggattacttactgaggcaggagaaggtgacagaccggatggatcacagcaaggttgaaaccgaaacggtgctctcctttgtagatgacattatcagcggcgctaaatccccatgcgctatgcccagccaagttcccgacaagcagcttaccaccatttctctgatcatccgctgtctggaacccgacacaatttacatgttcactttatggggagtggacaacactggaagaagatccaggccaagcgacgtcatcgttaagacaccctgccccgtcgtggatgatgttaaagcccaggagatcgctgacaaaatatataatctgtttaacggctacacttctggcaaagagcagcagacagcctataatactctgttagacctcggctcgccaacgttgcatcgtgtcctgtatcattacaaccagcattatgagtcatttggtgagttcacctggcggtgcgaggatgagctaggaccacgaaaccagtag

SEQ ID NO: 108806 - DNA, 1323 bp, Artificial Sequence
  Description of Artificial Sequence: Synthetic coding sequence
atgaatacacttctgtgcaaaggaatgttctgcctgcttagctgggaggccgactcaagagggcggctcggcgagtacaccttacagcccctgtccttacagaccgaagagacgaccgagctcggctcaaagaaagagctcaaatccatgccctttatcacctacctgtcagggttactgacggcccagatgctaagtgacgaccagcttatctcaggcgttgaaatccgctgcgaggaaaagggcagatgcccttcaacatgccatctctgtcggcggcccggaaaggagcaactgagcccaacacccgtcttgctggaaatcaaccgggtcgtccccctttataccctcattcaagacaatggtaccaaggaagcatttaagagcgcgttgatgagttcttattggtgctcaggaaagggcgacgtgatcgatgattggtgtaggtgtgaccttagcgccttcgacgccaatggactccctaattgcagccccctgttgcaacccgtcctgcggttatcccctacagtggagccaagttccaccgtggtcagtttagagtgggttgatgtccaaccagcgattggtaccaaagtctctgattatatcctgcaacacaaaaaggttgacgaatatacagatacggacttgtatactggcgaattcctctccttcgccgacgatctcttatccggactgggcacatcttgcgtggcagcggggcggagccacggcgaagtgccagaagtgagcatctactccgtcattttcaaatgtctcgaacccgacggcctctataaatttaccctgtacgcagtcgacacaagggggcgccacagcgagctctcaaccgtgacactgagaaccgcgtgtccactggtggatgacaataaggcagaagaaatagccgataaaatctataacttatacaatggatatacatccggcaaagaacagcaaatggcctataacactctgatggaagtctctgcttccatgctgttccgcgtccagcatcactacaacagtcactacgagaaattcggggacttcgtgtggaggtccgaggatgaactgggaccgcggaaggctcacctcatcctgcggcggctggagagggtctccagccactgttcctcactgctgaggtccgcctacatccagtccagagtggagactgtaccatatctcttctgtaggagtgaagaggtaaggccagcgggcatggtttggtactccatactgaaggatactaaaatcacttgtgaggagaagatggtgagtatggcgaggaatacgtacggcgagtcaaaaggccggtag

SEQ ID NO: 108807 - DNA, 4020 bp, Artificial Sequence
  Description of Artificial Sequence: Synthetic coding sequence
atggccgctgcaggggcccggctgagccccgggccaggctcaggcctgagagggcgaccaagactttgttttcacccggggcccccccctctcttaccgctcctcctgctcttcctgctgctgctgcccccccccccacttttggcaggtgccacagctgccgcaagccgggaacccgacagcccttgtcggctcaaaactgtcacagtgtccaccctccctgctttgagggaatccgacatcggatggtccggagcccgggccggcgccggcgcaggtaccggagctggtgccgcagcggcagccgcctcaccgggtagccccgggtccgccggaaccgctgcagaatcgcgccttctgctgttcgtgaggaacgagttgccaggaaggatcgctgtgcaagacgatctggataacaccgagctcccctttttcactctggaaatgtcaggcactgctgctgatatctcactggtgcattggagacagcagtggttagaaaacgggaccctgtactttcacgtatccatgtcttctagcggacagcttgcccaggcaacagcgccaacactgcaggaaccttcagagatcgtggaggagcagatgcatatcctgcatattagtgtgatgggaggtctgattgctctgctactgctactgctggtgttcaccgtcgctctgtacgcacagagaagatggcagaagcgtagaaggattccacagaaatctgcttcaacggaggcaactcacgagatccattatatcccaagtgtgctgctggggcctcaggccagggagtcgttccgctcatcccgtcttcaaacgcacaatagcgtgataggcgtgcctataagagaaacaccgatcttggacgactacgactgtgaagaggatgaggagccaccgaggagggccaaccacgtttcacgggaggatgaattcggtagccaagtgacccatacgcttgactctctcggacaccccggtgaggaaaaagtcgattttgagaagaaagctgcggccgaggccacacaggaaaccgtggaatctcttatgcagaagttcaaggaatcatttcgcgcaaatacaccaattgagatagggcagctccaacctccactgaggtctacatccgcaggaaagaggaaacggaggtcaaagtcccgaggtggaatctctttcggacgagcgaaaggtacttccggcagtgaggcagacgacgaaactcagctgacattttatacagaacagtatcggtcacgacgtagatcaaaaggactactgaagtccccggtgaataaaactgccctcaccctcattgctgtaagctcctgtatcctggcaatggtatgcgggtctcagatgtcttgtcctctgactgtcaaggtgacattgcacgttccagagcattttattgcagatgggtcatcttttgtggttagtgaaggctcctacctggatatctccgactggcttaacccagccaagctatctttgtattaccagataaacgccacatctccttgggtaagggatctctgtggacagcggactactgacgcttgcgagcagttgtgcgacccggagacgggagaatgctcttgccacgaaggctacgcacccgatccggtgcatcgccacctttgtgtgagatcagattgggggcagtccgaaggtccctggccatatacaactcttgagagaggctacgatctcgtgacaggcgaacaggccccagaaaagatcctgcgctcgactttcagcctgggtcagggactgtggctgcccgtctctaaatctttcgtcgtaccacccgtggagctgtctatcaaccccctggcctcctgcaaaacagacgtcttggtaaccgaagatcccgccgacgtcagagaggaggcaatgctgagtacttacttcgaaactatcaatgaccttctgtcatcgttcggcccggtcagggactgctcccgcaacaatggagggtgcacacgcaatttcaaatgcgtgtcagaccgacaggtcgacagcagcggttgtgtctgtcctgaagagctgaagccaatgaaagatggctccggttgctacgatcactcaaagggcatcgattgctccgatggcttcaatgggggctgtgagcaattgtgtcttcagcagacgctgcctcttccttacgacgctacatccagcaccatttttatgttctgcggctgcgttgaagagtacaaactggccccagatgggaagtcttgtctgatgctgagcgacgtgtgtgaaggccccaagtgtctgaaaccagattctaagtttaacgatacattattcggcgagatgctgcatggctacaataatcgcacgcaacatgtaaaccaaggccaggtttttcagatgacttttcgggaaaacaactttatcaaggattttccccaactggccgacggtctgctggttattccactccccgtagaggaacaatgccgcggcgtgttgtccgagccattacccgatctgcagttgctgaccggtgatatacgttatgatgaggccatgggctacccgatggtacagcagtggcgcgtgcgcagtaatctttatagggtaaagttaagcacaattactctggctgccggcttcactaacgtattaaaaatactcacaaaggaaagttccagggaggaattgctctctttcattcagcactatggttcccattacatcgccgaagcgctatacgggagcgaactcacatgcatcattcacttccctagcaagaaggtacagcagcaactgtggttgcagtaccagaaggagaccaccgagctcggaagtaaaaaggaactcaagtcaatgcccttcatcacataccttagcggtttgctcaccgcccaaatgctttcagatgaccaattaatttccggagtggagatccgatgtgaggagaaaggcagatgcccctccacttgccatctgtgcaggaggcccgggaaggaacagctttcgccgactccagttctgctcgaaataaatcgagtcgtacccctctatacgcttattcaggacaatggtacaaaagaggcctttaagagtgctcttatgtccagttattggtgtagtggaaagggcgacgtgattgacgactggtgccgatgcgacctcagcgccttcgatgccaacggcctccccaactgctcacccctcttgcagccagtgctacgtctttctccaaccgtcgagccaagttctactgtggtgagcctggaatgggtcgatgttcagcctgcaatcggtaccaaggtcagtgattatatactccagcataaaaaggtggatgagtacactgacaccgacttgtatacaggcgaatttttgagcttcgccgatgacctgctgtctgggctcggcacatcttgcgttgcggccggccgttcccacggggaagtcccggaagtgagcatttacagtgtgatttttaaatgtctcgagccggacgggctctataagttcaccctatatgcagttgacacaagggggaggcatagcgagctctccacggtgaccctgcgcaccgcctgccccctggtagacgataataaggcagaggaaatagccgataagatctataatttgtacaatggctatacgagtggcaaagagcagcaaatggcttacaatacactgatggaggtgtccgcctcgatgctgtttcgtgttcagcaccattacaatagccactacgagaaattcggggactttgtgtggagatccgaagacgagctgggtcccaggaaagctcaccttattctgagaagactggaacgagtgtccagtcactgttcaagtttactcagatccgcttacattcaatctcgcgtcgaaaccgtcccataccttttttgcagatccgaagaggtgagacccgcaggaatggtctggtattctattctcaaggataccaaaataacttgtgaagagaaaatggtctcaatggccaggaatacgtatggggagagcaagggacgatag

SEQ ID NO: 108808 - DNA, 1188 bp, Artificial Sequence
  Description of Artificial Sequence: Synthetic coding sequence
atgccttttatcacctacctctccggccttcttacggcccagatgctttcagacgatcagctgatctctggggtggaaattcgatgcgaagagaaggggagatgcccaagtacctgtcatctgtgccgtagaccaggaaaggaacagttgtcccctaccccggtccttctggaaataaaccgggtggtaccgctgtataccctgatccaggataacggcaccaaagaggcatttaaaagtgcgttgatgtcctcctactggtgctccgggaagggagatgtgatcgacgattggtgccgatgtgatctgtctgcttttgatgccaacggcctgcccaactgcagtccgctgctgcagcctgtcctccgactgtctcccaccgtggagccttcctccacagttgtgagtcttgagtgggttgatgtacaaccagcgatcggaaccaaagtgtctgattacatcctgcagcataagaaggtagacgaatatacagacacagacctgtacacgggggagtttcttagctttgcagacgacttgctgagcgggctggggactagttgcgtcgctgctggtagaagccacggcgaagtgcctgaggtttctatatattcagtaatcttcaaatgcttagagccggacggcttgtataaatttacactctacgcagtggacacgcgaggccggcactctgaactatccacagtgacattgaggactgcctgtcctctagtggatgataataaagcagaggaaatcgcagataagatttacaacctctacaatgggtatacttccgggaaagaacagcagatggcttataacacacttatggaagttagcgctagcatgctctttagagtccagcaccactacaactcccactacgagaaattcggcgacttcgtgtggaggtctgaggacgaacttggccctagaaaagctcacctcattctcaggcggttggaaagagtgtcttctcattgctcctccctgctacgatcagcatacatacagtctagggtggagaccgtcccatacctgttctgtagatcagaggaggtgcgcccagcagggatggtgtggtatagcattctcaaagacaccaagatcacatgcgaggaaaagatggtgtcgatggctcgtaacacctattatctcaccttaagtaaagtgtcaccattctag

SEQ ID NO: 108809 - DNA, 585 bp, Artificial Sequence
  Description of Artificial Sequence: Synthetic coding sequence
atgccttttataacatatctttctgggttactgacagcccagatgttaagcgacgaccagctgatttctggagtagagataagatgcgaagagaaaggtcgttgcccgagcacgtgtcacctctgcagaaggccaggaaaggaacagctgtcccctacccctgtgctgctagaaattaaccgcgtggtaccgctatatacgctgattcaggataacggcacaaaagaggccttcaagtcagctcttatgagtagttattggtgttcgggtaaaggtgacgtgatcgatgactggtgtcggtgtgatctatctgccttcgatgctaatgggctcccgaattgcagcccattgttgcaacctgtcttacggctctctcctacggtagaaccgtcttctaccgtggtgtcactggaatgggtcgatgtccagcccgccattggtactaaagtctcagattacattcttcaacacaagaaggtggatgagtatacagacaccgacctctacaccgtttactgctggataacgttcattgacttgaggatcctcaatcaaccatgtataccaggaatgaaacctacctag

SEQ ID NO: 108810 - DNA, 3867 bp, Artificial Sequence
  Description of Artificial Sequence: Synthetic coding sequence
atggcagccgcgggcgcacggcttagcccagggccagggtccggcctgaggggccgaccccgcctctgcttccaccccggtccaccaccccttctccccctacttttgctgttcttattgctgctgcctcctcccccactgcttgccggagcaactgctgccgcatcacgggagccagacagcccctgccgtttaaaaacagtgactgtaagcactctgcctgccctgagagagtctgacatcggctggagtggcgctcgggcaggtgctggtgcaggaaccggggccggagccgcggccgctgcagcctctcccgggtcccctggatctgccggcacagccgcagaaagccgtctgctgctcttcgtgcgcaatgagctgccaggacggattgctgtgcaagatgacctggacaacaccgaactaccattctttaccctggagatgtccgggacagccgctgacatttcacttgtgcactggcggcagcaatggctagagaatggtacattgtacttccacgtttctatgtctagtagcggtcagctggcccaggccacagctcccaccctgcaggagccctccgagatcgtcgaggagcagatgcatattttgcacatctccgtcatgggtggactcatagcactgctgttactgttgttagtcttcacggtcgctctctacgcccaaagacggtggcaaaagagacggcggattccccagaaaagtgcctctacagaagcgacacatgagattcactacatcccctcagtcctgttaggaccacaggctagagaaagctttaggtctagcaggctgcaaacccacaattcagttataggggtgccgattcgcgaaacccccattctggatgactacgattgcgaggaggacgaggagccccctcgaagagctaatcatgtttccagggaggatgagttcgggagccaggtcacacatacactggactccttaggtcaccctggggaagagaaggtggatttcgagaagaaggggggcatcagcttcgggcgggcgaaaggtaccagcgggagcgaagcagacgacgagacacagctcacattttatacagagcagtacaggagtcgaagacgaagtaagggtctactgaaatctcccgtgaataagacggcactgacactgattgccgtctctagctgcatcctcgcgatggtgtgtggttctcagatgtcctgtccccttaccgtgaaagtgacccttcatgttcctgagcattttatcgctgacggcagctccttcgtcgtgagtgagggctcctacctggatatttctgactggctgaatcctgcaaagctgtcgttgtactaccagatcaacgctaccagtccttgggttagagacctgtgcggacagcggactacagatgcgtgtgaacaattgtgtgaccctgagacaggtgaatgttcctgccacgagggctacgctccagatcctgtgcatagacacctatgtgtgcggtcggactggggacagtcagaaggcccgtggccttacactacgctcgagcgtgggtacgatctggtgaccggagagcaggcacccgagaagattctgcggagcacatttagccttggccagggtctgtggctgccggtctccaagtctttcgttgttccacccgtcgaactgagcatcaaccccctggcttcttgtaaaacagacgtcttagtgactgaggacccagccgacgtgcgggaggaagctatgctgtcgacatatttcgagacaattaacgatctcctaagctccttcgggcccgttagggattgcagccgcaacaacgggggctgcacccggaactttaagtgcgtcagcgacaggcaggtagactcatctgggtgtgtatgtccggaggaattgaagccgatgaaggatggttctggctgttacgatcactccaagggtattgactgtagtgatggtttcaacggagggtgcgagcagctgtgccttcagcagacactgcctctgccatacgacgccacttcatcaacaattttcatgttctgtgggtgcgtcgaggaatataaacttgctcccgatgggaagtcatgtttaatgttgtccgacgtgtgtgaaggaccgaagtgtctgaaacccgattccaagtttaatgacaccctatttggcgaaatgctgcatggctacaataaccgcacccagcatgtgaatcagggtcaggtatttcagatgacctttagggagaataatttcatcaaggattttccacagcttgcggacggtctgttggtaatccctctccccgtcgaagagcaatgccgcggagtcctcagtgaacctctgcctgacctgcagctgctcactggtgacattcgctatgatgaagctatggggtacccaatggtgcaacagtggagggtgaggtctaacctatatagagtcaaactaagtaccatcactctggctgcaggatttactaatgtactgaaaatcctgacaaaagaaagctcccgagaagagctgctcagttttattcaacactatgggagccactacattgcggaagctttatatgggtctgagctgacatgcatcatccacttcccgagcaagaaggtgcagcagcaactgtggctgcaataccagaaagagacaactgagctcgggagcaagaaagagttaaaaagcatgccattcattacttatttgagcggattactgacggctcagatgctgtcagacgaccagctgatctccggggtcgagattaggtgtgaggaaaaaggcagatgtccgagcacctgtcatctgtgccgacggccggggaaggagcaactgagtccaactcccgtcctgttagagatcaatagagtagttcctctatatacactgatccaggacaacgggaccaaggaagccttcaagtctgctctgatgagcagctactggtgctctggtaagggggatgtgattgatgattggtgtaggtgcgatttgtctgcgttcgatgccaatggcctcccaaactgcagcccactgctgcaacccgttctaaggctcagtcccacagtggaaccctcatcaacggtagtgtcactggagtgggttgatgtgcagccagccatcggcacgaaggtatcagactacattctgcaacataaaaaggtggacgagtacactgacactgatctatacaccggtgagtttctctccttcgctgacgatctactgtccggcctcgggacaagttgcgtggccgctggaagaagccatggtgaggtgccagaagtcagtatttactcagtcattttcaagtgtctagaacccgatggcctctataagtttacactgtacgctgtcgacacaagagggcgacattctgaactctctactgtgaccctacgaactgcttgtccgctggttgatgataacaaagccgaggagatcgccgataaaatatacaatctctataacggttatactagcggcaaagagcaacagatggcctataatacactgatggaagtgtccgcatccatgctctttagagtgcagcatcattacaacagccactacgagaagtttggcgacttcgtgtggagaagtgaggatgaactgggtcctcgcaaagctcacctaatcttgcggagacttgagagagtgtcaagtcactgttctagtctcctgagatctgcatatatccagagcagggtggagactgtcccctacttattctgccgatccgaggaagtccgcccagctggcatggtgtggtactcgatcctcaaagataccaagatcacctgtgaggagaagatggtttctatggctcgcaatacctatggtgaatctaaggggaggtag

SEQ ID NO: 108811 - DNA, 1188 bp, Artificial Sequence
  Description of Artificial Sequence: Synthetic coding sequence
atgccttttatcacctacctgagcgggctgctcactgctcagatgcttagcgacgatcagttgatctcaggggtcgagatcagatgcgaagagaaggggaggtgcccatccacatgccacctgtgccgccgtccaggcaaggaacagctgtctccaactcccgtgctgcttgagattaaccgggtagttcccctgtataccctaattcaggacaacggtactaaagaggcgttcaagagtgcactaatgtcatcatactggtgttccgggaaaggtgatgtaattgacgactggtgtcgatgtgacctctccgccttcgatgcaaacggactgccgaactgttcccctttgttacagcccgtgctgaggctatcaccaacagtggaaccaagctctactgtcgtgtccttggaatgggttgacgttcagccggccatcggcacaaaagtcagtgactatattcttcagcacaaaaaggtggatgagtataccgacactgacttgtacacaggcgaattcctgtcgttcgccgacgatctgctgtctggtctgggcacatcctgtgtcgccgctggccggtcacacggagaagttccagaggtgtctatttactccgttatcttcaagtgcctggagcctgatggactctacaagttcactctgtatgctgtcgacacgcgcggacgacattctgagctgtccactgtcaccctgcggactgcttgccctctggttgatgacaataaggccgaggaaatcgctgataagatatacaatctgtacaacggctatacatctggaaaagagcagcagatggcatacaatacacttatggaagtgtccgcaagcatgctgttccgcgtgcagcatcactacaacagccattatgagaaattcggcgacttcgtgtggcggtcagaggatgaattgggccccagaaaagcccacctgattttgcgacgcctggagagagtgtcctcccactgctcgtcgctgcttaggtcagcatacattcagtcaagggttgagactgtgccctatctgttctgcaggtctgaagaggtccgccctgctggaatggtatggtattccattctgaaggatacaaaaattacctgtgaggagaagatggtatccatggcgcggaatacgtattacctgacactgagcaaggtctctccattctag

SEQ ID NO: 108812 - DNA, 4008 bp, Artificial Sequence
  Description of Artificial Sequence: Synthetic coding sequence
atggcagcagctggcgcaagattgtcccctgggccagggagtggactaagagggaggccgagactctgttttcacccaggtccgccccctctactccctcttctattacttttccttctcctgttgccgccaccacccctactggctggcgctacagccgcggccagccgggagccggacagcccctgcaggctcaagactgttacagtctctactctgccagccctaagggagagtgacatcgggtggagtggcgctcgggctggagccggggccggaacgggcgcaggagctgctgcggccgctgcctctcctggctctcctggcagcgccggcactgcagcagaaagtcggctgctgcttttcgtccggaacgagctgccaggcaggatcgcagtgcaggatgatctggacaatacagagctcccattctttacgctggaaatgtccggtaccgctgcggatatttctctggtccactggcgccaacagtggctggaaaatgggacactgtacttccatgtgagcatgtcctcaagcggccaactcgctcaggcaaccgcacccaccttacaggagccttccgagattgtggaggagcaaatgcacattttgcatatctcggtgatggggggtctgatcgctttgctactccttctcttggtctttaccgtggcattatacgcccaacgtcgctggcaaaagagacgcagaataccacagaagagcgcatctaccgaagctacccacgagatccattatattccctccgtgttacttggaccacaggccagagagagttttcggtcatctcgcctccagactcacaactccgtcataggggtcccaattagggagacccctatcttggatgactatgattgcgaggaggatgaggagcctccaaggcgtgcaaatcatgtatcccgcgaggacgaatttggatcgcaagtgacacacactttggactcccttggtcatcctggagaggaaaaggtggactttgaaaagaaagccgccgcagaggccactcaggagacagtagagtcactgatgcagaaatttaaagaatcgttccgagccaatacccctatcgaaatcggacagcttcagcctccgctacgttctaccagcgcgggcaagaggaaaagaagatctaaatccagaggaggaatctcttttggaagagcaaaagggacgtcaggtagcgaagctgatgacgaaacccagcttacattttataccgaacagtatcgatcacggagacgaagtaaagggctcttgaaaagcccagtaaacaaaacagcccttacgctcatcgctgtttcttcctgcatactcgcaatggtgtgtggatcacagatgtcatgcccacttactgtgaaagtgaccttgcatgttccagagcattttatcgccgacggatcgagtttcgttgtctccgagggcagctatctggatattagcgattggctgaatccagccaagttgagcctgtattaccagatcaacgctacatcaccctgggtgcgagacttatgtggccaacggactaccgatgcttgcgaacagctgtgcgaccccgagacgggagaatgcagttgccacgaaggttacgcacccgatcccgtccaccgccacctctgtgttcgatcagactggggccagagcgaggggccctggccctacactaccctggaacgaggatatgatttggtaactggcgagcaggctccagaaaagatcctgtctcttgggcaaggtctgtggctccccgtgtccaaatccttcgtggttccacctgtggagctgtcaattaatcctctcgcttcgtgtaagaccgatgttctggtgaccgaggatccggctgatgtacgagaggaagcgatgctctcaacttattttgaaaccatcaacgatcttttatctagctttgggccagttcgcgactgttcacgaaacaatgggggctgtaccagaaacttcaagtgtgtttccgatcggcaggtggactctagcggttgcgtatgtcccgaggagctcaagccaatgaaggacggatctggctgttatgatcattcaaaggggatagactgcagcgacggatttaacggaggctgcgaacagctgtgcttgcaacagaccctgcccctaccatacgacgctacttctagcacgatatttatgttttgcggctgcgtggaagagtataaactagcgcccgacgggaagtcttgccttatgctaagcgacgtgtgtgaggggccaaagtgcttaaagcctgactctaaattcaatgataccctcttcggcgagatgctgcacggctacaataacaggactcagcacgttaatcagggccaggtcttccaaatgacctttagagagaataacttcatcaaagacttcccccaactcgccgacggcctgctggtcatcccgcttccggtcgaagaacagtgcaggggcgtgctgagtgagcctttgcctgacctccaattgctgaccggggacataaggtacgacgaggcaatggggtacccaatggtacaacagtggcgtgtgaggtccaacttgtaccgcgtcaaactgagtacaatcacacttgccgcaggcttcaccaacgtcctgaaaattctgacaaaggagtcctcccgggaagagctactgtcattcatccagcactacggctctcactacatagcagaagctctttacggctcagagttgacatgcattattcatttccctagcaagaaagtccagcaacagctgtggttacaataccagaaggaaaccaccgaacttgggtctaagaaagagttgaagagcatgccctttataacatatttgagcggcctgttgactgctcagatgttatcagacgaccagctcatctccggggtcgaaatccggtgcgaggagaaagggcggtgcccatccacctgccatctttgccggcgacctggcaaggaacagctgtcgccaaccccagttcttctcgagattaatcgggttgtacctctgtacaccctgattcaggacaacggtactaaagaggcctttaaaagcgcattaatgtcttcctactggtgctccggcaaaggcgacgtgatcgatgactggtgcaggtgcgatttgtctgcctttgatgcgaatgggctgcccaactgttcacctctcttacagcccgtgctgcggctcagtccaaccgtggaaccttcttctaccgtggtatcacttgagtgggtggatgtacagccggccattgggaccaaagtgagcgattatattttacaacacaagaaggttgacgagtacacagataccgatctttacacgggtgaatttttatcctttgccgacgacctcctgagcggcctagggacctcttgtgttgccgccggcagaagccatggcgaggtgccggaggtcagtatttattctgtgatcttcaagtgcttggagcccgatggactctacaaatttacattatacgccgttgatacacggggaagacatagtgaactgtcgaccgtcactctgcgcacagcctgtcctcttgtggacgataacaaggcagaagaaatcgcagataagatctataacctgtacaatgggtataccagcggaaaggagcaacagatggcttacaacacactgatggaggtttcggctagcatgctgtttcgagttcagcatcattacaactcacactacgaaaagtttggagatttcgtgtggcgctcagaggacgagctgggccctcgcaaagcccatttaatcctacgacggctggagcgcgtttcctctcattgctcatccttgctgaggtctgcttatattcaaagtcgggtggaaacggtgccttatttattttgtaggtccgaagaggtgaggcctgcgggcatggtctggtattcgattctgaaggacaccaagatcacatgtgaggagaagatggtgagtatggctcggaacacatatggtgagtccaaaggtaggtag

SEQ ID NO: 108813 - DNA, 297 bp, Artificial Sequence
  Description of Artificial Sequence: Synthetic coding sequence
tgaatggcctacaacactctgatggaagtatccgcctcaatgttatttcgagttcaacaccactacaattcccactacgaaaagtttggagactttgtgtggagatccgaagacgagttaggcccatccctgcttgagagttttatgagtctgcaagatattaatttgctggagcgccggccaggccggccccagcggcccggcaaccctctgagtaacgtatcgtggaggatcagcgagattgctccaacttcacacactgatatgtcagccgggatcaaggaaactgcgtcctag

SEQ ID NO: 108814 - DNA, 6828 bp, Artificial Sequence
  Description of Artificial Sequence: Synthetic coding sequence
atggccgccgaacgtcggtgcggctcaatgagagatcttcgcgcacaagtgacaagcgggctgctgcctttccctgaggtgacactccaagccctaggagaagacgagattaccttggaatccgtcctcagagggaaatttgctgccgggaaaaatggcctcgcctgcctcgcctgtgggccacagctggaggtagtcaattctatcactggcgaaaggctatcagcttaccggtttagcggcgtgaatgaacaaccgccagtcgtattggccgtcaaggagttcagctggcagaaaagaacagggctgctgatcgggctcgaagagactgaagggagcgtcctgtgcctgtatgacctcggcatcagtaaagtagttaaagcagttgtgctgccaggccgagtgactgccatcgagcctataatcaaccacgggggcgcaagcgccagtactcagcacctgcatcctagcctcaggtggctgtttggagtggctgctgtggtgacagacgtgggtcagattctcttggtggacctgtgcctagacgatctgagctgcaatcaaaatgaggtagaagcgtcagatctggaggtactgaccggaattccggccgaggtcccgcatatcagagagtccgtaatgaggcagggccgccatttgtgtttccagttggtgtctccaacaggtacagccgtgagtactcttagttatatcagcagaacaaatcagctggccgtgggttttagtgatggctatctagcactgtggaatatgaaaagcatgaaaagagaatactacattcaactggagagcggccaggttcctgtttacgctgtcacattccaggagcctgaaaacgatcccaggaattgttgctacctgtgggccgtccaaagcacacaggattctgagggagacgttctgtcacttcatttactgcagctcgcctttgggaatcgaaaatgcctggcatctgggcagatcctgtatgagggactcgaatactgcgaagaaaggtacactctcgatctgaccgggggaatgttccccctgcgcggtcaaacctctaatactaagctgttaggctgccagtcaatcgagaagtttaggagccatggcgatcgggaagagggcgtgaacgaagctctttctcctgatacctctgtgtctgtttttacatggcaggtcaacatctacggtcaaggaaagccttccgtctatctggggttattcgatatcaaccgctggtaccacgcgcagatgcctgactctctccgctctggggaatacctccacaactgttcgtactttgcgttgtggagcctggagtccgtagtgtcgcggacgtcccctcacggcatcctagacattttagtgcacgagaggagtctaaatcgcggcgtgcccccttcttatccacctcccgagcaattttttaacccatcaacttataattttgacgccacatgcctgcttaacagcggagttgtgcatctcacttgtaccggcttccaaaaagaaaccctcaccttcttgaagaagtcaggcccatccctgaacgagcttattccagatggttacaataggtgtcttgtggcggggcttttatcaccccggtttgttgacgttcagccctccagtctatcccaagaggagcagctcgaagccatactgtccgcagcaattcagactagctcactagggctcctcactgggtatattagaaggtggataaccgaagaacagcctaactccgcgacaaatttgcgtttcgtcctagagtggacctggaataaagtggttcttaccaaagaggagttcgaccgactctgcgtccccctatttgatggttcttgtcacttcatggatccccagacgatccagtcaatacaacagtgttaccttctcttaagcaacctgaacattgttctctcgtgcttcgcttccgaggccagagagattactgagcgtggcctcatagatctgtccaacaagttcgtcgtgtctcaccttatctgtcagtatgcccaggtggttctctggttcagccacagcggcttgttacccgaaggcatcgacgatagtgtgcagctctcccggctctgttataactatccagtgattcagaactattatactagccgaaggcaaaagttcgaacgactctccagaggtaagtggaatcccgactgcttaatgatcgacggcctggtaagtcaattaggagagaggatagagaaactctggaagcgagatgagggcggaacagggaaataccctcccgcctcactgcacgccgtcctggatatgtacctgctggacggggtgacagaagccgctaaacattcaatcactatctacttgctgctcgatataatgtacagctttcccaacaagacggatacccctatcgagagttttcctaccgttttcgctattagctggggccaggtgaaacttattcaaggcttttggctcatagaccacaatgactacgagagcgggttggatctgctttttcatcctgcaacggccaaaccgctaagctggcaacacagcaaaatcatccaggcatttatgagtcagggggagcacagacaggccttacggtacatccagactatgaagccgaccgtaagcagcgggaacgacgtcatcctgcaccttaccgtcctgctgttcaatcgttgcatggtcgaagcctggaacttccttaggcaacactgcaatcgacttaacatcgaagagttgctgaagcacatgtatgaggtatgccaggaaatgggcctcatggaagacttgctcaaacttcctttcactgatacagagcaagagtgcctcgttaagttcttgcaatctagcgcctcagttcagaatcacgagtttctcttggtgcaccacctacagcgcgcaaactatgtccctgcactgaagcttaatcaaacacttaagattaatgtgatgaacgatagggacccgagactccgcgagcggtccctggccaggaattccattctcgaccaatatggaaagatactgccacgagtccatagaaaactagctatcgagagagcaaaaccctaccatctgagtacatcatcggtatttcggctcgtgtctcgcccgaagcctctttcagcggtgccgaagcaagtggtaactggaacagtgctcacccggtctgtatttataaacaatgttctgagcaagattggggaagtgtgggcctccaaagaaccaattaatagcacaaccccttttaatagtagcaagatcgaagaaccatcccctatagtgtacagtctccccgcccccgagctgccagaggccttttttggtacccccatttctaaagccagccagaaaataagtagactgctagatttagtggtccagcctgtgccccggccctcacagtgtagtgaatttatccaacaaagtagtatgaaatcacccctgtaccttgtgagcaggtcgttgcccagttcttcccagttaaaaggatccccacaagcgatctcccgggcttctgaactccaccttctcgaaactcccttggtcgtgaagaaggctaagtcattagcaatgagtgtgactaccagcggttttagtgaattcactccccaaagcattttgagaagtacactcaggtctacaccccttgccagcccttcccccagtcccggtcgaagtcctcagcgtctaaaggagaccagaatcagctttgtggaggaagacgtgcatccaaaatggatccccggggctgccgacgatagcaagctcgaagtcttcaccacccctaaaaagtgtgctgtgcctgtggaaactgagtggttgaaatcaaaggatagaaccacttctttctttctcaacagtcccgagaaggaacatcaggaaatggacgagggatcccagtcgctggagaaactagatgtgtccaagggaaattcttctgtttccatcaccagtgacgaaaccacactggagtatcaggacgcccctagccccgaggatctggaagagacagtatttaccgcatcgaagcccaaatcttcttccactgcccttactaccaatgtcaccgagcagaccgagaaggacggcgataaggacgtgtttgcctctgaagtgaccccatctgacctgcagaaacaaatggggaatctcgaggatgccgagaccaaagacctcctggttgcagctgaagcattctctgaactgaatcacctgagtccagtacagggcaccgaagccagtctgtgtgccccatcagtgtacgaaggcaagatttttacgcagaaatcgaaggtgccagttttagacgagggactaactagcgtcgagacctatacacccgcaatccgcgcaaatgacaataaaagcatggccgatgtcctcggggatgggggtaactcttcgctcactatctccgaggggccgatcgtgtctgaacggcggctcaaccaagaagtggccctaaatctcaaagaagatcacgaggtagaggtgggggtgctcaaagagagtgttgatctgcccgaagaaaaactccctataagcgactccccaccagacacgcaggaaatacacgttatcgagcaggaaaagctcgaagcccaagattctggagaagaggcccgaaacctgagttttaacgagctgtacccctcaggtactctgaaactccagtataatttcgataccattgatcagcagttctgcgacttggctgataacaaggataccgcagagtgcgatatagctgaggtggatggggaactttttgtggcccagtccaactttacactgattctggaaggcgaggaaggcgaagtagaacctggggattttgctagcagtgacgtactgcccaaagccgcgaacaccgcaactgaggagaagctggtgtgcagtggggaaaatgacaaccatgggcaaatcgctaaccttcctagtgctgtcacctcggaccagaaatcccagaaggtagacaccctgccttacgttcccgagcccatcaaggtcgccatcgctgagaacctgctggacgtcatcaaggacacaaggtcaaaggagatcacctccgacactatggaacaatctatccatgaaacgatccccctggttagtcagaacattatgtgtcccactaaacttgttaaatctgcctttaaaacagcgcaggagacttccacgatgactatgaatgtgtctcaggttgacgatgttgtcagtagcaaaactcgaacccgtgggcagcgaattcagaacgtgaatgtcaagtctgcacaacaggaggcctctgcagacgtcgcaactcctaagatgcctggccagagcgtgcgcaaaaagacccggaaggctaaggagatatccgaggcctccgagaatatctacagtgacgtgagaggactctctcaaaatcagcagataccccagaattctgtgacccctagacgggggcggcggaaaaaggaggtcaaccaggatatcctggagaatacgtcaagtgttgaacaggaactgcagataaccactggccgcgagtccaagcgtctcaaaagttctcagctccttgaacccgccgtggaggaaaccactaaaaaggaggttaaagtgtcaagcgtgacaaaacgaaccccccgccggatcaagcgctctgtcgagaatcaggagtccgttgaaattatcaatgatttaaaagtctcaaccgtgacatccccctctcgtatgatccgcaagctgcggagtaccaacctggacgctagcgaaaacactgggaataaacaggacgataagagttcggataaacagcttcgcatcaagcacgtgcgccgcgtgcgcggaagggaggtgtcccccagcgatgtccgggaagattccaacctcgagtcatcgcagttaacagtgcaggccgagttcgatatgtcagctattcctagaaaacgaggccggccaaggaagatcaacccttccgaggacgtaggatccaaggcagtaaaagaggagcgctctccaaagaagaaagaagctccttcaatacggagaagatccactcgcaatacccccgcaaagtccgagaatgttgacgtgggaaaaccagcattggggaagagtatcctggtccctaatgaggagttatcaatggtaatgagcagcaaaaaaaagttgacaaaaaaaacggagagccagtcccaaaaaagaagcctgcactccgtctccgaagaacgcacggacgagatgacacacaaagaaactaacgagcaggaagaaagactgctggcaactgcctctttcacaaagtcttctcggagctctcggactcgatcctctaaggctatcttactgccagacctatcggaacctaataatgaacccttgttctctcccgccagcgaggtgccccgcaaggctaaggctaagaagattgaggtccccgcacagcttaaagagctggtgtctgacctcagttcacagtttgtaatctccccccctgctctcagaagtcggcagaaaaatacctctaataagaacaagttggaagacgagctcaaagacgatgcacagagtgtcgagaccctcggcaagcctaaagccaagaggatccggaccagtaagaccaagcaggcctccaagaacactgaaaaggaaagcgcctggagcccaccccccatagaaattcgtctcattagccctttagctagcccggcggatggggtgaaaagtaagccccggaaaacgaccgaggtcaccgggaccgggctggggcgcaataggaaaaagctgagctcctatcctaaacagattctgcgccgcaaaatgctctag

SEQ ID NO: 108815 - DNA, 6906 bp, Artificial Sequence
  Description of Artificial Sequence: Synthetic coding sequence
atggacagcctcgctggcttgtcacctcgcgaggcagctggggttctgagcctgagctgcgtaggcgtttgtagcacctgcgcatgggcatggccgcacggcagcatgcgcgatctcagagcccaggtcacttcaggcctccttcctttcccggaagttactctgcaggctcttggagaagacgagatcacactggaatcagtccttaggggcaagtttgccgccggcaagaacggcttggcctgtctggcttgtggccctcagttggaagttgtgaactctatcaccggtgaacgactgtcggcataccgcttttctggcgtgaatgaacagccccctgtggtgctcgcggtaaaggagttctcttggcagaagcgtacaggtcttctgatagggctggaggagaccgaagggagcgtcttgtgtctgtatgacttgggtataagcaaagtcgtgaaagcggtcgttctgccaggcagagtaacagcaatagaaccaatcattaaccacgggggagcaagcgcttctacccagcacctgcatccttctctccggtggctttttggcgtggccgctgtagtgactgatgttgggcagattctgctggttgatttgtgtctggacgacctgtcatgcaaccagaacgaagtggaggcatctgacctcgaggtgctgacagggatccccgccgaggttcctcacatcagggagtctgtcatgcgtcagggtagacatctttgctttcagttggtgtctcctactgggaccgcagtctctacgctctcctacatttcaaggactaaccagctggctgtagggttcagcgatgggtacttagccctgtggaacatgaaatctatgaagagagaatactacatccagctggagtctgggcaagtccctgtgtacgctgtgaccttccaggaaccagagaacgatcccaggaactgttgctatctctgggctgtgcagtctacgcaggatagcgaaggagacgtcctatctctacatctcttgcagctggcatttggaaaccggaaatgtctggccagcggtcagatcttgtacgaggggctggaatactgtgaggaacgctatacgctagacctgacgggaggaatgtttcctctgcgcgggcagacatctaacaccaagttgctgggctgtcagtcgattgaaaaattcaggagccacggggaccgagaagagggggtcaacgaggccctgagccccgacacgagcgtgtccgtgtttacgtggcaggtgaacatctatggacagggcaagccctcagtctatctgggcctcttcgacatcaaccggtggtaccatgcccaaatgccagatagcctgaggtctggagagtacctgcacaactgctcttacttcgctctctggagcctggagtcagtcgtgagccggaccagcccccatggtatattggacattcttgtacacgaaaggtcattaaatcgaggggtacctccctcgtatccaccacctgagcaattcttcaacccctctacttacaactttgatgcaacgtgtctgctgaactctggagtcgtacatttaacatgtacaggcttccagaaagagacgctcaccttccttaagaaatcaggacccagtctgaatgaactcattcccgacgggtataaccgctgtttagttgcagggctgctgtccccgcgcttcgttgacgtgcagccctcatcactgtcacaggaggaacagttggaggctattctctctgccgccattcagactagcagtctgggcctcttaacgggctatatcagaaggtggatcaccgaggagcagccaaattctgccactaatctgcgcttcgttctcgagtggacttggaacaaagtagtgttaacaaaggaggagtttgatcgactctgcgtgcccctgtttgacgggtcctgccactttatggacccacagaccatacaatcaattcagcagtgttatctcctgctgtctaatttgaatatcgtattgtcttgtttcgcctccgaggcccgtgaaattactgaaagaggcctcattgacctcagtaacaagtttgtggtttctcatttgatttgccagtacgcccaagttgtcctgtggttctctcattccggcctcttacccgaagggatcgatgatagcgtgcagttgagccggctgtgttacaattatcccgtgatccagaactattatacctccaggcgccagaagtttgagcgcctcagcagaggtaagtggaatcctgattgtctaatgattgatggacttgtttcccagctaggggagcgcattgagaaactgtggaaacgagatgaagggggtacagggaaatacccacctgcctctttacacgcagtgctcgacatgtacctcctcgatggcgtgacagaagcagccaaacactccataactatctacttgctgctggacataatgtatagcttcccaaataaaactgatacaccaattgagtcctttcctacagtgtttgccataagctggggccaagtgaaactaatccagggattctggctaatcgaccataatgattatgagagcggactagacctcctctttcaccctgccaccgctaaacctctgtcctggcagcatagcaagatcatacaagccttcatgtcgcaaggcgaacaccggcaggcactacgctatatccagactatgaagcctaccgtgtcaagcgggaacgacgtgatcctacatcttaccgtgctgttgttcaatagatgcatggtggaggcctggaacttcctcagacagcactgtaaccgattgaatattgaggagctgcttaaacatatgtatgaggtctgtcaggagatgggactaatggaagaccttctgaagttgcctttcactgatacagagcaagagtgtctggtcaaattcctgcagtcatccgcaagcgttcagaaccatgagtttctgctggtgcaccacctgcagagggcgaactacgtgccggccctgaagctgaaccaaaccttaaaaatcaatgtcatgaatgaccgggatccgcggttgagggaaaggtccctcgctagaaattcaatccttgaccagtacggtaagatactccccagggtccacagaaaattagccattgagcgagcaaaaccataccatctctccacctcctcggtgtttcgtctggtgagtagaccaaaacctctgtccgccgtacctaaacaagtcgtgacgggtaccgttttgactcggagcgtgttcatcaacaatgtgctgagtaagataggcgaggtctgggcctcaaaggagcccatcaactcgactaccccttttaattcaagcaagattgaagaacctagcccgattgtgtacagtctgcccgccccagaactgcccgaagcattcttcgggacacccataagcaaggcatctcagaagatctcccgcctgctggacctggtcgttcagccagtgcctagacccagtcagtgttccgagttcattcagcagtcatccatgaagtcacctctctatcttgtgagtaggagtctgccctctagctctcagttgaagggcagcccacaggccatatcacgggcatcggaattacacctgttggaaaccccactggttgtgaaaaaagccaagtccttagccatgtcggtgacaacctctgggtttagtgagtttacccctcagagtattcttcggagcacattacgttctacccccctggcatccccatctccttctcctggacggagccctcaacgcctgaaagaaacaaggatcagctttgtggaggaagacgtacaccccaagtggatccctggtgcagctgacgacagtaagctcgaggtgttcaccactccaaagaaatgcgctgttccggttgagacagaatggttaaagtccaaggatcgcacaaccagtttcttcctcaactcgccggagaaagagcatcaggagatggacgaggggagccagtccctcgaaaaactagacgtatctaaaggtaatagtagtgtctccatcacaagcgatgaaaccacgctggaataccaagatgctccttcccctgaagatcttgaggaaacagtatttacggcttctaagcctaaatcatcctccaccgcccttacaaccaacgtcacggagcaaacagagaaggatggggataaggacgtgttcgcttctgaagtcacgccatcagacctgcagaaacagatgggcaatcttgaggatgcggagacgaaagacctgctcgtggctgcagaggctttttctgagctcaatcacctgagccccgtgcaggggacagaggcgtcactctgtgcccctagtgtgtacgagggcaaaattttcacgcaaaagagcaaggtccccgtgctggacgagggtctgacttcagtcgagacttatacccccgctattagagctaatgacaacaagagcatggctgacgttctgggagatgggggcaattcctctctgaccatcagtgaaggccccattgtttccgagaggcgactgaaccaggaagtagctttaaatttgaaggaggatcatgaggtggaggtcggagtattgaaagagagcgtagacttaccagaagagaaactaccaatctccgactccccccccgacactcaagaaatccatgttatagaacaggagaagttggaagcccaagactctggggaggaagcacgtaatctctcctttaatgagctgtatccttccggcactctgaaattacagtataatttcgacacaatagaccagcagttctgtgatttggcggacaacaaggatactgcagagtgcgacatcgctgaagtggacggggagttgtttgttgctcagtccaatttcacgctcatccttgagggcgaggaaggcgaggtcgagccaggagacttcgcttcttctgacgtgctccctaaagccgccaatacagcaaccgaagaaaagctggtttgtagtggagagaacgataatcacggccagatcgccaacctgccatctgcagtcactagcgatcagaagtctcagaaggtcgacactctcccctacgttcccgaacccattaaagtcgctatcgccgaaaatctgctcgacgtcataaaggatacaagatccaaagagatcactagtgacacaatggaacagagtatccacgaaacgatccctttggtctcacagaacatcatgtgccctaccaagttagtcaagtcagcatttaaaactgctcaagagacgtccacaatgactatgaatgtatcccaggttgatgacgttgtttccagcaagacgcgcactcggggccagcgtatccagaacgtcaatgtcaagtccgcgcagcaggaggcatcggccgacgtggcaacccccaagatgccgggccaatcagtgcggaaaaagactagaaaggcaaaagagattagtgaagcttccgaaaacatttatagcgatgtgcggggtctttcccagaatcaacagatccctcagaactcggtgacacctcggcgcgggcgccgtaaaaaggaagtaaaccaggatatattggagaacacctctagtgtggaacaggagctccagatcactacagggagggagtcgaagagattgaaatcatcacagttgctcgagcccgctgttgaagagactaccaagaaagaagtaaaggtttcgtctgtcacaaaaaggacgccaagaagaataaagagatccgtagaaaaccaggaaagcgtggaaattatcaatgacctgaaggtttcgaccgtcacttctccctctcgcatgattagaaaactccgttccactaatctcgatgctagcgagaatacgggaaataagcaggacgacaagagcagcgataaacagctgcgtattaagcacgtgcgtcgggtcagagggagagaggtctcccctagcgacgtacgtgaggatagcaacctagaatcaagtcaactcactgtacaggccgagttcgatatgtcagctattcccagaaagcgtggaagaccaaggaaaatcaatcctagtgaagatgtagggtctaaagccgtcaaggaggagcgctcccccaagaagaaggaagccccgtccatccgtaggaggagcacacgcaatacaccggctaagagcgagaacgtagatgtgggcaaacccgctttgggtaaaagtattctggtgcctaacgaagagctgtccatggtgatgtctagcaaaaagaagcttacgaaaaaaaccgagagccagagtcagaagaggagtctgcacagtgtgtcagaggagagaactgacgagatgacgcacaaggagactaatgaacaggaagagcgcctgcttgcaacggcatcttttacaaaatcttccaggagttcacgcacccgtagctcgaaagccatcttactgcctgatctcagcgaacctaacaacgagcctctcttttcgccagcgtccgaggtgcccaggaaagccaaggccaagaagatcgaggtgcccgcccagctcaaggagttggtgtcagatctgagttcccagttcgtaatcagcccgccagcactgaggtctcgacagaagaacactagcaataaaaataagctcgaagacgagctcaaagacgacgcacagagtgttgagactctgggaaagccaaaagcaaagcgtatacgcaccagcaagactaaacaggcgagtaagaacaccgagaaggaatcagcatggtctcctcctcccattgaaatcaggttgatctcccccctggctagcccagcagacggagtgaaaagtaagcctcggaagaccacagaggtaacaggaacaggcctgggccgaaaccgcaaaaaattatcgtcataccccaagcagattttgagacggaagatgctatag

SEQ ID NO: 108816 - DNA, 6801 bp, Artificial Sequence
  Description of Artificial Sequence: Synthetic coding sequence
atgagagatctaagggcccaggtcaccagtggcctcttacctttcccagaggtgactctacaggctctgggggaggatgagatcaccctggaaagcgtgctaagaggaaaatttgccgccgggaagaatggtctggcctgtcttgcttgtggaccacaactagaggtagttaattctatcaccggtgagcgactgtctgcctatcgctttagtggtgtcaatgaacaaccaccggttgtgctcgctgtaaaggaattcagttggcagaagcgcaccggacttctgatcggcctggaagaaacggaggggtccgtgctgtgtctctacgatctgggcatttctaaagttgtgaaggctgtggttctccccggaagagttactgcaatagagccaattattaatcacggcggcgcttccgctagcacgcagcatctccacccgtcactcaggtggctgttcggggtggctgctgtggtgactgatgtgggacaaattcttcttgtcgacttatgtttggacgacctgtcctgtaatcagaatgaggtggaggcctctgatcttgaggttctgacaggcatcccagccgaggtgccccacattcgggagagcgtcatgcgccaaggaaggcacctttgtttccaactggtatccccaacaggaacagctgtctccaccttgagttatataagccggacgaatcaactggccgtaggcttttcagatggctatctcgcgttgtggaatatgaagagtatgaaacgagaatactacattcagcttgaatctggccaggtgccagtctacgccgtgacttttcaggaacctgaaaacgatccgaggaactgttgttatctttgggcagtccagagcacccaagacagcgagggagatgtcctgtccctccacctattgcagctggcttttgggaatcggaagtgtctggcgagcggacaaatcttatatgaagggctggagtactgcgaagagagatatacattggacctgacaggcggcatgtttcctctgaggggacagacctcaaatactaagctgttgggctgccagtcgattgagaaatttcggtcccatggggaccgggaggagggcgtcaatgaggccctcagcccggataccagtgttagcgtgttcacgtggcaggtgaacatctatgggcaaggcaaaccatctgtgtacttgggactgtttgatattaatcgctggtaccacgcacagatgcccgactcactgaggtcaggcgagtacctgcacaattgctcgtattttgctctgtggagtctcgagtcggtggtgagtagaacctcacctcatggcatccttgacattctcgtgcatgaacggtcacttaaccgaggagtgccccccagttaccctccccccgagcagttcttcaacccctcaacatataattttgacgccacatgtctgctgaatagcggagtggttcacctgacatgcaccggcttccagaaggaaacccttacgttcctaaagaagtccgggccatcccttaatgagctgattccagacggctacaatagatgtcttgtggcaggtttgctgtctccacgatttgtggatgtccagccttcttccttgtcacaggaggaacagcttgaggcaatactgtcagctgccatccagaccagtagtttgggattgcttactgggtacattagaaggtggataacggaagagcagccaaacagtgctactaacctgcgatttgtactggagtggacttggaacaaggtggtgctgacgaaggaagaattcgatcggttatgcgtgcctctgtttgacgggtcgtgccacttcatggaccctcaaactatccagtccattcagcaatgctacttgttactcagtaacttaaatattgtgctgtcctgtttcgccagcgaagcccgggagattacagaacgcggccttatcgacctgagtaacaagttcgtggtcagccatctgatttgccaatatgcccaggtggttttgtggttctcccacagcggccttttgcctgaaggcatagacgattcagtacagctgagccgactgtgctacaattatccagttatccaaaattactacacttcacgtaggcaaaagtttgagagattaagccgcggaaagtggaacccagattgtctcatgattgacggtttggtcagccagctgggagaaaggattgaaaaattgtggaaaagggatgaaggaggaacagggaaatacccgccagcttccctgcacgctgtgctggacatgtacctgctggacggtgtaaccgaggcagcaaaacattccataaccatctacctgctgcttgatatcatgtattctttccctaataagaccgatacccccattgaatcctttccaaccgtgttcgccatcagctggggccaagtgaaacttattcaaggcttttggttgattgatcacaacgattatgaatcaggactggatctcttgttccaccccgcaacagcaaaaccacttagctggcagcatagcaaaattattcaggcgttcatgagccagggcgaacacagacaggccctgcgatacattcaaactatgaaaccaacggtgtcatctgggaatgatgtcatattgcacctcaccgtgctactgtttaatagatgcatggtggaagcatggaattttctgagacaacactgcaatcggctaaatattgaagaattgctaaaacacatgtacgaagtgtgccaggagatgggcttgatggaggacctgcttaaactaccattcactgatacagaacaagagtgcctcgtcaagtttctgcagtcctcagccagcgtccagaaccatgagttccttcttgtccatcatttacaaagggccaactacgttcctgcgctgaagttgaatcagaccctgaaaatcaatgtgatgaacgatcgcgatcccagattgagagagcggagtctcgctaggaatagcattctggatcagtatggaaagatactgcctagggtgcatcggaaattggccatcgaaagggccaaaccctaccacttgtccacctcctctgtatttcgtcttgtgagcagaccgaaacccttatccgcagtcccaaaacaggtcgttaccggaactgttctgactagatccgtttttattaacaatgttctttccaaaattggcgaggtttgggctagcaaggagcctattaacagtacaaccccattcaacagttccaagatcgaggagccttcccctatcgtttattccctgcccgctccggagttacctgaagccttcttcgggacacctatcagcaaagcttcgcagaagatttctaggctgctggacctcgtcgtgcaaccggtgccacgtccaagccaatgctccgaatttatacagcaatccagcatgaaatcaccgctgtacctggtcagcagaagtctccccagtagcagccaactgaagggcagcccacaagctatttcccgcgcaagcgagctgcatctgttggagacacccctcgtagtgaaaaaggctaagtcactggcaatgagcgtgacaacatcgggattcagtgagtttacccctcaaagcattctgcgcagcacgctgcgctcaacaccactcgcatctccgtccccgtcacccggaaggagtcctcagcgccttaaagagaccaggattagctttgtagaggaggatgtgcaccctaaatggatccctggcgctgcggacgatagcaaattggaggtgtttacaaccccaaaaaaatgcgctgtcccggtggagaccgagtggctgaagtccaaggataggactacttccttctttctaaactccccagaaaaagagcatcaggaaatggatgaaggcagccagtctcttgagaagttggacgtttcaaaaggtaatagctccgtatctatcaccagtgacgagacaaccctagaataccaggatgcaccatctcccgaggacttagaagagactgtgttcaccgcttcaaagcccaagagctcatccacggccctcaccaccaacgttacagaacagacagagaaggacggtgacaaagatgtgttcgcatcagaggtgactccaagcgatttgcagaaacaaatggggaatctggaggatgcagaaaccaaggacctgctggtagctgctgaagcttttagcgagttgaatcacctgagccccgtgcagggcacagaggcctcgctgtgcgcaccaagcgtttatgagggaaagatttttacccaaaaaagcaaggtgcctgtcctggacgaaggactgacaagtgtggaaacatatactcccgccatccgggctaacgacaacaagtctatggccgatgtcttgggagatgggggaaattcgtctctgactatatcagaagggcctatcgtctcagaaagacgcttgaaccaggaggtcgctcttaacttaaaagaggatcacgaagtggaggtcggtgtcctcaaggaatccgtggatctccccgaagaaaaacttccaatatcagatagcccacctgacacacaggagattcatgtgatcgagcaggaaaaactggaggcccaggattcgggtgaagaagctcggaacttatcctttaatgaactctatccttctggcaccctcaagcttcagtataacttcgacaccattgaccagcagttctgtgacctcgcagacaacaaggataccgccgagtgtgacatcgcggaggttgacggagagttattcgtggcccagagtaacttcacgctgattctagagggcgaagaaggcgaggtggaacccggggattttgcgagctcagacgtgctcccaaaagccgcgaatacagccactgaggagaagctggtttgctctggagaaaacgataatcatggtcagatcgcaaacctgcccagcgccgtaacctctgaccagaaatcccaaaaggtggatactcttccgtacgttcctgaacctatcaaggtagcaatcgcagaaaaccttctggacgttatcaaggatacacgtagcaaggagattacctccgacactatggagcaatcaatacatgaaacaattccgcttgtgagccagaatatcatgtgtccaacaaaactagtcaagtctgcttttaagacggctcaagaaacctccaccatgaccatgaatgtttcccaagttgacgacgtcgtcagctctaagacaagaacccgcggccagaggatccaaaatgttaacgttaagagcgcacaacaggaggctagcgccgatgtcgctacaccaaagatgcccggtcagagtgtgagaaaaaaaaccagaaaggcaaaggagatcagtgaggcaagtgaaaacatctactctgacgtgcgtggactgagtcagaaccagcagatcccacagaactccgtgacaccaagaaggggaaggagaaagaaagaagtgaaccaagacatcttggaaaatacctcctccgtagaacaggaactacagatcactactggaagggaatctaagcgcctaaaatccagtcagctgctggagccggccgtcgaagagaccaccaaaaaagaggtcaaggtgtcctccgtaaccaagaggacgccaaggcgaatcaagcgaagcgtcgagaatcaagaaagtgtcgagataatcaatgacttaaaggtttcaacagtgacctctccgagccgcatgatcagaaagctgcgatctactaatctagacgcttctgagaacaccggaaacaaacaggatgataagtccagtgacaaacagctgcgcattaagcacgtccgccgggtgcgcggcagagaggtttccccatcggatgtcagggaagattccaatctggagagttctcagctgactgtgcaggcggaatttgacatgtctgccattccgagaaagcgtggccgccccagaaagatcaacccctctgaggatgtcggatcaaaggcagttaaggaagaaaggtcccctaagaaaaaggaggccccctccattcgcaggcgatcaactaggaatacacctgctaagtccgagaacgtggatgtcggaaaaccagctctaggaaagtccattcttgtaccaaatgaagaactgagcatggtcatgtcatcaaagaagaagctcacaaagaagacagaaagccagtcgcagaagcgctcgctgcacagcgtctctgaagagcgcaccgacgagatgacccataaggaaaccaacgagcaggaggaaagacttttagctacagcctcatttaccaaaagcagccggagttccaggactcgatcctcgaaagccatcctccttcccgatctgagcgagccgaacaatgaacctttgtttagccctgccagtgaggtgcctcgcaaagctaaagctaagaaaatagaggtgccagcccaacttaaggaactcgtgtctgatctgtcatcacaattcgtcatcagccctcctgcccttaggagcaggcaaaagaacacctcgaataaaaataaactcgaggatgaactgaaagacgatgcacaatccgtcgaaacactcggcaagccaaaggcaaagcgcataaggacaagcaagaccaagcaggcctctaaaaacaccgagaaggagtctgcctggtcccccccacctatcgagatccgtctgatatctccgttggcatcacccgccgacggtgttaagtcaaaaccgagaaagactactgaggtgactggcaccggactggggcgcaaccgcaagaagcttagcagctaccccaagcaaatactgagaagaaagatgctttag

SEQ ID NO: 108817 - DNA, 3567 bp, Artificial Sequence
  Description of Artificial Sequence: Synthetic coding sequence
atgaaggccgccgatgagccagcctacctcaccgtgggcaccgatgtgagcgccaaataccgcggagctttctgcgaggccaagataaagaccgtgaagcggttggtgaaggtcaaggtgctgcttaagcaggataacacaacccagctagtacaggatgatcaggtgaagggccctctccgtgtcggtgcaatcgtggaaacccgaacgagcgacggtagcttccaagaggctattatctcgaaactcacggatgccagctggtatactgtggtcttcgatgacggagacgagcgtaccctccggcgaacctctctgtgccttaagggggagcggcatttcgccgagtcagaaacactggaccaattgccactgacaaaccctgagcactttggtactccagtgattgcaaagaagactaatagaggacggagatcaagcttgccagttacagaggacgaaaaagaagaagagtcaagcgaggaagaggacgaagacaagaggagactcaacgacgaactgctgggtaaggtagtgtctgtagtgtccgcaacggagcgaacagagtggtaccccgcgctagtcatcagcccttcctgcaatgatgatatcaccgtgaagaaggatcaatgtctggtgcgaagcttcatcgatagcaaattctactccatcgcgcgcaaagatataaaagaggtagacatcctcaatctgccggaaagcgaattgtcaactaagcccggtctgcaaaaggcctcaatttttctgaaaactagagtagtgcctgataactggaagatggacatcagcgagatattagagtcctcgagctctgacgatgaggatggacccgctgaggaaaacgacgaggaaaaggaaaaggaggccaagaagaccgaggaagaggtgccagaggaggaattagacccagaggaacgcgataacttcttacaacaactctataaatttatggaggaccggggtacgcccatcaataaacctccggtgttaggatacaaggatctcaatctatttaaactcttccgcctcgtctaccaccagggggggtgcgataatattgactcaggagccgtgtggaagcagatctatatggacctcggtatccctattttgaatagcgccgcatcttacaacgtgaagaccgcttaccggaagtacctctatgggtttgaggaatactgccggtcggccaacattcaattccgaacggtccatcatcacgaacccaaagtcaaggaggagaaaaaagacctagaggaaagcatggaggaagctcttaagctggaccaggagatgcccctaacagaggttaagtccgaaccggaggagaatattgattccaactctgagagcgagcgtgaagagatagagctcaagtcccctcgcggcagaagacggatcgcccgggacgttaattccatcaaaaaagagatagaggaagaaaagaccgaagataaactaaaggataatgacacagaaaataaggatgtggacgacgactacgagactgccgaaaaaaaagagaacgagcttcttctcggccgcaagaatactcctaaacagaaggaaaagaaaattaagaaacaggaggactcagataaggattctgatgaagaggaagaaaaaagtcaggagcgagaggaaacagagtccaagtgcgattcagagggggaagaagacgaggaggatatggagccttgtctgaccggcactaaggtaaaggtgaagtatggcagggggaagacacaaaagatttacgaagctagcattaagtccaccgagatcgacgacggggaggttctgtacctggtgcattattacggatggaacgtgaggtatgacgagtgggtgaaggcagaccgaattatctggcctctcgacaaaggcgggcccaaaaagaaacagaagaaaaaggcgaagaacaaagaagattcagagaaggatgaaaaaagggatgaggaaagacagaaatcaaaacgcggaagaccccctctcaagtccaccctctccagcaatatgccttatggcttaagcaagaccgccaatagcgagggcaagtctgactcctgttccagtgattccgagacggaagacgccctagagaagaatctgataaatgaagaactcagccttaaggatgagctagaaaagaacgaaaatcttaatgacgacaagcttgacgaagaaaatcccaagatctcagcgcatatcctgaaagagaacgaccgtacacagatgcagcccttagaaactctcaagttggaggtgggcgagaacgagcagatagttcagatctttggaaacaagatggagaagacggaggaggtgaagaaggaggctgaaaaatcccctaaagggaaggggagacgtagtaaaactaaagacttaagcttggagattatcaagatctcctccttcggtcagaacgaagccggatcagagccgcacatcgaagcgcatagcttggaactcagcagcctggataacaagaatttttcaagtgcaacggaagatgagattgaccagtgtgtgaaagaaaaaaagcttaaacggaaaatccttggtcagagcagccctgaaaaaaaaattcgcatagagaacgggatggagatgacgaatacagtttcacaggaacggacaagcgattgtatcgggagcgaaggaatgaaaaacctgaacttcgaacagcactttgaacgagaaaatgaggggatgccttcccttattgccgagtctaatcaatgcattcagcaactgaccagcgagaggtttgacagccctgccgaggagaccgtcaatatccctctgaaagaagacgaggacgccatgccactgattggcccagaaacccttgtctgccatgaagtggacctggacgaccttgacgaaaaggataagacctccattgaggatgtggctgtcgagtcgtcggaaagcaactctctagtgagcatcccccctgcccttccacccgtagtgcagcacaacttctccgtcgcctcgccactgactctttcacaggacgagtcccgttccgtgaaaagtgagtctgacatcactatcgaggttgactcgattgcggaggaatcccaggaaggtctctgtgagcgcgagtccgccaatggcttcgagacaaatgtagcaagcggaacttgcagcatcattgtccaggaaagagagtcacgcgagaaaggtcagaagcgccccagcgatggtaatagtggactcatggctaaaaaacagaaacgcacaccaaagagaacctccgctgcagccaagaacgagaaaaatggaacagatgagctggacaacatgaattctactgagaggatcagcttcctccaggaaaagcttcaggagatacggaagtattatatgtctttaaaaagcgaagtggctaccatcgaccggcgccggaagaggctgaagaagaaggaccgagaagtgagccatgccggggcatccatgtcttctgcctcctccgatacaggcatgagtcctagtagttcctctcctccccaaaatgtgctcgcagtagagtgtaggtag

SEQ ID NO: 108818 - DNA, 3774 bp, Artificial Sequence
  Description of Artificial Sequence: Synthetic coding sequence
atgaaagcagctgatgaacccgcttacctgaccgtaggtacggacgtgagcgcaaagtaccggggggcattctgcgaggccaagataaagaccgttaagcgattggttaaagtgaaagtgcttctcaaacaggacaacacaactcaactggtgcaggacgatcaagtcaagggccccttacgggtgggtgcaatcgtcgaaaccaggacatctgacggatctttccaagaggcaatcatttcaaagctgacagacgcatcctggtacacagtcgtatttgatgacggcgatgagaggacgctgaggcggactagcctgtgcttaaagggagagcggcattttgcagagtctgaaaccctggaccagctaccgttgacaaaccccgagcatttcggaactcccgtgatcgcgaagaagaccaacaggggaagaaggagttctctgccagtgacggaagacgagaaggaggaagaaagttcagaggaggaggatgaggacaagaggagactgaatgacgaactcctgggtaaagtcgtgtccgtggtgtcggccaccgaacgaacagagtggtaccctgccttggttataagcccaagctgcaatgacgatataaccgtgaaaaaagatcagtgtctggtgcgatcttttattgacagcaaattttatagcattgcacgtaaggatattaaagaggtggacattttaaacctgcctgagtctgagctgtctactaagccaggccttcagaaggcctccatattcctgaagactagggtcgtccctgacaattggaagatggatatcagtgagattctagaatcttcaagttccgatgatgaggacggaccagccgaggaaaatgacgaggaaaaagagaaggaagctaagaaaacggaggaagaggtacccgaggaggaattagaccccgaggaacgcgataacttcctgcagcagctttacaagttcatggaagatcgggggacacctattaacaagccccctgtgctggggtacaaagatctaaacctcttcaagctatttagactggtctatcaccaagggggttgtgataatattgacagtggagctgtttggaaacagatatatatggacctggggattcctatcctgaactctgcagcctcatacaacgtaaaaacagcgtatagaaagtatttgtacgggtttgaagagtattgtcggtctgcgaatatccagttccgcaccgtccatcatcacgagcccaaggttaaggaagaaaaaaaggatttagaggagtccatggaggaggccttgaaactggaccaggagatgccgctgaccgaggttaagtccgagcctgaagagaacatcgacagcaacagtgaaagcgaacgggaagagatcgagctgaagtccccacgcggacgaaggcgaatagctagagatgtgaattctatcaagaaagagatagaggaggagaaaactgaggacaagttgaaagacaacgacacagaaaataaagacgtcgatgacgactacgagacagctgaaaaaaaggagaatgagctcctactcggaaggaagaacactccaaaacagaaagagaaaaagattaagaagcaggaagattcagacaaggatagcgacgaggaagaggaaaaatcccaggagcgcgaggagacagagtcaaaatgtgacagtgagggggaagaggacgaagaggatatggagccatgtctgaccgggacaaaggttaaagtgaaatatggaagagggaaaacacagaagatctacgaagcaagcatcaagtcaaccgaaatagacgacggggaggtactgtatctagtccattactatggttggaatgttagatacgatgagtgggtgaaggccgatcgcatcatttggccgctggataagggagggcctaagaagaagcagaagaagaaggcgaagaataaggaggattctgagaaggacgagaaacgggacgaggaacgccagaagtcgaaaagagggagaccacccctgaaaagcacgttaagtagtaacatgccctacggattgtctaagacagccaatagcgaggggaagagtgactcttgcagctctgattccgagactgaagacgctctggaaaagaatctgatcaacgaggaactttctctgaaggatgagctggaaaaaaacgagaatctgaatgatgacaaactggacgaggagaaccctaagatcagtgcccacatcctgaaagagaacgataggacccaaatgcagccactggaaacgctcaagttagaagtaggtgagaacgaacagatcgttcagatctttgggaataaaatggaaaaaactgaagaagtgaagaaggaggccgagaagtcccctaagggcaaagggagacggtcaaaaaccaaggacctttcgctcgaaatcatcaaaatttcatcttttgggcagaatgaggccggaagcgagcctcacatcgaggctcattcacttgagttgtcatctctggacaataaaaactttagctcagcaacagaggacgaaatagatcagtgtgtgaaagagaaaaagctaaagaggaagatccttggacagagttcaccagaaaagaagatccgaatcgagaacggtatggagatgaccaatactgtgtctcaggagagaacttcagactgtatcggctccgagggtatgaaaaacctcaactttgagcagcatttcgagagggagaatgagggcatgccgagcctgatcgctgaatccaaccagtgtatccagcagctgacctccgaacgattcgacagtccagccgaagagacggtaaacattccactgaaggaggatgaagacgctatgcccctgataggacctgaaactttagtgtgtcatgaggtagatcttgatgatctcgatgagaaggataaaacctccatagaggacgttgccgtggaaagctctgaaagcaactcattagtgagcatcccaccggccctgccccctgtggttcagcacaactttagtgttgctagccccctgacactttcacaggatgaatcacgttccgtgaaaagtgagagcgatataactatcgaagttgactctatagccgaagagtcccaagagggcttatgcgaacgagagagtgctaacggatttgagaccaatgttgcctcagggacctgcagtattatcgttcaggaacgggagtcacgcgaaaaggggcagaaacgcccttcagacggcaacagcgggctaatggccaagaaacagaagagaacaccaaagaggacatccgctgcggccaagaatgagaagaacggcacggggcagagcagtgattctgaggatctgcctgtgctcgacaatagctctaaatgcacacctgtcaaacacctgaatgtgagtaaacctcagaaactggcccgctcacccgcccgaatttccccccacatcaaggacggagagaaggataagcacagagagaagcaccctaacagcagcccaaggacctacaagtggagtttccaattgaacgagctggacaatatgaattctacagagcggatttcattccttcaggagaaacttcaagagattaggaaatattatatgagtctgaagtccgaggtcgctaccattgatcgccggcgcaaaaggctcaagaagaaggacagggaagtaagtcatgcaggggcgtccatgagttcagcgtcctcagacaccggcatgtctccaagttcctcctccccaccacagaatgttctggcagtagaatgtagatag

SEQ ID NO: 108819 - DNA, 3612 bp, Artificial Sequence
  Description of Artificial Sequence: Synthetic coding sequence
atgaaggccgccgacgagcctgcatatctgactgtgggtaccgacgtgtccgccaaataccgcggggccttctgtgaggccaaaataaaaacggttaaacggctggtgaaggttaaggtgctactgaaacaagacaacacaacacagctcgtccaggacgaccaggttaagggacccctccgcgtgggggcaatcgtcgagaccaggacctccgatggttccttccaggaagctattatatctaaactaacagatgcctcctggtacaccgtggtgttcgacgatggtgatgaacgtacattgcgccgtaccagcttgtgccttaagggcgaaaggcacttcgctgaatctgagactcttgatcaactcccactgacaaaccctgagcacttcggcacacccgtcatcgctaagaagacaaaccgcggcaggaggagttccctacctgttacagaagacgagaaggaagaggagtcttcggaggaagaggatgaagataagcgccgactgaatgacgagttgctgggcaaagttgtctccgtggtgtccgcaacagaacgtacggaatggtatcctgccttggtgatttccccctcatgcaacgatgatatcacagttaagaaggaccagtgtctggtacggtccttcatcgattccaaattttatagcattgcccggaaagacattaaggaggtggatatcctgaacttgccggaatctgagctcagcacaaaaccagggttacagaaggcatcaatatttttaaagacccgagtggtccctgacaactggaaaatggatatcagcgagattctcgaaagctcatccagcgacgatgaggatggccccgcggaagaaaacgatgaagaaaaagagaaagaagcaaaaaaaaccgaggaggaggtccctgaggaagagctcgaccctgaggagcgcgacaatttcctgcagcagttgtataaattcatggaggaccgtggtacccctatcaacaaacccccagttctgggatacaaagacctgaacctatttaagctgttcaggctagtgtatcaccaaggtgggtgcgataacattgactctggcgccgtttggaagcagatatatatggacctgggtattcccatcctcaatagcgccgcgagttataacgtgaagactgcgtatcgcaagtacctctacggctttgaggagtattgcagatctgcaaatatacaattccgcaccgtccaccatcacgagcccaaagtcaaagaggagaagaaagacctcgaggaatctatggaagaggccttgaagctagaccaggaaatgccactaacagaggtgaagagcgaacctgaggagaatatagattccaatagtgagagtgagagggaggagattgagctgaaaagtccacgggggcggcgtagaattgcccgggacgtcaactctattaagaaggagattgaagaggagaaaactgaagacaaactgaaggacaacgacaccgaaaacaaggacgttgacgatgactatgagactgctgagaaaaaggagaacgaactcctgctcgggaggaagaacacgcctaagcagaaggagaagaagatcaaaaagcaggaggactctgataaggacagcgacgaggaggaggagaaatcccaggagcgagaggagactgaatctaagtgcgactctgagggcgaagaagatgaggaggatatggagccttgtttgactggaacaaaggtcaaggtgaaatatgggcggggaaaaacacagaaaatatacgaagcttctattaagtccacagaaattgacgacggtgaagttctgtaccttgtgcattactatggctggaatgtccgctacgatgagtgggtgaaggccgaccgcattatctggcccctcgacaaggggggtcccaaaaagaagcagaagaaaaaggccaaaaataaggaggactctgaaaaggacgagaagagggatgaggagcggcagaagagtaaacgtggacgaccacccctgaagagcactctttcctctaatatgccatacgggctaagtaagactgcaaacagcgagggcaaatcagactcctgcagtagtgacagcgagactgaagatgcattagagaagaacctcattaacgaagaactgtctctgaaagatgagctggagaaaaacgagaatctgaacgacgacaagctggatgaagagaaccccaagatatctgctcacattctcaaagaaaacgaccggacgcaaatgcagccactcgaaactctgaaactggaagtcggagagaacgagcagatagttcagatatttggaaacaagatggaaaaaaccgaggaggttaagaaggaggctgagaagagccccaagggcaaaggtaggaggtcaaagactaaagacctgtcactagaaataatcaaaatctccagtttcgggcagaacgaagcagggtccgagccccacattgaggcacatagcttggagctgagttcactcgataataagaatttttcatcggccaccgaggatgagattgatcagtgcgtgaaagaaaagaaacttaagcgcaagatactgggacaaagctccccagagaagaagatccggatagaaaatggcatggagatgaccaatacggtgagccaggagcgaacaagcgactgtatcggctccgagggcatgaagaatctgaattttgagcagcattttgaacgcgaaaacgaaggtatgccatcactgattgccgagtcaaatcagtgcatccagcaactgacgtctgaacggtttgacagccccgccgaggaaacagtgaacatccctctcaaggaggacgaggacgccatgccactcataggacctgaaacacttgtatgccatgaggtggaccttgacgatctagatgagaaggacaaaacgtccatcgaggacgtggctgtggagtcgagtgagtccaatagccttgtgagcattcctcctgccctaccacctgtcgtacagcataattttagcgttgcttcacctctgaccctgtctcaggacgaatcacgatccgtcaagagcgaatctgacattactattgaggtcgatagcattgctgaggagtcccaggagggtctctgtgaacgagaaagcgctaatgggtttgagactaacgttgcttcgggaacctgctcaattatcgtccaagaaagagagtctcgcgagaaggggcagaagcgtccgagcgatggaaattccgggctgatggccaaaaaacagaagcgtaccccaaagcgtaccagtgctgctgctaaaaatgagaaaaatggaactggacagagctccgactctgaggacttgcctgtgctggacaatagcaatgaactggataacatgaactccaccgagcgcatctctttcctccaggagaaactgcaagaaattcgaaagtactacatgagtctcaagtccgaagtggcaacaattgatcgaagacggaagaggctaaaaaaaaaggaccgggaggtttctcatgcaggagcttccatgagtagcgcctcttcggatacaggcatgagcccttcaagcagctctccaccacaaaacgtgctggcagtagaatgtcgctag

SEQ ID NO: 108820 - DNA, 165 bp, Artificial Sequence
  Description of Artificial Sequence: Synthetic coding sequence
atgaaagctgcagatgagcctgcttatctgacagtgggcactgacgtgtcagccaaatatcggggtgcgttctgcgaagctaaaatcaagactgttaagcgtcttgtgaaggtcaaggtactgttaaaacaggacaatacaacccagttggtgcaagacgactag

SEQ ID NO: 108821 - DNA, 3567 bp, Artificial Sequence
  Description of Artificial Sequence: Synthetic coding sequence
atgaaggctgctgatgaacccgcctacctaaccgtcgggactgacgtctccgccaaataccggggagcattctgtgaggcgaagataaagacagtcaaacggttggtgaaggtgaaggtcctgttgaaacaagataacacaacacagctggtgcaggacgaccaggttaagggcccgttaagagtaggggccatcgtcgaaacgcggacgagtgacggcagctttcaggaggctatcatcagcaaactcactgatgcatcttggtacacagttgtattcgacgacggcgacgaacgtactttaagaagaacgagcctgtgtctcaaaggcgaacggcatttcgcagagagcgaaaccttggaccagctgcccctgaccaatccagagcattttggcaccccggtaatcgctaaaaaaaccaacaggggacgccggtcatctctgcctgtaacggaagacgagaaggaggaagagtcgagtgaagaggaagatgaggataagaggaggcttaacgacgaattgttgggaaaggtcgtgagcgtcgtttctgcaacagagcgaacagagtggtatcctgccctcgtcatcagcccttcttgcaatgacgacatcacggtcaagaaagaccagtgcctcgtccgttctttcatcgacagcaaattttattccattgcccggaaggatattaaggaggtagatatcctgaacctcccagaatctgagctgtctactaaaccaggcttgcagaaggcctccattttcctgaagacccgagtcgtgccagacaactggaaaatggacatttctgaaatactggagagttcaagctctgacgacgaggatgggccggccgaagagaacgacgaggaaaaagaaaaggaagcgaagaagactgaggaggaagtgccagaggaagaacttgaccctgaagaacgcgacaatttcctccaacagctctacaagttcatggaagacagggggacacctatcaataaacctcccgtgttgggttataaggacctgaatctatttaagctctttcgcctggtctatcatcagggaggctgtgacaacatcgacagtggggctgtctggaagcagatctacatggaccttggtatcccaatactcaactctgccgccagttataatgttaaaacggcatatcgaaagtacctgtatggcttcgaggaatactgccggagcgccaatattcaatttcgcacagttcaccatcacgagcctaaagtgaaggaggaaaaaaaagatctcgaagaatccatggaggaggcattgaagcttgaccaggagatgccactgacagaagtgaagtccgaacccgaggagaacatcgattcaaactcagaatcggagcgggaggagatagagctgaaatctccccgcggaagacgcaggatcgcccgggacgttaatagcattaagaaggaaattgaggaggagaagaccgaggacaagttgaaagataacgatacagagaataaggacgtggacgatgactacgaaactgctgagaaaaaagagaacgaattgctgctgggcagaaaaaacactcctaagcaaaaggagaaaaaaataaaaaagcaggaggacagcgacaaagactccgatgaagaagaggagaaatcccaggagcgtgaagagactgagtctaaatgtgacagcgagggtgaagaagacgaggaggacatggagccttgtctgaccgggactaaggttaaggtgaagtatggacgtggtaagacacagaaaatttatgaggccagtatcaagtctacagagatcgacgacggcgaagtattatacttggtccattattacgggtggaacgtgagatacgatgaatgggtaaaggccgataggataatctggcccctcgacaaaggcggccctaaaaagaagcagaaaaaaaaggcaaaaaataaggaagacagcgaaaaggatgaaaagagggacgaggagcggcaaaagagcaagcgtggacgcccccctttgaaaagcacactgagctccaatatgccttatgggttaagtaaaacagccaactctgaaggtaagtccgactcttgtagttccgactccgagacagaagacgccctggaaaagaatctgattaatgaagaattgtctcttaaggatgagctggagaagaatgaaaacctgaatgacgacaaactggacgaagagaatccaaagatttccgcccatattttaaaagagaatgatagaacccagatgcagcccctagaaactctaaaacttgaggtgggcgagaatgagcaaatagtgcagattttcggcaacaagatggaaaaaacagaggaagttaagaaagaagccgaaaagtctcctaaaggcaaagggcgtagaagcaagacaaaggatctatccctggagatcatcaagatcagtagcttcggccagaacgaggctggctctgaaccccacatcgaggcacactcacttgaactgagctcactcgacaacaaaaactttagtagcgccaccgaggatgagatcgaccagtgtgtgaaggaaaaaaaactgaagcgaaaaattctgggccaatcctctcctgaaaaaaaaataagaattgagaatgggatggagatgaccaacaccgtgagtcaggagaggacatcagactgcattggttccgaaggcatgaaaaatctcaattttgagcagcacttcgagagggagaatgagggcatgccgagtcttatcgcggagtctaaccagtgtatacagcagctgacctcagagaggttcgactccccggcagaagagaccgtgaacataccacttaaggaggatgaggatgctatgcctcttatcgggccagaaactctggtttgtcacgaagttgacttggacgatttagatgagaaggataaaactagtatcgaagacgtggctgttgagagctccgaatcaaattcactcgtctcgatcccaccggccttgccgcccgttgtgcagcataatttctctgtggcatcaccattgaccctctcccaagatgagagcaggagcgtcaagagcgaatcagatatcactatcgaggtcgactctattgctgaggagagtcaagaggggctctgcgaaagagagagcgccaacggattcgagactaacgtcgccagcggaacctgctcgatcattgtccaggaacgggagagccgcgagaaggggcagaaacgaccatctgatggcaactcaggtctgatggcaaagaaacaaaaacggacacctaaacgaactagcgcagccgcgaagaatgaaaaaaacggtaccgatgagttggacaacatgaacagtactgagcgcattagttttctgcaggagaaactgcaggaaatcagaaagtattatatgtctctgaagtcagaagttgccaccattgaccgtagacgaaagaggttgaagaagaaggaccgcgaagttagtcatgccggcgcaagcatgagctcagcatcctcagacactgggatgtccccttcaagctcgagtccaccccaaaacgtgttagccgtggaatgtcggtag

SEQ ID NO: 108822 - DNA, 3939 bp, Artificial Sequence
  Description of Artificial Sequence: Synthetic coding sequence
atgaaagcacttgacgagcccccttatctgaccgtgggtaccgacgtaagtgctaagtaccggggagccttctgtgaagctaaaataaagactgcaaagcgtcttgtgaaagttaaagtcacatttcgtcacgactcgtccaccgttgaagttcaggatgaccatataaagggccccctcaaggtaggtgcaattgtcgaggtgaagaatctcgatggcgcctaccaggaggcagttataaataagctcaccgacgcgtcatggtacaccgtcgtctttgacgatggagacgaaaagaccctccgacgctctagcttgtgccttaagggcgagcgccatttcgccgaatccgagactctggatcagctacccctgaccaatcctgaacactttggaaccccggttattggtaagaagaccaaccgcggccgcagatctaatcacatacccgaagaagaatctagctccagcagttctgacgaagacgaggatgataggaagcagatcgatgagctgctgggcaaagtggtgtgcgttgactacatcagcctggacaaaaagaaggcactgtggtttcctgccttggtggtatgccctgactgctcagatgaaattgccgtgaaaaaagataacatactggtccgttccttcaaggacggaaaattcacatccgtgcctagaaaggatgtccacgagataaccagcgacactgctcccaaaccagacgccgtgctgaagcaggcctttgagcaggccttggagttccacaagagtaggacaatcccggctaactggaaaaccgagctgaaagaagactcttcctcttctgaagctgaggaggaggaggaggaggaagacgacgaaaaagagaaggaggataatagttccgaggaggaggaagaaattgagccatttcctgaggagcgcgaaaacttcctccagcagttgtacaaatttatggaagaccgggggactcccatcaacaagcgtcccgttttaggataccgcaacctgaatctcttcaagctgttccgattagtacataagctgggtgggttcgacaatatagagtccggtgctgtttggaagcaggtataccaggacctgggcattcctgtcttgaattctgccgccgggtacaatgtgaagtgtgcatataagaagtatctgtacggatttgaagaatattgtaggtcagcaaatattgaattccagatggcactgcctgaaaaagtagtgaacaagcaatgtaaggaatgcgagaacgttaaggaaatcaaagtgaaggaggagaacgagacagaaataaaggagattaagatggaggaagagagaaacatcattccccgtgaggaaaagccaattgaggatgagatagaacgaaaggagaacattaagccctcactaggcagcaagaaaaatctgctcgaatccatccctactcacagcgatcaggagaaggaagttaacataaagaaaccagaggataatgagaatctggacgataaagatgacgataccaccagagtggacgaatcgcttaatatcaaggtggaggctgaggaggagaaggctaagagtggcgacgaaaccaacaaggaggaggacgaggatgacgaagaagccgaagaggaggaagaggaggaagaggaagaagaggatgaggatgacgacgataataatgaagaggaggagttcgaatgctaccccccagggatgaaagtccaggtgcggtacggacgtggcaagaaccagaagatgtacgaagctagtatcaaggactcggatgtggaggggggtgaagttctgtatttggtgcactactgtggctggaatgtgcggtacgacgagtggatcaaggccgacaagatagttcgtcctgcagacaagaatgtacctaagataaaacataggaaaaagataaagaacaagttggacaaggaaaaggacaaggatgagaaatactctcccaaaaattgcaagctgcgaagattgagcaaaccaccttttcagaccaatccgtctcccgaaatggttagcaagctcgacctaactgacgccaagaatagcgataccgcccacattaagtcaatcgagatcacgtctatcctgaacggactgcaagccagcgagtccagtgccgaggatagcgaacaagaagacgagcggggtgcccaagatatggacaataacggaaaagaagaatcaaagatcgatcatctgacaaacaaccgtaatgacctgatcagtaaagaagagcagaattcttcttccttgttggaggagaataaagtccatgccgatttggtgatcagcaaacccgtttccaagagccctgaaaggctgaggaaagatatcgaagtcctgagcgaagacactgattacgaggaagacgaggtcaccaagaagagaaaggacgtcaagaaagacacgacggacaaatcatcaaagcctcagatcaaacgaggtaagagaaggtattgtaatacagaagagtgcctgaagacgggctccccaggcaagaaggaggagaaagcaaaaaacaaggaatcactatgcatggaaaacagttccaacagttcctctgatgaggacgaggaggagacaaaagctaaaatgacacccacgaaaaagtataatggccttgaggaaaagagaaagtcgttaaggaccacagggttctatagtggattctctgaggttgccgagaagagaataaagctgttaaataattccgacgaaagactccagaatagcagagctaaggacagaaaggatgtatggtctagcattcaggggcagtggccaaagaagaccttaaaggagctgttctccgactccgatacggaagcagccgcttccccccctcatcctgcacccgaagaaggggtcgccgaggaatctctgcagacagtagccgaggaggagtcgtgcagtccttccgtggagctggagaaaccccccccagtcaacgtggatagcaaacccatcgaggagaaaaccgtggaggtgaacgatcggaaggccgagtttcctagttccggcagcaattctgttcttaacacccctcccactacacctgaaagcccaagtagcgttacagtcaccgaggggtcaaggcagcagtcaagtgtgactgtgtcagagccccttgcccccaatcaggaagaggtacggtccattaagtccgaaaccgacagcaccattgaggtagatagcgtagctggagagctgcaggacctccagagcgaggggaactccagcccagccggattcgatgcatctgtgtcctcatctagctcaaaccagccagagccggaacatcctgagaaagcctgcaccggccagaaacgagtgaaggatgctcaggggggcgggagttcctcaaaaaagcagaaacgctctcacaaggctacggtggttaataacaagaagaagggaaagggcacgaacagtagcgactctgaagagctttccgctggggaatctattactaagtctcagcccgtgaagagtgtctctaccgggatgaaaagccatagtacgaaaagtcccgcccggacccaatctcccgggaagtgtggcaagaacggggataaggatcccgacctcaaagaaccttccaaccgactaccaaaagtgtacaaatggagttttcagatgtcagatctcgagaacatgacgtcagcggagcggatcaccatcctgcaggaaaagttgcaggaaatccgcaagcactacctatctctgaaatcggaggtggccagcatcgaccgtagacgtaagaggcttaagaagaaggagcgagaaagcgcagctacatcgagcagctcctcatccccctccagtagcagtatcaccgctgccgtgatgctcacactggccgagcccagtatgagctctgcctcccagaatggtatgagcgtggagtgtcgatag

SEQ ID NO: 108823 - DNA, 3681 bp, Artificial Sequence
  Description of Artificial Sequence: Synthetic coding sequence
atgaaggcccttgatgagcccccatatcttactgtaggcacggacgtctcagccaagtaccgtggcgcattttgcgaagccaagatcaagacagcaaaacggctggtgaaagttaaagtcactttccggcacgattcgtcaaccgtggaggtgcaagatgatcatattaagggcccgctgaaagtgggagctattgtggaggtgaaaaacctggacggagcgtaccaggaggccgtcatcaacaaactcacagatgcatcctggtatacagtggtgtttgatgacggagacgagaagactctcaggcgatcctctctttgcctgaagggggagagacacttcgcggagtccgaaactctcgaccagctcccgttgaccaaccccgaacacttcgggaccccagtcataggcaaaaagaccaaccgcggccgacgctccaatcacataccggaggaggagagttcgtcatcctcctcagacgaggacgaagatgatcggaagcagatagatgaactcctgggcaaagtcgtttgtgtggactatatttccctcgacaagaagaaggcactgtggttccccgcactcgtggtgtgcccagactgcagtgacgagatcgcagtgaaaaaagacaacatcctagtgcgcagtttcaaagatgggaagtttacctccgttcctcgtaaagacgtacacgagattacctcagacactgcaccaaagcccgacgcagtgctgaaacaggcattcgagcaggcgctcgagttccataagtcccgcactatccctgccaactggaagacagagttgaaggaagatagcagcagctccgaggcggaagaggaggaagaagaagaggacgatgaaaaggaaaaagaagacaattcatctgaggaggaggaggaaattgaaccattcccagaagaacgagaaaacttcctgcaacagctatataagttcatggaggatcgaggaactcctatcaataagagaccggtgctcggatacaggaatctgaatctcttcaaactcttccgactggtgcataagttgggtgggttcgacaacatcgagtcaggcgcagtgtggaagcaggtctaccaggatctggggatcccagttcttaacagtgctgctggatacaacgtaaaatgcgcatacaagaagtacctgtacggctttgaggagtattgccgatctgcaaatattgagttccaaatggcactcccggagaaggtggtcaacaagcaatgcaaggagtgtgaaaacgtgaaagaaattaaagtgaaggaggaaaacgaaacagagataaaggagatcaagatggaggaggagcggaatattattcctcgggaggagaagccaattgaggacgaaatcgagagaaaggaaaacatcaaaccatccctgggcagtaagaagaatctgttagagagtattccgacccactccgatcaggagaaagaggtaaatatcaagaagcccgaggataacgagaatctcgatgataaggatgacgacaccactcgtgttgatgagtcattgaacatcaaggtggaagctgaggaggagaaagccaagtcaggttacgatgagtggatcaaagccgacaaaatcgtcagacctgctgacaaaaatgtgcctaagataaaacatcgcaagaagattaagaataagctcgataaagagaaggacaaagatgaaaagtattcacctaagaattgtaagctcagacgtctctccaagccacctttccagacaaatccaagtccagagatggtgtccaagctggatcttaccgacgcaaagaactccgataccgcgcacattaaatccattgagattacctccatcttgaacggactacaggcatctgagagtagcgccgaggattccgaacaagaagacgagaggggggcccaggacatggacaacaacggcaaagaagagtccaaaattgaccatctgacgaataatcggaatgacctcatttccaaagaagagcagaacagcagcagtttgctcgaggagaataaggtgcacgccgatctcgtgatatcaaaacccgtatccaagagccctgagcgtctccgcaaggatattgaagtcctctctgaggacacagattacgaggaggacgaggtaaccaagaagcggaaggacgtgaaaaaagacacaactgataaaagctcgaaaccacagataaaacggggcaagcggcgctattgcaatactgaagagtgcttaaaaactggtagtcctgggaaaaaagaggaaaaggcaaagaacaaagagtccttgtgtatggagaatagctctaattccagcagcgacgaggacgaggaagagactaaggcaaaaatgactcctaccaaaaagtataatggcctggaggaaaagcgtaaatcactgcgtacaacgggcttttatagcgggttttctgaggtggctgaaaagcgtattaaacttctcaacaactctgacgagcggctgcaaaactctcgtgctaaagacaggaaggatgtctggtcgtcgatacagggacagtggcctaagaagacactgaaagagctattcagcgattccgacacagaggctgctgcatcacctcctcatccagctcccgaagagggcgtggctgaagagtccctccagacagtcgcggaagaagagtcttgttctccatctgtggaactggaaaagccacctcccgttaatgtggacagtaaacccattgaagagaaaacagttgaagtgaatgacagaaaagctgaattccccagttccggcagcaattccgtgctaaataccccaccaacaacccctgagtctccatccagcgtcacggtgactgaagggtcaaggcagcagagctctgtcactgtgtccgagcctcttgccccaaatcaggaggaggtgagatccataaagagtgaaactgacagtacaatcgaggttgacagtgttgcaggagaactgcaggatctgcaatcggaaggaaattcttctcctgccgggttcgacgcttccgttagcagctcttcttccaaccaaccagagccggagcatcctgagaaggcctgcacagggcagaaaagggtaaaagacgctcaaggaggtggaagcagcagcaagaaacagaagcggagtcacaaagccaccgtagttaacaacaagaagaaaggaaagggtacgaactctagtgactccgaagagctgtccgcgggagagtcgattacgaagagccagcccgtcaagagtgtatcaactggtatgaagagtcactctactaaaagccccgcccgtacccagagtcccggtaagtgtggtaagaacggggacaaagaccccgatttgaaggaacctagtaacaggctgccgaaggtctataaatggtctttccaaatgtctgacctagaaaatatgaccagcgctgagagaataactatactccaagagaagctccaggagatccgcaagcactatctgtcgctaaagagtgaggtcgcaagcattgatcggcgtagaaaacggttaaagaaaaaggagcgcgaatctgccgcgacatccagttcatcatcctccccctctagttcatccatcaccgccgctgtcatgttaaccctagctgaaccatcgatgagtagcgcctctcagaatggtatgtctgtcgaatgccgatag

SEQ ID NO: 108824 - DNA, 3939 bp, Artificial Sequence
  Description of Artificial Sequence: Synthetic coding sequence
atgaaggccctcgatgagcccccatacctgacagtcgggaccgacgtctccgcaaagtacagaggagccttttgcgaagccaagattaaaactgcaaagagacttgtgaaagtgaaagtaacgtttcgacacgattcttctactgttgaggtgcaggatgaccacattaaaggccctctgaaagtgggggctatcgtagaagttaaaaatctcgacggggcatatcaagaggccgtgataaataaacttaccgacgcctcttggtacaccgtggtttttgatgacggggatgagaagacgttgcgacggtcgagcctctgccttaaaggggaaagacacttcgctgaaagcgagacactggatcagttgccactgacaaatccagaacattttggcaccccagtcattggcaagaaaacaaatagaggcaggcgctcaaatcacatacccgaggaggagagttcaagctcatcctcagatgaggatgaagacgacaggaagcagattgacgaactgctcggcaaagtggtctgcgtcgactatatttctctagacaagaagaaagccttatggtttcccgctcttgtggtgtgtcccgattgttcggacgagatcgctgttaagaaagacaatatcctggtaaggtctttcaaggacggcaaattcacgtctgtccccagaaaggacgtacacgaaattaccagcgacaccgctcctaaaccagacgcagtgcttaagcaggccttcgagcaagctctcgaatttcacaagagtcgcacgattccagcgaattggaaaactgagctgaaagaggacagttcctcatctgaggcagaggaagaagaggaagaggaggatgacgagaaagagaaggaggataacagcagtgaagaggaagaggagatcgaacccttccctgaagaaagggagaactttttacaacagctttataaattcatggaggacaggggaacaccgataaacaaaagaccagtgctgggatacagaaatctgaatctttttaaactttttaggctggtgcataaactgggtggatttgacaatatcgagagcggcgcggtctggaagcaggtgtaccaggacctgggtattccggtcctaaactctgccgctggttataacgttaaatgcgcatataagaaatacctatatggattcgaggagtattgcaggagcgctaacattgaatttcagatggccctgcccgagaaggtggtcaataagcagtgtaaggaatgcgaaaacgtgaaagagattaaggttaaggaggagaacgagaccgaaattaaagagataaagatggaagaggaaagaaacatcatccctagggaggagaaaccaatcgaggacgagattgaacgcaaggagaatataaagccctcgctcggttccaagaagaacctcctcgagtcaataccaactcactctgatcaggagaaagaggtgaatattaagaagcctgaggataatgaaaacctggatgacaaagacgatgatacgaccagggtagatgaaagtctgaacatcaaagtggaagcagaggaggagaaagcgaagtcaggcgatgagactaataaagaagaggatgaggatgatgaagaggcagaggaagaagaggaggaagaagaagaggaggaagacgaagacgatgatgacaataatgaggaggaggagttcgaatgctatcctccaggtatgaaagtgcaggttagatatggcagggggaaaaatcaaaaaatgtatgaagcatccattaaagactccgacgtggagggcggcgaggtgctgtatttagtgcactactgtggttggaacgtacgctacgacgagtggattaaagccgacaaaatcgtacgccctgcagacaaaaacgtgccgaagatcaaacatcgaaaaaagatcaagaacaaactggacaaagaaaaagataaggatgagaagtactctccaaaaaactgcaagttgaggagactatccaagcccccattccagactaatcctagtcccgagatggtgtctaaactcgacctaacggacgctaagaattcggatactgcacacattaagtccattgagattaccagcatcctgaatggtttacaagcatctgagagctccgcggaggatagtgaacaggaagatgaaagaggcgcacaagacatggataataatggaaaggaggagagcaaaatcgatcacctgacaaataaccgcaacgatttgatctcaaaagaagagcagaattcctcctctctactggaagaaaataaagtgcatgccgacctggtcattagtaagcctgtttccaagagtccagaacgcctcagaaaagatatagaggtgctgtccgaggatacagattatgaggaagacgaggtcaccaaaaaacggaaagacgtgaaaaaagataccacagataagagctcaaagccacagatcaagagggggaaacggcgctattgtaatactgaggaatgtctcaaaacaggctcaccaggcaaaaaggaggagaaagccaaaaataaggagtccctgtgtatggaaaacagctccaactctagcagcgacgaggatgaagaagaaaccaaagctaagatgacgccaacaaaaaagtacaacggcctcgaggaaaagcgaaagagtctgaggacaaccggcttctattccggttttagcgaggttgcagagaaaaggataaagcttcttaataacagtgatgaaaggctacaaaacagtagagcgaaggaccgtaaggacgtgtggagctctattcaaggccagtggccaaagaagaccctcaaggaactgttcagtgatagcgatactgaggccgcggcctcaccgcctcatcccgctcccgaagagggcgtggcagaagagagtctccagaccgtggccgaagaggagagctgctcgccctcggttgagttagaaaaaccccctcccgtgaacgtcgattctaagcccatagaagagaaaacagtggaagtaaacgatcgcaaagctgagtttccttcaagcggatctaactctgtcctgaacaccccccccaccacacccgagagcccatcatctgtcactgtgactgagggatcccggcagcagagctccgtgaccgtgtccgagccgttggcgccgaatcaagaggaggtgcggagtataaagagtgagaccgactcgacaatcgaggtggactccgttgcgggcgagctccaggatctacagtcggagggcaactcttccccagctggctttgatgctagcgtcagttcgagctctagtaaccagcctgagccagagcaccccgaaaaggcctgcacaggccaaaaaagagtaaaagacgcacagggggggggatcatcctctaagaagcagaagcgcagtcacaaagctacagtagtgaataacaagaagaaaggcaagggaactaattccagcgactccgaggaactctctgcgggggaatcaatcacgaagagccagccagttaagagcgtcagtaccggaatgaagtcccattcaactaagtcccctgcgcgaacccagtcccccgggaagtgtggaaaaaacggcgacaaggatcctgacctgaaggagcccagcaatagactgccgaaggtctataagtggtcctttcaaatgagtgacctggaaaacatgacctcagctgagagaattaccattctccaggagaagctgcaggaaatccgtaaacactacttatcactgaaaagcgaagtagcttcaatcgataggaggagaaagcggctgaagaaaaaagaaagagaaagtgcggcaacttctagctctagctccagcccatcttcttcgtcaatcaccgctgcagttatgctgacccttgcagagccaagcatgtctagcgcgtcccagaacggcatgagtgtggaatgtcgttag

SEQ ID NO: 108825 - DNA, 3462 bp, Artificial Sequence
  Description of Artificial Sequence: Synthetic coding sequence
atgaaggcccttgatgagcccccatatcttacagtgggaacagacgtcagtgctaagtacagaggcgctttctgtgaggccaagattaaaactgccaaaaggctggtgaaggtgaaggtgaccttcagacacgacagttccacagtggaggtccaagatgatcatataaaaggaccattgaaggtgggagcaatcgtggaggtcaagaaccttgatggtgcttatcaggaagccgttataaataaactgaccgacgctagctggtacaccgttgtgttcgacgacggcgatgagaaaacactgcggcggagttctttgtgcctcaagggagagcggcacttcgctgagtccgagaccctggaccaactgccactgaccaatcccgaacactttggcaccccggttattgggaagaaaacaaatagaggaaggaggagcaatcacatcccagaggaggaatcatcctctagcagcagcgacgaagacgaagacgatcggaaacagatcgacgagctactggggaaagtcgtgtgtgtagactatatcagtctggataagaaaaaagctctgtggttccctgctctggtcgtctgtcctgactgtagcgacgagatcgctgtgaagaaagataacatcctcgtccgctcctttaaagatggcaaatttacaagtgtgccaagaaaggacgtgcacgagatcacaagcgatacggcacccaaaccagatgcggttcttaaacaggcatttgagcaagctctagagtttcacaagagccgtaccattcccgctaattggaagaccgagctgaaagaagatagctcttcttcagaggctgaagaagaggaagaggaagaagatgatgaaaaggagaaggaggacaatagttccgaagaggaggaggaaattgagccattccccgaagaaagggagaattttctccagcagttgtacaagttcatggaggacagggggaccccaattaataaacgacccgtgcttgggtacaggaacttaaatttattcaaactcttccgactggtgcacaaactgggggggtttgacaatattgaaagcggagccgtatggaagcaggtgtaccaggatctgggaatcccagtattaaatagcgccgccggttacaatgtgaagtgcgcctacaagaagtatctgtatgggtttgaagagtattgccgttctgccaatatcgagtttcagatggcactgcccgagaaggtggtcaataagcagtgcaaggagtgcgagaatgtcaaggaaattaaggtaaaagaagaaaacgaaacagagattaaagagatcaagatggaagaggaacggaatattatcccgcgagaagaaaaaccgatcgaagatgagattgagcggaaggaaaatataaaacctagtctgggcagcaaaaaaaacctgctcgaatcgatccctacccactctgatcaggagaaggaagtaaatatcaagaaacctgaggataatgaaaacctggatgacaaggatgacgacaccactcgcgtggatgagagcctgaacatcaaggttgaagcagaggaggagaaagccaagtctggcgatgagacaaataaggaagaggacgaggacgatgaagaagctgaagaggaagaggaggaggaggaggaggaggaggacgaagacgatgatgacaacaatgaggaggaagagttcgaatgctacccccccgggatgaaagtgcaggttagatacggtcgcggtaagaaccagaaaatgtatgaagcttctatcaaagattccgatgttgaaggaggcgaagttctctatttggtccattactgcggttggaatgtgcggtatgacgagtggatcaaggcagataagattgttagaccggcggacaagaacgtacccaaaattaagcaccgcaagaaaattaagaacaaactggataaagagaaagacaaggacgaaaagtactctccgaaaaattgcaaactcagaagacttagtaagcctccattccagacaaacccgtcccccgaaatggtgagtaagctcgatttaaccgatgcaaagaactccgacaccgcccacattaaaagcattgaaatcacctccattctcaacggattgcaggcctcagagagctccgctgaggactccgaacaggaggatgaaaggggtgctcaagatatggataataatgggaaagaagaatccaagattgaccacttaacgaacaacagaaacgacttgatttccaaagaggagcagaactcctccagcctcctagaggaaaataaagtgcacgcagatctcgtgatctccaaaccagtgagcaagagtcccgagagacttagaaaagacattgaagttttaagtgaagatactgattacgaagaagacgaagtcacgaagaagcgcaaggatgtgaaaaaagacactacagacaagagctcaaaacctcaaataaagcgcgggaagagaaggtattgcaacaccgaagagtgtcttaagacagggtctcccggaaaaaaagaggaaaaggctaagaacaaagagagcctctgcatggaaaacagttctaactcatcatcagacgaggatgaggaagaaacaaaggctaagatgacccccacgaagaagtataatggattggaggagaaacgcaaaagtcttcgtacaacagggttttactcaggcttctccgaggttgccgagaagaggatcaaactgcttaacaatagtgacgaaagactacagaactcacgcgctaaagatcgcaaggatgtctggtcatccatccagggacaatggccaaaaaaaactctcaaagagctgttcagtgatagcgacacagaagctgccgcatccccgcctcatcccgccccagaagaaggggtggctgaagagtctctgcaaactgtggcagaggaagaatcttgttctccatctgtagaactggagaagcccccacctgtcaatgtggattccaagcccatcgaagagaagacagtggaagtcaacgatcggaaggccgaatttccctcctccggttctaacagtgtattgaacacccccccaacaacccctgaaagcccttccagtgtgaccgtgaccgaagggagcaggcagcaatcaagcgtgacagttagtgagcccctcgcacctaaccaggaagaggtgagaagcatcaaaagtgaaactgactccaccatcgaggtggacagtgtggctggagagctacaggaccttcagagcgaaggcaacagtagcccagccggatttgacgccagcgtctcaagtagttcttcgaaccagcccgaaccagaacaccccgaaaaggcttgtacaggtcagaagagggtgaaagatgctcagggcggcggttcgtcaagtaaaaaacaaaagaggtctcacaaagccaccgttgtgaacaacaagaaaaaggggaaaggcattctgcctcactag

SEQ ID NO: 108826 - DNA, 1452 bp, Artificial Sequence
  Description of Artificial Sequence: Synthetic coding sequence
atgaaagcactcgacgagcctccatacctcacagtcggaacagatgtgagtgccaagtaccgcggcgcattttgtgaggcgaaaattaagacagcgaagagactagtgaaggtgaaggtgaccttcaggcacgattcgtcaactgttgaagtccaggatgatcacatcaaaggtcctcttaaagtaggtgctatcgttgaagttaagaatctagatggggcctatcaggaagctgtgatcaataagcttaccgacgccagttggtacactgtcgtttttgacgatggcgacgagaaaacacttcgtcgctcttcgctgtgcttgaagggagagaggcacttcgcagagagtgagaccctagaccaactcccactgactaaccccgaacatttcggaactccagtgatagggaaaaagaccaaccgaggcaggagatctaatcacatcccagaggaagagtcatcttcgtcatctagcgacgaggatgaagatgatcgtaaacagatcgatgagctcttaggcaaggtcgtttgcgtggattacatcagtctggataagaagaaagctctctggtttccagccctggtggtgtgcccggattgctctgacgagatcgcagtgaagaaggacaatattctggtgcggtccttcaaggatggcaagtttacaagtgtgccacggaaagacgttcacgagattacaagcgacaccgcgccgaaacctgatgccgtcttaaaacaagctttcgaacaggcgctggagttccataaatcccggaccatcccggccaattggaaaaccgagctgaaggaagatagcagctcatctgaggcagaggaagaagaggaggaagaggacgatgagaaagagaaggaggataactcaagcgaagaagaggaggaaatcgaaccttttccagaagaaagggagaatttcttacagcagctctacaagtttatggaggatagaggaacacccatcaacaagagaccagtgttgggctaccggaatctgaacctgtttaaacttttccgtctggtgcacaagctgggagggttcgacaacattgaatcgggagccgtgtggaagcaggtataccaagacctgggcatacctgtgctgaattcagcggcagggtacaacgtcaagtgcgcctacaaaaagtacctgtatggattcgaagagtattgcaggagtgcaaacatcgagtttcaaatggcacttcctgagaaagtagtgaataaacaatgtaaggaatgcgagaacgtaaaggaaattaaagttaaagaggaaaatgaaaccgagattaaagaaatcaaaatggaggaggaaagaaacattattccacgagaggagaagcccattgaggatgagatcgagagaaaggagaacatcaagccctccctgggcagtaagaaaaatctacttgagtcaatccctacccactcctag

SEQ ID NO: 108827 - DNA, 1968 bp, Artificial Sequence
  Description of Artificial Sequence: Synthetic coding sequence
atgaaagcactggacgaacccccctaccttacagtaggcacagatgtgtcggctaaatatcgcggggctttttgcgaggcaaagataaaaactgccaagaggctcgtgaaagtgaaggtcactttcagacacgacagctcaacagtggaggtccaagacgaccacattaaagggcccctgaaagttggcgccatcgtggaagttaagaacttagatggagcttaccaggaggcagtaatcaacaaactaacagatgcctcttggtataccgtggtgtttgatgacggcgatgaaaagaccctgcgtcgctccagtctctgtctgaaaggagaacggcacttcgcagagtcggagacattggaccaactgccgctcaccaatcctgagcacttcgggactcccgtcatcggaaagaaaaccaatagagggcggagaagcaatcacattccagaagaagagagctcctcttcatcttccgatgaggacgaagatgaccgcaagcagattgacgaattgttaggcaaagtggtgtgcgtggattacatctctctggataagaagaaggctctctggttcccagccctggtggtgtgccctgattgctctgatgagatagccgtcaaaaaagataacattctggtgaggtcgtttaaagacggtaagtttaccagcgtgcctagaaaagacgtccacgagatcacctcagacacagccccgaagccggatgccgtccttaaacaggcattcgagcaggccctcgaatttcacaagtcccgaaccatccccgccaactggaagaccgaattaaaggaggattcttccagctctgaggcggaagaagaagaggaggaggaagatgacgaaaaagagaaggaagataatagtagcgaagaagaagaggagatcgagccctttccagaggagcgtgaaaattttctgcagcaactctacaaatttatggaagatagggggactccgatcaacaaaaggccggtccttggttatcgcaacctgaacctgttcaagttgtttagactggtgcacaaactaggaggttttgataacatagagtctggggccgtgtggaagcaggtttaccaggacctgggaatcccggtccttaactcggccgccggctataatgtcaagtgtgcttataagaagtatctgtacggattcgaagagtattgcagaagcgctaacatcgagtttcagatggcattacccgaaaaagtagtcaataaacagtgcaaagaatgtgagaatgttaaggagataaaagtaaaggaagagaatgaaacagagatcaaggagatcaagatggaggaagagaggaatattatccctcgggaagagaaacccatcgaggacgagatagagagaaaggaaaacattaaacctagtctcggctcaaagaagaacttgttggagtctataccaacacactccgaccaagaaaaggaagtgaacattaagaagcctgaagacaacgagaatctggatgataaggacgacgacaccactagggttgatgagagtctcaatataaaggtggaggctgaggaggagaaagccaagagcggcgacgagacaaacaaagaagaggacgaggatgatgaagaagctgaggaggaggaggaggaagaagaggaagaggaggatgaggatgatgacgacaataacgaggaggaggagttcgaatgctacccccctggcatgaaggtccaggtgagatatggtcgggggaagaaccagaaaatgtatgaagctagcatcaaggatagtgatgtcgagggtggtgaagttctttatctggtgcattattgcggctggaacgtcagatatgacgaatggatcaaggccgataaaatagtgagacctgcagacaaaaatgttcccaagatcaaacataggaagaagataaagaacagcgtttataagaagaaaaaaaaaaaaaaaaacaagtag

SEQ ID NO: 108828 - DNA, 1785 bp, Artificial Sequence
  Description of Artificial Sequence: Synthetic coding sequence
atggctgccccagttaaaggtaaccgtaaacagagcacagagggagacgcgctcgatcctccagcttcccccaagcctgccggtaaacagaatggcatccagaaccccatctcactggaggacagccccgaagctggaggagagcgggaggaagagcaggaacgcgaagaggaacaggcttttctggtatcactgtacaagttcatgaaagaacggcacacacccatcgagcgcgtgccacatttaggcttcaaacagatcaatctctggaagatctataaggcagtagagaagctgggggcatacgaacttgtaacagggaggcgcttgtggaaaaacgtttacgacgagctcggcggaagcccaggcagtacaagtgcagcaacatgtacccggcggcactacgagcggctggtgttaccctacgtccgacatttaaaaggagaagatgacaaacctctgcctacttcaaagccccggaagcagtacaaaatggccaaagagaaccggggtgacgacggcgccactgagagaccgaaaaaggccaaggaagagcgacgaatggatcagatgatgccaggaaagacaaaagcagacgctgccgacccagctccactcccaagccaagaaccccctcgcaatagcacggaacagcagggccttgcctctggctcctcagtcagttttgtaggcgcctctggttgtcctgaagcttacaaaaggctgttgtctagcttctactgcaagggtacccatggtataatgtctcccctagccaagaagaagctgctagctcaggtctcaaaagtggaggccctacagtgtcaggaggaggggtgccggcacggagccgaaccacaagcatctccggcagtgcaccttcccgaaagcccgcagtcccccaaggggctgactgagaactcacggcaccgcctaacccctcaggaagggctgcaggccccgggcggcagcctgcgagaagaggctcaggcaggcccatgtcccgcagccccaatattcaaaggctgcttctatacacaccctaccgaagtcctcaaacccgtgtctcagcatcctagagacttctttagccgccttaaggacggcgtgttgctggggccgcccggcaaggaagggctgtccgtgaaggagccccagctggtgtgggggggggacgcaaataggcccagtgcatttcacaaggggggatcccggaaggggatactctatcctaaacccaaggcttgttgggtctcacccatggccaaggttccagccgagtcccccaccctgcctccaaccttcccatcgagtcccgggctggggtctaagcggtctctcgaagaggagggagctgcgcacagcggcaaacgcctgcgagcggtatccccgtttctgaaggaggccgatgcaaagaagtgcggagccaagcctgctggaagcggactcgtgtcctgccttttaggccctgcactcggaccagtgccgcccgaggcgtacagggggaccatgctccattgccccttgaacttcacaggaacacccggacctctgaagggtcaagcggctcttccattctctcctcttgtgatacccgcattccccgcccactttttggcgaccgctggcccttcccccatggcggctggcctcatgcacttcccgcccacatcgttcgattctgccctgagacataggctttgccccgcaagttctgcctggcacgcaccaccagtaactacgtacgctgccccacacttttttcatctcaataccaaactttag

SEQ ID NO: 108829 - DNA, 1917 bp, Artificial Sequence
  Description of Artificial Sequence: Synthetic coding sequence
atggcagcgcccgttaaaggcaaccgcaagcagtccacggagggtgatgctctggatcctcctgcctctccaaaaccagccggcaagcaaaacggcattcagaatccaatcagccttgaggacagtcctgaggctgggggcgaaagggaagaagaacaagaaagggaggaagagcaagcctttctcgtaagcctttataaatttatgaaggaacgtcacaccccaatagagcgggtcccacacttgggctttaagcagattaatctgtggaagatctacaaggctgttgaaaaactgggagcctacgaactggtaaccgggcgtagactctggaagaacgtttatgatgagctcgggggatcacccggcagcacatccgctgcaacttgcactcggaggcactatgaacggctggtgcttccatacgtgagacatcttaaaggagaggacgataaaccactcccaacctctaaacctcgcaaacagtataagatggctaaagagaataggggcgacgacggagcaactgagagaccgaaaaaggcaaaggaagagcgaaggatggatcagatgatgcccggcaagacaaaggccgacgctgccgacccagctccactccctagccaggaacccccccgaaactctactgagcagcagggcctggcgagcgggtctagcgtgagtttcgttggcgccagcgggtgtcctgaagcctataagagactcctgtcaagcttttactgcaaaggaactcatggtatcatgtcacccctagcaaaaaaaaagctgttggctcaggtgagtaaagtcgaggccctgcaatgccaggaggagggctgtcggcatggcgctgagccccaggcatcccctgccgttcatctgcctgaatcccctcaatcacccaagggacttactgaaaattcccgccaccgcctgaccccccaagaggggcttcaggccccaggcggctccctgcgggaggaggcgcaggcaggaccttgccctgcagccccaatcttcaagggttgcttttatacgcacccaaccgaggtactgaaacctgtatcacagcaccccagagatttcttttccaggctcaaggatggcgtgttgctaggccctccaggaaaggagggtctatccgtaaaagaaccacagctggtgtggggaggtgacgctaatcgacctagcgcttttcacaagggcggctcccgtaagggtatattgtacccgaaacctaaggcctgctgggtgagccccatggctaaagtccctgctgagagccccactctaccacccacttttcccagcagccccgggctgggctctaagcgatccctcgaagaagaaggagcagcacattcaggtaaacggcttcgggccgtgagccccttcttaaaggaagccgatgctaagaaatgtggtgcgaagcccgccggaagcggtctggtgtcttgtctgctaggcccggctttgggaccagttcctcccgaagcctaccgaggaacaatgcttcattgcccccttaattttaccggaacgcaccaccagagtcaacctatgcagcggcctacatcaagtacctccactccgtcctgtcgcccagcgcacggtgttgtttacacagtcgaaagcaccggcgcctacaaccggcaggtcctcctgccggggggtagcgagcttgtgcctgctactcaggacactcgcgcgatgccactcgccgggcagcccggaacttccgaagaggaggggagtggcaaaaccggttttatttctcgtcaacagcctgagcccaggtccaggggcccatcctgttataaggccttgggcgaggatgggcagctgccacttcctcagtcgggcgcccgctctactcaggtggcacacgggaagagcaataagaagactccagtctag

SEQ ID NO: 108830 - DNA, 1581 bp, Artificial Sequence
  Description of Artificial Sequence: Synthetic coding sequence
atgaaagaacgacacacccccatcgagcgcgtaccccatctgggatttaaacagatcaatctgtggaaaatttataaagctgtcgaaaagctcggcgcttatgagctggtgactggcaggagactctggaagaatgtctacgatgagctggggggcagtcccggcagtacctcggcagccacctgcacccgtcgccactacgagcgcctcgtgctaccttacgtccggcatctcaaaggcgaggacgataagcccttaccaacatcgaagcctcggaagcagtataagatggccaaggaaaatcgtggggacgacggagccacagagagacctaagaaggccaaggaagagaggagaatggaccaaatgatgcctggtaaaactaaagcagatgcagccgacccagccccattgccatctcaggagccaccccggaattctacggagcagcagggtcttgcatccggctccagtgttagcttcgtgggggctagcgggtgccccgaggcttataagcgattgctctcatcattctattgcaaaggtactcacggcatcatgagtccactcgctaagaaaaagttgctggcacaggtcagtaaagtcgaggctctacagtgtcaagaggaaggttgcaggcacggtgccgagccacaggcaagtcccgctgtgcatctcccagaatctcctcaatcaccgaaggggttgacggaaaacagccgacatcggcttacccctcaggagggactgcaggcacctggtgggtcactacgagaagaggcccaggccggaccttgtccagctgcccccatcttcaagggctgtttctacacgcacccgacagaagttcttaaacccgtcagccagcatccccgtgatttttttagccgactgaaagacggtgtattacttggaccgcctggtaaggagggcctcagcgtgaaagagccccaactggtgtggggcggcgacgcaaaccgacctagcgcattccacaaagggggctcgaggaagggaattctgtatcccaagccaaaggcttgttgggtcagcccgatggccaaagtgcccgccgaatcaccaaccttacctcctacctttccctcctcgcccggcctgggttctaaaagatccctggaagaggagggggctgcacattctggaaaaaggctgcgcgccgtgtcgcccttcctgaaggaagctgatgctaagaagtgtggtgctaagcccgcggggagcggattggtgtcctgcctcctagggcctgctctgggtccagtgcctcctgaggcatataggggcaccatgctgcactgccctcttaacttcaccggtacacctggcccactgaaagggcaagccgccttgcctttttcaccattagtcataccagctttccccgcacatttcttggctactgctggcccgtcccccatggctgcaggcctgatgcacttcccccctacttcttttgattccgctcttcggcacaggctgtgtccagccagcagtgcctggcacgcccccccagtaacaacctacgcggccccccattttttccaccttaataccaagctatag

SEQ ID NO: 108831 - DNA, 3567 bp, Artificial Sequence
  Description of Artificial Sequence: Synthetic coding sequence
atggaaccgaattcgttacaatgggtgggtagcccatgcggcctccatggcccatatattttctataaggcattccaattccaccttgagggtaaaccgcgaatattgtcactgggcgacttcttctttgttaggtgtactccaaaggacccaatctgcatcgccgagctgcagctcctttgggaggagcgcacaagccggcagttgctgtcctccagcaagctctactttctgccagaagataccccccaaggtagaaattcagaccacggggaagacgaggtgatagcagtgtccgagaaagtaattgtcaaactggaagacctcgtcaagtgggtgcatagtgattttagtaaatggaggtgcggcttccacgctgggcctgtcaaaaccgaggcacttggacgcaacggtcagaaggaagctctgctgaaatataggcagtctacactgaacagcggactgaacttcaaggacgtgctaaaggagaaggccgatctgggcgaggacgaggaggaaaccaacgtaattgtgttgagctacccacagtactgtagatatcggtctatgctgaaaagaattcaggacaagccctcctccatcctgactgaccagtttgctctcgccctcggtggaatcgctgtcgtgtctagaaatccccagattttatactgccgggatacatttgatcaccctacgctgattgagaacgagtcgatatgtgacgagttcgcacccaatttgaaggggcgcccccggaagaaaaaaccgtgtccccagcgccgggattctttcagcggtgtgaaggattccaataacaactcggatggcaaagctgtagctaaggtaaaatgcgaagcacggagcgcattgacaaagcccaagaataaccacaactgtaaaaaagtgtccaatgaagagaagcccaaagttgcaatcggcgaagaatgcagggccgatgagcaagctttcctggtggcattgtataaatatatgaaggagcggaagaccccgattgagagaataccttatttgggatttaaacagattaacctttggacaatgttccaggccgcacaaaaactcggtgggtatgaaacaattaccgctagacggcagtggaaacacatctacgacgagctcggcggtaaccctggaagtacctctgcagcaacgtgtacaagaagacactatgaacgactgattctgccatatgaaaggtttatcaaaggtgaagaagataagcccctgccccctataaagcctcgaaagcaagaaaacagctctcaggaaaacgaaaataaaactaaggtgagcggaacaaagcgcatcaagcacgaaattcccaagtctaagaaggaaaaggagaatgccccaaaaccccaggacgcggcagaggtctcctcagaacaggagaaggagcaggagaccctaatcagtcagaaaagcatcccagaacccttacccgccgctgatatgaagaagaagattgagggctaccaggaattctcagcaaaacccctggccagcagagtcgacccagaaaaagataatgagaccgaccaggggtctaatagcgagaaggtggcagaggaggccggcgagaagggtccaacaccccctctgcccagcgcaccactggccccagaaaaggattctgctctggtcccaggggcctccaagcagccgttgacatccccctccgccttggtggactccaagcaggagtccaagctgtgctgcttcaccgagtcaccggaatcggagccccaggaagcttcgttcccaagcttccctaccacccaaccacccttagccaatcagaatgaaacagaggatgacaagttgcctgcgatggctgattacatcgcgaattgtactgttaaagtggaccagttaggctccgatgacatccataacgcactcaagcagactcccaaggtgttagtcgtgcaatcattcgacatgttcaaggataaagatctcactggaccaatgaacgaaaaccatgggctgaattatacgcccctactgtatagtagagggaaccctggcattatgagcccattagccaagaaaaagttgcttagccaggtgtctggcgcttcattgagctcctcgtacccctatggctcacccccacccctaatcagcaaaaagaagctgattgcaagagacgatctgtgtagcagcctaagtcaaacacaccatgggcagagtaccgatcacatggctgtgtcacggcccagtgttatccagcacgtccaaagttttcgaagtaagccgagcgaggaaagaaagaccattaacgacatttttaagcatgagaaactgagtcgaagtgatccccacagatgcagttttagcaaacatcatttgaacccccttgccgatagctatgtcttaaagcaagagatccaagagggcaaagacaagctactcgagaaacgtgctctgccgcactctcacatgccctccttcctggcagacttttatagttctccccatcttcattctctttaccgacacacggagcaccaccttcataatgaacagacctctaaatatccatccagggacatgtatcgggaatccgaaaattcctccttcccatcccatcgacaccaggaaaaacttcatgtgaactatttgacatccctccacttacaggacaagaagtccgcagccgctgaggcccccacagacgaccagcctactgatctgtccctgcctaaaaaccctcataaaccaaccggcaaagtactgggtctggcccattctactacaggtccacaggagagtaagggcatttcccagttccaggttcttggctctcagtcccgcgactgccaccctaaggcatgccgggtaagtcccatgacaatgtcaggacctaaaaagtacccggaatccctgagcagaagcgggaagcctcaccacgtgcgattggaaaacttcaggaagatggagggcatggtgcatcctatactgcaccgtaagatgagtccccagaatataggggctgctcgccccatcaaaagatccctggaagacctggacctagttatcgctggcaagaaagcacgagctgtgagccccttagaccctagcaaggaggtgtcaggaaaggaaaaagcaagcgaacaagagtctgagggtagcaaagccgcacacggcggacactcaggagggggctcagaaggacataagttgcccttgtcctctccaatttttccgggtctgtattcaggtagcctttgcaatagcgggctgaattcaaggcttccggccgggtattcccacagcctccagtatcttaaaaatcagactgtcctcagcccccttatgcagcctctggcctttcacagcctggtgatgcaacgagggatattcaccagccctactaacagtcagcaactgtacaggcatctcgcggcggcgactccagttgggagttcctacggagacttgttgcacaattctatatacccactcgccgccattaatccacaagccgcctttccaagttcacagctctcctcagtgcatccttccacgaaattatag

SEQ ID NO: 108832 - DNA, 2838 bp, Artificial Sequence
  Description of Artificial Sequence: Synthetic coding sequence
atggcaccaaacctgaagggaaggccacgtaagaagaaaccatgtccacagcggagagactcattcagcggggtgaaggacagcaataataacagcgatggcaaggcggtggctaaggtgaagtgtgaagcccgctcagcactgaccaaaccgaaaaataaccacaattgcaaaaaggtctccaatgaggagaagcccaaggttgccataggcgaagagtgccgggccgacgaacaggcttttctggtcgccttgtacaaatatatgaaggaaagaaagacccccatagaacgaatcccatatctcggctttaaacagatcaatctgtggacaatgtttcaagctgcccagaaactcggcgggtacgaaactattactgcgcgcaggcagtggaagcatatttacgatgagctgggaggaaatccaggcagcacttccgcagctacttgcactcgccgacattacgagagattgatcctcccatacgagagattcatcaaaggggaagaggacaagccactgcctcccatcaagccccgaaagcaggaaaattcgagccaggagaatgaaaataaaactaaggtcagcggcacaaaacgcataaaacacgaaattcccaagtcaaaaaaggaaaaagaaaacgctcccaagccccaagatgccgccgaggtttcatcagagcaggagaaggagcaggagacgctgatctcccagaagtcaattcccgaaccgctgcccgctgctgacatgaaaaaaaagatcgaggggtatcaggaattcagtgccaagcccctggcttctcgcgttgaccctgaaaaggacaacgaaacagaccagggatccaatagcgaaaaagtggcagaggaagcgggtgaaaaggggccgaccccccctcttccgagcgcaccactggcgccggagaaggacagcgctctggtaccaggtgcctcaaagcagcctcttaccagcccatccgcgctcgtcgactcaaagcaggagtcaaagctgtgctgtttcaccgagagtccagagtcagaaccacaggaagcatcatttccgagtttccctacaacccagccccccttagccaatcagaacgaaacagaagacgacaagttgcccgctatggcagactacatcgcaaattgcactgtgaaggttgaccagctgggctcagacgacatccataatgcgctgaaacagactcctaaggttctcgtggttcaatcttttgacatgttcaaggacaaggatttaaccggacccatgaacgaaaatcatgggctgaattatacccccctgctgtactctcgtgggaatcctggcatcatgtcgccactggctaaaaagaagctgctatcgcaggtgagcggagcttcactgtccagctcgtacccttacgggtccccgccgccactgatcagcaaaaagaagctgatcgcacgggacgacctgtgttcaagcctgtcgcagacccatcacgggcagtcgacagaccacatggccgtttcccggcctagcgtgattcagcacgtgcagtcctttaggagtaaaccgtctgaggagagaaaaaccatcaatgacattttcaaacatgagaagcttagccggtcagaccctcaccggtgtagtttctcgaagcaccacctgaaccccctggcagactcttacgtgctcaagcaggagatccaggagggcaaggataagctccttgagaaacgtgcccttccccattcccacatgcccagtttcctcgccgatttctacagctcaccacatctccacagtctgtataggcacaccgagcaccaccttcataatgagcaaacatccaagtaccctagtagggatatgtacagagaaagcgagaatagtagcttccctagtcatagacatcaagagaagctgcacgttaactacctgaccagcctgcatttacaagacaagaagtccgccgctgcagaggcaccgaccgacgaccagcccacagatctctccttgcccaaaaatccacataagcctacgggcaaggtgctgggcctagcacactcaaccaccggcccgcaggagtccaaagggatttcccaatttcaagtgctgggcagtcagtcccgggattgccacccgaaggcctgccgtgtctctcccatgacaatgagtggcccaaagaaataccccgaaagcttatcccggtctggcaagcctcaccatgtgcgactggaaaatttccgaaagatggaggggatggtgcatccaatactgcataggaagatgtccccccagaacatcggcgccgcccggcctatcaagcggtcgctggaggacttggatctagtcattgcagggaagaaggcccgcgccgtatcacccctggacccctctaaggaagttagcggaaaggagaaagccagcgaacaggagagcgagggatccaaagctgctcatggtggccattctggcggagggagtgagggccacaagctgcccttgtcttcgcctatattccccgggctgtattcaggttcgctgtgtaacagcgggcttaattctagactaccagccggatactcccacagcctgcagtatctgaaaaatcaaaccgtcctatcgcccctcatgcaaccactggcatttcactccctggtgatgcaaagagggattttcacaagcccaacaaatagtcagcaattgtatagacatttagcagctgcaacccctgtgggtagttcttacggcgatctcctgcataatagcatatatcccttggcggcaattaacccgcaagctgcttttccctcttctcagctctcttctgtccatccctcaactaaattatag

SEQ ID NO: 108833 - DNA, 1134 bp, Artificial Sequence
  Description of Artificial Sequence: Synthetic coding sequence
atgggtacaacagaagccacattgaggatggaaaatgtcgacgtgaaagaggaatggcaggatgaggacttgccacgcccccttcccgaagagaccggcgttgagctgctggggagccccgtggaagacacctcatctcccccgaacacactcaatttcaacggtgctcacagaaagcgaaaaaccctcgtggcgcccgaaattaatatctctctggaccagtccgaagggagcctgctgagtgacgattttctcgacactccagatgacctcgatattaacgttgatgacattgaaacccccgacgaaacagattcccttgagttcctgggaaacggaaatgaactcgaatgggaggacgacaccccagtggccactgccaagaatatgcctggggactcggccgatttattcggcgacggcacgaccgaagacggatccgctgccaatggaagattatggagaacagtgattatcggtgagcaggaacataggattgacctccacatgatccgaccatacatgaaggtggtcacgcacggtggatattacggcgagggtctgaatgccataattgttttcgctgcttgtttcctgcccgacagtagcctacctgattatcactacattatggagaatcttttcctgtatgtgatctcttcactggaactcctcgtggccgaggactacatgatcgtgtacttgaatggcgcaacgcctagaaggaggatgcctggaattggatggctgaagaaatgttatcagatgattgatcgccggctgcggaaaaacctgaagagtctcattatcgtgcacccaagctggttcatacggactgtcctggctatcagccgacctttcataagtgttaaatttattaacaagattcaatatgttcactctctggaggatttggaacagctgattccgatggaacacgtgcagattccggactgtgttctgcaatatgaagaagagcggctaaaagcacggagggagtccgcccgcccccagcctgagtttgtgctgcctcggtctgaggaaaagccagaagtggctcccgtcgagaacagatcagccctggtctcagaagaccaggagaccagcttgcaaccgttgcacaggagctcttag

SEQ ID NO: 108834 - DNA, 1116 bp, Artificial Sequence
  Description of Artificial Sequence: Synthetic coding sequence
atggggacaaccgaggcaactttgcgcatggaaaatgtggatgtgaaggaagaatggcaggacgaagatctgcctaggcctctgcctgaggagactggagtagagctgctaggcagccccgtggaggatacctccagcccacccaataccctgaatttcaacggggctcatcgtaaacgcaaaaccctcgtagctcccgagattaatatctccctggaccaatccgagggatctctactgtctgatgactttttggacactcctgacgatctggacattaacgtcgatgacatcgagactccggatgagactgacagtttagaatttctgggaaacgggaatgagttggagtgggaagatgatacacctgtcgccacagcaaagaacatgcccggagatagtgccgacctgtttggcgacggaactactgaggatggctccgccgcaaatggccgcttgtggcggaccgtcatcataggcgaacaggaacaccgcattgaccttcatatgattcgaccctatatgaaagtagttactcatgggggctattatggagaaggcctgaatgccattatagtttttgctgcatgttttcttccggattccagcttgcctgattatcactacattatggagaatctctttttatatgtgatctcatcactggagttgctggtggccgaggactatatgatcgtgtacctcaacggggccacaccaaggagaaggatgcccggcattggttggctgaagaagtgttaccagatgatcgatcgcaggctgagaaagaatcttaagtccctgattattgtgcatcccagctggttcattcgaactgtcttggctatttcccggccttttatctcagtgaagttcattaataagatccagtacgtgcattcactggaggacctggaacagcttatccccatggaacatgtgcagattcctgactgtgttttacaatacgaggaggagagattgaaagcccggagggaatccgcgcgaccacaaccagaattcgttctgccaaggagcgaggaaaaaccagaagtggccccagtggagaatagaagcgccctcgtgagtgaagatcaggagacacgcatgtcgtag

SEQ ID NO: 108835 - DNA, 1134 bp, Artificial Sequence
  Description of Artificial Sequence: Synthetic coding sequence
atggccgggagacgaagctcacaacccgggattgccctgcataatcccggtaaccaccaagtgcaaaacccacaaggcaggctcgagactgtccggccactccccgaagagacgggcgttgaacttcttgggagccctgtggaggatacctcatctcctccaaataccctcaacttcaatggcgcccaccgaaagcgcaagaccttagtggcccctgaaatcaatatcagtctggaccaaagcgaagggtccttgctctccgacgacttccttgacacccccgatgatctggacattaacgttgacgacatcgaaactcctgacgagaccgattcccttgagtttctgggtaacggcaacgaacttgagtgggaggatgatacgcctgtcgcgaccgccaagaacatgcctggagacagcgctgatcttttcggggacgggacaacagaagatggctccgccgcaaacgggcgcctgtggcggacagttataatcggggaacaggaacacagaatagacctccatatgatcagaccttacatgaaagtggtcacacatggaggatactacggtgaaggactgaatgccatcatcgtattcgcagcgtgctttctccccgatagtagtttgcccgattaccactacattatggagaacctctttctctacgtgatttcatccctggaattgttagtagcagaggattacatgatagtctacctgaacggggctactcccaggcgccgtatgcccgggattgggtggttgaaaaaatgctaccagatgatagataggcggctcaggaaaaatttgaagtcattaattattgtccatcccagctggttcatacgtacagtactcgccattagccgacctttcatctccgtgaagtttattaacaagatccagtacgtgcattccttagaagacctggagcagctgattcctatggagcacgtccagatccccgactgcgtgctgcagtacgaagaagaaagactgaaagccagacgagagagtgcacgtccacagccagagttcgtcctgccgagaagtgaggagaaacccgaagtggcaccagtggagaaccggtccgctctggtcagtgaggaccaggagacaagcatgtcatag

SEQ ID NO: 108836 - DNA, 1116 bp, Artificial Sequence
  Description of Artificial Sequence: Synthetic coding sequence
atgggtacaaccgaagctaccctaagaatggagaatgtggatgtcaaggaagaatggcaggacgaagatctaccacgtcctctgccagaggagactggagttgaactcttgggatcacctgttgaggatacttcctcaccacctaacaccctgaattttaacggtgcccaccgtaaacggaagaccctggtggccccagagatcaacatatccctcgaccagtctgaaggtagtctgctgtccgatgactttttagacacgcccgatgacctggacattaatgttgatgatatcgaaactccggatgaaactgacagcttggagttcttaggaaatggcaacgaactagaatgggaggacgataccccagttgccaccgccaaaaacatgcctggtgattcggccgatctttttggcgatggtactactgaagacggcagcgccgctaacggccgactctggcggactgtgatcattggagagcaggagcacagaattgatctgcatatgattcgcccttacatgaaggtagtcacgcacggcggctattatggagaggggctaaatgctattatcgtcttcgcagcctgtttcttgccagacagctctcttccggattatcactacatcatggagaatctcttcctgtacgtgattagctccctggagctgcttgtggccgaggactacatgatagtatacttgaacggtgctacacctaggagaaggatgcccggtatcggttggctcaaaaagtgttaccagatgatcgataggaggctcaggaaaaacctgaagagcctcatcattgtgcacccttcctggttcattagaaccgtgctggcaatctcaagaccctttatatctgtaaaatttataaacaagatacagtatgttcactccctcgaagacctcgaacaactaattcccatggagcacgtgcagattccggactgcgtgttgcagtacgaggaagagagactgaaagctagacgagagtccgcccgaccacaacctgagttcgtgttgcctcgttctgaggagaagcctgaggttgctcccgttgaaaataggtctgccctggtatcggaggatcaagagactagtatgtcttag

SEQ ID NO: 108837 - DNA, 1050 bp, Artificial Sequence
  Description of Artificial Sequence: Synthetic coding sequence
atggggactaccgaagcgactttgcgtatggaaaatgtggatgtgaaagaagaatggcaggatgaagatccccccccaaacactcttaatttcaacggagcccataggaaacgcaagacactggtggcacccgagataaacatatccctagaccagtctgaaggatcactgcttagcgacgacttcctcgacacccccgacgacctcgatatcaacgtggacgatatcgaaacacccgacgaaacggactcactcgagttcctgggaaacggcaatgagctggaatgggaggatgacacccctgtcgcaacagcgaaaaacatgccaggtgattctgcagatctgttcggagatggcactaccgaagacggatcagccgctaacgggcgcttgtggaggacggtcattattggagagcaggaacatcggattgacctccacatgatcagaccatacatgaaagtggtgactcacgggggctactatggcgaaggcctgaacgcgatcatcgtgtttgcagcttgttttctgccagatagcagtctacctgactaccactatattatggagaacttattcctctatgtcatctcctcgcttgagttactggttgccgaggactacatgattgtctatctgaacggtgctaccccacgaagaagaatgccaggcattggctggctgaagaagtgctatcagatgatcgataggcgccttcgaaagaatctcaagagcttgatcatcgttcatccaagctggttcattagaaccgtgttggcaatttctaggccctttatcagtgtgaagttcatcaataaaatccagtacgtccattcactggaagatctggagcagctgatccccatggagcatgtgcagattcccgattgcgttctgcagtacgaggaggagaggctaaaagcccgccgcgagagcgctcgaccacagccagagtttgttctgccacggtccgaagagaagcctgaagtggccccagtcgagaatagatcggccctagttagcgaggatcaggagacacgaatgagttag

SEQ ID NO: 108838 - DNA, 2448 bp, Artificial Sequence
  Description of Artificial Sequence: Synthetic coding sequence
atgaagagcaatcaagagcgcagcaacgaatgcttgccacccaagaaaagagagattccagcaacctctaggtcaagcgaagagaaagcacccaccctcccctcagataatcatagggtcgaagggacagcttggttgcctgggaacccagggggtcgtggccatggcgggggccggcacgggcctgccggaacctcagttgaattaggacttcagcaaggcatcggcttgcacaaggccttatcaactggcctcgactatagcccgccgtccgcaccacgcagtgtgccggttgccaccaccctgcccgctgcatacgcgaccccccagccgggaactcccgtgtcccctgtgcagtacgcacacctcccacataccttccaatttattggctctagccagtattccggcacttacgcctcgttcatcccgtcccagctaattccccccacagcgaaccctgtaacaagcgctgttgcctccgcggctggcgctaccacccctagccagaggagccagcttgaagcatattctacgctcctcgcgaatatgggttctctgtcacagactccaggccataaggccgaacagcagcagcagcaacagcagcaacagcagcagcagcaccagcatcaacaacagcagcagcagcaacagcagcagcaacagcagcaacacctttcaagagctccaggactgatcacaccaggatcacctccacctgcacagcagaaccagtatgtgcacatcagctctagtccccagaataccggccgaaccgcaagccctcccgctattccagtgcatcttcacccccaccagacgatgattccacacaccttgacactcggacctcccagccaggtcgttatgcagtacgccgactccggatcccacttcgtgccccgggaggccacaaaaaaagctgagtcttcccgactccaacaggcaattcaggctaaagaggttcttaatggcgagatggaaaagagccggaggtacggcgccccctcttccgcagatcttggcctgggcaaggccggtggtaagtctgtgcctcacccgtacgagagtcgacacgtggttgtgcatccttctcccagcgactactcctcgcgagacccctcaggggtgcgagctagcgtgatggtgctgccaaacagtaacaccccagccgccgaccttgaggttcagcaagccactcacagagaagccagtccctccaccttaaatgacaaatcaggattacatctcggtaaaccgggtcatcgctcatatgctttgtcaccacacactgtgatacaaacaacacatagtgcctccgaacccctgcccgtaggcttgccagccaccgcgttctatgcggggactcagcccccagtcattggttacctgagtggacaacagcaggccatcacttacgccgggtcactgcctcagcacctggtgattcccggcacccagcctttattgatcccagtgggcagcactgacatggaggccagcggagcagcccctgcaattgtcaccagcagcccccagttcgctgctgtgccccacacattcgtaaccacagctctgccaaaaagcgagaattttaatcctgaggccttggttacacaggcggcctaccctgcaatggtgcaggcacaaatacatttacctgttgtacagtctgtcgcaagccccgcagctgcacctccaacacttccaccctattttatgaaaggaagtattatccaactggcaaatggagagctgaagaaggtggaggacctgaagactgaggattttatccagagtgccgagatcagcaacgacctcaaaatagactcaagcaccgtggagcgcattgaagatagccactccccgggcgtggctgttattcaattcgcagtcggcgaacatcgtgcccaggtgtctgtggaggttctggtggagtacccattctttgtgttcggacagggctggagcagctgctgcccagaaaggacgtcccagctgttcgatttgccatgcagcaaactatctgtgggagatgtttgcatcagcttgaccctgaaaaacctaaaaaacggcagtgttaaaaagggccaacctgtcgaccccgcaagcgtactcctcaagcactccaaagccgacgggcttgccgggagtagacaccgctatgcagaacaggaaaatgggatcaatcagggtagcgcccagatgctgagtgaaaatggagaactcaagttccctgaaaagatgggtttgcccgctgctccatttctgactaaaatcgagcccagtaagcccgcagcgacacggaagaggagatggtcagccccagagtctcgcaagcttgaaaagtccgaagacgagccaccactgactctccctaaaccatcattgattcctcaggaggtcaaaatctgtatcgagggccggagcaatgttggaaagtag

SEQ ID NO: 108839 - DNA, 2448 bp, Artificial Sequence
  Description of Artificial Sequence: Synthetic coding sequence
atgaaaagcaatcaggagagatcaaacgagtgcttacctccgaagaagcgcgagattccggctacctcacgttcttctgaggaaaaggcccccaccctgccttctgacaaccacagagtggagggaacagcatggttacccggtaatcccggaggaaggggtcatggcggaggtcgccacggacccgcaggcacctccgtcgagttggggctgcagcagggtatcggtctgcataaggcactaagtaccggcctcgactactcaccaccttccgcgccacgttctgtcccagtcgccaccactttacctgccgcttacgcaacacctcaacccggaacaccggtttcacctgtccagtatgcacatttgcctcacacattccagtttatcgggtcctctcagtactccgggacctacgctagttttattcctagccagcttatccctcctaccgcaaatcctgtcaccagcgcagtcgcttcagctgccggcgctacgacgccatcccagcgcagtcagctcgaggcatattcaactctgctcgcaaatatgggttctctttctcaaacacccggtcataaggccgaacagcagcagcagcagcagcagcaacagcagcagcagcaccagcaccagcaacaacagcagcagcagcaacagcagcaacagcagcagcatctatcgagggcacccggcctcatcacccccgggtcgcctccccctgcccagcagaaccagtacgtgcatatctccagctccccacagaacactggccgaacagcatctcctcccgccatcccagtccatctgcatccccatcagactatgattccgcatacactcaccctgggtccaccgtcccaggtcgtgatgcagtatgctgattcagggtcccacttcgtacctcgggaggcaacaaagaaagccgagtcatcacgcttgcagcaggcgatccaggccaaagaggtgttaaatggggaaatggagaaaagcaggcgttatggggctccttcatctgctgatcttggcctgggcaaagccgggggaaaatctgtgcctcatccttatgagtcccggcatgtggttgtgcatccatcgccatcagactacagctccagggaccccagcggcgtgagagcttcggtcatggttttgcctaactctaatactcccgctgctgaccttgaagtacagcaggcgacgcacagggaggcctccccttccacattaaacgacaagagcggcctccacctcggcaagccaggtcacagatcctacgctttaagcccacacaccgtaatacagacaactcatagcgcctctgagcctctgcccgttggcctgcccgcaacagcgttttacgccggcacccaaccaccagtgatcggatatctgtcagggcaacaacaggccatcacatatgccggctctctaccccaacaccttgtcattcccggcacccaacccctcctgatccccgtggggagcactgacatggaggccagcggagccgcgcccgccatcgttactagtagccctcagtttgccgccgtacctcacaccttcgtgaccaccgccctgccaaagagcgagaacttcaacccagaagctctggtgacccaggcagcatacccagcgatggttcaagcccagattcatctcccagtggtgcaatcagtcgccagcccagccgcagctcctcccaccctgcccccctacttcatgaaaggaagcattatccagctggccaacggcgaattaaaaaaggtggaggatcttaagactgaagatttcattcagtctgcggaaatttccaacgatcttaagatcgactctagcacggtggagaggatagaggattcccacagtcccggagtagccgttattcagttcgctgtcggtgaacacagagcccaagttagcgtggaagtgctggtcgagtaccccttctttgtgtttgggcagggatggtcaagttgctgcccagagcggacatcacagttgttcgatctgccttgctccaaacttagcgtgggggatgtttgtatctcactcactctgaagaatttaaagaacggaagcgtcaaaaaagggcagccagtggatccagcctctgtcctcctaaagcacagcaaagccgacggacttgccgggtcaaggcaccgctatgctgaacaggaaaatggcatcaaccagggcagtgcacaaatgctaagcgagaatggagagctgaaatttcccgaaaagatgggacttcctgccgcccctttcctaaccaaaattgaaccaagtaagccagcggccactagaaaacggagatggtccgctcctgagagtcggaagcttgagaagagtgaagatgagccccctctgactctcccaaagccatcgcttatccctcaggaagttaaaatctgcatcgagggccgcagcaatgtcgggaaatag

SEQ ID NO: 108840 - DNA, 2448 bp, Artificial Sequence
  Description of Artificial Sequence: Synthetic coding sequence
atgaagtcaaaccaagagcgtagcaacgaatgcctgccccctaaaaagagggaaatccccgcgaccagcaggagttccgaggagaaagctccaactctaccctccgacaaccaccgtgtggagggaacagcatggctccccggcaacccaggcggtaggggacacggtggggggaggcacgggccagctgggacctccgtggagctgggactgcagcaagggatcggcctccacaaagccctgagcacaggcctcgattactccccgccatcagctccgaggtcagttccggtcgctacaaccctccctgcagcatatgcgacaccccagcccgggactccagtctcacccgttcagtacgcccacctcccccatacatttcagtttatcggttcttctcaatattccggtacttacgcttcgttcatacctagccagctcattcctcctaccgcaaatcctgtgacaagcgcagtggcctcagccgccggagctactacacctagccagaggagtcagctggaggcgtattccaccctgctggccaatatggggagcctttcacagacacctggacataaggccgaacagcaacagcagcagcagcagcagcagcagcagcagcatcagcaccaacagcaacagcagcagcaacaacagcagcagcaacagcagcacctgtctagagccccagggctgatcacacccggttccccacctccagcccagcagaatcaatacgtacacatatcttcttcaccccaaaatactgggcgaaccgcctcacctcctgcaattccagtccacctgcatcctcatcaaaccatgattccccacacgctcaccttgggtcccccatcccaggtcgttatgcagtacgccgattcgggcagccattttgtgccacgcgaggccacaaagaaggcagaaagttctcgactccaacaggcgatacaggccaaagaggtgcttaacggcgagatggagaaatccaggcgttacggggccccatcctcagctgatctgggtctgggaaaggcaggcgggaagtcagttcctcacccatatgagtctagacacgttgttgtgcatcccagcccttctgattacagcagtcgggacccatcaggagtacgtgcttctgtgatggtactgccaaattctaacacaccggccgctgacctggaggtgcagcaggctacccaccgggaggcctctccctctaccctcaatgacaaatctggcctacacctaggaaagccaggacatagatcatacgccttatcgccccatacggtgattcagacaactcacagtgccagtgaacctttgccagtaggattgccagccacggcgttttacgccggtacacagccacctgtgattggatatttatctggccagcagcaggcaataacgtacgctggcagtcttcctcaacacctagtgatcccggggacccagcctctgctcataccagtcggcagcacagatatggaagcgtccggcgccgcaccagctatcgtgacgtctagtcctcaatttgctgcagtgcctcataccttcgtaactactgctctgcccaaatccgagaatttcaacccagaggccctggtgacacaggccgcctaccccgccatggtgcaagctcagatacacctgcccgttgtgcagagcgtagctagccccgcagcggccccaccaacccttcccccttactttatgaagggcagcattatccagctcgcgaatggggaacttaagaaagtggaagacctgaagactgaagactttattcagtctgccgagatttctaacgacctaaaaattgatagtagcacagtcgaaagaatcgaggacagccactcacccggggtggccgtgattcagtttgcagtcggggaacaccgggcacaggtgtcagttgaagtactcgtcgagtacccctttttcgtgttcggccagggatggtcctcatgttgtccagagcgcaccagccagctttttgacctcccgtgctctaagttatcagtcggtgacgtgtgcatcagtctcaccctgaaaaatctgaaaaatggttcagtaaagaaaggccaaccagttgatccagcttccgtccttctgaaacacagcaaggccgatggattagctgggtctcgccacaggtacgctgagcaggagaacgggattaaccagggctcagcgcaaatgctctccgagaacggcgagttgaagtttcctgagaagatgggcctgcccgccgctcctttccttacaaaaatcgaaccgagcaagcctgctgccacaaggaagcgacgatggtctgccccagaaagcagaaaacttgagaaatcagaggacgaacctcccttaactctccctaagcccagtctgattccacaggaggtcaagatctgtatcgagggccgctcaaatgtgggaaagtag

SEQ ID NO: 108841 - DNA, 1428 bp, Artificial Sequence
  Description of Artificial Sequence: Synthetic coding sequence
atggcagccccgagacctccaccagccaggctctctggggtaatggtcccagcaccaatccaagatctggaagctctgagagcccttacagcccttttcaaggaacaacggaatcgggagacagcccctcgcaccatcttccaaagagtgttggatattttgaaaaagtcatctcatgccgttgagctggcctgccgcgatccctctcaggtggaaaacctcgcctcaagtctgcagttaatcactgaatgttttagatgtctacgcaatgcctgcatcgaatgtagcgtaaatcagaactctattcgaaacttagatactatcggagtggcagtggaccttatcctactgttcagagagctgcgggttgagcaagagtccctcttgacagcctttaggtgtggattgcagttcctgggtaatattgcatctcggaacgaggatagccagtctattgtgtgggtccacgccttccctgaattgttcctctcttgtctgaatcatccggacaagaaaattgtggcatattctagcatgatcctgtttactagcttgaaccacgagaggatgaaggagctggaagaaaatcttaatatagccatcgacgttatagacgcgtaccagaagcatccagagagcgagtggcccttcctgatcatcaccgacttatttctcaagagccccgagctcgtccaggccatgttcccgaaactaaacaatcaagagagagttaccctcctagatctgatgatcgcgaagatcaccagcgatgaacctttaacaaaagacgatataccagtctttctccggcatgctgagctgatcgctagcacttttgtggatcagtgcaaaaccgtactgaaactcgcatcagaagaaccacctgacgatgaggaggccctggccaccatacgcctgctcgacgttctctgcgaaatgactgttaacaccgaactactgggctatctgcaggtcttccccggcctgctggagagggttatcgatctcctgcgcgtcatccacgttgccggaaaagaaaccacaaatattttcagcaactgcggttgcgtgagggctgagggcgacatcagcaacgtcgctaacggctttaaatctcatctcattcggttaatcgggaacctgtgttacaagaacaaagacaatcaagacaaagtcaatgaactcgacggtataccactaattctggacaattgcaacatctctgactccaatccctttttaacccaatgggtgatatatgccatcagaaacctaaccgaggataacagccagaatcaggacctgatcgcaaagatggaggagcagggcctcgcagatgcgtccctactcaagaaagtaggattcgaggtggaaaagaagggggagaaattaatccttaaatcaactcgggatacgccaaagccctag

SEQ ID NO: 108842 - DNA, 1236 bp, Artificial Sequence
  Description of Artificial Sequence: Synthetic coding sequence
atggccgcccccaggccacccccagctagactgtccggtgtgatggttcccgctccaattcaggacctggaggccctgagagctttgaccgcgctatttaaggaacagcgtaaccgaaatttagacacaataggcgtggcggtggatctgatcttacttttcagggaactgagagtcgagcaagaaagcctgctcactgctttccggtgcgggttgcagtttctgggcaatatagcttccaggaatgaggattcccaatctatcgtgtgggtgcacgctttccctgagctctttctcagctgcctgaaccatcctgataagaagattgttgcttattcctccatgattcttttcacgagtctcaaccatgaaagaatgaaggaactagaggagaacctcaatattgccatcgatgtgattgacgcataccaaaaacatcctgagagtgaatggccttttctgattattaccgatcttttcctgaagtcaccggaattagtgcaggctatgttcccgaaactgaacaatcaagaacgcgtgacattattggatctgatgattgcaaagatcaccagcgacgagcctctcaccaaggatgacatccccgtgttcctgcggcatgccgagctgattgcttccacatttgtcgatcagtgcaagactgtgctcaaactagctagcgaggaacctcctgacgatgaggaagcattagccaccatacgtcttctcgatgtcctgtgcgagatgaccgttaacaccgagctgctgggctacttgcaggtgtttccaggcctactcgagagggtgatcgatcttctcagggtgatccatgttgcaggcaaggagaccacaaacatattttcaaactgtggttgtgtccgggccgaaggggacatctccaatgtggcaaatggattcaagtctcacctgattagattaatcggcaatctgtgctacaaaaacaaggacaaccaggataaggtcaacgaactcgacgggatcccactaatcctcgacaactgcaatatttctgacagcaacccattcctaacccagtgggtgatatacgctattagaaacttaactgaagacaacagtcaaaatcaggatttgatcgcgaagatggaggaacaaggtctcgcagacgcttcgctgctgaaaaaagtgggttttgaagttgaaaaaaagggcgaaaagttgattctgaaatccacgagggacacccccaaaccctag

SEQ ID NO: 108843 - DNA, 1362 bp, Artificial Sequence
  Description of Artificial Sequence: Synthetic coding sequence
atggccgcccctagacctcccccagctcggttgtcaggagtgatggtccccgcgcccatccaagatttggaggcactgcgggccctgaccgctctgtttaaggaacagcgaaacagagagaccgccccccgtactattttccagcgcgtgctcgacatccttaaaaaatctagccacgccgtcgaattggcctgtcgagacccgtcccaagtggagaacttggcttccagtctgcagctcatcacggaatgctttcgatgtctgcgtaacgcctgtatcgagtgttccgtaaatcagaatagtattcgcaacctcgacactattggtgtggctgtggatttgatcctgctcttccgtgaactgagagtcgagcaggaatctctgcttacagctttccggtgcgggctgcagttcctcgggaatatcgcatctcgtaacgaagattcccagagcatcgtatgggtgcacgccttcccggagctgtttctatcttgtcttaaccacccagacaaaaagatcgtcgcctatagcagcatgattttgttcacttccctcaaccatgagaggatgaaagaactggaggaaaatctaaatatcgcaatagatgtgatcgacgcataccagaagcatccggaatccgaatggcctttcctgatcatcactgatttgttccttaaatctccggagttagtgcaagcgatgttccctaagcttaacaaccaggagagagttacactccttgacctgatgattgccaaaattacatctgacgagccactaacgaaagacgacatccctgtctttcttcggcacgcagagctgatcgctagtacatttgtcgaccagtgcaagaccgtcctcaagctcgctagcgaagagccacccgtgatgtacccttacatgcgtatcgtgggaaagtttagattgctcgatgtcctgtgcgagatgactgttaacacggaactgctgggctacctgcaagtgttccctgggcttcttgaaagggttattgaccttctgcgagtaatccacgtcgccggaaaggagaccaccaacatcttttcaaattgcggttgcgtccgtgccgaaggcgacatttctaacgtggccaatggttttaagtcccacctgataaggctgattgggaatctttgctacaagaataaagacaatcaggacaaggtgaatgagctcgatggcatcccacttattctggataactgtaatatcagcgattcgaacccctgctccgacccagtgggcgacatctgtcacccaaagccctaccgccggcagcagcccaagccacgatttgattgcaaagacggcggaaccggtgccgggaggtgtattccaacttag

SEQ ID NO: 108844 - DNA, 2070 bp, Artificial Sequence
  Description of Artificial Sequence: Synthetic coding sequence
atgaaacctgttcacgaaaggagtcaagagtgtctcccccctaaaaagagagacttacctgtgacgagcgaggatatggggagaacgacatcctgtagtacaaatcatactccaagtagtgacgctagcgagtggagccgtggcgtagttgtagcaggacaaagtcaggcaggagctcgcgtgagccttgggggtgacggcgcagaagctattacaggtcttactgtggatcagtatgggatgctgtataaagtagccgtaccccctgccaccttcagtcctactggccttccatccgtagttaatatgagtccgctgccaccgactttcaacgtggcctccagcttgatccagcatcccggcatccactaccctccccttcactacgcacagcttccctccacaagccttcagttcatcggcagcccgtattctttaccctacgccgttccacctaactttcttccttcccccctcctgtcaccaagtgctaacttggctacctcacacctgccgcattttgtgccatacgcctcactactcgccgaaggcgccactccacccccccaggccccgtcccccgcccactcgttcaataaggctccaagtgccacttctccatcaggtcagctcccacatcacagttccacccagccgctggacctggccccaggccgaatgcccatttactatcagatgtcccgattgcctgcaggttatacgctgcacgagacgccgccggctggagcttcaccagtgctgactccgcaagagtctcagtcagctctagaggctgctgcagccaacggaggccagcggcccagagagcgcaacttagtccggagggaaagtgaggccctagactcccccaactctaagggcgaaggacagggcctggttcccgtcgtcgagtgcgtggtggacggacagctgttctcaggttctcaaacgcctcgggtggaagtggccgcacctgcacatagaggaacaccggataccgatttggaagtccagcgggtagttggcgctttggcctcacaggactacagggttgttgctgctcagcgtaaggaggaaccatcacctcttaacttaagtcaccacactccagaccaccaaggagaaggaagaggtagtgctaggaatcctgccgagttggctgagaaatcccaggcccggggcttctacccgcagagccaccaagaacccgtgaaacataggccactgcccaaagcaatggtggtggccaatggaaatctggtccccactggcaccgatagtgggctgctcccagtggggagtgaaattcttgtcgcatctagtctggacgtgcaggctagagccacttttcccgataaggaaccgactcccccccctatcacatcttctcacctgccctcccatttcatgaagggtgctatcatccaactggcaacaggcgaattaaaaagggtagaggatctgcaaacacaggacttcgttcgatcggctgaggtcagtggggggttgaaaatagattcttcgacagtggtggacatccaggaatctcagtggccaggcttcgtgatgctgcactttgtcgtcggtgaacagcaatctaaggtgtccatcgaggtaccacctgaacatccctttttcgtatatggacaggggtggtctagttgctccccgggccgaaccacgcagctattctctcttccctgccataggctgcaggtcggtgatgtgtgtatatcaatttcactgcagagtcttaattcgaactccgtaagccaggcctcttgtgcaccaccctcgcagctgggtcccccgagggaacgccccgagcggaccgtcctggggagtagggaactttgcgactccgaaggcaaatcacagcctgctggggagggctcgcgagtggtagaacccagccagcctgaaagcggggcgcaggcatgctggcccgcaccgtctttccagcgctactcaatgcagggcgaggaggctcgcgccgcactactgcgaccttctttcataccccaggaagtgaagctgagcatcgaaggcagaagcaacgccggcaaatag

SEQ ID NO: 108845 - DNA, 3942 bp, Artificial Sequence
  Description of Artificial Sequence: Synthetic coding sequence
atgcgctcagctgcagcagcacctcggagccccgctgttgccaccgagagcaggcgttttgctgccgctaggtggccgggctggaggtcccttcagcgccctgcccgcagaagcggcaggggcggcggaggcgccgcgccaggcccttatcctagcgctgctcctcctccaccaggtcctggtcctccacccagtcggcagagcagccctccgtccgcaagcgactgtttcgggtcaaacgggaacggggggggggcctttaggcccggtagccgacggctgctgggtcttggagggccaccaaggccattcgtggtcctgctgctccctcttgcatctcccggcgctccacccgccgcccccaccagagcttcacctctgggggcacgtgcttcacctcccaggagcggtgtgtccctggcccgccccgcaccgggatgccctcgccctgcatgtgaaccagtttacggtcccctgactatgtccctcaagccgcagcagcaacagcaacaacagcagcaacagcagcagcagcaacagcaacagcaacagcaacagcagcaacccccccccgccgctgctaatgtccgtaagcccggggggagcggacttttggcttctccagctgccgctcctagcccaagcagctcttcggtatccagctcctccgccaccgcaccatcctcagtggtggctgcaacatccggcggcggccgacccggcctcggtcgcggcaggaactcaaataaagggctgcctcagagcactatttcctttgacggcatatatgcaaatatgcgtatggtccacattttgacttcagtggtgggcagtaaatgcgaggtccaggtgaagaatggtggtatctacgaaggggtgtttaaaacatatagtcctaagtgtgacctggttctggatgccgcccacgagaagagcactgaaagctccagcgggccgaagcgcgaggaaattatggagtctatcctttttaaatgtagcgatttcgtcgtggtccaattcaaagatatggatagttcgtatgcaaaacgcgacgcttttacggattcagctataagcgccaaagtcaacggcgagcataaagagaaggacctggaaccctgggatgcgggggaactgacagctaacgaggagctggaagcccttgaaaatgacgtgtcgaacggttgggaccctaacgatatgttccggtataacgaagagaactatggcgtagtaagtacctatgactcgagcttatcctcatataccgtccctctggaaagggataatagcgaggagttccttaaaagggaagccagggctaatcagctggcagaggagatcgaaagctccgcacagtacaaggcccgcgtggccctggagaacgatgacagaagcgaagaagagaaatacactgctgttcagcggaatagcagtgagcgggaaggtcattctataaatactcgagagaataaatacatcccacccggccaacgcaacagggaagtgattagctggggctcgggaaggcagaatagtcctcgaatgggacaaccaggctccggcagtatgccaagccgttccacttcacacacaagcgactttaaccctaattctggtagtgaccagagggtggtgaacggaggcgtgccttggccttccccctgtccctccccaagctccaggccacctagccgataccagtcaggcccaaattccctgccaccaagagccgcaaccccaacacgtccccctagccgaccccccagtcgaccatcaagacctccgtctcatccgagcgcgcacggcagtccagccccagtatcgacgatgccgaagcggatgagcagtgagggccctccacgtatgtctcccaaggcccagcggcatcccaggaatcacagagtgtccgctggcagggggagcatctcaagcggacttgagttcgttagtcacaacccacctagtgaggcggccacacccccagtcgcaagaaccagcccctctggaggcacctggagcagtgtggtgagcggcgttccgcgccttagccctaaaacccaccgaccccggagtccgaggcagaacagtatcggtaacactccatcagggcccgtgttggcttccccacaggcgggcatcattcccactgaagccgtcgctatgcccatccccgccgctagccctacccccgcctcacctgcctccaatcgggccgtgacaccgagctcagaagctaaggatagccgactccaggatcagcgtcagaattcaccagccggtaataaagagaacatcaaacctaacgaaacatccccaagtttctctaaggcagagaataagggaatttcacccgtagtgtcagagcatcgaaaacagattgacgacctcaaaaagttcaagaacgattttagactgcagccttccagtacctccgagtcaatggatcaattgctgaataagaatagggaaggtgagaagtccagggatctcataaaggacaagattgaaccctctgctaaggatagtttcatcgagaactcctccagtaactgcacttccgggagttcaaagcctaactcaccgtcaatcagcccttccattttgagcaatacagagcacaaacgggggccagaggtgacttctcaaggcgtgcagacgtctagccccgcctgtaaacaggagaaggacgacaaggaggagaagaaggacgcagcggagcaggttaggaagagcaccctgaaccccaacgctaaagagttcaatccaaggtccttttcccagccaaagccatcaaccacgcccaccagccccagaccccaggcccagccatccccatctatggtggggcaccagcagccaacaccagtgtatacccagcccgtttgcttcgcccccaacatgatgtatcccgtgccagtaagcccaggcgtgcagcccctctaccccatcccaatgacacctatgcccgtgaaccaggccaagacgtaccgcgcagttcccaacatgcctcagcagcggcaagaccagcaccatcagtccgcgatgatgcacccagcaagcgcagctggcccaccgatcgcagcaacccctccggcctactccacacagtacgtggcatactcacctcaacaatttcctaaccagcccctcgtccaacacgtgccacactaccaaagtcagcacccacacgtatacagccccgtaatccaggggaatgccaggatgatggctcctcccacacatgctcaacccggtctcgtgagctccagcgctactcagtatggagcccatgaacaaactcacgctatgtatgcgtgtcctaaactcccctacaataaggagacatccccctcattctattttgccataagcacgggctcgctggctcaacagtacgctcatcctaacgctacccttcaccctcatacccctcatccccagccatctgctacccccaccggacaacaacagagccagcatggtggatcccaccccgctccctcccccgttcagcaccaccagcaccaagccgcccaggccctacaccttgcctccccccaacagcagagcgccatttaccatgccggcctcgccccaaccccccctagtatgacgcctgcttctaacacccagagtccacaaaatagcttccccgccgcccagcagacggtcttcacaatacatcctagccacgtccaacctgcgtatacgaaccccccgcatatggcacatgtgcctcaggctcacgttcagagcgggatggtgccatctcatccaaccgcccatgctcccatgatgcttatgacaacccagcctcctggtggacctcaggcggcattggcgcagtccgccctacagccgatccccgttagtaccacagcccattttccttacatgacccacccctccgtccaggctcaccatcagcaacagctctag

SEQ ID NO: 108846 - DNA, 2988 bp, Artificial Sequence
  Description of Artificial Sequence: Synthetic coding sequence
atgcggtctgctgcagctgctccacgttctcccgctgtggctaccgagtctcgacgcttcgctgctgcaaggtggccaggatggcgctcactgcagcggcctgccagacggtcaggccgaggtgggggaggcgccgctccgggtccttacccctcagcagcgcccccacctcccggtccagggcccccccctagcaggcaatcgagcccccctagcgctagcgattgttttggttctaacgggaacggtgggggcgcctttcgtccgggctcccggagactgctagggttgggcggccccccccgccctttcgtcgtcttactattacccttggcctctcctggagcccctccagcggcgcccacccgcgcttctcctctgggcgccagagcaagtccgcccaggtccggagtgtcattagcacgacccgctcctggctgtccccgtccagcatgtgagcccgtttacgggccgctgactatgtcattaaagcctcagcagcagcaacaacaacagcagcagcagcagcagcaacagcagcaacagcagcagcagcagcagcagccaccccctgcggccgctaacgttagaaagcccggagggagtggactgctcgcttcacctgccgccgccccttcgccttcctcttccagcgtgagcagctccagcgccactgcacccagcagtgtggtggccgcaaccagcggagggggcagacctggattgggtcgggggcgcaactccaacaaggggctgcctcagtccaccataagttttgacgggatttacgctaacatgagaatggtgcacatcctgacatccgtggtgggaagcaagtgtgaggttcaagttaaaaacggcggaatttacgagggtgtgttcaagacttactctccaaagtgtgacctggtgctagacgcggcccacgagaaaagtactgaaagcagctctgggcctaagagagaggagatcatggaatcaattcttttcaaatgttcagattttgtggtcgttcagttcaaggatatggactcatcctatgccaagagggatgcattcaccgatagtgccatctccgctaaagttaacggcgagcataaagagaaagatttggaaccgtgggatgctggagagctaaccgcaaatgaagaacttgaggcgctagaaaatgatgtgtcaaacggatgggatccgaacgacatgttcagatacaatgaagagaactatggggtggtgtctacctacgactcttctctctcgtcctatactgtccccctggagagagacaactccgaagaattcttaaagcgggaagcccgagctaatcaactggcagaggagatcgagtcgtctgcacagtataaagcccgtgtggcgctggaaaacgatgatagatctgaagaagagaagtatacggctgtacaacgtaatagttctgagcgcgaggggcactctatcaacaccagagaaaacaagtatatcccacccgggcaacggaatcgggaggtgatctcctgggggagcggccgccagaactcaccacgaatggggcagccgggatccggctccatgccgtctcggagcacatcccatacctccgattttaatcctaacagcggcagtgatcagcgtgttgtcaatggcggggtaccttggcccagtccctgcccttcgcccagttccagacccccatccagatatcagagcggaccgaattcgttacctcctagggctgccacgcccacaaggcccccgagccggcctccttcacgccctagccgaccacctagccacccgtccgcccatggatcccccgcacccgtgtccactatgccaaaacgaatgagctccgagggccctccccggatgagccctaaagcacagaggcatccaagaaaccaccgtgtgtctgccggccgcggctctattagctccgggctggagtttgtttcccataacccacctagcgaagccgcaaccccacctgtggctcgcaccagtccctctggcggcacttggtctagcgtcgtgagtggggttcctcgtctgtctcccaagacccacagacctaggtcccctaggcagaactccatcggtaataccccatctggcccagttctggctagcccccaggccgggatcatccccacagaggccgtcgctatgccaatacccgccgcatctccaactcctgcctctcccgccagcaaccgcgccgtgacccccagctccgaggcgaaggattctcgcctgcaggaccaaagacagaacagccccgctggaaataaagagaacatcaaacccaacgaaaccagcccctctttcagcaaggcggagaataaagggatctcacccgttgtgtctgagcatcgaaaacagatcgatgacctaaaaaaatttaaaaacgacttcaggttgcagccaagcagcacatctgaatcgatggatcagctgctgaacaagaaccgcgagggggaaaaatccagagacctgataaaagataaaatcgagcctagcgcgaaagacagttttatcgagaattcttccagcaattgcacaagcggatctagcaaaccgaactcaccaagcatttctccatccattctctctaacacagagcacaagcggggacctgaggtaaccagtcaaggggtgcaaacttccagtccggcctgtaaacaggagaaagacgataaagaagagaaaaaagacgctgcagagcaggtgcgcaagtctaccctgaacccaaacgcaaaagagttcaaccccagatccttctcccaacccaaacctagtacaactccgacatcacccaggccacaggcccagccaagccccagcatggtgggacaccagcagccaacccctgtgtacacgcaaccagtatgtttcgctcccaatatgatgtatccggttcccgtctctcccggagtgcaatatcaaatctgccccaatagcggaaagactagcatcatcagagtgccctag

SEQ ID NO: 108847 - DNA, 3189 bp, Artificial Sequence
  Description of Artificial Sequence: Synthetic coding sequence
atgctgaagccccagccgcttcagcagcctagtcagccccagcagccccctccaactcagcaggccgtggctagacgccccccgggaggtacctcacctcccaacggtggtcttccgggcccactcgctacttctgcagcaccaccgggaccgcccgccgcggcttctccttgcctgggcccagtggctgctgcaggatctggcttaaggcgaggggccgagggcatactggccccccagcccccccctccccagcagcaccaggagcggcccggagccgcagccatcggatcggcacgcgggcagagcacgggaaagggccctccgcagtcacccgtcttcgagggagtctacaataactctcggatgcttcactttctaaccgccgtcgtgggctcaacctgcgacgttaaggtcaaaaacggtactacttacgaaggaatatttaagaccctcagcagcaagttcgagcttgcagtggacgccgtgcaccgcaaagcttctgagcccgcgggtggccctaggcgggaggatatcgtcgacacaatggtgtttaagccctccgacgttatgctggtccacttcagaaacgtggactttaattacgctacaaaggataagttcaccgactccgccatcgcaatgaactctaaagtcaatggggagcataaggaaaaagtcttgcagagatgggaaggaggggacagcaactctgatgactatgacctggagtccgatatgtcaaatgggtgggacccaaatgagatgtttaaatttaatgaggagaactatggggtgaaaaccacatacgatagtagcctctccagttacacagtgcccttggaaaaggacaattcagaggagtttcgccagagagagctccgcgccgcccagctggcacgtgagatcgagtcctcaccccagtaccggctcaggatagccatggagaacgatgatggtaggacagaagaagagaagcactccgctgtgcagcgtcaaggcagcggcagggagagcccctccttggcctcacgggaaggcaagtacattcccctgccccaaagggtccgtgaaggtccacggggtggtgttaggtgtagctctagccgtggcggacgtcctggcctgtctagcctgccccctcgaggacctcatcacctggacaacagctcccctggtcccggtagcgaagcaaggggcatcaatggggggccatctaggatgagtcccaaagcacagagacctctgcgcggggctaagacactgagctctccatccaatcgcccgtcaggcgaaacctccgttcccccaccaccggccgttggccgcatgtaccctccccgcagccccaagtctgccgctcctgccccgatttccgcaagctgccctgagccccccattggttctgccgtgcccacaagctctgcctctattcccgtcaccagttctgtgtcagaccccggtgttggatcgatttctcctgcctccccgaagatttccttggcaccaacggatgtcaaagaactttctacaaaggaaccggggagaacactggagccgcaagagctggcgcgtatcgccggcaaggtgccagggctgcaaaatgaacagaagagatttcagctggaagagctgcgaaaattcggagcccagtttaaactccagccctcatcctctcccgagaactccttggatcccttcccaccacgtatcctcaaggaggagccgaaagggaaggagaaagaggtagatggccttctgactagcgagcccatgggcagccccgtgagcagcaaaacagaatcagtatctgacaaggaagacaaaccgcccttggcaccatccggggggaccgaaggccccgagcagcccccccctccctgcccttcgcaaaccgggagcccgcccgtgggcttaattaaaggggaggacaaagatgaagggcctgtggcggaacaggtgaaaaagagcacgctcaatcccaatgcaaaagagtttaaccccacgaagcccctcctctccgttaacaaatcaacgtccactcccacctcccctggccctaggacccactccaccccatcaatcccggtgctgactgccggccagtccggtctttactccccacagtacatttcatatatcccccagatacacatgggcccagccgttcaggctccccagatgtatccatacccagtctccaacagtgtaccaggacagcagggcaagtacagaggggcaaagggttctttgcccccgcaacgatcagaccagcaccagcccgcaagtgcacctcctatgatgcaggccgccgcagctgccggaccccctctcgttgctgcgactccatactctagctacatcccatataacccgcagcaatttcccggtcagccggctatgatgcagcccatggctcactatccctctcaacctgtgttcgccccgatgcttcaatcaaacccccgaatgctgaccagtgggtctcacccccaggccattgtgtctagtagcaccccacaatacccttccgcagagcagcctaccccacaagccctgtacgcaacagtgcaccaaagctatcctcaccacgccactcaactgcacgctcaccagccacagccggcaactacgccaactgggtcccagcctcagagccagcatgccgccccctcaccagtgcagcaccaggccgggcaggctccacatttagggtccggacagccccagcagaacctgtaccacccgggtgccctgactgggactcccccttcactgccacccgggccctctgcccagagcccacagagcagtttcccacaaccagctgctgtgtacgccatccatcatcagcagcttccccacggcttcacaaacatggcacacgtgacccaagcccatgttcagaccggaatcaccgccgctcctcccccacaccccggagccccgcacccgccccaagtgatgctcctgcacccaccacaatctcatggaggtccaccccagggcgctgtgccccagtcgggagttcctgctctgtccgccagcaccccttctccgtacccatacatcggccacccccagggtgaacagcccggtcaggcacccggcttcccaggaggcgccgacgacaggattcctccactcccaccgcccggtgaacttaagattgtcctggccgcaacgtag

SEQ ID NO: 108848 - DNA, 3228 bp, Artificial Sequence
  Description of Artificial Sequence: Synthetic coding sequence
atgctcaagccccagcctcttcagcagccctcacagccccagcaaccacctcccactcagcaggccgtagctagacgacctccaggcggcacctcgcctccaaacggtggactgccaggtcccctcgccacatcagctgccccacccggtccaccggccgcggcctctccctgccttggcccagtggcggcagctggctctggtctgcgacgaggggccgaggggatcctggcccctcagcctcctccccctcagcagcatcaagaaagaccgggagccgcagctattggttccgcgagaggacagtcaactgggaagggacccccacagtccccagtcttcgaaggggtctacaataactctagaatgcttcattttttaactgccgtggtcggaagcacatgcgacgtgaaggtgaaaaatggcacaacctacgagggaattttcaaaacactatcctccaaattcgagctcgcggtggacgccgtgcatagaaaagcttcggagcccgccggcggccccaggagggaagatatcgtggacaccatggtctttaagccctctgatgtgatgctggtgcacttcagaaacgtagactttaattatgccaccaaggataagtttaccgacagcgccattgccatgaactccaaagttaatggcgaacacaaagaaaaggtcctccaacgctgggagggcggagactccaattccgacgattacgacctggaatcggatatgagcaatgggtgggatccaaacgagatgtttaagttcaacgaggagaactacggcgtcaaaacaacatatgattcttcattgtcatcttacaccgtcccactcgagaaagataacagcgaggagtttcgccagcgagagttgcgcgcggcccagctcgctcgcgagatcgagtcatccccccagtaccggcttcgcatcgccatggagaacgacgatggccggactgaagaagaaaagcactccgccgtccagcgacaggggagcggccgcgagtctccaagtctcgcatctcgtgagggtaaatacattccactgccacagagggtccgggaagggcctcgtggcggggttaggtgcagctcttccagaggaggacgccccggcttgtcctctttaccacccagggggccacaccacctagacaactccagccccgggcccggttcagaggcgcgcggcatcaacggaggaccatctagaatgagtcccaaagctcaaagacctttgcggggggcgaagacgttatcctctccttctaacagaccaagtggtgagaccagtgttccccccccacctgctgtcgggcggatgtaccctcccaggtctcctaaatcagccgctccagcccctatctcagcttcatgccctgaaccaccaatcggctctgccgttcccacatcatctgcttcaatcccagttacctcctctgtgtcggaccccggcgttggttccataagtcctgcttcaccaaagatttctctggcaccgacagacgtgaaggagctctctacaaaggagcctggaaggacattagaaccacaagagcttgcccgcatagctggaaaagtgcctggcctccagaatgagcaaaagcgcttccagctggaggagctgcgcaagtttggggctcaatttaagctgcagccgtcttcctctcccgaaaacagcctcgacccatttcccccacggattctgaaagaagagcccaaaggcaaagagaaggaagtggatggtttactaacgagtgagcccatgggtagtccggtaagtagcaaaactgagtccgtgagtgataaggaagataagccccctctagcaccgtccggagggacggaaggacctgagcagcctccaccaccttgcccctcccagaccggatcacccccagtagggctgattaagggggaagataaggacgaaggccctgttgcagaacaagttaagaaaagcacactgaatccgaacgccaaagaatttaatccaacaaagcctctactctctgtgaacaagtccaccagtaccccaacgtctccaggacccagaacccattccacaccctctattcccgttctgacagcaggacagagcgggctatatagtcctcagtatatcagttatatcccgcagatacacatgggtcctgctgttcaggctcctcagatgtacccctatcccgtctccaactccgtgcccggccagcaagggaagtacaggggcgctaaaggctctttacctccacagcggtctgaccagcaccagcccgcgtccgcccccccaatgatgcaggccgcagctgctgctgggccacctctggtcgctgccaccccctattcaagctatataccttacaatccccaacagttccccgggcagcctgcaatgatgcagcctatggcacactacccatcacagcccgtttttgccccgatgttgcagagcaaccccaggatgctgacgagcggctctcatccccaagcaatcgtctcaagctcaaccccccagtatccatcagcagagcagccaacacctcaggccctgtacgcaacagttcaccagtcctatccgcatcatgcaacgcagctacatgctcatcagccccagccagcgactaccccgactgggtcccagcctcagtctcagcacgctgccccgagtcccgtccaacatcaggctggacaggcacctcatttagggtcaggtcaaccccagcagaacctctatcatcccggggctctgacgggaacccctccatcactgccgcccggcccaagcgcccagtctccgcagtcctcatttccacagccggccgcagtatacgctatacaccatcagcagctgcctcacgggttcaccaacatggctcatgtgactcaggcccatgtccagactggtattaccgcagccccgcctccccaccctggcgccccgcaccccccccaggtgatgctgctgcaccccccccagtcccatggaggacctccacaaggggccgttccccagagtggcgtgccagctctgtcagcatctacccccagcccttatccctacattgggcatccccaaggagagcagcccggccaggccccaggttttcctgggggcgccgacgatagaattcgcgaatttagtctagcaggagggatttggcatggccgcgctgagggacttcaggtgggccaagacgctagggtgttagggggtgaatag

SEQ ID NO: 108849 - DNA, 3135 bp, Artificial Sequence
  Description of Artificial Sequence: Synthetic coding sequence
atgttaaagcctcagccacttcaacagccctcccaaccgcagcagcctccccctacccaacaggcggtagcgcggcggcctcctggaggcacctcccctcccaacggaggcctacctggcccgctggccacctcggcagctcctcccggccctccagctgcagccagtccttgcctgggaccggtcgctgccgcaggttcgggcctgcgccggggtgcagagggcatcctggctccccagcctccacctccccaacagcaccaggagcgccccggggccgcagcgatcggctcggcgcgagggcagtccacaggtaaagggccaccccagagccctgtgttcgagggcgtttataacaactctagaatgctccattttctgaccgctgtggtgggatctacctgcgacgtaaaggtgaaaaacggtactacatatgagggcatcttcaaaactctgagctcgaagtttgaacttgccgtcgatgcagtgcatcgtaaagcaagcgaaccagcaggcggcccgaggagggaggatatcgttgacaccatggtgtttaaaccgtccgatgtgatgttggttcatttccggaatgtggactttaattatgcaaccaaggataagttcaccgacagtgcaattgccatgaatagcaaggtgaatggagagcacaaggagaaagtgctgcaacggtgggaaggcggtgactccaacagcgatgattacgacctggagagtgacatgtccaatggttgggatcctaacgagatgttcaagtttaatgaggagaactatggtgtgaagactacttacgactcaagtctctcatcttataccgtccccctggagaaggacaacagtgaagaatttcgtcaacgggagctgagagctgcacagctggcacgcgagatcgagagctctcctcagtatcgccttcgaatcgccatggagaacgatgacggacgcaccgaggaagaaaagcattctgccgtgcaacgtcagggttctggaagagagagcccctcactcgcctcaagagaagggaagtatattcccctgcctcagagagttcgggagggtccccggggaggggtgcgctgtagcagttcaagaggaggccgccccgggctcagctctcttccccccagggggcctcaccatttggataatagcagtcccggcccaggctccgaggcgcgcggcattaatggcgggccatccagaatgagtcctaaagcccaaaggccccttagaggggccaagacgctgagctcaccatcaaaccggccatccggggagacaagcgtccccccccccccagctgtgggtaggatgtatccaccccgcagccccaagagcgcagccccggctccaatcagcgcgtcctgcccagagcccccaattggcagcgcagtcccaacatcttcagccagcattcctgtgacttcttctgttagtgatccaggagttggaagcatttctccggcaagtcctaagataagcctggcaccaacagacgtcaaagagctctcgaccaaggagccaggacgaacacttgaacctcaggagctcgcaagaattgccggtaaggtgcccggccttcagaacgaacagaaaagattccagcttgaggaactgagaaagttcggtgcccaattcaaactccaacctagtagcagccctgagaactctcttgatccattcccaccacgtattctgaaggaagagcctaaaggcaaggaaaaagaggtagatggccttctaacatccgagccaatgggttcacccgtcagcagcaagaccgaatcagtctctgacaaggaggacaagccaccactagctccgagtgggggcaccgaggggccagagcagccaccacctccctgcccttcccagactggtagtcctcccgtgggtctgattaaaggtgaagataaagacgaaggcccagtcgcagagcaagtgaagaagtccacccttaacccgaatgccaaagaatttaatcccactaaaccactactgtcggtcaacaagtccaccagcacaccaacatctcccggacccaggacgcattccactccctctatccctgttctcaccgccggccagagcggactgtatagcccacaatacatttcatatatcccacaaatccacatgggtcccgccgtccaggcacctcagatgtatccttaccctgtctcaaacagcgtccctggacagcagggcaaataccgtggcgccaaaggcagtctgcctccacaacgtagtgatcagcatcagcccgccagcgctccgccaatgatgcaagcagcggcagccgccggccctcctcttgtcgccgccacaccttactctagctacatcccatacaaccctcaacaatttcctggccagcctgctatgatgcagcccatggcccattacccctcccagccagtgtttgcgcccatgttacagagcaatccaagaatgctcacatcaggtagccacccccaggccattgtcagttcatcaactccacagtaccctagcgctgagcagccgaccccacaggcattgtatgctacagtgcaccaatcgtacccacatcatgctactcagctgcacgcacatcagcctcagccagcaacaacaccaactggcagtcaaccacagagtcaacacgcagccccaagtcctgtgcagcaccaggcaggccaggctccccacctgggctccggccagccccaacagaatctgtaccaccccggtgcactgaccggcacacctccttccctgcctccgggcccatcggcccagtctccccagtcaagttttcctcagccagccgcagtgtatgctatccaccatcagcaactacctcatggttttaccaatatggcccacgtgacacaggctcatgtgcaaactgggatcacagccgcgccacccccccaccctggagctccccaccctccgcaagtgatgctgctgcaccctcctcagagccacggcggcccaccccagggagcagtgccacagtctggcgttcccgccctttcagcctcaactccctctccttacccctatattggccatccccaggtgcagtcccacccaagccagcagttaccattccacccgccaggtaactag

SEQ ID NO: 108850 - DNA, 1203 bp, Artificial Sequence
  Description of Artificial Sequence: Synthetic coding sequence
atgctaaagccgcagccccttcagcaaccaagccagccccagcagcctccacctacgcaacaggctgtcgctagaaggccgcccgggggtaccagcccacccaacggagggctgcctgggccactcgccacctcagctgcacctcctggccccccagccgcggcttccccatgcctgggtcctgtagcagccgctggtagcggacttagacgaggggctgaaggtatcttggcccctcagccgcccccaccccagcaacatcaagagcgaccaggggccgccgccatcgggtctgcccgtggtcagagcacaggcaaaggtcctccccagtcacccgtctttgagggcgtctacaataatagtagaatgctgcacttcctcactgccgttgtaggctccacatgtgatgttaaggtcaagaatggaaccacttacgagggcatatttaaaactctctcgagtaagtttgaactggcagtggatgccgtgcaccgtaaggcttcagagcccgctggagggcctcgtcgtgaagatattgtcgatactatggtctttaaaccaagcgatgtgatgctggtgcacttccgaaacgttgacttcaattacgccacaaaagataaattcacagacagcgctatcgcgatgaatagcaaggttaatggggagcacaaggagaaagtgctccagcgctgggagggcggcgacagcaattcagacgactacgaccttgagagcgacatgagcaatggctgggaccccaacgagatgttcaagtttaacgaagaaaactacggcgtgaagactacttacgacagttcactttcttcatacacagtaccactggagaaggataattcagaagaatttcggcagcgggagctccgggcagcacaactagctcgggaaatagagtccagtccccagtataggctccgcatcgccatggaaaatgacgatggtcgcacagaggaggaaaaacacagtgccgttcagcggcagggctccggaagagaaagccccagcctagcttctcgggagggtaagtacatccccctgcctccacatagaggccagggccagggccctgctggcgtcgggggcagctgtagcgctcctgcccgtccacaccccgtgttgccctcgcatccactgatctattctccagcgggagacgggcgttcttttatattttactatctctag

SEQ ID NO: 108851 - DNA, 3135 bp, Artificial Sequence
  Description of Artificial Sequence: Synthetic coding sequence
atgttaaagcctcagccactgcagcagcctagtcagcctcagcagccaccacccacacaacaagctgtggcccggcgccctcccggcggtacttcccctcccaatggaggtttgccaggtccccttgctacttcagcagctccccccggaccccccgccgccgcctctccatgtttaggtccagtggctgctgctggctccgggctcaggaggggcgctgagggaatcctggccccacagcctccgcccccccagcaacatcaggagagacccggagctgccgccatcggctcagctagaggccagtccaccggcaaggggccaccccaatcacccgtcttcgagggagtgtacaataactcacgcatgcttcacttcctcacagccgtggtgggctccacctgtgatgtgaaggtgaaaaatgggaccacatatgaaggtatctttaaaactctgagttccaaatttgagctggccgtcgacgcagtccataggaaagccagcgaaccagcagggggtccccggcgcgaagacattgtcgatactatggtgtttaagccttctgacgttatgctggtgcacttccgtaacgtggacttcaattatgcaaccaaagacaaattcactgacagtgccatcgctatgaactctaaggtaaacggggagcacaaggagaaagtgctgcaacggtgggaaggaggtgattcgaacagtgacgattacgatcttgaatccgatatgtctaatggctgggatccaaacgaaatgtttaaattcaatgaggagaactatggcgtgaaaaccacctatgatagctcgctttcatcctatactgtgccgcttgaaaaggacaattctgaggaatttcgccagagagaactgagagcggcgcagctggccagggaaattgagagctctcctcagtaccgcctcaggatcgccatggaaaatgatgatggccgtactgaagaggaaaagcattctgctgtacagagacaagggtccgggcgagagtcaccttccctggctagtagggaaggtaagtacattcctttgccccagcgcgttagagaaggacctaggggaggggtgaggtgttcctcaagccgcggaggtaggcctgggctgagcagcctaccacctagaggtcctcatcacctcgacaattcctcccccgggcccgggtccgaagctagaggaatcaacggcggcccatctaggatgtctcccaaggcacagcgaccccttcgaggcgctaagaccctgagttcaccctctaacaggccatccggggaaacaagcgtgccccctccgcccgccgtggggcggatgtatccacctcgcagtccaaagtcagccgctccggcacccatttccgcgagctgtcccgaaccccctatagggtccgcagtgcctacatccagcgcttcaattcccgtgactagttccgtgtccgatccaggtgtcggcagcatcagcccagcgtcacccaagatctcactggcgcccacggatgtgaaagagctgtctactaaggagccaggacggacactggagcctcaggagctagcccgaatcgcagggaaagtgccagggctgcaaaatgaacagaagcgattccaactggaggagcttagaaaattcggagcccagttcaaacttcagccctcttcttcacccgagaattctctcgacccctttccacctcggattctaaaagaggaaccaaaaggaaaggagaaggaggtcgacggcctgttaacaagcgagcccatgggttcgcccgtgtcctctaaaacagagtctgtgtctgataaggaagataagccccctttagccccttcaggtggcactgaggggcccgaacagccgccccctccgtgtccatcacaaactggcagtccacctgtaggactgatcaaaggagaggacaaggacgaggggccagttgccgaacaggtcaagaagtccacgctgaacccgaatgctaaagaatttaacccgactaaacctttattgtcagtaaataagtccacctcaacaccaacaagcccagggcccagaactcactccacccccagcatcccggtccttactgccggacagagtggcctatatagtccacagtatatctcttacattccacagatccacatgggccctgccgtgcaggctccccagatgtatccctaccctgtatcaaattctgtgccaggacagcaagggaaatacagaggcgctaaaggctcattacccccccagcggtcagatcagcatcagccggcttcagcgccgccaatgatgcaagcagccgccgcggctggcccgcctctggtggccgctaccccgtatagctcctatatcccttataacccgcagcaatttcctgggcagccagccatgatgcagcctatggcacattaccccagtcagcccgtgttcgcccctatgctgcaatctaacccccggatgctgacctctggatcacatccccaggctatcgttagctcctcaactcctcagtacccctcggccgagcagcccacgccacaggctctgtacgccacggtccatcagtcatatccccaccacgccactcagctgcacgcacatcagcctcagccggctactacccccactgggagtcagccccagtcccaacacgctgctccgtcaccagtgcagcaccaagcggggcaggccccacacctgggaagtgggcaaccgcagcaaaatctgtaccaccccggggcactcaccggcaccccacccagccttccccctggccctagcgcccagtctccacagtcctcttttccgcagcccgccgcggtgtatgctattcatcatcaacagctacctcacgggttcacaaacatggcccacgtcactcaagcacacgttcagacaggcatcaccgccgccccgccgcctcaccctggcgctccccaccccccccaagtgatgctccttcatcccccacagagccacggaggccccccacaaggggctgtcccacagtctggagttcctgctttatctgcctcgactcccagtccctacccctacatcgggcacccgcaagcccctctcccccctcctggcgagttgaagattgtactcgccgccacgtag

SEQ ID NO: 108852 - DNA, 3294 bp, Artificial Sequence
  Description of Artificial Sequence: Synthetic coding sequence
atgctgaagcctcaacccctccagcagccatcgcaaccccaacagccccctcctacacagcaggccgtcgccaggaggccaccgggcggtacctctcctcccaacggcggactgcctggaccacttgcaaccagcgctgcccccccgggaccacctgcagctgcgtccccctgcctggggcctgtcgcagcggcagggagcggcttacggaggggcgcagaaggcattctagccccccaacctcctcctccccaacagcatcaggaaaggcctggagctgccgcaatcggcagcgctcgaggacagagcacgggaaaaggtcctcctcagagccctgtgtttgaaggggtgtataacaattcacggatgctccactttcttacagcggtggttggctcaacatgcgacgtgaaggtgaagaacggaaccacatatgagggaattttcaagacacttagcagtaagttcgaactggccgtcgacgccgtacatcggaaggcctctgaaccggccggggggccgagaagagaagatatcgtggatacaatggtgttcaaaccatccgacgtgatgctagtgcatttcagaaatgtcgatttcaattacgcgactaaggacaagttcactgattccgccatagcgatgaacagtaaggttaacggtgagcacaaagaaaaggtgcttcaaaggtgggagggaggcgattcaaacagcgacgactacgacctggaatcagacatgtccaacgggtgggaccctaatgagatgtttaagttcaatgaggaaaattatggcgtcaaaacgacctacgatagcagcctctcatcatacactgtccccctcgagaaagacaacagtgaggagtttcggcagcgggagctcagagccgcccagcttgctcgtgaaattgagtcatctccccagtatagactgcggattgcgatggaaaacgatgacgggcgaaccgaggaggagaagcattctgcagtccagcggcagggatctggccgggaatccccttctttggcatcacgggaaggtaagtatattcctctgccacagcgggttcgtgaaggccctcggggaggagtgagatgctcttcatctcgtggtggtcggcctggcttatcttctctgccaccaaggggtccccatcatttggacaacagctccccgggcccaggcagcgaagccagggggataaatgggggtcccagcaggatgagcccaaaggcccagcgtccgctgaggggtgctaaaacacttagcagtccaagtaatcgcccctccggggagacgtccgtccccccaccacctgcagtcggaagaatgtatcctcccagatcacctaaatccgcggcacccgcccccataagcgcctcatgccccgaaccacctattgggtccgcagtgcctacgagttccgccagcataccagtcaccagctctgttagtgatcctggtgtaggcagcatcagccccgcatcccccaagatctcgctggcacccactgacgtcaaagaattatctaccaaagagcctggcagaaccctggaaccccaggaactggctcgcatcgcagggaaagtgcctggcctgcagaatgagcaaaagcggttccaactagaggaactccggaagtttggtgctcagttcaagctgcaaccctctagcagtcctgagaatagcttagaccctttcccccctaggatccttaaggaagaaccaaaaggcaaagaaaaagaagttgacggattgttaacttctgagcctatgggaagtccagtgtcttctaaaactgaatctgtgtccgataaggaagacaagccgcctctggccccctcaggcgggacagagggcccagaacagccaccacctccatgcccctcccagacagggtcacctccagtcgggctcattaagggagaggataaggatgagggtcccgtggccgagcaagtgaaaaagtcgacactcaacccaaatgccaaagagttcaatcctaccaaacccttgctgtcagtgaataaatccacctctacgcccacttcccctgggccacgcacacactccactccatctatacctgttttgacagccggccagagcgggctttacagcccgcagtatatctcctatatcccccaaattcacatgggccctgctgtccaggcaccacaaatgtacccctatcccgtgtctaactccgtcccgggccaacagggaaagtacaggggggccaaggggtccctgcctccccagcggtctgatcaacaccagccggcctctgctccacccatgatgcaagccgcagccgccgcgggtcctccgctggttgccgcaacgccctattccagctatatcccatataatcctcaacagtttcccggacaaccagccatgatgcaaccaatggcccactacccttcacagcccgtctttgccccgatgttacagagtaacccccgtatgctcacctctggcagtcacccccaggcaattgtaagttcctccactcctcaatacccaagcgctgaacagccgactccgcaggctctgtacgccaccgtgcatcagagctacccgcaccatgccactcagctccacgcccatcagccacagcccgctacaactccaacagggagccagccgcagtcacagcacgctgctcctagccctgtgcagcaccaggccggtcaggccccacacctcggaagtgggcaaccccagcaaaacctttatcacccaggcgcattgactgggactccgccatcccttcccccaggccctagtgctcaaagcccacagtcttcattcccccagccggctgcggtctatgccatccaccatcaacagctgcctcacggcttcaccaacatggctcacgttactcaggcacacgtgcagacaggcatcaccgccgccccccccccccatcccggagccccacatcctccccaagttatgttgctgcatcctcctcagagccatggcggtccgccacaaggggcagtgcctcaatccggagtgcctgcactgagtgcatctacacctagcccttacccttatattgggcaccctcagggagagcagccgggccaggctcctgggttccccggaggggcggacgacaggatcctctgcagggtcggccgctcccattcgagacgccggcagggactagccccggggtccgtgctgtgttttccaccgtcttcccttagctgtgatcccgccgcccctctgcctaccgcatctccagccttatccgatcctgattgcctgttgacgtag

SEQ ID NO: 108853 - DNA, 2679 bp, Artificial Sequence
  Description of Artificial Sequence: Synthetic coding sequence
atgagcgaacgcgccgctgatgacgtcagaggagaaccccgacgggcagcggctgctgcgggaggcgccgcggccgccgctgcccggcaacagcaacagcagcagcagcaacaacagccaccccccccacagccacagcggcagcagcatccaccaccaccaccccgcagaactcgccccgaggatggaggacccggcgctgcctcaacctctgctgctgctatggcaacggtcggggagcgccgaccattgccatcccctgaggttatgctgggacagtcttggaatctctgggtggaggcatcgaagctgcccgggaaggatggcaccgagttggatgagagcttcaaagagttcggcaagaaccgcgaggttatgggcctgtgcagggaggatatgcctatcttcgggttttgtcctgcacacgatgacttctacctggtcgtgtgcaacgactgcaaccaggtggtgaaaccgcaggcgttccagagtcactatgaacgaaggcatagcagcagctccaagccgcctctagccgtccctcctaccagcgtgttctctttctttccatccctatccaagtcaaaaggcgggagtgccagtggtagtaatcgatcctcatccgggggtgtccttagtgcctcatcatcctccagcaagttgcttaaaagtccgaaagaaaagctccaattgcgcgggaatacacgccctatgcaccctatacagcagtctcgagtgccccatggaagaatcatgacgcccagcgtgaaagtcgaaaaaattcaccctaagatggacggaacactcctgaaaagcgccgtgggacccacctgtcccgccactgtgagctccttggtgaagcctggtttaaactgtccttcaatcccgaagccaaccctgccgtccccgggacagattctcaacggcaaaggcttgcccgccccacccaccctcgagaagaagcctgaggataatagtaacaacaggaaattcttaaacaaacgcctttctgagcgggagttcgatcccgatatccactgcggggttatcgatctagataccaaaaagccttgtactcgctctctaacttgtaagactcattccctgacccagcggcgggctgtccaggggagacggaagcgctttgatgtgctcttagccgagcacaagaacaaaactcgagagaaagagctgatccgccaccccgatagccagcagcctccccagcccctcagggacccccaccctgcaccccctaggactagtcaggaacctcaccagaacccacacggtgtcatcccttcagagagtaagcctttcgtggccagcaaacctaagccacataccccaagcctccccagaccgccaggctgccccgcccagcaggggggatcagccccgatcgaccctcccccagtgcacgagtcaccacacccgcctttgccagctaccgagcccgcatccagactgagcagcgaagagggcgaaggagatgacaaagaagagtccgtggagaaacttgactgtcattacagcggacaccacccccaaccagccagcttctgcacattcggctctcggcagatcggccgcggttattacgtcttcgatagtcgctggaacaggttgcgatgtgccctgaacctgatggtggagaagcatttaaatgctcagctgtggaagaagatcccccccgttccatcaactaccagccccatctccactaggatcccgcaccggacgaattccgtccccacctcccaatgcggggtttcctatctagcagccgctacagtgagcactagtcccgtgctccttagttcaacatgtatatccccgaacagcaagtctgttcccgctcatggtaccactctgaacgcacagcccgccgcctccggcgcaatggacccagtctgctcaatgcagagtcgacaagtctcatccagctcaagcagcccgtccacaccatcgggactgtcttccgtgcctagctctccaatgagccggaaaccacagaagctgaaatccagcaaatcccttcgacccaaggagtcttcaggcaacagcacaaactgtcagaacgcgtcctcatccacgagcggtggatcagggaagaagagaaaaaacagcagcccattgctagtgcactcctcgtcctcctcctcgtcctcttcatccagcagccactccatggaatcattccgcaagaactgtgttgcccactctgggccaccttacccgtctacagttacatcctcccacagcatcggtttaaattgcgtcacaaataaggccaacgccgtgaacgttcggcatgatcagtccggtagagggccccccaccgggagccccgccgagtctataaagcgtatgtctgtcatggtgaacagttcagactccactctgtctctgggacctttcatccaccagtcaaacgagctccccgtgaattcacacggctcgttctcccacagccacacgcctctggataagctgatcggcaaaaagcgcaagtgctctccgagttcaagtagcatcaacaattcctcttcaaagcccacgaaggtcgccaaggtccccgccgtcaataatgtccacatgaaacatacagggacaataccaggcgcacagggcctgatgaactcctctttgctgcaccaacccaaagctcggccctag

SEQ ID NO: 108854 - DNA, 2838 bp, Artificial Sequence
  Description of Artificial Sequence: Synthetic coding sequence
atgagcgagcgagcagctgacgatgtcaggggcgagcccagaagagcggcagccgcggccggaggtgctgccgctgcagctgcacgacaacagcagcagcaacaacagcagcagcagccaccacctccccagccccagcggcaacaacaccccccaccaccaccacggcggacccggcccgaagacgggggaccaggggctgccagcacaagtgctgccgctatggcgacagtgggcgaaagacggcccttaccctcgccggaggtgatgttggggcagtcatggaatctgtgggtggaggccagtaagctgcccggcaaggacggcaccgaactggatgagtcttttaaggagttcggcaaaaacagggaggtcatgggcctgtgtagggaagacatgcccatatttgggttctgtccggctcatgacgatttttacttggtggtgtgcaatgattgcaaccaggtagtaaagccccaggcttttcagagtcactatgaacgtcggcacagtagtagttcgaaaccgccactcgccgtaccacctacctctgttttcagtttcttccccagcctcagcaagagcaaaggagggagcgccagcggttcgaaccggtccagcagcgggggggtcttgtcggcgagttcatcttcaagtaaactgcttaaaagtcctaaagaaaagctgcagttgcgaggcaataccagacccatgcatccgatccaacagagcagagttccgcacggtcgaatcatgaccccttctgtgaaggtggagaagatacatcctaaaatggacgggaccctgctcaaaagcgcggtgggtccaacttgcccagctaccgtgtcttccttagtaaaacctggtcttaactgcccttccataccgaagcctaccctgccctccccaggacagattctgaacggaaaagggttacccgccccgcctactctggaaaaaaagccagaggacaactccaacaataggaaattcctgaataaaagactgagtgagcgcgaattcgatccagacatccattgtggagtcatcgacttagataccaagaagccatgcacaaggtccttaacgtgtaaaacccatagccttacccagcggagggccgtgcagggtcgccgaaagagatttgatgtgttgctagccgagcataagaataaaacccgcgagaaggaactgatcaggcacccagatagccagcagcccccacaacccctccgagacccccacccggctcccccgcgaacaagccaggagccacatcagaacccccacggcgtgatccctagtgagagcaagcccttcgttgcaagcaagcccaagccccatactccatctctcccaaggccacctgggtgccccgcacagcagggagggtccgcacccattgatccaccgcctgttcatgaatcaccgcacccgccactgcctgccacagaacccgccagcaggctatcctctgaggagggagagggagacgataaagaggagtccgtagagaagttggattgtcattacagcgggcatcacccacagccggcttccttctgtaccttcggaagtcggcagataggtcggggttactatgtcttcgattctcgttggaaccgccttcgctgtgcgctaaatcttatggtcgaaaaacatttgaacgctcagctatggaagaaaatacctcccgtgcctagcactacctcaccaatttccactaggatcccacatagaacaaactcggtgcctacttcccagtgcggggtgtcatacctcgcagcggccaccgtgtcaacctctcctgtactgctgtcatccacatgtataagccccaatagtaaatctgtgccagcccatggcaccactctcaacgcccagcctgccgcaagcggcgccatggatccagtctgctcgatgcagtctaggcaggtcagctcctcttcttcttcgccttcgaccccctctggcctcagctcagtcccaagttcgccgatgtcccgtaaaccccagaaactgaaatctagtaaaagcttgaggcctaaggaatctagcggaaacagcacaaattgtcagaacgcttcttctagcacctcgggcggtagcggaaagaagcggaagaactcaagccccctgttggttcactcatcatccagctcatcttcatcctcttccagtagtcatagtatggagagcttcagaaaaaattgcgtggctcattccggcccaccttatccatcgaccgtgacctccagccactcaatcggcctaaactgtgtgaccaacaaggctaatgcggtcaatgtgcgccacgaccagtccggccggggccctcctaccgggtcgcccgccgagtcgattaagaggatgtctgtcatggtgaactcttctgatagtaccttaagcttaggacctttcatccatcaatcgaacgagttgccagtgaattctcacggatccttttctcactctcacacaccactggacaaactcattggcaagaagcgcaagtgttctccaagctcctcaagtatcaataattcctcctcaaagcccactaaggtggcaaaagttcctgcggtgaataatgtccacatgaagcacacaggcacaatcccaggcgcccagggactcatgaacagttccttgttgcaccaggatattagcagcccatgcctgcgcactggcatatccgctacgtctccgcaaagccccgatctgaagtccaaagggacttctcttaccgccgagaacagcacaggaaggaataacgcggacacatttgaggacaagttacatctccactcagccctgtggactcccaggtgcctgtag

SEQ ID NO: 108855 - DNA, 81 bp, Artificial Sequence
  Description of Artificial Sequence: Synthetic coding sequence
atgtccgagagggccgctgatgacgtgaggggtgagccaagacgcgccgcggccgccgctggaggggcagccgctgcctag

SEQ ID NO: 108856 - DNA, 2679 bp, Artificial Sequence
  Description of Artificial Sequence: Synthetic coding sequence
atgtcagagcgtgccgctgacgacgtccgcggggagccacgtagggccgctgcagctgcggggggagccgcagcagccgccgcgcggcaacagcaacagcagcaacagcaacagcaaccgccgcctccccaaccacaaaggcagcagcatcccccgccacccccgcgaagaactcgaccggaggatggggggccaggcgctgcatctactagcgcagcagctatggccacggtgggggagagaagaccacttcctagccctgaggttatgttggggcaatcatggaacctgtgggtggaagccagcaaattgccaggaaaagacgggacagaattggacgaaagttttaaagagtttggcaagaatcgggaggtgatgggtctttgcagagaggacatgccaatctttggattttgtccggctcatgatgacttttacttggttgtgtgtaatgactgtaaccaggttgtcaagccacaggcgtttcagtctcactatgaacggcggcatagctctagctctaagccccctttggcagtgcctccaacaagcgtgtttagctttttccctagtttgagtaaaagcaagggcgggagtgcttctggatccaatcgctcatcttctgggggtgtgctttctgccagctcttcatcctccaagcttctgaagtccccaaaggagaaattgcaattacgcggaaatacacgcccgatgcatcccattcagcaatccagagttccccatggcaggattatgacaccctccgtgaaggtggagaagattcaccctaagatggacggaacacttcttaagtccgccgtaggacctacatgtcccgcaaccgtgagcagcctggtgaaacccggactaaattgcccaagtatacctaagccaacactcccctcaccaggacagatcctaaacggaaagggccttcctgcgccaccaaccctcgagaagaagcctgaagataatagcaataatcgcaagtttctgaataaacgcctcagcgaacgcgagttcgacccagacatccactgcggcgtcattgatctggacacaaaaaagccctgtacacgatctctgacttgtaaaacgcactccctcacacaaaggagagccgtgcaaggacggagaaagaggtttgacgtccttttggcagaacacaaaaacaagaccagagaaaaagaactgatcagacaccccgactcacagcaaccacctcaacctctaagagatcctcatcctgctcccccaaggacctctcaggagccgcatcagaacccccatggggttattccttccgaatccaaacctttcgtggcatccaaacctaaacctcatacaccatcgctcccacgcccccccgggtgccctgcacagcagggcggtagtgcacccattgacccaccccccgtccacgagtcaccccacccgcccctccctgcaacagagcccgcctctaggctttctagtgaagaaggggagggtgacgataaagaggagtccgtggagaaactcgattgccactatagcggccatcacccacagcccgcctccttttgcacattcggcagccggcagataggtcggggctactacgtcttcgactcccgttggaatagacttcgttgcgccctgaacttgatggtcgaaaagcatttgaacgcacaactctggaaaaaaataccgcccgtaccaagtacgacctcccccattagcacacgcattccacatagaacaaacagcgtgccaacctcccagtgcggagtcagttatctggccgccgcaactgtgagcacaagtcctgtcttgttgagctccacttgcattagcccgaattcaaagtcagtccccgcacacggaacaaccctgaacgcccaaccagcagccagtggagcaatggacccagtgtgtagcatgcagtcacggcaagtctcatcctctagctcgtcacccagcacgccaagtggactcagtagcgtaccctcttctccgatgtctagaaagccccagaagttgaaaagcagcaagtcgctccgtccaaaagagagctccggcaattccacaaactgccagaatgcctcctcctcaacttcaggcgggagcggaaaaaaaaggaaaaactcctccccactgctggtgcactctagctcaagtagttcctcctcctcatcatcctctcattcaatggaaagcttccgcaagaattgcgtggcgcactctgggccaccatacccatctacagtgaccagcagtcactcaattggcttaaactgcgttaccaataaagccaacgccgttaatgtgcgccacgaccagagtggacgcggaccccccacaggaagccctgctgagtccatcaaacgaatgtcagtgatggttaactcatccgactcaactctgtcactaggcccctttattcaccagtcgaacgagctgcccgtaaacagccacgggtccttctcccacagtcacactcccctcgacaagctgattggaaaaaagcgcaagtgcagcccgtcatcgagctccattaacaatagctcttctaagccaacaaaggtagccaaagtgcctgccgttaataatgtccatatgaaacatacaggaaccataccgggagcccagggccttatgaactccagtctgctgcatcaacccaaagcaaggccatag

SEQ ID NO: 108857 - DNA, 2838 bp, Artificial Sequence
  Description of Artificial Sequence: Synthetic coding sequence
atgagcgaacgagccgctgacgatgtgcggggagaaccgcggcgggctgcggcagctgccggcggcgccgcagcggctgcagcacgtcagcaacagcaacagcagcagcagcagcagccaccaccacctcagcctcagcgccaacagcatccaccacccccaccgcgccgcacaaggcctgaggacgggggacccggagccgcctcaacatctgctgcggccatggccaccgtcggcgaacgccgtccattgcccagcccagaggtgatgctaggccaatcatggaatctgtgggtcgaggcgagtaagctgccgggcaaagatggcaccgaactggacgagtccttcaaagagtttggaaagaaccgggaggtcatgggcctttgtagagaggacatgcctatattcggcttctgcccagcccacgacgatttctacttggtggtgtgcaacgattgcaaccaggtagttaaaccacaggctttccaatctcattacgagcggagacattcttcaagttctaagccaccactcgcagtccctcctaccagcgtgttcagctttttcccttccttgtcgaaaagtaagggaggaagcgcgtcaggttcaaatcgatcgtccagtggcggagtgctgtctgcatcatcaagctcttcgaaactcctcaagagccctaaggagaaactacaactaagagggaatacacggccgatgcatccgatccagcaatccagggtaccacatggccgcattatgaccccgtcagtcaaggtggagaaaatacacccgaaaatggacggcacactcctgaaatcggcggttgggcctacttgccctgctaccgtatcatccctggttaaacctggcctgaactgccctagtattcccaaaccaacactgcctagtcctggacaaattctgaacggcaaggggctgccagccccacccacactggagaagaagcctgaagacaacagtaataatcgcaaattcctgaacaagcgtctctccgagcgagagtttgatccagatatccactgtggggttatcgatctcgatacgaagaaaccatgcacccgtagcctgacctgtaaaactcattcgctaacccagagacgcgcggttcagggaagacgaaagcggtttgatgtcctacttgcagagcacaagaataaaacacgggaaaaggaattgatcagacatccagattcgcagcagcctccccagccactgagggaccctcatccggcaccaccacgcaccagccaggagccacatcagaatccacacggtgtaattccgagcgaaagcaagcctttcgtcgcatccaaacctaagccacacactccatcgctgccaagacctccgggctgccccgctcagcagggaggaagtgcccccatcgatcctcctccggtgcacgagagcccccacccccccctgccggccaccgaacccgcgagtcgattgtcatctgaggagggggagggcgatgacaaggaggagtcagtcgagaaactggactgtcattacagtggtcaccacccgcagccggccagcttttgcactttcggaagccggcagattgggagaggttattacgttttcgacagccgctggaatcgtctaagatgcgccttaaatctcatggtggaaaagcatctgaatgcgcagctgtggaagaaaatcccccccgtaccttctacaacatcaccaatcagcacaagaatccctcatcggacgaactccgtgccaacgtcacagtgtggggttagctatctcgccgcggcaactgtgtctacatcccccgtgctcttaagtagcacctgtatctcccctaacagtaaaagcgtgccagcacatggtacaactctaaacgcccagcccgccgcatcaggagccatggaccccgtatgctccatgcaaagtcgccaggtcagctcctcgagctcaagcccttcaaccccctccggcctgagcagcgttccaagttccccaatgtcccggaaaccccagaagttaaaatcttcgaaaagcctccgccctaaggagtcaagcgggaatagcactaattgccagaacgcctccagttcgacttctggcgggtctggtaagaagcgcaagaactcctctccactactggtacattcctcaagttcatcgtcaagcagctccagttcttcccattccatggagagcttcaggaaaaattgcgtcgctcactcaggccccccttatccatccactgtcacaagcagccatagcattggcttgaactgtgtgaccaataaagcaaatgcagtgaacgttcgccatgaccagagtggaaggggcccgccgactggcagtcctgctgagtcgatcaaacgaatgagcgtcatggtgaactcctcagactccactttgagcctaggtcccttcatccaccagagcaatgagctgcccgttaacagtcatggttctttttcccattcccacactccccttgataagcttatcggcaaaaagcgcaagtgctccccatcatcatcaagtatcaacaactccagctctaagccgacgaaagtcgctaaagtgccagccgtcaataatgtacacatgaagcataccggcactatcccaggcgcccagggcctcatgaactcctcattgctccatcaggatatttcctcaccctgcctccgaacaggaatttccgctactagtccacaatcccccgacttaaaaagcaaaggcacaagcttgacagccgagaattcaacagggagaaataatgccgataccttcgaagacaagctgcacctccattcagcactgtggaccccacgctgtctgtag

SEQ ID NO: 108858 - DNA, 393 bp, Artificial Sequence
  Description of Artificial Sequence: Synthetic coding sequence
atgtccgagcgggcagcagatgatgtgagaggcgaaccccggcgggcggcggctgccgcaggcggtgccgccgctgcggctgcccggcagcagcagcagcagcagcaacagcagcaaccaccccccccacaacctcaacgacaacagcacccgccccctccccctcggaggactaggccggaagatggtggtcccggagcggcatccacctccgctgccgcaatggcgaccgtaggtgagcgtcgcccccttccttcccctgaggtgatgttaggtcagtcgtggaacctgtgggtggaagcaagcaagctgccgggcaaggatggtgataggataggtcggaagtttcaaggcgtgtggaatcgggaagtcatgggcctgtgccgtgagtag

SEQ ID NO: 108859 - DNA, 2244 bp, Artificial Sequence
  Description of Artificial Sequence: Synthetic coding sequence
atggagggctctaaaacaccactccagtcctcaccatctgctcaggagctgaaggctccactggaaaggagacacagtagctctagtaagccaccactggcagtacctcctactagtgtatttagtttctttccaagcctcagcaagagcaaaggcggtagcgcttccggcagcaaccgcagttcaagtggtggagtgctgtcagcttcatcctcctcctcaaaactactcaagtcacccaaggagaaactgcaactgcgcggcaatacacggcctatgcaccccattcagcagtctagggtcccacacgggagaatcatgacccctagcgtgaaagtagagaagatccaccctaaaatggatggcaccttgctaaagtcagcggtggggcctacctgtcccgccaccgtaagcagcctggtaaagccgggcctgaattgtccgagcatccctaaacctacactccctagccccggtcagattttaaacgggaagggactgcccgccccgcccacactcgagaagaagccagaggataactccaataataggaagtttctgaataagagactctctgaaagagagttcgaccctgatattcactgtggcgtgatcgatctggacaccaagaaaccatgtactagatccctcacctgtaagacacatagtctaactcagcgcagagctgtccaggggcggagaaagcggtttgacgttttactggccgaacataagaataagactagggaaaaagagcttataagacacccagattcccagcagcccccacagcctctgagggacccccacccagcccccccgcgcacgtctcaggagccccaccagaacccgcatggcgtcattccatcggaaagtaagccttttgtagcctctaagcccaagccccacacaccaagcctgcctagaccccccgggtgcccagcccaacagggtggttcagctccaatcgaccctccccccgtacatgaatcgccccatcctcctttgcccgctacagagcccgctagtcgtctctctagcgaggaaggggagggggacgacaaggaagaaagcgtggagaaactggattgtcattactccggacaccacccgcagccagcatctttttgtacctttggtagcaggcagatcggaagaggttactacgtcttcgactcaaggtggaaccggttgcggtgcgcgctgaacttgatggttgagaagcatctgaacgcccaactttggaaaaaaataccccctgtgccttccacaacttctcccatctcaacccgaatcccccatcggacgaacagcgtgcctacttctcagtgtggtgtgagctacctcgcggccgccaccgtgtccacttctcccgtgctgctgagcagcacctgcatctcccctaacagtaaatcagtgcccgcccacggcacaacacttaatgctcagcctgccgcctctggcgccatggaccctgtctgcagcatgcaatcccggcaggtgtcttccagctcttctagcccatctacgccatccggtctgtcttccgtgcctagcagccccatgtcacgaaagccacaaaaattaaaatccagcaagtccctcagaccgaaggagagttcaggtaatagcaccaactgccagaacgcatcaagctccaccagtgggggctcaggtaaaaagcggaagaattcctctccattactggtacacagctcctcatcgagcagttccagcagcagttcttcccattctatggaaagctttagaaaaaattgcgtggcgcatagtgggcccccatatccatcaactgtaacttcctcacattccatcgggcttaactgcgtcacaaataaagctaacgccgtgaacgtcagacacgaccagagcggccgcggtccccccacaggttctcccgcagagtccatcaaacgaatgtcagtcatggtcaattctagtgactctacactgtcccttggtccttttatccaccagagcaacgaactgccggtaaattctcatgggtcattctcccatagccacacacctctggacaagctgatcggaaaaaaaagaaagtgttctccctccagtagttctatcaataactcgtcctccaagccaaccaaggtggcaaaagtacccgcagtgaataacgtccacatgaagcacactggtacaatccccggggcccagggactgatgaactcatcccttctgcaccaaccaaaagccagaccatag

SEQ ID NO: 108860 - DNA, 663 bp, Artificial Sequence
  Description of Artificial Sequence: Synthetic coding sequence
atggaggaagacgaatttatcggggagaaaacattccagcgttactgcgctgaattcataaaacatagccaacagataggcgatagctgggagtggagaccctcaaaggactgcagtgacggttatatgtgcaaaatccactttcagatcaagaacggctcagtgatgagtcacttaggcgcttcaacccacggtcagacttgtcttccaatggaggaggctttcgaactgccgttggatgattgcgaggttatcgaaacagccgccgcgtccgaggtaattaaatatgagtaccacgtgttgtacagctgctcttatcaagtcccagtactgtatttcagagcgtcattccttgatggccggcctctgactcttaaagacatctgggagggcgtacacgaatgctataagatgcgcctgcttcagggtccctgggacacaatcacccagcaggagcaccctatcctcggccagccatttttcgttttgcatccctgtaaaacaaatgagtttatgacaccagtccttaagaatagtcagaaaattaacaaaaacgtgaactacattactagctggctctctattgttggacctgtcgtgggactgaacctccctctgtcatatgccaaagctacaagtcaggatgagcggaacgtcccttag

SEQ ID NO: 108861 - DNA, 378 bp, Artificial Sequence
  Description of Artificial Sequence: Synthetic coding sequence
atggaagaggacgagtttatcggggaaaaaacttttcagcgatactgcgccgagttcattaagcactctcaacagataggcgattcttgggagtggcgaccttccaaggactgctcagacggatacatgtgcaaaatccattttcaaattaaaaatggtagcgtgatgagccacctgggcgcgagtacgcatggacaaacttgccttcctatggaagtaaagtcgtgtagcgtgactcaagctggagtacagttgagagacctttccagcttgcaacccccgcccagcgggttcaaacaattcagttgcctgtccctcccaagtaactgggactatcgtgggtcccccctgcacctggcaaacttcttgtatttctag

SEQ ID NO: 108862 - DNA, 663 bp, Artificial Sequence
  Description of Artificial Sequence: Synthetic coding sequence
atggaggaagacgaatttatcggggagaaaacgttccaacgctactgcgcagagtttattaaacacagtcaacagattggggattcttgggaatggcgaccttcgaaggactgctcagatggctacatgtgcaagatccatttccagatcaagaatggatccgtaatgagtcaccttggtgcttcgacacacgggcagacatgcctgcccatggaggaagcattcgagttgcctttggacgattgcgaggtgatagagacagctgctgcgtccgaggtcataaaatatgagtatcacgtgctgtattcatgtagctatcaggtgcctgtgttatacttcagagcctccttcctggacggccgcccgttaactctgaaggacatttgggagggcgtgcacgaatgctacaagatgcgcctcctgcaaggcccatgggacaccatcacccagcaagaacatccaatactgggacaacctttcttcgtgctacacccttgtaagacaaacgagttcatgacacctgtcttaaagaatagccaaaagattaataaaaacgtgaactacattaccagctggttgtcaatcgtcggaccggtcgtgggcctcaacctccccttgtcatacgcaaaagcaacctcccaggacgagcgcaacgtgccatag

SEQ ID NO: 108863 - DNA, 882 bp, Artificial Sequence
  Description of Artificial Sequence: Synthetic coding sequence
atggaccggagagtcaagctttgggaggtgtttggtgagaagtgcgaattcaagggtagcctcagcggctcaaacgccgggatcacatcgatagaattcgatagtgctggtagctatttgctcgccgcttccaatgactttgcgagtaggatttggactgtagatgattaccgtttgcggcataccctgacaggccacagtggcaaagtactcagcgctaagtttctactggataacgccaggattgtaagcggatcacacgaccggactcttaagctttgggatctcaggtccaaagtgtgcatcaagactgtcttcgccggctctagttgtaatgatattgtctgcaccgaacagtgcgtcatgtctgggcacttcgataagaagattcgtttctgggacatcagatccgagtctatcgtgcgcgaaatggagctgctgggaaagataacagccctggatttgaaccctgagcgtaccgagctgttgagctgttcaagagacgacctgcttaaggtcatcgatctccggaccaatgccattaagcagacatttagcgcacccggcttcaagtgtgggtcagactggacccgggtcgtattttccccagatggaagttatgtcgcagcggggagtgccgagggctcactgtacatctggtcagtcctcactggtaaagtggagaaggtgctttccagcagcacagcccaccccagcatgcggtggagggggcgcccactcgcgcgcactctctctgtctggactaaggatgcaaaattatgctgtggccactcaacggacggggccttgcgtgctgggcgaaccccggttccaagctcagaagaggcacacggcctcctgcagccatgcccaggacgatag

SEQ ID NO: 108864 - DNA, 1335 bp, Artificial Sequence
  Description of Artificial Sequence: Synthetic coding sequence
atgagcagcgggctgcgcgctgccgattttcccaggtggaagcggcatatctctgagcagctgagacgcagggacaggctccaaagacaggcctttgaggagattatcctccagtataacaagttgctcgagaagagcgacctccatagtgttctggcccagaagcttcaagcagaaaaacacgatgttcccaacagacacgaaataaggcggcggcaggctagattgcagaaggagcttgctgaggccgccaaggaacctctacctgtcgagcaggatgatgacatcgaggtcatagtggatgagactagcgaccatacggaagaaacctctcccgttcgtgcaatctccagagccgccactagacgttctgtttcctctttccctgtgccccaagacaatgtggacacccatcctgggagcggcaaagaagtgcgggtgcctgcgacggcactatgcgtgtttgatgcgcacgacggggaggtcaacgccgtgcagttttcacccgggtctcgattactcgcaacagggggtatggaccgccgcgtgaagttgtgggaagtgttcggagagaagtgcgaatttaaaggctccctctctggaagtaacgctgggatcaccagcatcgaatttgattcggccgggagttatctactggctgcaagtaacgattttgcttcccggatttggactgtcgacgattatcggctgaggcatactctgaccgggcactctggtaaagtgctttccgcaaagttcctgctggacaacgcccgcatcgtgtctgggtcgcatgataggaccttgaagctctgggatctgaggtcaaaggtctgtattaaaaccgtgtttgcaggcagcagttgcaacgacattgtttgcactgagcagtgcgttatgagcggacactttgataagaagatcagattttgggacatcaggagtgaaagtatagtgagggagatggaactactgggtaaaatcacagccctagacctcaacccggagcggaccgagttactatcctgctcacgcgatgatttactcaaggtgatcgacctgcgcacgaatgctatcaaacaaacattttctgcccctgggttcaagtgtggatccgattggacacgagtggttttcagcccagacggctcgtacgtagctgccgggagtgcagagggctccctgtatatatggagcgtgctgacggggaaggtggagaaggtcctctctaaacagcattcttccagtattaacgccgttgcgtggtcaccctctggttcccacgtggtgtcggtggacaaaggttgcaaagcagttctctgggcacagtattag

SEQ ID NO: 108865 - DNA, 1287 bp, Artificial Sequence
  Description of Artificial Sequence: Synthetic coding sequence
atgtcatcggggctccgcgcagcagacttccctagatggaagcggcacatttcagagcagctgcgacgccgggacagactccagcgccaagcctttgaggagatcattttgcagtataacaaactgcttgaaaagtctgacctgcacagcgtgctggcccagaagcttcaggcggagaagcacgacgttcctaacaggcatgaaatacgacgaagacaggcccggctgcagaaagagctggccgaggccgctaaggaaccacttccagtggagcaagacgatgacattgaggtgatagtcgacgaaacctccgaccataccgaggaaacttcacccgtgcgggcgattagcagagccgcgaccaaaaggctttcccagcctgcaggagggctgctggatagcataactaacatattcggtcgacgcagcgtgagcagcttcccagttccccaggacaatgtagacacccacccaggatccggtaaagaagtcagggttccagctaccgccctgtgtgtcttcgatgcccacgatggggaagtgaacgccgttcaattctctcctggtataacatctatagagtttgacagcgcaggctcatacctcctagccgcttctaacgatttcgcgtcccgaatctggacagtagacgactacagacttagacataccctcacaggacatagcggaaaggtgctgtcggcaaagttcctcctggataacgctagaattgtatcaggtagtcacgaccgcactttgaagctgtgggacctccggtcaaaagtctgtatcaagaccgtgtttgcgggatctagttgcaacgacatcgtgtgtaccgaacagtgcgtcatgtctgggcacttcgacaaaaaaattcggttctgggacatcaggtctgagagcatcgttcgagaaatggaactcctgggaaagattactgccctagacctgaacccagaaaggaccgaattgctgagttgcagccgcgatgatcttcttaaggtgatcgatctccgaaccaacgccattaagcagacattttcagctccgggttttaagtgtggctccgattggacgcgggtggtgttctctcccgatggcagttacgttgcagcaggctctgccgagggtagcttgtatatttggtccgtgttaacaggcaaagttgaaaaagtgctctccaagcaacactctagcagtattaacgcagtggcctggagcccatccggatcccacgttgtgtctgtagacaagggatgtaaggctgtgctctgggcccagtactag

SEQ ID NO: 108866 - DNA, 1824 bp, Artificial Sequence
  Description of Artificial Sequence: Synthetic coding sequence
atgagttctggactgcgcgccgccgactttccacgatggaaacgacacatcagtgagcagctccggaggcgtgaccggcttcagcgccaggcattcgaggagatcatcctgcagtacaataagctcctcgaaaaatcagaccttcattctgtgctggcacagaaacttcaggctgaaaagcacgacgtacctaaccgtcatgagatctctcccggccatgatgggacctggaacgacaaccagctccaggaaatggcacagctgaggatcaagcaccaggaggaactgactgagctccacaagaagcgaggggaactcgctcagctcgtgattgaccttaataatcagatgcagcggaaagaccgcgaaatgcagatgaatgaggccaaaattgccgagtgcttgcaaacaatctctgatctggaaaccgagtgtcttgacttgaggacaaaactctgcgacttggagcgcgcgaaccaaacactgaaggacgagtacgacgcactgcagatcacttttactgccctcgaggggaaactgagaaaaactaccgaagaaaaccaggaactcgtaacgaggtggatggctgaaaaggcccaggaggcaaatagacttaacgccgaaaacgagaaagactcgcgtaggcggcaggcccggcttcagaaagaactcgctgaagccgctaaagaacctttgccggtcgagcaggacgatgatatagaggtgattgtcgatgagacctcagatcacactgaagaaacatccccagtgagggccatctcaagagcggccacaaagaggctcagtcagccagccggagggctgctggacagtattaccaatatcttcggtaggcgcagtgtgtcctcctttccagtgccccaggataatgttgatacgcaccctggcagcggaaaagaagtcagagtgcccgccaccgcactgtgcgtgtttgatgcccatgacggagaggtgaacgctgtgcaattctctccagggtcacgcctcctagccacaggaggaatggaccggagggtgaagttgtgggaggtgtttggcgagaaatgcgagtttaaaggatctctaagcggtagcaacgcaggaatcactagcattgaatttgactccgcgggctcctacctcttagcggcaagtaacgacttcgcctcccgaatttggacagttgacgattatcgactgcgccacactctgacgggacactcagggaaagtgttgtctgctaaatttctgcttgacaacgcccgtatcgtctcaggatcccatgatcgtacattgaagctctgggacctgcgatcgaaggtttgtatcaagactgtctttgccggatcaagttgtaacgacattgtctgtacagagcagtgtgtgatgtcaggtcactttgataagaaaatacgtttctgggacatccggtctgaatctatcgtgcgagagatggagcttctcggcaagataacagctctggatctaaacccagaacgtacagagttgctgtcgtgttcaagagacgaccttcttaaggttattgacctgcgtaccaatgccatcaagcagaccttttccgccccaggcttcaagtgcggctccgactggacccgagttgttttctcacctgacggaagctatgtggctgcaggctccgctgaggggtccttgtatatttggtctgtccttacggggaaagttgagaaggtgctgagtaagcaacatagcagcagtatcaatgccgtcgcatggagcccctcgggttcccacgtggtgtccgtggacaaaggctgcaaggctgtcctgtgggcccagtactag

SEQ ID NO: 108867 - DNA, 1875 bp, Artificial Sequence
  Description of Artificial Sequence: Synthetic coding sequence
atgtcgagtggcctgagggctgctgatttcccgagatggaagcggcacatctcagagcaattgcgccggagagatagactgcagagacaggcttttgaggagataattcttcagtacaacaaattactggagaagtcggatcttcacagtgtgcttgctcaaaagcttcaagctgagaagcatgatgtccctaaccggcacgagatttcaccgggccatgatggcacatggaacgacaaccaactccaagagatggcccagcttcgaatcaaacaccaggaggaattgacagagcttcacaagaaacgtggcgaactggcacagctcgtgatcgacctgaataatcaaatgcaacggaaagatcgcgaaatgcaaatgaatgaggctaagatcgccgaatgcctgcagactataagcgacctagagacggagtgcttagatctccggacgaagctttgtgaccttgagcgcgctaatcagacccttaaggacgagtatgatgcccttcagatcacatttacagccctagaaggaaagctgcgcaagaccacagaagagaaccaggagttagttaccagatggatggcagaaaaggctcaggaagctaataggttgaacgcggagaacgagaaagacagccgcagaaggcaggcacgattgcaaaaggaactcgccgaagcagcaaaggagccccttccagtggagcaggacgatgatatcgaagttatcgtagatgaaacgagcgaccacactgaggaaacctcacctgtgcgtgctattagccgggcagcgactaagagactaagccagccggcaggagggctccttgactccattaccaacatcttcggtttgtcagaatctcctcttctggggcaccactcaagttcggatgccgcccgacgtcgcagcgtgtctagcttcccggtgccacaagataatgtggatacccaccccggcagtgggaaggaagtgagggtgcccgctacagctttatgtgtgttcgatgcacacgatggcgaggtgaatgctgtgcagttttcgccgggctctaggttactcgcaaccggagggatggacaggagggttaagctgtgggaagtattcggcgaaaaatgcgagtttaaagggagcctgagtggcagcaacgccggaataacatccattgaattcgactctgcggggtcctacctgctcgctgcaagtaacgatttcgcctcccgcatctggacagtggacgattacagattacgccacactctcaccggacatagtggaaaggttctgagcgccaaattcctccttgacaacgcgaggattgtgagtggctcacatgatcggactcttaaactctgggacctgagatcaaaagtgtgcattaagaccgtgtttgctgggagctcctgcaacgacatagtgtgtacagaacagtgcgtgatgagcgggcactttgacaagaagattcgattttgggatatccggagtgagtcaatcgtgagagagatggagctattgggcaaaatcactgcactggacctaaatcccgagcgcaccgagctgctgagctgtagtcgagatgacctgcttaaagtgatcgacttgcgcactaacgccatcaagcagacatttagtgcgcctggattcaagtgtgggtctgactggacacgggtcgtcttctcccctgacggcagttacgtggccgccggatcggccgagggctctctgtacatctggagtgtccttacagggaaggtggaaaaggtcctgtctaagcagcacagctcaagcataaacgccgtggcctggtcaccctctggcagccacgtggtctccgtggacaagggctgtaaggctgtgctctgggcacagtactag

SEQ ID NO: 108868 - DNA, 1767 bp, Artificial Sequence
  Description of Artificial Sequence: Synthetic coding sequence
atgagttccggactaagggcggcagacttcccgagatggaagcgccacatctctgaacaattacgtcgccgggataggcttcagcgccaggccttcgaagagatcatcttacaatacaacaaattacttgaaaagtctgatctacatagcgtgcttgcacagaaacttcaggccgagaaacacgacgtccctaacagacatgaaataagcccagggcacgacggaacatggaatgataatcagctgcaggaaatggctcagcttcggatcaaacaccaggaagaattgactgagctacataaaaagcgaggggaactcgcacagctggtgattgatttaaacaaccagatgcagcgcaaagaccgagagatgcagatgaatgaagcgaagattgcggagtgtttacagactatatccgatcttgaaactgaatgcctggatttgaggacgaagttgtgtgatctggaacgcgcgaaccagacgctgaaggatgagtatgacgccctccagatcacttttacagcactggagggcaaactcaggaaaaccaccgaggagaaccaggaactggtaacgcgttggatggcagagaaggcacaggaagcaaataggttgaacgccgagaatgaaaaggacagtcgcagacgacaggcacggctgcagaaagagctggctgaagctgctaaagagcctctccccgtggagcaggatgacgacatagaagtgatcgttgatgagacatccgatcacacagaggaaacgagtcctgttcgagccatctcccgggcagcaaccaggcgctccgtttcctccttccctgtgccgcaggacaatgtggatacccaccctggatccggtaaagaggtgcgggtgcctgccactgctctctgcgtcttcgatgctcatgacggcgaggtgaatgcggtgcaatttagccctggtagtaggcttcttgctacgggcgggatggatcgtagagtaaagctttgggaggtgttcggagagaagtgtgagtttaaaggctccctgtcgggatcaaatgccgggatcactagtatcgagtttgattctgccggcagctacttactcgctgcatccaatgacttcgcttctagaatctggactgtagacgactatagattgagacacacacttactgggcacagtgggaaggttctgtccgctaagttcctcctggacaacgctagaatagttagcggttctcacgaccgcacactgaaactttgggatctccgatctaaagtctgtatcaagaccgtgttcgccggctcatcttgcaacgacattgtgtgcactgaacagtgtgtcatgagcgggcacttcgacaaaaagatcaggttctgggacatcaggagcgagagtattgttcgcgagatggagttacttgggaaaataaccgcactggacctgaacccggagcgcaccgaacttttatcgtgctcacgtgatgatctcctgaaagtgattgacctccggactaatgccatcaagcagacgttcagcgcccccggtttcaagtgcggctcggactggactcgtgtcgttttcagtcctgatggaagctacgttgcagccggatctgctgagggctctctgtatatttggtctgttttaacgggcaaggttgaaaaggttctctccaaacagcactcctctagcataaatgcggtcgcctggagtccatcggggagccacgtggttagcgtggacaaggggtgtaaagctgtgctgtgggcccagtactag

SEQ ID NO: 108869 - DNA, 2520 bp, Artificial Sequence
  Description of Artificial Sequence: Synthetic coding sequence
atggcacagttcgataccgagtaccagcgcctggaagcatcttattcggactcacccccaggtgaggaggaccttctcgttcatgtggctgagggttctaaaagtccatggcaccacattgagaatctagacttgttttttagccgagtgtacaatttgcatcagaagaatggcttcacctgcatgctgattggagaaatattcgaactgatgcagtttctgttcgtggtcgctttcaccacatttttggtttcctgcgttgactatgatattctgttcgctaataagatggtgaaccattcacttcatcctaccgaacctgtgaaggtaacactgcccgatgccttcctccctgctcaggtgtgttcagcccgaattcaagaaaatggatcccttatcactatccttgttattgccggggtcttctggatccataggctgatcaagtttatctacaatatttgttgttactgggagatccactcattctacctccacgctcttcgaataccgatgtccgccctgccctattgcacttggcaggaggttcaggcacgcatagtacagactcagaaagaacatcagatatgcatacacaaaagggagctcaccgagctggatatctaccaccgcatattacgttttcagaattatatggtagcactcgtgaacaagagcctgctgcccttgcgcttccgcctcccaggactaggggaagcagttttcttcacgcgtgggctgaagtacaactttgaactcatccttttctgggggcccgggagtctgttcttaaacgaatggtcccttaaagctgagtataaacgaggtggtcagcgattggaactcgctcaacgtctgtccaaccggatactctggatagggattgcaaacttcttgctgtgtccactcattttgatttggcaaatcctctatgcctttttcagctacgccgaggtgctcaaaagagaaccaggcgcccttggcgctcgatgttggtctctatacggacggtgttacctccgccacttcaacgagctcgagcacgagctccagtctagactcaaccggggctacaagcccgccagtaagtacatgaactgctttcttagccctctcctaactctcttggctaaaaatggcgcgttctttgctgggagcatcctggcggtattgatcgcgctcacgatctatgacgaagacgttcttgccgtggagcacgtgctaacaacagtcactctgctcggcgttacagtgaccgtttgtcgctccttcatcccggaccagcacatggtgttttgtcccgagcaacttctgcgtgtaatcctcgcccacatacactacatgcccgatcactggcaggggaatgcccatcgtagccagacccgggacgaattcgcgcagctgtttcagtacaaagcagttttcattctggaagaactgctctcgccaatcgtgacacccctgattctgatcttctgtttgaggcctcgtgcactagaaatcatcgacttcttccggaacttcacagttgaggttgtgggagttggcgacacctgtagcttcgcccagatggacgtgaggcagcatgggcatccccagtggttgtccgccggccagacagaagcttccgtatatcagcaggccgaggacgggaagaccgaattgtccctcatgcacttcgcaataactaaccctggttggcagcctccccgtgagtcaacagcctttctggggtttctgaaggaacaggtgcagagggatggcgcagccgcttctctcgcccaaggcgggttactgccagagaatgccctttttacctccatacagtctttgcagtccgaatcggaaccgctgtctctgatcgctaacgtcgtggcaggctcatcgtgtcgtgggccacctctgccgagggacctgcaggggagccggcatagagcggaggtggcctctgcactgcgcagttttagtcccctgcagcccggtcaggctcccacaggacgggcccacagtacaatgacaggatccggcgtcgacgccaggacggcctctagcgggtcttcggtgtgggagggtcagctgcagtctctagttctgagcgaatatgcgagcacagagatgagtctccacgcattatacatgcatcagttgcataagcagcaggctcaggcagaacccgagcgccacgtttggcatcgtcgggagagcgatgaatctggggagagcgctcctgacgagggtggagaaggggccagggcccctcagagcatcccccgctctgccagttacccatgcgctgctccaagacccggtgcccccgagacaactgctctccacggaggtttccaacggaggtatggtggaatcaccgaccccggaaccgtgccccgggtaccatcccatttctcaagattacccctcggcggatgggccgaggatggccagagtgccagcagacacccagagcccgttccagaggagggttccgaggacgaactcccccctcaagtgcataaggtctag

SEQ ID NO: 108870 - DNA, 2520 bp, Artificial Sequence
  Description of Artificial Sequence: Synthetic coding sequence
atggcacagttcgacaccgaataccagaggctggaagcctcgtatagtgactcccctccaggcgaagaagacctgttagttcatgtggccgaagggagcaaatcaccatggcaccacatcgagaatctagatctgttctttagtagagtgtataatctccatcaaaagaatggatttacctgcatgctgatcggggagatcttcgaactgatgcagtttctttttgtggttgcgttcaccacattcttggtgtcatgcgtggactatgatattctgtttgcaaataagatggtgaaccatagcctccatcctactgagcctgtaaaggtgacactgccagacgcgttccttccagcacaggtgtgcagcgcgaggatccaggagaacgggagtctgataaccattctggtcatcgctggagttttctggatccacaggcttattaagtttatctataacatttgttgttactgggagattcactctttctatctgcacgctctcaggatccctatgtcagccctcccatattgtacatggcaggaagtacaggctagaatcgtccagactcaaaaggagcatcaaatttgcattcataaacgcgagttgaccgagctggacatttatcataggattctgaggttccagaactacatggttgctctggtaaacaagagcctgttacctcttagattccgcctccctggcttgggcgaggcggtatttttcaccaggggactcaaatacaacttcgaactgattctattctggggccctggaagtttgtttctcaatgaatggagcctgaaagcagaatataagcgtggggggcaacgcctcgaactcgcgcagcggttgagcaaccgcattctttggatcggaatagctaacttccttttgtgtcccctgatcctgatttggcagattctctacgcctttttctcctatgcggaagttcttaagcgggaacccggtgcattgggtgcgagatgttggagtctgtatggcaggtgctacttacgccacttcaatgaactggagcacgagcttcagtcccggctgaataggggctacaaacccgcatcgaaatatatgaattgctttctaagccctttgctgacacttctggcaaaaaacggcgcatttttcgctggttctatcttggcagtgctgatcgccctgacgatctacgatgaggatgtgttggccgtggaacacgtgctgactaccgttacgctgttaggggttaccgtcactgtttgcagatccttcatccccgaccaacacatggttttctgccccgagcaacttcttcgcgtcatattggctcatatccactatatgcccgaccactggcaggggaatgcacacaggtcacagacaagggacgaattcgctcagctgttccaatataaggccgtgttcatcctcgaagagcttctttctcccattgttacccccctaattctgattttctgcttacgaccacgggccctggaaatcattgatttctttagaaattttacggtggaggtcgtcggcgtgggtgacacttgttccttcgctcagatggacgttaggcagcacggccacccgcagtggcttagcgccggtcagacggaagccagtgtgtaccagcaggctgaggacggcaaaaccgaactcagcctgatgcactttgctatcaccaacccaggttggcaacctcctcgagaaagtaccgcgttcctgggcttcctgaaggagcaggtccagcgagacggggctgcagcctccctggcgcagggtggacttttacccgaaaacgctctgttcaccagcatacaatcactgcagagcgagtcagaaccattgtcacttatcgcgaacgtggtggccggcagtagctgccgggggccacctctgccgcgggacctgcaagggtctcgacacagagctgaagtcgccagtgccctgaggagcttctcacccttacagcctggtcaagccccgaccggccgagcccactccacaatgaccggcagcggcgttgatgcaaggactgcctcgtccggctctagcgtctgggagggacaactccagagcctcgttctaagcgagtatgctagtactgagatgtcccttcacgccctgtatatgcaccaactccacaagcagcaggctcaagcagaacccgaaagacatgtatggcatcggcgtgagagcgacgagagcggtgagagcgcgcccgatgagggaggtgaaggcgctcgggcaccccagtccatccctcggtctgcctcctatccctgcgcagccccacgaccaggcgctcctgagacaaccgctctgcatggcgggttccagagacgctacggtggaattacagacccggggaccgttccacgcgtgccttcccacttcagccgactgcctcttggaggatgggctgaagatgggcagagtgcatcgcggcatcctgagcccgttcctgaggaagggtcggaagacgagctgccacctcaggtgcacaaagtctag

SEQ ID NO: 108871 - DNA, 2337 bp, Artificial Sequence
  Description of Artificial Sequence: Synthetic coding sequence
atgttgatcggagaaattttcgaactcatgcaatttctgtttgtcgtcgctttcaccacattcttagtttcctgtgtggactacgacatactgtttgctaataagatggtgaaccactcacttcaccccaccgagccggtcaaggtcacacttccagacgcatttttacctgctcaggtgtgttcagcccggatacaagagaatggctcactcatcactattttagtaatcgccggagtgttttggattcatcgtcttataaaatttatttataatatctgctgctactgggagatacactctttctacctccacgccttgcggattcctatgagtgcactgccatattgtacatggcaggaggtccaggctcggatcgtccagactcaaaaggaacaccagatatgtatccacaaaagggaactgaccgagctggatatttatcacagaatattgagatttcagaattacatggttgcactggttaacaagtctctgctgccactgagattccggctccccggactgggagaggcagtgttctttacaaggggcttaaagtataatttcgagctgatccttttctggggaccagggtctttatttctgaatgagtggagcctaaaagcagagtacaaaaggggcggccaaaggttggaactggcgcagcggcttagcaaccgaattctctggattggaatcgctaatttcctgttgtgcccactcattcttatctggcagatcctatacgcgttcttctcatatgccgaggttcttaaacgggaaccaggcgctctgggggcacgttgttggagtctatatggcaggtgctacctaagacatttcaacgagctggaacatgagcttcagagccgcctgaatcggggctacaaaccagcctcaaaatatatgaattgttttctcagccctctcctaacactactggctaaaaacggcgcctttttcgccggctccattctggccgtgctgattgctctgacaatatatgacgaagacgtgctagccgtggaacatgtgctgactactgtgaccctgcttggggtcacagtgactgtctgtagaagtttcatcccagatcagcatatggttttttgcccagagcaactcctgcgagtgatactggctcatattcattatatgcccgatcattggcagggaaatgcacatagatctcagacaagagacgagttcgcacaactgttccaatacaaagcggtgtttattctagaggagctcctgtcacctatcgtgactcctctgattcttatcttttgtttacgcccccgggctctggagattattgattttttccgaaatttcacggtcgaggtggtgggggtgggggacacttgttcctttgcgcagatggacgtgcggcagcacgggcacccacagtggctgagcgccgggcagaccgaagctagcgtgtaccagcaggcagaggatggcaagacagaattgtctctgatgcactttgcaatcacgaaccccggatggcagcccccccgggagagcacagccttcctaggatttctgaaggagcaagtgcagagagacggagccgcagccagcctggcacagggtggcctgctgccagaaaatgctctgttcacgagtatccagtctttacagtcagagtccgaaccgctgtcgctcatcgcaaatgtggtcgcaggttcctcatgtcggggcccccctctcccgcgggatctgcagggctccaggcatagagctgaggtggcttccgccctccggagtttctcgccactgcagcccggccaggccccaaccggtcgtgcccatagtaccatgaccggatccggagtcgatgcaagaaccgctagttctggctccagcgtctgggagggccagctgcagagcttggtcctgagcgagtacgcctcaaccgagatgtcactgcatgcactgtatatgcaccagcttcacaagcagcaagcccaggccgagcctgagaggcacgtgtggcacaggcgggagtccgacgaatcaggcgaatcggccccggatgagggcggtgaaggagcaagggctccccagtccatccctagatccgcttcttacccatgtgccgccccgcgcccaggagctcctgaaaccacagccttgcacggggggtttcagcgcagatacggcgggatcacagacccgggaactgttcctcgagtaccatcacactttagcaggttgcctctaggcgggtgggcagaggatggccagtcagcatccagacatccagaacccgtgccagaggaggggtcagaggatgaactccctcctcaagtgcacaaggtctag

SEQ ID NO: 108872 - DNA, 2520 bp, Artificial Sequence
  Description of Artificial Sequence: Synthetic coding sequence
atggctcaattcgataccgagtaccagcgtctcgaagcctcatatagtgactctcccccaggggaagaggacttacttgtccacgtggctgaggggtctaagagtccatggcaccacatcgagaacctggatctgttcttctcgcgcgtgtataatcttcatcagaaaaacgggtttacctgtatgttgattggggagatcttcgagctgatgcagttcttgtttgtcgtcgctttcacaaccttccttgtcagctgcgtcgactacgacattcttttcgcaaacaagatggtcaaccactctctgcaccccacagagcctgttaaagtgacactcccagatgcttttctcccagctcaggtttgttcagcccgaattcaggagaatggctccctgattacaatcctcgtcattgcaggagtgttctggattcaccggctgataaagtttatctacaacatttgctgttactgggagatccatagcttctatttgcatgctcttcggattcccatgtccgctctgccatactgcacctggcaggaggtccaagcgagaatcgtgcagactcagaaagaacaccagatatgcattcacaagcgtgaactaaccgagctcgacatttatcacaggattcttaggttccaaaattatatggtggcactggtcaataaatctctcctcccacttagatttagactgcccggcctgggagaagccgttttctttacaaggggactgaaatacaacttcgagttgatactgttctgggggcctgggagcttgtttctcaatgagtggtcactcaaggctgaatataagcggggggggcagcggcttgagttggcacaacggctgagcaatcggattctgtggatcggcatcgccaactttctgctgtgtcctctgattctaatatggcaaattctttatgcttttttttcatatgctgaagtgctgaaaagggaacccggagccctgggggctcgatgctggagcttgtacgggcgttgttacctaagacactttaacgagctagagcatgagcttcagagcaggctaaacagagggtacaagcctgcctctaaatatatgaactgctttttgtccccactgctcacactgttggccaaaaacggtgcattcttcgcggggtcgatactcgcagtcctgatagccctgaccatatacgacgaggacgtgctggctgtggaacatgtcctaaccactgtgacactgctcggcgtgacagtgacggtttgcaggagttttattccggaccagcatatggtcttctgccccgagcagctgctcagggtgatactagcccacattcattacatgcccgaccactggcaaggcaacgcacatcgttctcagacgcgtgacgagttcgcgcagctgttccagtataaggcagtgttcatcttagaagagctcttatcccccatcgtgacgcctctcatcttgattttctgtctcagaccacgcgctctcgagattatcgacttcttcaggaacttcacagtggaagtcgtaggcgtcggggatacttgttcctttgcccaaatggatgtccgccaacatgggcaccctcaatggctgagcgcaggccagacagaggccagtgtttatcagcaggccgaggacggcaagaccgagctcagcttgatgcatttcgctattactaatcccggctggcagcctccaagggagtccaccgctttcctggggtttctcaaggagcaggtccagagagacggtgcggctgcctctctagcccagggcggtctgcttcccgaaaatgcacttttcacaagcatccagagtcttcagtccgagtcagaaccactgtcactaattgccaacgttgtggcgggaagctcatgccgcggtccacctctaccccgggacctacaggggagtcgccatcgcgctgaagtcgcctctgctctgcgcagtttcagccctctgcagcccgggcaggcccctacaggccgggcacacagcacaatgacaggctctggggttgacgcaaggacagccagcagcggcagctccgtctgggaaggccagctacaatcactcgtgctcagcgaatacgcaagcaccgaaatgtctctgcacgccctttatatgcatcagctccacaaacaacaggctcaggctgagccagagcgccacgtgtggcatcggcgagaatctgatgagagcggtgagtcagcgcctgatgaaggcggcgagggtgcgcgggctccccagagtatacctaggagtgctagctatccctgcgccgcccccagaccgggcgcacctgaaaccaccgctctgcatgggggtttccagaggaggtatggcgggattacagatcccggaacggtaccacgggtcccttctcacttcagccgcttgccactcggcgggtgggccgaggacgggcagtcagcatcgcgccacccggagcccgttcctgaggaggggagtgaggacgaactgccaccacaggtgcataaagtgtag

SEQ ID NO: 108873 - DNA, 510 bp, Artificial Sequence
  Description of Artificial Sequence: Synthetic coding sequence
atggctcagtttgatacagagtatcagcgcctggaagccagctactccgacagtccaccaggagaggaggatctacttgtgcatgtggccgagggatctaagtccccttggcatcatattgagaacctggatctgtttttttctagagtgtacaatctccaccagaagaatggatttacttgtatgctgattggtgagatcttcgaactaatgcagttcctgttcgtcgtcgccttcaccacatttctggtgtcctgcgttgattatgacatcctgtttgccaacaagatggtaaaccactccctgcaccccactgagcccgttaaggtgacactgcccgatgctttcttgcctgcacaggtctgttctgcacggattcaggagaacggaagcctcattactattctggtgatcgccggggtcttctggatccataggctcatcaagttcatttacaacatctgttgttactgggagatacatagcttctatctgcatgcgctgaggtag

SEQ ID NO: 108874 - DNA, 435 bp, Artificial Sequence
  Description of Artificial Sequence: Synthetic coding sequence
atggcccaatttgacacagagtaccaacgtctcgaggcaagctacagcgatagtcctccgggcgaagaagacttgctcgtgcacgtcgccgaaggctctaaaagcccttggcaccatattgaaaaccttgatctattctttagccgggtgtacaatttacatcaaaaaaacggttttacctgcatgcttatcggggagatctttgagctgatgcagtttctgttcgtcgtggcgttcacgacttttctcgtgtcatgcgtggactacgacattctcttcgccaacaagatggtcaaccattcgctccatcccacagaacccgtgaaggtgaccctacccgacgcatttctgcccgcacaggtgtgctccgcccgcatccaggagaacggaagcctcataaccatccttgttatcgccggcgtgttttggatctag

SEQ ID NO: 108875 - DNA, 282 bp, Artificial Sequence
  Description of Artificial Sequence: Synthetic coding sequence
atggctcaattcgatactgagtatcagaggctggaggctagttattctgattccccccccggggaagaggatctactggtccacgtcgccgagggaagcaagtcgccttggcaccatattgagaatcttgacctattcttttcccgggtgtataacctgcatcagaagaatgggttcacatgtatgttgattggggagatctttgagctcatgcagtttttattcgtggtagccttcacaaccttcctcgtttcctgcgtggattatgatatactgttttag

SEQ ID NO: 108876 - DNA, 567 bp, Artificial Sequence
  Description of Artificial Sequence: Synthetic coding sequence
atggcccagttcgacacggagtaccagagactggaagcgtcttattctgattcacctcccggggaagaggatctcctcgttcacgtagccgaaggaagtaagtccccttggcatcacattgagaatttggatctcttcttctctcgtgtctacaacctccaccagaaaaacggtttcacgtgtatgttaattggtgagatttttgagctaatgcagttcctatttgtcgtcgcctttacaactttccttgtgtcatgtgtggactatgatattctgttcgccaacaagatggtcaatcatagtctccacccgaccgagccagtgaaggttactctgcctgatgcatttttacccgcacaggtgtgctccgccaggatccaggaaaacggctccctgatcactatccttgtcatcgctggcgtcttttggatacatcgtctaattaagtttatctataatatctgttgctactgggagattcactccttctaccttcatgctctgcgcatcccaatgtctgctctgccctactgtacctggcaggaggtgcaggcccgtatagtgtag

SEQ ID NO: 108877 - DNA, 396 bp, Artificial Sequence
  Description of Artificial Sequence: Synthetic coding sequence
atggcccagttcgacactgaatatcaaaggctagaggcttcatattctgacagccctcctggggaagaggacctgctggtgcatgtcgccgaaggaagcaaaagcccctggcaccacatcgagaatctcgacctgtttttttcaagggtctacaatctccaccagaagaacggatttacgtgcatgctgattggcgaaatattcgagcttatgcagtttttattcgtggtcgcctttacgacctttctggtgagctgtgtggactacgatattctcttcgcaaataagatggtaaatcatagtctgcatccaaccgagcccgtgaaggtcacactccctgacgcctttctgcctgcgcaggtgtgtagtgcccgcattcaagaaaacggctcttag

SEQ ID NO: 108878 - DNA, 294 bp, Artificial Sequence
  Description of Artificial Sequence: Synthetic coding sequence
atggcccaattcgatacagagtaccagaggctcgaagcgagctacagcgacagtccacccggggaagaagacctgctggtgcacgttgccgaaggctccaagtccccttggcatcacattgaaaaccttgatctgtttttctctagggtctataacctgcaccaaaagaacggtttcacctgtatgctcattggtgaaattttcgagctcatgcagtttttattcgtcgtcgccttcaccacattccttgtcagttgcgtagattacgacattctgttcgcgaataagatgtag

SEQ ID NO: 108879 - DNA, 519 bp, Artificial Sequence
  Description of Artificial Sequence: Synthetic coding sequence
atggcccagttcgacacagaatatcagcgtttggaagcgtcttacagcgatagtccaccaggagaggaggacctgctggtgcatgtggcagaagggtctaaatccccatggcaccatattgagaatttggatttgtttttctctagagtgtataacctgcatcagaaaaacgggttcacctgcatgctgatcggcgaaatctttgaactgatgcagttcctgtttgtggttgccttcactactttccttgtgagctgcgtggattacgatatactgttcgcaaacaagatggttaaccatagcctgcatccgaccgaacccgttaaggttacattacccgatgcatttcttcccgcacaggtgtgctcagcccgaatacaggagaatggaagcctgatcacgattctggtaatagctggggttttttggatacatcgcttaattaagtttatatataacatctgctgctactgggaaattcacagtttctatctgcacgcccttcgcattcctatgtag

SEQ ID NO: 108880 - DNA, 1662 bp, Artificial Sequence
  Description of Artificial Sequence: Synthetic coding sequence
atggccaagaatcggcgagatcgtaacagctggggaggctttagcgagaaaacgtatgagtggtcaagcgaagaagaggaaccagtgaagaaggctggccccgtgcaggtgctgatcgtcaaggacgaccactcttttgaactcgatgagacggccctgaatcggatcctgctctcagaggctgtgcgcgataaggaggtagtggccgtgtctgttgctggcgcttttaggaaagggaaaagtttcttgatggacttcatgcttcgttacatgtacaatcaggagtctgttgattgggtgggagactacaacgagcccttgactggattcagctggagaggtggcagcgagcgagaaaccacaggtatacagatctggtccgagatatttctgataaataaacctgatgggaagaaagtcgccgtgttgctaatggacacacagggaactttcgactcacagtccacccttcgcgattcagccaccgtgtttgcactgtctacaatgatctcgtcaatccaggtgtacaacttatcgcagaatgtgcaagaggacgatctccaacatctccagctgtttacggaatacggacgccttgccatggaggagacattcctaaagccatttcagagccttattttcctggtgcgggactggagcttcccctatgagttttcttatggcgcggacgggggagctaagtttctggagaagcgcttaaaagtgtccggaaatcagcacgaggaactgcagaacgtgagaaaacacatccactcttgctttacaaacattagctgtttcctgctccctcaccccggccttaaggtcgcgacaaacccaaattttgacggaaagcttaaggagattgacgacgaattcatcaaaaacctgaagattctgatcccatggttgctcagtcctgaatccttagacattaaggagatcaacggaaacaaaatcacctgccgcggactggtagagtactttaaggcatacataaagatctaccaaggcgaagaacttccccaccctaagtcaatgcttcaagctaccgccgaggcgaacaatctcgccgctgtggcgacagccaaggacacttacaataagaagatggaagagatatgcggcggagataagcctttcctggcccccaacgaccttcagacaaaacatctgcagctaaaagaggagtccgtgaaacttttcagaggggtgaaaaaaatgggcggtgaagagtttagtcgccggtacctgcagcagttagaaagcgagattgatgaattgtacatacaatatataaagcataacgattccaaaaacatcttccacgcagccagaacaccagccactctcttcgtcgtcatttttattacctatgttattgccggcgttaccgggtttatcggcctggacattattgcatctctgtgtaacatgattatgggactgacactgatcacactgtgcacatgggcatatatccggtacagcggggagtaccgcgaacttggagccgtcatcgatcaagtcgcagctgcattatgggaccaagccttgtataagctctactctgcagctgcaacacaccgacacctgtaccatcaggcttttcccacaccaaaatctgagtcaacggaacagagcgagaagaagaagatgtag

SEQ ID NO: 108881 - DNA, 1677 bp, Artificial Sequence
  Description of Artificial Sequence: Synthetic coding sequence
atggccaagaaccgccgagaccgcaattcttggggaggtttcagcgagaagacatacgaatggagctcagaggaagaggaacctgtgaagaaagctggaccggtccaggtgctcattgtaaaagatgaccatagcttcgagctcgatgaaacggcacttaaccggattctcctgtccgaagcagtgagagacaaggaagttgtcgccgtgtccgttgcaggggcctttagaaagggcaaaagcttcctcatggactttatgctgaggtatatgtataatcaggaaagcgtggattgggtgggagattacaatgagccattaaccggattctcatggagaggtggatccgaaagggagaccaccggtattcagatttggtctgagatctttctgatcaataagccagatggcaaaaaggtggccgtgctgctaatggatacacaaggcaccttcgacagtcagtctacccttcgcgattcagcaacagtttttgctttaagtaccatgatttcctcgattcaagtatataatctatcacagaatgtacaagaagacgacctacagcatttacaactgtttacggagtacgggcggttggcgatggaggaaacatttttgaaaccattccagagtctgatctttctggtgcgggactggagcttcccatacgaattttcttatggtgccgatggtggcgcaaagtttctggagaagaggctgaaagtgtctggaaatcaacacgaagagctgcaaaacgtccgcaaacatatccattcgtgttttaccaacatttcttgcttcctcctgccacatccgggattgaaagtagcgactaatccaaatttcgatggtaagctcaaggaaatcgacgatgaattcataaagaacctaaaaatcctaattccctggctgctcagtcctgagtccctggacattaaggaaattaatgggaacaagatcacctgtcgcggacttgtggaatattttaaagcctacatcaaaatctaccagggggaggagctcccacacccgaagagcatgctgcaggctacagcagaagccaacaacctggctgcggtcgcgacggcgaaagacacctataataaaaagatggaggaaatatgtggaggagacaagccctttctggccccaaatgatcttcagacgaaacacttacaactgaaggaggagtccgtgaaattgttcaggggagtgaagaaaatgggcggcgaggagtttagtagacgctacctgcagcaactagaaagcgagatcgatgagctgtatattcagtatatcaagcacaatgattccaagaacatttttcatgccgcgagaacgcccgccacactgttcgtcgtgattttcattacctacgtgatcgcaggcgttacaggctttatcggccttgatatcatcgcttccttgtgcaacatgatcatgggccttaccctaatcacactttgcacctgggcctatattcgctactccggcgagtatcgagagctcggtgcagtgatcgaccaggtcgccgccgcattgtgggaccaggggccatcccaccaagccttgtataaactgtattctgccgctgcaactcaccgccacctctatcaccaggcgttccctacccccaagtccgaaagtaccgaacagtccgagaagaaaaagatgtag

SEQ ID NO: 108882 - DNA, 1677 bp, Artificial Sequence
  Description of Artificial Sequence: Synthetic coding sequence
atggccaagaacagacgggaccggaacagctggggcggcttttctgagaaaacttacgaatggtcttctgaggaggaagaacctgtgaagaaggccggccccgttcaggtactgatcgtcaaggatgaccacagtttcgagctagatgagactgctctcaacaggattctgcttagcgaagcggtccgggacaaagaagtcgtggcagtgagtgttgccggggccttcagaaaggggaagagtttcctgatggactttatgctgcgatacatgtataaccaggagtcagtcgactgggtgggggattacaatgaaccgttaaccggcttctcatggcgcggcggaagcgaaagagagactacgggaatccagatctggagcgaaatttttctgataaataagcctgacgggaaaaaagttgccgttctgctaatggacactcagggcacgttcgatagtcaatcaaccctgagagactcagctactgtgtttgccttgtctacaatgatttcttcaattcaggtgtataatctctctcagaacgtacaagaggatgatctgcaacacctacagctctttactgagtatggccgattagctatggaagaaactttcctcaagccattccaatcactgatattcctcgtcagggattggagcttcccatacgagtttagctatggagctgacggcggggccaaattcttagagaagcggctgaaagtgtcaggcaatcagcacgaggagctgcagaatgtccgcaagcacattcactcttgcttcacaaacatttcttgcttccttcttccgcacccgggactgaaagttgcgactaatcccaatttcgatggtaaactaaaagaaatcgacgacgagttcatcaagaatctgaagatactgattccctggttgctgtccccagaatcactagacatcaaagaaataaacggaaacaagataacctgccgcggtctcgtggagtactttaaggcctatatcaaaatttatcaaggtgaagagttgccacatccaaagtctatgctgcaggccacagcagaagccaataatctggctgccgtggccactgccaaggatacgtataataagaagatggaggagatttgtggaggcgacaagccatttctggcaccaaatgatctgcaaacaaagcacctacagctgaaggaggagagcgtgaagctgttcagaggagtaaagaagatgggcggggaggagttctcccggcgttatctacaacagctagaatcagagatcgacgagctgtacatccagtatattaagcataatgatagtaagaatatatttcatgctgctagaacacccgccaccctgttcgtagtcattttcatcacctacgtgattgcaggggtaacaggatttatcggactggacatcatcgcttcactgtgtaatatgataatgggactgacactaatcaccctctgtacatgggcgtacattcgctactcaggagagtatcgcgagctgggtgccgtcatcgaccaggtggccgctgccctgtgggaccagggctccacaaatgaggcgctctacaagctgtactctgcggcagcaacccacaggcacctttaccaccaggccttccctactccgaaatccgaaagtacagaacagagcgagaagaagaagatgtag

SEQ ID NO: 108883 - DNA, 1662 bp, Artificial Sequence
  Description of Artificial Sequence: Synthetic coding sequence
atggcgaaaaaccggcgcgacagaaattcttggggcggcttctcagaaaagacctacgaatggagctctgaggaggaagagcccgtcaagaaggcagggcctgttcaggtcctgatcgtcaaggatgaccattctttcgaactggacgaaacagctttgaatcgcattctgctgtcagaggctgtgcgagataaagaggtcgtggccgtgtctgtagcaggagcttttcgaaagggcaagtcattcctgatggactttatgttgcgctacatgtacaatcaagaatctgtagattgggtgggggactataacgaaccattgaccggattctcttggagaggcggctcggaaagggagactaccgggatccagatttggtctgagattttccttattaataaacctgatggcaagaaggtggctgtgctgcttatggatacacagggtaccttcgactctcagtccaccctaagggacagtgcaaccgtgttcgccctatctaccatgatatcatccatccaggtctataatctgtctcagaatgtgcaagaagatgacttacagcacctgcagttatttactgaatatggtcgcctggccatggaggaaaccttccttaagcctttccagagccttatcttcctcgtgcgggattggagtttcccatacgaattcagctacggtgcggacggaggcgcaaagttcctcgaaaaacggctaaaggtcagtggaaaccagcacgaggaactgcagaacgtgaggaaacatatccacagttgcttcactaacatcagctgttttttactgcctcacccggggttaaaagtcgctaccaatccgaacttcgatggcaaattgaaagaaatcgacgatgagtttattaagaacttgaaaatcctgatcccttggctcttgtcaccagagtccctggatatcaaagagatcaatggcaataagattacctgcaggggactggtagaatatttcaaagcctacatcaagatctaccagggtgaggagttgccacacccgaaatctatgctgcaggcaacggcggaagcaaataatcttgccgcagtggcgacggcaaaggatacttataacaagaagatggaggagatctgcggaggagacaaaccttttttggctccaaatgatctgcagaccaagcacctgcagctgaaagaggaaagtgtcaagctgttccgtggtgttaagaaaatgggcggagaggagtttagccgacgatatctacagcagctggaatccgaaattgacgagctgtatattcagtacattaagcataacgatagcaaaaacatatttcacgccgcacggacccctgcgacgttatttgtggtgatctttattacttacgtaattgccggggttacaggttttatcggcctggacataatagcctcactgtgcaacatgatcatgggtcttacactgataacgctttgtacatgggcctatatcagatatagcggagaataccgcgagctcggtgccgtcatcgaccaagtcgctgccgctctgtgggatcaggcactgtacaagctgtattccgccgcagctacacaccgtcacctatatcaccaagcattccctaccccaaagtccgagtccaccgagcaatccgagaaaaagaagatgtag

SEQ ID NO: 108884 - DNA, 90 bp, Artificial Sequence
  Description of Artificial Sequence: Synthetic coding sequence
atggccaagaaccggcgtgaccggaacagctgggggggcttcagcgagaaaacttacgaatggagttctgaggaggaggagcccgtttag

SEQ ID NO: 108885 - DNA, 303 bp, Artificial Sequence
  Description of Artificial Sequence: Synthetic coding sequence
atggcaaaaaaccgacgcgatcggaactcgtggggcggattctccgagaaaacctatgaatggtcatctgaagaggaagagccagttaagaaagcaggaccggtccaggtgctgatcgtcaaagacgaccactcctttgagctcgacgagactgcattgaacaggatcctcctgtccgaagcggtgcgcgacaaggaggtggttgcagtctctgtggctggcgcatttcggaaggggaaatctttcctgatggacttcatgctgcgctacatgtataaccaggagtcggtcgactgggtgtag

SEQ ID NO: 108886 - DNA, 1701 bp, Artificial Sequence
  Description of Artificial Sequence: Synthetic coding sequence
atggtgctcaaaaagggcattaagttttttcaaagactgattaactccaaatctttacgctttggggaaaactacgaggatgatgacttagttaatagcgatgaggtcatgaaaaagccatgccccgtgcagatcgttctcgcacatgaggatgaccataattttgaactcgatgaggaagccttagaacagatactcctgcaagaacacatccgagatttaaacattgtggttgtctccgtggctggcgcctttcgaaagggcaagtcctttctgctggattttatgcttcgatacatgtataacaaggatagccagtcttggatcggcgggaataacgagccccttactggcttcacatggagaggtggctgtgaaagggagacaacgggaatccaggtctggaacgaagtttttgtcatagaccggccaaatggcaccaaggtggctgttctgttgatggatactcagggggctttcgatagtcagagtaccattaaggactgcgctactgttttcgcgctgtccacaatgaccagcagcgtgcaagtttataacttatctcagaacattcaggaagacgatctgcagcacctgcaactgttcacagagtacggcagactggcgatggaagaaatctaccagaagcctttccaaactttaatgtttctgatcagggattggtcttatccctatgagcatagttacggcttggaagggggcaaacagttcttggaaaagcgattacaagtgaagcagaaccagcacgaggaactccagaacgtgagaaaacatatacataattgtttctccaaccttggatgcttcctcttgcctcatcccggtttgaaggttgcaaccaatccatcctttgacgggcgtttaaaggatatcgacgaagacttcaaaagagaactcagaaacttggtgccacttctgctggcgcctgaaaatctcgtggagaaggagatcagtggcagcaaagtaacttgccgggacctggtggagtatttcaaggcttatatcaaaatctaccagggcgaagaacttccacatcctaaaagtatgcttcaggcgaccgctgaagctaacaatcttgcggcagtcgccggggccagggacacctactgtaaaagcatggagcaggtttgcggaggcgataaaccttacatcgcaccaagcgacttagaacgcaagcacctggacctgaaggaggtggctatcaaacaatttcggagcgtgaagaagatgggtggtgatgagttctgccgtaggtaccaggatcagctagaggctgaaatcgaagagacatacgctaactttattaagcacaatgatggtaagaacattttctatgctgcccgcactcccgcaactttattcgcagtgatgttcgcaatgtacataatcagtgggctgaccggatttattggactcaacagcatcgccgttttgtgcaaccttgttatggggctcgccctgatcttcctttgtacctgggcttatgttaagtattccggcgaattcagggagattggtaccgtgatcgaccagatagctgaaactctctgggaacaacggagtcccaggaaggtcttcagcaaattgttcgaggtgacgagacggcggatggtccaccgggccttatctagcgcacagagacagaggttgagctccaacaacaataagaaaaagaactag

SEQ ID NO: 108887 - DNA, 1752 bp, Artificial Sequence
  Description of Artificial Sequence: Synthetic coding sequence
atggctgagggtgacgaagcagcccgagggcagcagccccaccaggggttatggaggcggcgtcggacttccgacccctcggccgcagtgaatcacgttagttctaccacttcactgggtgagaactacgaagatgatgatttggttaacagcgacgaggtgatgaagaagccctgtcccgtgcagatcgtgctcgcacatgaggatgaccataatttcgagctggatgaagaggcgttggaacaaatcctgctgcaggagcacattcgggacctcaatatcgtggtggtgtcagttgccggtgcatttaggaaggggaagagcttcctgctcgattttatgctgagatatatgtataacaaagacagccagtcatggatcggtggaaataatgagccactgacaggctttacgtggcgggggggctgtgaacgagagacgactggcatccaagtgtggaacgaagtttttgtgattgacagacctaacggtaccaaggtcgccgtcttgctcatggatactcagggcgctttcgacagccaatccaccatcaaggattgcgctactgtatttgcgctcagcacgatgacctctagtgtgcaggtgtacaacctttctcagaatatccaggaagacgatctacagcacctgcagctctttactgaatatggacgtctggctatggaggaaatctaccagaaaccttttcagacattaatgttcctgattcgagattggagctatccctatgagcactcgtatggcctggaaggagggaaacagtttcttgagaaacggttacaggttaaacagaaccagcatgaggagcttcagaatgtgagaaagcacatacacaactgcttctctaatctgggatgtttcctcctgcctcaccctgggctcaaggttgcgactaacccttctttcgatgggcgcctgaaggacattgacgaggattttaagcgagaattgcggaatctggtgccgcttttgctggccccagagaaccttgtcgaaaaggaaatttcaggctctaaagtgacttgtagagacttagtcgagtactttaaggcctacataaagatttaccagggtgaggaactcccacaccccaaaagtatgctccaggccaccgccgaagcgaataacctggccgcggttgctggcgctagggatacctattgtaagagtatggagcaggtgtgcgggggagacaagccttatatcgccccgtccgatctggagcgaaagcacttggatctaaaggaagtcgccattaagcaatttagatctgttaagaaaatgggcggggatgaattttgccggcgctatcaggatcagctcgaggccgaaatagaagagacatacgcaaatttcatcaagcataacgacggtaaaaacatattctatgccgctcgtacacccgctactctctttgccgtcatgtttgctatgtatatcatcagtggcctcacaggatttataggtctaaatagtatcgccgtgctctgcaacctggtgatgggacttgcgctcatctttctgtgtacatgggcctacgtgaaatactccggtgaatttcgggagatcggcaccgtgattgatcagatcgccgagactttgtgggagcaagttctgaagcccctcggcgataacctgatggaagagaatataaggcagtctgtcaccaattcgattaaggccggactgacagaccaagttagtcatcatgcccggttgaagacggattag

SEQ ID NO: 108888 - DNA, 1239 bp, Artificial Sequence
  Description of Artificial Sequence: Synthetic coding sequence
atggacacccagggagcgttcgattcccagagcacaatcaaagattgtgccactgtgttcgctctttctacaatgacatctagcgtgcaggtgtacaatttatcacagaatattcaggaggatgacctacagcacttgcagcttttcaccgaatatggccggctggccatggaggaaatctaccagaaaccatttcagacacttatgtttctgattcgcgattggagctatccatacgagcactcctatggactggaaggtggtaagcagtttctggagaaaagattacaggttaaacaaaatcagcacgaggaactgcaaaatgtgcggaaacacattcacaattgcttctcaaaccttggatgtttcttattgccacacccagggctgaaggtggccactaatccttcttttgatgggagactcaaggatatcgatgaagacttcaagcgagagcttaggaacctggttcccttgcttctggccccagaaaatcttgtggaaaaagagattagtgggtctaaggtaacctgtagagatctcgtcgagtacttcaaagcctatatcaaaatctaccaaggtgaagaactgcctcacccaaagagcatgctgcaggctacagccgaagccaacaacctcgcagcggtcgccggggctcgagacacctattgcaagtccatggagcaggtatgcggtggggacaaaccctatatagccccctccgaccttgagcgcaagcacttagatttgaaggaagttgcaatcaagcaatttaggagtgtgaagaaaatgggcggggatgaattctgtcggcgataccaggaccagctagaagccgagatcgaggagacctatgcaaacttcataaagcacaacgatggcaaaaatatcttttatgccgctagaactcccgcaacactgttcgccgtaatgttcgcaatgtatataatctccggtttgacaggcttcataggcttaaatagcatcgccgtgctctgtaacttggtcatgggcctagctctgatttttctgtgcacctgggcctatgtgaaatattcgggggagttcagggagatcggcacagtaatcgaccagatcgcggaaaccctctgggagcaggtcctgaagcctctaggagataaccttatggaagaaaacattaggcagtctgttaccaactcaatcaaagccgggttgacggaccaggtctcacaccacgctagacttaagacagactag

SEQ ID NO: 108889 - DNA, 1740 bp, Artificial Sequence
  Description of Artificial Sequence: Synthetic coding sequence
atggccgagggagacgaggctgccaggggtcagcaaccccaccagggattgtggcggcgacgccgtacatccgacccttcagctgccgtcaaccatgtgtcgtcaacaaccagcctgggcgagaattacgaagatgacgatcttgtcaactctgatgaggtgatgaaaaagccttgtccggtgcaaatcgtgctggctcacgaggatgaccataattttgaattggatgaagaggccctggagcaaattctgctgcaggaacacattcgtgatttaaacatagttgtcgtgtctgtggcaggtgcgttccgcaagggaaagtctttcttgctcgacttcatgctaagatacatgtacaacaaggatagccagtcttggattggcggtaataatgagcctctgacgggattcacatggcgtggggggtgcgaaagagaaactacaggaattcaggtgtggaacgaagtgtttgtcattgaccgccctaacggtaccaaggtggccgttctgctaatggatactcagggcgccttcgatagccagagcacaatcaaggactgcgctaccgtattcgccctgtcaaccatgactagctccgttcaggtgtataacctgagccaaaacatccaggaagatgatcttcagcatctgcaactgtttactgagtatggcaggctggcgatggaagaaatctatcaaaaaccctttcagacattgatgtttcttatccgcgactggagttacccttatgagcatagctacggcctggaggggggtaagcaattcctcgaaaagcgtctccaggtgaagcagaaccagcacgaagaactgcaaaacgtcagaaagcatattcataattgcttttcaaacctgggctgttttctcttgccacacccgggtctcaaggtggccaccaatccctccttcgatggaagattaaaggacattgacgaggacttcaagcgggagctgaggaacttggtacccctcctgctcgcccctgaaaatctggtggagaaggaaatttcgggcagcaaggtcacctgcagggatctcgtagaatacttcaaagcatatatcaagatctatcaaggcgaggaattgccccaccctaaaagcatgctgcaagcgactgctgaggctaacaacctggccgctgtggctggagcccgggatacatattgtaagtctatggagcaggtctgcggaggagataagccttacatagccccaagtgatctcgagagaaagcacctggatctgaaagaagttgcgataaaacagttcaggtctgttaaaaagatgggaggcgacgaattttgtaggagataccaagatcagctggaggccgagatcgaagagacttacgctaacttcatcaaacacaacgatggaaagaacattttctatgcagctcggactccagccacattgtttgctgtgatgtttgctatgtatattattagcggtctcactgggtttatcggtctgaacagtatcgcggtcctgtgcaatctggtgatgggcctagccttaatctttctctgtacctgggcctatgttaagtactctggcgagttccgtgagatagggacagtgatagaccagatcgctgaaacattgtgggaacaggtgtttagcaaactctttgaagttactcgccggcgcatggtacaccgcgccctcagttctgctcagcgccagcgattgtcaagtaataacaacaagaagaaaaattag

SEQ ID NO: 108890 - DNA, 1239 bp, Artificial Sequence
  Description of Artificial Sequence: Synthetic coding sequence
atggatacccaaggagcctttgactcccagtctactatcaaagactgtgcaaccgtttttgcgctctcaacaatgaccagttcagtccaggtttataatctaagccagaatatacaagaggacgacctgcagcacctgcaactctttactgaatacggacggctcgcaatggaagaaatttatcagaaacccttccagaccctgatgtttcttattcgcgactggagttacccctacgaacactcgtacggcctcgagggcgggaagcagtttctggagaagcggcttcaagtgaaacagaaccaacatgaggagttgcagaatgtgagaaaacacatccataattgcttctccaacctcggctgttttctcctgccccaccccgggctgaaagtggctacgaacccatcgtttgatggcaggttgaaggatatcgacgaggacttcaaaagggagctccggaatctggtgcccctgttgttagctcccgaaaacttagtggaaaaggagatttctggatccaaggtcacttgccgcgaccttgttgaatactttaaggcctacatcaaaatttaccaaggtgaagagttgccccacccaaagtccatgctgcaggccacagccgaggcgaacaacctggccgccgtagccggtgctagagatacctattgtaagagtatggagcaggtgtgtggcggggacaagccttacattgcaccctccgatctggagcggaagcacctggacctcaaggaagtagcgattaagcagttccgttcagtgaaaaagatgggcggcgatgagttttgccggcggtatcaagatcagttagaggcggaaattgaggaaacttacgccaatttcattaaacataatgacggtaagaacattttttacgcagccaggaccccagctacgttatttgctgtcatgttcgcaatgtacatcatctctggattgaccgggtttatcggattgaacagcatcgccgtcctgtgcaacctggtgatggggctggccctcatattcctttgtacctgggcttatgtcaaatattccggcgagtttagggagattggaacagtgatcgatcagatcgcggagaccctctgggaacaggtgctcaagcccctgggcgacaacctgatggaggagaatattcgccaatccgttacaaacagcatcaaagctgggctgaccgaccaagtttcccatcacgcacgcctgaagaccgactag

SEQ ID NO: 108891 - DNA, 1242 bp, Artificial Sequence
  Description of Artificial Sequence: Synthetic coding sequence
atggatacccagggcgccttcgattcacagagcaccatcaaagattgtgctaccgtgttcgcgttaagcacaatgacctcctccgttcaggtgtataacttatcccagaatatccaggaagacgatctccaacatctgcagttgtttacagagtacggtcgccttgcgatggaagagatttaccaaaagcccttccagacactgatgtttctcatacgagactggtcctacccctatgaacatagctacggtttggagggcggcaaacagttcctcgaaaaacggctccaggtcaaacagaatcagcacgaggagctgcagaatgtccgcaagcatatccacaactgcttcagcaacctgggatgcttcttactgccccacccgggcctcaaggtggccaccaacccttctttcgatggccggctgaaggacatcgatgaggatttcaaaagggagttgaggaatctggtccctctgctgctggcacccgaaaatttagtggagaaggaaatctctggatctaaggtcacgtgcagggacctggtcgaatatttcaaagcctatatcaaaatctatcaaggggaggaactaccccaccccaaaagcatgctgcaggcgaccgcagaggccaataacctggccgccgtagcaggagcacgcgacacatactgtaagagcatggagcaggtatgcgggggtgataagccctacattgccccaagtgacctggagaggaagcatctcgatcttaaggaggtggcaattaaacagttcagaagcgttaaaaaaatgggcggtgacgaattctgccggcgataccaagaccagcttgaggccgaaattgaggagacgtacgctaacttcattaaacataatgacggtaaaaacatattctatgctgcgaggactcccgccaccctgtttgcagtgatgttcgccatgtatataatttctggacttactgggtttatcggcctgaactcaatcgccgttctgtgcaacctggtgatgggattagctctcatcttcctttgtacctgggcatacgtaaagtactctggagaatttagggagataggaacggtgatcgaccagattgcagagacgctgtgggaacagcgctccccaaggaaagtcttttctaagcttttcgaagtcaccaggcggcgaatggtgcatagagctctctcaagtgcgcagagacagcgactgagtagtaacaataacaaaaagaagaattag

SEQ ID NO: 108892 - DNA, 1707 bp, Artificial Sequence
  Description of Artificial Sequence: Synthetic coding sequence
atgagaaccgctggccgggacccagtttccgccggtctccaattcccaaaggatggctccacccagcgccctgctaatagagcacgattcgtgcctgccagaacacgtccgagtcctcttcatccctgttgtttttgcttcgagggcggaggctccatgctatcaccacaaagggtggccgctgccgcttctcggggcgccgacgacgccatggagagcagcaatatactgctgcaggatcacattagagacctagacgtagtggtggtatcggtcgccggagcctttagaaagggcaagagtttcatcctggactttatgctccggtacctgtactcccagaaagaaagtggccacagcaactggttgggagatccagaggagcccctcactggcttctcctggaggggggggagtgatcctgaaacaacaggaatccagatttggagcgaggtcttcaccgtggaaaagcccggcggtaagaaagtggccgttgtacttatggacacccagggggcctttgattcgcagtctactgtcaaggattgcgctaccatttttgctctgagtactatgacctctagtgtgcaaatctataacctgagccagaacatccaggaagacgacctgcagcaactccaactgttcacagaatacggacgcttagccatggacgagatttttcagaaaccattccagaccctcatgttcctggtgagagattggtcctttccttatgagtactcctatggtctgcagggcggcatggcttttttggacaagcgacttcaggtgaaggaacaccaacatgaggagattcagaatgtgcgaaatcacattcattcctgtttcagcgatgtcacatgctttctgctacctcatcctggtttacaggttgccacctctcccgattttgatggcaaactgaaagacatcgcaggagagtttaaagagcagctacaggctctcatcccgtacgtgttgaacccttccaagctcatggagaaagaaatcaatggcagcaaagtcacatgtcgcgggcttctggaatatttcaaggcctatatcaagatatatcagggcgaggacctgccccatccaaagagtatgctccaagccacagcggaggcaaataatctggctgccgctgcctctgcaaaagacatctactataataatatggaagaggtctgtgggggggagaagccttatctcagccctgatatcctagaggagaagcattgcgaatttaaacagttggcactcgatcatttcaagaaaaccaaaaaaatgggcggcaaagacttcagctttcgctatcagcaggaactggaggaggaaattaaggaactctacgagaatttctgcaaacataacggatccaaaaatgttttttctacctttcggaccccagctgtgcttttcacgggaatcgtggccttgtacatagcatccgggctgacgggattcattgggctggaggttgtggcccagttgttcaactgtatggttggactgcttctcatagcgcttctgacatggggatacatcaggtactcagggcagtacagggagctagggggagcaattgacttcggggccgcttacgtgctggagcaggcatctagccacattggaaacagcacacaggccaccgtgagagacgctgttgtggggcgccctagcatggacaagaaggctcaatag

SEQ ID NO: 108893 - DNA, 1626 bp, Artificial Sequence
  Description of Artificial Sequence: Synthetic coding sequence
atgcttagtccccagcgagtggcagccgccgcatccaggggagcagacgatgcaatggagtcgagtaaaccgggacccgtgcaggtggttctcgtacagaaggatcagcattcgtttgagctggacgagaaggcactcgccagcatactactgcaggatcatatcagggacctggatgttgtagtggtgtctgtggcaggggcctttcggaagggcaagagcttcatcctggattttatgctcaggtacctctacagccagaaggagtctgggcatagtaactggctaggcgaccctgaagaaccgttaacgggctttagttggaggggcggaagtgatccagagacgactgggatacagatctggtctgaggtgttcactgtagagaagcctggcggcaaaaaggtggccgttgtgctcatggatactcaaggagccttcgatagtcagagtacagttaaggactgcgctaccatattcgccttgagtactatgacatcatccgtgcagatttacaacctgagtcaaaacattcaggaggatgacctgcaacagctgcagctgttcacagagtacgggcggcttgccatggacgaaattttccagaaaccctttcaaacgctcatgttccttgtgagagactggtcgtttccctatgaatactcttacggcctgcagggaggtatggccttcctggataaacgcctacaggtgaaagaacaccagcacgaggaaattcagaacgttcgtaatcacatacatagttgcttttccgacgttacatgcttcctcctcccccaccccgggttacaggtcgccacatcccccgacttcgatggcaagctaaaggacatagctggagaattcaaggaacaactccaggccctgataccttatgtgctgaatcccagtaagctgatggagaaggagatcaacggtagcaaggtcacatgccgcggcctcctcgagtactttaaagcatacatcaagatctaccagggtgaagacttgcctcatcctaagagtatgcttcaagcaacggctgaagccaataatctggccgctgctgcctctgccaaggatatttattacaataacatggaggaggtgtgtggcggagagaaaccttatcttagtccagatattctggaagaaaaacattgcgagttcaaacagttagctctggaccacttcaaaaaaaccaagaaaatgggcgggaaggattttagttttcgatatcaacaagaactggaggaggagatcaaagagctctacgagaacttctgtaaacacaatgggtctaagaatgtattctctacgtttcggactccagccgttctatttactgggattgtcgccctgtacattgctagtggcctgaccggtttcattgggttagaggtggtcgcacagttattcaattgcatggtggggcttctgctaatcgccctactcacctggggctatatcagatactccggccagtaccgggagcttggcggcgccattgatttcggagcagcatacgtcctcgaacaagcctcaagccatatcgggaattcaacacaagccacggtcagagatgccgttgtcggcaggccatccatggataagaaagcccaatag

SEQ ID NO: 108894 - DNA, 1065 bp, Artificial Sequence
  Description of Artificial Sequence: Synthetic coding sequence
atgtctcgactgctacatgccgaggagtgggcagaagtcaaggagcttggcgaccatcaccggcagccgcagccacaccacctacctcagcctccacccccaccgcagccacctgctacacttcaggctcgagaacacccagtgtatcctcccgaactcagcctcttggactcaaccgacccacgcgcttggctcgcccccaccttacaggggatttgtacagccagggcggcccagtacttgttacatagccctgaattaggagccagcgaggctgccgctccccgggacgaagtggacggaagaggcgagctggtgcgtcgcagcagcggtggcgcctcctcttcaaagagtccaggcccagttaaggtgagggaacaactctgcaaactgaaagggggcgttgtggtagacgaactaggctgttcacggcagcgggctccatcttctaaacaggtaaatggggtgcaaaaacagcgtcgactggccgcgaacgccagagagcggcggcggatgcacggactgaaccacgctttcgaccagctcagaaatgtgataccgtccttcaacaatgataaaaaactctccaaatatgaaaccctgcaaatggcccagatttatatcaacgcactaagcgagctgctgcagactccttcaggtggcgagcaaccacctccgccaccagcatcctgcaaatcagatcatcaccacctgcgtacagcagcctcttacgaaggtggcgccggtaatgccacagcagccggtgcccaacaagccagtggggggagccaacgccccactccgcctggttcttgtaggactcgcttcagtgctcctgcaagtgccggagggtactcagtccaactagacgcactgcattttagtaccttcgaagactctgccttgacagcaatgatggctcagaaaaacctgtcaccttccttaccgggcagcatcctccagccggttcaagaggaaaatagcaagaccagcccgagatctcaccgcagcgacggtgaattttcccctcactcgcactatagcgattctgatgaggctagttag

SEQ ID NO: 108895 - DNA, 459 bp, Artificial Sequence
  Description of Artificial Sequence: Synthetic coding sequence
atgaagtcttgtaaaccaagcgggcctccagccggggcacgggtggcccccccatgtgcgggcgggaccgaatgtgctgggacttgtgccggagccggccgactcgagtcagctgcccgtcggaggcttgccgctaatgcccgggagcggaggcgtatgcaaggattgaacacagcgttcgaccgcttgcgccgcgtggttccccagtggggccaggataaaaagctgagtaaatatgagacattacagatggcactgtcttacattatggctctaacgaggatccttgccgaggctgagcggttcggttctgagcgcgactgggtcggactacattgcgagcactttgggagagaccattatctgccattccctggcgctaaacttccaggcgagagcgagctctactctcagcggctcttcggctttcaaccagagccattccaaatggccacctag

SEQ ID NO: 108896 - DNA, 627 bp, Artificial Sequence
  Description of Artificial Sequence: Synthetic coding sequence
atgtggagatcctgcctgaggcttagagacggcggacgccgcctgcttaatcgacctgctggtggccccagtgcctcgatgtctcccggccccaccatcccttctcctgcccgcgcttacgccccaccgaccgagaggaaacgcttctatcagaatgttagcataactcagggggagggggggtttgaaatcaatctagatcaccggaagctcaaaaccccgcaggctaagttgtttactgttcccagcgaagctctcgccatagcagttgctacagagtgggacagtcaacaggatactatcaaatactataccatgcacctgacaacgttgtgcaataccagcctggacaaccccacccagaggaataaggaccaacttatcagagccgccgtaaaattcctggatactgacaccatctgctatagagtagaggagccagagacgctggttgagctgcaacggaatgagtgggaccctatcatagagtgggcggaaaagcgctatggggttgagatatccagctccaccagtatcatgggcccgagtattcccgccaagacacgggaggtgctggttagccacttggcctcctacaacacatgggccctgcaaggaatggattag

SEQ ID NO: 108897 - DNA, 618 bp, Artificial Sequence
  Description of Artificial Sequence: Synthetic coding sequence
atgtggcggtcctgcctgcgcctccgagatggcgggcgtcgcttgctcaaccgaccagccggaggtccaagcgccagcatgagccccggccccacaattccttctcctgccagggcttacgcccctcctaccgagaggaagcggttctatcagaacgtgtccatcacacagggagagggtggttttgaaatcaacctagaccataggaaactcaaaactccgcaggcaaagttgttcacagttccttcggaagccctagccattgccgtcgccactgagtgggacagccagcaggatactataaaatactacacaatgcacctgaccacgctttgtaacactagtctagataatcccacacaaagaaacaaagatcagcttattagggctgccgtgaagttcctcgacaccgacacaatatgctatcgcgtggaggagccagaaacactcgttgaattgcaacgcaatgaatgggaccctattatcgaatgggcagaaaagaggtacggggtcgagatcagttcgtctaccagcatcatgggcccatctattcccgccaaaaccagggaggtcctcgtttctcacctcgcgtcctataatacttgggccctgcagtag

SEQ ID NO: 108898 - DNA, 870 bp, Artificial Sequence
  Description of Artificial Sequence: Synthetic coding sequence
atgtggaggtcttgccttcgtctccgggacgggggtagacgtctcctgaacagacctgccgggggcccatctgcctccatgtcacctggccccacaatcccttcaccagccagagcgtatgctccccctacagaaaggaagagattctatcagaacgtgtctatcacacagggagaaggtggtttcgaaatcaatcttgatcataggaagctgaaaacacctcaggccaagttgtttaccgtgccgagtgaggctctcgccattgccgtggctactgagtgggattcccagcaggacacaatcaagtactatacaatgcacttgaccactttgtgcaacacttctctcgacaaccccacccaacggaataaggatcagctaataagggcggccgtgaagtttctcgacacagacacaatctgttaccgcgtggaagagccagaaactctcgtggagctccagagaaatgaatgggatcctatcattgaatgggctgaaaagaggtacggcgttgaaatcagctcctctacgagtatcatgggtcctagcatccccgctaaaacccgggaggtcctggtgagtcatttggccagctacaacacatgggctcttcaaggaatcgagttcgttgcggcacagttgaagtctatggttctgactctaggactgattgacctgcgacttactgtggagcaggccgtgttgctctcacgtcttgaagaggaataccagatccagaagtggggcaacatcgagtgggcacacgattacgaactgcaggagctccgtgcccggactgcagcgggaaccttgtttatccatctttgtagcgaaagcaccaccgtgaaacataaactcctcaaggagtag

SEQ ID NO: 108899 - DNA, 1590 bp, Artificial Sequence
  Description of Artificial Sequence: Synthetic coding sequence
atgctcggattcgtgggtcgcgtcgctgcagcgcctgcgtccggcgctttgcggcggttgactcctagcgcaagtcttcccccggcacaactactactacgggccgctcccaccgctgtgcacccagtgcgcgactatgccgcccagacaagcccatcaccaaaagctggagccgctaccggacgcatagtggccgtaatcggcgcagtcgtcgatgtgcagttcgacgaggggctgcctccaattttaaatgcgctcgaggtccagggccgcgagaccagattggtgctggaagttgcccagcacctaggcgagagcactgtgcgaacaatcgcaatggatggtaccgaggggctagttaggggacaaaaagtcctggatagcggtgcgccgataaaaattccagtgggtccggagacactaggccgaattatgaacgtgatcggggaaccaattgatgagcggggccccattaagaccaaacagttcgccccaatccacgcagaggcgcctgaattcatggagatgtccgtcgagcaggagatcctcgtcacaggtataaaagttgttgatcttctagctccctacgcgaaggggggaaagatcggtctatttggcggggccggggtcggcaagacagtacttatcatggaactcatcaacaacgttgccaaggctcatgggggttacagcgtattcgccggggtaggcgagcgcactcgggagggaaacgatctgtaccatgaaatgatcgaatctggggtgatcaatctgaaggacgctacctccaaagttgccctcgtgtacggccagatgaacgagccccctggagctagagcccgcgtggccctgactggtttgacggtggccgagtatttccgagatcaggagggacaggacgttttgctcttcatagataatatctttcgatttacacaagctggatccgaggtttccgcactgctgggccggatcccgtcagctgtaggttatcagcccacactggcaactgacatgggtactatgcaggagaggatcaccaccactaagaagggaagcattacctcagtacaggcaatctatgttcccgccgatgatctgacggaccccgcccctgcaaccacgttcgcccatcttgatgcaaccaccgttctgtcccgagctattgcagaactgggcatctaccctgctgtggacccccttgacagtacgtctaggattatggacccaaacattgttggctcagaacactatgacgttgcccgaggtgtgcaaaaaattctgcaagattacaagtcattgcaggatataattgcaatactcgggatggatgagctcagcgaggaagacaaactcacggtgtcccgagcaagaaaaatccagcggtttctgtctcagcccttccaggtcgccgaagttttcaccggccacatgggaaagctcgtgccattgaaggaaactattaagggattccagcagattcttgcgggcgagtacgatcacctccccgaacaagcgttttacatggttggacccatcgaggaagctgttgcaaaagctgataaactggccgaagagcactcaagctag

SEQ ID NO: 108900 - DNA, 156 bp, Artificial Sequence
  Description of Artificial Sequence: Synthetic coding sequence
atggtggcgtactggaggcaggcaggactgagttacattcgatacagccagatttgtgccaaggccgtgcgcgacgctctgaaaacagaattcaaggccaacgctgaaaagacctctggttccaacgtcaagattgtaaaagtgaaaaaggagtag

SEQ ID NO: 108901 - DNA, 156 bp, Artificial Sequence
  Description of Artificial Sequence: Synthetic coding sequence
atggttgcctactggcggcaggcaggcctgtcctacatccgctacagccagatctgtgccaaagccgtgagagacgcactcaaaaccgagtttaaagcaaacgctgaaaagacatccgggtccaatgtgaaaatcgtgaaagtgaaaaaagagtag

SEQ ID NO: 108902 - DNA, 156 bp, Artificial Sequence
  Description of Artificial Sequence: Synthetic coding sequence
atggtggcatactggaggcaagccgggctaagctatatcaggtatagccagatctgcgccaaggctgtacgagatgccttgaagacggagttcaaagctaacgctgagaagacatcaggctcaaatgtaaagattgtgaaggtcaagaaggagtag

SEQ ID NO: 108903 - DNA, 894 bp, Artificial Sequence
  Description of Artificial Sequence: Synthetic coding sequence
atgttctcacgtgctggcgttgccggactctcagcgtggacactccagcctcagtggattcaggtgaggaacatggccaccctcaaggatatcaccagacgactgaagagtattaagaacattcagaagatcacgaagtcaatgaagatggtagcagccgcgaaatacgcccgggcagagagggaattgaaaccagctaggatttatgggctcggctcactcgcactgtacgaaaaagcagatatcaaaggtccggaagataagaagaaacacctgcttatcggtgtctcctctgatcgcgggctgtgcggggccatccactcgagcatagcaaaacaaatgaagtcagaggtggccacccttacagccgcaggtaaagaagttatgctggtcggcatcggtgacaagatacgcggcattttgtaccggacgcacagtgatcagtttctcgtggccttcaaggaagtagggcggaagccaccaacattcggcgacgcatccgtgattgccctggagctactgaatagcggttacgaattcgacgaagggagcatcatcttcaacaaattccggagcgtgatcagctataaaactgaggagaagcctatctttagtttgaatacagttgcatctgcagactctatgtcaatctacgacgacatcgacgctgatgtgcttcagaactaccaagaatataacctggccaacattatctattatagtctcaaagaaagtacaacttctgagcagtctgctaggatgaccgcgatggataatgcctctaagaacgcttccgaaatgatcgacaagttgacgttgaccttcaataggacacggcaggctgttatcactaaggagctgattgaaattatctccggcgccgccgctttgtag

SEQ ID NO: 108904 - DNA, 897 bp, Artificial Sequence
  Description of Artificial Sequence: Synthetic coding sequence
atgttctcccgggcaggggttgcaggcctgtccgcttggactctgcagccacagtggatccaggttcgtaacatggccacactgaaggatatcacgcgacgcctgaaatcaataaaaaatattcagaagatcacaaagtctatgaagatggtagccgcagctaagtacgcaagggcagagagggagctgaaacctgcgagaatctatggacttgggagcctggcattgtatgaaaaagctgatatcaaaggacccgaagacaagaaaaagcacctgctcattggcgtgagctcagaccgcggactctgcggagcaatccatagtagcatcgctaagcagatgaagtccgaagtggctactctgactgccgcagggaaagaggtcatgctggtcgggatcggtgataagatcaggggaatcctataccgcactcacagcgatcagttcctagtcgcattcaaggaggttgggagaaaaccccctaccttcggtgacgcatcagtgatagctctggaattacttaactccggctacgagtttgacgaagggtctattattttcaacaagtttagatcagtcatctcatataagaccgaagaaaagcccatattctccttgaacaccgttgcttcggcagactccatgagcatttacgacgatatcgacgccgatgtactgcagaactaccaggaatataatctcgccaacattatctactacagtctgaaggaaagtacgaccagcgagcaaagcgcccggatgaccgccatggataacgcaagcaagaatgcctcggaaatgatcgataagttgactctgactttcaacagaacacgccaggccgttatcacgaaggagctgattgaaattatcagcggcgctgccgctctcgactag

SEQ ID NO: 108905 - DNA, 753 bp, Artificial Sequence
  Description of Artificial Sequence: Synthetic coding sequence
atgaagatggtcgcagctgccaagtacgctagagccgagagggaacttaaacctgctaggatttacggcctcgggtccctggcgttgtacgaaaaagcagacataaaaggccccgaggacaagaaaaaacacctgctaattggggtgagttcagacaggggtctctgtggagccatccattctagcattgctaagcaaatgaagtccgaggttgctaccttaactgctgccgggaaggaagtaatgctggtcgggattggggacaaaattcggggcattctctaccgcacccattctgaccagttcctcgtcgctttcaaggaggtggggcgtaagccccctacgttcggagacgcttccgttattgctctagaacttctgaatagcggctacgagttcgacgaggggtccatcattttcaataaatttagatccgtgatatcctataagactgaggagaagcccatattttcactgaataccgtggcatcagcagatagcatgagcatatatgacgacattgatgccgacgtccttcagaattatcaggagtacaaccttgccaatataatttactatagcctgaaggaaagtacgacttcagagcagtccgccaggatgacagcgatggataatgcgtccaagaatgccagcgagatgatagataaactgaccctgacctttaaccgcacacgccaagcggtcattacaaaggaacttatcgagattatctctggggcagctgcgctgtag

SEQ ID NO: 108906 - DNA, 642 bp, Artificial Sequence
  Description of Artificial Sequence: Synthetic coding sequence
atggcggcccccgccgtaagtggcctgtcaaggcaggtgagatgcttcagcacatctgtcgtacgccccttcgctaaactggtgcgccccccggtgcaagtgtacgggattgaaggacggtatgcgacagcactgtactctgctgcgtccaaacagaataaacttgagcaggtggagaaagagttactcagagtggctcagatcctgaaggaacccaaagtcgctgcttccgtactcaacccctacgttaaaagatccatcaaggtcaaaagtctgaatgacattacagccaaagaacgattcagtccgctcacgaccaatctgatcaatctgttggcagaaaatggcaggttgagcaacacacagggcgtcgtctccgctttctctacgatgatgtccgtgcacaggggggaagtgccctgcaccgtgaccagtgcgagccctctggaggaagccaccctgagcgaactgaagacagtcttaaagtcgtttctcagccagggtcaggtgctaaaactagaggctaaaaccgacccaagcattctgggcggtatgatcgtgcggatcggcgaaaagtacgtggacatgagcgtcaagacaaagattcagaagctgggtcgggccatgcgtgagattgtgtag

SEQ ID NO: 108907 - DNA, 411 bp, Artificial Sequence
  Description of Artificial Sequence: Synthetic coding sequence
atgcaaaccgccggagcactcttcattagccctgccttaattcggtgttgtaccaggggcctaatccggcctgtttctgcatcattcttaaactcacctgtgaactcaagcaagcaacctagttattctaacttccctttacaggtggccagaagagagttccaaactagcgtggtcagtagggatatagatacagccgcgaaatttatcggtgctggggcggctacagttggggtagcgggaagtggcgctggtatcggtactgtgttcgggagcctcataattggttacgcgcgcaatcccagccttaaacaacagctgttctcttacgccatacttggatttgctctctctgaggcaatggggctgttctgtctgatggtggcttttctcatcctgtttgctatgtag

SEQ ID NO: 108908 - DNA, 411 bp, Artificial Sequence
  Description of Artificial Sequence: Synthetic coding sequence
atgcagactgctggtgccctgttcatatcacctgcgctcatcaggtgctgtacccggggattgattaggcctgtcagtgcctcattcctaaattcacctgtaaattcttccaaacagccctcatactctaacttccctttacaggtggccagaagggagtttcagacatcagtggtgtctagggatatcgataccgccgctaagttcattggagcgggcgcagccactgtaggggtggccgggtctggagctggtatcggcaccgtgtttggctctctgattatcgggtacgctcgaaatccatctctcaagcagcagctctttagctatgccattttgggttttgcactgagcgaggcaatgggactgttttgtctaatggtggcgttcttgatactattcgccatgtag

SEQ ID NO: 108909 - DNA, 474 bp, Artificial Sequence
  Description of Artificial Sequence: Synthetic coding sequence
atgcccgagctcatcctgagccctgccactgcgccccatccactgaaaatgtttgcttgctcaaagttcgtgagtacgccaagcctcgtaaaatctacctcccaacttctgagcaggcctttgagtgccgtcgtgctcaagcgccccgaaattcttactgacgaatctctgagctcactggccgtgtcttgccccttaacaagcctcgtatcaagcaggagtttccagacttcggccataagtcgggatattgacacggctgcgaaatttatcggggccggagcagccacagtgggtgtcgccggtagcggcgccggaatcggtaccgttttcggatccctcattatcggctacgctcggaaccctagccttaaacagcaactgttctcttacgctatcttaggtttcgccctctctgaggctatgggcctgttttgtttaatggtggccttcctgatactctttgccatgtag

SEQ ID NO: 108910 - DNA, 597 bp, Artificial Sequence
  Description of Artificial Sequence: Synthetic coding sequence
atgcctgaattaattttatatgtggcaatcactctgtccgtcgccgaacgacttgtcggacccgggcacgcttgtgccgaacctagctttagatccagccggtgcagcgcgcctctgtgcctgctctgctctggctcgagttcccccgccacagccccccaccctctcaaaatgtttgcctgctctaagtttgtgtcgaccccctctctcgtgaagtcgacgagccagctgctgtctaggccccttagcgccgtggttctgaagaggcctgaaatcctgacagacgaatctctgtccagtttggctgtctcatgtcccctcacaagcctggtgtcgagcaggtcattccagaccagcgctatctcccgggacatcgataccgcagccaagtttatcggggctggcgctgccacagtcggagtggcaggctcaggagcaggcattggaaccgtgttcggctcgttaattattggctacgcacgtaatccctctctcaagcagcagttattcagttatgctattctgggattcgccttgagcgaggcgatgggattattttgtctgatggtcgcattcttgattctcttcgctatgtag

SEQ ID NO: 108911 - DNA, 426 bp, Artificial Sequence
  Description of Artificial Sequence: Synthetic coding sequence
atgtttgcctgctctaaatttgtatccaccccgagtctagtgaaatctactagccagttactgtccaggccactgtcagcggtggtcctgaagcgccccgagattctgacagatgagtccctttctagcctggcggtgtcctgtcccctcaccagcctggtgtcatctcgatcgtttcagacttctgccatctcaagagatatcgataccgctgcaaagttcataggagctggcgccgcaacagtgggagtggccgggtccggcgccggaatcggtactgtcttcggttccttaatcatagggtacgctcgtaatcctagcttgaagcagcagttgttcagctacgcaatactcggcttcgcgctgtccgaggcaatgggcttgttctgcttaatggtggcatttctgatattgtttgcaatgtag

SEQ ID NO: 108912 - DNA, 429 bp, Artificial Sequence
  Description of Artificial Sequence: Synthetic coding sequence
atgttcgcttgtgccaagttggcgtgtacgccgtccttgattcgggctggttcccgagtcgcttacagacctattagcgcctctgtccttagccggccagaagcgtctcggaccggcgagggctccacggtcttcaacggcgctcagaacggcgttagccagctgatccagagagaattccagacctctgccatctcaagggacattgacacggctgcgaagtttattggcgctggcgccgccaccgtgggggtggctggatcgggtgccgggattggcactgttttcggctctctgatcattggctatgccaggaacccctcccttaagcagcaactgtttagttacgccattcttggatttgcactcagtgaggccatgggtctgttttgcctgatggtggcctttcttatcctctttgccatgtag

SEQ ID NO: 108913 - DNA, 429 bp, Artificial Sequence
  Description of Artificial Sequence: Synthetic coding sequence
atgtttgcctgcgcaaaactggcttgtactccctccctgattagagcgggctctagggtagcctaccggccgatctccgctagcgtgctgtccaggcctgaggcttctcggacgggtgaaggcagcacagtttttaacggcgcacagaatggggtctctcagctgattcagcgcgaatttcagacttcggccatcagccgggacattgatactgccgcaaagtttattggcgcaggcgccgctactgttggcgttgctggaagtggggcaggcattgggactgtgtttggcagcctcatcatcggatatgcacgcaatccctcccttaagcagcagctgttctcatacgcaatccttggattcgccctgtccgaggccatgggactgttttgtctgatggtggcatttctgatcctctttgcaatgtag

SEQ ID NO: 108914 - DNA, 429 bp, Artificial Sequence
  Description of Artificial Sequence: Synthetic coding sequence
atgtttgcctgcgctaagctcgcttgcactccatcactcattagggccgggagccgagtggcatacaggcctattagcgcttccgtcctgtctcgacccgaagcctctcggactggtgaaggctcaaccgtcttcaacggcgctcagaacggcgttagtcagcttatacaaagggagtttcagacgtcagccatctcaagggatattgatacagcagctaagttcattggagccggtgctgcaacggttggcgtcgctggttccggagctggaatcggaactgtgttcggctccctcataattgggtatgctcggaacccttctttgaagcagcaactgttctcttacgcaatcctcggcttcgcgctttcagaggcaatgggccttttctgtcttatggtagccttcctgattctattcgcgatgtag

SEQ ID NO: 108915 - DNA, 210 bp, Artificial Sequence
  Description of Artificial Sequence: Synthetic coding sequence
atggtgccccccgtgcaggtttccccattaattaaactcgggagatactctgctctctttctgggggtggcctatggcgcaaccagatataactatctgaagcctagggcagaggaagaacggaggatagctgccgaagagaagaagaagcaggacgagctcaagaggatcgcacgagaactggccgaagatgatagtatcttgaagtag

SEQ ID NO: 108916 - DNA, 327 bp, Artificial Sequence
  Description of Artificial Sequence: Synthetic coding sequence
atgattctccagcgtctgttccgctttagtagcgtcatcagatcagcggtgtccgtgcatctgcgcaggaacatcggagtgaccgccgtcgcgttcaacaaagagttagatccaattcagaaactgtttgtcgataaaataagggagtataagagcaagagacagacctccggggggccagtcgatgcctcatccgagtaccagcaagaactagagcgcgagctttttaaattgaaacagatgtttggcaacgccgatatgaacacgttccctaccttcaagtttgaggacccaaaattcgaggtgattgagaagccacaggcatag

SEQ ID NO: 108917 - DNA, 327 bp, Artificial Sequence
  Description of Artificial Sequence: Synthetic coding sequence
atgatccttcaacggctcttcagattctcgtctgttattaggtccgctgtctccgtgcatcttcgcaggaatattggggtcacagccgtggcttttaacaaggagctggaccccatccagaagctgtttgtggataagatccgcgaatataagtccaagagacagacctccggcggacccgtagacgcatcaagcgaataccagcaggagcttgaacgcgagctgtttaagttgaagcaaatgttcggtaatgccgacatgaacaccttccccacatttaagttcgaggaccctaaatttgaggtcatcgaaaagccccaggcttag

SEQ ID NO: 108918 - DNA, 327 bp, Artificial Sequence
  Description of Artificial Sequence: Synthetic coding sequence
atgattctgcagaggctgttccggttctccagtgttattaggtccgccgtttccgttcatctcagacgcaatatcggcgtcactgctgtggcttttaataaggagctggatccgatccaaaaactcttcgtcgataagattagagagtacaaatcaaaacgccagacctctggtggacctgtcgatgcctcctcggaatatcagcaggagctggagcgcgagctgttcaagttaaagcaaatgttcggaaatgcggatatgaacacatttcctacatttaagtttgaggatcctaaatttgaagttatcgaaaaaccccaggcctag

SEQ ID NO: 108919 - DNA, 327 bp, Artificial Sequence
  Description of Artificial Sequence: Synthetic coding sequence
atgatcctgcagcgactgtttcggttctcaagcgtgatcagaagcgccgtcagtgttcacctccgccggaacataggcgtgacagccgtagcctttaacaaggaacttgaccccatccagaaactgttcgttgataagattcgcgaatacaagtcaaaacgccagacgagcgggggccccgtcgatgcttcatcagagtaccaacaggagttggaacgtgagctgttcaaattgaagcaaatgttcggcaacgccgatatgaacactttcccaaccttcaaattcgaggaccccaagtttgaggttattgaaaagccccaggcttag

SEQ ID NO: 108920 - DNA, 327 bp, Artificial Sequence
  Description of Artificial Sequence: Synthetic coding sequence
atgatactgcaaagattgttcaggtttagttccgtaatccgaagcgctgtctctgtccacctgcgccgcaacattggtgtgaccgccgttgcttttaacaaggaacttgatccaatccagaaactgttcgtggacaaaatcagggagtacaaatctaagcggcagacctctggcggtccagttgatgcatcgtccgagtaccagcaggaactggaaagagagctgtttaagctgaaacagatgtttggcaatgcagatatgaacacgttcccaacattcaaattcgaggaccctaaatttgaggttatcgagaaaccccaagcctag

SEQ ID NO: 108921 - DNA, 351 bp, Artificial Sequence
  Description of Artificial Sequence: Synthetic coding sequence
atgcactgtgatggtggcatctccatgatcctccagcggctctttcgcttttcatctgtgatcaggagcgctgtctcggtacatctccggagaaacattggggtgactgctgtggcatttaacaaggagctggaccccatccagaaactgttcgttgacaaaataagagagtacaagtctaaaaggcagacgagtgggggcccggttgatgcctccagtgagtaccaacaggagttggagagagaactgtttaagctcaaacagatgtttggaaatgcggatatgaatacttttcctacgtttaagttcgaggacccgaagttcgaggtgatcgagaagcctcaggcgtag

SEQ ID NO: 108922 - DNA, 567 bp, Artificial Sequence
  Description of Artificial Sequence: Synthetic coding sequence
atgaccgccaagggaagtaccggcatggagattctcctgtccacccttgagaatacaaaagacctccagaccactctgaacatcctgagcattttggtggaactcgtatcagccgggggcgggcggagagtatcctttctcgtgaccaaaggtggaagtcagatcttgctgcagctgctgatgaatgctagcaaggagagcccgccacatgaggacctgatggtgcagatccacagtatccttgccaagatcgggccgaaagataaaaagttcggggtcaaagcacgtatcaacggcgctctgaacatcacacttaacctcgtaaagcagaatctgcagaaccatcgattagtgctgccttgcctccagttactgagagtgtattcggctaacagcgtgaacagcgtgagtttgggaaaaaacggagtggtcgagttaatgttcaagataatcgggccatttagcaagaagaatagttcattgataaaaaataagtgtcaggagagttgtcggcagagaatctgcccaagcgccttcaataatctgtgcagactggcacccccttag

SEQ ID NO: 108923 - DNA, 3681 bp, Artificial Sequence
  Description of Artificial Sequence: Synthetic coding sequence
atgtcaaagttgaaggtgatccctgaaaagtcactgaccaataactcccggattgtgggtctgttggcccaactcgagaaaatcaacgccgagccttcagagagcgacactgctaggtacgtgacaagtaaaattttacatttggcgcagtctcaagagaagactcgtcgtgaaatgacagccaaggggtcgacaggcatggagattcttctcagcaccctcgaaaatacgaaggatctccagacaacactgaacattctgtccatcctggtcgagctggtgagcgctggcggaggaagacgcgtgtcttttctcgtcacaaaggggggaagtcagatcctgctccaactattaatgaacgcaagtaaagaaagcccaccccatgaagacctgatggtgcagatacattccatattggcaaaaatcggtccgaaggataaaaagttcggggtcaaggcccggatcaatggtgcactcaatattactctcaatttggttaaacagaacttgcaaaaccacagactcgtcctgccttgtttgcagctgttaagagtatactcagccaacagtgttaacagcgttagcctaggaaaaaatggcgttgtcgaactcatgtttaagataataggaccttttagtaaaaaaaattcttccctcataaaggttgccctggataccctggctgcgctgcttaagagtaagaccaacgcgaggcgtgcagtggatcggggctatgtccaggtccttttaacaatttacgtcgattggcatcgccacgacaatcgtcatcgtaacatgctgatcagaaagggcatactacagtccctgaaaagcgttaccaacataaagttggggcgtaaggcattcatcgatgccaacggaatgaagattctttataatacttcccaagagtgtttggctgtgaggaccttggaccccctcgtcaatacctcttcactaataatgcggaagtgcttcccaaagaacaggctccccttacccacaatcaaatcctcatttcactttcagctcccagtgatccccgtaactggaccagtggcacagctgtacagcctccctccagaggtggatgatgtcgtggatgagagcgatgataatgacgatatcgatgtggaggcagaaaatgagactgaaaatgaggatgatctcgaccagaacttcaaaaatgatgacattgagaccgatattaataagttgaaaccgcagcaggagcctggccgcactatcgaggatcttaaaatgtatgaacacttatttcccgaactggtcgacgactttcaggattacgatctgataagcaaggagccaaagcccttcgtatttgagggaaaggttcgtgggcctatcgtggtgccaacagcaggagaggaaacttcgggcaacagtggcaacctacgcaaggttgtgatgaaagagaatatcagcagcaaaggcgacgagggggagaagaagtctactttcatggatctggcaaaggaagatatcaaagacaacgacaggacactccagcaacagcccggcgaccagaatagaactatttcaagtgtgcatggacttaacaacgacattgttaaggccctagaccgcattacattacagaacataccctctcagactgcgcccgggttcactgctgaaatgaagaaagactgttcactgcctctgaccgtcctgacctgtgccaaggcatgtccccacatggcgacttgtggcaatgtgctgtttgagggacgcacggtgcaattgggaaaactctgctgtacaggtgtggaaaccgaagacgatgaagatactgagagcaatagctctgtagaacaggcttcagtggaggtgccagatggcccaacactgcacgatcccgatctgtatatcgaaattgttaagaacaccaagtctgtgcccgagtacagcgaggtggcttaccctgactactttgggcatatccctccaccgtttaaggagcctatcctcgaaagaccatacggtgtgcagcgcacaaaaatcgcacaggacatcgaacgcctcatccatcagagtgacattatagacagagttgtgtatgacctagacaacccgaattatactatccctgaggaaggcgacatccttaaatttaatagcaagtttgaatcaggcaatttgcgcaaagtgatccagattagaaaaaacgaatacgatctcattctcaactcagacattaatagcaaccattaccaccagtggttctactttgaagtgtcgggcatgagacccggggttgcataccgctttaatattatcaactgcgagaaatcgaattcccagtttaattacggcatgcagcccctgatgtactccgttcaagaagccctcaatgctcgcccttggtggatcagaatgggcactgacatctgctattacaaaaatcatttcagcaggtcctccgtggccgcaggaggacagaagggtaaaagttactacaccattaccttcactgtcaactttccccataaagacgatgtgtgttatttcgcttaccactacccttatacctactccacacttcagatgcacctacagaagttggagtctgctcacaacccacagcaaatctatttcagaaaggatgtactgtgtgaaaccctctccggcaattcctgtcctttagtcaccatcactgccatgccagaaagtaattattatgagcacatatgtcactttcggaaccgcccatacgtgttcctaagtgcacgggtccacccaggagagactaatgcctcttgggtcatgaaagggaccctcgaatacctgatgtcaaataatccaactgctcagagcctgcgggagagctatatattcaaaatcgtgccaatgcttaacccggatggtgtgattaacggcaatcaccggtgctccctgagcggcgaagatttgaaccgccagtggcaatctcccagtcccgacttgcatcctacgatctaccacgcaaagggtctgctccaatacctcgctgcagtgaaacgcttgccacttgtttattgcgattaccatgggcacagcagaaaaaaaaacgtcttcatgtacggctgtagcatcaaagaaaccgtgtggcacactaacgataatgctacgagttgcgacgtagtggaagacaccggatatagaacactgcctaagattctctcgcatatagcccctgccttctgtatgtctagctgcagcttcgttgtggaaaaaagcaaggaatccactgcacgcgtcgtggtgtggagggagatcggcgtgcaacgtagctacacaatggaatctacgttgtgtggttgtgatcagggcaagtataaaggccttcaaatcggaacccgggagcttgaagaaatgggggcaaaattttgtgtgggactgctgcggcttaagaggttaacgagcccactggagtataacctcccatctagcttactggactttgaaaacgacctgattgaatcatcatgcaaggttacttcccctaccacctacgtgctagacgaagatgaacctaggttcctggaggaggtggattatagcgcagagtctaatgatgaactggacatcgaactcgccgaaaatgtgggcgactacgagccctccgcccaggaggaagtgcttagtgattctgagctgtccagaacgtatctgccctag

SEQ ID NO: 108924 - DNA, 567 bp, Artificial Sequence
  Description of Artificial Sequence: Synthetic coding sequence
atgactgcaaagggaagtaccgggatggagatcctgctgtctaccctggaaaacactaaagatctccagacgaccctgaatatcttgtcaattcttgtggaactggtaagtgctggagggggcagacgagtgtctttcctggtgaccaaagggggatcgcaaatcctactccagcttctgatgaatgcgtccaaggaatccccgcctcatgaggatctgatggtgcagatccatagtattctcgccaagatcggaccgaaggacaagaagttcggcgtcaaagctcggataaatggggcacttaatattactctcaacctggtgaaacaaaacctgcagaaccataggttagtgctcccttgcttgcagctgctgcgcgtgtattctgccaacagtgtgaatagtgtgagcctgggcaaaaatggcgtcgtggaactcatgtttaaaatcattggcccgttctcgaagaaaaactcaagccttataaaaaataaatgccaagagagctgtaggcagcgcatctgtccatctgcttttaataacctgtgccgactggcgcctccttag

SEQ ID NO: 108925 - DNA, 714 bp, Artificial Sequence
  Description of Artificial Sequence: Synthetic coding sequence
atgtccaagctcaaagtaatccctgaaaagtctctgactaataactcaagaatcgtgggcctcctagctcagctcgagaagatcaacgcagagccttctgagagtgacacagctcgctatgtcacatccaaaatcttacacttagcccagtcccaagagaagacccggcgcgaaatgacagcgaaaggatctaccggaatggaaatcctcttaagtacgttggaaaacactaaggatctgcagacaactcttaacatcctgagcatccttgtggagctggtcagtgccggcggcggaagacgtgtgagctttctggtcacaaaaggggggtctcagatcctgcttcagcttctcatgaatgcttccaaggaatctccacctcatgaggacctcatggtgcagattcacagtatcctggcaaaaatcggcccaaaggataaaaagttcggcgttaaggcccgaatcaacggtgcattgaacattacccttaacctggtaaagcagaacctgcagaaccaccggctggttctcccctgcttacagttgttacgcgtatactctgctaatagtgtgaactccgtcagcctaggaaaaaacggggttgtggaactcatgttcaagatcatcggccctttctctaagaagaacagctcccttattaagaacgtatggcagtctgggctgtggatactactgtccatcccgccggtttag

SEQ ID NO: 108926 - DNA, 3561 bp, Artificial Sequence
  Description of Artificial Sequence: Synthetic coding sequence
atgagtaagctgaaagtgattcccgagaagtccctcacaaacaactctcgcattgtcggattgttagcccagcttgagaaaatcaacgctgagccgtcggaatcagacactgcccggtacgtgacatcaaagatactgcaccttgctcagagtcaagaaaagacgcgacgagaaatgacagccaaaggctcaaccgggatggagatccttctctccacgctggagaatactaaagacttacagacaacccttaatatattgagcatcttagtggagctggtgtccgccggaggcggacgcagggtcagcttccttgtgaccaagggagggtcccagatcctcctgcagctgctgatgaatgcatcgaaggaaagccccccacacgaagacttgatggtgcagatccactccatcctggctaagattgggcctaaagacaagaaatttggggtgaaggcccgcataaacggtgccctgaacatcacccttaacctggtcaaacagaacctgcagaaccatcgccttgtgctgccgtgtctgcagctgctcagagtgtattccgcgaacagtgttaactctgtgtccttgggaaaaaatggggtcgtagagctgatgttcaagatcatcggcccatttagtaaaaaaaattcctctttgatcaaagttgccctggataccttagccgccctgctgaaaagcaaaaccaacgctagaagagcagtcgaccgcggatacgttcaggtgctgttgactatttacgtagattggcataggcatgacaataggcaccggaatatgcttattaggaaggggatactgcagtccctgaagtctgtcaccaacatcaagctggggaggaaagcattcatcgacgccaatggaatgaaaatcctctataatacatcacagctcccggtgatccctgtgaccggtcccgtcgctcagctctattcccttccccctgaggtcgacgatgtcgtggatgagagcgatgataatgatgacattgacgtcgaggccgaaaatgaaaccgaaaacgaagatgacctcgatcagaactttaagaacgacgatatcgagaccgatatcaacaaactcaaacctcaacaggagcctggacgcacgatcgaggatctaaagatgtacgaacacctcttcccagaactggtggacgacttccaggattatgaccttatcagcaaagaacccaaaccattcgtcttcgaaggtaaggtgagagggcccatcgttgttccgacagccggggaggaaactagcgggaactcaggaaatcttagaaaggtggtaatgaaggagaacattagctccaagggagacgaaggcgagaaaaaaagtacatttatggacctcgccaaagaagacataaaggataacgacaggactctgcagcagcagcctggcgaccagaatcgcaccatttcctctgtgcacggactgaacaatgacatcgttaaagcattggaccgcatcaccttgcaaaatatcccatcccaaacggccccagggtttacagctgaaatgaaaaaggattgttccctcccgcttactgttttaacttgcgccaaggcctgtccccacatggccacctgcggaaacgtgttattcgagggccgaaccgtgcagctgggtaagttatgctgtaccggggtagaaaccgaagatgatgaagatacggaaagcaactcttcagtcgagcaagcctccgtggaagtgcccgatgggcctaccctgcatgatcccgatttgtacattgagattgttaagaatacaaaatctgtccctgagtacagcgaggtggcctaccctgactactttggccacatacccccaccttttaaggagcccattctggagagaccatacggtgtgcaacgcaccaagatagctcaggatattgagcgactcatacatcaatcggacatcatcgaccgtgtagtctacgatctcgataaccccaactatacaattcctgaggaaggcgacatcctcaagtttaatagtaagttcgagtcgggcaacctgagaaaggtcatacagatacgtaaaaacgaatacgacctaatcttgaactcagatattaacagtaaccactatcaccaatggttctactttgaggtttctggtatgagacctggagtggcttaccgttttaacataatcaattgtgagaaatccaactcacagttcaattacgggatgcagcccttgatgtatagtgtccaggaagcactgaatgcacggccatggtggatcaggatgggaaccgacatctgctactacaaaaaccacttttcacgaagctcagtggccgctggcggtcagaagggcaaatcatactataccatcacatttaccgtgaattttcctcacaaagatgatgtatgttactttgcctaccattacccttatacctactctacactgcagatgcacctacagaagctagaatccgctcacaatcctcagcagatctactttcgcaaagacgtgctgtgtgaaacactgagtgggaactcttgtccccttgtgaccataactgcaatgcccgagtcaaattactatgaacacatctgtcactttcggaacagaccttacgtgttcttgtcggctcgtgttcacccaggggagaccaatgcgagctgggtgatgaagggaactctggagtacctgatgtccaacaatcccactgcacaatcccttagagaatcgtatatttttaaaatagtacccatgctaaatccagacggagtgattaatggcaatcaccgctgcagcctgtccggcgaagacctgaatcgccagtggcagtccccatcccccgacttgcacccaaccatctaccatgcaaaaggactacttcagtatttagctgctgtcaaaagattacccctggtgtactgtgattatcatgggcactccaggaagaaaaacgtttttatgtacggctgctctatcaaggagactgtttggcataccaatgataacgccacctcttgtgatgtggttgaagacactggttaccggactctgcccaaaatcctgagccacatagctcctgctttctgtatgtcctcctgttcattcgtcgtggaaaagtccaaggaatccaccgctcgcgttgtagtttggcgggaaattggagtccagagatcctacaccatggaaagcaccttatgcggctgcgaccaaggtaaatacaagggtctgcagatcgggacacgcgagcttgaggagatgggggcaaagttctgcgtaggtctactgcgcctcaagcgtcttacctctcccctcgagtacaatcttccgagctcactcctcgactttgaaaacgatctgattgagagttcctgtaaagtgacgtcccccacaacatatgtacttgacgaggacgaacctaggtttctagaggaagtggactacagtgcggagtctaacgacgagctcgacattgaactcgccgaaaatgtgggtgactacgaaccttctgcccaagaagaagtgttgtccgactctgagctaagtcgcacttatctaccatag

SEQ ID NO: 108927 - DNA, 3717 bp, Artificial Sequence
  Description of Artificial Sequence: Synthetic coding sequence
atgcggacaggtagcgcagcctctagcgcagctgcagctgctgccgcagcagcggcaagcgcctcacctgctacgggtgtctgtatgaaaaccccaggaggcggccgaaggggaattcggcgcgacccaggggccgaaccaggcgcagcagcactgcggggccccagacagaggcccatcctttcacgcctaaccaacaattctagaatagtgggtcttctggcccaacttgagaaaattaatgcggagccctccgagagtgatactgcacgatacgtgacctccaagatcctccacctagctcagtcccaggagaagacgcgccgagagatgacagcgaaggggtcaactggaatggaaattttgctgtcgacgctggagaacacaaaagatctgcagaccacactgaatatactctcgatcctggttgagcttgtgtctgccggtggcggcaggcgcgtttcctttctcgtcactaaagggggtagccagatactgcttcaactactgatgaatgcgagcaaggaatcccccccacatgaggacctcatggtccagattcactctattctagcgaaaattgggcctaaggacaagaagtttggagtaaaggcccgcatcaacggcgccctaaacatcaccctcaacctagtgaagcagaacctccagaaccataggctcgtgctaccctgtttgcagcttttacgagtctattctgctaacagcgtgaattcggtgtcgttgggcaaaaatggcgtggtcgaattaatgttcaaaatcatcggcccctttagcaaaaagaattcatccttaattaaagtggctttagacacactggccgctctgctgaaaagtaagaccaacgcccgacgggcagtcgacagagggtatgtgcaggtcctcctcacgatatacgtggactggcacaggcatgacaatagacaccgcaacatgttgatcagaaaaggtattctccagtcccttaagtctgtcacaaatatcaaactcgggcgaaaagcttttatcgatgctaacggcatgaagatactgtataatacgagtcagctgcccgtgattccagttactggtcctgtggcacaactttactctctgccacccgaggtggatgatgtggtggatgagagtgatgataacgatgatattgatgtggaggcggagaatgagactgagaatgaagatgatctggaccagaacttcaagaatgacgatatcgaaaccgacatcaacaaactgaagcctcaacaggaaccgggaaggactattgaagatctcaagatgtacgaacacctgttccccgagctcgtggatgactttcaagactatgatctgatctctaaggaacccaagcctttcgtgtttgaaggaaaggtacggggacccattgttgttcctaccgcaggagaggagaccagcggaaattccgggaaccttaggaaagtggttatgaaggagaacatctctagcaagggcgacgagggagagaagaaatcaactttcatggatcttgccaaggaggacatcaaggacaacgatagaacacttcagcaacaacccggcgaccaaaataggaccatcagctccgttcatggtctgaataacgacatcgtcaaggcacttgatcgcatcaccctccagaacataccatcccagacagcacccggatttaccgctgagatgaagaaggactgcagcttgccgttaacagttttgacttgcgccaaggcttgtccccacatggctacatgtggcaatgtcctgtttgagggacggacagtccaactgggtaagttatgctgtacaggagtcgagactgaagacgatgaagataccgagtctaacagttctgttgagcaggccagcgtagaagtgcctgatggccctaccctccacgacccagacctatacatcgaaattgtgaaaaataccaaatccgtgcccgagtattcagaagtggcctacccagactacttcggacacatacctcctccgtttaaggaacccattctggaacgtccatatggcgtgcaacgcaccaagatcgctcaagatattgagcgattgattcaccagtccgatattatcgatcgggtagtttacgacttggacaatcctaattacaccatcccggaggagggagacatcctgaaattcaattctaagttcgagtcaggcaatcttagaaaggtaattcagattaggaaaaatgaatacgacttgatcctaaattccgatattaactcaaaccactaccaccagtggttctacttcgaagtgtcagggatgcggcccggtgttgcttaccggttcaacatcataaattgcgaaaagtctaacagtcagttcaactacggtatgcagccactgatgtactccgtacaagaagctcttaatgctcgaccctggtggattaggatgggcacggatatctgttattataagaatcatttctcaaggtcctcagtggccgcaggtggacaaaaggggaaaagttattacacaatcacctttacggtgaacttcccccacaaagacgatgtgtgctactttgcataccactacccgtacacctatagcacgctccagatgcatctccagaaacttgagtccgcccataaccctcagcagatatacttcagaaaggacgttttgtgtgagactctcagcggtaactcgtgtcctctcgtgaccataaccgccatgccagaaagcaactactatgaacatatttgccacttccggaacaggccttacgttttcctgtctgccagggtccaccccggagaaacaaatgcatcgtgggttatgaagggcactttggaatatctgatgagcaataaccccactgcccagagcctgcgtgaaagttacatctttaaaattgtgcccatgttgaatccggacggcgtgatcaatggcaaccacagatgcagtctgagcggagaggacctgaatcgccaatggcaatcccctagccccgacctgcacccaaccatctatcacgcgaaagggctgctccaataccttgctgcggtcaagcgccttcccctggtttactgcgattaccacggacacagcagaaaaaaaaatgtcttcatgtatgggtgttctatcaaggagaccgtctggcataccaacgataatgccacttcatgcgacgtggtagaggacaccggttaccggaccctccctaagattctgagccacattgcccccgccttctgtatgagttcatgttctttcgttgtggagaagtccaaagagagtacagcccgcgtggtagtgtggagggagatcggggtgcagagatcttacaccatggagtctactctgtgtggttgcgatcaagggaagtacaagggccttcagatcggcactcgcgagctggaggaaatgggtgcaaaattctgtgtgggcctcctgcgcctgaaacgcttaacatcgcctctcgagtataacctaccgtcttctctgctagactttgaaaatgacctgatcgaatctagctgtaaggtgacgagtccgactacctacgtcctcgacgaagacgagcctcgctttctggaggaggtcgactattccgcagagagtaatgatgagctcgatattgagctggctgagaatgtgggtgattacgagccctctgcccaagaagaggttctcagtgattccgagctttcccgcacctacttgccctag

SEQ ID NO: 108928 - DNA, 1932 bp, Artificial Sequence
  Description of Artificial Sequence: Synthetic coding sequence
atgaatgcctctaaggagtcccccccgcacgaagatttgatggtgcagatccacagtatcctggcaaaaatcggtccaaaagcagtgaatagcgtgtctctgggaaagaacggcgtcgtcgaactaatgttcaagattattggcccattttcgaagaaaaactcatcattgatcaaggtggccctggacacactcgccgcacttctaaagtcaaaaactaacgcaaggagagctgttgaccgtggctacgtgcaggtgttgttgacaatctatgtagactggcaccgccatgacaacaggcacaggaacatgcttattaggaagggcatcctccagtccctgaagagcgtcacgaacatcaagctgggccgtaaagccttcatcgacgcaaatggcatgaaaatcttatataacacaagtcaagagtgtcttgcagtcagaactttggaccctctggtgaacacgtcttccctgatcatgcgaaaatgtttccccaaaaaccgcctccccctgccaaccatcaaatcctctttccatttccagctgcccgttatccctgttacagggccggtggcacagctctacagtctgcctcccgaagtggacgacgttgttgatgagtctgatgataatgatgatatcgacgttgaagccgagaatgaaaccgagaacgaggacgatctagatcagaattttaagaatgacgacatcgaaaccgacatcaacaagctgaaaccacagcaggagcccggccgaacaattgaagacttaaagatgtacgaacatcttttcccagagcttgttgatgacttccaggattatgatcttattagcaaagagccaaaacctttcgtgttcgagggaaaagtaagaggtccgattgtggtgcctacagccggtgaggagacgtcgggcaattcgggaaacctgagaaaagttgtgatgaaggaaaacatctccagtaagggtgatgagggagagaagaagtccaccttcatggatctggctaaggaggacatcaaggataacgacagaacactgcaacaacaacctggggatcagaaccggacaatttccagcgtgcatggcttgaataacgacattgttaaagcacttgatcgcattacactgcaaaacatcccatcacagactgccccaggattcaccgctgaaatgaaaaaagactgttctctgccactgacggtgcttacatgtgcgaaggcctgcccccacatggctacctgtggaaatgtgctgttcgagggcaggacagtgcagctcggcaaattgtgctgtaccggtgtggagactgaagacgatgaagacacagaatcaaatagctctgtggagcaggcatccgtagaagtgccagatggtccgactctgcacgatcctgacctgtacatcgagatagtaaagaatacaaaatcagtgccagagtacagtgaagtagcctaccccgattacttcggccacattccaccacccttcaaagaaccaatccttgagcgcccttacggcgttcaacgcaccaagatcgcacaagatattgaacggctcatacaccaatcagacatcatcgatagggtggtgtatgatctggacaacccaaattataccattcccgaagagggcgatattctaaagttcaatagtaagttcgaaagcggaaacctccggaaagttatccagataagaaagaacgagtatgaccttattttaaatagtgacatcaatagtaaccactaccatcaatggttctattttgaagtttcaggtatgcggcccggtgtggcctataggtttaatatcattaactgtgagaagtctaactcgcagtttaattacgcgctgccacttatgtcctggatgaagatgaaccttgattcgctcaagaagctcattaccgtgcagaaagtaatgatgagctag

SEQ ID NO: 108929 - DNA, 1086 bp, Artificial Sequence
  Description of Artificial Sequence: Synthetic coding sequence
atggtccacgcagaggccttctctcggcccttatcccggaacgaggtcgtaggcctgatctttaggttgactatatttggcgccgtgacatacttcaccattaaatggatggtcgacgctatcgatcccacgagaaagcagaaagtggaagcacaaaaacaggccgagaaactgatgaaacaaatcggcgtgaaaaatgtcaagctgtccgaatacgagatgtccattgctgcacatttggttgatcctcttaatatgcacgtgacatggagcgacatagctggtctggatgacgtcattaccgaccttaaggatacagtgattctcccgataaagaaaaagcatcttttcgaaaattcacgcctcctgcaacccccgaaaggcgtgttactctacgggcctccaggatgtgggaaaacactcatcgctaaggcaacagctaaggaagccggttgtcgcttcataaacctccagccctctacccttactgacaagtggtatggcgagtcacagaaattagccgcagccgtattttccctggccattaaactccagccatctatcatatttattgacgaaattgactctttcctgaggaaccgttccagttcggaccatgaggcaacggcaatgatgaaggcccaattcatgtctctatgggatggacttgacactgaccattcttgtcaggtcatcgtgatgggagccactaaccgacctcaggatctggattctgccataatgaggcggatgcctaccagattccatatcaatcagcctgccctgaagcagcgagaggccatactgaaattaattttgaagaatgagaatgtggaccggcatgtggatctcctggaggtagcgcaagagaccgacggtttctctggctctgacctcaaggagatgtgtagagatgccgcactcctgtgcgttagagaatacgtaaactctacctcggaggagtcacatgatgaggatgaaatccggccggtgcagcagcaagacttacacagagctattgagaaaatgaaaaagagcaaagatgcggcatttcagaacgtgctgacccatgtatgtctcgattag

SEQ ID NO: 108930 - DNA, 1086 bp, Artificial Sequence
  Description of Artificial Sequence: Synthetic coding sequence
atggtacacgctgaagcttttagccgcccactgtcccggaacgaagtagtgggattaatatttagactgactattttcggcgctgtaacatacttcacaatcaaatggatggttgacgccatcgacccaacccgtaaacagaaagtcgaggcacagaagcaggctgaaaagttgatgaagcagatcggcgtgaaaaacgtcaagctcagcgaatacgaaatgagtatagcagcacacctcgtggacccactcaacatgcatgttacttggtctgatattgccggcttggatgacgtaataacagacctcaaggacaccgttattttacccattaagaagaagcacctcttcgaaaatagccggctgttgcaaccccccaagggtgtcctcctgtacgggccccccggttgcgggaaaacccttattgccaaggccaccgcaaaagaagcgggatgcaggttcatcaacctgcagccctcgactctgactgacaagtggtacggggagagccaaaagttagccgccgcagtgttcagcctagccatcaaattgcaaccaagcatcatcttcatcgacgagatcgacagcttccttagaaatagaagttcatccgatcatgaggcaaccgcgatgatgaaagcacagttcatgtccctctgggacggtttggacaccgatcatagttgtcaggtcatcgtgatgggagctactaatcgaccccaggacctggacagtgcaatcatgcggagaatgccaacgagatttcacatcaaccagcccgcccttaaacagagagaggctatactgaaattaattttgaagaacgaaaacgttgacaggcacgtagacctgcttgaggtggcccaggaaacagacgggttcagtggaagtgatttgaaggagatgtgtcgtgatgctgctttactatgcgtgcgtgaatatgtgaattcaacatccgaggagagtcatgatgaagatgaaataaggcccgttcagcagcaagacctccaccgcgcaatcgagaagatgaagaagtcaaaagacgccgcgtttcaaaatgttctgacccatgtgtgtctggactag

SEQ ID NO: 108931 - DNA, 822 bp, Artificial Sequence
  Description of Artificial Sequence: Synthetic coding sequence
atgaaacaaattggcgtcaagaacgtaaaacttagcgagtatgaaatgagcattgcagcccacctggttgatccattgaacatgcatgtgacgtggtccgacatcgctggactggatgacgtgattaccgatttaaaagatactgttattctcccaatcaaaaaaaagcacctgttcgaaaactcacgcctgctccagccaccaaaaggagtccttttgtacggcccccctggctgcggtaaaacattgatcgctaaagctaccgccaaagaggccgggtgccgatttattaatctccagcccagtacgctgacggataaatggtacggggaatcacagaagctcgcagctgcggtgttttcactcgccattaagctccagccatccatcatcttcatagacgagatcgattcctttctgaggaataggtcctctagtgaccatgaagcaaccgctatgatgaaggcacagtttatgagtctgtgggacggacttgatactgaccacagctgccaggctttaaagcaaagagaagccattttaaagttgatccttaagaacgaaaacgttgacaggcacgtggatctcctggaggtagcccaggagacggatggcttttccggcagcgacctcaaagagatgtgtcgcgatgccgcgctcttgtgcgttcgcgaatacgtgaattccacgtccgaggaatcgcatgatgaggatgaaatccggccggtgcagcagcaggacctgcacagggcaatcgaaaaaatgaagaaatctaaggacgctgctttccaaaatgtactgacacacgtctgtctggattag

SEQ ID NO: 108932 - DNA, 864 bp, Artificial Sequence
  Description of Artificial Sequence: Synthetic coding sequence
atggtccacgccgaggccttttcaaggcccctttcgagaaatgaagtggttgggttgatctttaggctcactatcttcggagctgtgacgtacttcaccattaaatggatggtcgatgccattgatccgacacggaagcagaaagtggaggcacagaagcaggccgagaagctgatgaaacagataggcgtaaaaaacgtgaaattgagcgagtatgagatgtcaattgcagctcatctcgtcgatcccctgaatatgcacgtcacctggtcagacattgcaggtctcgacgatgtaatcaccgacctgaaagatacggttattctgccaatcaaaaagaagcatctgttcgagaactccaggctcctccagccccccaagggcgtgctgctatacggacctccagggtgtggcaaaacattgattgccaaggccaccgccaaagaagctggctgtagatttataaatttgcagccaagcactttgacagacaagtggtacggggagagtcagaagttagccgcagccgtcttctcgctggctattaagctgcagccgtctattattttcattgacgagattgactcattcctcagaaaccgctcttccagtgatcacgaggcgaccgctatgatgaaggctcagttcatgtccctgtgggacggccttgacaccgaccacagttgccaggtgattgtgatgggggccacaaacagacctcaggacttggattccgctatcatgagaaggatgcccacacgtttccatattaaccaacctgcactgaaacagcgcgaggctatccttaaactcattctcaagaacgaaaatctgagaaagctcaagcctagagaggttctttag

SEQ ID NO: 108933 - DNA, 4173 bp, Artificial Sequence
  Description of Artificial Sequence: Synthetic coding sequence
atggtagtgctgagatcatcacttgaactgcacaaccattcagccgcatcagctactggatccttggatctgtcttctgactttctctccctggaacatattggacgccgacggctccgcagcgccggcgccgcccagaagaagcccgccgcaacaactgctaaggcaggggacggcagcagcgttaaagaagtcgaaacctatcaccgaactcgggccctgcgtagcttgcgcaaggacgcgcagaatagttctgattctagctttgaaaagaacgtggagatcactgaacaactggccaacgggcggcactttacacgtcaactggcccggcaacaggctgacaaaaagaaagaggagcacagggaagacaaggtcattcccgtgacaaggtccttgcgagctaggaacatagtccagtctactgagcacctacacgaagacaacggtgatgtggaggtgcggcgtagctgtcgtatcagaagtagatacagtggcgtaaatcagagtatgttatttgataagcttattaccaataccgcagaggctgtgctccaaaagatggacgacatgaaaaaaatgagaagacagaggatgcgtgaacttgaggatttaggcgtctttaatgaaaccgaagaaagcaatctgaacatgtacactcggggaaaacagaaggatatacagcgcaccgacgaggagaccacagataaccaggaaggatccgtagagtctagcgaagaaggagaggaccaggagcacgaggatgacggtgaagacgaggatgatgaggatgacgatgacgatgatgacgacgatgacgacgacgatgacgaagacgatgaggacgaagaggatggcgaggaggagaatcagaagcgatactacctgcggcaacggaaagcgactgtctattatcaggctccgctggagaagccaagacaccaaagaaaacccaacatcttttactctggccccgcttctccagcacgaccccgttacaggctaagtagcgccgggccccgatccccgtactgcaaacgcatgaatcgtaggcggcacgccatccattccagtgatagcaccagtagcagctcctctgaggacgaacaacacttcgagcgcagacgtaaaagatcccgtaacagggccatcaaccgatgtttaccgttgaacttccgcaaggatgaattaaaaggaatctacaaagatcgtatgaaaattggcgctagtctggccgatgtcgatccgatgcaacttgattcttctgtgcgcttcgactccgtcggcggattgtccaaccatatcgcagcactgaaggagatggttgtgtttccgctgttatatcctgaggtgttcgagaagtttaaaattcagcccccgagaggctgcctgttctacgggccccccgggaccggcaaaaccctggtggcccgcgcgctggccaacgagtgctctcagggcgacaagagagtcgcattcttcatgagaaaaggcgctgactgtttgtccaagtgggtgggcgagagcgagcgacaactgcggctgctgttcgatcaggcgtaccaaatgagaccatccatcatctttttcgacgagatcgacggacttgcccctgtaaggtcatccaggcaggatcagattcactcttccattgtgagcactttgctcgcactgatggacggcttagactcacgcggtgagatagttgtgatcggcgccacaaatcgcctagacagtatcgatccagctttgagacgacctggacgattcgaccgagaattcttattctcgttgccggataaagaggcccggaaggagatccttaagatccatacacgtgattggaatccgaaacctctcgatacgtttctggaggagcttgcagagaattgcgtgggctactgtggggctgacatcaagtctatctgtgccgaggctgcactttgcgcgctgcgtcgccgatatcctcagatctataccacgtctgaaaagctgcagctcgacctatccagcatcaacatcagcgccaaagacttcgaagttgcgatgcagaaaatgatacctgccagccaacgcgccgtgacctcgccgggacaagccctgtccacagtcgtgaagcccttgctgcagaataccgtggacaaaattttagaggcattgcagcgtgtgtttccccacgctgagtttcggacgaataagacattggactctgacattagctgtccactcctggaatccgatttggcctactccgacgatgatgtacccagcgtgtacgagaatggactgtcacagaaaagttcccataaagctaaagacaatttcaacttcctgcacctaaacagaaatgcctgctaccagcccatgtcctttcgcccaaggatattgatcgtcggtgaaccaggatttggccaggggtcccacctggcccctgcggtcatccatgcattggaaaaattcaccgtgtacacgctggatatcccggtgcttttcggggtgtccacaacgtctcctgaagagacgtgcgctcaggtgatcagggaggccaagaggaccgctcctagcatagtttacgtgcctcatatccacgtttggtgggaaatcgttggcccaaccctgaaggctacgttcacgaccctcctccagaacataccatccttcgcgcctgtccttctcctggccacctcagataaaccacacagtgcccttcctgaggaagtgcaggaactcttcattcgggactatggtgagatctttaacgtccagttgccagataaggaggaaagaactaagttcttcgaggacctcatcctcaagcaagcagctaaaccaccaatatcaaagaaaaaggcggtgctccaggccttagaggtcctgccagtcgcacctcctccggaaccgcggtcactgactgccgaggaagttaagagactcgaggagcaggaagaggacacgtttagagagctgcggatctttctccgaaacgtcacccatcgactggctatagataagagattcagagttttcacgaagccagtagatcctgacgaagttcccgactacgtaaccgtcattaaacagcccatggacttatcttccgtgataagcaaaattgacctccataagtaccttacagttaaagactacctccgggatattgacctgatctgcagtaacgcgctggaatacaatccagatcgggatccaggggaccggctgattcgccatagagcttgtgcgctgcgcgacaccgcctatgccatcatcaaagaggagctggatgaggactttgagcagctgtgcgaggaaatccaggagtctcgaaagaagagaggctgttcttcaagcaaatacgccccttcatactaccatgtaatgcctaagcagaattcgacactcgtgggggacaagaggagcgaccctgagcagaacgaaaagttgaaaaccccaagcacaccagtcgcttgcagcacacccgcacagctgaaacgtaagattagaaaaaagagtaattggtatctcggaacaatcaagaagcgccgaaaaatttctcaggcaaaggatgacagtcaaaacgctatcgaccacaaaatagaatccgataccgaagaaacccaggacaccagcgtagaccataatgagacaggaaacaccggtgagtccagcgttgaagagaatgagaagcaacaaaatgcatctgaatcaaagctcgagttacggaacaattcaaacacttgtaatatcgaaaatgagcttgaggatagtcggaaaaccaccgcttgtactgaactccgggataagatcgcttgtaacggagacgcctcaagctctcagatcatccacattagcgatgagaacgagggcaaggaaatgtgcgtcctgaggatgacacgggcccgacgaagtcaggttgagcagcaacagctgatcactgttgaaaaggctctggccatcctgagccagcccacgccttcattagtggtggatcatgaacggttgaaaaacttgttgaagaccgtcgtcaaaaaaagccagaactataacatttttcaattagagaatctgtacgccgtgatatcacagtgcatctacagacatagaaaggaccatgacaaaactagcctcatacagaaaatggagcaagaggtcgaaaatttttcgtgtagtaggtag

SEQ ID NO: 108934 - DNA, 1719 bp, Artificial Sequence
  Description of Artificial Sequence: Synthetic coding sequence
tgaggtgcattagcactagcggccccaaggcgttgccgccaaccactacctgggcgcgattgtgctcccggggctccgcctgccggcgctgtttctcgagccgggcgcattggcttgttccctagtccagtctgcacaagcgcagccgttagatccggttccggttacgccaaggacgccctgaacctagcacagatgcaggaacagaccttacaactggaacaacaaagcaagcttaaagaatacgaagccgcggtggagcagctcaagtcggagcagattagagcccaggctgaagagaggcggaagactctctccgaggaaaccaggcagcaccaggccagggcccagtaccaggacaagctggctcggcagcggtacgaggatcagttaaagcaacagcagctactgaacgaagagaatctccggaaacaagaggaatccgtgcagaaacaggaagccatgaggcgtgccacagtcgaaagggagatggaactccgacataagaacgagatgctgcgagttgaggctgaggccagggcccgggcgaaggcggaacgggagaacgccgatatcattcgagagcagatccgcctgaaggcagccgagcaccgccaaactgtactggagagcatccgcacagccggtaccttatttggggaagggtttcgcgcttttgtgaccgactgggataaagtcaccgcaacggttgccgggctgaccctgctggccgtgggcgtgtacagtgctaagaacgcaactttggtagctggtagattcattgaagccagactaggaaaaccctctcttgtccgagagacatcccgtattacggtcctcgaggcactgagacacccaatccaggtgagccgccgattgctgagcaggcctcaggatgcactcgagggggtggtgttgagccctagtctggaagctagagtgcgggatattgccatcgccacgaggaacacaaagaagaataggtcactgtacagaaatatcctcatgtatggccctcctggaaccggaaaaaccttgtttgcaaaaaaactcgccctgcactctggcatggactacgccatcatgacgggaggggacgtggctccaatggggagggagggcgtaaccgcaatgcataaattgttcgattgggcgaacacatccaggcgaggcctgctactattcgtcgatgaggctgacgcttttcttaggaaacgggccactgaaaaaatcagcgaagatcttagggccacgctgaatgcattcttgtaccgaactggccaacattccaataagtttatgctggtgcttgcctcaaaccagcctgaacagtttgactgggcaattaacgatcgcataaatgagatggtacactttgacctccccggtcaagaggaacgagagagactcgttcggatgtacttcgataagtacgtccttaagcctgccacggaagggaaacagcggctaaaactagcccagttcgactatgggcgaaaatgttccgaggtagccaggttgaccgagggaatgtctggccgcgagatcgctcagctggctgtgagctggcaggccacagcttacgcttctgaagatggggtgctcaccgaagcaatgatggatacacgcgtgcaggacgccgtgcagcaacatcagcagaagatgtgctggcttaaggctgaaggacctggccggggtgacgagccaagcccttcctag

SEQ ID NO: 108935 - DNA, 1905 bp, Artificial Sequence
  Description of Artificial Sequence: Synthetic coding sequence
atgagctggctctttgggattaataaggggcctaaaggtgaaggggccgggccacccccacccctgccgcccgcccagcccggcgccgaagggggcggggatcgaggcctaggggaccgccccgcccctaaggacaagtggagtaatttcgacccgacagggctggagcgcgccgcaaaagccgcccgggagctggagcacagtcggtacgcgaaggacgcactcaatctggcccagatgcaggagcaaacccttcagctcgaacaacagagcaagctgaagatgcggttagaagccttaagtctccttcacacgctcgtttgggcctggagtctctgtcgtgctggcgccgtacaaactcaagagagactttcaggttccgcttcacctgagcaagtacccgccggggagtgttgtgcactgcaagaatacgaggcagcggtggagcagctgaagtctgagcagattcgtgcacaagccgaagaacgccgaaagacccttagtgaagagacgcggcaacatcaggccagagcccagtatcaggacaagctggcccggcagaggtacgaggaccagctgaaacagcagcagctcctcaacgaggaaaacctgcgtaagcaagaagagagcgtgcagaagcaagaggccatgagaagggccaccgtggaaagggaaatggaactcaggcacaagaacgagatgctccgggttgaagcagaagcaagggctcgagcaaaggcagagcgagaaaatgccgacatcattagggaacagattcgtcttaaggccgccgaacataggcagaccgtgcttgagtccatcagaaccgcaggaaccctgtttggcgaaggtttcagagcttttgtgacagactgggacaaggtgaccgcaactgtggcagggttaaccttgctcgcagtgggggtgtattctgccaaaaatgctactttggttgccggtaggttcattgaggcccgtctgggtaagccctcactcgtgagagagacatcaagaattactgtcctggaagctctccgccatcctatccaggtgtcccgccggctgctcagtcgccctcaagacgcgctcgagggggtcgtcctcagcccatctctggaggctcgcgttcgagacatcgccatagctactcgcaacaccaaaaagaaccggtcgctgtacaggaatatacttatgtacggaccccctggtaccgggaaaacactctttgctaaaaaattggcactgcatagcgggatggattatgctatcatgactggtggagatgtggcaccgatgggaagggaaggcgtcaccgccatgcataagctgtttgattgggctaacacctctagaagaggccttctcctctttgtcgatgaggccgatgcattcctgaggaagcgggcaaccgagaagatctcggaagacctccgggccacattgaacgcctttttgtatcgaacaggacaacatagcaataagttcatgttagtgctggcttccaaccaaccagagcagtttgattgggcaatcaatgatcgcattaacgagatggtgcacttcgacctcccaggccaggaggaacgcgaaagactcgtaaggatgtactttgataagtacgttttgaaacctgccacagaaggtaagcaacgcctcaaacttgcacaatttgactatggacgtaagtgctctgaagtcgctcgactcacagagggaatgtcgggaagagaaatcgcgcagcttgctgtgtcatggcaggccaccgcctatgcaagtgaagatggggtgctgaccgaggctatgatggacacccgcgttcaggacgcggtccaacagcaccagcagaagatgtgttggttgaaggcggagggtcctggccggggcgacgaaccttcaccgagttag

SEQ ID NO: 108936 - DNA, 1761 bp, Artificial Sequence
  Description of Artificial Sequence: Synthetic coding sequence
atgagttggctgttcggtattaataagggcccaaagggagaaggggcaggtcctccgccacccctcccccctgcccaaccaggggctgagggtggcggagatcgtggtctcggcgaccggcccgccccaaaggacaagtggagcaacttcgaccctacaggcctggagagagccgcgaaagccgctagagagctggagcactcccgctatgctaaagatgccttgaacctggctcagatgcaagaacagaccttgcaactcgagcagcagagcaaactgaaagagtatgaagccgcagttgaacaattgaagagcgagcagatccgtgctcaggctgaggaacgcagaaagaccctcagtgaggagacgcgccaacatcaagcacgcgcccagtaccaagataaactagcccggcaacgatacgaggatcaactcaaacaacagcagctcctgaacgaagaaaatcttagaaagcaagaagagagtgtgcaaaagcaggaagcaatgaggagggccaccgtggaacgcgaaatggagctgcgccacaagaacgagatgctcagggtggaggccgaggcaagggccagagccaaagctgaacgcgagaacgccgacatcatcagagagcaaatccggctgaaagcggccgaacacaggcaaaccgtcttggaaagtattaggaccgcagggaccctttttggagagggctttcgggccttcgtgaccgactgggataaagtgacggctacggtggcggggctcactctgctggccgtgggtgtttactctgcaaaaaatgcaacacttgtggcaggtagattcatagaagctagattaggcaaaccctctctggtaagggagacttcaagaattactgtacttgaagccctgcgccacccgattcaggtctcacggaggttactgtctcgcccccaggacgctctcgaaggtgtcgtcttatcaccctcccttgaggctcgggttcgcgatatcgccattgctacgcgtaacactaagaagaaccgatccctgtacaggaatatactcatgtatggccccccaggcaccgggaagactttatttgccaaaaagctggcactccacagtggaatggactacgccatcatgacaggcggcgacgttgcacccatggggcgcgagggggtcactgctatgcacaagctgtttgattgggccaatacatcgcggagaggccttctcttgttcgtggacgaggcggacgcgtttttgcggaaaagggccaccgagaaaatatccgaagacctgcgcgccactctgaatgcctttctgtacagaacgggacagcactcaaacaagttcatgcttgtcttagccagtaatcagcctgagcagtttgactgggctatcaacgaccggatcaacgagatggtgcattttgatctccctggccaagaggagcgggagcgcctagtgagaatgtacttcgataaatatgtgctcaagccagcaacggaagggaaacaaaggcttaagctggcacagtttgattatggtagaaaatgttccgaggtggccagattgaccgaggggatgagtgggagggaaatcgctcagttggccgtgagctggcaggccaccgcttacgccagcgaggatggtgtgctgactgaagcaatgatggatacgcgagttcaggatgcagtgcagcagcatcaacagaaaatgtgctggctcaaggccgaggggcccggcagaggggatgagcccagtccaagctag

SEQ ID NO: 108937 - DNA, 792 bp, Artificial Sequence
  Description of Artificial Sequence: Synthetic coding sequence
atgtacggtccacccggaacgggcaagacgctattcgcaaaaaagctggccttgcatagtggaatggattacgctatcatgacggggggcgatgttgccccaatgggacgtgagggggttacggccatgcacaagcttttcgattgggccaacacgagccgccgagggctgcttctgttcgtcgatgaggcagatgcctttctgcggaagcgcgcaactgaaaagatttctgaggacctccgagcaaccctgaacgctttcctgtacagaacgggacagcacagtaataatccaagccacgtctctcacgggggttcctctcccgctggacgcccttggctgactccccaggcccgatgggctcccagattcatgctggttttggcctctaatcagccagaacagtttgactgggcaatcaatgaccggattaatgagatggtgcacttcgacctccctggccaggaggaacgggagagattggttcggatgtattttgataagtatgtccttaaaccagctaccgaagggaaacagcggctgaagctggcccaatttgactatggacggaaatgctcagaggtggccaggctgacggaaggaatgtccgggcgtgaaatcgcccaactggcagttagttggcaggcaaccgcatacgcctcagaggatggagtgctaactgaagcgatgatggataccagggtgcaggacgccgttcagcagcaccagcagaagatgtgctggctgaaagcagagggtcctgggcggggcgatgagcctagcccttcatag

SEQ ID NO: 108938 - DNA, 606 bp, Artificial Sequence
  Description of Artificial Sequence: Synthetic coding sequence
aaattggccctgcatagtggcatggactatgcgattatgacaggcggagatgtcgctcccatgggcagagaaggggtgacggccatgcataagctgtttgattgggccaacacgtcaagaagaggcttgcttctattcgtggacgaggccgacgcttttctgcgcaaacgagccactgaaaagatttctgaagaccttagagcaactctcaacgccttcctgtataggactgggcaacatagtaacaacccttcccacgtttctcacggtgggagctctcctgccgggcgcccctggctgacacctcaggcgagatgggcccccagatttatgctggtgctggcctccaatcagccagaacagtttgattgggctataaacgatagaatcaacgagatggtgcactttgatctaccagggcaagaagagagggaacgattagtacgcatgtatttcgacaagtacgttttgaagccagcaaccgaaggcaagcagcggttaaagttagctcagtttgactatggtcggaagtgtagcgaggtcgctagattgactgagggcatgtcagggagggaaattgcccaactcgctgtgtcctggcaatag

SEQ ID NO: 108939 - DNA, 435 bp, Artificial Sequence
  Description of Artificial Sequence: Synthetic coding sequence
atgtgcctttgcaggccgctgctgccccagcgggcccagtaccaggacaaactggcccgtcaaagatatgaagaccagctcaaacagcagcagctgttgaacgaggagaatttgcgcaagcaggaagaatcagtacagaagcaagaagctatgcgccgcgcaacagtcgagagggagatggaactgcgtcacaagaatgagatgctgcgggtggaagcagaagctcgggcacgggcaaaggctgagcgcgaaaacgctgatatcattcgcgagcagatcagactgaaggccgccgagcacaggcagacggtgctcgaaagcatcagaacagccggaaccctcttcggagaaggcttcagggctttcgtaacagactgggataaagtgaccgcgacagtggccgggctgactctgctggccgtgggcgtgtattag

SEQ ID NO: 108940 - DNA, 309 bp, Artificial Sequence
  Description of Artificial Sequence: Synthetic coding sequence
atgaggctggaggcactgtctcttctccatacactggtgtgggcatggagcctgtgcagagccggtgctgttcagacccaagaacggctgtccggctcagcatctcctgaacaggtgccagccggagaatgttgcgcactgcaggagtatgaagctgctgtagaacaattgaagtctgagcagatccgcgctcaggccgaggaaaggcgtaagacattatcagaagaaacacggcaacaccaggccagagcccagtaccaggacaaacttgcaagacagaggtacgaagatcagctgaagcagcaatag

SEQ ID NO: 108941 - DNA, 1524 bp, Artificial Sequence
  Description of Artificial Sequence: Synthetic coding sequence
atgcaagagcagacactgcagctggagcaacagtcaaaactcaaggaatatgaggccgccgtcgagcagcttaagagtgagcagatcagggcccaggccgaggagcgtcgaaaaacactttcggaagaaactcgccagcaccaggccagggcacagtaccaagataagctggcgagacaacggtacgaggatcagctgaagcagcagcaactcttgaacgaggagaacttgcggaagcaagaagagtcggtgcaaaagcaggaagctatgcggcgggccacggtagagcgtgagatggagcttaggcacaagaatgagatgttgagggtcgaggccgaggcgagggccagagctaaagccgaaagggagaacgctgacattatacgggaacagattcgtctgaaagcggcagagcatagacagaccgtcttggaaagcattagaacagcgggtaccctctttggagagggattcagggcatttgtgaccgactgggataaagtaaccgccactgtggctgggctgaccctcctcgctgtgggcgtctacagcgccaagaatgctaccctagttgctggccgtttcattgaagcccggctgggcaaaccaagcctggtgagagaaacatcgagaatcaccgtgctagaggcattgcgacatccgatacaggtcagccgcagactgctcagcaggcctcaggatgcccttgaaggtgtggtcctttctccaagcctggaggcgagggtcagagatatcgcaatcgcaacaaggaacacgaagaagaataggtccctgtacaggaatattctgatgtatggtccccctggcactggtaaaaccttattcgccaaaaagcttgcgctgcactccggaatggattacgcaatcatgacaggaggtgacgtggcaccaatggggcgcgagggagtgactgccatgcacaaattattcgattgggccaataccagtcgccgcggccttttgctgtttgtcgatgaggctgacgctttcttacgcaagagggctaccgagaagattagtgaggatctgagggctaccctcaatgccttcctgtaccggaccgggcaacattccaacaagtttatgcttgttctcgcctctaatcagcccgagcagtttgattgggccattaatgacaggattaacgaaatggttcactttgatttgcctggccaggaagagagggagaggctggtgcggatgtattttgacaagtatgtgctgaaacctgccacagaaggtaagcagcgactcaagctcgctcaatttgactatggacgcaagtgcagcgaggttgctcgactgaccgagggcatgtctggtcgcgagatcgcgcagttggcagtgtcctggcaggcaactgcatatgcttcagaagatggcgtgctcacagaggctatgatggatacacgggtgcaggacgctgtgcagcagcaccagcagaagatgtgctggttgaaagccgagggccctggccggggggacgaaccctctccatcttag

SEQ ID NO: 108942 - DNA, 1947 bp, Artificial Sequence
  Description of Artificial Sequence: Synthetic coding sequence
atgagttggctgtttggggtgaataagggaccaaaaggtgagggggctggcccacccccaccactacctcctgcccagcctggggctgagggtggcggggaccggggtctgggggatcgccctgctccaaaggataaatggtctaattttgatccaaccggcctcgagcgcgccgcgaaggctgcacgggagctggagcattcacgttacgcaaaggaagctcttaacctcgctcagatgcaggaacagacattgcaactggaacagcaatccaagttgaaggagtacgaggcagcagttgaacagctgaagtccgagcagatcagggcccaggcagaggagcgtaggaagactctgtccgaagaaacccggcaacaccaggcgagggcacagtatcaggataagctagctcggcaacgttatgaggaccagctgaaacagcaacaacttctgaatgaggagaatctgcgcaaacaggaagagtccgtacagaaacaggaggctatgcgacgggctaccgtcgagagagagatggagctgcggcacaaaaatgaaatgctcagagtggagacagaggcgcgagcacgcgcgaaggccgaacgcgagaatgctgacatcatccgtgaacagattcgcctgaaggcctccgaacatcgccaaactgttctcgaatctatccggaccgccggtactctcttcggcgaaggtttcagggcattcgtgactgaccgcgacaaagtcaccgcaactgtagcgggtctgaccctactcgctgtaggggtgtatagcgccaaaaatgcaacagcagtgaccggcaggttcattgaggcccggttagggaaaccctctctcgttagagaaacctcacgcataacggtattggaagcactcaggcatccgattcaggtcagcagacgcttattatcccgccctcaagatgtccttgagggcgtggtactgagcccttccctggaggccagggtacgcgatatcgcgattgccacacggaacacaaaaaagaaccgaggcctttaccggcacattctgttgtacggacctcctggaactggaaaaaccttgttcgccaaaaaactagcccttcattccggcatggattatgctatcatgacgggaggggacgtcgcacccatgggaagggagggcgtcaccgcgatgcacaaactatttgactgggcaaatacgagtcgtagaggcctgttgcttttcatggacgaagccgatgcgttcctgagaaagagagcaaccgaagaaatcagcaaggatctgcgggcaacccttaacgctttcctctaccacatgggccagcactctaataagttcatgctcgtactggcatctaacctgcccgaacagtttgattgcgcaatcaacagtaggattgacgttatggtacacttcgatctaccgcagcaggaagaacgcgagagactcgtgaggttgcacttcgacaattgtgtgttgaagcctgccactgaaggcaagagaagactcaagctcgcccagttcgattacggtagaaagtgttcagaagtggctaggctgaccgagggtatgtccggtagagaaatcgcacagctcgcagtatcttggcaagccaccgcttatgcctccaaggatggtgttttgactgaggccatgatggatgcgtgcgtgcaagacgcagtgcagcagtaccggcaaaagatgcgttggttgaaggccgagggcccaggtagaggagttgaacatcctctctccggcgtccagggtgaaacccttaccagctggagtctggctactgacccaagttatccgtgcctggccggcccttgtacttttaggatttgttcctggatgggaaccggcctttgccctgggcctctgtctccgcggatgtcctgcggaggtggaaggccattttgtccacctgggcacccactgctgtag

SEQ ID NO: 108943 - DNA, 900 bp, Artificial Sequence
  Description of Artificial Sequence: Synthetic coding sequence
atgagctggctctttggggtgaataagggcccaaaaggagaaggagcaggacccccacctccacttcctccagctcagccgggggctgagggaggcggcgacagaggcctgggcgacaggcctgcaccaaaggataagtggtcaaatttcgacccgacagggttagagcgagctgcaaaagccgcacgggaactggagcattcccgttacgctaaagaggctctcaaccttgctcagatgcaagaacagaccttgcagctggagcagcagtcaaagttgaaacaacttctcaacgaagagaacctgcggaagcaggaggagtcagtgcagaagcaccgtcagactgtcctggagagtatccgaacggccggtaccctatttggggagggcttccgcgctttcgttacagacagagataaagtcactgctaccgtggctggcctgaccctcctggccgttggagtctactccgctaagaatgccacagcggtgaccggaaggtttattgaggctcggctgggaaagcctagcctggtgcgagagacttcccggatcacagtattggaagccctacggcatcctatacagcaggtcagcaggagacttttgtctcgcccacaggatgtgctagagggtgttgttttatctccttctctcgaggcaagagttcgtgacatagccatcgcgacacgcaataccaagaaaaaccggggcctgtacagacacattttactttatgggccccccggaacaggcaagaccttgtttgcgaaaaaacttgctctgcattcgggtatggactacgccataatgacaggaggcgatgtggctcccatgggaagagaaggggtcacggcgatgcataaactatttgactgggcaaacacttcccgccgctag

SEQ ID NO: 108944 - DNA, 351 bp, Artificial Sequence
  Description of Artificial Sequence: Synthetic coding sequence
atgcggcgcgccaccgtggaacgcgagatggagctgcggcacaaaaacgagatgctgcgtgtggagaccgaagcccgcgcccgggccaaggcggaaagggaaaacgcggatatcatccgcgagcagattaggctgaaagctagtgagcacagacagacagtcttagaaagcatccggacagcaggcactctgttcggtgagggatttcgggcctttgtaaccgacagggataaggtcacagcaacagtgaatatttttataaagcagggatggcaggttgctgagcgccaacactttaggcggcggagatgggcggaccacgaagtgaggcgctcacggtcaagctggtag

SEQ ID NO: 108945 - DNA, 1449 bp, Artificial Sequence
  Description of Artificial Sequence: Synthetic coding sequence
atgctgagggtcgagaccgaggctagagcgcgtgcaaaagccgagcgtgaaaacgccgacataatcagagagcagatccggctaaaggcaagtgaacacaggcagacggtcctggaatccatacgcacggcgggcacactctttggcgaggggttccgggccttcgtgactgaccgagataaggtgaccgccactgtggctgggttgacactgctcgcagtaggcgtgtacagtgcaaaaaacgctaccgccgttacaggcaggttcatcgaggccaggttgggaaagcctagtttggtccgtgaaaccagtcgcatcaccgtactcgaggccttgcgacatccaatccaggtgagcaggcgccttctctctcggccccaggacgttctggagggcgtagtgctgtcagtgtcaccctccctggaggctcgggtccgggatattgccattgccactcggaacaccaagaagaacaggggcctatatcgtcatatcctattatacggccccccagggactggcaaaactctgttcgccaagaagctggcacttcacagcggcatggattatgcgatcatgacaggcggcgatgtcgccccaatgggacgagaaggcgtcaccgcgatgcacaaattgttcgattgggccaataccagtcggagaggcttgcaggaagagatctctaaggacctgagagctacactgaatgccttcctctatcatatgggccagcactccaataaccggtttatgctggtgcttgccagtaacctccctgaacaatttgattgtgccatcaactcaagaatagacgtgatggtgcacttcgatctcccccagcaagaggaaagagaacgtttggtccgcttgcatttcgataattgtgtcctcaagcctgcgaccgagggaaaacgaatgggcgtcgggcagctaccagtgtttagacccccccctcatggcgttggctcagcagcactggccgcgtctctgggaaacagcttccccagaaggctgaagctcgctcaattcgactacggaaggaaatgttctgaggttgcaaggcttactgagggtatgagtggacgggaaattgctcagcttgccgtatcgtggcaggcaactgcttacgccagtaaggacggtgttctcactgaagctatgatggatgcctgcgtgcaggatgccgttcagcagtaccggcaaaaaatgcgctggctgaaggcagaagggcccgggcgcggtgtggaacaccctctcagcggcgtccaaggtgagacgctcacatcatggtctctcgcaacagatccctcctatccctgtttggccggcccctgtacatttcgtatctgcagctggatgggaaccggcctctgcccaggcccattgtcaccaagaatgtcctgcggcggaggaagaccattctgtcccccaggacaccctctactctag

SEQ ID NO: 108946 - DNA, 354 bp, Artificial Sequence
  Description of Artificial Sequence: Synthetic coding sequence
atgaggagagcaacagtggaaagagagatggagctgcggcacaaaaacgagatgctgcgagtggagaccgaggcacgggctcgggccaaggccgaaagggagaatgcagatatcatcagagagcagatcagacttaaagctagcgaacacagacagaccgtgttagagtccatccgcacagccggtaccttgttcggcgagggtttcagggcatttgttactgacagagacaaagtgaccgccacggtaaatattttcatcaagcaggggtggcaggtagcagagcggcagcatcacttcaggcgccgacggtgggccgaccatgaagtccggcgctcccgatctagctggtag

SEQ ID NO: 108947 - DNA, 5535 bp, Artificial Sequence
  Description of Artificial Sequence: Synthetic coding sequence
atggtcggggtcctcgcgatggctgccgcggccgctcctcctccagtcaaagattgcgaaatcgagccgtgtaagaagcgtaagaaagatgatgacacatcaacatgtaagactatcactaagtacctctccccattgggtaagactcgggacagagtgtttgccccccccaaacccagtaatatcttagattacttcaggaagacaagccctacaaatgaaaagacccagcttggaaaagaatgcaagataaagagccccgagagcgttcccgtagacagcaacaaagactgcactacacctctcgaaatgtttagcaacgtggagttcaagaagaagcgcaaacgagtgaatctgtcccaccagcttaataatatcaagactgaaaacgaggcccccatagagataagtagcgacgatagtaaggaagattactctctcaataatgatttcgtggagtcgagcacaagtgtgttgcgttacaagaagcaggtcgaggttctcgctgaaaatatccaagatacgaagagccagcctaatactatgacttcactgcagaattctaagaaggtgaatccaaaacaaggaaccactaagaatgatttcaaaaaacttcgaaagcgtaagtgtagagacgtggttgacctgagcgagtctctgcccttagcggaggaactgaatcttttaaaaaaagacgggaaggatacgaagcagatggagaatacgacttcccatgctaacagcagagacaatgtcactgaggcggctcaactgaatgattctatcataaccgttagctatgaagagtttttaaagagccacaaggagaataaagtcgaggagatccccgattccactatgtccatttgcgttccaagtgagactgtcgacgaaatcgtgaagagcggatacatttcagaaagcgaaaattcggaaatttcccagcaggtgcggttcaaaaccgtgaccgtactggcccaggttcatcccatcccacctaaaaagaccggcaagattccccgaatcttcctgaagcagaagcagttcgagatggagaacagcctatcagaccccgagaacgagcagacagtccaaaagcgcaagtctaatgtggtaattcaggaggaggagctcgagctagcagtgttagaagcaggcagcagcgaggccgtaaagccaaagtgcacattagaggagcgtcagcagtttatgaaggcgtttcgccagcctgcttcagatgcgttaaagaatggggttaagaagagcagcgataagcagaaagacctgaatgaaaaatgcctctatgaggtaggacgagacgataatagtaagaaaatcatggaaaacagcgggatacagatggtgtcaaagaatgggaacttgcagttgcacactgacaaaggcagcttcctcaaggaaaaaaacaaaaagctgaagaagaaaaataaaaagaccctggacacgggggctattcctggcaaaaaccgggagggaaacactcagaaaaaagaaaccactttctttttaaaggagaaacaatatcaaaataggatgagcttgagacagaggaaaactgaatttttcaaatccagcactctgtttaataacgagtccctggtgtacgaggacattgcgaatgacgatcttttgaaagttagcagtttatgcaacaacaacaagctgtctagaaagacctcaatccctgtgaaagatatcaaactgacgcagagcaaagctgagagcgaggcttcccttctgaacgtcagcactccaaaaagcactaggcgctctggccgtatatcttctacccctacaacagagacgatcagaggcattgacagcgacgacgtccaggataatagccaactgaaggcttccacgcagaaggcggccaatctctctgagaagcattcactctatacagccgaactcataaccgtgcccttcgactctgagagtcccataagaatgaagtttacaaggatttctacaccaaagaagagcaagaaaaagagtaataagcggtccgagaagagcgaagccacagacggaggatttacaagccagatacgcaaggcgtcaaacacctctaaaaatattagcaaagccaagcagctcattgaaaaggccaaagcccttcacatcagtcgttccaaagtcaccgaagagatcgccatcccccttcggcggtcaagcagacatcagacgctcccggagcgcaagaaactcagtgaaaccgaggactccgtgatcataattgactcatctcctactgcgctgaagcacccggagaagaaccagaagaagctccaatgcctcaatgatgtgttggggaaaaagctgaacactagcaccaaaaatgtgccaggcaaaatgaaggttgcgcccctgtttctggtaagaaaggcacagaaggctgctgaccccgtaccatcctttgacgagagtagtcaggacacgtctgaaaaaagccaggactgcgacgttcaatgcaaagcaaaaagagactttctcatgtcgggattaccagatctcctcaaaagacagattgctaagaaggccgcggctctcgacgtgtataacgcagtaagtacatcattccagagggtggtgcacgtacagcagaaagacgacggctgttgtctgtggcatctcaagccacccagctgtcctctgttgacgaaatttaaagaactaaataccaaggtaatagacttatctaaatgtgggattgcactaggcgagttctccactttgaattccaaactgaagtctgggaacagcgccgctgtctttatgcgcaccagaaaagagtttactgaagaggtgcgcaatctgctgttggaggaaatcagatggtcaaatcctgagtttagccttaaaaagtacttccctctactcttgaagaagcagatagagcatcaagttctgtcctctgaatgtcacagcaaacaggagctggaggccgacgtatctcataaggagaccaagagaaagcttgtggaggcagagaacagtaaatctaagcgtaagaagcccaacgagtattccaaaaatttggaaaaaactaatcggaaaagcgaggaactgagcaagaggaacaattctagcggtatcaagctagatagctcgaaagacagcggtacagaggacatgctgtggactgagaaatatcaaccgcagacggcctctgaactgatcggcaatgagttagctatcaaaaaactacacagctggctgaaagactggaaacgaagggctgaactggaggagcgccagaatttaaagggaaagcgcgacgagaagcacgaggatttttctggtggaattgacttcaagggttcttcagatgacgaggaggaatcccggctgtgtaatacagtacttatcaccggccctactggagtcggtaagactgcggccgtctacgcgtgcgcccaggaactgggtttcaaaatttttgaggtgaacgcctcgtcccagcgttccggacgccagattctgtcacagctgaaagaggctacccaaagtcaccaggtcgataaacagggagtgaacagccagaaaccctgtttttttaactcttattatattggaaagtctcctaaaaaaatttccagcccgaaaaaagtggtcacatctccccgaaaggtgcctcctccctcaccaaagtcctcggggccaaagcgagcgctcccgcctaagaccctggccaattactttaaggtgtcacccaagcccaagaataatgaggaaatcggcatgctgctcgaaaataataaggggattaagaactctttcgagcagaaacagatcacacagactaaaagtactaacgcgaccaactcgaacgtcaaagatgtgggagccgaagagccaagccggaaaaacgccacctcattgatcttatttgaggaggtggacgtgatatttgatgaggatgccgggttcctgaacgctataaagacctttatggccacgacgaagaggcctgtcattctgactacaagcgacccaacattcagcctgatgttcgatggttgttttgaggagatcaaattctctacaccctcactgctgaatgtcgcatcctacctgcaaatgatctgcttgactgagaacttccgtacagacgtgaaagactttgtaactctgctgactgcaaatacttgcgatatccggaaatccattctttacctgcaattctggatccggtcagggggtggtgtactggaggaacggccactgacactctacagggggaatagtcggaatgtccagctagtgtgcagtgagcatggcttagacaacaagatttatcctaaaaataccaagaaaaaacgagtagatctgcccaaatgtgacagcgggtgcgcagagacactcttcggcctcaaaaatatcttctctccctctgaggacttgttttcattcctcaaacacaaaatcactatgaaggaagaatggcacaagttcatccaactcctcacagagttccagatgcgaaacgtggacttcctttattcaaatctcgagttcattctacctctaccggtcgacaccattccagaaactaaaaacttctgtggcccctctgtcacagtggatgcctctgccgccaccaagtccatgaactgcctcgcaagaaagcattccgaaagggaacagcccctcaagaaatcacaaaagaagaagcagaaaaagactttagtgattctagacgattccgaccttttcgacactgatctggacttccctgaccagagtatctccttgtcttccgtttctagcagcagtaatgcggaagagtcaaagactggcgacgaggaaagcaaggctagagacaaagggaacaaccccgaaacgaaaaaatcaatcccatgtcctcctaagaccacagccggcaaaaaatgctccgccctggttagccactgcctcaattctttatctgaatttatggataatatgtccttccttgacgctctgttaacggatgtgagagaacagaacaagtatggcagaaacgatttctcctggactaatggcaaggtaacatcagggctttgtgatgagttttcgctggagagcaacgacgggtggacgtctcagtcgagtggcgaactcaaagcagctgcagaggcactcagtttcactaagtgtagcagtgcgatctctaaagctctcgaaacactcaactcgtgtaagaagttgggaagggacccaacaaacgacctgaccttttacgtctcccagaaaaggaataacgtatacttctcccagagtgctgctaacctggacaatgcctggaagcggatttcagtcataaagtctgtgttctccagtcggtccctgttgtacgtggggaataggcaggcaagtataattgagtatctgcctactctgaggaacatctgcaaaacagagaaattgaaggaacaggggaagtcaaagcgtcgcttcttgcattactttgagggcatccacttggacatacccaaagagaccgtgaacacacttgcggcagattttccctag

SEQ ID NO: 108948 - DNA, 3543 bp, Artificial Sequence
  Description of Artificial Sequence: Synthetic coding sequence
atgtccgccgactcaagccccctggtaggaagtaccccaaccggttacggaactctcaccattggcacttcgatcgatcccctctcctcgtcagtatcgagcgtgagactttccggatattgcggcagcccgtggcgggtcattggatatcacgtcgtggtgtggatgatggccgggatccctcttctgctgtttcgctggaagcccctgtggggggtgaggctgcggctgcggccctgtaatctcgcgcacgcagagacactggttattgagatcagggacaaagaggattcatcatggcaactgttcacagtgcaggtccagacagaggctatcggcgaaggatccctggagccctctccccaatcccaggccgaagacggccgatcccaggcggcagttggtgcagtgcccgagggtgcctggaaagataccgcacaacttcacaaatccgaggaggccgtttcagtcggccagaaaagagtactccggtattatctgtttcaagggcaaaggtatatttggatcgaaacccagcaggccttctaccaggtttccctgttagaccacggacggtcctgtgatgatgtgcacaggagcagacacggcttgagccttcaagaccaaatggtgagaaaggcaatctatggtccaaacgttatctccattcctgtgaaaagttatccccagctgttggtagacgaagcactcaacccctactacggattccaagctttttcaatcgcactttggttggctgatcattactattggtatgcgctgtgcatcttcctgatcagcagcatctccatttgcctgtccctatataagactagaaagcagagtcagactctgagagacatggtgaagctgtccatgcgggtctgcgtctgcagacctgggggcgaggaagagtgggtcgattccagcgagctcgtgcccggcgattgtcttgtgctgccgcaggagggtggcttgatgccttgcgatgcagcactggtagcgggtgaatgcatggtgaacgagtcctctctgactggcgagtctataccggtccttaaaacggctctgcccgagggcctggggccctattgtgctgaaacacacaggcgacacacactgttctgcggcacattgatcctacaggcccgggcatacgtaggaccacacgtgctggccgtcgttaccaggactgggttttgcactgccaaaggcggcctggtttcatcgatattacatccccggccaataaactttaagttctataaacactctatgaagttcgtggctgcgttgagcgtactcgctctgctgggaacaatttactcaatattcatcctctataggaaccgcgtcccgctgaacgagatcgtcatccgcgcacttgatcttgttacagtagtagttcctccagccctgcccgcagccatgacagtctgcaccctctacgcacagtctcgattacggcgccagggtatcttctgcatccatcctctgcgtattaatctgggcggcaagcttcaactcgtgtgctttgataagacaggaacacttacggaagatgggttagacgtgatgggcgtggtccctctgaaggggcaagcatttctgcctctggtgcccgaaccacgacgcttgcctgtggggcctctgctgagagcgttggccacctgtcatgcactttctagactgcaagacactccggtgggggatccaatggatcttaagatggtcgaatcaactggctgggtgctggaggaagagcccgccgcagatagcgctttcggtacccaagtgctggcggtgatgcgaccccccctttgggaacctcaactgcaggccatggaagaaccccccgtccccgtctccgtgctgcacaggtttccattcagctcggcactgcaacgaatgtctgttgtggtggcctggcctggggccactcagcccgaagcatatgtaaaaggatctcctgagctggtggccggtttatgcaatcccgaaactgttccaacggatttcgcgcagatgctccaatcgtatacagctgccggatatcgtgttgttgctctcgcctccaagcccctccccaccgtcccaagcctggaggctgcacagcaactcacacgagatacggttgagggagacctgagtctcctcggattgctggtcatgcgcaatctcctgaagccacaaacaacacccgtcattcaggccttgaggaggacccggataagagccgttatggtcaccggcgacaatctacaaacggcggtgactgtggcaagaggatgcggcatggtggccccccaggagcatttgatcattgtgcacgcaacccacccagaaaggggtcagcctgctagccttgaattcctgccaatggaatcccccactgcagtgaacggggtaaaggatcccgaccaggccgcctcttacaccgtggaaccagatccccggtctcgccacctggctctcagcggccctacctttggtatcatcgtcaagcattttcctaaactgctcccgaaagtactggtgcaggggaccgtatttgcgcggatggcacctgagcagaaaaccgagctggtatgcgaactgcagaaactccaatattgcgtcggtatgtgtggagacggtgctaatgactgtggggccctgaaggctgcagacgtgggcatctccctaagccaggcggaggcatccgttgtgagcccttttaccagctctatggcgtctatagagtgtgtgccgatggtcatccgtgaggggaggtgctctttggatacatccttctccgtgttcaagtacatggcactctattcccttactcagtttatatcagtccttattctgtacacaattaacacaaacttgggcgacctgcagtttctagccatagatctggtcattaccaccacggtagcagtcctcatgagtaggactgggcctgccctcgtgctcggccgggtccgccccccgggcgctcttctgtctgttcccgtattgtcttctctgctgctgcagatggtactggtaaccggcgtccagcttggaggttacttcctgactctggcgcagccctggttcgtcccccttaatcgcactgttgccgcacctgacaatttacctaactacgagaatactgtggtcttctctttaagcagtttccagtacctgatcctggccgccgccgtctccaagggcgctccattcaggcgccctttgtacacgaatgtaccattcctggttgcccttgcgctgttatcctcagtgctcgtaggtctggtgctggtgccagggctgctccaggggccattagctttaagaaacattaccgatacgggattcaagctccttttactcggcttggtgacccttaatttcgtgggagcctttatgctggagtctgtattagatcagtgcctccctgcttgcttaagacgcctccgacccaaacgggcttccaagaaacggttcaagcaactggagcgagagctcgcagagcaaccttggccacccctccccgccggcccactgcgctag

SEQ ID NO: 108949 - DNA, 3477 bp, Artificial Sequence
  Description of Artificial Sequence: Synthetic coding sequence
atgtcagccgatagtagtccactggtgggcagtacgcccacagggtacggcaccctgaccattggaacgtccatcgacccactcagctcttctgttagctctgtgagactgagcggctactgcggcagcccttggcgcgtgataggctatcatgtggtggtctggatgatggctgggatacccctgctgcttttccggtggaagccactttggggagtgaggctcaggctgagaccttgtaacttggctcatgccgagactctagtgatcgagattagagataaggaagatagctcttggcagctgttcacagtccaggttcagaccgaggctataggcgaaggatctttggagccttctccgcagagccaggcagaggacggcaggtcacaagctgcggtgggcgcggtcccagaaggggcttggaaggatactgcccagctgcacaaatccgaggaagcaaaaagggtgctcaggtattacctgttccaggggcaacgctatatatggattgagacacagcaggctttttaccaggtgtcacttttggatcatggacgaagctgcgatgacgttcaccgcagccgtcacggcctgtcactgcaagaccagatggtgagaaaagcaatatacggccccaatgtgatctcaatcccggtaaaaagttacccacagcttcttgtggacgaggctttgaacccttattacgggtttcaggccttttccatcgccctgtggctggccgaccactattattggtacgctttgtgcatctttctcattagcagcattagtatttgtctgtcgttatacaaaactaggaaacagtcacagacactgcgtgacatggtgaagttaagcatgcgggtgtgcgtgtgcaggccaggcggcgaggaggagtgggtagacagcagtgaactcgttcccggcgattgtcttgtgctcccgcaggagggaggcctgatgccttgcgatgcggccctggtagctggagaatgcatggttaacgaatccagtctgacaggcgagtccattccagttctgaagaccgccctgcccgagggcctaggcccgtactgcgcagaaacccacaggcgccacacactgttctgtggaacactaatcctccaggcccgcgcatacgtgggtccacacgtccttgcagtcgttacacgtaccggcttctgtacggcaaagggtggtttagtttcttctatactgcatcccagaccaattaatttcaagttctataagcactcgatgaaattcgtggctgccctgagcgttcttgcactattaggcacgatctactcaatttttatcctgtatcgcaaccgcgtgcctctgaatgagatagtgatccgggccctggatctggtgacggtcgttgtgccgcccgcgcttccagcagctatgacagtatgcacattgtacgcccagagcaggctcaggcgacagggcatcttttgcattcatcccctaaggatcaatctgggtggcaaactacaacttgtgtgtttcgacaaaactgggacccttaccgaggacggcctcgacgtgatgggcgttgtcccccttaagggacaagcctttctgccactggtgcctgagccgcgccggctgccagttggtccactgttgcgagctctcgcgacctgtcacgctctgtctcggctacaggatacccctgtcggtgatcccatggacctcaagatggtggaaagtacaggttgggtcctcgaagaggagcccgctgcagattctgcgtttggaacacaagtcttggctgtcatgcgcccacctctctgggaacctcagcttcaggctatggaggaaccaccagtcccagtgagcgtgttgcacaggttccctttttcttctgccctgcagcggatgtccgtagtcgtagcctggcccggagccacccagcccgaggcctacgtcaaggggagcccagagctcgtggctggcctctgcaaccccgagactgtgccgaccgatttcgcccagatgctgcaaagctacacggcagcaggatatcgagtggtggctctagcgtctaaacctctgcctacagtgccgagtctggaggccgcacagcagctcacgcgggacactgtggaaggggatctgtcattgcttggattgcttgtgatgcggaatctcctgaagccccagacgacccctgttatccaagctctcaggcgaactcgaattcgcgccgtcatggtgaccggcgataacctccagaccgccgtgactgtggccaggggatgcggtatggtggcccctcaggagcatctgattattgtgcatgcaactcatcccgaacggggacagcctgccagtctagaatttctccctatggagagccccaccgccgttaacggcgttaaggttttggtccaggggacagttttcgctagaatggcgccagagcagaagacagagctcgtgtgcgaactgcagaaactccagtactgcgtgggcatgtgcggcgacggagcaaatgattgcggagctctgaaggccgcagacgtggggatttcactgagtcaagcagaggcttctgtagtttctccctttacgagttccatggccagcattgaatgcgtgcccatggtcatcagagaagggaggtgctctttggatacctcctttagtgtcttcaagtacatggccctgtactccctgacacaattcatctccgtcctgattttatacaccattaacaccaatctcggcgacttacagtttcttgccatagatctggtgataactaccacggttgcggtgttgatgtcccgtaccggccccgcccttgtgctcggacgggttagaccccctggcgcccttctttctgtgcccgttctgagctcccttctgcttcagatggtattggtgacaggtgtgcagctgggcggctatttcctcacactcgcccagccctggttcgtgcccttgaaccggaccgtggccgccccagataatctgccgaactacgagaatactgtggtcttcagcctttcctcctttcaatacctgattctggcggctgccgtgtctaagggggcccctttcaggcgaccactgtataccaatgaacgtgctaggcctgtccctccacgactgcctgctcctccccccgcccaggcaggacttcaagaagcccttcaggccgctggaacaagggctggtcgagccgcactggctgctgcagctcgaagaccccctgaggttgttcaggcacacggacacccaaggcattggaactcattgcctctgtcccaccaattagaccctagtccggcaacaccccccccccccccaccaaccagtctacggttggccaccgtttatactccacccccaagacccccgcctccctggggctcagtggattattgtcccctgccatggacgatcccgagaaggggggggtccccccagttgccttctgtcctcctctccgtttag

SEQ ID NO: 108950 - DNA, 3528 bp, Artificial Sequence
  Description of Artificial Sequence: Synthetic coding sequence
atgtccgctgattcctcacccctggtcggctcgacccctaccggctatggcacactcacaattgggacgtcgattgacccactgtcgtctagcgtctcttcagtgcgcttaagtggctattgcgggtccccatggagagtgatcggctatcacgtcgtcgtatggatgatggccggtataccactcctgttatttaggtggaaaccactttggggagttcgtcttcggcttaggccttgtaatttagcgcatgccgagaccttggtgattgaaattcgagataaagaggacagctcatggcaactgttcacagtacaagtacaaaccgaggcaatcggcgaggggtccctcgagcccagcccacagtcacaggctgaagacggtcgttcccaggcagcagtaggtgcagtacctgagggtgcgtggaaagataccgcgcagctccacaaaagtgaggaagccaaacgcgtacttcgatattacctgttccaggggcagcgttatatttggatagagacccagcaggcgttctaccaggtgagcctgcttgaccatggccgtagctgtgatgatgtgcacagatcccggcacgggctttcactgcaggaccaaatggtgcgaaaagcaatctacggcccaaatgtgatttcaattcccgttaaaagctacccccagctactggtggacgaggctctgaatccctattacggtttccaggcctttagcatcgcactgtggctcgctgatcattattattggtatgcgttgtgtattttcttgatctccagcatcagcatctgcttgagtctatataagacccgaaaacagtctcagaccttacgcgatatggtgaaactgtcaatgcgggtctgcgtgtgtcgccccggaggcgaggaggagtgggtagactccagcgaacttgtccccggagactgccttgtactgcctcaggaaggtggtctcatgccgtgtgacgcagcactggttgccggggagtgcatggtgaacgaatcctccctgactggtgagtcaattccggtgctgaagactgcccttcccgagggactggggccctattgcgcagaaactcaccgtcgccacactctgttttgcggcactctcatcttacaggcaagggcatacgtcgggccgcatgtgttagcagtcgttactcgcaccgggttctgcaccgctaagggcgggctggtatcatctatcctgcatccaaggcctatcaactttaagttttataagcatagtatgaagtttgttgcagcactttcagtgctagcactgctgggaactatttactctatttttatcctgtatcggaatcgagtgccccttaacgaaatagtgatacgagcgctcgatttggtcacagtggttgtgccacccgctttaccagctgcaatgaccgtgtgtacactgtacgcccagtctcgcctgaggcgccagggtatattctgtattcaccctctccgtatcaatctcggcgggaagttgcagttagtgtgcttcgataaaactggaaccctaaccgaggatggcctcgatgtgatgggcgtcgtcccgcttaagggacaggcctttctgccgctggtgccagaaccccgccgtttgcccgttggtcctctgctgcgggccttggccacttgccacgccctctcacgactacaggacacccctgtgggagaccccatggacctgaagatggttgagtcaacggggtgggtgcttgaggaagaacccgcggcagactccgccttcggaactcaagtccttgctgtgatgcgcccacccctctgggaacctcagctgcaggctatggaagagccccctgttccagtttctgtcctgcatcgatttcccttttcttctgcgctgcagcgtatgtccgtagtcgttgcctggcctggcgcaacacaaccagaggcctacgtcaaagggagtcccgagttggtagccggcctatgcaatccagaaaccgtgccaaccgattttgctcaaatgctacagtcatataccgccgcaggctaccgggtggtggccctggcctccaaaccattacccaccgtgccatcactggaggcagctcagcagctgacacgtgataccgttgaaggggatctatccctcctgggcctgcttgtgatgcgcaatttgctcaagccccagaccacaccggttattcaagctctcaggagaacacggattagagccgtgatggtcaccggggacaacctccagacggcagtaaccgttgccaggggatgcgggatggtggccccacaagaacatctgatcatcgtacacgcaacccatcctgaacgcggtcagcccgcctccctcgagtttcttcctatggaaagcccgactgccgtgaacggtgtgaaggacccagatcaggccgcctcttacacagtggagcctgaccctagaagtagacacctcgccctgagtggtcctaccttcggcattattgtgaagcacttccccaagttgttgcctaaagtcttggttcaggggaccgttttcgccaggatggcgccagagcaaaaaactgagttggtctgcgaacttcaaaaactgcagtattgtgtgggaatgtgtggagacggggccaacgattgtggggccctcaaagccgccgacgtaggaattagcctcagccaggccgaagccagcgtggtttcaccttttacttctagtatggccagcattgagtgtgtaccaatggtgatcagggaaggccggtgcagcctggacacctccttctcagtgtttaagtatatggcgctctacagcctcacccagtttatctcggttttgatactgtacacaataaacaccaacctgggcgaccttcagtttctggctatcgatctagtcatcacgacaaccgtggcagtgctgatgtcaagaactggacccgctctggttcttggcagggtgcggccccctggagccctactcagcgtacccgttctgagcagcctgcttctccagatggtgctggttacaggtgtccaactgggtggctattttctgacgctcgcccagccctggttcgtgcctctgaacagaaccgtagccgccccagacaaccttcctaattacgaaaacaccgtggtattttcactctctagtttccagtatctgatattagccgctgcagtcagtaaaggcgctcccttccgtcggccactgtatacaaatgtgcccttcctggttgctctcgctctgttgagttcagtgttggtcggtctggtgctcgtccccggcttgctacagggacctctagctctgcgaaacattacggacacggggttcaagttacttctccttggcctggtgacccttaacttcgtgggagcttttatgctggagagcgtcctcgaccagtgtctgcctgcatgcctcaggcgcctgaggccaaagcgcgcaagcaagaaacgctttaagcaacttgagcgagagctcgcagaacagccatggcccccactgccggccggccccctgcggtag

SEQ ID NO: 108951 - DNA, 3372 bp, Artificial Sequence
  Description of Artificial Sequence: Synthetic coding sequence
atgtcacgggccaccagtgtgggcgaccagctcgaggcgccagctcggactatctacttgaaccagccccaccttaacaaattcagagataatcagattagtaccgccaaatactctgtgctgacatttctgccaaggttcctgtacgagcaaatacgccgagccgcaaacgcctttttcctgtttatcgcgcttctgcagcagattcccgatgtatcaccgacgggccggtatactaccttagtccctttaatcatcatcttaactattgctgggattaaagagatcgttgaagatttcaaacgccacaaggccgacaacgcggtgaataaaaagaaaaccatcgtgttacgcaacgggatgtggcatacaataatgtggaaggaggtggccgttggagacattgtgaaagtcgtgaacggtcagtatctgcccgctgacgtcgtgttgctgtcctccagcgaaccgcaggcaatgtgttacgtcgagaccgccaacttggacggggagaccaacctgaagattcggcagggcctgagtcacacagccgacatgcagaccagggaggtactgatgaagctctcaggaacaattgagtgtgaagggcccaatagacatttgtacgatttcactgggaacttaaacctcgacggaaaatcattggtggccttagggcccgaccagattctgttgagaggaactcagttaagaaatacacagtgggtcttcggcattgttgtatataccgggcatgacaccaaactgatgcagaactcaacaaaggcgcctctcaaacggtctaacgtggagaaagttaccaatgtgcagattttggtcctgttcgggatactgctggtgatggcattagtttcctctgcaggagctttatactggaaccgcagccacggagaaaaaaattggtatataaaaaagatggacacaactagcgataattttggctacaatctgttaacgttcattattttgtataataatctcatcccaatctcactgctcgttacactggaagtggtgaaatacacgcaggccttgttcattaactgggacacggacatgtattacattggcaacgacacgccggccatggcaagaacctcaaatctaaacgaggagctgggccaggtcaagtacctgttttccgacaaaaccggaaccctgacatgtaatatcatgaacttcaagaagtgtagtatcgcaggtgtgacatatggacactttcctgagttggctcgcgagccttctagtgatgacttttgccgaatgccgccgccatgcagtgatagctgcgacttcgacgacccgcgcttgctgaaaaatattgaggaccgtcatccaactgctccctgcattcaggagtttttgaccctcctggccgtgtgccacaccgttgttcctgagaaagacggggacaacataatttaccaggccagcagcccagatgaagccgctttggtgaagggggctaaaaagcttggttttgtgttcacagcccgaactcctttcagtgttatcattgaggccatgggccaggaacagacattcggcattctgaacgtcttagagttttccagcgacagaaagcggatgagcgttatcgtgagaacaccatcaggacggctgaggctatattgtaaaggcgccgacaacgtgatctttgagcgactcagcaaagatagcaagtatatggaagagaccctatgtcacttggagtacttcgctaccgaaggactgagaactctttgcgtggcatacgctgatctgtctgagaatgagtacgaggaatggctgaaagtgtatcaggaggcgagcacgatcctcaaggatcgggcacagcgactcgaagagtgctacgagataatcgaaaagaatctgctgctgttaggagcgaccgcaatcgaggaccgcttacaggcgggggtgccagaaacaatcgccaccctgttgaaagcggaaataaagatatgggttttaactggggataaacaggaaacagccattaatatcggatatagttgtcgcctcgtgagtcagaacatggccctgatcctgctgaaggaggactcacttgacgcaacacgggcagcaattacccaacattgcaccgatctcggtaatctcctgggcaaggaaaacgacgtggcactgatcattgatggccacactctaaagtacgcgctgtcttttgaggtgcggaggagtttcttagatctggcacttagctgtaaagctgtgatttgctgtcgcgtttcccccctgcagaaatccgagattgtcgatgtggtgaaaaagcgagtgaaggccattactctggccattggtgatggggctaacgacgtgggcatgatccagacagcacacgtgggggtcggcatcagcgggaacgagggcatgcaggcaaccaataacagcgactacgccatcgcgcagttctcctatctcgaaaagctgctcctggtgcatggagcctggagctacaacagggtcaccaagtgtatcttatattgcttttataaaaatgtggtgctgtacattatcgagatattcaccgctttgccccctttcacattgggaatttttgagcgatcttgtacgcaggagagcatgttgaggtttccacaactgtacaaaattacccagaatggcgagggctttaatacaaaagtgttttggggtcattgcatcaatgcgctggtccactccctgattttgttctggtttcctatgaaggccttggaacacgacactgtgctcacgagtgggcacgctaccgactacctgttcgtaggtaatatcgtgtacacttacgtggtggtgaccgtgtgcctgaaggctggcctagagactaccgcctggaccaaattcagtcatctggccgtttggggctctatgttgacttggctggtcttctttggaatctacagcaccatatggcctacaatcccaattgcacccgatatgcgtgggcaggcgaccatggtactgagtagcgcgcacttttggctaggcttgttcctcgtcccaaccgcatgcttaatagaagacgtggcttggcgagctgccaaacatacctgcaagaaaactctcctggaggaggtacaggaattggaaaccaaatctagagtgttaggtaaggccgttcttcgggattctaacggaaaaagattgaatgaacgcgaccgtttaatcaagcgtttaggtaggaaaacgccgcccacattattccggggatcttccctccaacagggagttccacacggctatgcatttagccaggaagaacacggcgccgtgagccaagaggaggtcattagagcatacgataccacaaagaagaaaagtaggaagaagtag

SEQ ID NO: 108952 - DNA, 426 bp, Artificial Sequence
  Description of Artificial Sequence: Synthetic coding sequence
atgtcaagggccacaagcgttggagaccagttggaggcccctgcgaggaccatttaccttaatcagccacaccttaataagttccgcgacaaccagatctcgaccgcaaaatattcagtactcacctttctgccacgcttcctgtatgaacagattcggagagctgctaatgcattctttctattcatcgcgctccttcagcagatccccgacgtgagtcctacaggtaggtataccaccctggttcccctgattataatcttaaccatcgccggcatcaaagagattgttgaggatttcaagcgacacaaagcagataacgccgtcaacaagaaaaagaccatcgtattgagaaatggcatgtggcatacgatcatgtggaaagaagaaaacagtcctcccttcaaggaaatttcccccctctag

SEQ ID NO: 108953 - DNA, 3567 bp, Artificial Sequence
  Description of Artificial Sequence: Synthetic coding sequence
atgttaaatggcgcaggcttggataaggccctcaaaatgtccctgcctcgccggagccgcatccgttcaagtgtggggcccgttagatcctctctgggttataagaaggctgaagacgagatgagccgtgctacatccgttggcgatcagttagaagccccggctaggacaatctacctgaaccagcctcacttgaataagttccgggacaaccagatttctactgctaagtactctgtgctcacatttctccctcggttcctctatgaacagatccgccgtgctgcaaacgcattttttcttttcatagcgctactgcaacagattcccgatgtgtctccaactggtcgttatacaactctcgtgccactgatcattattctgactatcgccggcattaaagagattgtcgaagacttcaagagacataaggccgataacgcagtgaataaaaagaaaactatcgtgctgcggaacggaatgtggcatacaatcatgtggaaggaggtagcagtaggagacattgttaaagtggtcaacggccaatacttgcctgccgatgtggtgctgctgtcaagcagcgaacctcaggccatgtgctacgttgaaaccgctaacttggacggcgagacaaatctcaagatcagacagggactgagccacaccgccgatatgcagacacgcgaggtactcatgaagctgagtgggaccatcgaatgtgaagggcctaatcgacacctctacgacttcaccggcaacctcaatctcgacggcaaatccttagtcgctcttggccccgatcagatccttcttcgaggcactcagctgcggaacacacagtgggtgtttggtatcgtagtatatacaggccacgacactaaacttatgcagaactcgactaaggctcctctcaaacggtcaaacgtcgaaaaggtcaccaatgtacagattcttgtgcttttcggcattctgctggtaatggcgcttgtttccagcgctggagcactgtactggaaccggagccacggcgagaagaactggtatatcaaaaaaatggacactacttctgataacttcggttacaatctcctcactttcattatcctgtacaacaacctgatcccaataagccttcttgtcacgctggaagtggtgaaatatacgcaggcgcttttcataaattgggatacagacatgtactacatcgggaacgacactcccgctatggcacgcactagcaacctgaatgaagagttgggacaggttaaatacttgttcagcgacaaaactgggacgttaacctgcaacattatgaactttaaaaagtgcagcatcgcaggggtgacctatggccacttccctgaactcgcccgtgagccttcgagtgacgacttctgtagaatgcctcccccttgctccgactcttgtgattttgacgatccacgactcctcaagaacattgaggatagacaccccactgccccctgcattcaggagtttctgaccctcctggctgtgtgtcataccgtggttccagaaaaggacggggacaacatcatttatcaggcctcctcaccagacgaagccgcgctggtgaaaggcgctaaaaaactggggttcgtgtttacggcacgtacgccgttctctgttataattgaagcaatggggcaggaacagacattcggcatcttgaacgtactggaattcagtagtgaccgaaaacgcatgtccgtgatcgtgaggacccctagcggaaggctgcgcctgtattgcaaaggggcggacaacgtgatcttcgagcgcctctccaaggacagtaagtacatggaggagacactctgtcacctggaatatttcgcaacagaaggtctgcgcacactctgcgtggcgtacgccgatctaagcgagaatgaatatgaggagtggcttaaggtgtaccaggaagcctcaaccatcctgaaagaccgggcccagcgtctcgaggaatgttatgaaatcattgagaaaaaccttctcctcttgggagcaactgcgatcgaggacagactccaggctggtgttcctgagacaatcgctacccttttaaaggccgagatcaaaatctgggtccttactggagataagcaagagaccgccattaacatcggttacagttgtcgcctggtgtcacagaatatggcactcatcttattaaaagaggactccctggacgcaacgagggccgccattacacagcactgcaccgacttaggtaacttactgggcaaggaaaatgatgtggctctcattattgatggccatacactgaagtacgccctgtccttcgaggttcggcgatccttcctcgatttggctctctcgtgcaaggccgttatttgctgtcgggtgagtccactacagaaaagcgagattgtggatgttgtcaagaaacgagtaaaggcaatcactcttgccatcggcgatggggctaatgatgtgggaatgatccagactgcacacgtgggggtaggcattagcggcaatgaaggcatgcaggccaccaataattcagattatgccattgctcagttctcttatctagagaaacttttgctggtccacggtgcttggtcatataaccgggtgaccaaatgcattctctattgcttctataaaaacgtggtcctgtacatcatagagttatggtttgcttttgtaaatgggtttagtgggcagattctgttcgaacgctggtgcattggcctgtacaatgtcatctttaccgccttgccacctttcactcttggcatcttcgaacgctcttgcacccaagagtcgatgctcagatttccccagctctataaaatcacccagaacggcgagggattcaacactaaagtgttctggggccactgcattaatgccctggtgcacagtctcatattgttctggttcccaatgaaggctttagaacatgacacagtcctcacctcagggcacgctaccgattatctgttcgtgggaaacattgtctacacgtacgtagttgtcacagtgtgtctgaaagctggcctggagacaactgcttggacaaaattcagtcatctggccgtttgggggtctatgctgacctggctcgtgttttttggcatatatagcacgatatggcctaccataccgatagcacctgatatgcgagggcaggcgaccatggtgttgtcctcagcgcatttctggttgggtttgttcttagtgccaacagcgtgtctcatagaagacgtcgcttggcgggctgccaagcatacatgtaaaaagacattgctggaggaggtccaggagctggagaccaaatcacgtgtactggggaaggcagtgctccgtgactccaacggtaaacgcctaaatgagagagaccggcttatcaaacgtttggggagaaaaacccctcccacgctgttcagggggtcatccctccaacagggtgtgccgcatggctacgcctttagccaggaagaacatggcgctgtatcacaagaagaagtcatccgcgcctacgacactacaaaaaagaaatcccgaaaaaaatag

SEQ ID NO: 108954 - DNA, 2907 bp, Artificial Sequence
  Description of Artificial Sequence: Synthetic coding sequence
atgaggtgtccaggaccacgcctccttgagaccagctggcgccacccaccagctccattcaccagcaccaataggcacctgtatgactttaccggaaacttgaacctcgatggcaagtccctggtagcacttggaccagaccagatccttctccgggggacccagctgagaaacacacagtgggtgttcggcatcgtggtgtatactggtcatgacacaaagttgatgcaaaattccactaaagccccattaaagcgcagcaacgtggagaaggtaactaatgtgcaaattctggtgttattcggcatcctattggtcatggcactggtcagcagcgcgggagccctgtactggaataggagccatggtgaaaagaactggtatataaagaaaatggacacaacctccgacaacttcggatacaacctcctgacattcatcattttgtataacaacttaatcccgatatctctgctcgttactctcgaagtggtgaaatacacacaggctctgttcatcaactgggacaccgacatgtactacatagggaacgatactcccgctatggctcggacgagtaatctgaacgaggagctgggccaggtgaagtatctgttctctgacaaaacaggcacccttacttgtaacattatgaatttcaaaaaatgttcaattgcaggtgtgacctatggccattttcccgagttggcccgggagccttccagcgacgacttctgtcgaatgcctcccccttgttccgactcctgcgattttgatgatcctcgactgctaaagaatatcgaagaccgccacccgacagctccttgcatccaggaattcctgacattgctggccgtttgccatacggttgtaccggagaaggatggggataatatcatctaccaggcaagttctcccgacgaagctgccttggtaaagggagccaaaaagctcggctttgtctttacggcaaggacacctttttcagtgatcatcgaggctatgggtcaggaacagaccttcggaattctgaatgtgcttgaattttccagcgataggaaaagaatgtccgtgatcgttcgcacaccgagcgggcgcctgaggttatattgtaagggcgctgacaatgttattttcgagcgcttgtcaaaagactccaagtacatggaggaaaccctgtgtcatctggaatacttcgccacagaaggcctgcgaaccctgtgtgtggcttatgccgatttatctgaaaatgagtacgaggagtggctgaaagtttaccaggaggcatccacaatcctcaaggatagggcacagagactggaggaatgttatgagataatagaaaaaaacctcctgctactaggagctacagccattgaggatcgtcttcaagcaggcgttcctgagacaattgccacgctgctcaaagctgagatcaaaatctgggtcctgaccggagataagcaggaaactgccataaacatcgggtacagctgtcgacttgtctcacagaatatggcactcatactgctgaaagaggatagcttggatgccacaagagcggcaatcacacaacactgcaccgacttgggaaacttactggggaaagagaacgatgtggccttgataattgacggccacaccctgaaatatgcgctcagcttcgaggtgagacgcagtttcctggatctcgctctgtcgtgtaaggcagtgatctgctgccgagtctcccccctgcagaagtcagagatcgtggatgtggtaaaaaagcgagtgaaggccataaccctggctataggggatggagctaatgatgtcggcatgattcagaccgcacatgttggggtgggaatttcgggcaatgagggtatgcaggccaccaacaacagtgactacgcaattgcgcagttcagttatctggaaaaactgctgctcgtccacggcgcctggtcctacaaccgcgtgaccaagtgcatattgtactgcttttacaaaaacgtcgtattgtacattatcgaattatggttcgcgttcgtgaatggtttcagcggccaaatcctcttcgagagatggtgcattggcttgtacaatgtcatcttcactgcccttcccccattcacactggggatatttgaacgctcctgcactcaggaatctatgctgcggttcccgcaactttataagatcacccagaacggcgaaggtttcaacacaaaggtcttctggggacactgtatcaacgccttggtgcattcactcatcctgttttggttcccaatgaaagctctggaacatgatacagtgttgacaagcggacatgctaccgattatctctttgtcgggaatattgtgtatacttacgtggtggtgaccgtgtgtctgaaggcgggattggagacgactgcatggactaagttctctcatctcgctgtttggggaagcatgctaacctggctggttttcttcgggatctatagcactatatggcctaccatcccaatcgcgccggacatgaggggacaggcaacaatggtactctcctcagctcatttctggcttggcctgttcttggtccccaccgcctgcctgatcgaagacgtcgcgtggagggctgctaaacacacttgcaaaaaaactctcctggaggaggtgcaggagctggagacaaagtcacgagtcttgggaaaagccgttctgagagattccaatgggaagcgcctgaacgaaagagatagactgattaagcgtctcgggcgaaaaactcctcccaccttattccgaggaagtagcctgcagcaaggggtgccccacggctatgccttttcccaagaagagcatggggctgtatcccaggaggaagtgataagggcctatgatacaacaaaaaagaagtcacggaaaaagtag

SEQ ID NO: 108955 - DNA, 3903 bp, Artificial Sequence
  Description of Artificial Sequence: Synthetic coding sequence
atgggtactgggcccgcacagacacctcggagtactagagccggaccagagccttccccagctcccccaggacctggcgacacgggcgactccgacgtcactcaggaaggaagtggacctgctggaattaggggcggggagaccgttatacgtgctggcatgggcgattctcccgggcggggagctcctgagcgcaggcacaaggcccaaccaggaagggctagaaagtatgagtggcgacctgagggaccaaccagcatgggatctctggggcaacgagaggacctgcaagacgaggataggaattccgcatttacttggaaggttcaggccaacaatcgcgcatacaacgggcagttcaaagagaaagtcatactgtgttggcagcgaaagaaatacaaaacaaatgtcattagaactgcgaagtacaacttttactcttttttgccactgaacttgtatgagcaattccaccgggtgagtaacctcttcttccttattataattatattgcaatcgattcccgatatcagcacactgccctggttctcactctcaaccccgatggtgtgtctgttgttcatcagggccacccgcgatctcgtggatgacatgggcagacataaatccgatagggccatcaataatcgaccatgtcagatcttgatgggcaagtcctttaagcaaaagaaatggcaagatctctgcgtgggggacgtggtttgcttgcgtaaggacaacatagtgcccgcagatatgctgctgcttgcaagcactgagccaagctccctctgttatgtcgaaaccgtggatatcgatggcgagactaacttgaaattcaggcaggctctgatggttacacataaggaactggccactattaaaaagatggcctcattccaagggactgtgacgtgcgaggcaccgaactcacggatgcaccacttcgtgggttgtcttgaatggaacgataaaaagtactcactggatatcgggaacttgctactgaggggctgtcgcatcaggaatactgatacgtgttacggcctagttatctatgctggcttcgatacaaagatcatgaaaaactgcgggaagattcatctcaaacggaccaagcttgacctgctgatgaacaaactggttgtagtgatttttatatccgtggtgttagtctgtttggtgctcgcctttggcttcggatttagcgttaaggaattcaaggaccaccactactaccttagcggagtccacggttccagtgtcgctgctgagtcgttctttgtcttctggtctttcttgatccttttatccgtcactatccccatgtctatgttcatcctgagcgaattcatatacctggggaacagcgtttttatcgattgggatgtccaaatgtactacaagcctcaggacgtccctgccaaagctcgatccacctccctgaatgaccacctggggcaggtcgaatacatctttagtgacaagactggcacattgacccagaacatcctcacattcaataagtgttgcatatcgggccgggtatacggcccagactcggaagctaccactaggccaaaagagaatccctacctgtggaataagttcgccgatggcaagctgcttttccataatgctgccctgctgcacctcgtccggacaaacggggatgaggccgtacgggagttctggcgactcctggccatttgtcacacggtaatggtccgcgaaagtccccgtgaacgaccagaccaactcctgtaccaggcagccagccccgacgagggcgcactggtcactgctgccaggaattttggctatgtttttctgtcccggacccaggatacagttactatcatggaattgggagaagaaagggtctaccaagttttagcaataatggattttaattcgacacgcaaacggatgtccgtcctggtcaggaaacccgagggcgccatttgcctatatacaaaaggagccgataccgtgatcttcgaacgactgcaccgccgaggagctatggagtttgccaccgaggaagcactcgccgccttcgctcaggaaacattaagaaccctctgtttagcttaccgcgaggtcgccgaagacatttacgaggactggcagcagagacatcaggaggcctccttgttacttcagaatcgtgcccaggccctgcagcagctgctgggtgccaccgcgatagaggacaggctccaggatggagtgccagaaacaatcaaatgtctcaagaaatccaatattaaaatttgggtcctcaccggtgataagcaggaaacggccgtgaacatcggatttgcctgcgagctgttgtccgagaacatgctgatcctggaagagaaagagattagtaggatcctggaaacttactgggagaattctaacaacctcctgacccgcgaatcactctcacaggttaagttagcgctggttattaatggtgatttcctcgacaaactcctggtgagtctacgaaaggagccccgtgctcttgcccagaatgtgaacatggacgaagcctggcaagagcttggtcagagtaggcgggactttctgtacgcaaggaggctgtccctgttgtgccgcaggttcggtttgcctcttgctgctcctcccgcgcaagacagccgggctagacgcagtagtgaggtgcttcaggagcgggcttttgtggacctggcctcgaaatgtcaggctgtgatctgttgtagagttactccaaaacagaaggccctgatcgtcgcgcttgtgaaaaaataccatcaggtggtcactctggccataggagatggcgcaaacgatattaacatgattaagaccgccgacgtcggcgtcggtcttgccggtcaggaggggatgcaggctgtgcagaattctgatttcgtactcgggcaattctgcttcctccagaggctgttactggtacatgggagatggtcttatgtaagaatctgcaaatttctgcggtatttcttctataagtcaatggcctctatgatggtgcaggtctggtttgcatgctataacggctttaccggccagccattatacgagggttggttcttagccctgttcaatctgttgtactcaactctgccagtcctttacattggtctttttgagcaggatgttagcgcagagcagagtctcgagaagcccgagttgtatgtggtgggacagaaggacgagctctttaattattgggtgttcgtgcaggctatcgcacacggcgtaacaacgtcactggtgaacttttttatgacgctctggatctctagggacaccgcaggccccgcgagcttcagtgaccatcagtccttcgccgtagtagtggccctgagctgccttttaagtatcactatggaagtgatcctcatcatcaagtattggacagccctgtgtgtggcaaccatcttgctgtcccttggcttttatgctattatgaccactacaacacaatctttttggcttttccgcgttagccctaccacattcccattcctgtacgccgatctctcagtgatgagctctccttctattctgctggttgtgttgctcagcgtgtccataaatacctttcccgtgctggctctgcgagtaattttcccggccctgaaggagctccgggctaaggaagaaaaagtggaggaaggacccagcgaagaaattttcaccatggagccactgccccatgttcatagggaaagcagggccaggagaagttcgtacgcattctctcaccgggagggatatgcaaacctgattacacaggggaccattttgagaaggggccccggggtgtcaagcgacattgcctctgagtcactggacccgagcgacgaagaagcagcctctagcccaaaagaatcccagtag

SEQ ID NO: 108956 - DNA, 1737 bp, Artificial Sequence
  Description of Artificial Sequence: Synthetic coding sequence
atgggcgatagccccggtagaggagcacctgaaaggcgacacaaggcacaacctggacgggcacggaaatacgagtggcggccagagggccccacaagcatgggttcgctgggccagcgcgaagacctgcaagatgaggatcgcaatagcgcattcacatggaaagtccaagcaaataacagggcctataatgggcagttcaaagaaaaagtgattctatgctggcaacggaagaagtataaaaccaacgtgataaggactgcgaagtataacttttactcttttctccctctaaacctatatgagcagttccaccgcgtgtctaacctcttctttctgatcataataatcctgcaatccatccctgacatttcgacattgccatggttctcactgtcaactcccatggtgtgcctactgtttatccgtgccacccgcgacctggttgacgacatggggcgtcataagtctgacagagccattaataatcggccatgccagattttaatgggaaagagctttaaacagaaaaaatggcaagatctctgcgtgggtgacgtggtatgcctgagaaaagacaatattgtccctgccgacatgctcctgttagctagtaccgagccatcctcactttgctatgtggaaacagttgacattgacggagaaacaaacctgaagttccggcaagccctgatggtgacacacaaggagctggcaaccattaaaaagatggcctctttccagggaaccgtgacctgcgaggcccctaattctcgtatgcatcattttgtaggttgtctggaatggaatgataaaaagtatagcctggacatcggcaatctgttgctccgcggatgcaggattaggaatacagatacatgttatggcttggtgatctacgcaggctttgacaccaagatcatgaaaaattgtgggaagattcacctgaagagaactaagcttgatcttttaatgaacaagcttgtggtggtaatattcatcagcgtagtgttggtgtgcctggtcttagctttcgggtttggcttctcggtgaaggagtttaaggaccatcactattacttgtccggcgtgcacggctcaagtgtggcagccgaatccttctttgtgttctggtctttccttatattattgtctgttaccatccctatgagcatgttcatcctcagcgaattcatctatctaggtaatagtgtttttattgattgggacgtgcaaatgtactacaaacctcaagatgtgccagccaaggcaaggagtacttccttgaatgaccatctcggccaagtcgaatatatatttagtgacaagaccggtacactgactcaaaatatattaaccttcaataagtgctgcataagcgggcgggtctatggtgcagcccctacccccgagctccccgctggatccagcatcttcaaagggctacgagtccccgagaaccagagccatgtttggcctcacgcacagcatctgcgtcccaatctaaaccaggggaccgttgcacggtggccaggattcttatggcggggtcctggcaagttttttttcttccttcgccagtctctgaccctctccacccaggcggggatgcagtggtgcaatttgggctccctccagtcaccaccaccaaggttcaagagattttcctggctctcgctcccaagcagctgggattaccggcacctcccaccacacctgatcttcttgtatttctag

SEQ ID NO: 108957 - DNA, 3792 bp, Artificial Sequence
  Description of Artificial Sequence: Synthetic coding sequence
atgggcgacagccctggaagaggcgcaccagaacggaggcataaagctcaacccggtcgggccagaaagtacgagtggcggccagagggcccaacttcaatggggagcctcgggcaacgagaggacctccaggatgaggatcgaaacagtgcattcacatggaaagttcaggccaacaaccgggcgtataatggccagtttaaggagaaagtgattttatgttggcagcgaaagaagtacaagacgaacgtcattaggacagctaaatacaacttttatagtttccttccgctgaatctttatgagcagttccacagagtcagcaatcttttttttctgatcataatcatcctgcagtccatccctgacatttctactttgccatggtttagcttatctacacctatggtgtgtctgttattcatccgtgcgacgcgggacctggtggacgacatgggtagacacaaatcagaccgtgctataaacaacagaccctgtcagatcctgatgggaaaaagcttcaaacaaaaaaagtggcaagatctgtgtgtgggcgacgttgtgtgcctccgcaaggataacatcgtcccagccgatatgctcctgttggcctcaacagaaccttcatccctttgctacgtcgagacagtcgatatcgatggcgaaaccaacttgaagttcaggcaggcgctcatggtgactcataaagagctggcaactataaaaaaaatggcatccttccaaggaaccgttacttgcgaagcacccaatagccgtatgcaccactttgtcggctgtctggagtggaatgacaagaaatattctctggatatcggcaatctcttacttcgaggatgtcgcattcgcaatacagatacttgctacgggttggtcatttatgctgatggctatatgttcgttggtttcgataccaagattatgaaaaattgtggcaagatccatctgaaaaggacgaagttggatctcctcatgaacaagttagtggtggtaatttttatcagtgttgtgctggtgtgcttggtgttggccttcggtttcggctttagcgtgaaagaattcaaagaccaccactactacctgagcggcgttcacggtagtagcgtggcagctgaatctttcttcgtgttctggtctttcctcatcttgttgtcagttactatccctatgtcgatgttcatactttcagaatttatatatcttggaaactctgtattcatcgattgggatgtccagatgtactacaagccacaggacgtacctgctaaggcacgttcgacatcactcaacgatcatttaggtcaggtagagtatattttctcggataagacaggaaccctcacgcagaacattttaacctttaataaatgctgtatttctgggcgcgtatatgggccagattcagaggcgactacgagaccaaaggagaatccctatctatggaataaatttgcggacgggaaactgctgtttcacaacgccgccctcttgcacctggtccggacaaacggcgacgaagccgtgagagagttttggcggctgttagcgatctgtcacaccgtcatggtgagggagtctccccgtgagcgccctgatcagctgctgtatcaggcggcttccccagatgaaggagcactggttacggcagctcgtaattttgggtatgtgttccttagccgtactcaggacaccgtcaccatcatggaattgggcgaagagagggtgtaccaagtcctcgccattatggattttaattcgactagaaagcggatgtccgtgttggtgagaaagcctgaaggcgccatctgtctgtatactaagggtgcggacacagtgatctttgaacggttacatagacggggagccatggaattcgccacggaagaggcactcgccgcatttgctcaagaaacacttcgcacactgtgtctagcttatagagaagtcgcggaagacatctacgaggattggcagcaacggcaccaggaggccagcctgctcctgcagaatcgggctcaggcccttcagcaggtctacaatgagatggagcaggacctgagactcctgggtgccacggcaatcgaggaccgcctccaggatggagtgcctgaaacaattaagtgtttaaaaaagtctaacataaagatctgggtactcaccggtgacaaacaggaaactgctgtgaacattggctttgcctgcgaactgctgtccgaaaatatgctgattctcgaagagaaggagatcagccgtatcctagaaacctactgggaaaatagtaataacctactgacccgcgaaagcctgtctcaagtcaaattggccctggttattaacggagatttcttggacaaattactcgtatcactccgtaaagaacctcgcgctcttgctcaaaatgtaaatatggacgaggcctggcaggagctgggccagtctcgaagggacttcttgtacgctaggagattatcgcttctctgcaggcgattcggactacccctggcagccccaccggcccaagacagccgagccagacggtcatcggaagtgctgcaggagcgcgcgttcgttgacctcgcgagcaagtgccaggccgtgatttgttgtagggtcaccccaaagcagaaggcactaatcgtggccctcgtgaaaaagtaccaccaagtagtgacgcttgctatcggtgacggggccaacgacatcaatatgatcaagacagccgatgttggtgttggcttggcaggccaggagggcatgcaggcagttcaaaactccgatttcgtgctgggacagttctgcttcctgcagcgattgctcctggtccatggcaggtggagctacgtgagaatatgcaagttcctgcgctatttcttctacaaatcgatggcttctatgatggtgcaggtctggtttgcgtgctacaatggattcacaggacagccactgtatgaaggttggttcttagcactgtttaatctattgtatagcacccttccggtcttatacataggtctgtttgaacaggacgtgagcgctgaacagagccttgagaagcccgagctgtatgtcgtgggtcagaaagacgagctttttaattactgggtgttcgttcaagccatcgcgcacggggtgaccacttctctggtcaacttctttatgacactatggatcagccgcgatacagcgggtcctgcaagcttctcggaccatcaaagcttcgcagtcgtggttgccttgtcgtgcctgcttagcatcacaatggaagtgatcctgattattaaatactggaccgcgctttgcgtggccaccattctgctgtctcttggcttttatgcgataatgacgaccaccacccagagtttttggctttttcgcgtctctccaaccacctttccgttcctctatgcagacctgtcagtgatgagctccccctcaatcttgctggtggtgctattatcggtctccatcaacacctttcctgtgctggctctgagggtcatattccccgctttgaaagagctcagagccaaggaagaaaaagttgaggaaggtccatccgaagaaatctttacaatggaaccgctccctcacgtgcatcgggagtctcgtgccaggcggtcaagctacgccttctcccatcgcgaggggtacgctaatctgattactcagggtaccatccttcggcgcggtcctggcgtgagcagcgatattgctagtgaatcactggatccaagtgatgaggaggccgcgtctagccccaaagagtcccaatag

SEQ ID NO: 108958 - DNA, 3933 bp, Artificial Sequence
  Description of Artificial Sequence: Synthetic coding sequence
atgggtacagggccagcacaaactccaagaagcactagagctggccccgaaccttctccggctccccctggacccggagataccggtgattctgacgtgacacaagaggggagcggaccagccggcattcggggaggagagaccgtcattagagccggcatgggggattcccctggccgcggggctcccgaacggcgacacaaggcgcaaccgggtagggcgagaaagtatgaatggaggcccgagggcccgacgtctatgggcagcctcggacagagagaggatttgcaggatgaggacaggaattctgctttcacatggaaagttcaagccaataacagggcctacaatggccaatttaaagaaaaagtaattctctgttggcagaggaaaaaatacaaaaccaacgtcatcaggactgcaaaatacaacttttatagctttctgcctctcaatttatacgaacagttccacagggtgtctaacctattttttctcattattatcatcctacagtctatacctgatatctcaacacttccctggttctcattgtccactccaatggtgtgtctgcttttcatcagagccacccgagacttggtagacgacatgggacggcacaagtctgaccgcgctatcaataaccgcccttgtcagatcttgatgggcaaaagttttaagcagaaaaagtggcaggatctttgtgttggcgatgtggtgtgcctgagaaaggataatattgtgccagctgatatgctgctgctggcgagtacagagcctagctccttgtgctacgtggagaccgtagatatcgacggagagacaaatttaaaatttcggcaggccctcatggtgactcataaggagttagctacaattaaaaaaatggccagcttccagggcactgtgacctgtgaggcccctaacagcagaatgcatcacttcgtcggttgtttagagtggaatgacaagaaatactcgctggacataggcaatttgctgttgcgtgggtgtcggatccggaataccgacacttgttacgggttagtgatctatgctggattcgataccaagattatgaagaattgcgggaaaatccatttgaagaggaccaaactggatttgctcatgaacaagcttgtggttgttattttcatctctgttgtactggtgtgtctggttctggccttcggattcggattctccgtgaaagagttcaaagaccaccattactatctcagtggcgtgcatgggtcttctgtcgctgccgaatccttttttgtattctggtccttccttatcttgctctctgtgaccatccctatgtctatgtttatacttagcgagtttatatatttgggtaacagcgtgttcatcgattgggatgttcagatgtactacaagccgcaggatgtccctgccaaggcaagatctacttccctaaacgatcatttgggacaagttgaatatatcttttccgataaaacaggtaccctgacacaaaatatcctgaccttcaataaatgctgtataagtgggagagtctacggacccgactcagaagctaccacccggccaaaggagaatccttatttatggaacaagttcgccgacgggaagttactgtttcacaatgcagctctgcttcatctggtgaggacgaatggggatgaggcggttcgtgagttttggcgtctgctcgctatttgtcacactgttatggtgagggagtctcctcgggaaaggcccgatcagctcctttatcaggccgcctctcctgatgaaggcgctctcgtcaccgctgccaggaacttcggatacgtgttcctgagtaggacacaggataccgtgaccataatggaattaggagaagagcgagtgtaccaggttctagccataatggacttcaactccactaggaaacgtatgagtgtgctagttcgcaaaccagagggcgccatatgcttgtacaccaagggcgccgacacagtgattttcgaaaggctgcaccgccgaggagccatggagttcgccaccgaggaggccctagccgcctttgcacaagaaacactgcgaactttgtgcctggcataccgcgaggtcgcagaagacatatatgaggactggcaacagaggcaccaggaggcctccctcctgttgcaaaatcgggcccaggccctccagcaagtctacaatgagatggaacaggacctcaggttgcttggcgccactgccatcgaagatcggctacaagacggcgtgcctgagacaattaagtgtcttaaaaagtcaaacatcaagatttgggtgctcactggggacaagcaggaaaccgccgtgaacatcgggttcgcatgtgaacttctgtctgaaaatatgctgattttggaggagaaagaaatatcacgcatcctggagacatactgggagaacagcaacaacctgctaactcgcgagagcctttcccaggtcaaactggctctagtcattaacggggattttctcgataaacttttagtctcgttaaggaaagagcccagagctttagcccagaacgtcaacatggatgaggcttggcaagaactgggccagtcacgccgtgacttcttatacgcaaggaggctgagtctgctatgtagaaggtttggactgccactggcggcgccacctgctcaggatagccgcgcccgccgctccagcgaagtgcttcaagaacgcgcgtttgtagatctggccagtaagtgtcaggcggtgatatgttgccgcgtgacgccaaagcagaaagctctcattgtggctctcgtcaaaaaataccaccaggtcgtgaccctagctattggcgacggggccaacgacatcaatatgatcaaaactgcagacgtgggagttggtctcgccggccaagagggcatgcaagcagtccagaatagcgatttcgtgctgggacagttctgcttcctccaaaggctcttgctggtgcacgggcgctggagctacgtccggatctgtaaattcctgcggtattttttctacaaatccatggcctcaatgatggttcaggtgtggtttgcttgttacaatggtttcacaggacagcctctttatgaggggtggtttctggccctgtttaacctcttgtatagcactctacctgtcctgtacatcggtctgttcgaacaagacgtgtccgccgagcagagccttgaaaagcccgagctctatgttgttggtcaaaaggacgagcttttcaactactgggtgtttgttcaggctatcgcacatggtgtgacaacctctcttgttaactttttcatgaccctgtggatttctagggacactgcaggcccagcaagtttcagcgatcaccagagctttgccgtcgttgtagccctgtcgtgtttgctaagtatcacaatggaagtaatccttataatcaaatactggactgctctgtgcgtcgcgactattttgctgtctttaggattttacgccatcatgaccaccaccacgcaatctttctggctatttcgagtgtcaccaacaacttttccctttctctacgctgatcttagtgtgatgtctagtccatctatcctcttagtagtgctgttgtcagtctcaatcaatacgtttcccgtccttgcattacgggtgatatttcctgctctgaaagagctgagagccaaagaggagaaggttgaagagggtccctctgaagagatcttcacaatggagcccctgcctcacgtgcatcgcgagagccgcgctagaaggagtagctatgcattctcccaccgggagggctacgctaatctgatcactcaggggacaatcctgagacgtggtccaggcgtgtcctcagacatcgccagtgaatctctggatccatctgatgaggaggccgctagctccccgaaggaatctcagtag

SEQ ID NO: 108959 - DNA, 3006 bp, Artificial Sequence
  Description of Artificial Sequence: Synthetic coding sequence
atggaggcggctcatgctaagaccactgaagagtgtctagcctattttggcgtcagcgagactactggtctgacaccggaccaggtaaagagaaacttagagaaatacggattgaacgagctccccgcagaggagggtaagacactgtgggaactggtgatcgagcaattcgaggatttgcttgtgcggatactgctgctggccgcatgtatctccttcgtgctggcatggttcgaggagggggaggaaacgatcaccgcgtttgtcgagcctttcgtgatcctgcttatcttgattgccaacgcaatcgtgggcgtatggcaggagcgcaatgcggagaacgctattgaagcgctgaaggagtacgaaccagagatgggaaaggtgtatcgagcagaccgaaaatccgttcagcgcatcaaagctcgcgatattgttccgggcgatatcgttgaagttgccgtcggggataaggtccccgccgacatacgaatcctggctatcaagtccaccacactgcgagtcgaccagtcaattcttaccggcgagtccgtgagtgttattaaacacaccgaaccagtgcccgatccgagagctgtgaatcaagataagaaaaacatgctgttttcaggcactaatattgccgccgggaaagccctggggatcgtcgccaccacgggtgtgggcacagaaattgggaaaattcgcgatcaaatggccgccactgagcaggataaaaccccccttcagcaaaagctggacgagtttggggagcagctatctaaggtcatttctctcatctgcgtggccgtttggctgatcaatattgggcacttcaatgaccctgtgcacggggggagttggttccgaggggctatttactactttaagattgcagttgctctggcagtggccgcgatccctgaagggctgcctgctgttataactacatgcttggcattgggtacgcgaaggatggccaagaagaacgctatagtcagatctctgcccagtgtagagacattgggttgcaccagcgttatttgtagtgacaaaacaggtacgctgaccacaaaccaaatgtccgtttgtaaaatgttcatcatcgacaaagtggacggagacatatgtctgctgaatgaattttccatcactgggagcacatatgctccagagggtgaagtgctcaaaaacgacaaaccagtgagacctggacagtacgacgggctagtcgagctggcaacaatctgcgctctttgtaacgattcctcacttgatttcaatgaggcgaagggtgtttacgagaaagtcggagaagccacagaaacggcattaaccaccctggttgagaagatgaacgtcttcaataccgacgtgaggagtctgagtaaggttgaaagggccaacgcctgtaatagtgtgatccgacaactcatgaaaaaggagttcaccctggaattctctcgggatagaaaatccatgagcgtctactgttctcccgcgaagtcaagtcgcgccgccgtgggcaacaagatgttcgtcaaaggggcacctgagggtgtgatcgatagatgtaactacgtgcgggtcggaactacgcgagtacctctgacaggaccagtgaaggaaaaaatcatggctgtgatcaaagaatgggggacaggccgcgatactttgagatgtctggccctggcaactagagacactcctcctaagcgggaagagatggtgctcgacgattcagcacggtttcttgagtacgagacagatcttacgttcgtgggcgttgtaggcatgttggatccacccaggaaagaagttaccgggtccattcaactgtgtagagacgcaggcatcagagtcatcatgatcactggagataataaggggacagcgattgccatctgcaggcggattgggatcttcggagagaatgaggaagtcgccgaccgggcctacactggcagagaatttgacgacttaccacttgcggaacagagggaggcctgcaggagagcctgctgctttgccagagtcgaaccctcgcataaatcgaaaatcgtggagtatctgcaaagttatgatgagataacagccatgaccggcgatggcgtcaatgacgcccccgccttgaagaaagccgagatcgggatagctatgggttccggaaccgctgttgctaaaacggcgagtgaaatggtactcgccgacgataacttctctaccatcgtagccgcggtcgaggagggtcgggcaatctataacaatatgaaacagttcattcgctacctgatttcgtccaatgtcggggaagtagtttgcatattcctgactgcagcccttggtctcccggaggcactgatccccgtgcagcttttgtgggtaaacttggtaacggatgggctgcccgccaccgctctgggctttaaccctcctgatctggacatcatggatcgacccccacgcagtcccaaggaacctctcatttctggttggctgttctttaggtatatggccataggtggatatgtgggcgccgcaactgtgggggccgccgcctggtggtttctttacgctgaggacgggcctcatgtgaactacagccagctgacacattttatgcagtgcaccgaagacaatacccattttgaggggatcgattgtgaagtgtttgaggcgcctgaacctatgactatggcgctctccgtcctggtgacaatcgagatgtgtaacgccctgaactctctctctgaaaatcagtctctgctccggatgccaccctgggtgaatatttggttattgggcagtatttgcctgagcatgtccctgcactttctcatcctttacgttgatcccctgcccatgatcttcaagctcagagccctcgatctgactcagtggctcatggtacttaagattagcctgccagtgataggattagatgaaattttgaaattcgtggcacggaattacttagaggaccctgaagatgagagaaggaaatag

SEQ ID NO: 108960 - DNA, 2535 bp, Artificial Sequence
  Description of Artificial Sequence: Synthetic coding sequence
aaacggcgcaatcccgggcggcaggcagtaggtcacaccgaggaggatccaccgagagttggtacaccctggaaagaacataccggcccaggcccacaagaaggtagcactatggaagcagctcatgcaaagaccaccgaggagtgcctagcgtactttggcgtgagcgagactaccgggctaacaccagaccaggtgaaacggaatctggagaagtatgggttgaatgaactccctgcagaggaaggcaagactttatgggaactcgtgattgagcagttcgaggacctgttagtaagaatcctgctgctcgcagcttgcatttcctttgtcctagcgtggtttgaggagggggaggagaccatcacagcattcgtagagcccttcgttattctgctcatacttatcgcaaacgctatcgtcggtgtgtggcaggaacgtaatgccgaaaacgcaattgaagcactgaaggagtatgaaccagagatgggcaaggtatatagggctgatcggaagtccgtgcagcggatcaaagccagagacatcgtcccaggtgatatcgttgaagtcgccgtgggagataaagtccccgctgatatccgcatccttgccattaagtccaccacactgagagtggaccagtcaattctaaccggggagtctgtgtcagtgattaagcacaccgaaccggtgcctgacccaagagctgttaaccaggacaaaaagaacatgcttttctcggggactaatattgccgctggaaaggccctgggaatcgtcgccactactggagttggcaccgagatcggtaaaatccgcgatcaaatggcggccacagagcaggataagacacccctgcagcagaaactggatgaatttggtgaacaactcagtaaggttatctctttgatttgcgtcgcagtctggctgatcaatatcggccactttaatgaccccgtacacggagggtcctggttcaggggcgctatttattatttcaagattgccgtggctttggccgtagctgccatcccagagggcctccccgctgtcattacgacttgcttagctcttggaacacggcggatggccaagaagaatgcgattgtgcgaagcctgccaagcgtcgaaaccctggggtgtacgagcgtgatttgttccgacaaaactgggacactcactacaaatcaaatgagcgtgtgcaaaatgttcatcatcgataaggtggatggtgatatctgtctattaaacgaattcagtattacggggagcacatatgccccagagggagaggtactgaagaatgacaagccagtacggcctggacagtacgacggcctggtggaactcgctacaatctgcgcactgtgtaatgattcttcactggacttcaacgaagctaagggcgtgtatgagaaggtgggagaagccactgagaccgccctaactactctggttgagaaaatgaatgtttttaacaccgacgttaggtccttgtctaaggtggaaagggccaatgcatgcaacagtgtgattcgccagctaatgaaaaaggagtttactctcgagtttagccgtgacagaaagagtatgtcagtctactgctcaccagccaaaagctctagggccgccgtgggtaataaaatgttcgtcaagggcgcacccgagggggtgatagacagatgcaactatgtccgagtcggcactacacgtgttccgctcactgggccggtcaaggagaagatcatggcagttataaaggaatggggcactgggagagacacccttaggtgtctggccctggcaactcgcgataccccgcctaagcgagaggagatggtcctagatgactcagcacgtttcctcgagtatgagaccgatctgactttcgtcggggtggtcgggatgctcgaccccccacgcaaagaggtgacaggctccatccagctgtgccgggatgctggcataagggtgataatgatcacaggcgacaacaaaggcacagctattgccatctgtcgtcgcatcggcatatttggcgaaaacgaggaagtcgcagatcgagcctatactgggcgtgaattcgatgaccttccccttgcagaacagcgcgaagcatgccgtcgggcttgctgtttcgcccgagtggaaccttctcacaagtcaaagatcgtggagtatctccaatcttacgatgaaatcaccgccatgaccggcgatggtgtcaacgacgccccagcgctgaagaaggcagaaatcgggatcgctatggggtctggtacagcagtggcgaagaccgcatccgagatggtgctcgctgatgataatttctctaccatcgttgctgctgtggaagaggggcgagctatttacaacaatatgaaacagtttattcgttacctgatctcatctaatgtgggagaggttgtttgcatttttctgacagctgccctgggcttgcctgaggccttaatccctgtgcagctgttgtgggtaaatctggttacggactgtgccgaactgttaatctattag

SEQ ID NO: 108961 - DNA, 2985 bp, Artificial Sequence
  Description of Artificial Sequence: Synthetic coding sequence
atggaggccgcccacgccaagacaaccgaggaatgtcttgcatattttggcgtgtccgaaacaacgggacttaccccagaccaggtcaagagaaatctggagaagtatgggctgaatgaacttccagcagaggaggggaaaactttgtgggagctcgtgatcgaacaattcgaggatctgctggttcgcatcctcctgctcgcagcctgtatatctttcgtgctggcctggtttgaagagggtgaggagactattaccgctttcgtagagccttttgtgattcttttgatcctaattgcaaatgctattgtgggggtctggcaggaacgcaatgctgaaaacgcgattgaagccctgaaagagtacgaaccggagatgggaaaggtgtatagggcagacagaaaatccgtgcagcgcataaaggcaagagatatcgtcccaggtgacattgttgaggtggctgttggggataaagtgcccgccgacatccgaatacttgcgatcaaatcgaccaccctgagagtggaccagagtatcctgacgggtgaatctgtcagtgtgattaaacacacagaacccgtgcccgaccctcgggccgtcaaccaggacaagaagaacatgctgttcagtgggaccaatatcgctgcaggtaaggcccttggcatagtggccaccactggcgtcgggacagagatcggcaagattagggatcaaatggcagctactgagcaggataagacaccactgcagcaaaagctcgatgaatttggagagcaactatccaaggtgatttcactcatatgcgtggctgtctggctcatcaacatcggtcactttaatgacccggttcatggaggcagctggtttaggggtgccatttactatttcaaaattgctgttgccttagccgttgcagctataccagaggggctgcctgcagtcataacgacctgcctggctttgggcaccaggcggatggctaaaaaaaacgccattgtaagatcactgccgtctgtggagacgctgggctgcacaagtgtgatatgctcagacaaaactgggaccttaacgaccaaccaaatgtccgtgtgcaaaatgttcatcattgacaaagtagacggggatatctgtctgttgaacgagttctctatcactggtagtacctatgcccccgaaggtgaggttcttaaaaatgacaaaccagtgcgcccaggacagtatgacggcctagtggaactggcaacaatctgtgcattgtgtaatgatagcagccttgatttcaatgaggctaagggcgtttatgagaaggtgggcgaagcgacagaaacagcattgacaacacttgtggaaaagatgaacgtgttcaacaccgatgtcagatctctgagtaaagtggagagagcgaatgcttgtaattccgtgatacgccaactgatgaagaaagagtttaccctcgaattttcgagggaccgtaagagcatgtccgtttattgcagcccggcaaagagtagtcgtgctgccgtggggaacaaaatgttcgtcaagggagccccggaaggtgtcattgacagatgcaattatgtaagagtcggcaccacccgcgtgccactgacagggccggtgaaagagaagattatggctgtgatcaaggagtggggtaccggccgcgacaccctgagatgtctggcactggcaacccgggacacaccacccaagcgggaagaaatggttctcgatgactctgctaggtttttagaatatgagactgaccttacattcgtgggggtagttggaatgttagatccaccaagaaaagaggttacagggtccattcagctgtgtagagatgctggtatcagggtgataatgattactggggataataagggcaccgctatcgccatctgtcgaaggatcggcatatttggtgagaatgaggaagttgccgatagagcctacaccggtagagaattcgatgacctccccctcgctgagcagcgggaagcttgccgtcgggcttgctgtttcgccagggtggagccctcacacaaatccaagattgtggaatacctacagtcttacgacgaaattacagctatgacgggcgacggtgttaacgacgctccggccttgaagaaagcagagattggtattgcaatggggtccggcacagcagtggcaaaaaccgcctctgagatggtgcttgcggatgacaactttagcaccatcgtggccgccgtagaagaggggcgggcaatctacaacaacatgaagcagttcataaggtatctgatctcctctaacgtgggggaagttgtgtgtatctttctgaccgcagccttaggactgccagaggcactaattcctgtgcaattgctctgggtgaacctcgtgacagacgggcttccagccaccgcattgggcttcaatcctcccgatctggatatcatggatcgaccacccaggtctccgaaggagcccctgatcagtggatggttatttttccggtatatggccataggcggatatgtgggagcagcaacagtaggagccgcggcctggtggtttctgtacgccgaagatggcccccacgtaaattactcacaattaacacactttatgcagtgtactgaagataacacccatttcgaaggtatagactgtgaggtgttcgaggctcccgaaccaatgacaatggcgttaagcgtccttgtcacgatcgagatgtgcaatgccttaaactcactttctgaaaaccagtccctcctccggatgccaccttgggtgaacatttggctcttgggcagtatttgtctgtctatgtcgctgcacttcctgattctttacgtagatccgctgccgatgatttttaagctaagagcacttgatctgactcagtggctcatggttcttaaaatttcattgccggtaataggcttagatgaaattctaaagttcgtggcacgcaattatcttgagggctag

SEQ ID NO: 108962 - DNA, 2610 bp, Artificial Sequence
  Description of Artificial Sequence: Synthetic coding sequence
atgggaaaagtttatcgcgcggaccggaaatctgtgcaacgcatcaaggctagagatatagtgcctggggatattgttgaggtagccgtgggcgataaagtccctgcagatatccgcatcttggctatcaagtccactacacttagagtcgatcagtcaatattgacaggagaatccgtaagcgtgatcaagcatacagagcctgtccctgacccgcgggcagtgaaccaggataaaaaaaatatgctcttcagcggaacaaacatcgctgccggaaaggctttaggcatagtggcaactaccggggtgggcacagagatcggcaagatccgggaccaaatggctgccacggaacaggataaaacccctctccagcaaaaactggatgagttcggtgagcagttaagcaaggtcatttctttaatctgtgtggcagtgtggctgatcaatatcggacacttcaacgatcccgtacacggtggcagctggtttcgcggtgctatctattattttaagatcgctgttgcactggccgtggcagccattcccgagggtttacccgccgtcatcaccacctgcctggctcttgggacacgccgaatggccaagaaaaacgctattgttaggtctctaccctccgtggaaactctgggctgcacttccgttatatgcagcgataagactgggactctgaccacaaatcaaatgtcagtgtgcaaaatgttcataattgataaggtcgacggggatatatgtctcctcaatgaattcagcatcactgggagcacctacgcgccggagggtgaggttctgaagaacgataaacccgttcgtcccggtcagtacgatggcctggttgagctcgcaactatttgcgcactctgtaatgactccagcctagacttcaacgaagcaaagggggtgtatgagaaagttggcgaggccaccgaaactgctctgaccacattggtcgagaagatgaacgtttttaataccgacgtacgttcactaagcaaagtcgaacgggccaacgcctgtaactcagtcattcgccaacttatgaaaaaagaatttaccttggagttctctagagataggaagtctatgtcagtgtactgttccccagccaaatcatcacgagcagcggtgggtaataaaatgtttgtaaagggcgccccagagggcgtgattgatcgttgtaactatgtgagggttggcacgactcgagtgcctctgactggtcctgtgaaggaaaagatcatggccgtcattaaagagtgggggacgggaagagatacacttcgatgtctcgcattggctactcgcgacacccctccaaagcgagaggagatggtcttagacgattccgctcgatttttggagtatgagactgacctgacttttgtcggagtcgtgggaatgctagaccccccacgcaaagaggtcacgggaagcatacagctctgtcgggacgcaggaattcgagtcattatgatcacaggagataacaaaggaaccgcgatcgctatctgccggcggattggaatcttcggcgagaatgaagaggtggccgatagggcatatactgggcgcgagtttgatgacctccccctcgccgagcagcgcgaggcatgtcgaagggcgtgttgcttcgcgcgcgtcgaaccaagtcataagagcaagatcgtggagtatctccaatcctatgatgagataaccgccatgaccggcgatggcgtaaatgatgcccccgctcttaagaaagcagaaatcgggattgccatggggagtggaactgcagtggccaaaacggccagcgaaatggttttagctgatgacaatttctcaacaattgtcgccgccgttgaggagggtagagctatttacaacaacatgaaacaattcattcgttacttgataagcagtaacgtcggagaggtggtctgtatatttctaactgctgctctggggctgcccgaagcattaattccagtacagctgctgtgggtgaatctggtgaccgatgggctgccagcaacagccttagggttcaacccccccgatctcgatataatggacagaccccctcgaagccctaaggagcccctaattagcggatggctcttttttcggtacatggcaattggcggctacgtcggcgccgcaactgttggtgcagcagcctggtggtttctgtatgctgaggacggcccacatgttaattattcccagctcacccatttcatgcagtgtacagaggataatacccactttgagggcatagattgcgaagtgtttgaagccccggaacctatgaccatggccctctccgttctcgtcactattgaaatgtgtaacgccctcaattctctgtcagagaaccagagcctacttagaatgccgccctgggtaaatatttggctgctaggatctatctgtctgtctatgtcactgcactttctgattctgtacgtggatccgctccccatgattttcaaactccgcgccctcgacttgacccagtggctgatggtgctgaaaatttcactgcctgtgatcggactggacgagattttaaagttcgttgccaggaactatctggagggctag

SEQ ID NO: 108963 - DNA, 2994 bp, Artificial Sequence
  Description of Artificial Sequence: Synthetic coding sequence
atggaaaatgcacacaccaagaccgtcgaagaggtgcttggacattttggggtcaatgaatccactgggttgtccctggagcaggttaaaaaattaaaagagcgatggggtagtaatgaactgcctgcagaggaagggaagacacttctggaactcgtaatcgagcaatttgaagatctgctggtgcgcattctgttgctcgccgcctgtatctcctttgtgctggcgtggtttgaggagggcgaggagacaatcaccgcctttgttgagccttttgtaattctgctgattctggttgcaaacgccatcgtgggcgtgtggcaggagcgcaatgccgagaatgccattgaagccctgaaggagtacgaacctgaaatgggcaaggtgtacaggcaggaccgcaaaagtgtccagagaattaaagcgaaggatatagtgccgggtgacattgtagagatcgccgtgggagacaaggtgccagctgacatccgcctgacaagcatcaaatctaccacccttagagtcgatcagtccatactgaccggcgaatccgtcagtgtcattaaacatactgaccctgtccctgatccgcgggccgtgaaccaggataaaaagaatatgttgttttctgggacaaacattgcagcaggcaaggctatgggggtggttgttgcaaccggggtgaacaccgagattggtaagattcgggatgagatggtcgccaccgagcaggagcggacaccgctgcagcagaagctcgacgagtttggtgagcagctctctaaagttattagcctaatttgtatcgctgtatggatcattaatataggtcactttaacgatcccgtccatggcggtagttggatacggggtgcaatatactacttcaagatcgcagtcgcccttgctgtggcagcaattccggaaggcttgcctgcagtgatcactacttgtctggcactgggaacccgaagaatggctaagaagaacgcgatagtgaggagtttacctagcgtcgagactttggggtgtactagcgtgatctgtagtgataagacaggcaccctgacgaccaaccaaatgtctgtatgcagaatgtttatcctggatagagtcgaaggcgacacatgtagcctcaatgaatttaccatcaccggcagtacctacgctccaattggagaggtgcataaagatgacaagcccgtcaattgccaccaatacgatgggctggtagaactggccacaatctgcgcattatgtaatgattcggccctagactacaacgaggccaaaggtgtgtacgaaaaagttggagaagctaccgagacagctctgacctgcctggttgaaaagatgaatgttttcgataccgaattgaagggtctgtccaaaatagagcgcgcgaacgcttgcaactccgtaattaagcagctcatgaagaaagaattcacattagagttttctcgggaccgcaaaagtatgtctgtttactgtacgcccaataaacccagccgcacatctatgtcaaagatgttcgttaagggtgccccagaaggcgttattgaccggtgcacacacatcagggtgggatccaccaaggtgccaatgaccagcggggttaaacagaagattatgtcggtaataagggagtgggggagcggaagcgacaccctgcggtgcctggccctagccacccatgacaatccactccgcagggaggagatgcacctggaggactcagctaacttcataaaatacgagactaacctgacgtttgtaggctgcgtgggaatgctcgaccctccacggatcgaggtagcctcatcggtgaagctttgtagacaagccggtatcagggttattatgatcactggagataacaaaggcactgccgtagccatatgtcggcgcattggcatctttgggcaggacgaagatgtgacatcaaaagctttcaccggcagagagtttgacgaattgaacccttcagctcaacgtgatgcgtgcctaaatgccagatgtttcgcacgggtggagccttcccacaaaagcaagattgtagaattcctacagtcctttgacgagattaccgcaatgacaggagacggggtgaatgacgcgcctgccctaaagaaggctgagatagggatcgccatgggctcgggcactgcggtggcaaaaaccgcatctgaaatggtgctggccgacgataacttctctaccatagtagctgcagtagaggagggaagggcaatatataacaatatgaaacaatttatccggtacctgatttccagtaatgtgggcgaggtggtatgcatattccttactgctgccctcggcttccctgaggctctcatccccgtgcagttgctttgggtcaacctagtaacagacgggctgccagctaccgccctggggttcaatccaccggacctggatatcatgaataagccccctcggaatcctaaggagcctttgataagtggatggctgttctttcgttatctggcaatcggttgttacgtgggagctgccaccgtgggcgcagctgcatggtggtttatcgccgctgacggagggcctagagtctctttctaccaactgagccactttttacagtgcaaggaagacaacccagattttgaaggggtcgattgcgctatctttgagtctccgtaccccatgacaatggccctttccgtgctagtgaccatcgagatgtgtaatgccctaaactccctgtccgaaaaccagagcctgctgaggatgcctccctgggagaacatttggttagtgggcagtatatgcctttccatgagtctgcattttctgatcctttatgtggaacccctgccgctgattttccagatcaccccattaaacgtcacacaatggctgatggtgcttaaaatcagtctgccggtgattctgatggacgaaacattgaagttcgtcgcacgcaactacctggaacccgccatactggaatag

SEQ ID NO: 108964 - DNA, 3048 bp, Artificial Sequence
  Description of Artificial Sequence: Synthetic coding sequence
atggagaatgcccacaccaagacagtagaagaggttctggggcacttcggtgtgaacgagtctactgggctctcactggaacaggtcaagaagctgaaagagcgttggggaagcaacgagctccccgccgaggaaggcaaaactctcttggagctggtgatcgagcagtttgaagacctcctggttcggatccttctccttgctgcctgtatctccttcgttctggcatggtttgaggagggcgaagaaacgataaccgccttcgttgagcctttcgtgatccttctgatactcgtagccaacgctatcgtgggagtgtggcaagaaaggaacgctgagaatgctatcgaagctctcaaggagtacgagcctgagatggggaaggtctaccgccaggacagaaagagcgtgcagaggatcaaggccaaggacatcgtcccgggtgatatcgttgaaatcgccggtgagtcggtgtccgtgataaaacatacagatcccgtacccgacccccgtgccgtcaatcaggacaagaagaacatgctgttctcaggtaccaatatcgccgccggcaaagccatgggggtcgtggttgctaccggcgtgaatacagagatcggaaagatccgggacgagatggtggccactgaacaggagagaaccccacttcagcaaaagctggacgagttcggtgaacagctgagcaaagtaatcagcctgatctgtattgccgtctggatcataaacatcggacacttcaacgaccctgttcatggaggcagctggatccgcggcgccatctactattttaagatcgcagttgcactggctgtagccgccatcccagagggtctgccagccgtgatcactacctgcctggccttgggcactagaagaatggccaaaaaaaatgccatcgtacgatctctaccatccgtggaaaccttagggtgcacatcagtgatctgttccgacaaaacaggcaccttgaccacaaaccagatgtccgtctgccgcatgtttatactggaccgggtagagggcgatacctgctccctgaatgagtttacaataactggttccacctacgcaccgatcggtgaagtccataaggatgacaagccagttaactgccaccagtacgatggcttggtagaactggccactatatgtgctctgtgtaacgactcggctctcgactacaacgaggcgaagggtgtctatgagaaagttggcgaagccacggagaccgccctcacatgtctagttgaaaagatgaatgtgtttgacaccgagttgaagggccttagtaagatagagcgggcaaacgcatgcaattctgtcataaagcagctcatgaaaaaagagttcacactcgaattctctagggatcgcaagagcatgtccgtgtactgcacgcctaacaagccctctcgtaccagcatgtcaaagatgttcgttaagggtgccccagaaggtgtcatcgataggtgcacccacatccgtgtgggatccaccaaagtccccatgacgtccggggtgaagcagaaaatcatgtccgtgatccgggaatggggatccggatccgatacacttaggtgtttagctctcgccacacacgataacccactccgtagggaggagatgcacctcgaagactccgccaattttatcaagtatgaaactaatctgacatttgtggggtgtgttgggatgttggaccccccacgcattgaagtggcctcatcagtgaaactctgtcgacaggcagggattagggtcattatgatcaccggggacaataagggaaccgctgtcgcaatttgtcgcaggattggcatttttggacaagatgaagatgtcacaagcaaggctttcactggccgagagtttgacgagttaaacccaagtgcacagcgagacgcatgcctgaacgcgagatgctttgctcgggtggaaccgtcccataagtccaaaatagtggaatttctccaatctttcgacgaaattactgctatgacaggggacggtgtcaatgatgcccctgccctcaaaaaagctgaaattggcatcgccatgggaagcggtactgcagttgcgaaaacagccagcgaaatggttcttgcagacgataatttttccacgatagtcgcagctgtcgaagaaggccgagccatctataataatatgaagcaattcatccggtacttgatcagtagcaacgtgggcgaggtcgtctgtatctttttgacagcagcactcggcttcccagaagccctgatccctgtccagctgctgtgggttaatttggtgacagatggcctccctgcgacagcactggggtttaaccctcccgacctagatattatgaacaaaccccctaggaatccaaaggagcctctgatctcgggatggctattttttagatacctggccattggctgctacgtgggcgcggcaaccgtgggcgcagcggcgtggtggttcatagccgccgatggggggccaagagtaagcttttatcaactctcacatttccttcagtgcaaagaggataaccccgatttcgaaggggttgattgtgctatctttgagagtccctacccaatgaccatggcactgagcgtcctggttacgatcgagatgtgcaacgcattgaacagtctgagtgagaaccaatccttattgagaatgcctccatgggagaatatctggttagtggggtcaatctgtttgagtatgtccctgcacttcctcatcctgtacgtcgagcctttgcccctcatattccaaattacgccgctgaatgtgacacagtggcttatggtgctgaaaataagtttgcccgtgatccttatggatgagaccttgaaattcgtagctcgcaactatctggaaccaggtaaggagtgtgtgcaacccgctaccaagtcctgcagttttagcgcctgtaccgatggtatttcctggcctttcgtcttgctgatcatgcccctggtcatctgggtgtactcgactgacacaaattttagcgacatgttttggtcttag

SEQ ID NO: 108965 - DNA, 3129 bp, Artificial Sequence
  Description of Artificial Sequence: Synthetic coding sequence
atggaaaacgcacatacaaaaacagtggaggaggttctcggtcacttcggagtcaatgaatctactggcctgagcctggaacaagtcaagaaattgaaggagaggtggggctctaacgagttaccagcggaagaagggaaaaccctactggagctcgttattgagcagttcgaggacctgcttgtgcggatcctgttactggccgcttgtatttcttttgtgcttgcatggttcgaggaaggcgaggaaaccatcacagccttcgtcgagccatttgtgattctgctgatcctcgtggccaacgccatcgtcggcgtatggcaagaaaggaatgctgagaacgccattgaagccctgaaggagtacgaacctgagatgggaaaggtataccgccaggatagaaagtccgtacaaagaatcaaggccaaggatatcgtaccgggcgatatagtcgagatcgccgtaggcgacaaggtgccagccgatatcagacttactagtataaaaagtactactctgcgcgtcgatcagtcgatcttgacaggcgaatcggtgagcgtcatcaaacatacggaccccgtccccgatcccagggccgtgaaccaagacaaaaaaaacatgctatttagcggtactaatatagctgctggcaaagcaatgggcgtcgttgtcgctacaggcgtgaacactgagatcggcaaaattagagatgagatggttgccaccgagcaggaacgaacaccgttgcaacagaaactggatgaatttggcgaacagctgtcaaaggtaatcagcctaatctgtattgccgtgtggataattaacataggtcacttcaacgaccccgttcatggaggcagctggatcaggggcgccatctattatttcaaaattgccgtcgccctggcagtagctgcaatcccagagggccttccagcggtcattacaacatgcctggctctgggcaccagaagaatggccaagaagaatgccatcgttcgctccttacctagcgtagagaccctgggctgcacctctgtgatctgcagcgacaagactggaactctgacgaccaatcaaatgtctgtttgtagaatgtttatattagatcgggtcgaaggcgatacttgctctctgaacgagtttaccattactggatccacttatgcccccatcggcgaggtgcataaggacgataaaccagtgaactgtcatcagtacgatggcctggtggaacttgccacaatctgcgccctttgcaacgacagcgccctcgattacaacgaagcgaagggcgtgtacgaaaaagtcggcgaggcaacagaaaccgccttaacttgtctggtggaaaagatgaacgtgttcgatactgaattgaagggactcagcaagatagagagggccaatgcatgcaacagcgtcattaaacagctgatgaagaaggaatttacactggaattctcacgggatagaaagtctatgagtgtgtactgcacacctaataaaccttcgcgtacttcaatgagtaagatgttcgtgaagggcgcgcctgagggtgtgatcgatcgctgtactcatatccgggttggatccacaaaggtgcctatgacttccggcgtcaagcaaaagattatgtctgttatccgggagtggggcagcgggtcggataccctcagatgtctagcattggccacacatgacaatccactccggcgggaggagatgcacctggaggatagcgcaaactttatcaagtacgaaactaacctgactttcgttggctgtgtgggaatgctggacccccctagaattgaggttgcttcgtctgtgaagctgtgtagacaggctggtattagagtcatcatgataacgggtgacaacaaagggactgctgttgctatctgcagacgtattgggatctttgggcaggacgaagatgtcacaagtaaggcctttaccggtcgggaatttgacgagctgaaccccagcgctcagagggatgcctgcctcaatgctcggtgctttgctagagtggaaccctctcacaagtctaagattgtcgagttcctccagagtttcgatgagattaccgccatgaccggggacggggtgaatgacgcgccagcgcttaaaaaggcagaaatcggaatcgctatgggttctgggaccgctgtggccaagaccgcatctgagatggttcttgccgatgacaacttttccacgatcgtagcggcagttgaggagggcagagcgatctacaataatatgaagcagttcatccgatatctgatctcttctaatgtgggggaggtagtgtgcatcttcctaactgctgcactcggcttccctgaggcactgatcccagttcaactcctgtgggtgaatctcgtcactgatggcctgcccgcaacagcattgggctttaatcccccggacctcgatataatgaataagcccccgcgtaatcccaaggaacctttaatcagtggatggctcttttttcgatacctcgccataggctgctacgtgggagcagcgaccgtgggtgcagctgcttggtggttcatagcggcggatggtgggcctcgggtttctttttatcagctgtcacacttccttcagtgtaaagaagataaccctgacttcgagggggtggattgcgctattttcgaaagcccgtaccctatgaccatggcactaagcgttctggtgactatcgagatgtgcaacgctcttaattccctgtctgaaaatcaatcgctcctcaggatgccaccatgggagaacatctggcttgttggatccatatgcctgtctatgagcctccatttccttatcctgtacgtggaacctttaccactcatattccaaattaccccacttaacgtgacacagtggctgatggtgctaaagattagcctccccgttattcttatggacgagactctgaagttcgtggctcgcaactacctagaaccaggaaaggaatgcgttcagcctgccaccaaatcctgcagttttagtgcctgtactgacggtatatcttggccctttgtcctgctgatcatgcctctggtaatttgggtgtattccactgacaccaattttagcgatatgttttggtcctag

SEQ ID NO: 108966 - DNA, 2802 bp, Artificial Sequence
  Description of Artificial Sequence: Synthetic coding sequence
tagacaatcactgcatttgtggaaccgtttgttatcttgctgatcttagttgcaaatgcaatagtgggtgtgtggcaggagcggaatgctgagaatgctattgaggcgttgaaggagtacgaacctgagatgggcaaagtgtacaggcaagatcgaaaatccgtccaacggatcaaggctaaggacattgtccccggcgacatcgtggagatcgccggtgagagtgtgtcagtgatcaaacacacagatcccgtccccgacccgcgcgccgtgaaccaggataagaaaaatatgctgtttagcgggacaaatattgccgctgggaaggccatgggcgttgtggtcgccaccggagtaaataccgaaatcggcaaaatcagagacgagatggtggctaccgagcaggagcgcacacctctccagcagaagctcgatgagttcggagaacagctttctaaggtgatctcactgatctgcatcgccgtctggataatcaatattggccatttcaatgatcccgtgcacggcggttcttggatcaggggtgctatctactacttcaaaatcgcggtggccctggccgtggccgcaattcccgagggactcccggctgtcattactacttgccttgccctgggcactcggagaatggccaagaagaatgccattgtacggtcactcccttctgtggaaaccctagggtgtacctctgtgatatgttctgacaaaaccgggaccctaacaactaatcagatgtcagtgtgtcggatgttcatcctggaccgagtggaaggagacacatgcagtctgaatgagttcaccattactgggagcacatacgcacccatcggcgaagtgcacaaggacgataaacctgtcaattgtcatcagtacgatgggctcgttgagctcgccacgatctgcgccctctgcaacgattccgctctggattacaatgaggcaaaaggcgtatacgagaaggtgggagaggccacagagaccgcactgacttgcctggtggagaaaatgaacgtgtttgacaccgagctgaagggcctgagtaaaattgaacgcgctaacgcatgcaacagtgtaatcaagcaactgatgaagaaagagttcactctggaatttagtagagatcgaaaatccatgtcggtttattgtactcccaacaaaccctctcgcacttccatgtccaaaatgttcgttaagggtgcccctgagggggttatcgatcggtgtactcatatccgcgtgggctcaaccaaagttcctatgacgtctggcgtcaagcagaaaattatgagtgtcatcagagaatgggggtctgggagtgacaccttaagatgcttggccctggcgacccatgacaaccccctgcggcgagaggaaatgcacctcgaggactctgctaacttcataaaatacgagactaacctcacttttgttggatgcgtgggcatgctcgaccccccacgaatcgaggttgcatcttccgtaaagttatgtaggcaagctggcatcagggttatcatgattactggagataacaagggaaccgccgttgccatctgtcgccgcatcggcatctttgggcaggacgaggacgtcaccagcaaggcttttacaggacgcgagttcgacgaactcaacccctctgcgcaaagagatgcatgtctgaacgcgcggtgcttcgctagggttgagccctcacataagagtaagatcgtcgaattccttcagagcttcgacgagatcacagcgatgacgggagatggcgtcaatgacgcccctgctttaaaaaaggctgagattgggatcgccatgggaagcggcaccgccgtggccaagactgcctctgagatggtgctcgccgacgataatttctccacaattgtcgcagcggtggaggaaggtagggctatttacaacaacatgaagcagtttatccgctatttaattagctccaacgtcggagaagtggtctgcatctttttgactgcagccctgggctttcctgaggctctcattcctgtccagctgctttgggtgaacttagtgactgacggattgccggcaactgctctcgggtttaatcctccagacctggacatcatgaataagccgccccgcaaccccaaagaacccttgatcagtggttggctcttcttcaggtacctggctatcggatgctatgtgggagccgctaccgtgggagcagcggcctggtggttcattgccgctgacggaggccctagagtatccttttaccaactttctcacttcttacagtgcaaagaggacaatcccgactttgaaggtgtagattgcgccattttcgagtcgccatacccaatgaccatggccctcagcgtgctggtaacaatagagatgtgtaatgcgctcaattctctttcagagaaccagtctctattacgaatgcctccctgggagaatatctggctggtggggagtatctgcctgtcgatgtccttgcattttttgatcttatatgttgaacccctccccctgatctttcaaataacacccctgaatgtcacacaatggctgatggtgcttaagattagtctacccgtcattctgatggatgaaacattgaaatttgttgcacggaactatttggaaccaggcaaggagtgtgtacagccagccacgaagagctgtagtttttcagcatgcactgatgggatctcttggccatttgttttacttatcatgcccttggtcatttgggtatactctaccgatacgaactttagtgatatgttctggtcctag

SEQ ID NO: 108967 - DNA, 3663 bp, Artificial Sequence
  Description of Artificial Sequence: Synthetic coding sequence
atgggggacatggccaacaattccgtggcttattccggcgttaagaacagcctgaaggaagctaaccacgacggcgattttgggatcacccttgcagagctacgggccctgatggagctgaggagcacagatgccctgcgcaagatacaggagagctatggggacgtatacggaatctgcaccaagctcaagacctcgccaaatgaaggcctctctggaaacccagccgaccttgagagacgcgaagccgtgtttggcaagaacttcattccccctaaaaagccgaagacctttctacaactcgtctgggaagccctgcaagatgtcaccctgattatcctcgaaattgccgctatcgtgtccctgggtcttagcttttaccagccgcccgagggggataatgctttatgtggggaagtgagcgtgggcgaagaagagggcgagggggagacaggatggattgagggggctgcaatcctgctctccgtcgtctgcgtggtcctggtgacagccttcaatgattggtctaaggagaaacagtttcgtggactgcagtctcggattgagcaagaacagaagttcacggtcatcaggggcggccaagtcattcagattcccgtcgcagacattacggtcggggacatcgcacaggttaaatacggggacctgctaccagccgatggaatcctgattcagggcaacgacctgaagatcgacgagtcgtccctgacaggcgaatcggatcacgtgaagaaatctctcgacaaggacccactgttgctgtccggaacccacgtcatggagggatccgggcgcatggtagtgactgctgtgggtgttaacagccagacaggcattattttcaccctactcggagcggggggtgaagaagaggagaaaaaggatgagaagaaaaaggagaagaaaaacaagaagcaggatggcgccatcgaaaaccggaataaagctaaagcccaagacggggcagccatggaaatgcagccgctgaaaagtgaggagggcggggatggagatgaaaaagacaagaaaaaggccaatcttcccaagaaagagaaatccgtcctccagggtaagttaacaaagctggctgtgcagattgggaaggctggcttactcatgtccgccatcaccgtgatcattctggtgctttacttcgtgatcgacacgttttgggtgcagaagaggccttggttggccgaatgcacgccgatatacatacagtattttgttaagttcttcataataggggttacggttttggtggtggccgtaccagagggcttgccccttgcagtgacaattagcctggcttattctgttaagaagatgatgaaggacaataacttagtaagacatctagatgcctgcgagaccatgggtaatgctactgccatctgcagcgacaaaacaggcaccctgactatgaacaggatgaccgtcgtccaagcatatattaacgagaagcattacaagaaagtccccgaacccgaagccatacctccaaatattctgtcttatctcgtgactggaatctccgtgaactgtgcttataccagcaaaattctcccgcctgaaaaagagggagggctccctcgacatgtgggcaacaagaccgaatgcgccctgctcgggctgctgctggatctgaagagagattatcaagacgtgcgcaatgagataccagaagaggccctgtacaaggtctatactttcaattccgtgaggaagagtatgtcaactgtcttgaaaaattcagatggctcctatcgcattttcagcaagggtgcgtctgagatcattctgaagaaatgtttcaaaatactgagcgccaacggggaggccaaggtcttccgcccacgggatagggatgatatagtgaaaacggtcatagaaccaatggcatcagagggccttaggacaatctgcctagccttccgcgacttccctgctggggagcccgaacctgagtgggacaacgagaacgatatcgtgaccggattaacctgtattgctgtggtgggaatcgaagacccagtgcggccagaggtgccagacgccatcaaaaagtgccaaagggcggggataaccgttcgcatggttacaggcgataacataaatactgcacgagccattgctactaaatgcggcatcctgcacccaggtgaggatttcctctgtctcgaaggaaaggatttcaaccgcagaatcagaaatgagaaaggtgagattgaacaggagaggattgacaagatatggccaaaattaagagtgcttgcccgaagttctcctacggacaaacatacattagtgaaaggtattatcgactcgaccgtcagtgaccagcgtcaggttgttgccgttacgggcgatggcacgaatgatggccccgcactgaaaaaagccgacgtcgggtttgctatgggcatagccgggaccgacgtggcaaaggaagcttcagacataattttgacagacgataactttaccagcatcgtcaaagcggtgatgtgggggcggaacgtgtacgattcgatctccaaatttctgcagtttcaactgactgtgaacgtcgtagcggtcatagtagcatttaccggagcctgcattacccaggattcgccactcaaggcagttcagatgttatgggttaatttgatcatggacactttagcgtccctggcgctggcgacggaaccaccaaccgagtctttgctcctgcgcaagccctatggtcggaacaagccactcattagccggaccatgatgaagaacatcctgggacacgcattttaccaactggtcgtcgtgttcacgctcttgttcgcaggagaaaaatttttcgatatcgattcgggccggaacgcacctctacacgccccaccatccgaacactatactatagtatttaacacatttgtgctgatgcagctgttcaatgagattaatgcccgtaaaatacacggcgaacggaacgtctttgaggggatcttcaataatgcaatcttctgtactatcgtcttgggcacgtttgtggttcagatcatcattgtgcagttcggtgggaagccattctcctgttccgaactgagtatagaacagtggctttggagcatctttctcggcatgggcaccctgctctgggggcagctgatttcaactatccctacatcccggctgaagttcctgaaggaagccggacacggcacacaaaaggaggaaatccccgaagaagagcttgccgaggatgttgaggagatcgatcatgccgaacgcgagctgaggcgaggtcagatactttggttccggggcctaaaccggatacaaacccagatccgcgtggttaacgcattccgaagctcactgtatgagggactcgagaagcctgagtcgaggtccagcatccataacttcatgacgcaccctgaatttaggatcgaagatagcgaaccccacattcccctaatcgatgatactgacgcagaggatgatgctcctaccaagagaaattcttccccccctccctcccccaacaaaaacaataacgccgtagactcgggaatacacttgacaatcgagatgaataaatccgccacctcgtctagcccaggatccccattgcactctttggagacgtcattatag

SEQ ID NO: 108968 - DNA, 3555 bp, Artificial Sequence
  Description of Artificial Sequence: Synthetic coding sequence
atgggggacatggcaaacaactccgtggcctatagcggagtaaaaaacagtttgaaggaggcaaaccatgatggcgattttgggatcacgttggcggaactgcgagctctcatggaactcagatccaccgacgcactgcgcaagatccaggaatcatacggagacgtgtatggcatttgcaccaagctcaaaacgtcccctaacgaaggcctgtctgggaaccccgcagacctggaaaggagagaggccgtttttgggaagaattttattccccccaagaaaccaaagactttcttgcagctcgtgtgggaagctctgcaggatgtcactctgataatcctggagatcgcggccatcgtcagcctcggattgagcttttatcagcctcccgaaggcgataatgccctgtgcggtgaagtttcggtaggggaggaggaaggggaaggcgaaaccgggtggatcgaaggagctgccatcttgctgagcgtggtatgtgtggtccttgtgaccgctttcaacgactggtctaaagagaaacagtttcgaggattgcagtccagaattgagcaggaacagaagtttaccgtgataagaggagggcaggttatccagatccccgtggctgatatcacagttggtgacattgcccaggttaaatacggagatcttctcccagcagatggaattcttatccagggaaacgacctgaaaatcgatgaatctagccttacaggggaatccgaccacgtgaagaaatctctggacaaggaccccctccttctgagtggaacacacgtgatggagggtagcggacggatggtggtgactgcggtaggcgttaacagccagactggaataatttttaccctgctgggcgctggcggggaggaggaggagaaaaaggacgagaaaaaaaaggaaaaaaaaaacaaaaagcaagacggcgcaatcgaaaatagaaacaaagctaaggctcaggacggggcagccatggaaatgcagcctctaaaatctgaggaaggtggcgatggtgatgagaaagacaaaaagaaggccaatctccctaagaaagagaaatcagttctgcagggtaaactgaccaagttagccgtccagatcggcaaagcgggtctgctgatgagcgccatcacagtgatcatcctcgttctttatttcgttatcgacacattttgggtccaaaaacggccctggctggccgagtgtaccccaatctacattcagtacttcgtaaaattctttattatcggtgtcactgtgcttgtggtggccgtcccagaggggctccccctcgcggttacaatctcattggcatactctgtgaaaaaaatgatgaaggacaacaatctcgtgcgtcacctcgacgcctgcgaaaccatgggcaacgccactgccatttgctcagacaagacgggcacacttacaatgaacagaatgacggtggtgcaggcatacatcaatgagaagcactataagaaggtgcctgagccagaggctattccacccaacatattgtcgtatcttgttactggaatttctgttaactgcgcatatacatctaaaatcctgcctccggagaaagaaggcgggctccctcgccacgtcggtaataaaacggagtgcgccctgctggggctcttactggatttgaaaagggactatcaggatgtacggaacgaaatccccgaggaagcgctatacaaggtgtatacatttaattcagtgagaaagtcaatgtctacagtgctgaaaaactctgacggaagttatcgcattttcagcaagggggcctctgaaataattctgaagaaatgctttaagattctaagcgccaatggcgaagcaaaggtgttccgaccccgggaccgtgacgatatagtcaagactgttatagaacctatggcctccgaaggtctgaggaccatttgtctggccttccgggactttcccgccggagagccggaaccggagtgggacaatgagaatgacatagttactggcctgacgtgcatcgccgttgtgggcatagaggatccagtgagaccagaagttccggatgcgattaaaaagtgtcagagggcgggcatcacagtgcgaatggtgacaggtgataatattaacactgcacgagccatagcaacgaagtgcgggatccttcaccctggagaggactttctttgtctggagggcaaggatttcaatagaaggatacgcaacgagaaaggggagatcgagcaagagagaatagacaaaatttggccaaagctccgcgtgttggcccggagcagccccactgataagcatacactggtcaagggtattattgacagtacggtgtcagaccagcggcaagtagttgcggtgaccggtgatggcacaaacgatggaccagctctcaagaaagccgatgtggggtttgccatgggcatcgctggcaccgacgtggcaaaagaagcatcggacatcatcctgaccgatgacaacttcaccagtattgtaaaagccgtgatgtgggggcgcaacgtgtatgacagcattagcaagttcctgcagtttcaactgactgttaacgtggtcgcagtaattgtggccttcaccggtgcgtgcatcacccaggattcccctctgaaggctgtacaaatgttatgggtgaacctgatcatggacaccttagccagcttggcgttagccacagagccccccaccgagtcactcctgctgagaaagccatacggcagaaacaagccattaatttcccggaccatgatgaaaaatatcctcggtcatgccttttatcagttggtggttgtgttcacgctactgttcgcaggcgagaagtttttcgatatagacagtggtcgtaatgcacccctacatgcccctcctagtgagcattacacaatcgtatttaatacttttgtgttaatgcagctgttcaatgagattaatgccagaaaaatccatggcgaaagaaatgtattcgagggaatcttcaacaacgcaattttttgcaccattgttctaggaacgtttgtcgtacagctaatcagcactattccaacatccagactgaaattcctcaaagaggccggccacggcacacagaaggaagaaattccagaggaggagctcgcagaagatgtagaagagattgaccacgcagagagggaactgaggagggggcagatactttggtttagaggactgaacaggattcaaactcaaatccgggtggtgaatgcttttcgtagtagcctatatgaggggctggagaaacctgagtccagatcttcgattcataattttatgacgcatccggagtttaggatcgaggatagcgagcctcacatccccctcattgacgatactgacgctgaagatgacgcaccaacaaagcggaattcgtctcccccgccctcgcctaacaagaacaataacgccgtggatagcggcattcacctgaccattgagatgaacaagagcgcgacctcgtcatctccaggaagccctctgcattcccttgagacttctctgtag

SEQ ID NO: 108969 - DNA, 3531 bp, Artificial Sequence
  Description of Artificial Sequence: Synthetic coding sequence
atgggtgacatggccaacaattctgtagcttatagcggagtgaaaaactccctgaaagaagccaaccatgacggcgatttcggaataactctcgcagagctccgggcccttatggagctcaggagtacagatgcgctgcgtaagatccaggagtcctatggggacgtatacggcatctgtactaagctgaaaactagcccgaatgagggcctctccgggaaccctgctgatttagaaaggcgcgaggccgtgtttgggaaaaacttcattcctccaaaaaagccaaaaacatttctgcagctggtatgggaagctctgcaggatgtaactctcataattctggaaattgccgccattgtgagtctcggcttatcgttttaccagccccccgaaggtgataatgctttgtgcggcgaagtatcggtcggcgaagaggagggagaaggggagactggctggatagaaggagctgccatcctgctttctgtggtttgcgtggtgctagtcactgcgttcaatgattggtctaaggaaaaacagtttcggggactacagtcccgaatcgaacaggagcaaaaattcaccgtgattcgcggtggccaggtaattcaaattcccgtcgctgacattacagtaggcgacatcgctcaggttaaatatggtgacctactgccggctgatggaatcctgatccaaggaaacgatctcaagattgacgagtcgtcgctgacaggggagagtgaccacgttaaaaagagcctggataaggatccactccttctctcagggactcacgtgatggagggcagtggcagaatggtcgttacagcagtgggagtaaattcacagaccggcatcattttcacactgttaggcgctggaggcgaagaggaagaaaaaaaagatgagaagaaaaaagaaaagaaaaacaagaagcaggatggggccatcgaaaatagaaacaaagcaaaagcccaggatggagctgccatggaaatgcaacctctcaaatccgaggaggggggagatggagatgagaaggacaaaaagaaggccaatttgcccaagaaagaaaaaagtgtactccaaggcaaacttaccaagcttgccgtgcagattggcaaggcaggactgctgatgagtgccataacagttattatacttgtgctgtacttcgtgatcgatacattctgggtgcagaaaagaccatggctggccgagtgcacgccaatttacattcaatacttcgtcaaattcttcatcatcggcgttaccgtactggtggtggcagtgccagaagggcttccgctggctgttactatttccctggcttacagtgtcaaaaaaatgatgaaggataataaccttgtgaggcacttggacgcctgtgaaaccatggggaacgccacggctatttgcagcgacaagaccggaacgctgacaatgaatcgcatgacagtcgtccaggcatacatcaacgagaagcattataaaaaggttcccgaaccagaagccattcccccaaatatcctctcctacctagtgacggggatcagtgttaattgtgcctacacgtcaaaaatactccctccggaaaaagaaggtggtctgcctcgacacgttgggaataaaaccgaatgcgctctgttaggtctgctcctggacctcaagcgcgactaccaggacgttaggaacgagattcctgaggaagccctttacaaggtgtacacatttaacagcgttcgaaagagcatgtccaccgttcttaagaattcagacggctcatatagaatattttccaagggcgcctctgagatcatattaaagaaatgctttaaaattttgtctgcaaatggcgaagcaaaagtgttccgcccaagagatagagatgatattgttaagaccgtgattgagccaatggcgtctgagggcttgcggacaatctgtctcgcctttcgggatttccctgctggcgagcctgaaccagaatgggataacgagaatgatatagttaccggattaacttgcatcgccgtggttggtattgaagatcctgttcgccctgaggttccggatgcgatcaagaagtgtcagagggcggggataaccgtgcgcatggtgactggagacaatatcaatacagccagggcaatcgcaacaaaatgcggaattcttcatcccggagaggattttctgtgcctcgagggcaaagattttaatcggagaatccggaacgagaagggagaaattgagcaagagcggattgataagatctggcctaagcttcgagtacttgccagaagttcccccaccgataagcacacactcgtgaaaggcatcatagactctactgtgagtgatcagcggcaagtggtcgccgtaacaggggacggcaccaatgacggccctgccctgaagaaagctgacgtaggcttcgcaatggggatcgcgggcaccgacgtggctaaggaagctagcgatatcattctcaccgatgacaacttcacatccatcgtgaaggcggtgatgtggggccgaaacgtgtatgattctatatccaaatttttgcagttccagctgacagtgaacgtcgttgccgtcattgtagccttcactggagcctgcattacccaggactcccctctgaaggctgtgcagatgctgtgggtgaatctgattatggatacactggctagcctggcactggccaccgaacctccaaccgagagcctgctgctgcgcaaaccatatgggcgcaacaaaccactgatatcccggacaatgatgaagaatatcctcggccatgcattttaccagctcgtggtggtcttcacccttctctttgccggggagaagttcttcgacatagatagtggtcgaaatgcacccctccacgcccccccctccgaacactacaccatcgtgtttaacacttttgttctgatgcagctgttcaatgagatcaacgccaggaagattcacggtgagaggaacgtttttgagggaatcttcaacaatgccattttctgcacaatagttctgggtacattcgtcgtgcaaatcattatcgtgcagttcggcggcaagcctttcagttgttccgaattgtcaattgagcagtggctgtggagcattttcttaggcatgggaacactgctttggggccagctcatctcaacaataccaacctccagacttaagtttctgaaagaagcaggccacggtactcagaaggaagagatcccagaggaggaactagcagaggatgtagaggaaatcgaccatgctgagcgggaattgcgccgggggcaaattctgtggtttagaggactgaaccggatccaaacacagatggacgttgtgaatgcctttcagtctggctcgtccatccaaggggctctaagacggcagcctagcatcgccagtcaacaccatgatgtgaccaacatcagtaccccaacccatgtggtgttttcaagttccaccgcctccaccaccgtgggatacagttcgggcgaatgcatctcttag

SEQ ID NO: 108970 - DNA, 2892 bp, Artificial Sequence
  Description of Artificial Sequence: Synthetic coding sequence
atgtttctcgtcatcggaacacacgtgatggagggtagtggtcgtatggttgtgaccgccgtgggggtaaacagtcaaactgggattatttttaccctgctgggtgcgggaggcgaggaggaggaaaaaaaagacgagaagaagaaggagaagaagaataaaaagcaggatggagctatcgagaaccgcaacaaggcaaaggcacaggacggggctgctatggagatgcaaccattaaagagtgaggagggtggagatggagacgagaaggacaagaagaaggcgaatctccccaagaaggagaagagtgtgctgcagggtaaattgactaaacttgcagtgcagatcggaaaagctggtctgctgatgtctgcaatcactgttataattctcgtactttacttcgttattgacacattctgggtgcagaaaagaccgtggctcgcagaatgtacccccatatatatccagtacttcgtgaaattcttcattattggggtgacggtgctggtggtggctgtacctgagggccttccactagccgtgaccatctctctggcttattcggtgaagaagatgatgaaagacaacaacctggtgaggcacctggatgcatgcgaaaccatgggcaacgccactgctatctgcagcgacaaaacaggaacacttacaatgaatagaatgactgtggtgcaggcttacattaatgagaagcattacaagaaagtcccagagccagaagcgatcccccccaacatcctcagctacctggtgacggggatctccgttaactgtgcttacacgagtaaaatcctgccccctgaaaaggagggtggcctgcctagacacgtcggaaacaagaccgagtgtgcactgctgggactgctgttggacctgaagcgtgactaccaggatgtgaggaacgagatccctgaggaggcactgtacaaggtttatacattcaactcagtgcggaaatctatgtctacggtgcttaaaaactccgacgggtcctatcgtatatttagcaagggtgcgtccgagatcattctcaaaaagtgtttcaagattttaagcgctaatggggaggccaaggtcttccgccctagagaccgggatgatatcgtgaaaacagtgattgaacctatggcatctgaaggactcagaaccatttgccttgcctttagagatttccccgccggagagccagagcccgaatgggacaatgagaatgacattgtgaccggccttacctgcatcgctgtcgtgggcatcgaggatccagtgaggccggaagtccccgacgccatcaaaaagtgccagagggccggcatcactgtccggatggtgacaggtgacaacattaatactgctagggccattgctacaaagtgtgggattttgcaccccggggaggatttcctatgtctggagggcaaagatttcaaccgacgcatccgcaatgaaaagggtgagatcgagcaggagcggattgataagatctggcccaagctgcgggtgctggcgcgctcctccccgacagacaagcacaccctcgtcaaaggaatcatcgacagcaccgtctcagaccagcgacaggttgttgccgtgacaggagatgggaccaatgacggacccgcgctcaagaaggccgacgtgggcttcgccatgggtattgctggcactgatgtggccaaagaggcatccgacatcatccttaccgatgataattttaccagtattgttaaggccgtgatgtggggaaggaacgtttacgatagcatctcaaagtttctgcagtttcagcttaccgtgaatgttgtcgcagtgatcgttgcgttcacaggagcgtgcattactcaagactctcctttgaaagctgtccagatgctttgggtcaacctgattatggacactctcgccagccttgctctcgccaccgagcccccaacggaaagcctcctgctacgtaaaccgtatggtagaaataagcctctgatcagccgcaccatgatgaaaaacatccttggacacgcgttttatcagcttgtggtagtttttacactactcttcgcaggcgaaaaattttttgacatcgactctggcaggaacgcccctcttcacgcacccccgagcgaacattacaccattgtgttcaacacgttcgtcttgatgcagcttttcaacgaaattaatgctaggaagatccacggagaaaggaatgttttcgaggggatcttcaacaacgcaatattttgtactatcgtgctgggcactttcgttgtgcagatcataatcgtacagtttggcggtaagcccttcagctgttccgagctttcaatcgaacagtggctgtggtccatattcctgggcatgggaactttgctgtggggccagctgatctcgaccattcccacttctcgcttaaaattcctgaaagaggctggccatggcacacagaaagaggaaattccagaggaagaacttgctgaggacgtggaagaaatcgaccatgccgaacgtgagctccgccggggacaaatactttggttccgcggattaaatagaattcagacccagatccgcgtcgtgaacgcgtttagaagctcactttatgaagggctggaaaagcccgaatcaagatcatcaatccacaactttatgactcatccagaatttaggattgaggactcagagcctcacatccctttaatcgatgacactgacgccgaggacgatgccccgaccaaaagaaacagttctccaccacccagcccaaataaaaataataatgccgtcgattctgggatccacctaacaatagaaatgaacaagagtgccaccagctccagcccgggcagccccctccacagtctggagacctcactctag

SEQ ID NO: 108971 - DNA, 3663 bp, Artificial Sequence
  Description of Artificial Sequence: Synthetic coding sequence
atgggtgatatggccaacaattctgtggcatatagtggcgtaaaaaacagtctcaaagaagccaaccatgatggtgacttcggcataactctggccgagctcagagccctgatggagctccggtctactgatgctttgcggaagatccaggaatcatacggggacgtgtacggcatctgcaccaaactcaagactagtccaaacgagggactgagcggaaatcctgctgacctggaaagaagagaggccgtcttcgggaaaaatttcatcccacccaagaagcctaagaccttcctgcagctggtctgggaggcgctgcaggacgtgacccttattattctcgagatcgcagccatagtatctctgggcttgagcttctaccagccaccagagggcgacaacgctctttgcggggaggtgagcgtgggggaagaagaaggcgaaggggaaactggttggatagagggcgcagccatcttgctctctgtggtgtgtgtggtcctggtgacggcctttaacgactggtctaaggagaagcagtttcggggtctgcagagtcggattgaacaggaacagaaattcaccgtcatacgtggtggccaggttattcagattcccgtggctgacatcacggtcggcgacattgcgcaggtaaagtacggggatctgctccctgcagacgggattttgattcagggcaatgacctgaagattgatgagagtagtctgacgggcgagagtgatcacgtgaaaaagagccttgacaaagatcccctgctgctcagcggaacccacgtcatggaaggatcaggccggatggtggttaccgctgtaggggtgaacagtcagacaggaatcatctttaccctgttgggggccggaggtgaagaagaggaaaaaaaggacgaaaaaaaaaaggagaaaaagaacaaaaagcaagacggcgctattgaaaatcgaaataaggctaaggctcaagatggagccgcaatggaaatgcaaccactaaaatccgaggagggaggggatggagatgaaaaagacaagaaaaaggcaaaccttcccaaaaaggagaagagtgtgctgcaggggaaactgaccaaactcgccgtgcagattggaaaggctggcttgcttatgagcgcaatcacggtgatcatcctcgtgctctatttcgtcattgacacattctgggtccagaagcggccatggctcgcagagtgtacgcctatctatattcaatatttcgtgaagttctttatcataggtgtgacagttttggtggtggccgtaccagaggggctgccactggctgtgacaatatccttggcctatagcgttaagaagatgatgaaggataataatctggtgaggcacctcgacgcctgtgagacaatgggaaatgcgacggcaatttgttctgataaaacagggactcttactatgaacaggatgactgtagtacaggcctatatcaacgagaaacattacaagaaggttccagagccagaggccataccccccaacattttatcctacttggttacaggtatcagtgtcaattgcgcatataccagcaagattttgcctcccgagaaagaagggggtctgccaagacatgtggggaataagactgagtgtgctctgctaggactgctgctggaccttaaaagagactatcaagatgtgagaaacgagatcccagaagaggccctgtacaaggtgtatacctttaatagcgtccgcaagtcaatgagcactgtcttgaagaatagcgacggctcttatcggatcttttcaaaaggcgcttctgaaattatcctgaagaaatgttttaagatcttgtctgccaacggagaggccaaggtgttccgtcctcgagatcgggatgatattgtgaagacagtgattgagccaatggcatccgaggggttacggacaatctgcttggcttttcgggattttcctgccggggagccagaacccgagtgggataacgagaatgacatcgtgacaggtctgacctgcatcgcagtggtggggattgaggatccggtgcgtccagaggttcccgatgcgatcaaaaaatgtcagcgcgctggtattaccgtgaggatggtaacaggcgacaacattaataccgctagggccattgcaacgaagtgtgggatcctgcaccccggagaggactttctgtgtctagagggaaaggactttaatcggcggatcaggaatgagaagggggagattgagcaagaaaggattgacaagatctggccaaagctgcgtgttctggctaggtcttcacctacggacaaacataccctcgttaaggggattatcgacagtacagtcagtgaccagcggcaagtcgtggccgtgacaggcgatggcaccaacgacggccccgccctgaaaaaggctgacgtagggtttgctatgggcattgccggaaccgatgtcgcaaaagaggcctcagatattatcctgacagacgataacttcacttccatcgtcaaggctgttatgtggggtcgcaacgtgtacgactcaatttccaaattcctgcagttccagctgactgttaatgtagttgcagtgatcgtggcattcaccggcgcgtgcatcacccaggatagcccgctaaaagcggtacagatgttgtgggtgaacctcattatggataccctggcgtctctggccttagcaacagaaccaccaaccgagagcctgttgcttcgcaagccgtacggccggaacaaaccactaatcagccggaccatgatgaaaaatatactggggcacgctttctaccagcttgtcgttgtattcacattgttgtttgccggggaaaagttcttcgacatcgactccggtagaaatgctcctctacacgccccaccctccgaacattacacgatcgtgttcaacacgtttgtcctgatgcagttattcaatgagattaatgcaagaaagattcatggggagaggaacgtttttgaaggaattttcaataatgcgattttctgtacaatcgtgctgggaacattcgtggtccagataataatcgtgcagttcggagggaagcccttcagctgcagcgaactcagtatagagcaatggctatggagtatcttcttaggcatggggaccctcctgtggggacaattgatttccaccattcctacctcaaggcttaaatttctcaaggaggccggccatggcacacagaaggaagagatccccgaggaagaactggcagaagatgttgaggagatagaccacgccgaacgggagttacggagagggcagatcctctggtttcggggcttgaaccggattcagacgcagatacgtgttgtgaacgctttccgcagttcactatacgaagggctggaaaaacccgagtccaggtcaagtatccataatttcatgacacatccagaattccggattgaggatagcgagccacacatccccttgattgatgacaccgatgctgaggatgacgccccaaccaaacgtaactcttcccctccccccagccctaacaagaacaacaatgctgttgacagtgggattcatttgaccattgagatgaacaaaagcgccacttcgagctcccctggatcgccccttcacagtctggaaacttcactgtag

SEQ ID NO: 108972 - DNA, 306 bp, Artificial Sequence
  Description of Artificial Sequence: Synthetic coding sequence
atgggggacatggcaaacaacagcgtggcctactcaggcgtcaaaaatagtctcaaagaagcaaaccatgatggagatttcggaatcactcttgccgagctgcgggctcttatggagctgcgatcaactgatgctctgcgtaagattcaggagagttatggcgatgtctacggcatctgtacgaagctcaaaaccagccccaacgagggggagttttattacgcatgtttttggtttttcgtacagagagtactttacatttggctgattaacgagcacgcctacatcattctggccattgtgtag

SEQ ID NO: 108973 - DNA, 3600 bp, Artificial Sequence
  Description of Artificial Sequence: Synthetic coding sequence
atgggcgatatgaccaattcggatttttattccaagaaccagcgcaacgagagctcccatggaggcgaatttggatgtacaatggaggagctgaggagtctcatggaactgaggggcaccgaagccgtcgtgaaaattaaagagacgtacggagatacagaggccatttgccggcggttgaagacaagtccagtggaaggtcttccaggcacagcgcccgacctcgaaaaaagaaaacagattttcggacagaattttattccacccaagaaacctaagacatttctgcagctagtttgggaagcactccaggatgtgacccttatcattttggagattgcggccatcataagtttgggactcagtttctaccatcctcctggcgaggggaatgaaggctgtgcaacagctcaggggggcgcggaagatgaaggcgaagcagaagccgggtggattgaaggcgctgctattttactgagcgttatctgcgtggtgctggtgactgcctttaatgactggtctaaagagaaacagtttagaggcctgcagtcacggatagaacaagagcaaaaattcaccgtggtgcgtgcgggccaggtggtccagattccagtcgccgagatcgtggtgggcgatatcgcccaagtcaagtacggagatctgttgccagcagatgggctattcattcaggggaacgacctaaagatagatgaaagtagccttacaggggaatccgatcaggttaggaagagtgtggataaagacccaatgctactttccggaactcatgttatggaagggtcaggtcgtatgttggtgacagcagtgggcgtcaatagccagacagggattattttcacattgctgggggcaggcggggaagaggaggagaagaaagataagaagggtgtgaaaaagggggatggcctgcaactgcccgcagccgacggcgcagccgcttcgaatgctgcagactcggctaacgcctcgctcgtcaatgggaaaatgcaggatggaaatgtggacgcatctcagtctaaggcgaagcagcaggatggcgcggccgcgatggagatgcagccgttgaagtctgccgaagggggagatgctgatgacagaaagaaggcttctatgcacaagaaggaaaaatccgtgctacagggcaagctaacaaaactcgcagtgcagattgggaaagccggcctggtgatgtccgctatcactgtaattattctagttttgtattttactgtcgacactttcgtggtgaacaaaaaaccatggctgccggagtgtacgcccgtgtacgtccagtacttcgtaaaatttttcatcatcggcgtgaccgtcttagtggttgccgtgcctgaaggtctacccctcgctgtgactataagtctggcatactccgtgaaaaagatgatgaaggataacaatctcgtacggcacctcgacgcctgcgaaactatggggaatgccaccgcaatctgctcggacaaaaccgggacattaacaacgaaccgcatgaccgttgtgcaggcctatgtcggcgacgtgcactataaagaaatacctgacccttctagtattaacactaaaactatggaactgcttataaatgcgatagccatcaactccgcatacactaccaagattctgcctcccgaaaaagaaggcgccctcccacgccaggtgggtaataagactgagtgcgggcttctgggcttcgtgctcgatctgaaacaggactatgaacccgtacggtcccagatgccagaggagaagctgtataaggtgtacacctttaatagtgtgagaaagtcaatgagcaccgttatcaaactccccgatgaatccttcaggatgtactccaaaggcgcgtctgagatcgttctcaaaaagtgttgtaaaatcctgaatggcgccggcgagccccgagtgttcaggccacgggaccgggacgagatggttaagaaagtaattgagcccatggcctgcgacggcctacgcaccatctgtgtagcatacagggattttccttcctctcctgaacccgattgggataacgaaaatgacattttgaatgagttgacatgtatttgtgtggtgggcattgaggatccagtgcgcccagaagtgcccgaagcaattaggaaatgccagagagctgggataacagttagaatggtgactggcgacaacataaacacagcgagggcgattgcaatcaagtgcgggatcatccaccccggagaagactttctgtgtcttgaggggaaagagttcaatcgtaggatcaggaatgaaaagggtgaaatagagcaggaacgaatcgataaaatttggccaaaactacgcgtgctagcacgctcaagccctactgacaagcataccctcgtgaagggtatcatagatagtacccatacagagcagagacaggttgttgctgtcacaggcgacggcaccaatgacggccctgctctgaaaaaggccgatgttggctttgcaatgggaattgccggcaccgatgtggccaaggaggcctctgacatcatattgactgacgacaacttcagttcaatcgtgaaggcagtaatgtggggccggaacgtgtacgactctatcagcaagtttctgcagttccaactcactgtaaatgttgtggcagtgatcgttgccttcacgggagcttgcattacacaggatagccctctaaaagcagtacagatgctctgggtaaacttgatcatggataccttcgccagtctcgcgttggcgaccgaacccccaactgagactctgctgctgaggaagccgtacggtagaaataaacctctcatttctagaaccatgatgaagaacattctgggacacgccgtatatcagttggccttgatttttacactattatttgtcggggaaaagatgttccagatcgattctggcaggaatgccccactgcatagccctccttccgagcattatactataatttttaacacatttgtcatgatgcagctttttaatgaaattaacgcccggaagattcacggagagagaaacgtattcgatgggatcttcaggaatccgatcttctgcacaatcgtgctgggcacctttgccatacaaatcgtcattgtgcagtttggcgggaagccatttagctgctcgcctttgcaactggaccagtggatgtggtgtatattcattgggttaggcgagctggtctgggggcaagtgattgctacaattccaacctccaggttaaagttcctcaaagaggcagggcgactgacacagaaggaggagatccctgaggaggaactgaatgaggacgtggaggaaattgaccacgccgaacgcgaactgcgtagagggcagatcttgtggtttcggggcctcaataggatccagacccagatcgaggtggtgaacacctttaaaagcggcgctagcttccagggtgccctgcgtcggcaaagcagcgtgactagtcagagccaggacgtcgccaacttaagtagcccgagtcgcgttagcttgtcaaatgcacttagcagtcccacctccctacccccagccgcagccggcagggaatag

SEQ ID NO: 108974 - DNA, 3690 bp, Artificial Sequence
  Description of Artificial Sequence: Synthetic coding sequence
atgggcgatatgaccaacagcgacttctattccaagaaccaacgtaacgagagctcacatgggggggagtttggatgtactatggaggaattaaggtccttaatggaactgcgcggaacagaggctgtcgtcaagattaaggaaacttatggagacacagaggcaatatgtaggagacttaagacttcacccgtagaagggctccccggtactgccccagacctggaaaagagaaaacagatattcggccagaacttcatacctcctaagaagccaaagacgtttctgcagctggtgtgggaagccttacaggacgtcacactgattatactggagatcgctgctattatcagcctgggcctcagcttctatcacccccccggagagggcaacgaaggatgcgctactgcccagggaggagctgaggacgaaggggaagcagaggctgggtggattgagggagccgccatattactctctgttatctgcgtcgtgctggttacagcctttaatgattggtctaaagagaagcagtttagagggctgcagtcgaggattgaacaggagcaaaaattcactgtggtgcgcgcagggcaagtggtacaaattcctgtggcagaaattgtggtcggcgatatagcccaggttaaatatggagacctgcttcccgctgatggcctgttcattcagggaaacgacttgaagattgatgagagctcactgactggagaaagcgatcaggtccggaaaagtgtggacaaagatcccatgttgttgagtggaacccatgttatggagggcagcggaaggatgctggtcacagccgtcggcgttaattcacaaaccgggattatcttcaccctgctgggagccggcggggaggaggaagaaaagaaagataaaaaaggtgtgaagaaaggggacggactacaactgccagctgccgacggggctgccgcatctaacgccgccgattccgctaatgcttccctggtgaacgccaagcagcaggacggggcggccgccatggaaatgcaaccactgaaatccgctgagggcggggacgccgatgatcgcaaaaaggcgtcaatgcataagaaggaaaagtctgtcctgcagggcaaactaacaaaattggcggtacagattggcaaagctggtctggttatgtcagcaattaccgtgattatcttggttttgtatttcacagtggacactttcgtggtgaacaaaaaaccctggcttccagaatgcaccccagtctacgtccaatattttgtaaagttcttcattatcggagtgacagtgctggtggtggcggtgcccgaaggactccctctggcagtcactatcagcctcgcctactccgtcaagaaaatgatgaaggataacaacttagtgcgacacctcgatgcatgtgagacaatgggcaacgccacggctatctgtagtgataagaccggaactctgactacaaacaggatgaccgtggttcaggcctatgtaggtgacgtgcactacaaggagattccagatccgtcatctataaacaccaagactatggaattgctcattaacgccatagctattaacagtgcctacaccacaaagatcttgcctcccgagaaagaaggagcattgccacggcaggttggaaataaaaccgagtgcggcttactggggttcgtgctggatttgaaacaggattacgagcctgtgaggtcgcagatgcccgaagagaagctttataaggtctacaccttcaacagtgtccggaagtcgatgtccactgtcataaagctacctgacgagtccttcaggatgtactccaagggggcttctgaaatagtgctgaaaaagtgctgtaaaattcttaatggggcgggagagccccgggtcttccgtccccgcgatcgggatgagatggtaaagaaagtaatagaaccaatggcttgcgatgggctgcgaactatttgtgtggcgtacagggattttccgtcgtcgccagaacctgactgggacaacgagaatgacatcctaaatgaactgacatgtatctgcgtggtaggaattgaagatcccgtgaggcctgaggtcccagaggctattcgaaagtgccaaagggccggaattaccgtccggatggtaacaggagacaatattaataccgcccgagctatcgcgataaagtgtgggattatacatccaggagaggattttctgtgtctcgaggggaaggaattcaacagacgtattcggaatgaaaagggggagatcgaacaggaacgtatcgataagatttggcctaaattgcgggttttggcccgatccagccctacagacaagcacacactagtgaaaggcatcattgactcgacgcatacagagcagcggcaggtcgtggccgtgaccggcgacgggacaaatgacggccccgccctgaaaaaagccgacgtaggttttgcaatgggcattgctggcactgatgtcgcaaaagaggcctccgatatcatcctgactgatgataatttcagctctatcgtcaaggctgtcatgtggggcagaaatgtctacgattcaataagcaaattcctgcagtttcaactgacggtgaacgtggttgctgttatcgtggctttcaccggggcttgcataacgcaggactcccccctgaaagccgtgcagatgctttgggtgaacctgataatggacactttcgcttctctggcattagccaccgagcctcctacagaaaccctgctcctgcggaagccatatggtaggaataagcccctgatttccaggacaatgatgaagaatatcctcggacacgccgtgtaccagctggcactcatattcactctgctttttgtgggggagaagatgttccaaatagatagcgggcgaaacgctccgctgcactcgccaccaagcgagcactatactatcatattcaacacttttgtcatgatgcagctgtttaatgaaatcaacgccaggaagattcacggcgagcgtaacgtgttcgacggtatattccgcaaccctatcttttgcactattgtcctggggacctttgcaatccagattgtcatcgtgcagtttgggggcaaaccgttttcttgcagccctctgcagctggatcagtggatgtggtgtatcttcattggactgggcgagcttgtttggggacaggtgatcgctaccatccctaccagtcgtctaaagttcttaaaagaggccggacgactcacccagaaagaagaaatccccgaagaagaacttaacgaggatgtggaggaaattgaccatgcagaaagggagctgagacgcggccagatactgtggttcagggggctcaacaggattcaaactcagattagggtcgtgaaggcctttagatcgtcgttgtacgaagggttggaaaagccggagtcacgcacttctattcacaatttcatggcccatcccgagtttcgaattgaagattctcagccacacatccccctaatcgacgataccgacctggaggaggacgccgctttaaaacagaacagttcgccaccgagtagcctgaacaagaataacagtgccatagattcgggcattaacctcactaccgatactagtaaatccgccacctccagctccccaggaagtcctatccatagtctagagactagcttgtag

SEQ ID NO: 108975 - DNA, 3732 bp, Artificial Sequence
  Description of Artificial Sequence: Synthetic coding sequence
atgggcgatatgacgaacagcgatttttacagcaaaaaccaacgaaatgagtcttctcatggaggggaattcggctgcactatggaggaactccggtcactgatggaactgcgcgggaccgaagcagttgtgaagatcaaagagacctatggtgatacagaagccatttgtagaagattaaaaacctccccggtggaaggattacccggcaccgcccctgacttggagaagcgcaaacaaatatttggccaaaacttcatcccaccaaagaaaccaaaaactttcctgcagctcgtgtgggaggctctgcaggatgttaccctgattatcctggaaatagctgccatcatcagtttaggactatcgttttatcatccccctggagagggcaatgagggatgcgccactgctcaaggcggagccgaggatgagggcgaagccgaggccgggtggatcgagggagcagccattcttctttccgttatttgtgtggtactcgtcacggccttcaacgactggtctaaggagaagcagtttagggggctgcaatctaggatcgaacaggagcagaagtttacagtggttcgggcaggacaggttgtccaaatccccgttgccgagattgtggtcggtgacatcgcccaagtgaaatatggcgacctgctgcctgctgacggtctattcatccagggcaatgatctcaaaatcgatgagagttctctaactggcgagtccgaccaggtgaggaaatcagtcgataaagaccctatgcttcttagcggaacccacgtcatggagggcagtgggagaatgctcgtcacagctgtgggagttaattcccagaccggtataatattcacattgctcggtgcaggaggggaggaggaggaaaagaaggataaaaagggagtgaagaaaggggatgggttgcagctgcctgcggccgatggggcggccgcatctaacgcagccgatagtgctaacgccagtctggtcaatggaaaaatgcaagatgggaacgtagatgcctcccagagtaaagcaaagcagcaagacggcgcagcggccatggagatgcagcctttgaaatccgccgaaggtggagacgccgatgaccgaaaaaaggcgagcatgcacaagaaagaaaaaagcgtcttgcaggggaagctgacaaagttggccgttcagattgggaaggcgggcctggtgatgtctgccatcaccgtaatcatacttgtcctgtactttactgttgacactttcgtggtgaacaagaaaccatggttgccagaatgcacaccggtatatgtacagtacttcgtgaagttcttcattatcggcgtcacggttttagtcgtggccgtcccggaaggccttccacttgcagtgacgataagtttagcttactctgtcaagaagatgatgaaggataacaatttagtcaggcacctggatgcatgcgaaacaatggggaatgctacggcaatctgctcggacaagaccggaacattgactactaaccgtatgacagtggtccaggcttacgtcggcgacgttcactataaggaaatccccgatccctctagcataaacactaaaaccatggaactgttaatcaatgctattgctataaatagcgcctacaccacaaagatcctccccccagagaaggagggcgcattacctaggcaggtgggcaataagacggaatgcggactcctgggcttcgtcctcgacctaaagcaggactacgagcccgtacggtcacagatgcccgaggaaaagctttacaaggtgtacacatttaacagcgtacggaagtctatgtctacagtgattaagctcccggatgagtcctttcggatgtatagcaaaggcgccagcgagatcgttctcaaaaagtgttgtaagatcctcaacggtgccggcgagccaagagtttttaggcctagggaccgggatgagatggtcaagaaagttatcgagcctatggcatgcgatgggctgaggacaatctgcgtcgcatatcgagacttcccatccagccccgagcctgattgggataatgagaacgacattctgaatgagttaacatgtatctgcgtcgttggtatcgaagacccggtacgacctgaagtgcccgaggcaattcgcaaatgccagagagctggcatcactgttcgcatggttacaggagataacattaacactgccagggctatcgccatcaagtgcgggatcatacatcctggggaagacttcttatgtcttgagggcaaggaatttaatcggaggatcaggaacgagaagggcgagatcgaacaggagcgcatcgataagatctggcccaaattgagagtattggctagatcatcacccacggacaagcatacacttgttaagggcatcattgattccacccataccgaacagcgacaggttgtggcagtgaccggcgatggaaccaatgatggccctgctctgaagaaggctgatgtgggctttgccatgggtatcgcggggaccgacgtggccaaggaagcctccgatattatcctaaccgatgacaattttagctcaattgtcaaggctgtcatgtggggacgaaacgtctacgactcaatctcaaagttccttcagtttcagctgacggtgaatgtagtagcagtcatcgtggctttcaccggagcctgtataacccaggacagcccgctgaaagcagttcagatgttatgggtgaatctaataatggatacttttgcaagcctggcgctcgcaaccgagccccccactgaaactttattgctccgtaaaccatatgggcggaataagccactcatctcacgtaccatgatgaaaaatatattaggtcacgccgtttaccaactggctctgattttcactctcctgttcgttggagagaagatgtttcagattgattctggtaggaacgctcccctccattcccccccttccgagcactacaccatcatcttcaacacatttgttatgatgcagctgttcaacgaaatcaacgctagaaagattcacggcgagcggaacgttttcgacggcatcttccgcaacccgatcttctgcaccattgtgttgggtacgtttgccatccaaatcgttatagtccagtttggcggcaagccatttagctgctccccgcttcagctggaccagtggatgtggtgcattttcatcggccttggcgagcttgtatggggtcaagtgatagccaccattcccacgtccaggcttaagttcctgaaggaagctggtcgcttgacccagaaggaagaaatccccgaggaggagctaaacgaagacgtggaggaaatcgaccacgctgaacgcgaactgcgaagaggccaaattctttggttccgcgggctcaataggatccagacgcaaattcgcgtagttaaagccttccgtagctctctgtatgagggcctggaaaaacctgagtcccgaacttctattcataatttcatggcccacccagagttcaggatagaggattcacagcctcatatcccactgatcgacgacactgacctggaagaggatgcagctctgaagcagaatagttccccccctagttcactgaataaaaataatagtgcaatcgattcggggataaacttgacgaccgataccagcaaatctgctacctcctcttcaccagggtctccaatccattcgctggagacaagcctgtag

SEQ ID NO: 108976 - DNA, 3732 bp, Artificial Sequence
  Description of Artificial Sequence: Synthetic coding sequence
atgggcgacatgaccaactctgacttctattcgaagaaccagcggaacgagtcatcccacggcggggagttcggctgcacaatggaggagctgaggtcactgatggaacttcgaggaacagaggcagtagtcaaaattaaggagacatacggcgatacagaggcaatttgccgccgcctgaagacgtcacctgtcgaaggcctgcctggcactgctcccgacctggagaaaagaaaacagatctttggacagaactttattccccctaaaaagcctaagacatttctgcagcttgtgtgggaggctctccaagatgttacactgatcatacttgaaattgctgccattatctccctggggctcagcttttaccaccctcctggcgaaggtaatgaaggctgcgcgaccgcccaggggggggctgaggacgaaggagaagcagaggcaggatggatagagggcgcagcaattcttttgtcagtaatatgtgtggttcttgtgacagcctttaacgactggtccaaggagaaacagttcagaggcctccagagccggatcgagcaggaacaaaagtttactgtcgtccgggcaggccaggtggtccagattcctgtggctgaaatcgtggtcggcgacattgcccaggtgaagtatggagacctcctgccggcagatggattattcattcagggcaacgatctcaaaattgatgagtcgtctctgaccggggagtccgatcaggtgcgcaagtccgtcgataaagaccctatgctgctgtctgggacccacgtgatggagggaagcggtagaatgctggtgaccgctgtgggagtgaatagccagacagggatcatctttactctcctgggggctggtggtgaagaggaggaaaaaaaagataaaaagggggtgaaaaagggcgatggtctccagctgcccgccgccgatggagccgctgcttcaaacgcggccgactccgccaacgcgagcctcgtgaatgggaagatgcaggatggtaacgtcgatgccagccagagcaaagccaaacagcaagatggtgccgctgctatggaaatgcagccactaaagagcgccgaggggggggatgccgatgatcgcaaaaaggcttctatgcacaagaaagaaaaatccgtgttgcagggcaagctaaccaaactggccgtgcagattggaaaggccggtctcgtcatgagcgcgatcacggttattattctcgttctctattttacggtggatacatttgtggtgaataaaaagccgtggctgcctgagtgtactcccgtgtacgtgcaatactttgtgaaattttttataataggggtgacagtgctagtcgtggccgtccccgaggggcttcctctggccgtgacgatcagccttgcatactctgtgaaaaagatgatgaaggacaataacttggtgagacatctcgatgcttgcgaaaccatgggaaacgccactgccatctgttcagataagaccggcacactcaccaccaatagaatgactgtagtgcaggcctacgttggtgacgtgcactacaaagaaatccccgacccgtcatctatcaacacaaaaaccatggagctgctgattaatgctatcgctatcaattccgcctatacaaccaagatcctgccccctgagaaagagggcgcactccctagacaggtggggaacaaaacagagtgcggattactcggttttgtgctggacttaaaacaggattatgagccggtcaggtcccagatgcccgaggaaaagctgtacaaggtgtacactttcaattccgtccggaagagcatgtcaacagtcatcaagttgccagacgagtcctttcgaatgtattcaaagggggcttccgaaattgtcctgaaaaagtgttgtaaaattctcaacggggccggggagccccgtgtgtttcggccacgggaccgcgatgagatggtcaagaaggtgattgaacctatggcttgcgacgggctgcgtaccatctgcgtcgcatatcgagactttccttctagtcctgagcctgactgggataatgaaaacgatattttgaatgaactcacatgtatatgtgttgtcggcatcgaggatcccgtccggcctgaggtaccagaagccataagaaaatgccagagagctgggatcactgtgaggatggtgactggcgacaatataaacacagctcgcgcgatcgccatcaaatgcggaataattcatcccggtgaagacttcttgtgcctagagggcaaagaattcaaccgaaggattcgcaacgagaagggggagatcgagcaggaacgcatcgacaagatatggcccaagctgagagtgctagctcgcagcagtcctacagacaagcatactcttgtcaaggggattatcgacagcacccatacggagcagagacaggttgtagcagttacaggcgacggcacaaatgacggcccagctctgaagaaggcagatgtcggctttgcgatgggtattgccggcacagacgtagccaaggaagcaagcgatatcatcctcactgacgataatttctccagcatagtgaaggctgtgatgtggggtagaaacgtgtatgatagcatctctaaatttctgcagttccagcttaccgttaatgtcgtagccgtaatcgtggcttttacaggcgcctgtatcacgcaggattcacccctcaaggctgtccagatgctctgggtcaatctcattatggacacctttgcctccctggccctggctaccgaacctccaaccgaaacacttttattacggaagccatacggccggaataagccactgattagccgcacaatgatgaagaacatccttggacacgctgtatatcaattggccctcattttcacattactctttgtgggcgagaagatgtttcagatcgactccggacgaaatgcgcctctgcatagccccccctcggaacactataccatcatctttaatacattcgttatgatgcagttgtttaatgagatcaacgcacgtaagatccacggtgaacgtaacgtttttgacggcatcttcagaaaccctattttttgcactattgtcctagggaccttcgctattcaaattgtcattgtgcagtttggaggaaagccctttagctgttctcccctgcagctggatcagtggatgtggtgtatctttattggcctgggggaattggtttggggccaggtgatagccactattcctacctcacgcttaaagttcttgaaggaagccggtaggcttacccaaaaggaggagatcccggaggaagagctcaatgaagatgtcgaggagatcgaccacgcagagagagagcttaggagagggcaaatactgtggttccgcgggctcaaccgaattcagacgcagatcagagtggttaaagcattcagatcctctctctacgagggcttagagaaacccgaatccaggactagcatccataatttcatggcccatccggaatttcgaatcgaggactcccagcctcacatacccttgattgatgacaccgatcttgaggaagacgctgcactcaaacagaactcaagtccaccctcatccctgaataaaaacaactctgccatcgatagtggcatcaatttaaccaccgacacatccaagagcgcaactagctctagtcccggctctcccatccacagcctagaaaccagcttgtag

SEQ ID NO: 108977 - DNA, 3597 bp, Artificial Sequence
  Description of Artificial Sequence: Synthetic coding sequence
atgggggatatgaccaacagtgacttttactctaagaaccagcggaacgaatccagccacggtggcgagttcgggtgcactatggaagaactcaggtctctgatggagctacggggaacagaggctgtcgttaaaatcaaggaaacttacggtgacaccgaggcaatctgccggcgactcaagacgtccccagtggagggacttccgggaacagcaccggatctggaaaaaaggaaacagattttcggccagaatttcatcccacccaaaaaacccaagacatttttgcagctcgtctgggaggccctgcaggacgtgacacttattatactcgagatcgctgccatcatcagcctcggtctctccttctatcacccaccaggcgagggaaatgagggctgcgcaactgcccagggtggtgccgaagatgaaggggaagccgaagcaggctggatagagggcgcggccatcttgctgagtgtaatctgcgtggtgttagtgacggcttttaacgactggagcaaggagaaacagtttcgtgggcttcaatctaggatcgagcaagaacagaaattcaccgtggtacgagcgggacaagtggttcagatccctgtagcagagattgtagtgggagatattgcacaggtcaagtatggcgacctccttcctgctgatggcctcttcatccaggggaacgacctgaaaatcgatgagagcagcctaaccggtgagtctgatcaggtgcgcaagtcagtagacaaagacccaatgctcctcagtggcacccatgtgatggagggatcagggcgtatgttagttacggctgtgggtgtgaattctcagaccggcattatcttcactctcctgggagccggtggggaggaggaggaaaagaaggacaaaaaagcaaagcagcaggacggagctgcagcaatggaaatgcagcccctcaagtccgcagaggggggggacgccgacgatcggaagaaagccagcatgcataagaaagaaaagtccgtcttgcagggcaagcttacaaaattggccgtgcagatcggcaaagcaggcctggtcatgagcgcgataacggtgattattctggtgctttacttcactgtggatacatttgtggtcaataaaaagccttggttgcccgagtgcacacctgtgtatgtacagtatttcgttaagttctttatcatcggtgtcactgtactggttgtggccgtcccagaaggtctacctctagcagtgaccatttcactcgcttactccgttaaaaaaatgatgaaagacaacaacttggtccggcacctggatgcatgtgaaactatggggaacgccaccgcaatctgcagcgataagacaggaactcttaccacgaaccgcatgacagttgtgcaggcctacgtaggggatgtccactataaagaaatcccggatccatcatccatcaacaccaaaactatggagctcctgattaacgccatcgcgataaatagcgcatacacaaccaagatcctacccccagagaaagaaggggccctgcctcggcaggtgggcaataagaccgagtgtggactgctgggattcgtcctggacctgaagcaggattacgaacccgtgaggtcacagatgccagaggaaaagttgtataaggtgtatacattcaatagtgtacgtaaaagcatgagcaccgtgataaaacttcccgacgagagcttccggatgtattccaaaggagcgtccgaaatagtgctcaaaaagtgctgcaagattctgaatggtgccggggagccacgcgtcttcagacctcgcgaccgcgacgagatggtgaaaaaggtaatcgagcctatggcctgcgatggcttgcggaccatatgtgtggcctaccgtgatttccccagtagcccagagcccgattgggataacgagaacgatatcttgaacgaactcacgtgcatctgcgtggtgggcatcgaggacccagtgcggcctgaggttcctgaagctatcagaaagtgtcagagggcaggtataacagtgcgcatggtcacaggagataacatcaacaccgctcgagcaattgccattaagtgtgggattattcacccaggtgaagatttcctgtgtctggaaggcaaagaattcaataggcgaattcggaatgaaaagggtgaaatagaacaggaacgaatagataaaatttggccaaagttgcgagtactggctaggagctctccaaccgataagcataccctggtaaagggcattatcgattctacacatacagaacagcgccaggttgtcgccgtgaccggtgatgggaccaacgatggacccgccctgaagaaagcggatgtggggttcgctatgggcatagcagggaccgacgtggcaaaggaagctagtgatattattctgactgacgacaatttctcttctatcgttaaagccgtcatgtggggaagaaacgtttacgacagcatcagcaagtttctgcaattccagctgactgtgaacgtggttgcagtcatcgttgcctttacgggagcgtgcatcacccaggattccccactcaaagcagttcagatgctgtgggtgaacttaattatggatacctttgctagcttggccctggcgaccgagcctccaactgagaccttactcttgagaaaaccttatggacggaataagcctctgattagccgaacaatgatgaaaaacattttaggccacgccgtgtaccagctggccttaatcttcactctcctgtttgttggagaaaagatgttccagattgacagcggccggaatgcgcctctgcattcccccccttcagaacactatactatcatattcaatacattcgtcatgatgcaattattcaacgagattaatgcccgaaaaatccacggcgagagaaacgtattcgatggaatcttcagaaacccaatcttttgcacgattgtgctgggtacatttgccattcagattgtaattgtccagttcgggggcaagcccttttcatgtagtcctctgcagttggatcagtggatgtggtgcatatttataggattgggtgaactggtttggggccaagtcatcgccaccatccctaccagccggctcaagttccttaaggaagccgggcgactaacacagaaggaagagattcctgaggaggaactgaacgaagatgtggaggagattgaccacgcagaacgggaactgagacgcggccaaatattgtggtttcggggccttaaccggatccagacccagatccgagtggtgaaggcattccgatccagcctctacgaaggcctggagaaacccgaaagcaggacatctatccacaacttcatggcccatccggagttcagaatagaggatagccagccacacatcccccttatcgacgacacagatctggaggaagacgccgctctgaagcagaatagcagcccaccaagctcgcttaacaagaacaactctgccattgactctgggatcaacctaaccaccgacaccagcaagtctgccacctccagtagcccaggctcacccatccactctcttgagacctctctttag

SEQ ID NO: 108978 - DNA, 3597 bp, Artificial Sequence
  Description of Artificial Sequence: Synthetic coding sequence
atgggagacatgaccaacagcgacttttattccaagaaccagaggaacgagagctctcacggcggcgaattcggatgcacgatggaagaactgcggtcactgatggagttgaggggaacagaagctgtcgttaaaattaaagagacatatggagacaccgaagcgatttgcaggcgtcttaaaaccagccccgtcgagggccttcccggaaccgcgccagatctggagaagcggaaacagattttcgggcaaaatttcattccacccaagaaacccaagacgttcctgcagctggtgtgggaggctctccaggatgttacactcattatactggagatcgccgccattattagtctcggcctgtctttctaccacccacccggtgagggtaatgagggctgcgctaccgcgcaaggcggcgccgaggacgaaggcgaagccgaggctggttggatagagggtgccgctatattgttgtccgtgatctgtgtggtgctcgtgactgcctttaacgactggtctaaggagaagcagtttaggggcctgcagtctagaatcgagcaagagcaaaagttcacagtggtgcgggctgggcaggtggtgcagattccggtcgcagaaatcgtcgtcggggacattgcccaggtgaaatacggagatctgttacccgctgatggcttatttatccagggaaacgatctgaagatcgacgagtcttccttgacaggggagagcgatcaggttcgtaagtcagtcgataaggaccctatgctactgagcgggacgcatgtgatggaaggcagtggccgcatgctcgtgactgcagtgggggtgaatagccagactggaataatctttacgctactcggcgctggcggcgaagaagaggaaaagaaagacaaaaaagcaaagcagcaggacggggccgccgccatggagatgcaaccactgaaatcagctgaaggcggcgatgcggacgacaggaaaaaggcaagcatgcataagaaggaaaagtcagtactgcagggaaaactgactaagctggccgttcagattggtaaggccggcctggtcatgagcgccattaccgttatcattctagtgctctacttcaccgtcgatactttcgtggtgaacaagaagccttggttgcccgagtgtaccccagtgtatgtgcagtatttcgtcaaatttttcatcattggtgtgaccgtcttagtggtggccgtgcccgagggcctgccactggctgtgaccatctctcttgcttacagcgtcaagaaaatgatgaaagacaacaatctcgtccgtcacctggatgcttgtgagactatgggaaacgccacagccatttgcagcgacaagaccggcaccctgacaacaaacagaatgaccgttgtgcaagcatatgttggagacgtccattataaagagatcccagatcctagttccataaataccaaaacaatggagctcctgataaatgctatcgctattaacagcgcatacacaacaaaaatattgccacctgagaaagagggcgcgctcccgcggcaggtgggcaacaagaccgagtgcggccttctgggctttgtgttagacctgaagcaagattacgaacctgtgcggtctcagatgcccgaagaaaagttgtacaaagtgtatacgtttaactcggtgaggaaatcaatgtccacagtaattaagttgccggatgaaagcttcaggatgtattccaagggagcatcggaaatagtcctcaaaaaatgttgcaaaatcctcaacggcgccggagaaccaagggtgttcagaccacgagaccgtgacgaaatggtgaagaaagtgatcgagcctatggcctgcgatgggctccggaccatctgtgtggcttaccgagatttcccctcctcccctgaacctgactgggataacgagaatgatatcctgaatgaactgacctgtatttgcgtggtggggatcgaggatcccgttcgacccgaggtccctgaagctattcgtaaatgccagcgagccgggatcaccgtgaggatggttacaggcgacaatattaatacggcgcgcgccatcgccattaaatgtggcataatacaccccggcgaggacttcctgtgcctggaaggaaaggaatttaatagaaggattcgaaatgaaaaaggcgagattgaacaggagcgcatcgataagatatggcctaagctcagggttctcgcccgcagctccccaacagacaaacacacattagtgaagggtattattgacagcacccacactgagcaaaggcaggttgtcgcggtgacaggggacggcactaacgatgggcccgcactgaagaaggccgatgtgggtttcgcgatggggattgcgggcaccgacgtagctaaggaggccagcgacatcatcctgaccgacgacaacttttcaagcatcgtaaaggccgtcatgtgggggcgcaacgtctatgactctatttctaaatttctgcaatttcagcttaccgtcaatgtagttgccgttattgtggcttttactggggcctgcatcacccaagatagccccctgaaagctgtgcagatgctctgggtgaacctaataatggacacttttgcatccctcgccctggccacagagcctcctaccgagaccctcctgctccggaaaccttatggacgcaacaaaccattgatcagcaggacgatgatgaaaaacatcctggggcatgcagtttatcagctggccctcatatttacacttttgttcgtgggagagaagatgttccagattgatagtggacggaacgctcctctgcattcgcccccctccgaacactatactatcatttttaacaccttcgtgatgatgcagctcttcaatgagataaatgctcgcaagatacatggcgaaaggaatgtcttcgacggcatcttccgaaacccgatcttctgtactatagttctgggaaccttcgctattcagatcgttatcgtgcaatttggcgggaagcccttttcttgtagcccccttcagctggatcagtggatgtggtgcattttcatcggactgggcgagctcgtttggggccaggtaatagcaacaatcccaacctctagactgaagttccttaaggaggcaggccgactcactcagaaagaggaaatccccgaggaggagctcaatgaggacgttgaggagatcgaccacgccgagagggagttgcgcagagggcagatcctgtggtttaggggcctcaatcgtatccaaacccagatcagggtggttaaggccttcaggagtagtttgtacgagggcctggagaagccagagagcagaacgtctatccataatttcatggcccaccccgagtttaggatagaagattctcagccccatattccgctcatagatgacactgatctggaggaggacgctgctctaaagcaaaacagctccccgccatcctccctgaacaagaacaacagtgccattgattccgggatcaacctgaccaccgacacctcaaagtcagcgacttcctcaagcccaggttctcccatccactctcttgaaactagtctctag

SEQ ID NO: 108979 - DNA, 1299 bp, Artificial Sequence
  Description of Artificial Sequence: Synthetic coding sequence
atgactgttgtacaggcctatgtgggagacgtccactacaaggaaatccctgatccttcgtccattaacaccaaaaccatggagttactgatcaacgccatcgccattaactccgcctacacgactaaaatccttcctcccgagaaagaaggtgccctgccacggcaagtgggtaatgtctatgacagtattagtaagttcctccagtttcaactgaccgtcaacgtggtggccgtgatcgtggcattcactggtgcttgtattacccaggattcaccactgaaggccgtgcaaatgctgtgggtgaatttaatcatggacaccttcgccagcttggccctggccactgaacccccaaccgagacccttctgctgaggaaaccctatgggcgaaataaaccactgatctctaggaccatgatgaagaacatcctgggccacgcggtctaccagcttgctctcatctttacattactgttcgtgggcgaaaaaatgtttcagatagattctgggaggaacgcaccccttcacagcccacccagcgagcattataccattatttttaatacttttgtcatgatgcagctctttaatgaaataaacgctcggaagattcatggagagcggaatgtgttcgatggtatcttcaggaacccgatcttttgtacaattgtgctcggcacatttgccattcagattgtgattgttcaatttggtggcaagccattttcctgtagccccctgcagctggaccagtggatgtggtgcatatttattggtttaggagagttagtgtggggacaggtgattgcgaccatccctacctcccggttgaagtttcttaaagaggcggggagattgacgcagaaagaggaaatccccgaggaggagctgaacgaggacgtcgaagagatagaccatgccgaacgggaattgaggcgcggacaaattctgtggttccgcggcttgaacagaatccagacccagatccgagtggtaaaggcattcagatccagtctatacgagggtctcgaaaagcctgagagccgcaccagtattcacaatttcatggcccaccctgaattccgtatcgaagactcacagccccacatccccctgatcgatgatactgacttagaagaagatgcggcgctcaagcagaattctagtcctcccagtagccttaataagaacaattccgcaattgacagcggtattaatctgaccacagacacatctaaaagcgcgacatcttcttctcccggcagtccaatccattcactggaaacatccctgtag

SEQ ID NO: 108980 - DNA, 3537 bp, Artificial Sequence
  Description of Artificial Sequence: Synthetic coding sequence
atggaacttagaggcaccgaggccgtggtcaaaatcaaggaaacttacggggataccgaggctatttgccgcaggctcaagacgagtccggtggagggattgcccgggaccgcccctgacttggagaagagaaaacagatattcgggcagaatttcattccaccgaagaagccaaagaccttcttacaacttgtatgggaggcgctgcaagatgtgactctcattatcctggagatcgcagccatcatcagcctgggtctctctttctatcatccacctggggaagggaacgagggctgcgccactgcccagggcggcgcagaggatgagggcgaggcggaggcaggctggattgagggcgccgcaatacttctgtcagtcatttgcgttgtgctggtaactgcctttaacgattggtcaaaggaaaaacagtttagaggccttcagtctaggatcgagcaggaacagaaattcactgtagtgcgagcagggcaagtggtccaaattcctgtcgcggaaatcgtggtgggagacattgctcaggtcaagtacggagacctgctcccagccgacgggctgttcatacaggggaatgaccttaagattgatgagtcaagtttgacaggcgagtcagaccaggtccgaaagagtgtggacaaagacccaatgctgctgagcggtacacacgtcatggagggctccggccggatgctggtgacagccgtcggggtgaacagtcaaacaggcattatttttacgctgctgggtgctggaggcgaagaggaagaaaaaaaggacaagaaaggcaaaatgcaagatggaaacgttgatgcctcacagagcaaagcgaaacagcaggacggtgcggccgctatggaaatgcagcccttgaagagtgccgaaggaggcgatgctgatgatcgcaaaaaagcctctatgcataagaaagagaagagcgtgctgcaggggaagctgaccaagctggcggtgcaaattgggaaggccggcctggtcatgtccgccattacagtcattattctcgtgttatattttacagttgacaccttcgtggtgaacaaaaagccttggctcccggagtgcaccccagtgtatgtccagtacttcgttaagttcttcatcattggcgtgacagtgcttgtcgtggcggtcccagagggattgcctttagcggtgaccatctccctcgcctattccgtcaagaagatgatgaaagataacaacctggtgcggcatctggacgcttgtgagacaatggggaacgctactgcaatctgctcagacaagaccggaacgcttacaacgaataggatgacagtcgtgcaggcttatgtcggagacgtgcattacaaagagatccccgacccctcctcaatcaatactaagactatggagcttctgattaatgctatcgccattaactcggcctatactaccaaaattcttccacccgaaaaggagggggccctccctagacaggttggcaacaagaccgagtgtggccttttggggttcgtgttagacctgaagcaggactatgaacctgtccggtcacagatgcctgaggaaaagctgtataaggtgtatacgttcaattctgtgagaaagtccatgagtactgtcatcaaactgcccgatgagtccttccgcatgtatagcaagggtgctagcgagatagttctcaagaagtgctgcaagatcttgaatggagccggcgaaccaagagtttttaggccgagagatagagatgaaatggtcaaaaaagtgatagagcccatggcatgtgatggcttgcgaaccatctgcgttgcataccgagacttcccttccagtcctgaaccggattgggataacgagaatgatattctgaatgaactcacgtgcatctgcgtagtcggaatcgaggatcccgtgcgccctgaagtacccgaggccatacgcaaatgccagagggcaggcatcacggttaggatggtcactggtgacaatataaatactgctcgggctatagctatcaagtgcggcatcatccaccccggagaagattttttgtgtctggaaggaaaggagttcaatcgaaggatccgcaacgaaaagggcgagatagagcaggagcgcatagataagatatggcccaagctgcgggtattggctcgatcgtcacccacagataagcataccttagtgaaggggatcattgactcgactcacaccgagcagaggcaagtcgtcgccgtgacaggggatggtactaatgatggacccgccctgaagaaggccgatgtcggctttgccatgggtatcgccggcacggacgtggccaaggaggcttccgacatcattctcactgacgacaactttagtagcatcgtcaaagcggttatgtggggccgaaacgtctacgactccatctcgaaatttctgcaattccagctgactgtgaacgtagtggctgtgattgtggcctttacaggggcctgcattactcaagatagcccgttaaaagcggtccagatgctttgggtgaacctcattatggataccttcgcctccctcgcccttgccactgaaccacctacagagacactgcttctcagaaaaccttacgggcggaacaaacccctgatttcacgcaccatgatgaagaacatcttgggtcacgctgtctaccagctggcactgatctttacattgctctttgtcggggagaagatgtttcagatcgattccggccgaaacgcaccattacactcaccaccttctgaacactatacaattattttcaatacatttgtgatgatgcaactattcaatgaaattaacgctcggaagattcacggagagcggaacgttttcgacgggatcttccgcaaccccatcttctgtaccatagtgctggggacttttgccatccaaatcgtaattgtgcagttcggtggaaagccattcagttgctcacctctacagctggaccaatggatgtggtgcatcttcattggcttgggagaattagtgtggggacaggtgatcgctacgatcccgacttcccggctaaaattcctgaaggaggctggtcgtctcactcaaaaagaggaaattcccgaagaagaactcaacgaggacgtagaggaaatagatcacgccgaaagagaactccgtcgcgggcaaatactgtggttcagaggcctgaacaggatccaaacccagattagggtcgtgaaggcttttagaagctctttatacgagggactcgaaaagccagaatcaaggaccagcatacacaatttcatggcccatcctgaattccggatcgaggactcacagccacatatacctttgatcgacgatacagacctggaagaggatgccgccctgaaacagaactctagccccccatcaagcctgaacaagaataatagcgcaatcgatagcgggatcaacctcactacagatacctcaaagagcgccacatccagtagtcctgggtctcccatccatagcttagagacgagtctttag

SEQ ID NO: 108981 - DNA, 3663 bp, Artificial Sequence
  Description of Artificial Sequence: Synthetic coding sequence
atgggtgacatggctaattcgtcaatcgagttccacccaaaaccacaacagcagagagatgtaccccaagcaggggggtttggctgcacactggccgaactacggacactaatggaactccgcggagccgaagctctgcaaaagatagaggaggcatatggtgacgttagcggcctctgtcgtcggctgaagacatcccctacggaggggctggcagataataccaacgacttagaaaagcggcgccagatttacgggcagaacttcatcccgccaaaacagccgaaaacattcctgcaattggtgtgggaagctttgcaagacgtgaccctgattattcttgaggtggccgctatagtctcattaggcctcagtttttacgctcctccaggagaggaatcagaggcctgcgggaacgtgtcaggaggagccgaagatgagggggaagctgaggccggttggattgagggagcagctatactgttgtctgttatctgcgtggtactcgtcacagctttcaacgattggagcaaggaaaaacagttcagaggattacagagcaggatcgagcaggagcagaagtttacggttatccgcaacgggcagctactgcaggtcccagtcgccgcactggtcgtgggtgatatagcacaagttaagtacggagacctgcttcccgcagatggggtgctgatacaggccaatgatttgaagatcgacgagtcctcactgacaggcgaatccgaccacgtccgtaaatctgctgacaaagatcctatgctgctgagcgggacccacgtaatggagggcagtggccggatggttgtaaccgccgtgggcgttaattcacagaccggcatcatcttcacgcttctgggagccggtggagaggaggaggaaaagaaagataaaaagggaaagcagcaggacggcgccatggagagttctcagactaaagctaaaaagcaggacggcgccgtggccatggagatgcaacctcttaagagcgcggaagggggggaaatggaggaaagagaaaagaagaaggccaatgctccaaagaaagaaaagtcggtgttgcagggaaaactgactaaactcgcagtgcagattgggaaggcaggactggtaatgagcgcaatcaccgtgattatcctggttctctattttgtgatcgagacctttgtagtcgagggccgcacgtggctcgcagagtgtacccctgtctacgtgcaatattttgtcaagttcttcattattggagtaacagtgctagtggtggcagtccctgagggacttccactcgctgtgacgatttccttggcatactcagtgaagaagatgatgaaagataacaatctcgtcagacacctggacgcctgcgaaaccatgggaaatgcaactgccatctgctcggataagaccggaaccctcacgacaaaccggatgacagtggtgcagagctatctcggagacacccattataaagagattcctgcgccgagtgctctgactccaaaaatcctagacttgcttgttcatgccatatctattaactccgcatacacaacaaagattctaccaccagaaaaggaaggagccttgcctcgccaggtaggtaacaagaccgagtgtgctttgctcgggttcgtgctggacctgaagagagatttccagccagttcgcgagcaaattcctgaggacaagctctacaaagtgtacactttcaattctgtgagaaagtccatgtccacagtgatccggatgcccgacggaggcttcaggctcttttccaaaggggctagtgaaatcctgctgaagaagtgcaccaacattctgaattctaatggcgaactcaggggctttaggccccgggacagagacgacatggtgagaaagatcatcgaaccaatggcctgtgacgggctgcgaaccatttgcatcgcatatcgcgatttcagcgccggacaggagcccgattgggacaatgaaaacgaagtcgtgggcgatttgacatgcattgccgtggtggggattgaagaccccgttaggcccgaggttcccgaagctatcaggaaatgtcagcgcgctggcattactgtcagaatggtgacaggcgacaatattaacacagctcgggctatagcagcgaagtgcggcattatccagccaggggaagacttcctctgcctcgaaggcaaggaatttaatcgacggatacgcaacgagaagggggaaatcgagcaggagcgcttggacaaggtatggccaaaattgcgcgtgctcgcgagatccagtcccacagacaagcatactctagttaagggtatcattgacagcacaaccggcgagcaacggcaagttgttgccgtgacaggtgatgggacaaatgatggacccgctctgaaaaaagcagatgtcggtttcgcaatgggcatcgcggggaccgacgtggccaaagaagccagtgatatcattcttaccgacgacaacttcacatctatcgtgaaggcagtcatgtgggggaggaacgtgtatgattctatatctaagtttttacagtttcagctcacggtgaacgtcgtggctgttattgtcgcttttacaggtgcttgtatcacacaggattcaccattgaaggctgtgcagatgctgtgggtcaacttaataatggatacatttgctagtttagcgctcgccaccgagccaccaaccgaaagccttctcttgcggaaaccctatggaagagataaacctctcatttctaggaccatgatgaaaaatatcctcgggcacgctgtctaccagcttgccattatatttactttgctgtttgtaggcgagttattttttgatatcgacagcggccgcaacgccccactgcacagtcccccaagcgagcactataccattatcttcaatacattcgtaatgatgcaactcttcaacgaaattaacgctcgtaaaattcacggagaaaggaatgtgttcgacggaatcttctccaaccccatcttctgtaccatcgtcctaggaacatttggcatccagattgtgatcgtgcagtttggaggcaagcctttcagctgctccccactgtcaacagagcagtggctctggtgtcttttcgttggggttggggagctggtgtggggacaggtcatcgcaactatcccaacctcacaacttaagtgtttgaaagaggccggccacgggcccggcaaggacgagatgactgacgaagagctggcagagggcgaagaagaaatagaccacgctgagagggagctccgaaggggccaaattctctggtttagaggattgaacagaatacagacccagattcgggttgttaaggcatttcgcagctccctctacgaaggtctggagaaacccgaaagtaagactagcattcacaactttatggccacacctgaatttctgatcaatgattatacacacaatatcccccttattgacgataccgacgtggacgaaaatgaggaacgccttcgcgcaccaccacctccaagcccaaatcagaacaacaacgccatagactcaggcatatacctgacaacccatgtcaccaagtcggctacatcttcagtgttcagttcttccccagggtcaccgttacactccgttgaaacttcactttag

SEQ ID NO: 108982 - DNA, 3663 bp, Artificial Sequence
  Description of Artificial Sequence: Synthetic coding sequence
atgggcgatatggcgaactcatctattgagttccacccaaaaccccagcagcagcgggatgtgcctcaagcaggcgggttcggatgcacgctggctgaactgcgcaccctgatggagctccgaggcgctgaggcactgcaaaagatagaggaggcatacggggatgtaagtggcctgtgccgcagattaaaaaccagtccaacagagggcctggccgataatactaatgatctggaaaagaggcggcagatatatggacaaaatttcattccacctaaacagcccaaaactttccttcagttggtctgggaggcactgcaagacgttaccctgatcattttggaggtagcggcaatcgtttccttgggcctgtccttctatgctccacccggagaagagagcgaggcatgcgggaatgtgagcggtggtgccgaagatgagggggaagccgaggctggatggatagaaggcgccgccatcctgctctcggtgatttgtgtggtcctcgtgacagcttttaatgattggtcaaaagaaaaacaattccgaggactgcagtcccgtattgagcaggaacagaaatttaccgtgataagaaatggacaactgctgcaggttcccgtggcggcactggtggtgggtgacatcgcccaggttaagtacggcgatctgctgcccgccgacggcgtcttaatccaggccaatgatctgaaaatcgacgaatcgagtctgacaggcgagagcgaccacgtgcggaagagcgccgataaggacccgatgttactctctggaacccatgttatggaggggagtggcaggatggtggtcacggcagtcggagtgaattcccagaccggaatcatcttcacccttttgggcgccggaggagaggaagaggagaaaaaggacaaaaaagggaagcagcaagatggagctatggagtcttcccagaccaaggctaaaaagcaagacggagcagttgccatggaaatgcaacctctgaagtctgccgaaggaggagagatggaagagcgagaaaaaaaaaaggcaaacgctcctaagaaggagaagtctgtactccagggtaaattgacaaagttggccgtccaaatcggaaaagctgggctggtcatgtccgctatcacagtgatcatactggtgctgtactttgtgatagagacctttgtagttgaaggaaggacctggcttgccgagtgcacaccagtgtatgttcagtacttcgtaaaattttttatcattggcgtgactgtgttggttgtggctgtgcccgaaggcctgccactggctgtgactatctccctcgcctactcggtgaagaagatgatgaaagacaataatctggtaagacacctcgatgcttgcgaaactatgggcaacgctacagctatttgtagcgacaaaactggaacccttactacgaacaggatgacagtcgtacagtcatacctcggggacacccactataaagagattccagccccttccgctctgacaccaaaaatcctggatttattggtgcatgccatatcaattaactcagcctacactaccaagatactgccacccgagaaggagggagcactgcccaggcaggtaggcaataaaaccgaatgtgccctcctcggcttcgtcctggatcttaagcgcgatttccagcctgtgagggagcagatacccgaggacaagttgtataaggtatatacattcaattcagtgcgcaagtccatgtccacggtgattagaatgcctgatggcggattcaggctattctcaaagggcgcaagtgagattctgctgaaaaagtgtaccaatatcctgaactcaaacggtgaacttcggggattcaggcctagggaccgggacgatatggttcgaaaaattattgaacctatggcttgtgacggcctcagaactatttgcatcgcttatcgagatttttctgccggccaggagcccgattgggataacgagaatgaggtggtcggtgacctaacgtgcatcgctgttgtaggtattgaggaccctgtacgtcctgaagttcctgaggctattaggaaatgccagcgggccgggatcacggttcggatggtcaccggagacaacatcaatacggcgagagccatagcagccaaatgcggcatcattcaaccaggtgaggattttttgtgtctagagggcaaagagtttaatcggaggatacgcaacgagaagggcgaaatcgagcaagaacggctggacaaggtgtggccaaaactccgagttctagccagatcaagcccaaccgacaagcatacgctggtgaaggggatcatcgactccacaacaggtgaacagagacaagttgttgccgtgaccggagacggcacaaatgatggcccagccctcaagaaagcagacgttggcttcgccatgggaatcgcaggcacagacgttgcaaaagaagcctcagacattattctcacagacgataattttacttctatcgtgaaagccgtgatgtgggggagaaacgtgtatgattccatctctaagtttctgcagttccaactcactgtcaatgttgtcgccgtcattgttgctttcaccggtgcatgtatcacacaggacagcccgctcaaggcagttcagatgctctgggtcaacctgatcatggacacattcgcaagcctagctctggctactgagccgcccacagaatccttgctcctgcggaagccatatgggcgggataagcccctcatctcacggactatgatgaagaatattctgggtcacgccgtgtaccagctggcaattatctttacactgctctttgtcggagagctgtttttcgatatcgactcagggaggaacgctccgttgcatagccctccttctgaacattatacaataatcttcaatactttcgttatgatgcagctgttcaatgaaattaatgcaaggaaaatccacggagagcggaacgtctttgacggcatttttagcaatcccattttctgtaccatcgttctggggactttcgggatccaaatcgtaatcgtccagttcggcggaaaacccttctcctgtagtcctctgtcgacagaacagtggctgtggtgtctgttcgtcggggtgggagaactggtctggggccaagttattgctaccatacccacgagccaactcaaatgcctcaaagaggcgggccacggtcccgggaaggacgagatgaccgacgaggaactggcagagggggaagaggagatcgaccatgcggaacgagagctgcggcgaggtcagatattatggttcagagggctgaatcgcattcagacgcaaattcgggtggtcaaagccttccgttcaagcctgtacgagggcctcgaaaaaccagagtccaagacctcaattcataatttcatggccacccccgaattcctgattaacgattatacccataatattcctttgattgacgacactgatgtcgacgagaatgaggaaaggctgagggcacctccccccccatcacccaaccagaataacaacgccattgacagcggcatttaccttaccacgcacgtgactaaaagcgcaacaagtagcgtcttttccagcagcccgggatcccctctgcacagcgtcgagacttcgttatag

SEQ ID NO: 108983 - DNA, 3522 bp, Artificial Sequence
  Description of Artificial Sequence: Synthetic coding sequence
atgggtgatatggcgaacagctccatcgaatttcaccccaaaccccagcaacagcgtgacgtgccgcaggccgggggctttggctgtactctggcggagctgagaacactgatggaattaagaggggccgaggctctgcagaaaattgaggaagcgtatggggacgtgtccggcctatgtagaagactaaagacgtctccaacagaaggtttggccgataacactaacgatctggaaaaaagaaggcaaatctatgggcaaaactttataccacccaagcagccgaagaccttcctgcaactggtgtgggaagcactacaggatgtcactctcataatcctcgaggttgcagctatcgtctccctgggcctgtcattttatgcccctcctggcgaggaaagcgaggcttgtggcaatgtgtcaggcggcgccgaagacgaaggtgaagccgaagccggctggatagaaggtgctgcaatcctactgagtgtgatatgcgtcgtcctggtgactgccttcaatgattggagcaaagagaagcaattcagaggcctccagtcgcgtatcgaacaggaacagaaattcactgtaatccggaacggacaacttctccaagtgcccgttgctgccctggtggtcggagatatcgctcaggtcaaatacggggatctcttgccagcagacggcgttctgatccaagcaaacgacctgaaaattgatgagagctccctcacaggtgagtcagaccatgtccgcaaaagcgcagacaaggaccctatgcttctgagcggcactcacgttatggagggatcaggcaggatggtagttacagccgttggcgtcaactcgcaaaccggaattatctttaccctgctgggtgccggcggagaggaggaagagaagaaagacaaaaagggcaagcagcaggacggggccatggagtccagccagacaaaagccaagaagcaggacggcgccgtggctatggagatgcagcctcttaaaagcgctgagggaggggagatggaggagagagagaaaaaaaaagccaacgcacctaaaaaagaaaagtcagtcttgcagggcaaactgaccaaattggccgtgcagattggaaaggcaggactcgttatgtcagctattaccgttattatcctggtgttgtattttgtaattgagacattcgttgtagaagggcgaacgtggttggccgagtgcactcccgtttacgtccagtattttgtgaaattcttcataatcggcgtcacagtcctcgtggtggcagtaccagagggcctgccgcttgccgtgacaatatctctggcttacagcgtaaagaaaatgatgaaagataacaatcttgtcagacacctcgacgcctgcgagacaatgggaaatgctacggctatatgttctgataaaacgggaaccctaacgaccaatcggatgactgtagtccagtcttacctgggcgacacgcattacaaagagatacccgcaccaagcgccctaactcctaaaatccttgacttacttgtccacgccatctctatcaactccgcctacactacaaagattctgccacccgagaaggaaggcgctctccctcgccaagttgggaacaagaccgagtgcgcacttctgggttttgtcctggacctcaagagagacttccagccagtgcgcgagcaaattcccgaagataagctgtacaaggtgtacactttcaattccgtgcggaagtctatgagcactgtcattcgcatgcccgacggcggcttcagattgttctccaaaggagcctctgagattctgctgaaaaaatgtaccaacatcctgaattccaacggggagctgaggggctttaggccacgggatcgggacgacatggtgaggaaaatcattgagcctatggcgtgcgatggcttgcgcactatttgtattgcctaccgggactttagcgccggacaggagcccgactgggacaatgagaacgaggtggtgggggaccttacctgtattgccgtcgtgggaattgaagatcccgttcgcccagaagtgccagaggcaatacgcaaatgtcagcgggccggtatcaccgtccggatggtgacgggcgataacatcaacactgctagagcaatcgccgccaaatgtggaattatccagcctggagaggactttttgtgcctggaaggaaaggagttcaaccggaggatacgcaatgagaagggggagattgaacaggagagactggacaaagtgtggcctaagttgagggtgctcgcccggagctcccccacggataagcataccttggtgaaaggcattattgacagtactacaggggagcagaggcaagtggtcgcagtcacaggagacggaacaaacgatggcccagcgctgaaaaaggcagatgtgggctttgcaatgggtatagccgggaccgatgtggctaaggaagctagcgatatcattctgacggatgataacttcacgagcatagtcaaagcagttatgtggggtaggaacgtgtacgattctattagcaagtttctccaattccagttaacagtcaatgtggtagctgtcatcgtggctttcacaggagcctgtatcactcaagactcccccttaaaagccgtccaaatgttgtgggtgaacctaattatggatacctttgctagccttgccttagccacagagccgcccactgaatcactgctgcttagaaagccatatggaagagacaaaccactcatttcaagaaccatgatgaaaaacatcctgggacacgccgtgtaccagctcgctatcatttttaccctcctatttgtaggtgagctcttctttgatatagacagcggcagaaatgcccctctccacagtcctccttcagagcattatactatcatattcaatacatttgtgatgatgcagctcttcaatgagattaacgcacgaaagatccatggtgagcgtaacgtttttgatggaatctttagcaaccccatattttgtacaattgtgttaggcacttttggcatccaaattgtaatcgtccagtttggcggcaagccgttttcctgcagccctttaagcactgagcagtggctctggtgcctctttgtaggcgtaggggaattagtttggggacaagtcatagccacgatccccacatctcaactgaaatgtttgaaggaggccgggcatggccccggcaaagacgagatgaccgatgaggaattggccgagggcgaggaggaaattgatcacgctgaaagggagcttcgcaggggtcaaatcctctggtttcgcggactgaaccgcatccagactcagatggaagttgtgtcaacattcaagcgctccggctcggtacagggggccgtgaggcggcgctcaagcgtactgagccagctgcacgacgtaacaaacttgtccactcccacgcacgcgatactctctgccgcaaatcctacgtccgccgcgggcaacccaggaggcgaaagcgttccttag

SEQ ID NO: 108984 - DNA, 3480 bp, Artificial Sequence
  Description of Artificial Sequence: Synthetic coding sequence
atgggggacatggctaactcatctatcgaatttcatcccaagccgcagcagcagagggatgtaccccaagccggcggattcggctgcaccctggctgaactacgtacactaatggagttgaggggggcagaggccctgcagaagattgaagaggcatatggggatgtgagtggattgtgccgacggcttaaaaccagcccaacagagggtctcgcagacaatactaatgacctggaaaagaggagacagatttatggtcagaatttcatcccaccgaaacaaccaaaaacctttctacaactggtttgggaggctcttcaggacgtcaccctgatcatcttagaggtggcagcgatcgtgtctctcgggctctctttctatgcaccacccggcgaagagtccgaggcctgtggtaacgtcagcggtggcgcggaagatgagggtgaagcagaggctggatggatcgagggcgctgccatccttctgtccgttatttgcgtcgttcttgtgactgctttcaatgattggtcaaaggagaaacagtttcgcgggctgcagagccggatcgagcaagagcagaagtttactgttatccggaatgggcagctgctgcaggtaccagtggcagccctggtggttggcgatatcgcccaggtaaagtatggagatttactgcccgccgacggggtgctcattcaagcaaatgacctaaagatagacgagtcaagcttgactggggaatctgaccatgttagaaagtctgccgataaggatcctatgctgctgtccggcactcacgtcatggagggcagcggcaggatggtcgtcacagctgtaggggtcaactcccaaaccggcattatctttacacttctcggagctggcggggaggaggaggagaagaaggacaaaaaagccaaaaagcaggacggagcagttgccatggaaatgcagcccctgaaaagcgcagaagggggcgaaatggaggagcgcgaaaagaaaaaagctaacgcccccaaaaaggaaaaatccgtcctccaaggcaagcttaccaaactggctgtgcagatcggaaaggcgggactggtcatgtcagctattactgtaatcatcctcgtgttatattttgtgatagagacatttgtggtggagggaaggacttggctggcggaatgtacgccggtttacgtgcagtatttcgtgaagttcttcattattggagtgacggtcctggtggtcgcggtccccgaagggctgcccttagcagtaacgattagcttggcctattcagtcaagaagatgatgaaggacaataatctcgtgaggcacctcgatgcatgcgagaccatgggaaatgcaacagcaatctgctcagacaaaactggaactctgacaacaaaccggatgactgtggtgcagagctatctgggtgatactcactacaaggagatccccgcccctagcgcactgacgcccaaaattttagatttgttggtacacgccatttcaattaactcggcttacactacgaaaatcttaccaccagaaaaagaaggggccttaccccggcaggtgggaaataagaccgagtgcgcgctgttaggatttgttcttgaccttaagagggatttccagccagttagagagcagatcccagaggacaagctgtacaaggtgtatacattcaactccgtccgaaagtctatgtccaccgttatccgaatgcctgatggcggattcagactgttctccaaaggagcctctgagattcttctgaagaaatgcactaatattttaaatagcaatggcgaactcagaggctttaggccccgggacagggacgatatggtcaggaaaatcattgaacccatggcctgtgacgggctacggaccatatgtatcgcttatcgagacttctctgccgggcaggagccagactgggacaacgagaacgaggtggtcggagatttaacttgcattgctgtggtgggaatcgaggaccccgttcggccagaggtacctgaggccataagaaagtgtcaaagagcaggcataacggtcaggatggtcacaggcgataacatcaacactgcccgggccattgccgccaaatgtggaatcatacaacccggtgaggattttctgtgcctggaaggcaaggagttcaatcgacgcattcgaaatgagaagggcgagatcgagcaggaaaggctggataaagtttggccaaagctgcgcgttctggccagatctagccccaccgacaagcatactctggtaaagggaatcatcgactcaactaccggagagcagcggcaggtagtggctgtgaccggagacggcacaaatgacggacccgccctcaaaaaagccgacgttggtttcgcgatggggatcgcaggcaccgacgtcgcaaaggaagctagtgatattattcttacagatgataattttacctctatcgtcaaagcagtaatgtgggggagaaacgtctatgactcgatatctaagtttttgcagtttcagctaacagtaaacgtagtcgctgtgatcgtggctttcaccggcgcatgcatcactcaggattctcccctgaaagccgtccagatgctgtgggtgaacctaataatggatacgtttgcaagcctggccctcgcaacggaacctcctacagagtcgctgctgctaagaaagccctacggcagagataaaccactaatcagtcgcactatgatgaagaatatactcggtcacgctgtgtatcagttggcaattatcttcactttgctgtttgtgggggagcttttcttcgacattgatagtggtaggaatgctccccttcattctccacccagtgagcactacactatcatatttaatacattcgttatgatgcagcttttcaatgagattaatgccaggaagatccacggggaacggaatgtcttcgacggcatattttcaaatccaatcttctgtaccattgtgttagggacatttgggatacagatagtgattgtccagtttggggggaagccattctcctgttcccctctctctactgaacaatggttgtggtgcctgtttgttggcgtcggggaattagtgtggggccaagtgattgccaccattcccacttctcagctcaagtgcttgaaggaggcaggccatggcccaggaaaggatgagatgactgatgaggagctggccgagggcgaagaggagatcgaccatgccgaaagggaactgcggcgtgggcaaatactgtggttccgcggactcaatcgcattcagactcaaatggaagtggtgtcgacatttaagagatccgggtccgttcaaggagctgttcggagaaggagtagcgtactctctcagcttcacgacgtaaccaacttgtccacccctacacacgcaatcttaagcgcagcaaatcccacatctgctgccggtaatccggggggcgagagtgttccatag

SEQ ID NO: 108985 - DNA, 3480 bp, Artificial Sequence
  Description of Artificial Sequence: Synthetic coding sequence
atgggagacatggcaaacagtagtatcgagtttcatccaaaaccacagcagcaacgcgatgtgccacaggcaggtggtttcgggtgcacattggcggagctccgaactctgatggagctaagaggagctgaggcactgcaaaaaattgaggaggcatatggagacgtgtccgggctctgtaggagactgaagacgagcccgactgaaggactggccgacaatacaaacgacctggagaagcgccgacagatttatgggcagaatttcatcccaccgaaacaacccaaaacgttcctccagttagtctgggaggccctgcaagacgtcaccttgatcatattggaggttgccgcaatcgtgtccctggggctctcattttatgcaccacccggcgaagagagtgaagcctgcggtaatgtttccggtggcgccgaggacgaaggggaggctgaagccggctggattgaaggcgccgcaattttgttaagcgtcatctgtgtggtgttagtgacagccttcaacgattggtcaaaagagaaacagtttcgcggtctgcaatcccggattgagcaggaacagaaattcaccgttatccgaaacggccagcttttgcaggtgcccgtagctgccttggtggtcggcgacattgctcaggtgaaatacggcgatcttctgcccgccgatggagtgctaatccaggctaatgacctcaaaatagatgaatctagcctgacgggcgagtccgaccacgtaagaaaatcagcagacaaagatccgatgttgctgagcgggacacacgtcatggagggcagcgggcgtatggtcgtcaccgcagtgggggtcaactcacagactggcatcattttcactctcttgggagctggcggcgaagaggaggagaaaaaggataagaaggccaagaagcaggacggagccgtcgccatggaaatgcagcccctgaaatccgccgagggcggagagatggaggagagagagaagaaaaaggccaacgcccctaaaaaggagaagtctgtactccaagggaagttgactaagctggccgtacaaatcggcaaggccggactggtcatgtcagcaatcacagtgattatcctcgtattatactttgtgatcgaaacattcgtggtcgaggggcgcacctggctggcagaatgcacaccggtatacgtgcagtattttgtcaaattcttcataattggggtgacagtgctcgtggtggccgtgcctgagggcttgcctctggccgttacaatttcactggcctactccgtcaagaaaatgatgaaggataacaatctggtgcgacacctggacgcttgtgagaccatgggcaacgcgaccgcaatctgctccgacaagactggcactttaaccactaacagaatgacagtggttcagagctatctcggggacacccattataaagaaatacccgcacccagcgccctgacccctaaaattctggacctgcttgtccacgcgatcagcattaattctgcttataccaccaaaatcctccccccagagaaggagggggctctgcccagacaggtgggaaataagacagagtgtgctttgctgggctttgtgttagacctcaaaagagatttccagccagtgagggaacaaatcccagaagacaaactgtacaaggtctacactttcaattctgtcagaaaaagcatgtcaaccgttatcagaatgccagatggcggcttcaggctctttagtaaaggagcttcagaaatcctgctgaaaaaatgcactaacatcctgaacagtaacggagagctgcggggattcaggccgcgcgaccgggatgatatggtgcgtaagatcatagaacccatggcatgtgatggactccgaactatctgcatcgcatatcgagatttcagcgcagggcaggaacccgactgggacaacgaaaacgaggtggttggggatctgacatgtattgccgttgtgggcattgaagaccccgttagaccagaggttccagaagccatccgcaagtgccagcgcgctggcattactgttcgcatggttaccggcgacaacattaatacagcccgggctattgcggccaagtgcggcattatccaaccgggagaggacttcttgtgtctggagggcaaagaatttaataggcgcattcgcaacgagaagggtgagatcgaacaggaacgcctggacaaggtgtggcccaaactgcgcgtgttggcccggagtagcccgaccgataagcacacgctggtaaagggaatcatagactccaccacgggcgaacaacgacaggtggtggcagtgaccggcgacgggactaatgacggccccgctctaaagaaagctgacgttgggttcgccatgggtatcgcggggacggatgtggcgaaagaggcaagcgacataatactgaccgacgacaactttactagcatcgtgaaggcggttatgtggggacgcaacgtgtatgactcaatctccaagttcctgcagttccagcttactgtgaacgtggtggcagttatcgtcgcttttactggagcatgcattacgcaagactccccccttaaggctgtgcagatgctctgggttaacctcatcatggatacgttcgcctccttggcactcgctaccgagccacccaccgaatcgttgctactccggaagccctatggaagagacaaaccactgatctcgagaaccatgatgaagaatatcctgggacacgcagtgtatcagttggcgataatcttcaccctgctgttcgtaggagagttgttctttgatatcgatagtggacggaatgcccccctccactcacctccttccgagcattatacaataatcttcaacacgtttgtgatgatgcagttatttaacgaaatcaacgcgcgtaagatccacggagagcgtaatgtcttcgatggtatcttctctaaccctatcttctgcaccatcgtgctgggaacatttgggatccagatcgtcatcgtgcagtttgggggcaaaccattctcctgttcaccattgtccactgaacaatggttatggtgcctgtttgtgggggtgggtgaactggtctggggtcaggtgatcgctactatacccactagtcagttaaagtgcttaaaggaggctggccacggtccaggaaaggatgaaatgacagacgaggagctggctgagggggaggaagagatcgatcacgccgaacgggaattaaggcgaggtcagattctttggttccggggacttaaccgcatccagactcagatggaagtggtgtctacctttaaacgcagtggctccgtgcagggtgcagttcggagacggtctagcgtgttgagccagctgcatgacgttaccaacctgtccaccccaactcacgcaattctttctgcggctaatcccacatccgcagctgggaatcccgggggagagtccgtaccttag

SEQ ID NO: 108986 - DNA, 3465 bp, Artificial Sequence
  Description of Artificial Sequence: Synthetic coding sequence
atgggggatatggccaattcctccattgagtttcaccctaagccacaacagcagagggacgtgccccaggcaggcggcttcgggtgtaccctggcagagctccgtacactaatggagcttcgtggggcagaggccctgcagaagatcgaagaagcttacggggacgttagcggactttgtaggagacttaagacttctcccaccgagggcctggcagataataccaacgatcttgagaaacgcaggcagatctacggacaaaatttcatcccccctaaacagcccaaaacgtttttacagcttgtgtgggaagccctgcaggatgtcactttgattattctcgaagtagcagcaatcgtgtcccttggtttgagcttctacgcccctccaggggaagagtctgaggcttgcgggaacgtgagcggtggagcagaagatgagggggaagccgaggctggttggatcgagggcgcagctattctgctgagtgtcatctgtgttgtgctagtgacagccttcaatgattggtcaaaagagaaacagttcaggggcctccaatccaggattgagcaagaacagaaattcacagtgatccgaaacggtcaactcctgcaggtgcctgtggcggctctggtggtgggcgatatcgctcaggtgaagtacggcgaccttttaccggcagacggcgtcttgatccaggccaacgacctgaagatagacgaatcgtcactgaccggcgaatctgaccacgtgcggaaatctgccgataaagacccaatgctactaagtggaactcacgttatggagggatctggtagaatggtcgtcaccgctgtcggcgtcaattcacagacggggataattttcacactgctaggagccggaggggaagaagaggaaaaaaaggacaaaaaagcaaagaagcaagacggggcagtggcgatggagatgcagcctctcaagtccgccgagggtggagaaatggaggagcgtgagaaaaagaaagccaacgcccccaaaaaagaaaaatctgtacttcagggcaagttgactaagcttgctgtgcaaatcggaaaggctggtctggtcatgtccgccataacagtcataatcttggtgctgtacttcgtgatagagacgtttgtggttgaagggagaacatggctagcggagtgcacacccgtgtacgtccagtacttcgttaagttcttcatcataggagtcaccgtcctggtcgtggccgtgccggaaggactaccactggcagtgaccatctccctcgcatattcagtcaagaagatgatgaaagacaataacctggtccggcatctggatgcatgtgagaccatggggaatgccactgccatttgctccgacaaaacgggaaccctgacgaccaatcgcatgacagttgtgcagagctacctcggagatacccattataaagaaattccggcgccgtctgcgctgacaccaaagattcttgacctgctggtccatgccatttccatcaactccgcatacactaccaagatcctgccacctgaaaaagagggtgccctcccgcgccaggtggggaacaagacggaatgcgccctgctgggttttgtcctcgatctcaagagggatttccaaccagtgcgcgagcaaatccctgaggacaagctgtacaaggtttacaccttcaatagcgtccggaagtctatgagcacagtgatccgaatgcctgatggcggttttaggctctttagcaaaggagccagcgaaattttactgaaaaagtgcactaacattctcaatagcaacggtgagctacgggggtttcgccctagagaccgcgacgatatggtgcgcaagattatagagccaatggcatgtgacggactgagaacgatctgcatcgcttatagggatttctccgctggacaggaaccggattgggataacgagaacgaggtcgtgggtgacctgacatgtatagcggtcgtcggtatcgaggaccctgtgaggccggaggtccctgaggccatccggaagtgccagcgagctggcataacagtacggatggtgactggcgacaacatcaacaccgctcgtgccatcgccgctaaatgtggcatcatccaacctggagaagactttctgtgtctcgagggcaaggagttcaaccggaggatccggaatgagaaaggggaaatcgaacaggaaagactggacaaagtgtggcctaagctgagagtcctcgcccggtcatccccaacggacaaacacactctcgtgaaagggatcatcgactctaccactggcgaacaacgacaggtcgtcgctgtgacgggcgatggcacaaacgacggacccgctctgaaaaaggcggacgtgggatttgccatgggcattgcgggcaccgacgttgccaaggaggcatctgatatcatactcacagacgataatttcacctcgattgtcaaagccgtaatgtggggaaggaatgtgtatgactccatatcaaagttcctgcagtttcagctaacggtgaatgtggtagccgtgattgtcgccttcaccggagcttgtattacacaggactctcctttgaaggccgtgcagatgctgtgggtgaatttgataatggacacttttgcctctctggcactggctactgaacctcctactgaatcccttctgctgcgaaaaccttacggccgagataagcctctcattagtcgcacaatgatgaagaatattctgggccacgctgtttatcaactggccattattttcactctcctgtttgtcggagagctgttttttgacatcgacagcgggcggaatgccccactgcacagtcccccatcagagcactacactattatattcaacactttcgtgatgatgcaattattcaatgaaatcaacgcccgtaagatacatggggaacgtaacgtgtttgatgggatcttcagtaaccccatcttttgcaccatcgtgctcggaacctttggaatccagatcgtaattgtccaatttggcgggaagcccttctcttgctcacctctgagcaccgagcagtggctgtggtgtctgttcgttggagtgggggagctcgtgtggggccaagtgattgcaacaattcccacctcccagctgaagtgcctgaaagaggccggtcatggccccggaaaggacgagatgaccgacgaggagctcgccgagggggaagaggagatcgatcacgctgaaagagagctcaggagaggtcaaatcctctggttccgcggcctgaatcgcattcagactcaaatggaagtagtgagcactttcaaacgcagcgggtccgtgcagggagcggtgcgccgacggagctctgtgctatctcaactccacgacgtcactaatctctccacacccacacacgcgatcctgagtgccgctaacccaaccagcgcagccggttctgagagctag

SEQ ID NO: 108987 - DNA, 3513 bp, Artificial Sequence
  Description of Artificial Sequence: Synthetic coding sequence
atgaccaatcctagcgatcgggtcctgcctgccaatagtatggccgagagtagagaaggcgacttcggctgcactgttatggaactgaggaagcttatggagctccgatccagggacgccttaacacagatcaacgtgcactacgggggggtgcaaaacctgtgttctcggctgaaaacttctccggtcgaggggctctccggtaaccccgcagacttggaaaagagaagacaagtctttggccataatgttattcccccgaaaaagcccaagacattcctggagttggtctgggaggctctgcaagacgtgactctaatcattcttgaaatagcagccatcatttccctggtgctgagcttctatcgtcctgcaggcgaagaaaacgaactctgcggacaggtagccacaacccccgaggatgaaaatgaggcacaagccggttggatcgagggggccgccattctgttttctgtcataattgtagtgctcgtcacggcttttaatgactggtcaaaagaaaagcagtttagaggcctgcagtgtcgcatcgaacaagagcagaagttcagtataatcaggaatgggcaactgatacagctgcctgtggcggaaatagttgtgggtgatatcgcccaagtgaagtacggagatctgctgcccgcggacggcatactgatccaggggaacgacctcaaaatcgatgagagcagcctaacaggagagagcgaccatgttaagaagtcattagacaaagatcctatgctcctgtcaggaacacacgtgatggagggatctggcaggatggtggttactgcagttggcgttaactcacaaacaggtatcattctgacgctgctcggggtcaacgaggatgacgagggcgaaaagaagaagaagggaaaaaaacagggggtgccagagaaccgcaataaggctaaaactcaggatggagtggctttagaaatccagccattgaactcccaggaagggatcgataatgaagagaaagataagaaagccgtgaaagtaccaaagaaagagaaaagcgtcttgcagggaaagctgacaagactggctgttcagatcggaaaggccgggctgctgatgtccgcgctgactgtgtttattttgattctatacttcgtgattgataacttcgtaattaataggcgaccttggctcccggagtgcacccctatttacattcaatattttgtgaaattcttcatcattgggatcaccgtcctggtagtggcggtgcctgagggactcccattagccgtgaccatctctctggcatactccgtaaaaaaaatgatgaaagacaataatttggtgagacatctagatgcttgcgaaacaatgggaaatgccacagcgatttgctctgataagactggcactctcaccatgaatcgtatgactgttgttcaagcatacattggtggcatccactatcggcagattccaagccccgacgttttcctccccaaagtcctggatctgatcgtgaacgggataagtatcaattccgcgtatacatcaaagatccttcctcctgaaaaggagggtggtctgccacggcaggtcggcaataagacggaatgcgctttactcggctttgtgacagatctcaaacaggactatcaggcagtacgcaacgaggtgccagaagaaaagctgtacaaggtgtatacattcaactctgtgcgcaaatccatgagtaccgttattaggaaccctaacggcggtttcagaatgtactccaaaggtgcatccgagatcatccttcggaaatgtaataggatccttgacagaaagggtgaagctgtgcccttcaaaaataaggacagagatgacatggttaggactgttattgagcccatggcgtgcgatgggttgaggaccatatgcatcgcatacagagactttgacgacactgaaccatcttgggataatgagaatgaaatcctgaccgagctgacgtgcatcgctgtggtgggaattgaagacccagtgagacctgaagtccctgacgctatcgcgaagtgcaagcaggcagggatcactgtgcggatggtaaccggtgataatataaatactgcccgggctatagctactaaatgcggtatactgaccccgggtgacgactttttatgtctagagggcaaggaattcaacagactgattcgtaacgagaagggtgaggtggagcaagaaaagttagataagatttggcccaagttgagagtgctggctcgttcttccccaactgataaacatacccttgtgaagggcattattgacagtactgttggcgagcaccgacaggtagttgctgttactggcgatgggacgaacgacgggccagctcttaaaaaagccgatgtgggttttgccatgggaatagctggaaccgacgtggccaaagaggcttccgacataattctgacagacgacaattttaccagtattgtgaaggctgtaatgtggggtagaaatgtgtatgactctatatctaagtttctccagttccagctgaccgtcaatgtggtcgccgtgattgttgcttttactggagcctgtatcacccaagacagcccacttaaggcggtgcagatgctctgggtgaaccttatcatggacaccttcgccagcctcgccctcgcaacagagccacccactgagagtttgctgaagcggagaccttacgggagaaacaagcccctcatatcacgcactatgatgaaaaacattctcggccatgcgttctatcagcttattgtgatttttatactggtgtttgctggggagaagtttttcgatatagattccggacgaaaagctccgctccattcaccaccaagccagcattatactattgtatttaacacatttgtactgatgcaattgtttaacgagatcaattcaagaaagattcatggggaaaaaaacgtattctctggtatctaccggaacataatcttttgttccgtggtcctcggaacgtttatttgccagatctttatcgtcgagttcggaggcaaacctttttcttgcacctcactcagcctgagccagtggctttggtgcctgttcatcggtattggcgagctgctgtggggccaattcattagtgctatccctacgcgctccctgaaatttctaaaagaggccggacacggcacaaccaaagaggagattacaaaagacgcagaagggctggatgaaattgaccacgcggagatggaactgagaagagggcagatcttatggtttagggggctcaatcgcatccagactcagattgatgtcattaataccttccagaccggagcctcatttaagggcgtgctcaggagacaaaacatgggacagcatttggatgtgaaactggtgccttcatcttcatatgtggccgtcgcccccgtgaaatcctccccgacaacttcggtccctgccgtttccagtcctcctatgggcaaccagtccgggcaatcggtcccttag

SEQ ID NO: 108988 - DNA, 390 bp, Artificial Sequence
  Description of Artificial Sequence: Synthetic coding sequence
tagattggagagcttctttggggccaattcatctctgcaatccccactaggagccttaaattcctgaaggaagccggacatggcactaccaaggaggaaatcacaaaggatgcagaaggcctggacgagatagaccacgctgaaatggagcttaggcgcggccaaatactatggtttcgcggacttaaccgcatccaaacgcagatcgatgtgatcaatacatttcagactggggcctcttttaagggagtgctcagacgacagaacatgggccaacacctggacgtgaaacttgtgccttcatcatcctacgtggctgtagcccctgtgaagtcgtctcccactacctcagtgcccgccgtgagttcaccccctatggggtctgagtag

SEQ ID NO: 108989 - DNA, 3618 bp, Artificial Sequence
  Description of Artificial Sequence: Synthetic coding sequence
atgacaaacccctcagaccgtgttctcccagccaattcaatggcggaatccagagaaggcgatttcggatgtaccgtgatggaactgcggaaactgatggaattaaggtcccgggacgctttgacccagattaatgtgcactatgggggcgtacagaacctctgtagcaggttgaagacatcacccgtcgaggggttgtcgggcaatcctgcagacctcgaaaagcgccggcaggtattcggccacaacgtcatccccccaaaaaaaccgaagaccttcctggaacttgtgtgggaagctctgcaggatgtcacgcttattattttggaaatcgccgccatcatttccttggtgctgagtttctataggccagcgggagaggaaaacgaactctgcggccaggtcgcaactaccccagaggatgagaacgaggcgcaggcaggttggatagagggggccgctatcctcttttcggtgattatagtggtccttgtcactgcctttaatgactggtcaaaggaaaaacagttccgggggttgcaatgtcgaatagagcaggaacagaaatttagcatcatccgcaacggtcaactcatccaactgcccgtggccgagattgtggtcggagacattgcccaggttaagtacggagacctgttgcctgctgacggcatcctgatacaagggaatgatctcaagatcgacgaaagctctctcactggcgagtcagatcatgtaaaaaagtctcttgacaaggaccctatgctcttgagtggtacccatgtcatggaaggtagcggacgtatggttgtgacagccgtcggcgttaactcccaaacaggcatcattctcacgcttctcggtgtaaacgaagacgacgagggtgaaaaaaagaaaaaaggcaagaagcagggtgtcccggagaacaggaataaggccaagacacaggatggcgtggcgctggagatccagccactgaacagccaggaggggatcgataacgaagagaaggacaagaaagctgtgaaggtgccaaaaaaagaaaaatccgtcctccaaggcaaactgactcgtctggccgtgcagattggcaaggccggactcctcatgagcgccctcactgtgtttattctgattctttactttgtcatcgacaactttgtcatcaacaggcgtccctggctcccagagtgcactccaatttacatccagtattttgtcaagttcttcataatcggaatcacagtgctggtggtggccgtccctgagggactacccttggccgtgacgatctccttggcttatagtgtgaagaagatgatgaaggataacaacctcgtgcggcatctggatgcctgcgaaaccatgggcaatgctaccgctatttgttcggataaaacagggaccctgactatgaaccgcatgactgtggtgcaagcctacatcggaggcattcattaccggcagatacctagcccagacgttttccttccaaaggtcttggacctgattgtgaacggcatcagcatcaatagcgcatacactagcaaaatcctcccaccagaaaaagaagggggtttgccacgccaggtgggaaataagacagagtgcgcccttttgggattcgtgacagatctgaagcaggactaccaagccgtgaggaatgaggtgcctgaggaaaagctgtataaagtttatacatttaattcagtgcgcaagagtatgtcgactgtgattcgaaatccaaacggggggttccgcatgtacagtaagggagctagcgaaataattctgcggaagtgcaataggattttagaccgtaagggtgaggccgttccatttaaaaataaggatagggacgacatggtcaggacagtcatcgagcctatggcttgcgacggtctgaggaccatttgtattgcttaccgcgatttcgacgacactgagccaagttgggacaatgagaacgagatcttgacggaattgacctgtatcgcagtggtgggaattgaagacccagtcaggcccgaggtccctgatgccatcgctaagtgtaaacaagcaggcatcaccgtgcgtatggtcaccggggacaacatcaacacggccagagccatagccactaaatgcgggattctaactcccggagacgattttctctgcctggagggaaaggagtttaacaggctgatcaggaatgaaaagggcgaggtagaacaggaaaagttggacaagatctggcccaagctgcgcgtcctagcgcgaagttcacctactgacaagcatacacttgtaaagggcatcatcgacagcaccgtgggggagcaccgccaagttgttgccgttactggagacggcaccaacgatgggccggctttaaagaaggccgatgtcggattcgctatggggatcgccgggactgatgttgcaaaagaggctagtgacatcatactgacagatgataacttcacctccattgtaaaagcagtcatgtggggacgcaatgtctacgattcaatctcaaagtttctccaattccagctgacggtgaatgtcgttgccgtaatcgttgcttttaccggggcatgcatcacccaggattccccacttaaagcagtacaaatgctgtgggttaacttgataatggacacattcgcaagtttagcattggccaccgagcctccgacggagagcctactcaagagaagaccctatggtagaaataagcctctgatctcacggaccatgatgaaaaatatactcggacacgcgttctaccagctgattgttatttttatacttgttttcgctggggagaagtttttcgacattgatagcggtcgcaaggctccacttcatagcccgccctcacagcactatacaattgtctttaatactttcgttctcatgcagctatttaacgagatcaatagccggaagatccacggggagaagaacgttttttctggaatttatcggaacatcatcttctgtagcgtagtgttgggcacattcatttgtcaaattttcatcgtcgagttcggggggaagcccttttcttgcacttcactgtcattgtcgcaatggctttggtgtctatttattggcataggagagctgctgtggggccaatttatcagtgcaatccccacacgcagtttaaagtttttgaaagaggcaggacatggcactacaaaggaagagatcaccaaggacgcagaaggcctggacgagatagatcacgccgagatggaattgcgaagaggccagatactttggtttcgtggccttaaccggatccaaacccagatcaaagtagtcaaagcctttcatagctccctccacgagtccattcagaagccttacaaccagaagtccattcactcctttatgacccacccagagttcgctatagaagaagaactgccccgcacaccgctgctggatgaggaggaagaggaaaacccagataaagccagcaagttcggtacccgggtcctgctgttggatggcgaggtgactccctacgcgaacacaaacaataatgccgtggactgtaatcaggtccagctacctcaatccgatagcagcctccagtccttagagaccagtgtctag

SEQ ID NO: 108990 - DNA, 3513 bp, Artificial Sequence
  Description of Artificial Sequence: Synthetic coding sequence
atgaccaatcccagtgatagagttctgccagctaatagcatggccgagtctcgagagggagacttcggatgtaccgtcatggagttgcggaagctgatggagcttcgttcacgagatgccctgactcaaatcaacgtccattatgggggggtgcagaatttatgctctcgccttaagacctcacccgtggaggggctcagtggaaacccagcagacctcgagaagcgccgtcaggtctttgggcacaacgtcatcccccccaagaaaccaaaaacgtttctggaattggtgtgggaagccctgcaggatgttactctaattattttagaaatcgcagctatcataagtttggttctgtctttttaccgccctgcgggtgaagagaacgaactatgcggacaggtcgcgaccaccccggaagatgagaatgaagcccaggccgggtggatagagggggccgcaatactgttttctgtgatcatagttgttttggttactgcgttcaacgattggtccaaagaaaaacagttcaggggacttcaatgcaggattgagcaagagcagaaattttctatcattagaaacggccagctcatacagctaccagtggcagagatcgtagtcggagacatcgctcaagtaaaatatggcgacttgctgcccgctgatggcatcctcatccaggggaatgatttgaagatcgacgaatctagcctcaccggcgagagtgatcacgtcaagaagtcgctggacaaggatccgatgctattgagcggcacccacgtaatggaagggagcggcagaatggtggtcactgcagtgggagtgaacagccagactggaatcatacttacccttctcggggtcaatgaagatgacgagggggagaagaaaaaaaaagggaaaaagcagggtgtccctgaaaataggaataaagcaaagacacaggacggggtggctcttgagattcaacccctgaacagccaggaagggatcgacaatgaggaaaaagataagaaagcagtcaaagtgcccaaaaaggaaaagtcagtgttacaaggcaagctgactcggctcgcagtccagattggcaaagccggcctactcatgagcgccttgaccgtgtttattcttattctgtactttgtgattgacaatttcgtgattaatcgccgtccctggctccctgaatgtacacccatctacatccaatatttcgtcaagttttttattattgggatcaccgttttggtggtggccgtgcctgaaggactcccccttgccgtcactatctcgctggcgtactccgttaaaaaaatgatgaaagacaacaacctggtaagacacctcgacgcctgcgagacaatgggcaacgcgactgccatctgtagcgataaaacaggcactctgaccatgaatagaatgactgtggtgcaagcttacatcgggggaatccattaccgccaaatcccgtctcccgatgtcttcttaccaaaggtgctggatctgatcgttaacggaatctccattaactccgcgtacaccagcaaaatcctcccccccgaaaaggaaggtggactgccacgacaggtagggaataaaaccgagtgcgcgctcctgggattcgttacagatctcaagcaggactaccaggccgtgcgcaatgaagtccccgaagaaaagctgtacaaggtatacacttttaattcagtgaggaagtccatgagcaccgtgattagaaacccaaatggaggattccggatgtattctaagggcgccagcgaaatcattctacggaagtgtaacaggatactcgatcgcaaaggagaagctgttccttttaagaacaaagacagagacgacatggttcggaccgtgatcgagcccatggcttgtgacgggctgagaacaatctgcatcgcatatagggattttgacgacaccgagccaagctgggataatgaaaatgagatcttgacggagctgacatgtatcgcggtggtcgggatcgaggatcctgtgcgccctgaagtgccagacgcaatcgccaaatgcaaacaggctggtatcaccgttcggatggttaccggggataatataaacactgcacgagcaattgccactaagtgcggaatcctcacgcctggagatgacttcctctgtctggagggcaaggaattcaatcgactgattcgtaatgaaaagggcgaggtggaacaagagaaattagataagatttggccaaagttaagggtacttgcccggtcctcacctaccgataaacacaccctcgtcaaagggatcattgatagtacggttggcgaacacaggcaggtagtggccgtcaccggtgacggcacaaatgacggtcctgctctaaaaaaggcagatgtggggttcgcaatgggcatagcagggactgatgtcgctaaggaggcctccgacattattcttacagatgacaacttcacaagcattgtgaaggcagtcatgtgggggagaaatgtgtacgacagcatcagcaaattcctccaattccagctcaccgtgaatgttgtcgcggtgatcgtcgcattcactggcgcctgtatcacccaggactcacctctgaaagccgttcagatgctgtgggtgaatctgattatggacacatttgccagcctggctcttgcgacagagccacccaccgaatcactgcttaaaaggaggccatatgggaggaacaagccgctgatctccagaaccatgatgaagaatattctggggcacgccttctatcagttgattgtgatctttatactggtgtttgccggagagaagttttttgatatcgactctgggcgcaaagcgccactgcatagccctccttcacagcactatacaatcgtctttaatacctttgtcctgatgcagttattcaatgagattaactcacggaaaatccatggggagaagaacgtctttagcggcatctaccgcaatatcattttttgcagcgtagtgcttggcacctttatctgccagatttttatcgtggaattcggaggaaaaccgttttcttgtacttctctttctctgagtcagtggctatggtgcctctttattggcattggcgagctgctgtgggggcaattcatctcagcaattcctacacggagcttgaaatttcttaaagaggccgggcacggcactacaaaagaagagattacgaaggacgccgaaggcctggatgagatagatcacgccgaaatggagttgcgaagggggcagatcttgtggtttaggggcctgaaccgtattcagacgcaaatagacgtaattaacacctttcaaaccggagccagctttaagggagtcctgcgccggcagaatatggggcagcatctcgacgtcaagctggtaccctcctcttcctatgttgccgtcgcccctgttaaatcctctcctacgaccagcgttcccgctgtgagttcgcctcccatggggaaccaaagcggacagtcggtgccttag

SEQ ID NO: 108991 - DNA, 3477 bp, Artificial Sequence
  Description of Artificial Sequence: Synthetic coding sequence
atgacaaacccttcagaccgggtgctgcccgcaaacagtatggcggagtctcgagaaggagatttcggttgtactgtcatggaactgaggaagttgatggaactccgatcccgcgatgctcttacacagattaatgtgcactacggcggggtgcagaatctatgctctagacttaaaacgtctcccgttgaggggctgagcggtaatcctgcagacttggaaaagagacggcaggtgttcgggcacaatgtcatcccccctaagaagcctaaaacattcctcgaacttgtgtgggaggccttgcaggacgttactctcattattctcgaaatcgctgcaatcataagtttagttttatcattttaccggcctgcaggggaggagaatgaactgtgtggtcaggtagcgactaccccagaagatgagaacgaagcacaggccggatggatcgagggggcggccatactgttcagcgtgatcatagttgtgctggttactgcgtttaacgattggtctaaagagaagcagtttcgtggattgcaatgccgtatcgagcaggagcagaagttctctatcatacggaatggtcagctgattcagctaccagtcgctgaaattgtggtgggtgacatcgctcaggtcaagtacggcgatctgctgccagccgacggaattctgatccaggggaatgacttgaaaatcgatgagagctcactaacgggcgagtccgaccatgtaaagaagagcttggacaaagatccaatgctgctctccggaactcatgtgatggaggggagtggacgcatggtcgtcacggccgtaggggtcaactcgcagacgggcattattctcacgcttctgggtgtcaatgaggatgacgagggcgaaaagaagaagaaggcgaaaacccaggacggtgtggctctggagatacaaccacttaactcgcaggagggaattgacaacgaggagaaggacaagaaggccgttaaagtgcccaagaaggagaagagtgtcctgcagggaaagctgactcgacttgctgttcagatcggaaaggccgggttgctcatgagcgctttaacagtgttcatcctgattttgtactttgtcatcgacaacttcgtcattaacaggcgtccatggctaccagaatgcactcccatttatatccagtatttcgtgaagtttttcattatagggatcaccgtgttagtggtagcggtccccgagggactgcctctggcggtcaccatttcactggcttattccgtaaagaagatgatgaaggacaataacttggtacgtcatctggacgcttgcgaaactatgggaaacgctacggctatctgttcagacaagacggggacactgaccatgaatagaatgacagtagtccaagcatatatcggtggcatccactaccgccagattcccagccctgatgtctttcttccaaaggtgctcgatctgatcgtgaacggcatttccattaactccgcatacacctctaagattcttcctcccgagaaggagggcggtttaccacggcaggtgggcaacaaaacggaatgcgcacttttaggatttgtcaccgatctgaaacaagattaccaagccgtgcggaatgaagtcccagaggagaaactatacaaggtctacaccttcaactctgttcgaaaaagcatgtcaactgtgattcgcaatccaaacggcggatttaggatgtattcaaaaggagcgagcgagatcatcctccggaaatgcaatcgtatcttagaccggaagggagaagccgtgccctttaaaaacaaggacagggacgacatggtgaggacggtgatcgagccaatggcctgcgatggtctcagaactatctgcatcgcatacagggacttcgatgatacagagccgtcttgggacaatgaaaatgagatcctgaccgagttaacatgcattgccgttgtgggcattgaagaccccgtgcgccccgaagtgccagatgctatcgccaagtgcaagcaggccggtattactgtgcggatggtcaccggcgataatatcaatacagcgcgggcaattgctactaagtgtgggatcctgactccaggcgacgacttcctgtgcttagaaggcaaggagtttaaccggctaatccggaatgagaagggtgaggtagagcaggaaaaactcgataaaatctggccaaagctgcgggttcttgccaggagcagccccactgacaaacatactctggtgaaaggaattatcgactccactgtcggtgaacaccgccaagtcgtagccgttactggagatggcaccaacgacggccccgccctgaagaaggctgacgtgggattcgccatggggatagccggcaccgacgtcgctaaggaggcaagcgatataattttaacagatgataatttcacttctattgttaaggcagtgatgtggggccgcaatgtatacgactcaataagtaaatttcttcaatttcagctcacagtcaacgtcgttgcggtgattgtagccttcaccggagcctgcatcactcaggattctccacttaaagccgtacagatgctgtgggtcaaccttattatggatacattcgcaagtctggccttagcgaccgaaccaccaacggagtccttgctgaaaagacgaccatatggaagaaacaaaccactgatctcccggacaatgatgaaaaatatcttaggccatgccttctaccagctaattgtgatttttatccttgtgtttgcaggtgagaaattttttgacatcgactcaggtaggaaggcccccttgcattccccaccctcccagcattataccattgtattcaacacgttcgtgcttatgcagttatttaacgagatcaattctagaaaaatacatggcgagaagaatgtcttcagcggcatataccggaacattattttctgtagcgtggttttgggcacctttatctgccagatctttatagtcgaattcggaggtaagccattctcatgcacatctttatctctctctcagtggctgtggtgcctctttatcggtataggcgagctcctgtggggccaatttattagcgcaatccctaccaggagtctgaagtttcttaaagaagcaggccatggaacaacaaaggaggaaattacaaaggatgcagaaggactggacgagatcgatcacgcagaaatggaacttagaaggggtcagattttatggttcagggggctgaacagaatccagactcagatcgatgtaatcaacactttccaaaccggcgcttctttcaagggcgtgttaaggcgacagaatatgggccagcatttggacgtgaagctggtccctagttcatcctacgtggcagtcgctcccgttaaaagctcacccactacctcagtgcccgccgtaagtagcccgcctatggggaatcagtcaggacagtctgtgccatag

SEQ ID NO: 108992 - DNA, 3405 bp, Artificial Sequence
  Description of Artificial Sequence: Synthetic coding sequence
atgaccaatccttcggacagggtcctgcctgccaattcaatggccgagtcaagagagggcgattttggttgtaccgtgatggagttgcgaaagctgatggaactgcgcagccgagatgccctgacacagatcaacgtgcattatggcggggttcaaaatttgtgctcccggctgaagacctctccagtggaaggcctgtccgggaatcccgctgacttagaaaagcggcgacaggtctttggacacaatgtaatcccccctaagaagcccaagacattcctggaactggtatgggaggcactccaggatgtgacgctgataatcctggagattgccgcaatcatttccctagtgctaagtttttaccgccctgccggggaagaaaatgaattatgtggccaagttgccacaactccagaggacgaaaacgaagcacaggccggctggattgagggcgcagccatccttttctctgtgataattgttgtgttggtgactgccttcaatgactggagcaaagaaaagcagttccgcgggctccaatgtagaatagagcaggagcagaaattttcaattatcaggaacggtcaactgattcagctgcccgtagccgagatagtggtgggagacatcgcacaggtgaagtatggcgatctcctgccggctgatggaatcctgatccagggaaacgatctgaagatcgatgagtctagcctgacaggagaaagcgaccatgtgaagaagtcgctcgacaaggatccaatgcttctgagcggcacacatgtcatggaggggagcggcaggatggttgtgaccgctgtgggagtaaactctcagacggggattatcctgaccctgctgggcgtgaacgaggacgacgagggagaaaagaaaaaaaagggtaagaagcaaggagttcccgaaaataggaataaggctaaaacacaggacggtgtcgccctcgaaatacagcccttaaactctcaggaaggcattgacaatgaagaaaaagacaagaaggccgtaaaagtgccgaaaaaggagaagtcagtgttgcagggaaaattaactcgactggccgtccagatagggaaggccggactcctcatgtccgcccttaccgtatttatacttattctctattttgtgattgacaattttgtaattaaccgtagaccttggctgcccgaatgcacccctatctatatccaatacttcgtcaaattctttattatcggcattactgtgctggtcgtggcagtgcccgagggtttgccccttgccgtcacaatatcattggcgtactctgtgaaaaaaatgatgaaggataataatttagtaagacacttggatgcttgtgaaacaatgggcaacgccactgccatttgctctgacaaaactggcaccctcactatgaacaggatgaccgtagtgcaggcatacattgggggcatacactatcggcagatcccttcacctgacgtgtttctgccaaaggtcctcgacctcatcgtgaacgggatctctattaatagcgcttacacctcgaagatcctcccccctgaaaaagagggagggctaccccggcaagtggggaataaaacagaatgcgccctcctgggttttgtcaccgacctgaaacaggactaccaggctgtgagaaacgaagtgcccgaagaaaaattatataaagtttataccttcaactcagtgcgcaaaagtatgtccaccgtcatcagaaatccgaatgggggcttccgcatgtattcaaagggtgcatcagagataatactgagaaaatgcaatagaattttagaccggaaaggagaggccgtcccatttaaaaataaggaccgcgacgacatggttcgtaccgttattgagcccatggcttgcgacggtctaagaaccatctgcatcgcctatcgcgatttcgacgataccgaaccatcatgggacaacgaaaatgagattttgaccgagcttacctgtattgcagtggtgggtattgaggaccctgttcggccagaagtgccagacgcaatcgccaagtgcaagcaggctggcataaccgtgaggatggtgacaggcgacaacatcaacacagccagagcaatagctacgaagtgcggtattctcaccccaggggacgactttttgtgtctcgaaggcaaggaattcaatagattaatacgcaacgagaagggagaggtagaacaagagaaacttgacaaaatttggccaaagctgcgcgtactggcacgctcaagccctactgacaagcatactctggttaagggaatcatcgactccactgtgggcgaacaccgtcaggtggtcgcagtgacaggggatgggaccaacgatggccccgccctgaagaaggccgatgtgggttttgccatgggcatcgccggtacagacgtcgccaaagaagcttctgacatcatcctcactgacgacaacttcacgtccattgttaaagcagtcatgtggggcaggaacgtgtatgattccatatcaaagtttctgcagtttcagctgaccgtaaatgtcgtggccgttattgttgcctttaccggtgcatgcatcacacaggacagtcctcttaaagccgttcaaatgctgtgggtcaacctcattatggatacctttgcttcactagcactggccactgagcccccgaccgagagccttctcaaaagacgaccatacggccggaataagcctcttattagccggaccatgatgaaaaacatcctgggccacgccttctatcaactcatcgtgattttcatactcgtgtttgccggcgagaaattctttgacattgactctggccgcaaggcacccctgcattcacccccttcccaacattacaccattgtttttaacacatttgtgctgatgcagctattcaacgagattaacagtaggaaaattcacggtgaaaaaaatgtgttctctgggatctaccgcaatatcatcttttgctcggtagtgctgggtacgtttatctgtcaatttatctctgctatccccaccagaagcttaaaatttttgaaggaagcaggtcacggcaccacaaaagaggaaataacgaaggacgccgaagggctggacgaaattgatcacgcagaaatggaacttcggcggggacagatcctttggtttagaggtctgaatcggattcagactcagattgatgtaataaatacttttcagaccggcgcctcctttaagggagttcttcgccggcagaacatggggcagcacctggacgtgaagctggtgccatcatccagctacgtggccgttgccccagtcaaaagcagccccacgacctcggtgcctgccgtaagctcccctccaatggggaaccagagcgggcaatctgtgccctag

SEQ ID NO: 108993 - DNA, 354 bp, Artificial Sequence
  Description of Artificial Sequence: Synthetic coding sequence
tagggcggaaagccgttctcgtgcacctctctcagcctgagccagtggctttggtgtttgttcatcgggatcggtgaattgttgtggggacagtttatttccgccattcccactaggagtctgaaattccttaaggaagccgggcacgggacaaccaaagaggagatcaccaaggatgccgaggggttggacgagattgatcacgcggaaatggagctgagaagaggccagatactatggtttcggggtctgaacaggatacagactcagcatctcctacaggactctgacctgttgcccgacaaggaggaagccataatcagcagtagtttgttcccttcatgtaatttttag

SEQ ID NO: 108994 - DNA, 2667 bp, Artificial Sequence
  Description of Artificial Sequence: Synthetic coding sequence
atgaaggttgccaggtttcagaagatccccaacggagaaaacgagaccatgatcccagtgctcacctctaagaaagcttctgagttacctgtttcagaggtggcgagcatcctgcaggctgatctgcagaatggcctgaataaatgcgaagtgagtcaccgtagggctttccatgggtggaacgaattcgacatcagcgaggatgaacctctgtggaagaagtatatcagccagttcaagaatccactcatcatgctccttctggcttccgcagtcatctctgtcctaatgcaccagttcgacgacgccgtgtcaattactgttgccatcctcatcgtggtgaccgttgcattcgtgcaagagtacaggagtgagaagagtcttgaagaactgtccaaattggtgccacccgagtgtcactgcgtacgagaagggaagctggagcatacactcgcccgtgaccttgtcccaggcgacactgtatgcctatctgtcggagatcgcgttcctgctgatctgaggctcttcgaggccgtggatttaagcatcgatgagtcttcacttacaggcgagacaaccccctgcagtaaggttaccgcccctcaaccggcagctacgaacggcgacctagcatctagaagcaatatcgcgttcatgggcaccctcgttcgctgcgggaaggctaagggcgtggtgataggcactggcgagaactcagaattcggggaagttttcaagatgatgcaggcagaggaggcccccaaaaccccactgcagaagtcaatggatttattgggaaaacagctctccttttattccttcgggataattggaatcatcatgctcgtggggtggctacttggaaaagatattttggaaatgtttaccatatctgtgtcattggccgttgctgccattcccgagggtctgcccatagtagtgactgtaacactggccctgggggtgatgcgcatggtgaagaagcgggccatagtgaagaaattacccatcgtggaaacactcggatgttgtaatgtgatttgttctgacaaaactggaacactcaccaagaacgaaatgacggtcacccacattttcaccagcgacggattacacgcagaagtcactggggttgggtacaaccaattcggcgaggtgattgtggacggcgatgtagtccacggcttttataaccccgcagtgagtagaattgtcgaggccggatgcgtttgcaatgacgcagtgatccggaataataccctaatgggtaagccaactgagggagcgctgattgctctggcgatgaaaatggggcttgacggcttacagcaggattacatcagaaaagccgaatacccgttcagtagtgaacagaaatggatggctgtgaagtgcgtgcataggactcagcaggatagacccgagatatgcttcatgaaaggcgcctacgaacaggtgatcaagtactgtaccacgtaccagtccaaagggcagacgctcacgctgacgcaacagcagcgggatgtgtaccagcaggagaaggctcggatgggcagcgctggcctacgcgtgctggcgcttgcctcagggcccgagttgggacagcttaccttccttgggcttgtgggaatcatcgatccacccagaaccggcgtaaaggaggccgtgacaactctgatcgccagcggagtgagcataaaaatgattactggggattcccaggaaacagcggttgccatagcctcccgactggggctgtattccaaaacctctcaatccgtgagcggcgaagaaattgacgcaatggacgttcagcagctctctcagatcgtgccaaaagtagccgtattctatagagcatcccctagacataagatgaagattatcaaatcgctgcaaaagaacgggagtgtggttgccatgaccggggacggcgtcaatgacgccgtcgctctcaaggccgccgacatcggagtggccatgggccagacgggtaccgacgtatgtaaggaagccgccgatatgatacttgtggatgacgatttccagaccatcatgagcgcgatagaagagggcaagggcatctacaacaacatcaaaaacttcgtgaggtttcagctgtcgacttccattgccgctctgaccctcatcagtttggcaactcttatgaattttcctaatcctcttaatgctatgcaaatactgtggattaacatcattatggatggacccccggcgcagtctcttggggtggaacccgtggataaagacgtcattcggaaacctcctaggaactggaaagatagcatcctaaccaagaatcttatactgaagatattagtgtcgtcaattattattgtgtgcggtaccctgtttgtgttctggagggagcttcgtgataacgtcattacgcccagggacacaaccatgacctttacatgcttcgtcttcttcgacatgttcaatgccttgtctagtcggtcccagaccaagagtgtatttgaaatcggcctgtgttctaatcgcatgttctgttatgcagtattggggtcaatcatgggccaattgctcgtgatatactttccccctctacagaaagttttccagaccgagagcctttctatcttgggcctggccctgggcgaagagtggactgccgcaggatag

SEQ ID NO: 108995 - DNA, 2877 bp, Artificial Sequence
  Description of Artificial Sequence: Synthetic coding sequence
aaggtagcacgctttcaaaaaatccctaatggagagaatgaaactatgatacccgtgttgacctcgaagaaggcatctgaactgccagtcagcgaggtcgcttctatattgcaggcagatctgcagaatggtctgaacaagtgcgaagtgagtcacaggcgcgccttccacggttggaacgagttcgacatatctgaggacgaacccttgtggaaaaaatacattagccagttcaaaaacccgctgattatgctgctgcttgccagtgccgtcattagcgtccttatgcatcagtttgacgacgcagtctctatcacagtggccattttaatcgtagtgacagtggccttcgtacaggagtacaggtccgaaaaatctctcgaagaactgagtaaactggtgcccccggagtgtcactgcgtaagggaaggcaagctggaacacactctggcgagggatcttgtacctggagataccgtatgtctgagcgtgggcgatagggttcccgcggatctgcgcctgttcgaggccgtggatctttccatcgacgaatcgagcttaaccggagaaacaaccccctgtagcaaagtgacagctccgcagcctgccgcaactaatggtgacctggcctcccgaagcaacatcgctttcatgggcacactggtgaggtgcggaaaggccaaaggtgtcgtgatcggaactggcgagaattcagaattcggtgaggtcttcaaaatgatgcaagccgaggaggcgcctaaaacaccacttcagaaatctatggatcttctaggtaaacaattgtccttctactcctttggtatcatcggaatcataatgctggtgggctggctgctgggtaaggacatcctcgaaatgtttactatctctgtgtccctcgccgtggcagctatccccgaggggctcccaatcgtggtgacagtgacgttagctcttggcgtcatgcgcatggtgaagaagagagctatagtcaaaaagctgccaattgtcgagacccttgggtgctgtaatgtgatctgtagcgacaagaccggtacactgactaaaaacgaaatgacggtgacccacatatttacctccgatggacttcacgccgaggtgactggggtcggctataatcagtttggggaggtgatcgttgatggtgatgttgtacatggcttctataatcctgccgtttcccgcatcgtcgaagccggatgtgtgtgcaacgacgcagtaatccgaaataataccttaatgggaaaaccaaccgagggtgcacttatcgccctggccatgaagatgggcctggacggactgcagcaggattatatccgcaaagcagaatatcctttctccagtgagcagaagtggatggcggtaaaatgtgtccatagaacacagcaggaccgacctgagatatgctttatgaagggggcttatgagcaggtaataaagtactgtaccacataccagagcaaggggcagaccttaactttgactcagcaacagcgtgatgtctatcaacaggaaaaggcacggatggggtccgctggcttaagggtgctggcactcgcctctggcccggagctgggccaactgacattcctcggcctggtcgggattattgatcctccgagaaccggtgtaaaagaggctgttaccaccctgattgcttccggcgtttccatcaagatgattaccggtgacagtcaggaaactgcagttgcgatcgccagccgactcggtttgtacagtaagaccagccagtccgtgagcggcgaggaaattgatgccatggacgtgcagcaactgtcccagattgtgcccaaagtcgccgtattctaccgcgcctcacctcgtcacaagatgaaaatcatcaaatcattacaaaaaaatggctccgtggtcgctatgacaggagacggtgtgaacgacgccgtggctttgaaagctgccgacataggtgtcgccatgggccaaacggggacagatgtctgcaaggaggccgccgacatgattttagtcgacgatgacttccagacaattatgtctgccatcgaggaagggaagggaatctacaataacatcaaaaactttgttagattccagctgtctacttccatcgccgccttaaccctcatatcattagcaacgctaatgaattttcccaatcctctaaacgccatgcaaatcctctggataaatataatcatggacggcccccctgcacaatccttgggcgtggagccagtagataaggatgttattaggaaaccacctaggaattggaaggactccattcttacaaagaacctgatcttgaaaatcttagtgtcctcaatcatcattgtgtgtggcacattgttcgttttctggagggagctgcgggacaacgtgattacacccagggatacgactatgaccttcacctgttttgtttttttcgatatgttcaacgccctttcttctcgctctcagactaaatctgtctttgagattggcctgtgtagtaatagaatgttctgctatgccgtcttaggcagtattatgggtcaactgcttgtcatctactttccacccctgcagaaagtgttccaaacagagtctttgtccattcttgatcttctgttcctactcgggctgacgtcctcagtctgcattgtagccgagattatcaagaaggtcgagcgcagtcgagagaaaatacaaaagcatgtcagcagtactagctctagctttttggaggtttcctcttccagtggcaactttgtcgccgtatggctgtgggaaagaagcggccagcagctggtggaaatccacccacatctggagacgggcttgccactgactgaggatgtgagctgtgtgtag

SEQ ID NO: 108996 - DNA, 2850 bp, Artificial Sequence
  Description of Artificial Sequence: Synthetic coding sequence
atgaaggttgcaaggtttcaaaaaatccccaacggggaaaacgaaaccatgatacctgttcttacctctaagaaggcttccgaactacccgtcagtgaggttgcatccatcctgcaggctgatctccaaaatggtttgaacaagtgcgaagtatctcatcgccgggctttccatggatggaacgaattcgacatatcagaagacgagcccctgtggaaaaagtatatctcccaattcaaaaaccctcttataatgcttctcttagccagtgctgtgatatctgtgttaatgcatcagtttgacgatgccgttagcattacagtggctatcctgatcgtggtcacagtggcgtttgtgcaggaatacagatccgaaaagtctctggaagagttgagcaagctggtccccccagagtgccactgcgtacgggagggcaaacttgaacataccctggcacgtgacctggtgccgggagataccgtctgcttgtccgtgggggatagggtgcccgcagatttgagattattcgaggcagtggacctctccatcgacgagagttcactgacaggcgagaccacaccctgttccaaggtaacagcaccacaacctgcagccacaaacggtgacctggcaagtaggagcaacattgctttcatgggcactctggtgaggtgcggcaaggcaaagggagttgttatcggaactggagaaaattccgagttcggggaggtattcaaaatgatgcaggccgaagaggcccctaaaacccccttgcaaaaatccatggaccttcttggtaaacagctgtctttctattcctttggcatcataggtatcatcatgcttgttgggtggctgctagggaaggacattctggagatgtttactatttccgtaagcctcgctgtagccgctatacctgagggcctccccatagtcgttacagtgacgctggcccttggtgtgatgcgcatggtgaagaaacgcgctattgtaaaaaagcttcccatcgtggagactttggggtgctgtaacgtgatctgttctgataaaacaggtaccttaacgaaaaatgagatgactgttactcatattttcactagtgatggattgcacgcagaggtgacgggcgtggggtacaaccaatttggagaggtgatcgttgatggagacgtcgtgcatggattttataacccagcagtgtcaagaatcgtcgaagcgggctgtgtctgcaatgatgcagtgattaggaataacactctgatggggaaaccaacagaaggtgcactcattgccctggcgatgaagatgggcttggacggactccaacaagattatattcggaaggccgagtatcccttctcatcggagcaaaaatggatggccgtaaagtgcgtacatagaactcaacaagacaggcccgaaatctgcttcatgaagggagcgtacgaacaagtgatcaagtactgcacaacttaccagtcgaagggccaaactcttaccttgacccagcagcagcgggatgtgtaccaacaggagaaagcacggatgggcagcgccgggctgcgggtcttggcactcgcctctggacccgagctaggccagctcacgtttctgggactggtcggtattattgatccaccacggaccggcgtgaaggaagcagtcacgactttaatagcatctggagtcagtataaagatgattaccggtgacagtcaggagacagcagtggctattgcatcacgtctggggttgtactcgaaaactagtcagagtgtaagcggggaagagatcgatgccatggatgtgcaacaactctcccagattgtacctaaggtggccgtgttctaccgcgccagtcctaggcacaaaatgaagatcatcaagtccctacagaaaaatgggtcagtggtggctatgacaggggacggcgtgaacgacgcagtggccctaaaggctgccgatatcggtgtggcgatggggcagactggaaccgacgtttgtaaagaggccgcggatatgattctagtggacgacgacttccagactatcatgagtgccattgaggagggaaaaggaatatacaataatataaagaacttcgttcgatttcagctaagtaccagcatcgcagcactgaccctgatctccctggccacccttatgaactttccgaatcctctgaatgcaatgcagatcctgtggatcaatatcattatggacggcccccccgctcagtccctgggggtggaacctgtcgacaaggatgtgatcagaaagccgcccaggaactggaaggactctatcctgacgaagaacctgatcctcaagattctggtgtcaagcatcatcatcgtctgtggcaccctgtttgtgttttggagagaactaagagacaacgtgataacgcctcgtgacacgacaatgacttttacttgttttgtgttcttcgacatgttcaacgctctgtcatcaagaagccaaaccaagagcgtctttgagataggcctatgttcaaaccgcatgttctgctatgccgtattaggcagtattatggggcagttactggttatatatttcccacccctccagaaggtgtttcagactgaatccttgagcatcctagatctcctgttcctgcttgggctcacatcttcagtctgtattgtggccgaaattatcaaaaaagtcgaacgatcccgtgaaaagatccagaaacacgtttcttcgacttcatcaagtttcctggaggtgtggctctgggagcggagtggacagcagctcgttgagattcatccccatctggaaaccgggttgcccctgaccgaggatgtgtcatgcgtgtag

SEQ ID NO: 108997 - DNA, 2922 bp, Artificial Sequence
  Description of Artificial Sequence: Synthetic coding sequence
atggacagtctcctgccaccatcaagatttagttatttcaaaaagtaccccttgcatgcgatacgcagatatctcagcacacttcggaatcaacgagccgaagaacaggtcgctcggttccagaaaatccccaacggggagaatgagactatgatccccgtgctaacatccaaaaaagccagcgaactccccgtctctgaagttgccagcatcctccaggccgaccttcaaaatggattgaataagtgtgaggtcagccatagacgtgcctttcacgggtggaatgaattcgatatttctgaagatgaacccttgtggaagaaatacatctctcagttcaagaatccactcatcatgctactattagcaagtgcagtgatttccgtccttatgcatcagttcgacgacgccgtttctataactgtggcaatccttatagtggtaacggttgcttttgtgcaagagtacaggagcgagaaaagcctcgaggaactgtctaagcttgtaccaccagaatgccactgcgtgcgcgagggtaagcttgagcacaccttagcaagggacctcgtgccaggtgacaccgtctgcctcagcgtgggagatagagtccccgcagacttgcggctgttcgaggccgtggatctttctatagatgagagttctttaactggtgaaacaactccttgcagcaaagtgaccgccccccaacctgctgccactaatggcgacctcgcctcaagatcgaacattgctttcatgggcacactggtgcgttgcggcaaagcaaagggagttgtaatcggaacgggggaaaattctgagtttggggaggtgttcaagatgatgcaggccgaagaagcccccaaaacccccctccagaaaagcatggacctactggggaagcagcttagcttctatagcttcgggatcattgggatcattatgctagtgggatggctgttgggcaaggacatactagagatgttcaccatctccgtgagcttagccgtcgcagccattcccgaaggactgcccatcgtggtgacggtgacgctggccttaggcgtaatgcggatggtgaaaaaacgggctatcgtgaaaaaacttcccattgtggagaccctaggctgctgcaatgtcatttgcagcgacaagacgggcacactgacaaagaatgagatgacagtgactcacattttcacctcagatggtctgcatgcagaggttacaggcgtcggctacaatcagttcggggaagtgattgtagacggcgatgtggttcatggtttctacaaccccgcagttagtagaatcgtggaagccggctgtgtttgcaatgatgcagttatccgcaataatactttgatggggaaacctaccgagggcgccttaatcgctttggctatgaagatggggcttgacggcctgcagcaggactatattcgcaaggcagagtatcctttttctagcgagcagaagtggatggcagtcaagtgcgtgcaccgaacgcagcaggaccgccctgagatttgctttatgaaaggcgcctacgaacaagtgatcaagtattgtactacctaccaaagcaagggccaaactctgactctgacacaacagcagcgggacgtgtaccagcaggagaaagcacggatgggctccgctggattaagggtcctcgccctcgcttcaggccctgagctaggccagctcaccttccttggcctggtcggcatcatcgaccccccacggaccggtgttaaggaagcggttactactcttatcgctagtggtgtgagtattaaaatgattacgggcgatagccaggagacagcagttgctattgcatcacggctggggctgtacagcaaaacctcacagagcgtgtctggcgaggaaattgacgccatggatgtgcagcagcttagtcagatcgtgcccaaagttgccgtgttttatcgagcttcaccccggcacaaaatgaaaatcattaagtctctgcagaaaaacggcagcgtcgtggccatgaccggagatggcgtgaacgacgccgtggccctcaaggcagcagacatcggagtcgcaatgggccaaactggcaccgacgtgtgtaaagaggctgctgatatgattttagttgacgatgactttcaaaccattatgagcgcgatagaggaaggtaaaggcatatacaataatatcaaaaactttgttcgctttcaactgtctacctctatagcagccctgacgctcatttctctggcgaccctaatgaactttcctaacccactgaacgcaatgcagattctgtggattaatatcatcatggacggcccgcctgctcagtccctgggagtggagccagtggataaagacgtgatcagaaaaccccctaggaattggaaagattcaatcttaacgaagaatttaatcctaaaaatcctagtatcttccatcatcatagtctgcggcaccctattcgtcttctggcgtgagctgcgagataatgtgatcacccctagagatacaacgatgacattcacgtgctttgttttctttgatatgttcaacgccctgtccagcaggagtcagactaagtctgtcttcgagatcggcctgtgttccaaccgtatgttctgctatgccgtgttagggtctattatgggacaactgctcgttatctacttccctcctctgcaaaaagtcttccagactgaatccctctctattctggatcttttgtttctcttaggcctgaccagtagtgtatgcatcgtggccgaaattattaaaaaggttgagaggtcacgggagaagattcaaaagcatgtgtggctctgggagcgaagtggtcagcagctggtggagatccatcctcacctggagacgggtctacccctgactgaggacgtatcttgtgtgtag

SEQ ID NO: 108998 - DNA, 2820 bp, Artificial Sequence
  Description of Artificial Sequence: Synthetic coding sequence
atgaaggtggcaagattccagaaaattcctaatggtgaaaatgagaccatgatccctgttctgacctctaagaaggctagtgagctgccagtaagtgaggtggccagtattctccaggctgatttacaaaacggactgaataagtgcgaagtcagccaccgacgggcctttcatggctggaatgaattcgatatcagcgaagatgaaccgctgtggaagaagtatatcagccagttcaagaatccgctgattatgctgttactggcatctgccgtgattagcgtactcatgcatcagtttgatgatgccgtttcaatcacggttgccatcctcattgtggtgaccgtcgccttcgtgcaggagtatcgtagtgaaaaaagcctggaagagctgtctaagctggtcccacctgaatgccactgcgtgcgggagggaaagctggagcatactcttgctagagacctggtcccgggcgacaccgtgtgcttgagtgtaggtgaccgggtgccagctgaccttcggctattcgaagccgtagacttatccattgacgagtcttctttgaccggcgaaaccacgccttgtagcaaagtcacagctccccagccagccgctaccaatggagacctggctagcaggagtaatatagccttcatgggtaccttggtgcggtgcggtaaagcaaagggagtggtaataggaacaggagagaattccgagtttggggaggtctttaaaatgatgcaggccgaagaagcacctaagaccccactacagaagagtatggatctccttggcaaacagctgtcgttttattcatttggcattatcggaattattatgctcgtcgggtggttacttgggaaagatattctggagatgtttacaatatcagtctcactcgccgtcgctgccattcctgaggggctccctatcgtggtaacagtcacacttgcgctgggagtgatgcggatggtgaaaaagcgcgctattgtcaaaaagctgcccattgttgaaacactgggttgttgcaacgtgatttgctccgataagactggaacactgacaaagaatgaaatgacggttacacacatattcacatcggatggtctgcatgctgaagtgacaggagtggggtataatcagttcggcgaggtgatagttgacggtgacgtcgtgcacggattctacaatccagctgtatccaggatcgtcgaggccgggtgcgtctgcaacgatgccgtcatcagaaacaacacactcatggggaagccaactgagggggcgctgattgctctggctatgaaaatggggttggacgggcttcagcaggattatatcaggaaggccgagtatcccttcagctctgagcagaaatggatggccgtcaaatgcgtgcatcgcactcagcaagaccgcccggagatttgctttatgaaaggcgcctatgagcaagtgatcaaatattgcacaacatatcaatcaaaggggcagaccctcaccttaacgcagcagcaaagggatgtatatcaacaggagaaggctcgtatgggttcagctggtcttcgggtgttggccctcgctagcggccctgaactgggtcagttgaccttcctgggactcgttggaatcattgatccaccgcgcaccggagtgaaggaggcagtgactacactcattgcatctggggtgtccatcaaaatgatcaccggggacagccaggagacagctgtggccatcgcttcacggctcggactctacagtaaaacttcgcagagtgtgagtggggaggagattgacgctatggatgtacagcagctgtctcagatagttcctaaagtagcagttttctaccgggcaagccctagacataagatgaagattatcaaatctttgcaaaaaaacggcagtgtggtagcgatgacgggcgatggggtcaacgatgccgtcgcacttaaggccgcggatatcggcgttgccatgggccagacaggcacagacgtatgtaaggaggccgctgatatgatcctcgtagacgatgattttcaaacgatcatgagcgccatcgaggaagggaaagggatttacaacaatattaaaaattttgtacgattccagcttagtacgtccattgcagctcttacactgataagtctggcgacgctgatgaattttcctaaccctttaaatgccatgcaaattctttggatcaatatcatcatggatggaccgcctgcccagtcactgggtgttgagccagtcgataaggacgtcattcgcaaacctccacgtaactggaaagattccatccttaccaagaacttgatcctgaaaatcctggtgtcaagtatcatcattgtgtgtggaacactctttgttttctggcgtgagctgcgtgacaacgtgataacaccacgggatacaaccatgacattcacatgcttcgtgttctttgatatgtttaacgctctatcctcaaggtcccagactaagagtgtttttgaaatcggactgtgctcaaataggatgttttgttacgcagtcctgggctccataatgggccaattgcttgtcatatacttcccaccactccagaaggttttccaaacagagtccctgagcatccttgatcttctgtttttgctggggctcacatcatcagtgtgcatagtggccgaaataatcaagaaagtggagaggtcacgagagaaaattcagaagcacgtctggttgtgggagagaagcggccagcagttagtcgaaattcatccccaccttgaaactgggctgccactgaccgaagatgtgtcatgcgtgtag

SEQ ID NO: 108999 - DNA, 2760 bp, Artificial Sequence
  Description of Artificial Sequence: Synthetic coding sequence
atgaaagtggcgcgttttcagaagatcccaaacggcgaaaacgagacgatgatccctgtgctgacgtcaaaaaaagctagcgaactgcccgtatccgaggtcgcctccatcttgcaagcagatctgcaaaatgggcttaacaagtgtgaggtgtcccacaggcgggctttccatggatggaacgaatttgatatctctgaagacgagcctctgtggaagaagtatatctcccagtttaaaaaccccctgatcatgcttttgctggcctctgccgtcatatcagtgctgatgcatcagtttgatgacgctgtgtcaattaccgtggccatccttatagttgtaacagtcgcttttgtgcaggagtatcgtagcgagaaaagcttggaggagttgagcaagctcgtcccccccgaatgccattgcgttcgcgaaggcaaactcgaacacacccttgcccgagacctcgtcccaggcgatacagtttgtttgagtgtgggcgacagagttcccgccgacctgcgtctgtttgaagcagtggacctgagcatcgatgagtcaagtctgaccggcgagaccaccccttgtagtaaggtgacagcacctcaacccgcagccaccaacggggatctggcatccaggagcaacattgctttcatgggaaccctcgtccggtgcgggaaggccaaaggcgtcgtcattggtaccggggagaattccgaattcggggaagtattcaaaatgatgcaggccgaggaggccccaaaaaccccactacaaaaatccatggatctccttggcaaacaactgagtttttattccttcggcataattggcataatcatgttagtaggctggctcttgggtaaggatatcctggagatgtttacaatttcagtttcccttgcggtcgctgctattcctgaggggctacctattgttgtgactgtcacactggcgctgggcgtgatgcgcatggttaaaaagcgtgcaattgtcaaaaagctgcctattgtggaaaccctgggctgttgcaatgtgatctgctctgacaaaactggcacgcttactaaaaacgagatgactgtaacacatatttttacaagcgacgggctgcacgccgaagtgacgggggtcggatacaaccagtttggagaggtcatagtcgatggcgacgtagttcacggcttctataacccagccgtcagccggattgtcgaagcaggctgtgtgtgtaacgatgccgtgattcgtaacaatacgttgatggggaagccgaccgagggagcactgatagccttagccatgaagatggggctcgacgggttgcagcaagactacattaggaaggccgagtacccattttcgtctgaacagaaatggatggctgtgaagtgcgtgcaccgaacacagcaagatcgccccgaaatttgctttatgaagggagcatatgaacaggttattaaatactgcacgacttaccagagcaagggtcaaacacttactttgactcaacagcagagagacgtgtaccagcaagaaaaagctcgtatgggttctgctggccttagagtcctggcactggccagcggcccagaactggggcagctgaccttcctgggtctggtgggaattatagatccacccagaacgggtgtcaaggaagcagtgacaaccttgatcgccagcggcgtttctattaagatgattaccggggattcacaggagactgccgtggccatcgcatcccgactgggactctacagtaagacatctcagtcagtgtctggagaagaaattgacgcaatggacgtgcagcagctgagccagattgttcctaaggtggccgtattctatcgcgcctccccccggcacaaaatgaaaatcatcaagagcctgcagaagaatggcagcgttgtggctatgactggcgatggagtcaatgatgccgtggctctgaaggccgccgacattggagtagcaatgggccagactggcacagacgtctgcaaggaggcagctgacatgatacttgtggatgatgacttccaaactatcatgtccgcaattgaggagggcaaggggatctataacaacattaagaatttcgtgaggtttcagctgagtaccagcatagcagcactgaccctgatttctctcgctacgttaatgaactttcccaatcctctgaatgcgatgcagattctgtggatcaatataattatggacggccctcccgctcagagcctgggggtcgagcccgtcgataaggacgtgattagaaagcctcccagaaattggaaggattccatattgaccaaaaacctcattctgaaaatcctggtctcttccatcatcatcgtgtgcggcacactctttgtgttctggcgtgaactccgtgacaacgtgattaccccacgggataccacgatgactttcacatgcttcgttttttttgacatgtttaatgcgctgagtagccgatctcaaacaaagtcagtttttgagatcggactttgctccaaccgcatgttctgttatgccgtattgggaagtatcatgggccagctgttagtcatctacttccctcccctgcagaaagtcttccagacagaatcactgtccatcctggatttactatttcttctggggctcacgagttctgtgtgtatcgtggctgaaatcatcaaaaaagtcgagagaagcagagagaagatccaaaagcatgtgtcctctacatcatcaagtttccttgaagtttag

SEQ ID NO: 109000 - DNA, 2712 bp, Artificial Sequence
  Description of Artificial Sequence: Synthetic coding sequence
atgattccagtgctcacgagcaaaaaggcctccgaactccccgtgtcagaagtggcctcgattctgcaggcagacctgcagaatggattaaataagtgcgaagtgtcccacagaagggccttccatgggtggaacgaattcgacatatctgaagacgaacccctgtggaagaaatacatcagccagtttaaaaatcctctgatcatgctgctcctagcttccgccgtgattagcgtgttgatgcaccagtttgacgacgcagtgagcattaccgtggcgatactgatagtggtcactgtggcgtttgttcaggaatacagaagtgaaaaaagcctcgaggagttatccaagctggtccctccagaatgtcactgtgtgagagaaggaaagctagaacacactcttgcccgagacctggttccaggtgacaccgtctgtctatctgttggggatagggtgccagctgatctgcgtctgttcgaggctgtcgacctgtccatagacgaaagttctttgaccggagagaccacaccctgcagtaaggtaaccgcaccacagcccgcagctacgaatggcgaccttgcctcccggtccaacattgccttcatgggcacccttgtcaggtgcggcaaagctaaaggtgtggtgattggcactggagagaattcagagttcggcgaggtatttaagatgatgcaagcagaagaagcccccaagacccctcttcaaaaaagcatggaccttttaggaaagcagctgtctttttactcgttcggtattatcggcatcataatgcttgtcggctggttgctaggcaaagatattctcgagatgttcaccatatctgtgagcctggccgtggcggctatcccggaagggcttcccatcgtggttaccgtgaccctggcactgggagtgatgaggatggttaaaaaacgagcaatcgtcaagaaactgccaattgtggaaactctaggctgctgcaatgttatctgtagcgacaagacaggcactcttacaaagaatgagatgaccgtgacgcacatcttcacttccgatggccttcacgccgaggtgacaggagtcggatataaccaatttggggaggtgattgttgacggggatgtggtgcatggattttacaaccccgctgtgtcacggatcgtggaggcaggctgcgtgtgtaatgatgccgtgatcaggaacaataccctgatggggaagcccaccgaaggagccttgatcgctttagccatgaagatgggcctcgacgggcttcaacaagattacataaggaaagccgagtacccattctcaagcgagcagaagtggatggccgtgaaatgcgtgcacaggactcagcaagatcgacctgagatctgctttatgaagggcgcctatgagcaggtcatcaaatactgcactacgtatcagagtaagggccagactctcacattgactcagcaacagcgggacgtgtaccaacaggaaaaggctagaatgggctctgcaggactgcgggtactggcgctcgcgtcagggccggagctcgggcagttgacgttccttggactcgtgggcatcatcgatcctccaagaaccggcgtgaaggaggcagtcacaaccctgattgcgtccggcgtctctatcaagatgataacgggcgattctcaggagacagccgtggccatcgctagccggttaggactctactccaaaacatcccagtctgtgagcggtgaggagatcgatgccatggacgtgcaacagctttctcaaatcgtcccaaaggtggccgttttctatagggcctcaccacgtcacaaaatgaagattatcaagagtctccagaaaaatggctcggtggtcgcgatgaccggagatggagtcaacgatgccgtggctctgaaggcagccgacattggtgtggccatgggacagactggcacggatgtatgtaaggaggcagccgatatgatccttgttgatgacgactttcagaccattatgtccgcaatcgaggaagggaaaggcatttataacaacattaagaactttgtaagatttcagctgtccacttctatagcggcccttacccttatctcgctcgccaccctgatgaacttccctaatccacttaacgccatgcagatcctctggataaatatcataatggacggcccacccgcgcaaagtctgggagtcgagcccgtcgacaaggatgtcattcgcaaacccccacgaaactggaaggacagcatactgaccaagaatctgattttaaagatcttagtcagcagcattattatagtgtgcgggaccttatttgtgttctggcgcgaactgcgggataacgtgataaccccaagggacactactatgacattcacctgttttgtcttcttcgacatgtttaatgctttgagcagtagatctcaaaccaagtccgtgttcgagatcggattgtgtagcaatcgcatgttctgctatgccgtgctcggttcaattatgggccaacttctggtcatctattttcccccactacagaaagtgttccagacagagagcctatcaatcttggatcttttatttcttcttgggcttacatcatcagtttgcatcgtagcagagataataaaaaaagtagagaggagtcgggagaagatccagaagcacgtaagctccacttcatcttccttcttggaggtgtag

SEQ ID NO: 109001 - DNA, 363 bp, Artificial Sequence
  Description of Artificial Sequence: Synthetic coding sequence
atgaaggtcgcaagattccagaagatccccaatggggagaatgaaacaatgatccctgttttgactagcaagaaggcatcagaacttcccgtctccgaagttgcctctattctccaagccgacttacagaacggcctcaataaatgtgaggtctcgcaccgcagagcgtttcatggatggaatgagtttgacatatctgaagacgagccactctggaaaaagtatatttcacagttcaagaacccattgattatgctcctgctcgcctccgctgtcatcagtgtgttaatgcatcaatttgacgatgccgtgtcaatcactgtggctatcttaatcgtagtgactgtcgcattcgtccagtag

SEQ ID NO: 109002 - DNA, 2712 bp, Artificial Sequence
  Description of Artificial Sequence: Synthetic coding sequence
atgatccctgtgttaaccagtaaaaaagcttccgagttacctgtatcagaagtggcttcaatcctccaagccgatctccaaaacggcctgaacaaatgcgaagtgtcgcatcggcgagcctttcatggctggaacgaattcgacatttctgaggacgagcctttgtggaagaagtacattagccaatttaagaaccccttaatcatgctattactggcttccgctgttattagcgtcctgatgcaccagtttgacgacgccgtgtcaattacggtggccattttaattgttgttacagtggcttttgtacaggagtaccggtcagagaagagccttgaagagttatccaaactcgtcccacctgaatgccactgcgttagggagggaaaacttgagcacaccctggcaagggacctcgtccccggcgataccgtctgcctcagcgtgggagaccgagtgccagcagacctccggctcttcgaagctgtggaccttagcattgatgagagctcgctgacaggcgaaacaacaccatgctccaaagtgacagcgccacaacccgccgccaccaacggggatctggcatctcgctccaatatcgcatttatgggcactcttgtgcgatgtggaaaggccaaaggagtggtaattggcactggcgaaaatagcgagttcggcgaggtctttaaaatgatgcaggcagaagaggcccccaagacccctctccaaaaaagtatggatctgcttggcaagcagcttagcttctacagctttggcatcattggcatcatcatgttagtaggctggttactgggcaaggatatcttggagatgttcactatcagcgtcagtctggccgtggcggctatcccggagggcttgcccatcgttgtaaccgtcaccctggcgctgggggtcatgcgcatggtaaaaaaaagggcaattgttaaaaaactgccaatagtggaaactcttggatgttgcaatgtgatttgttctgataaaaccggcacactcactaagaacgaaatgaccgtgacccacatctttacatccgatggcttacatgcagaagtcactggcgttggctacaaccaatttggagaggtgatcgtggacggggacgtagtccacggcttctataaccccgcggtctcgcggatcgtggaggctgggtgcgtgtgcaacgatgccgtgatcaggaataacacattaatggggaaacctaccgaaggtgctctcatcgcactggcaatgaaaatggggttagacgggcttcaacaggactacatccggaaagccgagtacccattttcatccgagcagaaatggatggcggtcaagtgcgtgcaccgtacccagcaggatcgaccagagatctgctttatgaaaggggcctatgagcaggtcattaagtactgtacaacataccaatccaagggccagacactgaccctcacacagcaacagagagatgtgtaccaacaggagaaagcaaggatggggagtgccgggcttagagtgcttgccttggcctctggaccagagctgggacagctaacattcctggggttggttggcataatcgacccaccccgtaccggagtcaaggaagccgtcacaacacttattgcatccggggtgagcatcaagatgattactggggattcccaggagactgccgtggccatagccagccggctgggactgtattctaagaccagccaatcagtatccggggaggaaatcgatgctatggatgttcagcagttgagtcagatcgttcccaaggtggcggtcttctacagagcgagtccccgccataagatgaagataattaaatcactgcagaaaaacgggagtgttgtcgcaatgacgggggatggggtcaatgacgcagtcgcacttaaggcagctgatattggagtcgcaatgggtcagaccggcactgacgtgtgcaaagaggccgcagatatgatcctggtggatgatgattttcaaacaattatgtctgccattgaggagggcaaggggatttataacaatattaaaaatttcgtccggtttcagcttagtacaagcattgctgccctgactctcataagtctggccacccttatgaacttcccaaaccctttgaatgcaatgcaaatactatggatcaacataattatggatgggccacctgctcagtccttgggggtggaacctgtggataaagacgtgataaggaagcctccccgaaactggaaggatagcatcttaacaaaaaacctgatattaaagatcttagtcagttctattattattgtgtgcgggactctctttgtgttttggcgcgaactgcgagacaacgtgattaccccccgcgacaccacgatgacgttcacttgttttgttttctttgatatgtttaatgccctttccagtcggtcccagaccaaaagtgtatttgagatcggcctgtgctccaatagaatgttttgctacgccgttctcggaagcattatgggacagttgctggttatttactttccgccattacagaaggtgtttcaaacagagtccctgagcattctagacctcctgttcctgttagggcttacctcttccgtttgtattgtcgcagagatcataaaaaaggtggaaagatctcgggagaagatccaaaagcacgtatctagcacatcaagctcctttctggaagtgtag

SEQ ID NO: 109003 - DNA, 2772 bp, Artificial Sequence
  Description of Artificial Sequence: Synthetic coding sequence
atgatccctgtgctgacttcaaagaaggcctcggagctcccggttagcgaggtagctagcatactgcaggccgacctccagaacggattaaacaagtgcgaggtgtcacatcgacgtgcctttcacgggtggaatgaatttgacatttccgaagatgagcctttatggaaaaaatatatcagtcagttcaagaacccactgatcatgctgctgcttgcatccgccgtgatctcagtactgatgcaccaatttgatgatgcggtcagtatcacagtggcaatacttatcgtggtgacagtggcttttgtgcaggagtataggtctgagaagagtctggaggagctgtccaaactggtgccccccgagtgtcactgcgtgcgggaaggcaagctggagcacaccctggcacgtgatctagtgccgggtgacactgtgtgtttgtcagtgggagacagggtgcccgccgatctgaggctgttcgaggctgtggatctgtctatcgatgagagtagcctcactggcgagaccaccccctgtagcaaggtgactgcaccccagccagccgcaacaaacggcgaccttgccagcaggtcaaacattgcatttatggggacgctcgtcaggtgcggaaaggctaaaggggtggtgatcggaaccggcgagaattctgagttcggagaggtttttaaaatgatgcaggccgaagaggcaccaaaaacgcccctgcagaagtcaatggacctccttgggaaacagctgtccttttacagtttcgggattattggaatcattatgttagtgggctggctgttgggcaaagatatcctggagatgtttaccattagtgtatcccttgctgttgccgccattccagaaggcctgccgatcgtggtgaccgtgactctcgccctgggcgttatgcgcatggtaaaaaagcgggcaatcgtcaagaaactcccgatagtagaaaccctgggctgttgcaacgtgatctgtagcgacaagaccggaaccctgacaaaaaatgagatgaccgtcactcatatatttacctctgacggactgcacgctgaggtaaccggggtcggctataaccagttcggagaagttatcgtggatggcgatgtggtgcacggattttacaaccctgctgtttctcggatcgtcgaggccggctgcgtttgcaatgacgccgtgattagaaacaacacattgatgggaaaaccaactgaaggagcactgatcgccttagccatgaaaatggggctggacggccttcagcaagactatattaggaaagctgagtatccgttttcatccgagcaaaagtggatggcagtgaaatgcgtgcatcgcacccagcaggatcgtcccgagatctgtttcatgaagggggcctatgaacaggttataaaatactgcaccacgtatcaaagtaaaggtcagaccctcaccctcacacagcaacagcgcgatgtatatcaacaggaaaaggccagaatgggatcagcaggtttgcgcgtgctggcacttgcctctggcccagagctcgggcagctgacctttcttggactggttggaattatcgatcccccccgcacgggagtgaaggaggcggtgaccacactcattgcctcaggagtgagcatcaaaatgatcactggggattcccaggagacagctgtcgccattgcgagtcgcctggggctgtattctaagacgtcccagtccgtatctggcgaagaaatcgacgctatggatgttcaacagctgtcacagatcgtgcccaaggtggctgtgttttaccgtgcgtcgcctcgccataagatgaagatcatcaagagccttcagaaaaacgggagtgtggtcgccatgaccggagatggggttaacgatgctgtagctctcaaggccgcagacatcggtgtggcaatgggtcagaccggtactgacgtgtgcaaggaagcagccgatatgatcttagtcgatgacgatttccaaacaatcatgagcgccatagaagaaggcaagggcatctacaataatattaagaatttcgttagatttcagctatctacgagtattgccgccctgacattaattagcctcgcaaccctcatgaacttcccaaatcccctcaatgccatgcaaatcctctggatcaacattatcatggatggccctcctgcacagagtctgggagtggaacccgttgacaaggatgtaattagaaagcctcccagaaattggaaggactccatcttaaccaagaatcttatcttgaagatactggttagttccattatcattgtgtgcgggactcttttcgtgttctggagagaattgagagataatgtaattacgccgcgggataccaccatgacgttcacgtgctttgtgttcttcgacatgttcaacgcgctgagcagccgaagtcaaaccaagagcgttttcgaaatcggcctgtgttcaaatcgcatgttttgctacgccgtcctgggctctatcatgggtcagttgttagtgatttacttccctcctttacagaaagttttccagactgagtccctgtctattctggacttactgttccttctcggcctgacctcaagcgtctgtattgttgccgaaattatcaaaaaggtcgagcgctcgcgagagaagatccagaagcatgtgtggttgtgggaacgcagtggacagcagctggtagagatccacccccatctcgaaactggtctccctctgactgaagacgtgagttgcgtatag

SEQ ID NO: 109004 - DNA, 249 bp, Artificial Sequence
  Description of Artificial Sequence: Synthetic coding sequence
atgattcccgtgctgacctcaaagaaggccagtgaacttcccgtctccgaagttgcatccattctgcaggctgaccttcagaacggccttaataagtgtgaggtgtcgcaccggcgcgcttttcacggatggaacgaattcgacatctccgaggatgagcccctctggaagaaatatatcagccagtttaagaaccctctcatcatgctcctcctggcttccgccgtgatatcagtgctgatgcactag

SEQ ID NO: 109005 - DNA, 2760 bp, Artificial Sequence
  Description of Artificial Sequence: Synthetic coding sequence
atgaaggtggccaggttccagaaaatcccgaacggggaaaatgaaacaatgattcccgtgcttacatcaaagaaagcgtctgaactgcccgttagtgaagtggcgagcattctccaggcagacctccagaacgggctgaacaagtgcgaagtgagtcatagacgtgctttccacggatggaacgagttcgacattagtgaggacgaaccactgtggaaaaaatatatctctcagtttaagaacccactgatcatgctcttgctggcttccgctgtgatttctgtgctaatgcatcaattcgatgatgcagtctccattacagtggccattctcattgtagtgacagtagccttcgtgcaagagtaccgctctgaaaagagcctggaagagctatctaagctcgtgcctcccgaatgccattgcgtccgtgaggggaaactggagcatactctggctagggatctggtacctggcgatactgtttgtctttcggtgggtgatcgggtgcccgcagaccttaggctgtttgaggccgtcgacctgtcaattgatgagtccagccttacgggtgagaccactccgtgcagcaaggttaccgccccccagcctgccgccaccaatggagatctcgcctctaggtctaacattgccttcatgggaaccctagtacggtgtggtaaggcgaaaggggtggtgattggtacaggagagaattcagagttcggcgaggtatttaaaatgatgcaagctgaagaagctcccaagactcctcttcagaagagcatggatctgctgggcaagcagctctctttctactcattcgggatcatcggcattattatgctggttgggtggctactggggaaggacatcctagaaatgtttacaataagcgtgagcctggctgtagcagctattcctgaaggcttacccattgtggtaaccgtgacacttgcgctgggtgtgatgcgcatggtgaaaaaaagagccatcgtgaaaaagctgcctattgtggagacactgggttgctgcaatgttatctgtagtgataagacaggcaccctaactaaaaacgaaatgacggtgactcatatttttacttctgatggtcttcacgctgaggtgactggggtgggatataaccaatttggggaggttatcgtggatggcgacgtcgtgcacggcttctacaatcctgcagtcagtaggatcgtcgaggctggctgcgtatgtaatgatgcggtcattcgcaataatactctcatggggaagcccactgaaggggcccttattgctctcgccatgaaaatgggcttggatgggctccagcaagactacataaggaaagcggagtacccattttccagcgaacaaaaatggatggccgtaaagtgtgtgcaccgtacgcagcaagacagaccagaaatttgttttatgaagggcgcctacgagcaagtgataaagtactgtaccacttaccaatcgaaggggcaaactctcaccctgacacaacagcaacgcgacgtttaccagcaggagaaggcgaggatggggtcagccgggttgagggtgcttgcattggcctcaggcccggagttaggacagctgactttcctcggtctggtgggtattattgatcctcctcggacaggcgtgaaggaagcagttacaacgttgatagctagcggcgtcagtatcaagatgatcacaggtgactcacaggaaactgctgtcgccatagcgtccaggctgggtctgtactcaaaaaccagtcagtccgtgagcggcgaggagatcgatgccatggatgttcaacagctgagccaaattgtgcccaaagtggccgttttctacagggcgtctccccgacataaaatgaagatcatcaagtctctgcagaagaatgggtcagtggtcgcgatgacaggcgatggggtgaatgacgcagtggcactgaaagcggctgatatcggggtggctatggggcagaccgggaccgacgtttgtaaagaggcagctgacatgatcctcgttgacgatgacttccagacaattatgtccgcgattgaggaagggaagggtatttataataatataaaaaatttcgtcagatttcaactctcaaccagcattgccgcgctcacgcttatatcattagccactctcatgaatttcccaaaccccctgaacgccatgcagatactctggatcaacatcattatggatggcccccctgctcagtccttgggtgtggaaccagtggataaagacgtcatccgcaaacccccccgcaattggaaggacagcatccttaccaaaaatttaattctgaagatcttagtatcttctatcattatcgtttgtggtacactgttcgtgttttggcgggagctgcgcgacaacgtaattacgccgagggatacaacaatgacttttacttgttttgtcttcttcgatatgttcaatgccttatcaagtcgttctcaaactaaatcagtgtttgaaattggcctctgttctaaccgaatgttttgttatgccgttctgggctcgattatgggacagctcctggttatttactttccgcccctgcagaaggtgttccaaaccgaatcactgagtatattggaccttcttttcctgttggggctgacctcaagcgtttgcattgtggctgagatcattaaaaaagttgaacggagccgggaaaaaattcagaaacacgtcagcagtacaagctcaagctttctggaggtctag

SEQ ID NO: 109006 - DNA, 309 bp, Artificial Sequence
  Description of Artificial Sequence: Synthetic coding sequence
atgaaagtcgcaagattccagaagatccctaacggggagaacgagacaatgattcctgtgctcacaagcaagaaggcaagtgagctccccgtcagtgaggtcgccagcatactgcaagcagacttgcagaacggcctgaataagtgcgaagtcagccataggcgcgctttccacggctggaacgagtttgacatttccgaggatgaacccttgtggaagaaatatatttcccagtttaaaaaccctctcattatgcttctgctggcttccgcagtgatctccgtactgatgcaccaattcgatgattag

SEQ ID NO: 109007 - DNA, 2760 bp, Artificial Sequence
  Description of Artificial Sequence: Synthetic coding sequence
atgaaggtggcaaggtttcagaagattcctaacggggagaatgagaccatgatccccgtccttacgagtaagaaggctagtgagctgcccgtctctgaggtggcgagtattctgcaggccgaccttcagaacggcctgaacaagtgcgaagttagccacagacgcgcctttcacggatggaacgagttcgacatctcagaggatgaacctctttggaaaaagtatatttcacagttcaagaacccgctgattatgctgttgctggctagcgctgttatatccgttctgatgcaccaatttgacgatgcagttagcatcacagttgctatcctgatcgtggtgactgtggcattcgtgcaggaatacaggtctgaaaaaagtctggaagagctatctaaacttgtcccacctgagtgtcactgcgttagggagggaaaactggagcataccctggctagagatcttgtgcccggagacactgtgtgtttgtcagtaggcgacagggtccccgctgatctgcgactcttcgaagccgtcgacctgagcatcgatgaatcttctctcaccggggaaaccaccccttgctcaaaagtcacagccccccagcccgcggcaactaatggagacctggcatcacggtctaatattgctttcatggggaccctcgtccgatgtggcaaagctaagggcgtggttattgggactggggaaaactcagagtttggggaagtgtttaagatgatgcaagctgaggaggctcctaaaaccccacttcaaaaaagcatggatttgttagggaaacagctgagcttctatagctttggaatcattggcattatcatgctggtcgggtggctactgggcaaggacatcctcgaaatgtttacaattagcgtctcacttgccgttgctgcaattcctgaagggctcccgattgtggttacggtcacactagcgcttggagttatgagaatggttaaaaaaagagccatcgtgaagaagctgcccattgtagagaccctgggctgttgtaatgtaatttgttctgataagaccggaaccttgaccaagaacgagatgaccgtgacgcatatttttaccagtgacgggctgcacgctgaggttactggagttggatataaccagtttggagaggttatagttgatggagacgtggtgcacggcttctacaatccagctgtgagccgcatagtcgaggcaggttgcgtttgtaacgacgccgtcatccggaataacacactcatggggaagcccacggagggggctctgatcgctttggccatgaagatgggcctggatggcctccagcaggactacatccgcaaggccgagtacccattttcatctgagcagaagtggatggcggtgaaatgtgtgcaccgtacacaacaggaccggccggagatctgtttcatgaagggcgcctacgagcaggtcataaagtactgcacaacataccaaagcaaagggcagacactcaccctgacacagcagcaacgggatgtctatcaacaggagaaagcccgtatgggatctgcaggcttaagggtcctggctttagcgtctggccctgaactagggcaattgacctttctgggcttggtgggcattatagatcctcctaggaccggtgtgaaggaagcagttacgacgcttattgccagtggcgtgagtattaagatgattactggggatagtcaggagactgccgtggccattgcttctagattgggtctgtatagcaaaaccagtcagtctgtgtccggcgaggaaattgacgccatggatgtgcaacagctgtctcagattgtgccaaaggtggccgtcttctaccgcgcctccccccgccataagatgaagattatcaaaagcttgcagaagaacgggtcagtggttgctatgacgggggacggtgtaaatgatgccgtcgccctaaaagcagccgatatcggagtcgctatgggccagaccggcactgacgtgtgcaaggaagctgcagatatgatcttagtcgatgatgacttccagaccattatgagtgcaattgaggaaggaaagggcatctacaacaatattaagaatttcgtccggttccagctttcaacctctattgcagcactgacactcatctccctggcaaccctgatgaatttccccaaccccttgaacgccatgcaaatcctctggatcaacattattatggatgggcctcccgctcagagccttggagttgaacctgttgataaggatgtcattaggaaaccacccaggaactggaaggacagtattctaaccaaaaacctaatccttaagattctggtttcctcaattatcatcgtgtgtggaactctttttgttttctggcgtgagctgcgcgataatgtcatcacccccagagacacgacgatgaccttcacatgttttgtattcttcgatatgtttaatgcactgtccagtagaagccagacaaagtctgtgttcgagattggactctgctctaacaggatgttttgctacgctgttcttggatcaattatgggccagcttctggttatttactttccacctcttcagaaagtcttccagacagagagtctctcaatactcgatctgctctttctgctgggcctcacctcttctgtttgcatagtggctgaaatcattaaaaaggtggaaaggtccagggagaaaatccaaaaacatgtgtcatccacctcgtcatccttcctggaagtctag

SEQ ID NO: 109008 - DNA, 2772 bp, Artificial Sequence
  Description of Artificial Sequence: Synthetic coding sequence
atgattccagtgctgactagcaaaaaggcctcagaactgccagtctcagaggtcgccagcattctgcaggccgacctccagaatggcctcaataagtgcgaggtgtctcacaggcgcgcattccatggctggaatgagttcgatatctcagaggatgagccactctggaaaaagtacatctcacagtttaagaatcccctgattatgctgctccttgcgtctgccgtcatttcagtcttgatgcatcagtttgacgacgcagtcagtatcacagtggccattttgatcgtggttaccgtcgcgttcgtgcaagagtaccggagcgaaaagagcctggaggaattgtccaagctggtaccgccagagtgccattgcgtacgggaaggcaagctggagcacacactcgccagagacctcgtacctggcgacacagtgtgcctgagcgttggcgaccgcgttcccgcagatctccgcttgttcgaagccgtggacctttccatcgatgagagctcactgactggagaaaccacaccctgtagcaaggtgacagcacctcaacctgcggcaactaatggagatctagctagccgttctaatatcgcattcatgggaacgctcgtgcgctgcgggaaggccaagggagtagtgatcggcaccggcgagaactctgagttcggtgaggtgtttaagatgatgcaggccgaagaggcgcccaaaactcctctgcagaaatccatggatttacttggaaaacaactcagtttctattcatttggaatcattgggatcatcatgttggtcggatggctcttggggaaagacattctggaaatgttcactatttcagtgagcctggcagtggccgcgatcccagagggattgcctatcgtcgtgaccgttactcttgctctgggagtaatgaggatggtgaaaaaaagagctatcgtgaagaaattacccatcgtggaaacactgggctgttgtaacgtgatctgctctgacaagactggtacattaacgaagaatgagatgactgtgacacacatttttacctccgatggtttgcacgcagaggtcacgggagtcggatataatcagttcggcgaagtgatagttgacggagacgttgtgcacggtttctacaaccctgcagtgtcaagaatcgtggaagccggctgcgtgtgtaatgacgcagtcattaggaataacacgctgatgggcaaacccactgaaggtgctctgatcgcactggctatgaaaatgggtttagacggtttgcagcaggactacattcgaaaggccgaatatccattctccagcgagcagaaatggatggctgtgaaatgtgtccaccggacacagcaggatcgacctgagatctgcttcatgaagggcgcatacgaacaggtcattaaatactgtaccacctatcagtctaaaggccagactcttaccctaactcagcagcagcgggatgtgtaccagcaagaaaaagcaagaatggggtcagccgggctgagggttttggccttagcctcaggaccagaactcggccagctcacctttttgggcctcgtagggattatcgatccccctaggacgggcgttaaagaggcggttacaaccctgatcgcaagtggggtttccattaagatgatcactggggacagccaggaaacagccgtggctatcgccagcaggctcggactctatagcaaaacatctcagagcgttagtggtgaagagatcgatgcaatggacgtgcagcagctgtcgcagatagtccctaaggtcgccgttttctacagggcgtcgccacggcataagatgaaaatcattaagtctctccagaagaatggcagcgtggtcgccatgacaggagatggggtgaatgatgcagtggctctcaaggctgccgatatcggtgtggcgatggggcagaccgggacagacgtttgtaaagaagcagccgatatgatactggtcgatgacgatttccagactatcatgtctgctattgaggaggggaaagggatctataataacattaagaactttgttaggttccaactgtcaacgtctatcgccgcgcttacactcatcagcctcgcgaccctgatgaattttcctaaccccctcaacgcaatgcagatcttgtggattaacattatcatggacggccctccagcccagagcctgggggtggagccggtagacaaagatgtgattcggaagccccctcggaactggaaagactcaattctgaccaaaaatttgatactgaaaatcctggtctcctcaattatcatagtgtgcggaactctgttcgtgttctggagagagctgagagataacgttattactcctagagacaccacaatgaccttcacttgttttgtattttttgatatgttcaatgccctgagcagtaggagtcagacaaagtcagtgtttgagattggcctttgctctaacaggatgttctgctatgccgttctgggctctattatggggcagcttctggtgatctattttccccctcttcaaaaggtgttccaaactgagagcctgtccatcctcgatctgctgttccttttgggactgacgtcgtctgtgtgtatagtggccgaaattatcaagaaagtggaacggtcccgggagaagattcaaaaacacgtgtggctgtgggagaggtccggacaacagctggtggagatccacccccacctggagacaggcctgccacttactgaagacgtgagttgtgtgtag

SEQ ID NO: 109009 - DNA, 2835 bp, Artificial Sequence
  Description of Artificial Sequence: Synthetic coding sequence
atggactctcttctgcctccaagcagattcagttacttcaagaagtatccgttgcacgccattcggcgctacctaagcactctgaggaaccagagggcagaagagcaggtggctcggttccagaaaatccctaatggggaaaacgaaacgatgatcccagtgctgaccagcaagaaggcctctgaactcccggtgtctgaggtggccagtattctgcaattcaaaaatcctctcattatgctgcttctcgcttctgctgttatcagtgtgctgatgcaccagtttgatgacgctgtgtcaattacagtcgccattctgattgtcgttactgtcgcatttgttcaggaatatcgctctgagaagtcccttgaggaactcagcaagctagtgcctcctgaatgtcattgtgtgcgtgaagggaagctagagcacacactcgcgcgtgacctggtaccaggagacacagtgtgtctgagcgttggagaccgggtacctgccgacttgagattattcgaggccgtcgacctgagtatcgatgaatcaagcctcaccggagaaacgactccgtgtagcaaggtgaccgccccacaacccgccgccactaatggggatcttgcctcccgctccaatattgcatttatgggaaccctcgtgcggtgtggtaaagccaaaggggtagtcattggaacgggcgaaaattctgaattcggggaggtatttaagatgatgcaggccgaagaggcacctaagaccccactgcaaaaaagcatggacctgcttggaaaacagctctctttctattcttttggtatcattggaattatcatgcttgtaggatggctgcttggcaaagacatcttggagatgttcacaattagcgtttctttagcagtggcagctattcccgagggactgccaatcgtggtaaccgttactctggccctgggagtaatgcggatggtaaaaaagcgagctatcgtgaagaagctcccaatcgtggagaccctcggctgctgtaacgtcatctgttccgataagactggaacactgacaaagaatgaaatgactgtgacacatatctttacgtccgatggtctccatgccgaagttacgggtgtgggatacaaccagttcggggaggtgatcgtcgacggcgacgtggtgcacggattctacaatccagcagtatcaagaatcgtcgaagcggggtgtgtgtgcaacgatgcagtgatcagaaataacacgctgatggggaagccaaccgaaggtgctctgattgcactcgcaatgaaaatgggcctggatgggctccagcaggactacatccgcaaagctgagtaccccttctccagtgagcagaagtggatggctgttaagtgcgtccaccgcacacaacaagatagaccagaaatttgcttcatgaaaggagcctatgagcaagtgatcaagtactgcacaacataccagtcaaaaggccagactttgacattgacccagcaacagcgagatgtatatcagcaagagaaggcaaggatgggttctgcaggtctcagagtcctggcactggcttcgggacctgaactaggacagttgaccttcctgggcctagttggcataatcgacccccctagaactggagttaaagaggcagtgacaacccttattgccagcggcgtgtccattaagatgataaccggagattcccaagaaactgccgtggccattgcaagcagacttgggttgtattcaaaaacgtcacagtcagtgagcggcgaagaaattgacgctatggatgtccagcaactcagccaaatagtgccgaaagtcgctgtgttctatcgagcatctcctagacacaaaatgaagatcatcaagtcccttcaaaagaatggaagtgtagtggccatgacgggcgacggcgtaaatgatgctgtggcactgaaagccgcagacataggcgtggcgatgggacagactggaaccgacgtctgtaaagaggccgctgacatgatcttggtcgatgacgattttcagactataatgtctgctattgaagaaggcaaggggatctataacaatatcaaaaacttcgtacgctttcagctctccacgagcatagccgccctcacactgataagcctggctactctgatgaatttcccgaatccattgaatgctatgcagattttgtggattaatatcatcatggacgggccacctgcacagtcactgggtgtggaacccgttgataaggatgtgatacggaagccacctcggaactggaaggactctattctaactaagaacctgatcctgaaaatcttagtatcttcaattataatcgtttgcggaacactgtttgtgttttggcgagagctgagagacaatgttattacgcctcgtgacaccacaatgaccttcacttgttttgtgttcttcgacatgttcaacgctctctcttctagatcacagaccaaaagcgtgtttgagattggattgtgctccaatcgaatgttctgctacgctgtactcggatctatcatgggtcagcttcttgtgatctactttcctcctctgcagaaagtcttccagacagagagcctgagtattctagatttactgttccttcttggcctgacaagtagtgtgtgtatcgtcgccgaaattattaagaaggtggaacgatcccgggagaaaatacagaaacacgtgagttcgacatctagcagcttcctcgaggtttggctgtgggagcggtctggccagcagttggtggaaatccacccccacctggaaactggactaccgctcaccgaagatgtgtcttgcgtgtag

SEQ ID NO: 109010 - DNA, 2841 bp, Artificial Sequence
  Description of Artificial Sequence: Synthetic coding sequence
atggtcgaggggagagtgtctgagtttctcaagaaactgggctttagcggtggcggccggcaatatcaggcgctagagaaggatgaagaagaagcgcttattgatgagcagtctgagctcaaggccatagaaaaagagaagaaggtcacagccctcccccccaaagaggcctgcaagtgccaaaaagaagacctcgcccgcgccttctgcgtggatctccacactggcctatctgagttttcagttactcagcggcggttggcccatggctggaatgagtttgtcgccgataacagtgagccagtctggaagaagtatttagatcagtttaagaaccccctgattctgctactgttggggtcagccctcgtctccgtactgacaaaggagtatgaagatgcggtttccatcgccactgcagtactggtggtagtgactgttgcattcatacaggaataccggtccgaaaagtctctggaggaactgacaaaaatggtgcctccagaatgcaattgcctgagggaaggaaagctccaacacttactagcaagagaacttgtgcccggggacgtagtgtcactcagtataggcgacagaatacccgctgatataaggctcactgaggttaccgacctgctcgtggacgaaagctctttcaccggggaggccgagccatgcagtaaaactgatagccccctcaccggaggtggagatctgacgacgctttctaacatcgtgttcatgggcaccctggttcagtatggtcggggccagggggttgtgatcggtacaggggagtcttctcagttcggagaggtctttaagatgatgcaggctgaagagacaccaaagacacccctacagaaatcaatggaccggctaggtaagcagctcacgctattctccttcggcatcattgggctgatcatgctcataggctggagccaggggaagcagctgctgtctatgtttaccattggagtaagtcttgcggtcgccgctatacccgagggactgcccatcgtagtgatggtcacgctcgttctcggcgttctgagaatggccaaaaaacgcgtgattgtcaaaaagctcccaatagttgaaaccctaggttgttgcagtgtcctttgcagtgataagaccggcactctgactgcgaatgagatgactgtaacacagttggtcacttcagacgggctaagggcggaagtgtctggcgtgggatatgatgggcagggtacagtctgcctcctgccaagcaaggaagtgattaaagaatttagcaatgtgagtgtgggcaaactcgtagaagccggttgtgtggccaataacgccgtgatcagaaaaaacgctgttatgggccagcctaccgagggcgcattgatggctttggccatgaagatggatctctctgacattaagaattcctatatcagaaagaaggagataccattctccagcgagcagaaatggatggcagtgaagtgttccttaaaaacggaggatcaagaagatatctactttatgaagggcgccctggaggaggtcatccggtattgtacgatgtacaataatggggggatccccctcccgctgaccccacagcaacggtctttttgcctccaagaagaaaagagaatgggctcgttggggctcagggtgctcgccctggcttctgggcccgagcttggccggctgacctttctgggcctggtcggaatcatcgatcctcctcgcgtgggagtgaaagaggccgttcaggttctctctgaatcaggtgtatcagtgaaaatgattacaggagatgcattagaaaccgcacttgccatcggccgcaatataggtctctgtaatgggaaactgcaggccatgagcggagaggaggttgatagtgtagaaaaaggtgagctggcagacagagtggggaaggtctccgtcttctttaggacttctcccaaacacaagttgaagatcattaaagcattgcaggagagtggcgcaatcgtagcgatgacaggcgatggggtaaatgacgccgtggcgttgaaatccgcagacattggtattgccatgggacaaacaggaaccgacgtcagcaaagaggctgccaatatgatccttgtggacgacgatttttcggcgatcatgaatgccgtggaagagggcaaggggatattctataatatcaagaactttgtcagatttcagctgtctaccagcatctctgctttaagcctgattacattgagcacagtctttaatttacccagtccactcaacgccatgcaaattctttggattaacatcataatggacggtcccccagctcagtcactcggcgtcgaaccagtggataaggatgcttttcggcagcccccaaggtccgtgcgggatactatactgtccagggctctgattctgaaaatcctgatgagtgcagccatcataatctcaggcaccctgttcattttttggaaggagatgcctgaggatcgagcttccaccccgagaacaaccacgatgacctttacatgcttcgtgttctttgacctcttcaatgcgctgacatgcagatcccaaactaaactcatattcgagatcggattcctccgaaaccatatgttcctttactctgtgctcgggtctatcctcggccaattggccgttatctatatacctcccttgcagagagtattccagaccgagaacttaggcgccctcgatttgctgttcctgaccggactggcctcttccgtttttatcctttcagagttactgaagctctgtgagaaatactgctgcagtccaaagagggttcagatgcatcccgaagacgtctag

SEQ ID NO: 109011 - DNA, 2928 bp, Artificial Sequence
  Description of Artificial Sequence: Synthetic coding sequence
atggttgaggggagggtgagtgaattcctaaagaagctgggcttttccggaggaggaagacagtaccaggctttagaaaaggacgaagaggaagctcttattgacgagcagagtgagctcaaagccattgagaaggagaagaaagtcaccgccttacctcccaaggaggcgtgcaagtgtcagaaggaggatctggctcgcgccttttgcgtggacctgcacaccggcctctcagagttttccgtcacccagcgacgtttggcccacggatggaacgagtttgtcgctgataatagtgaaccggtatggaaaaagtatctcgatcaattcaagaatccactcatcctgctcctcctcggctctgcccttgtctccgtgctcaccaaagagtatgaggatgccgtttccatcgcgactgcagtgctggtggtggtcacggtggcctttatccaagaataccggtcagaaaagagtctggaagagttaaccaagatggtgcctcccgagtgcaattgcctgcgggagggtaagttacagcacctgctggcaagagaattagtcccgggagacgtggtgagcctctccataggagacaggatcccggcagacatccgcttgaccgaggttacagaccttctcgtcgacgaatcctctttcaccggggaggcggagccctgctcgaaaactgactccccactaacaggggggggtgaccttacaaccctgagtaacattgtcttcatgggcacgctggtccagtacggtagaggccagggggttgtgatcggaaccggagaatcctcccagtttggggaggttttcaaaatgatgcaagcggaggagacaccgaagactcctctgcaaaagtctatggatagactgggcaagcagctgacgctgttcagttttggcatcattggccttataatgctgattggctggtctcaaggaaaacaactgttgagtatgttcacgatcggcgtgtctctcgcagtggctgcgatccccgaagggctgcccatcgtggtgatggtgacattggtgttaggagtgctgaggatggccaaaaagcgtgttatagtgaaaaagctcccaattgtggagactcttggttgttgcagcgtgctctgctctgataagacaggcactcttacagccaatgaaatgacagtgacacaactggtcacatctgacggcctgcgggctgaagtgtccggggtaggttatgacggccagggtacggtgtgtctgctgccaagtaaggaagtgatcaaagaattcagcaatgtgtcggtgggaaagcttgttgaagccgggtgcgtcgccaataatgctgtgatccgcaaaaacgccgtaatggggcagcccactgagggtgctctaatggctctggctatgaagatggatctgtctgacatcaagaactcctatatacgaaagaaggagatcccattctcatctgaacagaagtggatggcggtcaagtgttcactgaaaaccgaggatcaggaggacatctattttatgaagggggccctggaggaggtaataagatattgtactatgtacaacaatgggggcatacctctgcctttgacacctcagcagagatcattctgcctgcaggaggaaaagaggatgggaagcttgggcttgagggtgttggcattagctagcggtccagaacttggacgcctcacttttctggggctggtcgggatcatcgatcccccgagagtgggcgtaaaagaggcggtacaggttctgtcagagagcggggtctccgtgaaaatgatcactggtgacgcgttggagaccgccctcgcaattggccgaaacataggattgtgcaacggaaagttacaggccatgagtggagaggaggttgactctgtggaaaagggagagctcgcagaccgtgtgggaaaagtgtctgtattcttccgtacctcccctaagcataagctgaagatcattaaggccttgcaggagtccggagctatcgttgccatgaccggcgacggagtgaatgatgccgtggcacttaagtcagccgacatcggaatcgccatgggacagacaggcacagacgtgtccaaggaagccgccaatatgattctggtagatgatgatttctcagcgatcatgaatgccgtggaagagggtaagggcatcttctacaatattaaaaactttgtaagatttcagctctccacatccatttcagctctcagcctgataacattaagcaccgttttcaatctgcccagtcctctcaacgcaatgcagatcctgtggatcaatattatcatggatgggccgcccgcacaacgctcgtcgcagaaaactgaggtgtgctgtacggccgttagacttggagtggaggggaggggggaatccacttgggctggacgggcaggtctgggtgttgaacccgtggataaagacgcatttcgccagcccccccggagcgtcagagacaccatcttgtccagagcactgatcttgaaaatcctgatgagcgctgcaattatcatatctgggacactgtttattttttggaaggaaatgcccgaagacagggcttccactccacgaactacgaccatgacctttacatgtttcgtcttttttgacctcttcaatgcattgacatgcaggagccagaccaagcttatttttgaaattgggttcttgaggaatcatatgttcctatattctgtcctggggtcaattctgggacagttggccgttatctacatccctcccctgcagagagtcttccaaaccgagaatctgggcgccctggatcttcttttcctgacaggcctagctagtagtgtctttatattgagcgagttacttaagttatgcgagaaatattgctgctcacctaagcgggtgcagatgcaccctgaggatgtatag

SEQ ID NO: 109012 - DNA, 2388 bp, Artificial Sequence
  Description of Artificial Sequence: Synthetic coding sequence
atgcggacaccgagcgcaagcccacggcagtgcctttcttggtctctgagtcctagttcatccctgcgcgaaggaaagctgcagcacttgcttgctagggaattggtgcctggagatgtcgtttccctcagcattggcgacaggattccggccgacattcgccttactgaggtcacagaccttctggttgatgaaagcagcttcaccggtgaagcagagccatgctctaagaccgacagtccactcacgggaggcggcgatctaactactttaagtaacattgtcttcatgggaacacttgtccagtacgggcgcggtcagggagtcgttattgggaccggagagtcttcccaattcggagaagtgttcaaaatgatgcaggcagaagaaaccccaaaaacacccctgcaaaagtccatggaccgactggggaagcagctcaccctgttctcttttggcatcatcggacttatcatgttgatcggctggtcccagggaaaacagcttctttcaatgtttaccattggagtaagcctagctgtcgccgccatccctgaaggcctccccatcgtcgttatggtcactcttgtcctcggagtgcttcggatggccaaaaagagagtcatcgtgaagaaactccccattgtggagactctggggtgctgcagtgtgctgtgctccgataagacgggcactttaacagctaacgagatgacggttacccagttagttacatctgatggcttgcgggctgaggtgtctggtgtcggctacgatggccaaggcaccgtgtgtctgttgcccagcaaagaggtaatcaaggagttttctaacgtgtccgtgggcaaactggtggaggcggggtgtgtggccaacaacgccgtgatcagaaagaacgcggttatgggacagcccaccgagggtgctttaatggccctggccatgaagatggatctgtctgatataaaaaattcatatatcaggaaaaaagaaatccccttctcctcggagcagaaatggatggccgtcaagtgctcactcaagaccgaagaccaagaggacatctactttatgaagggtgctctcgaagaagtcattcgctactgcacaatgtacaataatgggggcatccccctccccctaacgccgcagcagcgaagtttctgtctacaggaggagaagcgaatgggcagcctcggattgcgagtgttggcacttgcaagtgggccagaacttgggaggctcacttttttaggactcgttggcatcatcgatcctcctcgcgttggggttaaggaagccgtgcaggtcctgagcgaaagcggtgttagtgtgaaaatgattacaggtgacgccctagaaacagctttggccatcggtcgaaatataggcctatgcaatggaaagctgcaggctatgtccggggaggaggtggactcagttgaaaaaggagaattagctgaccgagttgggaaggtaagcgttttcttccggacgtcacccaagcacaaactcaagatcattaaagcactgcaggagtcaggagcaattgtcgcaatgacaggagatggggtgaacgatgctgttgcactgaaatccgctgacattgggattgctatgggacagaccggaaccgacgtatctaaggaagccgctaatatgatcctggtggatgacgatttctcggccattatgaacgctgtggaggaagggaagggaatcttttacaacatcaaaaatttcgtccggttccagctgtcaacaagcatttccgccctgtctctgataaccctctctacagtgttcaacctgccgtcacccctgaacgcaatgcagattctgtggatcaacattattatggacgggccaccagcacaaagcctcggagtggagccagtagataaggatgcgtttcgacagccaccgaggtcagtgagggataccatactttcacgagcgcttatcctcaagattttgatgtcggcagccattatcatctcaggcaccctattcattttctggaaggaaatgcctgaggaccgtgccagcacccccaggaccaccaccatgacctttacctgtttcgttttctttgacctgttcaatgccctgacctgtcggagtcagactaagctaatcttcgaaattgggttcctgcgcaaccacatgttcctgtatagtgtgctagggagcatacttggacagttagctgttatttatatcccgccacttcagagggtgttccaaactgaaaaccttggtgccctggacctgctcttcctcacaggtctggcaagcagtgtatttatcctttcagagttactcaagttatgcgagaagtactgctgcagcccaaaacgagtccagatgcatccagaggacgtgtag

SEQ ID NO: 109013 - DNA, 3090 bp, Artificial Sequence
  Description of Artificial Sequence: Synthetic coding sequence
atggaagccgcccatctgcttcccgcagccgatgtcctacgccacttcagtgtcaccgcagagggaggcttgtctccggcccaggtgaccggcgccagagagcgatacgggccgaatgagctgccatcagaggaaggaaaatcactgtgggaacttgtgttggaacaatttgaagatctcctcgtcaggattctgctgttggccgcactcgtgtctttcgttctcgcctggttcgaggagggcgaggaaaccactactgcctttgtggaaccactagtgatcatgctcattctggtagccaatgctatagtgggggtctggcaggagaggaacgccgaatcagcaatcgaggcactgaaagaatatgagccagaaatgggcaaggtgatccggtccgatcgtaagggggtccagaggattagagcccgggacatcgtacctggggatattgtggaggtggctgtgggcgacaaagttccggctgatctcagattaatcgagattaaatctacaacactcagagtggatcaatcaattctgactggggaaagtgtttccgtcacaaaacatactgaggcgatcccagaccctcgtgccgtcaatcaggataagaagaatatgctatttagcggtacaaacatcacctccgggaaggcggtaggggtggccgtcgcaacaggtctgcatacagagctggggaaaatcagaagccagatggctgccgtggaaccagagcgtacccccctgcagcgaaagctggacgaattcgggcgacagctttcacacgcaatttctgtgatatgcgtagctgtctgggtgatcaacattggacattttgccgatcccgcccacggcggaagctggctccgtggtgcagtgtactattttaagattgcagtagcgctggcggtcgccgctattccggaaggcctgccagcggtgatcactacgtgccttgctttaggcacgagacgcatggcccggaagaacgcaattgtgcgctcacttccatctgtggaaacactggggtgcaccagtgtgatttgctccgacaaaaccggcacattgactaccaaccagatgtccgtgtgtcgcatgttcgttgtggccgaagcggacgctgggtcatgtctcctccacgagtttacaatcagcgggactacatacactcctgagggggaggtaaggcagggtgatcaacccgtcaggtgcggtcaatttgatggccttgtcgaactggctactatctgcgccttatgtaacgattcagctctggactacaatgaggctaaaggtgtctacgagaaggtcggagaagcaacagagactgccttaacctgcttggttgaaaaaatgaatgtgtttgacaccgatctgcaggcactcagcagagtggaaagggcaggtgcatgtaataccgtcataaaacagttgatgcgaaaggagttcacactggagttcagccgcgaccggaagtcaatgtccgtctactgtacccctacccgcccgcaccctacaggacaagggtctaagatgtttgtgaagggcgcgccagagagcgttatcgagagatgctcatccgtgcgggttgggtctcgcaccgcccctctgacacccacctctcgcgagcagatcctcgccaagatcagagactggggtagcgggtctgatacactgcgctgcctagcgctagcaacccgcgatgcacccccgaggaaagaggatatggaacttgatgactgctccaagttcgtgcagtacgagacagaccttacttttgtgggctgtgttggcatgctcgacccgccacgccctgaagtggctgcctgcatcactcggtgttatcaggccgggattagagttgtcatgatcactggtgataataagggaacagcggtagctatatgccggagactcggaatattcggggacaccgaggatgtggccggcaaggcctacaccggaagagaattcgacgatctgagccccgagcaacagcgtcaggcttgtcgaacagctagatgtttcgccagagtggaacctgcacacaagtcccgcatcgtggagaatctgcaaagcttcaatgagattaccgctatgactggcgatggagtcaatgatgctcccgctctgaagaaagcagagattggcatcgcaatgggcagcggcactgcggtggccaagtccgcagccgagatggtgctctccgacgacaattttgcgtccattgtcgctgcagtcgaggagggcagggcaatttactccaatatgaagcaattcatcaggtacctcataagctcgaatgtgggcgaggtggtctgtatcttcctaaccgccattttggggctgccggaggccctgataccagtccagctcttgtgggtaaatctggtcaccgacggactccctgctacagctctgggctttaatcctccagacctagacatcatggagaagctaccccgatcacccagggaggccctcatctcaggctggctattctttaggtaccttgccatcggcgtgtatgtgggcttagccaccgtagctgctgccacatggtggtttgtttatgacgcggagggaccacatatcaacttttaccaactgcgaaacttccttaagtgttctgaggataatcccctgtttgccggtatagattgcgaagtctttgagtcccggttccctaccacaatggccctcagcgtgttagtaaccattgaaatgtgtaacgctcttaattctgtctccgaaaaccagtctctactcagaatgccaccttggatgaatccttggctactggtggccgtagctatgagtatggccctgcactttttgattctgcttgtgcccccgctacccctcattttccaggtgactcctctctcaggccgccagtgggtggtggtcctgcaaatttctctacctgtcattctcctggatgaagcgttgaagtatctcagcagaaaccacatgcatgcttgtctgtatcccggtcttttacgtacggtgtcacaagcttggtcaagacagcctctaaccacatcatggactcctgaccacaccggactggcctccttgaaaaagtag

SEQ ID NO: 109014 - DNA, 3132 bp, Artificial Sequence
  Description of Artificial Sequence: Synthetic coding sequence
atggaggccgctcacctgcttcctgccgccgacgtgctccgacatttcagcgtgaccgccgaaggaggtctcagtcccgctcaggtcacaggcgcgcgggagagatatgggcccaacgaactgccaagcgaggagggtaagtccctctgggagcttgtgctcgagcagtttgaagacctcctggtgaggatccttcttctggcagccctggtgtctttcgtcctcgcctggttcgaagaaggcgaggagaccaccaccgccttcgtagagccacttgtgattatgctaattctcgttgcaaacgccattgtcggggtgtggcaggagagaaacgctgagagcgcaatcgaagctctaaaagagtatgagcccgaaatgggcaaggtgatcaggtccgaccgaaaaggtgtccagcggattagagccagagatatcgtcccaggagatatagtggaggtggccgtgggtgataaagtccccgcagacctccgattgatagaaatcaaatcaacgaccctgcgggtggaccagtctattctgaccggcgaatcagtgtcagtaactaaacatactgaagccattccggacccacgggctgtcaatcaagataagaaaaatatgctattcagtggcacaaatataacaagtggcaaagctgttggtgtcgccgtagcgacaggcctccataccgaacttggtaagattagaagccagatggccgctgtagagcccgaacgcaccccccttcagcgcaaattggatgaatttgggagacagttatctcatgcgatctccgtcatctgtgtagcagtctgggtcatcaatatcggccacttcgcagatccagcacatggggggtcctggctacgtggggctgtgtactactttaaaatcgccgtggcccttgctgtggccgctatccccgaaggactcccggcagtcataaccacgtgtctcgccctcggtacgcggcggatggccagaaagaatgctatcgtcagaagcctgccgtcagtggaaacattgggctgtacttccgtgatctgttccgataagactggaacattgacgacaaaccaaatgagcgtgtgccgaatgttcgtagtggccgaggctgatgcaggatcatgtctgttgcatgagttcaccatcagtgggaccacttacacccccgagggagaagtccgccagggcgatcagccagtgaggtgtggacagttcgacgggctggtggagctcgccactatctgcgcattgtgtaacgactcagccttagattataacgaagctaaaggcgtttacgagaaagtaggcgaagccacagaaacggcattgacgtgcctggttgaaaagatgaacgtcttcgacactgacctccaggcattgagcagggtcgagcgtgccggagcctgcaacaccgtgatcaagcagttgatgagaaaagaattcactctggagttcagcagggatcgaaaatcaatgtctgtctattgcaccccaacacgtccacatccaacaggacagggcagcaagatgttcgtcaagggggcgccagaatcagtaattgaacgctgctcttctgtgcgggtcgggtcgcggacggcaccgcttacccccacatctagggaacaaatcctagccaagatcagagactggggctccgggtccgacaccctgcggtgcctagctcttgccactcgggatgctccacccaggaaggaggatatggagctggatgactgctcaaagttcgtgcagtacgaaacagacttaacgttcgtgggctgtgtggggatgctggatcctccacgccctgaggtggctgcctgcattaccaggtgctatcaggccggaatcagagtggtgatgatcaccggagacaataagggaacagccgtggcaatatgcaggagactgggtatcttcggagacacagaggacgtcgccgggaaggcttacacaggcagagaattcgatgacttatccccagagcagcagcgtcaggcgtgtagaaccgccagatgttttgctcgggtcgaacccgcccataagagtagaatcgtcgagaaccttcagagtttcaatgaaattactgcgatgaccggcgatggcgtaaacgacgccccagcactaaaaaaagcggagatcggtatcgcaatgggatccggaacagctgttgcaaaaagcgccgctgagatggtgctgagcgacgacaactttgcttccatcgtggccgcagtggaggagggccgtgctatttacagcaacatgaagcagttcattcgctatcttataagttctaatgttggtgaggttgtatgtattttccttactgctatccttgggctgcctgaggctctcataccggtgcaacttctctgggtgaacctagtcactgatggactgccagcaaccgctctcgggttcaacccacctgatttggacatcatggaaaaactgcctcggtcaccccgggaggccttgatttcaggctggctgttttttcgttacctggcaattggtgtgtacgttggccttgccaccgtggccgctgcaacctggtggttcgtctacgacgcagaggggccccacatcaatttctaccaactgcgcaactttctgaaatgttctgaagataatcctctgttcgcaggcattgattgcgaagtgttcgaatcccgcttcccaaccacaatggccttgtcagtgctggttaccattgagatgtgcaatgccctcaactcggtgtccgaaaatcagagcttgctccgtatgcctccatggatgaacccgtggctgttggtcgcagttgctatgtctatggcattacacttcctgatcttgctggtgccccccctgccactaatcttccaagtcacacccctgagcggaagacaatgggtagtcgtcttacagatatctctcccggtgatcctgctagatgaggccctcaagtacctgtctcgtaaccacatgcacgcatgcctttacccggggttgctccgcactgtgagtcaggcctggtcacgccagccattaacgacttcctggacccctgatcacacaggacgcaatgaacccgaggtcagcgccggtaatagagttgaatctccagtgtgcacgtctgactag

SEQ ID NO: 109015 - DNA, 3159 bp, Artificial Sequence
  Description of Artificial Sequence: Synthetic coding sequence
atggaggccgcgcatctattgcctgccgccgatgttctgcgccatttctctgtgacagcagaaggcggcttgagccccgctcaggttaccggagcccgtgagcgatatggccccaacgaacttccttcagaagagggtaaaagtctgtgggagctggtacttgagcagttcgaggacctgctcgtacgaattctgctgcttgccgccctcgtgagctttgtgcttgcttggttcgaggaaggcgaggaaacaaccacagcctttgtggagccactggtcattatgctgatcctcgtggccaatgccattgtgggcgtgtggcaagagaggaacgcagaatctgctatcgaggccctgaaggagtatgaaccagaaatgggtaaagtcatacgctcagatcggaaaggggtgcaacgaatcagagccagggacatcgtgcccggcgatattgtcgaggtcgcagttggcgacaaagtgccagctgaccttagactaattgagatcaaatctaccacgctgcgagtggatcagagcatcttaaccggggaaagcgtgagtgtgacaaaacacacagaagccataccagatccccgcgcagtgaatcaggacaaaaagaatatgttgttcagcgggactaacatcacgagcggtaaggcagtgggggtggcggtcgcaacaggactccacaccgaactcggcaagatcaggtcgcaaatggcagcggtcgaacccgagagaacacctctgcagaggaaactcgacgaattcggcaggcagctctcccacgccatatccgtcatatgcgtggcagtatgggttatcaacatcggtcatttcgcagaccctgcccatggtggctcatggttacggggtgctgtctattatttcaagatcgccgtcgcgcttgcagttgcggccattcctgaaggtctgccagccgtcattaccacctgcttggccttaggcactcgccggatggctcgaaagaacgccattgtcagatccctgccatccgtcgaaaccttaggctgcactagtgtgatctgcagcgacaagaccggcaccctgacgacaaaccagatgtccgtctgccgaatgttcgtggtggcggaggcagacgccggatcttgtctgctgcacgagttcaccatttctgggacaacctatactcccgaaggagaagtgcggcagggcgaccagccggtgcgctgcggccagttcgacgggctggtcgaattggcaaccatctgcgccctgtgcaacgattccgccctggattacaacgaggcaaagggcgtctacgaaaaggtgggagaggcgaccgagacagccctaacctgtctggtggaaaaaatgaacgtgtttgatacagacttgcaagcgctgtcccgtgtcgaacgggctggcgcttgcaacactgtaattaagcagctgatgaggaaggagttcaccctcgagttctctcgcgatagaaagagcatgagcgtatactgcacccccacgcgacctcacccgaccggacaagggagtaaaatgttcgtgaagggtgctcccgaatccgtcattgaacgctgctcttcagttcgggtggggtcaaggaccgccccgctgacgcccacctccagagaacagatcctcgccaaaattcgcgactggggctcgggcagcgacaccctgcgctgcttggccctggcgactagagacgctccgccacgcaaagaagacatggaacttgacgactgcagcaaatttgtccaatacgaaacagacctgacttttgttggctgcgtcgggatgctggaccctccacgtcccgaggtggctgcatgtattaccaggtgttaccaggcaggcatccgagtggtgatgattactggcgataataaagggactgctgttgccatctgcagaaggctgggcattttcggggacaccgaggacgtggcaggcaaagcctatacaggcagagaattcgatgacctgtctcctgagcaacaacgacaagcttgccgtacagcaaggtgtttcgccagggtggaacctgcacataaaagtcgtatagtggaaaatctgcaatctttcaatgaaatcacagctatgactggtgacggtgtgaacgacgctcctgcgcttaaaaaggccgagatcggcatcgcaatgggtagtgggacagctgtggcaaagtccgccgccgagatggtattgtctgatgacaacttcgcttccatcgtggcagccgtcgaagagggcagagctatctactccaatatgaaacagttcattcgctacctgatttcttctaatgtgggtgaagtggtgtgtatcttcctgaccgctattcttgggctgccagaagcactaatccccgtgcaattactgtgggtgaacctggttaccgatggactgcctgccactgcactgggttttaaccctccagacctagacatcatggagaagctcccgcgatccccgagagaagcgctgatttctgggtggctgttcttccggtacctggccatcggggtatacgtggggcttgccaccgttgcagcggccacgtggtggttcgtatatgacgcagagggtccacacattaatttctaccagctgaggaactttctcaagtgctctgaggataatcccctattcgcgggcatcgattgtgaggtgttcgagtctcgctttccaaccactatggccttgtcagtgctcgtcaccatcgagatgtgcaacgctctgaattccgtatcggaaaaccagtcactgctccgcatgccgccttggatgaatccctggctacttgtagctgtggcaatgagcatggctctgcacttcctgattctgctggttccgcctctgcctctgatttttcaagtaacgccattgagcgggcgccaatgggtggttgtgcttcagatctccttacctgttatcctgttagacgaggctttaaagtatctcagcagaaatcacatgcatgcatgtttgtaccccggtctcttgagaaccgtgtcacaagcttggtcacggcagcccctgacaacatcttggaccccagatcacaccgggctggcttctttaggacaggggcactctatagtatctcttagtgagttgctgcgcgaaggcggtagtcgggaagagatgtctcagaagtag

SEQ ID NO: 109016 - DNA, 3090 bp, Artificial Sequence
  Description of Artificial Sequence: Synthetic coding sequence
atggaggccgcacatcttttacctgcagcggacgtactgagacacttcagcgtaactgcagagggcgggcttagtccagcacaggtcactggtgcccgagagagatatgggcccaatgagttgccttctgaagaagggaagagtttgtgggagctggtgcttgagcagtttgaggacctgctcgtcaggattctgcttctcgccgcactcgtttctttcgtccttgcctggtttgaagaaggagaagaaactacaaccgcttttgtggagccccttgtcatcatgctcattttggttgccaacgcgatcgtgggggtatggcaagagcgcaacgcagagtccgccatcgaggcgctaaaagagtatgaacccgagatgggaaaggtaatccggtcagaccgcaagggggtccagcgcatccgtgcccgggacattgtgcccggggacattgttgaagtagccgtcggagataaagtgcccgccgacctgagacttattgaaatcaagagtactacactcagagtggaccaatctattctgaccggggaatcggtctccgtaacgaaacacaccgaagcaatccctgatcccagagctgtgaatcaggacaagaaaaacatgcttttttccggcacgaatataacctccggaaaagccgttggcgttgccgtcgctaccggtctgcacaccgaacttggtaaaatacgaagccagatggctgccgtggaacccgaaaggaccccattgcagagaaagctggacgaattcgggaggcagctgtctcacgctatctcagtcatatgcgtcgccgtatgggtgattaatattggccacttcgccgacccggcccatggagggtcgtggttgagaggggctgtatactacttcaagattgcggttgcgctggccgtggccgcgattcccgagggactcccagccgtaattaccacttgcctggccctggggacacggaggatggcccggaagaacgctattgtccgatccttgcccagtgtagagactctgggctgcacctccgtgatatgttcagacaagaccggaacccttacaaccaaccagatgtcagtgtgccgtatgttcgtggtggcagaagcagatgcagggtcatgtctcctgcatgagtttaccatctccggtacaacctacaccccagagggcgaggttaggcaaggcgaccagcccgttagatgtggacagttcgacggcttggtggaattagcaacaatctgcgctttgtgcaacgatagcgccctggattacaacgaagctaagggtgtgtacgaaaaagtgggagaagctaccgagacagcactgacgtgtctggtggagaaaatgaacgtcttcgacacggacttgcaggcactgtcacgggttgaacgcgcaggagcctgtaacactgttataaaacagctgatgaggaaggaattcacacttgaattttcccgcgatcggaaaagtatgtctgtgtactgtacgccaacccgaccacatccaaccggtcagggctctaagatgtttgtgaagggtgctccagaaagtgtgattgagcggtgtagctcagtgagagtggggagtagaaccgccccccttactccgactagcagggaacagatcctggctaagatccgcgattggggcagtggatcagatactctccgttgtctagcgctggccacaagagacgcaccccctcgcaaggaggatatggagctggatgactgttccaagtttgtgcagtacgaaactgacttgacatttgtcggctgcgtgggtatgctagatcctccaaggcctgaggttgccgcctgtatcactcggtgctatcaggctggcataagagttgttatgataactggggacaacaaaggcactgcggtagccatctgccgaagactgggcatcttcggagatacagaagatgttgccgggaaggcatacactgggagagagttcgatgatctgtctcctgagcaacaacgccaagcttgccggaccgcccgttgcttcgcgagagtggagcctgcacataaaagcagaatcgtggagaacctacagagtttcaatgaaattaccgcgatgacgggtgatggtgtcaacgatgccccagctctaaagaaagccgaaattggaattgcaatgggctccgggactgccgtcgccaaatccgctgcagagatggtgttgtctgatgataacttcgcttctatagtcgccgccgttgaggaggggagagccatctattcaaacatgaagcaatttattcgatatctgattagcagcaatgtaggtgaggtggtctgcatcttcttgacagcaatacttggcctgccagaggctcttataccggtgcagttgctgtgggtcaacttggtcacggatgggctgcctgcaactgccctgggctttaatcctccagacttagacataatggaaaagctccctcgctcccccagagaagccctgattagcggctggctgttcttcagatacttagcgattggcgtgtacgtgggcctcgcaacggtggcagcagccacatggtggtttgtgtacgatgcagagggtcctcatatcaacttttaccagctgaggaattttctaaaatgttctgaggacaacccactgttcgccggcatcgattgtgaagttttcgaatctcgattccctactaccatggcactgagtgtgctggtcactatcgaaatgtgtaatgctctaaatagcgtctccgagaatcaatccttactaagaatgccaccatggatgaacccctggctcctcgtcgccgtcgccatgagtatggctttacacttcctgatactcttagtgccgccattacccctgattttccaggtcacaccccttagtgggcgccagtgggttgtcgttctacagatttctctgcccgtcatcctgctggacgaagctttaaagtatctttctcggaatcatatgcacgcgtgtttgtatccgggactgctccggaccgtgtcacaggcgtggagtcggcagccactgacgacttcttggactcccgatcacaccggactcgctagcctcaagaagtag

SEQ ID NO: 109017 - DNA, 651 bp, Artificial Sequence
  Description of Artificial Sequence: Synthetic coding sequence
atggagaagctacctaggtcaccgagagaggcattaattagtggatggcttttcttcaggtacttagccattggagtgtatgttgggctcgccactgttgcagctgctacatggtggttcgtttatgatgccgagggtcctcacattaatttttatcagctgaggaattttttaaagtgttccgaggacaacccactctttgcaggcatcgactgcgaagtgttcgagagcaggttccctacaacaatggcgctgagcgtcctggtcaccatcgagatgtgcaatgcactgaacagcgtcagcgagaatcagtctcttctacggatgccgccatggatgaacccttggcttctggtagcagttgcaatgtccatggctttgcacttcttaattctcttggtgccacccctgcctctcatctttcaggtcaccccactcagtgggcgtcaatgggtggtggtcctgcagattagcttgcctgtgattcttctggacgaggccctgaaatatctctcaagaaatcacatgcatggcccagggacacagcatagactcgccgtgcgagccgcccagcgcgggcgcaagcagggccggaatgagcctgaagttagtgccggcaatagggtcgagtcccctggcccaggaggatag

SEQ ID NO: 109018 - DNA, 3000 bp, Artificial Sequence
  Description of Artificial Sequence: Synthetic coding sequence
atggaggctgctcacctgttacctgctgccgatgtgctgaggcacttctctgtcaccgcagaaggagggctctctccggctcaagtgacgggagcacgggagcggtatgggcctaacgaactgccatctgaggaggggaaaagtctttgggagcttgtcctggagcagttcgaggacttgctagtcaggattctgctgttagctgcactggtgagcttcgtcctcgcctggtttgaggaaggtgaggaaactaccacggccttcgtcgagcctctagtaattatgctgatcctggttgcaaatgctatcgtaggcgtttggcaggagcggaacgccgaatccgcgatagaggctctcaaggagtatgagccagagatgggaaaagtgatacgatctgaccggaagggcgtgcagcgaataagggctagggacattgtcccgggcgacattgtcgaggttgcagtgggagacaaggtgcccgctgacttgaggcttattgagatcaagtccaccaccttgagagtggatcagtccatcctgacaggcgaatctgtttcagtgaccaagcatacagaagctattccggatccaagagctgtgaaccaggacaagaagaacatgctattctccgggactaacattacgtcaggaaaggctgtgggggtggcagtggccaccggtctacacaccgagcttggaaagattcgtagccaaatggccgccgtggagcccgagcggacccccctgcagaggaagctcgacgaatttggacggcaactcagccacgcaatctctgtgatctgcgtggcggtctgggtcataaatattggacacttcgccgatcctgctcatggtggttcatggttacgaggggctgtgtactatttcaagatcgctgtcgccctggctgtggcagccatcccggagggcctgcccgccgttatcaccacatgcctggctctgggtacacgaagaatggcgagaaagaatgccattgtgaggagccttccgtccgtggaaaccctgggatgcacatctgtgatctgtagcgacaaaaccggtacactcaccaccaatcagatgtccgtttgcaggatgtttgtggtcgccgaggcagacgccggctcttgtctcctgcacgaattcactatttcgggcacaacatacaccccagaaggagaggtccggcagggcgatcagcctgtacgatgcgggcagtttgacggtctcgtcgaactagcaacaatttgcgctttgtgtaatgattcggccctggattataatgaagctaaaggggtctatgagaaggtgggcgaggctaccgaaactgcattgacttgtctggtcgagaagatgaacgtgtttgacacagacttgcaagccctcagccgggtcgaacgagcgggtgcctgtaacacagtgatcaagcagctgatgcggaaagagtttacgctggagttttcacgggatcgcaagtccatgtctgtttattgcaccccaactaggcctcatcccaccggacagggcagtaagatgttcgtcaaaggcgcgcctgagagcgtgatcgaacggtgcagctccgtgagagttggatctcgcacggcaccactgaccccgacgtcccgcgagcagatcctggcaaagatccgcgactgggggtccggaagtgacaccctgagatgtttggccctggctaccagagacgctccccctagaaaggaagacatggaattagacgattgctcgaagttcgtacagtacgagactgatctgacatttgtgggatgtgttggaatgcttgacccaccacgtcctgaggtggccgcgtgtatcacgagatgttatcaggctgggattcgcgtcgtcatgattacaggcgataataagggtactgcggtggccatctgcagacgactgggcattttcggcgatacagaggatgtggctggcaaggcctataccggccgtgaattcgacgacctgtcgcctgagcagcaacggcaagcctgtcggaccgcccgttgtttcgcaagagttgaacccgctcacaagagcaggatcgtcgagaacctccagtccttcaatgagatcacagccatgacgggcgacggggtaaatgacgcccccgctctgaagaaggccgagattggcatcgccatgggctcagggactgccgtggctaagagcgctgcagagatggttctatccgatgataattttgcctccatcgtggcagcagtggaggaggggcgagccatttattctaacatgaaacagtttattcgatacctgatcagttctaatgttggggaggtggtgtgcatttttctaacagctattctggggctgccagaggccctcatcccggtgcagctgctctgggttaacttggtgaccgatggtctgcccgccacagcacttggcttcaatccacctgacttggatatcatggaaaagctgccgcgctcgccccgcgaggccctgattagtgggtggttgttcttccgctatctggcaattggtgtctacgtgggcctggccaccgtggccgccgcgacatggtggtttgtctatgatgctgaagggccgcacattaatttctatcagctccggaattttctcaaatgctctgaggacaaccccttgtttgcgggcattgattgtgaggtgtttgagagccggtttcctacaaccatggccctgtccgtcctcgtaacaatcgagatgtgcaatgccttgaactcagtgtccgagaaccaatctttgttgaggatgccaccctggatgaatccctggctccttgtggccgtggccatgtcgatggcactgcatttcctgatcctcctagttccacctctgcccctgattttccaagtgactcctctgtccggacgtcagtgggtcgtggtcttacagatctcactgccagtaattttacttgatgaggccctgaaatatctgtccagaaaccatatgcatgaggaaatgagtcagaagtag

SEQ ID NO: 109019 - DNA, 2997 bp, Artificial Sequence
  Description of Artificial Sequence: Synthetic coding sequence
atggaagccgcgcatctgctcccggctgctgacgtgcttcggcacttttcagtgacggccgagggaggcctgagtccagcccaggtcaccggcgctagggagcggtacgggcccaatgagctgccatcagaggaagggaagtccctgtgggaactggtgcttgagcagttcgaggatctgctggtccgcatcctgttgctcgccgcacttgtatctttcgtgctggcctggtttgaagagggcgaggagactaccacagcctttgtggaacctctcgtgattatgctcatactagtagccaacgcaattgtgggagtgtggcaggagcgcaatgccgaaagtgccattgaagccctgaaggagtatgagccagagatgggaaaggtcattagatcggatcgaaagggcgtgcaacgcattcgggcacgagacatcgttcctggagatattgtagaggtggctgtgggagacaaggtgcctgccgacctacggctcatcgagattaagagcacgactctgcgggtagaccagtcgatcctgacaggggaaagcgtgagtgtcaccaagcatacagaggccatccccgatcctcgagcagtgaaccaggataagaaaaacatgttattctctggtactaatattacctctggcaaggctgtcggtgtcgctgttgcaactggcctgcatacagaactgggtaagattcgaagccaaatggctgccgtggagcctgaaaggacgccattacaaagaaagttagatgaattcgggaggcaactttcgcatgccatttcagtgatctgcgttgctgtatgggttatcaacatcggacacttcgctgatcctgcccacggtggttcctggctgagaggagccgtctattactttaagattgccgttgctttagcggtcgcggccattcccgagggattacccgcagtgataacaacctgtctcgctctcgggactaggcggatggctcggaagaacgcaatagtgcgctccttgcctagtgtcgaaacccttggatgcaccagcgtgatctgctcggacaaaactgggaccctcacaaccaaccagatgtcagtgtgtcgaatgttcgtggtggcggaggcggacgcagggtcctgtcttctccatgagttcacaattagcggtaccacctacactccggagggcgaagtacggcaaggcgaccaacccgtgcgctgtggacagtttgacggcttggtggagctggcaaccatctgcgccctgtgtaatgactccgctctggactataatgaggctaagggagtttatgagaaggttggggaagcaaccgaaacagctctcacatgtctggttgagaagatgaacgtgttcgacacggacctgcaagcactgagtcgcgttgagcgagcaggcgcctgcaacaccgtgatcaaacagctgatgagaaaagagttcacacttgagttctctcgtgacagaaagtctatgtccgtgtactgtactcctactcgaccccaccctaccgggcaaggctctaaaatgtttgtgaaaggagcccccgaatcagtcatcgaacggtgctcatcagtaagagtcgggagccgaacagcgccgctgacacccaccagcagggagcagatattagctaagattagggattggggttctggcagtgacacgctgcgatgcctggccctagcaaccagggatgcgcccccgaggaaagaagatatggaactggacgattgctctaagttcgtgcagtatgaaaccgacctgacattcgtgggttgcgtcggcatgctcgacccacccagacccgaagtagccgcttgtattacaaggtgctaccaggccggcattagggtggtgatgatcacaggagataataaaggcaccgctgttgccatatgcagacgcctgggcatattcggagacacagaagatgtggccgggaaggcatacactgggcgcgagttcgatgacctgtcacccgagcagcagcggcaagcgtgccggacggctagatgcttcgcccgcgttgagcccgcacacaaatcacgtatcgtggagaatctacagtccttcaacgagattacagcaatgacaggagacggggtgaatgatgcccccgcactcaagaaggccgaaatcggcatagccatgggatccgggaccgcagtcgctaagagtgcagcagagatggtcctgtcggacgataattttgcaagcatcgttgccgcggtcgaggagggtagggctatctattcaaacatgaaacaattcatccgttatctcatcagctccaatgttggcgaggtcgtctgtatcttcctgaccgcaatcctgggtctgcccgaggccctgatcccagtccagctgctgtgggtgaacttagtgaccgatggtttgcccgccaccgctttaggttttaatccacctgatctggatatcatggaaaagctgccaagaagccccagggaggccctgatctcgggctggcttttctttcggtacctcgctatcggggtctatgtcggactcgcaacggttgcggcagccacatggtggttcgtttatgacgctgaaggtccacacattaacttttaccaactccgcaatttcttgaagtgtagcgaagataatccacttttcgcaggcatcgactgcgaggtctttgaaagccggttcccaactactatggccctgtccgtgttggttaccatcgagatgtgcaacgctttgaacagcgtgagtgaaaatcagagtctgctccggatgcctccttggatgaacccgtggctcctggtagccgttgcaatgtctatggccctacacttccttattttgttagtgccgcccctgccgctcatattccaggtgacaccactaagcggaaggcagtgggttgtggtccttcagataagtttacctgttatattactcgacgaggcgttaaagtatctgagtaggaatcatatgcatgggcatacccagagctag

SEQ ID NO: 109020 - DNA, 2997 bp, Artificial Sequence
  Description of Artificial Sequence: Synthetic coding sequence
atggaagcggcacacctgctgccagcagccgatgtgctgcgccatttctccgttactgctgaaggaggccttagccctgcacaggtgacgggggcccgcgagcggtatgggccgaacgagctccctagcgaagaggggaaaagtctttgggaattagtattggaacagtttgaagacctgttagtccgcatcctgctgctcgcagcgctggtgtctttcgttctggcctggttcgaggagggcgaggaaactactaccgcattcgtggaacctcttgtcatcatgctgatcttagtggccaacgctatagtcggcgtgtggcaagagcgtaacgccgaatctgccatcgaagctctaaaagaatatgagcctgagatgggcaaagtaattaggagcgatcgaaaaggcgtgcagaggattcgggccagagatatcgttcccggcgacatcgtcgaggtggctgtgggcgacaaagtgcctgctgatctccgcctgatcgagattaagtcaacaacactccgggtggaccagtctatcttgacgggagagtccgtctcggtgactaagcacacagaggctatcccggacccgagagcagtaaaccaggataaaaaaaatatgctgtttagcggtacaaacataacgagcggcaaggccgtgggagttgctgtcgcaactggcctccacaccgagttggggaaaattcgctcccagatggcagccgtcgaacccgagagaaccccgctgcaaagaaagcttgatgaatttggtaggcaactgtcgcatgccataagcgtgatctgtgtcgctgtgtgggttatcaacattggccactttgctgatccagcgcatggggggtcttggctaagaggagctgtttactactttaaaattgcggtagccctagctgttgcagcgatccccgaaggtcttccagccgtcattacaacttgtctggcactcggaactcggagaatggctagaaaaaacgcaatcgtccggagcctgccatcagtggagacactggggtgtacttctgtgatttgttccgataagactggaactctcacgaccaaccagatgagcgtttgtaggatgttcgtcgtcgcagaggctgacgcagggtcatgcctgctgcatgagtttactattagtggcactacatatacccctgagggagaagtcagacaaggagaccaaccggtcaggtgtggccagtttgatggtcttgtggagttggccaccatctgtgccttgtgcaatgactcagccctcgactacaacgaagccaagggggtctatgagaaagtcggcgaagcgactgaaacggccctgacgtgcctggtggagaagatgaacgtgttcgacacagatctgcaggcgctctcccgcgtggagagggctggcgcctgcaatacagtgatcaaacagttgatgcgtaaggaatttactctggaattcagccgggatcggaagtctatgtcagtctattgcactcccactaggcctcacccaaccggccaggggagcaaaatgttcgtcaagggagcccccgaatccgtcatagagcggtgctcctctgtgcgggttgggtcccggactgcccctcttacgcccacctcaagagagcagatattggcaaaaattcgggattggggttcgggcagcgacaccctgcgctgcctggctctcgcaacaagagacgctccacctcggaaggaagacatggagctagatgattgtagcaagttcgtccagtatgaaaccgatctcactttcgtgggctgcgttggaatgctcgatcccccacgcccggaagtggccgcgtgcattacacgctgctaccaggccggtataagggtagttatgataacaggagacaacaagggtaccgccgtggctatctgtcggaggttgggaatatttggggatactgaagacgtggccggcaaagcctatacaggacgagaatttgatgatctttcccctgaacagcaaagacaggcctgcagaacagctcgttgttttgctagagttgagcccgcccataaaagtcgcatcgttgagaacctccaatcattcaatgagatcacagcaatgaccggtgacggggtgaacgatgcccccgccctcaagaaagctgaaattggtatcgccatggggagcggaacagcagttgccaagtctgctgccgagatggttctgtccgatgacaatttcgctagtatcgtagcggccgttgaagaggggagggccatctacagtaatatgaaacagtttatacggtacctgatttcgtccaatgtgggggaggtggtgtgcatcttcttaaccgcgattctgggactcccagaagctctcattccagtgcagctgctgtgggtcaacttggtaactgatggcctgcccgccaccgctcttgggttcaaccccccagatctcgatatcatggagaaactgcccaggagccctagagaggcactgattagcggctggctgttctttcggtatctggctataggggtgtacgtaggcttagctaccgtcgccgcggcaacatggtggtttgtatacgatgcggagggccctcacataaatttttaccaattacgcaattttttgaagtgctcagaggataacccactatttgctggcattgactgtgaagtctttgagtccaggttcccaacaacgatggctctttcagtgctggtgaccatcgaaatgtgcaatgccctcaactcagtgtcagagaatcagtccctgctcaggatgccaccatggatgaacccatggctcctagtagccgtagccatgagcatggccctccacttcttaattctattggttccaccgctgcccctgatatttcaggtaacccccctctctgggagacagtgggtggtggtactgcagatctcactaccggtgatcttgctggacgaggcactgaaatatctttccagaaatcatatgcatgagatgagccagaaatag

SEQ ID NO: 109021 - DNA, 1386 bp, Artificial Sequence
  Description of Artificial Sequence: Synthetic coding sequence
atgactgtgccaaaagagatgcctgagaagtgggcgagagcgcaagcgcccccatcttggtctcgaaaaaagccgtcctggggaactgaagaggagagacgagcccgggctaatgatagggagtataacgagaagtttcaatatgcctccaattgcattaagacaagcaagtataacattctgacctttttacccgtcaacctgttcgagcagttccaggaggttgcgaacacttattttctgtttctgttaattttgcagctgataccccagattagtagcttatcatggttcacgaccatagttcctcttgtattggttctgacgatcacagccgttaaggacgccaccgatgattatttccgccataaatcggataaccaggtgaacaacaggcaatcccaggtcttgataaacggtattctgcagcaagaacagtggatgaacgtgtgtgttggagacatcataaaactggagaacaaccagttcgtagcagcagatcttttacttcttagctccagtgaaccacacggactttgttacatagaaacggccgaactggatggagaaaccaacatgaaggtccgccaggctattcctgtaacttcagagctcggggatatttctaaacttgctaagttcgacggcgaagtcatttgcgaacctcccaacaacaaacttgacaaattctccgggaccttatattggaaagagaacaaatttccccttagtaatcaaaatatgttactcagaggttgtgtgctacgaaacacagaatggtgttttggccttgtgatctttgccggccctgatacaaaactcatgcagaacagtggacgtaccaaatttaagaggacatccattgacagactaatgaacacacttgtgctgtggattttcggcttcctggtatgcatgggtgtcattctggcgattggcaatgccatctgggaacacgaagtaggcatgcggtttcaggtatatctgccatgggatgaggctgttgatagtgcattcttttcaggtttcctgtcattctggtcttatatcataatattaaatactgttgtaccaatctcactttacgtctctgttgaggttatcaggctcggccattcatatttcataaactgggacaagaagatgttctgtatgaaaaagcgaactccagcagaggcccgcaccacaactcttaacgaggagttgggccaggtggagtatattttctcagacaagaccggcactctcacacaaaatataatggtgttcaacaaatgcagtattaatggccatagttatgtcgggtccgaggggccgcgcaggaaagggcccagctggccagggaccgtggcccacgcttatagccatagcactctgggggggtag

SEQ ID NO: 109022 - DNA, 1164 bp, Artificial Sequence
  Description of Artificial Sequence: Synthetic coding sequence
atggctgtatgtgcaaagaagcgacccccagaggaggaacgacgtgcccgggcaaatgaccgtgagtataatgagaagttccagtacgcaagcaactgtataaagacttctaaatacaatatcctgaccttcctacctgtgaatctgtttgagcagttccaggaggtcgccaatacatacttcctcttcctgctcatcttgcagctgatcccacagatatcctctctcagttggttcacaactattgtgcctttagtccttgttttgactattacagccgtaaaggatgctaccgacgattatttcaggcataagtctgacaaccaggtcaataaccggcagtcgcaggtgctcatcaatgggattctgcaacaagaacagtggatgaacgtttgcgtgggcgatataatcaaacttgaaaataaccaatttgtcgccgctgatcttctgctgttgagctcttccgagccacatgggctttgttatatcgagactgcagagctcgacggagagactaacatgaaagtgcggcaggccataccagtgaccagcgaactcggggatattagtaaactggccaagtttgacggagaggtgatctgtgaacctcccaataataaacttgacaaattttccggtacgctttactggaaggaaaataagtttccgttgagcaaccagaacatgcttctcagaggatgcgtgctgcggaataccgaatggtgtttcgggctggttatttttgccggtccagacactaagcttatgcaaaatagtggccgcaccaagtttaagcgtacgagcattgaccgactgatgaacactttggtgttatggatttttgggttcctggtttgcatgggagtgatcctcgccatcggcaacgccatctgggaacacgaggttggaatgaggttccaggtttaccttccatgggacgaagccgtagatagtgccttcttcagcgggtttctgtccttctggagctatatcatcatcctcaataccgttgtgcccatcagtttgtatgtgcgctacgtgccatcattgacctggggcctttctagagaatccggcgggcctatcgaattattcttctctatgaagatgaaatctctgaggtcaaatgaaaaaagcagttcttcctgtaccgtgaatatttag

SEQ ID NO: 109023 - DNA, 3672 bp, Artificial Sequence
  Description of Artificial Sequence: Synthetic coding sequence
atggacaccctacgggccgttccactcttttctatcagcggcttattctcctttccttatcgagtgtcacatggcattgccgggattcttttgggggagatggccgtgtgcgcaaaaaagcgcccaccagaggaagagaggcgcgcacgggcaaacgaccgtgagtacaatgagaagttccagtacgcatccaattgcatcaaaacaagtaagtacaatattctgacatttctccccgtgaacctgtttgaacaattccaggaggtggccaatacctactttctgttcttgctcatacttcaactaattccacagatcagcagcctgtcctggttcaccaccatcgtcccactagtcctggtgctcacaatcacagcggtgaaggacgccaccgacgactatttccggcacaagtccgacaaccaagtgaataataggcagtcccaggtgctgatcaatgggatcctgcaacaggaacagtggatgaacgtgtgtgtgggtgacatcattaagctggaaaataatcagtttgtggctgctgacctgctccttctgagctcttccgagccgcatgggctttgctatatcgaaacagccgagctagatggcgagacaaatatgaaggtgcgtcaggccatccctgtaactagcgagctgggggacataagcaagctcgccaagtttgatggagaagtgatctgcgagccgcctaacaataagctcgataagtttagtggtaccctgtattggaaggagaacaaattcccattgtctaatcaaaatatgcttttacggggatgcgttctgcgcaacaccgagtggtgcttcggcctcgtgatcttcgcaggtccagatacaaaactgatgcagaactcaggtaggactaagttcaaacggacttcgatagacagactgatgaacacactagtcctttggatattcggtttcctggtttgtatgggagtgatcctcgcaattggcaatgctatttgggaacacgaagtaggcatgcgattccaggtgtacctcccgtgggatgaagctgtggatagcgcatttttcagcgggtttctatccttttggtcatatatcatcattctgaatacagttgtgcctatcagtctgtatgtctctgttgaggtgattagactggggcactcatactttatcaattgggacaaaaaaatgttctgcatgaaaaagaggaccccagcggaggctcgcaccacaaccctgaatgaagagctgggacaggtcgaatacatcttctccgacaaaacgggaacgttgacacagaacatcatggtgttcaataaatgttctataaacgggcattcctacggtgatgtgtttgacgtgcttggccacaaagccgaattgggagaaaggcccgaacccgtcgattttagctttaatccattggcagataaaaaattcctcttttgggacccttcactgctcgaggcagtgaaaatcggtgacccccatacacatgaatttttccggttgttatccctctgccacacagtgatgtcagaagagaagaatgaaggggaactctattataaagcccagagtccggatgaaggcgcactcgtgaccgccgcccggaattttggatttgtctttagatcccgaaccccaaagaccatcacggtgcatgaaatgggtaccgccattacttatcagctgctggccattctcgactttaacaacattaggaagcgtatgtccgtgatcgtgagaaaccctgaagggaaaatacgcttgtactgcaagggcgccgacaccattctccttgacagactgcaccatagcacccaggagcttctgaacacaaccatggaccacttgaatgaatatgccggcgaagggcttcgcactctggttttagcgtataaagatcttgacgaggagtactacgaagaatgggctgagcgtcggctacaggcatcgctcgcacaggacagtcgggaagacaggcttgcctccatctacgaggaagtggagaataatatgatgttattgggggccactgcgatcgaggacaaactacagcagggggtgcctgagaccattgcactgctgactctcgctaacattaagatctgggtgctgactggcgataagcaggagactgccgtgaatatagggtattcctgcaagatgttgacagacgatatgacagaagtgttcatagttaccggccatactgtactggaggtgcgcgaagagctccgtaaggcgagggagaagatgatggacagctctcggtcagtcggcaacggattcacatatcaggacaagttgtcgtcaagcaaattgacaagcgtgctcgaggccgttgcgggggagtacgccctggtgatcaacggtcactccctggcgcacgctttggaggcagatatggagctagagtttttagaaaccgcttgcgcatgcaaggctgtgatctgttgtagggtcacacccttgcagaaggcgcaggtggtggaactggtgaagaagtataaaaaggctgtgactctggccatcggcgatggggctaacgatgtcagtatgatcaagaccgcccatatcggggtgggcatatctgggcaggagggcattcaggctgtgctggcgtctgattacagcttttcccagtttaagttcttacaacgcctgctgcttgttcacggcaggtggagttatctgcgcatgtgcaagtttctctgttatttcttctacaaaaattttgcttttactatggtgcatttttggttcggctttttttgcggcttttcagcacagaccgtctacgatcagtatttcatcacgttatacaatatcgtgtacaccagtctgcccgttctagctatgggcgttttcgaccaggatgtccccgaacagagatccatggaatatcctaagctctatgagccgggccagttaaacttgctgtttaacaagcgcgagttctttatttgtatcgcgcagggcatttacacatctgtccttatgttctttatcccttatggcgtgtttgccgatgctacccgggacgacggcactcagctagcagattaccagtctttcgccgtcactgtcgctacaagtcttgtgatcgtagtgagcgtccagatcggcctagatacgggctactggacggcaattaatcacttctttatctggggctctctagctgtctacttcgccatcttgttcgccatgcacagcaacggcctgtttgacatgttcccgaatcagtttcgattcgtggggaacgcccagaacaccctagcccagcccaccgtctggttgacaattgtactgaccactgtggtgtgtattatgcctgttgtggccttcaggttcttgcgactcaacctgaagcccgacctgtctgacacggttagatatacacagctcgttagaaagaagcagaaagcacagcaccgctgcatgcggagagtgggcagaacaggcagccggcgctcaggctatgctttttctcaccaagagggtttcggcgagttgattatgtcagggaaaaatatgcgactttcatctctagcgctgtcttccttcactacaagatccagctcatcctggatcgaatcactcaggagaaagaaatctgatagcgcttcgagcccgagcgggggagccgacaaaccgctgaaggggtag

SEQ ID NO: 109024 - DNA, 3444 bp, Artificial Sequence
  Description of Artificial Sequence: Synthetic coding sequence
atggcggaccaaattccgctgtatccagtgcggtcagccgccgccgctgcagctaaccgtaaacgagctgcttactacagtgcggcggggccgcgacctggagccgaccgtcatagccgataccagcttgaggacgaaagcgcgcacctggatgagatgcccctgatgatgtctgaggagggctttgagaacgaggagagtgactatcatacactgccccgggctcgtatcatgcaacgcaaacgcgggttggagtggttcgtttgtgatgggtggaagttcttatgcacaagctgttgtggttggctgattaatatatgccgtagaaaaaaggaactcaaggctagaactgtgtggctgggttgcccagaaaagtgcgaagagaagcatcctcgaaattctatcaagaaccagaaatacaatgtgtttacttttattcctggagttctgtatgaacaattcaaatttttcctgaacctctattttctggttatttcctgttcgcagttcgtgccggctctgaaaatagggtacttatacacatattgggcaccactgggatttgtattagccgtcaccatgacccgcgaggctatcgacgaattccggcgctttcagcgggacaaggaggtgaacagtcagttgtacagcaaacttactgtgcgcggaaaagtacaggtaaaatcctccgacattcaagttggtgatctgattatcgtggagaagaaccagcggatcccctcggacatggtttttctgaggacctcagagaaggcaggctcatgtttcatccgcacggatcaattggacggagaaactgactggaaattgaaggtcgcggtatcttgcacacaacaactgccagctcttggtgatttgttctccataagcgcgtatgtttatgcccagaaaccccagatggacatccattcctttgaaggcacattcactcgtgaagattctgacccgcccatccacgaatctttgagcatagagaatactctttgggcttctacaattgtcgcttctggcaccgtcatcggcgtggtgatttatacaggaaaagagactcgatccgtgatgaacaccagcaatccgaaaaacaaggtggggctcctagacctcgagctgaaccgactgaccaaagccttatttctggccctggtcgcactctctattgttatggtgaccctccagggtttcgtagggccttggtaccgcaacctctttcgcttcctgctactgttctcctatatcattcctatctccctccgggtgaatttggatatgggaaaggctgtgtacggctggatgatgatgaaggacgagaacattccaggcacagtggtgcgcacgtccacaattcccgaggaactgggccgcctcgtgtatctgcttaccgacaaaactggcaccctgacccaaaacgagatgatttttaaacgattgcatttgggaactgttagttatggcgctgacacaatggacgaaattcaaagccacgtgcgggattcctattcccagatgcagtcgcaggcgggcggcaacaacaccggatccactccactccgcaaagcacagtccagcgcccctaaagtccggaaatcagtctcttcaaggatccacgaggctgtgaaagcaattgtgctctgccataatgtcacaccggtctacgagagtcgggccggggtgacagaggaaactgaatttgccgaggctgaccaggatttcagcgacgagaacaggacctatcaggcctcttcacccgatgaggtcgcccttgttcagtggactgagagcgtgggcttgaccctggtaagcagagatcttaccagcatgcaactgaagaccccctctggacaggtgctctctttttgcattctgcaactcttcccgttcacctccgagtccaaacggatgggcgtcattgtacgggacgaatcaacggccgagatcacattctatatgaagggcgccgacgtggccatgagcccaatcgtccagtataatgattggctggaggaagaatgtgggaacatggcccgggaggggctaaggaccttagtcgtggccaaaaaagctcttaccgaagaacagtatcaagacttcgagagcagatacactcaagcaaagctttcaatgcacgatcgatctttaaaagtggccgcagtggtggagtccctggagagggagatggaacttctgtgcctgactggcgtggaagatcaactccaggctgacgtcaggcccaccctcgagatgctgaggaacgcgggaattaaaatatggatgcttaccggtgacaaactcgagactgccacttgcatcgccaaatccagccatcttgtaagtcgtactcaagacatccatatatttcggcaggtaaccagcagaggagaggcccatttggagctcaatgccttcagacgaaagcacgattgcgcgctcgttatttccggcgacagtcttgaagtatgtctgaagtactatgagcacgagttcgtcgaattagcatgtcaatgtcccgccgtcgtgtgctgtagatgctcaccgacccagaaagccaggattgtcactctgctgcagcagcacaccgggcgacgcacgtgtgccatcggagatggcggcaacgatgtgtcaatgatccaggccgcggattgcggcattggcatcgagggaaaagagggcaaacaggcatctctcgctgccgatttctctatcacccagttcagacatatcgggcgcctgttaatggtgcatgggaggaatagctataaacgatcagctgcgctcgggcaatttgtaatgcatagaggcctcatcatcagcacgatgcaggccgtcttttcctctgttttctacttcgcatctgtgcccttgtatcagggattcttgatggttggctatgctacaatttacacgatgttccccgtgttcagtctggttcttgaccaggatgtgaagcctgaaatggccatgctgtatcccgagctctataaggatttgacaaagggaaggtcactgagttttaagaccttcctgatctgggtcctcatcagcatatatcagggcggcatcctgatgtacggcgctctcgtgctgtttgagagtgagtttgtgcacgttgtggctattagttttaccgctctcattctcactgagctattgatggtggcacttacagtgagaacatggcactggcttatggtcgtggcagagttcctgtcactgggctgttacgtgagttccttggctttcctgaatgagtacttcgggattgggagggttagtttcggcgccttcttggacgtagccttcatcaccacagtgacctttctttggaaggtcagcgccattactgttgtgtcctgcttgcctctgtatgtgctcaaataccttaggcggaagttgagtcctccaagctattgtaaactggcttcgtag

SEQ ID NO: 109025 - DNA, 408 bp, Artificial Sequence
  Description of Artificial Sequence: Synthetic coding sequence
atgcaagccgtgttctctagcgtcttctactttgcctctgttccactctatcagggattcctgatggtcgggtacgcgacaatctataccatgtttcctgtcttttcgctcgtgctcgatcaggatgttaaaccggaaatggctatgttgtacccagagctgtacaaggaccttacaaagagccagcaagacggtcgatctaatcggcggcagcatgaaaggctgacttccggtacatcagggcacgtttgggaccccggaagcttcttccgcatacgagtgagtggaaagggtgctagaaacgccggtaagattcttgtgcttcagaatttgcctcacctgggttttaacaagtacctcccaagacgccacccccatgtctggggacccggggccctaagggtctag

SEQ ID NO: 109026 - DNA, 3411 bp, Artificial Sequence
  Description of Artificial Sequence: Synthetic coding sequence
atggccgaccagattcctctgtatccagtaagaagtgctgcagctgctgccgctaaccgtaagagggccgcctattattcagccgcggggcccaggcccggtgcagaccgacactcacggtaccagctggaggatgaatcagcccacttggacgagatgccccttatgatgtccgaagaggggttcgagaatgaagaatctgattaccacactcttccccgggctagaattatgcagcgtaaaagggggctcgagtggtttgtttgtgacggttggaagtttctttgcacctcttgctgcgggtggctgataaacatctgtcggcgcaagaaggagctcaaagcacgaactgtgtggttgggatgtccggagaagtgcgaggagaaacatcctcgcaacagcatcaaaaaccagaaatacaatgtattcacctttattccaggcgtgctgtatgaacaattcaagttctttctaaatctgtacttcttggtgatctcatgctcgcagtttgttcccgcgctcaaaattggctatttgtatacctattgggctcccctcgggtttgttctggcagttaccatgactcgggaagctattgacgagtttcgtcgctttcagcgggataaggaagtcaatagccagctctacagcaaactaactgtgcggggaaaggtccaggtgaaatcgagcgatatccaggtgggagaccttattatcgtggaaaagaaccagcggatcccctccgatatggtgttcctgcgtacctccgaaaaggccggctcatgctttataagaaccgatcagctagatggggagacagattggaaactaaaagttgcagtttcttgcacacagcagcttcccgcactcggagacttgtttagcatcagtgcctatgtttacgcccaaaagccccagatggacattcattcattcgaagggacttttacccgggaggactctgacccccccatccatgagtccttgtccatcgaaaacactctgtgggcctctaccatcgtggcgtccggtaccgtcataggagtggtgatctatacgggaaaggagacaaggagtgtaatgaatacgagcaatccgaagaataaggtggggctgctggacctagagttaaatcgcctgacgaaggcgctctttcttgcactcgttgctctgtctatcgtcatggtaaccctgcaaggattcgtgggcccctggtaccggaacctgtttcggttcttgcttttattttcatacattataccaattagcctaagggtgaatctggacatgggaaaggccgtttatggctggatgatgatgaaagatgagaacattcccggcacagttgtaaggaccagcactattcctgaggagctagggcgcctggtctacttactcactgacaaaacaggaacactgacacagaacgagatgatctttaaaagacttcacctgggcactgtgtcctacggggccgacactatggatgagattcagtcgcacgtccgagattcatactcccagatgcagtcgcaggccggcggcaataatactggcagcacccccctgcggaaggctcaaagcagcgctccaaaggtgcgcaaaagcgtctcgtcacgcattcacgaggccgttaaagccatcgtactctgtcataatgtgacccccgtgtacgagtccagggctggggttacagaggagactgagttcgcagaagcagaccaggatttctcagatgagaacaggacctatcaagccagctcaccagatgaagtggcactggtgcagtggactgagagcgttggcctgacacttgtttctcgcgatcttacctcaatgcagctgaaaaccccttctggtcaggttctctccttttgcatcctccaattgtttccatttacttctgaaagcaagcgcatgggagtaatcgtgcgggatgaaagcacagccgagatcacattctatatgaaaggcgccgacgtggccatgagcccaattgtccagtacaacgattggcttgaagaggaatgcggaaacatggccagagaaggattgaggacactggtggtggccaagaaagcactgactgaggagcaataccaggactttgagagccgatacactcaggctaagctttctatgcacgaccgttctcttaaagtggccgccgtggtcgagtctttagaacgagaaatggaactgctgtgcctgactggagtggaggatcagctgcaggctgatgtgcgccccaccctagaaatgcttaggaatgcaggaatcaagatttggatgcttaccggagacaagctcgaaacagcaacgtgcatcgcaaaaagctcacacctggtttcgcggacccaggacatacacatctttcgccaagtgacctccagaggggaggcccatctggagcttaatgcctttcggagaaagcatgattgcgctctggtgatttcaggtgattctctggaagtgtgtctgaaatattacgagcacgagtttgtagaactggcttgtcagtgtccagctgttgtttgttgccggtgctcaccaacccagaaagcacgcatcgtcacattacttcagcagcataccggtcgtcggacctgcgctatcggagatgggggcaacgacgtctcgatgatccaggccgctgattgcgggattgggatcgaggggaaagagggcaaacaggcttctctggcagctgattttagtatcacccagttccgtcatattggtagactccttatggtacatggaaggaactcctacaagcgttctgccgccttgggacagttcgtcatgcacagggggctgataatctcaactatgcaggccgttttcagcagcgtcttctactttgcctctgtgcccctgtatcagggtttcctaatggtcggctacgcaaccatttataccatgttccctgtgttttccctggtcctagatcaagacgtgaagccagagatggctatgctgtatcctgagctgtataaggacctgaccaagggtaggtcactgtcgtttaaaacctttctgatttgggtgctcattagtatctaccagggagggatcctaatgtacggcgctcttgtgctcttcgaaagcgaattcgtccacgtcgtcgccattagcttcacagcactcatcctgaccgaattattaatggtggccctgactgtacgtacatggcactggttgatggtggtggctgaatttctgtctctgggatgttatgtcagctcactggctttccttaacgagtacttcgacgtagcttttattacaaccgtgactttcttgtggaaggtatctgctatcaccgtcgtcagttgcttgccgctgtacgtgctcaaatacctgagaaggaagctctccccgcctagctattgtaaactcgctagctag

SEQ ID NO: 109027 - DNA, 411 bp, Artificial Sequence
  Description of Artificial Sequence: Synthetic coding sequence
atgcctctcatgatgtcagaggagggatttgaaaacgaagagtctgattatcataccctgccaagggcgagaatcatgcaaagaaagcggggcctggagtggtttgtgtgtgacggatggaagttcctgtgtacttcctgttgtgggtggctgataaatatctgccggcgcaagaaagaattgaaagcccggaccgtgtggctggggtgtccggaaaagtgtgaagagaaacatcctcgcaattccataaaaaatcagaagtataatgtttttacattcatcccgggggtcttgtacgagcagttcaaattctttctcaacctgtacttcctggtgatctcatgtagtcagtttgtgcctgccttgaaaattggttacttgtacacgtattgggcgcctcttatgacttag

SEQ ID NO: 109028 - DNA, 609 bp, Artificial Sequence
  Description of Artificial Sequence: Synthetic coding sequence
atgcaacgcaagagggggcttgaatggtttgtatgcgacgggtggaaattcctgtgcacttcatgctgtgggtggcttatcaacatatgccgacggaaaaaagagttgaaggcgcgcactgtgtggttggggtgtccagagaaatgtgaagagaaacacccacgaaactctattaagaatcagaagtacaacgtctttacatttatcccgggcgtgctatacgaacaatttaagttctttctgaatctgtatttcctggtgatcagctgtagccagttcgtgccagcgcttaagatcgggtacctttatacctattgggctccactgggttttgtgctagcggtcaccatgaccagggaagcaatcgacgagttccggaggtttcagcgagataaagaagtaaactcacaactatactctaagttgactgtgcgaggaaaagtccaagtgaaatcctctgacattcaggtcggcgatctaatcatcgttgaaaaaaaccagaggatccccagcgatatggtgttcctgcgcacatcagaaaaggctgtgtccaataatctcgactactgcagtcatctggtgttgtttattttttgttttttaaactag

SEQ ID NO: 109029 - DNA, 1374 bp, Artificial Sequence
  Description of Artificial Sequence: Synthetic coding sequence
atggctcgtgaggggcttagaactctggtggtagcgaagaaagcattgactgaggagcagtatcaagacttcgagagcaggtacacacaagcaaaactgtctatgcatgatcgtagcctaaaggtggctgctgtagtggagtcgctcgagcgcgaaatggaattactgtgtttgactggggttgaggaccaactacaagctgatgtgaggccaaccctagaaatgctgcggaacgcaggcattaaaatctggatgttaacgggagacaagctagagactgctacctgcatcgcaaaatcctcacatttagtctctagaactcaggacatacacattttccgccaagtcacatctaggggtgaagcacatctggaactgaacgctttcagaaggaagcatgattgcgctctggtaatctctggcgattccctcgaggtgtgccttaaatactacgagcacgagttcgtggagcttgcatgtcagtgccctgcagtggtgtgctgtaggtgcagccctacccagaaagcccgtatcgtcacactgctgcagcagcacaccggcaggcgtacttgtgcaattggggacggcgggaacgacgtgtctatgattcaggccgcagattgtggaattggcatagagggcaaggagggtaagcaagcatctcttgccgccgattttagcattacacagttccgacacataggacgcctgctaatggtccatggccggaattcatacaagcggtcagcagcactcggacagttcgtgatgcaccgcgggctgataattagcacgatgcaggcagtgttttcatcagtcttctacttcgccagcgtccctctgtaccaaggattcctcatggtgggatacgctactatttataccatgtttccagtgttttctctggtgctggatcaggacgttaaaccggaaatggccatgctgtatcccgaactgtataaggatctgaccaaggggagatcactctccttcaagaccttcctcatttgggtgctcattagcatataccaagggggcattctgatgtacggggcactcgtgctcttcgaaagcgagttcgtgcacgtggtcgctattagcttcacggccctgatcctcacagagctcctgatggtcgctctgactgtgagaacatggcactggcttatggtcgttgccgaatttctttcactgggctgttatgtcagctcactcgctttcctgaacgagtacttcgacgtagccttcataacgaccgtgacatttttgtggaaagtgtccgcaattactgtggtgtcatgcctgcctctatacgtcttaaagtatttacggaggaagctcagcccgccctcatattgtaaactagcgagttag

SEQ ID NO: 109030 - DNA, 4500 bp, Artificial Sequence
  Description of Artificial Sequence: Synthetic coding sequence
atggagagggaaccagctggcactgaagaaccggggccgccagggagacgtagaaggcgtgaggggaggacgcgtacagtcagatccaacctcctgccaccccctggagccgaagaccccgccgctggtgcggcaaagggagagcggcgccgcagacgtgggtgtgcgcagcatctggcagacaatcggctgaaaacaaccaagtataccttgctgagcttcctcccaaaaaacctatttgaacagtttcaccgacctgcgaatgtatatttcgtctttatcgctctgttgaattttgtccccgcagtcaatgcattccaacctggtctcgcattggcccctgtgttgtttatcctggccatcacagcgttcagggatctgtgggaagactatagccggcatcgtagtgaccacaagattaaccatcttggttgcctggtcttcagcagagaggagaaaaagtacgttaatagattttggaaggaaattcacgtgggtgactttgtgcggcttcgctgcaacgagattttccctgcggacatattgctgttatcatcgtctgacccggatgggctttgccacattgagaccgctaacctggatggggagaccaaccttaagcggcgtcaagtagtccgtggcttctccgagctcgtttccgaattcaatcctttgacgttcacttctgtgattgaatgtgagaaacccaacaacgatctgtcaaggtttagagggtgcatcatccacgacaatggcaagaaggcaggcttgtataaagagaatctcctcctacgtggatgcacactgaggaatacagacgccgtggtcgggatagtgatttacgcaggacacgagaccaaggcccttttgaacaattcaggcccacgctataaaagatccaagctcgagcgacagatgaactgcgacgtgctctggtgcgtgttgctactggtgtgcatgtccttgttttctgcagttgggcacggcctgtggatttggcggtatcaggagaaaaaatcactattttatgttcctaaaagtgatggaagtagcctgtccccggtcactgccgcggtgtactccttcttgactatgataatagtgctgcaggtgttgatacccataagcctatacgtgtctatagagatcgtcaaggcctgtcaagtgtatttcattaaccaagacatgcagctgtatgatgaggagactgatagtcaacttcagtgccgcgctcttaatatcactgaggacctcggccaaattcagtatattttcagcgacaaaaccggaaccttaacggagaacaaaatggtctttagaaggtgcactgtttcgggggtggaatatagccatgacgccaacgcacaacggcttgctcggtatcaggaagcggactctgaggaggaagaggtggtgcctcggggcggatcagtatcccagcgtggttccatcgggtcccaccaatctgttagggtcgtacaccggacccagtccacaaagagccaccggaggaccggatctcgggctgaagcaaagagagccagcatgctgtcaaagcacactgcattctcgtccccaatggagaaagacataacacctgacccgaaacttctcgagaaagtgagcgaatgcgacaaatcactggctgtagcgcgccatcaggagcatctactggctcacctgagtccggagttgtcagacgtgtttgacttctttatcgccctcaccatttgcaatactgtagttgtgacctcccccgaccaacctcgtaccaaggttagggtccgctttgaactgaaatcaccggtgaagaccattgaggatttcctgcgtagatttacaccctcgtgccttaccagcggctgcagctctatcggctccctcgccgccaacaaaagctctcacaagctagggtccagcttcccgtcaacaccatctagtgatgggatgcttctccgacttgaggagagattgggacaaccgacgagtgccatagcgtcaaatgggtattctagccaggccgacaattgggcaagcgagctagcccaggaacaggagtctgagcgggagcttagatacgaagcggaaagcccagacgaggcggcacttgtgtacgcagctcgggcgtacaactgtgtcttggtggaacgcttacatgatcaggtgtcggtggagcttccacacttgggcaggcttacattcgaattgctgcatactctgggcttcgactctgtgaggaaaaggatgtccgtcgtcataagacaccccctcacagacgaaattaacgtttacaccaaaggcgccgacagcgtcgtcatggatttgctccagccatgctctagcgtggacgcccgggggcggcatcagaagaagatcagaagcaaaacccagaactatctgaacgtatatgccgccgagggattacgcacactgtgtatagccaaaagagtactgagtaaagaagaatatgcctgctggctgcaatcccacctcgaagccgaatcgtccctcgaaaactccgaggaattattgtttcaatctgctatccgacttgagactaatttgcatttgctaggcgctaccgggattgaggaccggcttcaggacggggttccagaaaccatttcaaagttaagacaggccgggctgcagatttgggtactgacaggagacaagcaggagaccgctgtcaacatagcatacgcctgtaagttgctcgaccatgatgaggaggtcattacactcaatgcgacctcccaggaggcctgtgcagcattgctggatcaatgcttgtgttacgttcagtccaggggcttgcaacgtgctcccgaaaagacaaagggcaaagtctctatgcgcttttcttctctatgtccgccgagcacatccactgctagcgggaggcggcctagcctcgtgattgacggaaggtcacttgcttacgcattggaaaagaatctggaagataaattcttgttcctcgcgaaacagtgtcggtccgtgctatgttgccgctcgacgcccttacaaaaatctatggttgtgaaactggtgcgttcgaagctcaaagcaatgacactggccattggtgacggggccaatgatgtttctatgattcaggtggccgacgtgggggtcggcatctcaggacaggaaggcatgcaagctgttatggccagcgatttcgctgtgccaaagttccgctacctggagaggctgctgatcctgcacgggcattggtgctacagtcgtctggcaaatatggtgttgtattttttctataagaacaccatgttcgtcggcctgctgttctggttccaatttttttgtggtttcagcgctagcactatgattgaccagtggtatctgatattctttaatctcctgttttcctccctcccccccttagtcaccggagtactggacagggatgttcccgccaatgtactgctgacaaatcctcaactgtacaaatctggacagaacatggaagagtaccgaccacggacattttggttcaacatggccgatgctgcttttcaatctcttgtttgcttttctataccttatctggcctattacgactctaatgtcgatctatttacgtggggaacgcctatcgtgacaatcgccctcctgacgtttcttctgcatctgggcatcgagactaagacatggacctggctgaattggatcacatgcggtttttcagtactgctcttttttacggtggccttaatctataatgcgagctgcgccacgtgctatccacccagtaacccgtattggacgatgcaggcactgttgggcgatccagtcttttatctgacttgtctgatgacccccgtcgccgctttactgccaagactctttttcaggagtctgcagggccgtgtgtttcctactcagcttcagctggcacggcagttgaccaggaagtccccccggcgctgcagcgctcctaaagagaccttcgctcaggggcgtctgcctaaagatagtggaaccgaacacagttctggccggacggtaaagacatcagtaccgttgtctcaaccttcctggcatacccagcaaccggtgtgctctcttgaagcatcaggggagccctccacagtggacatgagtatgccggtccgcgaacatactttactcgagggattatctgcgccagctcccatgtcttctgccccgggagaagctgtgcttcgaagccccggtgggtgcccggaagagtcaaaggtccgcgccgccagtacagggagggtaacacccttgtcctctttgttttccctaccgacattcagccttttgaactggatctcctcgtggtccctggtcagccgactcggctccgtcctgcagttttcaagaaccgaacagttagccgacggacaggccgggcgcgggctgcccgtccaacctcactccgggcggagtgggctccaaggacccgatcaccgactgttgattggcgccagctctcgtcgttctcagtag

SEQ ID NO: 109031 - DNA, 3405 bp, Artificial Sequence
  Description of Artificial Sequence: Synthetic coding sequence
atggattgttcccttgttaggactctagtgcatcgttactgtgccggggaggagaactgggttgacagtaggaccatttacgtcgggcatagggaacctccacctggggctgaagcctacattccgcagaggtatcctgataaccgcatcgtgagctctaagtatacattttggaacttcattcccaaaaacctgttcgagcagtttaggagagtggctaatttctactttctgataatcttcttagtgcaacttattatcgatactcccacatccccggtaacttctgggctacctctgttttttgtcattacggtcaccgctattaagcaaggttatgaagactggctaaggcacaaggctgacaatgcaatgaatcaatgtcccgtgcacttcatccagcatggcaagctcgtcaggaagcagtcaagaaagttgcgtgttggcgatatcgtcatggtgaaggaggatgaaaccttcccttgcgatttgatcttcctgtccagcaatcggggcgacgggacatgtcacgtcactactgctagcctggatggcgaatcctcccataagacacattacgccgtgcaggatactaagggttttcacaccgaagaagacatcggggggcttcatgccacaatagagtgtgagcagccccagccagacctttacaagttcgtcggccgtataaatgtctactctgacctgaacgacccagtggtaaggcctctcggaagtgagaatcttctgctacggggcgctacattgaaaaatacagagaaaattttcggtgtggctatctacaccggaatggagacaaaaatggctctgaattaccaaagcaaatcccagaaacggtccgcagtggaaaagtctatgaacgcctttttaatcgtctatctatgtatcctcatctctaaggcccttattaatacagtgctcaaatatatgtggcagagcgagcccttcagggatgaaccctggtataaccaaaagaccgagagcgagcgccaacgaaacctgttcctgaaagccttcacggatttcctcgctttcatggtcctgttcaactatattatcccagtgtccatgtacgtgaccgtggaaatgcagaaattcctggggtcatacttcatcacctgggacgaggacatgtttgacgaggagaccggcgagggtcctttagtgaacacttctgatttgaatgaggagctcggacaggtagagtatatcttcacagacaagacgggaaccctaaccgaaaataatatggaatttaaggagtgttgtatcgagggccacgtctacgtgccacacgtaatctgtaacggtcaggttctgccagaatcaagtggtattgatatgatagatagcagccctagtgtgaatgggagggagcgtgaggagcttttttttcgtgccttgtgcttgtgccacacagtccaggtaaaggacgatgacagcgttgatggtcctcgcaagagcccagacgggggtaagagctgtgtgtatatctcgagctcacccgacgaggtagcccttgtggaaggcgtgcagcgccttggatttacgtatttacgattgaaggataactacatggagatactcaatcgagaaaatcatatcgaacggttcgagctgctggagatcctctcttttgactctgtgagacggaggatgagcgtaattgtcaagagcgccaccggcgaaatttacttgttttgtaagggcgctgactcctcaatctttccgcgcgtgattgagggcaaagtggatcaaatccgggctcgggtggagaggaacgctgtggagggcctacggaccctttgtgtcgcctataagagactcattcaggaagagtatgaaggcatttgcaaactcttgcaggcagctaaagtcgccctgcaggaccgagagaaaaagctcgctgaagcatatgaacagatagagaaagatctgacgttacttggggctacagcggtggaggacagactgcaggagaaagcagccgatacgatagaggccctgcagaaagctggaataaaggtgtgggtgctgacgggcgataaaatggagaccgccgcagccacttgctacgcctgcaaactgtttcgacgcaacacacagctactggaattgaccaccaaacggattgaggaacagtccttgcacgacgtactgtttgagttatccaagacagtgctgcgtcactctggcagtctgacacgggacaacttgtcggggctgtctgccgatatgcaggattacggcctcatcatcgatggcgccgccctgtccctgatcatgaaacccagagaggacgggtcctcaggcaactacagggagctgtttcttgaaatctgtaggtcttgcagcgccgttttatgctgtcggatggcccctctccagaaggctcagattgtgaagctgataaaattttctaaggagcatcccatcacactggcgatcggggacggagccaacgacgtaagtatgatcctcgaggcgcatgtaggtataggcgtaatcggtaaagagggccgccaggcggcacgaaattccgattacgctattcctaaatttaaacacctgaaaaagatgctgttggtgcacgggcacttctattacattcggatttcagaactggtgcaatatttcttttacaaaaacgtgtgcttcatctttccgcagttcctgtatcagtttttctgcggattctcccagcaaaccctctatgacaccgcttacctgactttgtataacattagtttcaccagcctccccatcctcctgtactctctcatggagcagcacgtgggaatcgatgtcctgaagcgcgatcccaccttgtatagggacgtggcaaaaaatgccctgttgaggtggagagtgttcatttattggaccttgcttgggctgtttgacgcactagtgttttttttcggcgcttactttgtcttcgagaacacaaccgtgacaagcaatggccagatatttggcaactggactttcggaacattggtctttaccgttatggtctttactgtgactctcaagcttgccctggatacccactactggacctggattaaccactttgttatctggggaagcctactgttctacgtggtattttcgctcctctgggggggtgtcatctggccattcttgaactaccagcggatgtattacgtttttatccagatgttatccagcgggcctgcttggctggctatcgtgttgttggtgactatatcactgctgcccgatgtcttgaaaaaggtgctctgcagacaactttggcccactgccaccgagagagtgcaaactaaaagccaatgcctgtccgtggagcagtcaacaatcttcatgttgtctcagacctcctcttccctcagcttttag

SEQ ID NO: 109032 - DNA, 3576 bp, Artificial Sequence
  Description of Artificial Sequence: Synthetic coding sequence
atggattgcagtctggtgcggaccctggtgcatcgttactgtgctggcgaagagaactgggtagactcccgaactatttacgtgggccatcgcgaaccccctcctggggcagaggcctacatacctcagcgctacccagataaccgaattgtaagctcaaaatacaccttttggaactttatccctaaaaatctctttgagcagttcagacgcgtagccaacttttatttcttgatcatttttttagtgcagctgattattgacacaccaacaagcccagtaactagcgggctgccattgttctttgtgatcaccgtcacagccattaaacagggatacgaggactggcttcgtcataaagcagataacgccatgaaccagtgccccgtgcacttcatccagcatggaaaacttgtgcggaaacagtccaggaaactcagggtcggggatatcgtcatggtgaaagaggacgaaacatttccctgtgatctgatctttctgagctccaatcgcggagacggtacctgtcacgtaactacagcctcactggacggtgaaagcagccataaaactcactacgccgtgcaagatactaagggttttcacactgaggaagatatcgggggcctgcacgccactattgaatgcgaacaaccacagcccgatttatataaattcgtgggtaggatcaacgtttatagcgatctgaacgatccagttgtgagaccgcttggttctgaaaatttgctgctgcgcggcgccactctgaagaatacggagaaaattttcggagtggccatatacacagggatggaaacgaaaatggctcttaactaccagtcaaagagccagaagcggagtgctgtcgagaagtccatgaacgcttttctgattgtatacctttgcattctgatctcaaaggcacttatcaacacagttctgaagtatatgtggcaaagtgagccttttcgggatgagccctggtataatcagaagaccgagtcagagcgccagcgaaacctcttcctgaaggcctttactgactttctggccttcatggtgctgttcaattacatcattccggtcagtatgtacgtcaccgtggagatgcaaaagtttcttgggtcgtacttcattacatgggatgaggacatgtttgacgaggagacaggcgagggaccgcttgtgaatacatccgacctaaacgaagaactggggcaggtggagtatattttcacagataaaaccgggaccctcaccgaaaataatatggagttcaaagagtgttgcatcgaagggcacgtctacgtgccccacgtcatttgcaatgggcaggtcctgcccgagtccagcggcattgacatgattgattccagtcctagcgtcaacggccgcgaacgggaagaactgtttttccgcgccctgtgtctgtgccatacggttcaagtgaaggacgatgattccgttgacggcccccgaaaatcccctgatggcggcaagtcatgcgtgtacatttcaagttctcccgacgaggtggctctagtggagggcgtacagcgcctgggattcacatacctgcggttgaaggacaattacatggagatccttaatcgagagaatcatatagaacgttttgaactgctggagattctcagctttgacagcgtgcggcggagaatgagcgttattgtgaaatcagcgaccggtgagatctacctattttgtaagggcgctgactcctccatttttcctagagttatcgaaggtaaagttgaccagataagagcccgcgtcgagagaaatgcagtggagggcctgagaaccttgtgcgtagcctacaagaggctgatccaggaagagtacgaagggatctgtaagctgctccaggccgctaaggtggctctccaggaccgggaaaaaaaactggcagaagcttatgaacaaatcgagaaggacctgacactgctcggggcaaccgccgtggaggaccggctgcaggagaaggccgctgacaccatcgaggcccttcaaaaagctgggattaaagtttgggtactcacaggggacaagatggagaccgctgcagccacatgctatgcgtgcaaactgttcaggagaaatactcaattactggaactgactacaaagcgaatcgaggaacagagcctgcatgacgtgctttttgagctgagtaagacagttctgcgccactcaggcagcctgactagagacaacctgtcagggctttcagctgatatgcaggactacggacttataatcgacggcgccgctttgagtctcatcatgaaaccacgggaggacgggtctagcggcaactatagggaactcttcctagagatctgtagatcctgctccgctgtgttatgttgcagaatggcccctctccagaaggctcagatcgtgaagctgattaagttttctaaggaacatcctattaccctggctattggcgacggcgccaatgatgtaagcatgatcctcgaagcgcacgtggggattggggtgatcggcaaggaggggcgccaggcagccaggaatagtgactatgccatcccgaagtttaaacatctgaaaaaaatgctcttagtccacgggcacttctattacatcaggatttctgagctggtacagtatttcttctataagaacgtgtgttttatcttcccgcagttcctctatcaattcttttgcggattctcacaacagacactgtacgataccgcctatctgaccctgtataatatctcgttcaccagccttcccatactactgtacagcctgatggaacaacacgttggcatcgacgtccttaagcgagatccaaccctctaccgggacgtcgccaaaaatgccctgctgcgatggagagtgtttatctactggaccctgctcggactctttgatgcccttgttttcttctttggtgcatatttcgtcttcgagaacaccaccgtgacttccaatggacagatattcggtaactggacatttggaaccctcgtcttcaccgtgatggtgtttacagtgacgctgaaactcgcactcgatactcactactggacctggatcaaccatttcgtcatttggggaagtctgttgttttatgtggtgtttagtttgctgtggggaggcgttatctggccgttccttaattatcagcgcatgtattacgtctttatccaaatgttgtcttcagggccagcttggttagccatcgttctgttggtcacaattagtctcctaccagatgtgctgaaaaaggtgctgtgtagacagctttggcctaccgccaccgagagggtgcaaaatggctgcgctcagcccagagatcgtgattctgagttcacaccactggcatcgctgcagagccctggctaccagtctacctgcccatccgcggcctggtactcttcacatagccagcaggtgactctggctgcctggaaggaaaaggtgtccactgaaccaccaccaatcctgggtggttcccatcaccactgcagctccattccgtcccattcatgtccacgctcccgcgtcggtatgttagtgtag

SEQ ID NO: 109033 - DNA, 3405 bp, Artificial Sequence
  Description of Artificial Sequence: Synthetic coding sequence
atggactgcagcctggtgcgcaccctggtccatagatactgcgcaggcgaggaaaactgggtcgacagccgaacaatctacgttgggcacagggaaccgccccccggagccgaggcctacattccccagcggtaccccgacaacaggatcgtaagctctaaatacacattctggaatttcatcccaaagaatctattcgaacagttcagacgcgttgcaaacttttacttccttatcatcttcttggttcagctcataattgacacgcctaccagccctgttacttctggactgcccttattttttgttatcaccgtaacagccattaagcagggatacgaggactggttgaggcacaaggctgataatgcaatgaaccagtgccctgtccacttcatccagcacggtaagctggttaggaagcagagtcggaaactccgagtcggcgacatcgtaatggttaaggaggacgagacatttccttgtgatctaatattcctgagcagcaataggggcgacggcacctgtcacgtgacaacagcctctctcgacggagagtcatctcataaaacccactatgcagtacaagacaccaaaggatttcatactgaggaagacatcggcggattgcatgccactattgagtgtgaacagccacagcctgatctgtacaagtttgtgggccgcatcaacgtatacagtgatctaaacgaccctgtcgtccgcccgctgggcagcgagaacctactcctcagaggcgccacgctcaaaaacacggagaaaattttcggcgtagccatctacacaggaatggagaccaagatggcactgaattaccaaagtaaatcacagaagcggtctgccgttgagaaatccatgaatgctttcttgatcgtctatctatgtatcctaatctcgaaggccctgattaatacagtgcttaagtatatgtggcagagtgagcctttccgggacgagccttggtataaccagaagacagaaagtgaacggcaacgaaatttgtttctgaaggcttttactgatttcctggctttcatggttctatttaactatatcatcccggtatccatgtacgtgactgtggagatgcaaaaatttctcgggtcctacttcatcacctgggatgaagacatgtttgatgaagagacaggagaggggccactggtgaatacttctgatctcaacgaggaattggggcaggtggagtacatttttactgacaagactggcacactgacggagaacaacatggaattcaaagaatgctgcatcgaaggtcatgtgtacgtgcctcacgtgatttgtaacggccaagtacttccggagagctcgggaatcgatatgatcgattcaagcccaagtgttaacggaagggagcgggaggaattgttttttcgcgccctctgcctgtgccacacggtgcaagtgaaggatgatgactccgtagacgggccccgcaagtccccagatgggggaaagagctgcgtgtatatatccagctctccagacgaggtggctctggtggagggtgtacagcggttggggttcacttaccttcggttgaaagacaattacatggagattcttaaccgcgagaaccacattgagcgctttgaattgctggagatcctgagcttcgacagtgtacgacgccgaatgtctgtgatcgtgaagtctgccacaggcgagatttatttgttctgcaaaggagcggacagttcaatctttccgagggtgattgaaggcaaagtcgatcaaattcgggctcgcgtcgaaagaaacgcggtggaaggcctgaggacattgtgcgtggcctacaagcggctgatccaagaggagtatgagggcatctgcaagctactgcaagccgctaaagttgctttacaggaccgcgagaaaaaactggctgaagcatacgaacaaatcgagaaggacctaacactgcttggggctaccgcagtcgaagacagactgcaagagaaagctgccgataccatcgaggctctgcagaaagctggcattaaagtgtgggtgctcaccggggacaagatggagaccgcggctgctacgtgttacgcctgtaaactttttcgtagaaatacccaattgctagagttaactacgaaacgtatagaagaacagtccctgcacgatgtacttttcgaactgagcaaaaccgtgctgaggcattctgggagcctgactcgggacaacctgtctggtctctccgcagatatgcaggactacggactgattatcgacggtgcggccttatcattaattatgaaacccagggaagacggctcatctggtaactatcgggaactgtttctggaaatttgccgatcctgctccgccgtcctgtgctgccgcatggcccctcttcaaaaggctcagattgtgaaactgatcaaattctctaaagaacacccaatcacattggcgattggggatggggcaaatgatgtttccatgatcctggaggcacacgtgggcatcggcgtaataggcaaggaaggcaggcaggctgccagaaattctgactatgctatacctaagtttaagcatcttaagaaaatgctgctggtgcacgggcatttctactatataagaatctccgaactggttcaatactttttttacaaaaatgtctgttttatctttccgcagttcctttatcaattcttctgtggatttagtcagcagactctttacgatactgcgtaccttactctctataacatctctttcacctctctgccaatcctgctgtatagtctaatggagcaacatgtgggtattgacgttctaaagcgggaccctacattgtatcgcgacgttgccaagaatgctctgctgaggtggagggtgttcatttactggacactccttgggctcttcgatgcactggtgtttttttttggagcgtattttgtcttcgagaacactacagtgacttcaaacggccaaatttttgggaactggacttttggcaccctggtgtttacggtcatggtgtttacagttactctcaagcttgcactagacacccactactggacttggatcaatcattttgtgatctggggttccttgctgttttacgtcgtgttttccctgctgtggggtggcgttatttggccctttcttaactaccagagaatgtactacgtgttcatacaaatgttaagtagcggacctgcctggctggcaatcgtgctgctggtcaccattagccttctgcccgacgtgctgaagaaagttttgtgtaggcaactgtggccaacagctacagaaagagtccagacaaaatcgcagtgcctgtctgtggagcaaagcactatctttatgctgtcacagacctcatcgtcgctgagcttctag

SEQ ID NO: 109034 - DNA, 2808 bp, Artificial Sequence
  Description of Artificial Sequence: Synthetic coding sequence
tagtatgtcggccaccgtgagccaccccctggcgcagaagcatacatcccacaacgctaccctgacaaccgtatcgtgtcatctaagtacaccttctggaacttcattcctaaaaacctcttcgagcaatttcgccgcgtcgctaacttttactttctcattatttttctggtgcaattgataatagacacgcccacctcacccgttacctctggactgcctctgtttttcgtgatcaccgtgaccgcaatcaagcagggttatgaggattggttgcgccacaaagccgacaacgcaatgaatcagtgcccagttcatttcatccagcacggcaaacttgtgagaaaacagagcaggaagctacgggtgggcgacattgtaatggtcaaagaggatgagacctttccatgtgacctcatcttcctcagtagcaaccgcggagatggcacatgtcacgttactaccgcctccctcgatggagagtcaagtcacaaaacacattatgccgttcaggataccaagggattccacacagaagaagatataggcggcctgcacgccactatcgagtgtgaacagccccagcccgacctgtacaagtttgttgggaggattaacgtgtactcagacctaaacgatccagtggtgagacccctcggatccgaaaatctgctgctgcggggagctaccttgaaaaacactgagaagatctttggtgtcgcgatatacactgggatggagactaagatggctctaaattaccagtctaagtcccagaagaggtctgccgtcgagaagagcatgaatgcatttctaattgtttatctgtgtatactgatctctaaggccctgatcaacacggtgctcaagtacatgtggcagtcggagccattccgggatgaaccttggtacaatcagaaaactgaatctgagcggcagagaaatctgttcctcaaggcgtttacagatttcttggcattcatggtcctcttcaattacatcattcctgtgtccatgtacgtgaccgtggaaatgcagaaattcctgggtagctatttcatcacttgggatgaggacatgtttgacgaggagactggtgaaggccccctcgtcaatactagcgaccttaacgaggagctcggccaagtggaatacatctttacagataaaactggtaccctgactgaaaataatatggaattcaaggaatgttgtatcgagggacacgtatacgttcctcatgttatttgtaacggacaagtcctgccggaaagctccggcattgatatgatagattcctccccttccgtgaatggtagggagcgcgaggagttgttctttagggctctgtgcctttgccacaccgtccaggtgaaagatgatgacagcgtagatggccccagaaagtcccccgatggggggaaatcttgcgtctacatttccagcagtccagacgaggtggctttggtggaaggcgttcagaggctgggattcacctatctgcgcctgaaagacaactacatggagatcctgaaccgagaaaaccatatagagcgattcgaactgctggagattctctccttcgactccgtgcgcagaagaatgagtgtgatcgtcaaaagtgccactggggaaatctatctgttttgcaagggcgcagatagttccatctttccacgcgtgatcgaggggaaggtcgatcagatccgcgcacgagtggaaaggaatgctgtggaggggcttagaaccctgtgtgttgcctataagcgtctcatacaggaggaatatgagggaatctgtaaattgcttcaggccgccaaggtcgccctgcaagaccgcgaaaagaagttggcagaagcctatgagcaaatcgagaaggatctcaccctgctgggggctaccgccgtggaggatcgccttcaggagaaggctgccgataccatagaagcattacagaaggctggcattaaagtgtgggtcttaaccggggacaaaatggagacggccgccgcgacatgctacgcatgtaaactatttcgtaggaatactcagctactggagcttaccaccaaacggatcgaagagcagagtttgcacgacgttctctttgagctgtccaagaccgtgctcaggcactccggctccttaacgcgagacaacctgtccggtctctccgcagacatgcaggattacggactgatcattgatggagcagctctaagcctgattatgaagcccagggaagatggttcgagcggcaattatagagagctgttcttggaaatatgccggtcctgtagtgcagtcctatgttgcagaatggccccactgcagaaagcccaaatcgtgaagctgattaaatttagcaaagaacatcccattacgctggccatcggggatggagccaacgatgtgtcaatgatacttgaggcccatgtgggcattggggtgatcggtaaggagggtaggcaggctgcccgcaactccgactatgccattccaaaattcaaacatctgaaaaaaatgctgctagttcatggccacttctactacattcggatctcggagttagtccagtattttttctataagaacgtctgttttatctttcctcagttcctgtaccaattcttttgcggattttctcagcagaccctgtacgatactgcatatctcactctttataatatcagcttcacctctctgcccatcctcttgtactcccttatggaacaacacgtagggatcgatgtgctgaaacgagaccctactctgtacagataccatccgcccaatagtttgtcctag

SEQ ID NO: 109035 - DNA, 1119 bp, Artificial Sequence
  Description of Artificial Sequence: Synthetic coding sequence
atgtccgttattgtgaaatctgcaacaggggagatttacctgttctgcaaaggagcagacagctcgatcttcccccgtgtgatagaaggcaaggtggaccagattagggcgagggtcgaacgaaatgccgtggagggcctccggaccctttgtgtggcctacaaaaggctgattcaggaagaatacgaagggatatgtaaattactccaggcagctaaggtggcactgcaagatcgcgaaaagaaactggctgaagcatacgagcagatcgaaaaggacctgaccctgctaggcgcgaccgccgtggaggacagactgcaggaaaaagcagcagataccattgaagcattgcagaaggccggcattaaggtttgggttctgaccggggacaaaatggaaaccgcggctgccacatgctacgcctgcaaactttttagacgtaacacacaactcctggaactcacaaccaaaaggatcgaggaacagtcgttgcacgatgttctctttgagctgtctaaaaccgtgctacgtcattccggatcactgactcgcgacaacctgtctggcctgtcggcagacatgcaggactacgggttgataattgacggcgcagccctctcattgattatgaaaccaagggaggatggctcctccggtaactatcgagagctctttcttgaaatctgccggtcatgctcagctgtcctctgttgtcgcatggctccactgcagaaagcgcagattgtaaagcttatcaagttcagtaaggaacaccccatcaccctggcgattggagacggcgctaacgatgtatcaatgatcctggaagcccacgtaggaatcggcgtaataggcaaagagggcaggcaggcagctaggaacagtgattacgccatcccaaaatttaaacatctgaaaaagatgctactcgtccacggacacttctactacatccggatatcagaactcgtgcagtattttttctacaaaaacgtgtgctttatctttccccaatttttgtaccagttcttctgtggcttttctcagcaaggaaggcggcaggagtgtccagccgctttggccagggtccacttgctggatgcaccaggaaccgtgtag

SEQ ID NO: 109036 - DNA, 1059 bp, Artificial Sequence
  Description of Artificial Sequence: Synthetic coding sequence
taatcaatcttcccccgcgtcattgagggtaaggtagatcagattcgagcccgggtcgaaagaaacgccgtggagggactgaggactctttgtgtggcctataagcggcttatccaggaagagtatgaagggatctgcaaactcctgcaagcagccaaagtggcgctgcaagatagagagaaaaaacttgcggaagcttacgagcagatagagaaggaccttactctcctgggggctacagcggtcgaagaccgtttacaagaaaaggcggccgacaccatagaagcgctccagaaggctgggattaaagtatgggtactcaccggggataaaatggaaaccgcagccgctacctgttatgcctgcaagctgttccgtaggaacacgcagctgctggagcttacgacaaaacggatcgaggagcaatcactgcacgatgtcttgttcgagctgagcaaaacagtgcttcggcacagtgggagtctgaccagggacaacttatcagggctgtccgccgatatgcaggactatggtctcattattgatggcgctgctctctctctcattatgaagcctagagaggatggctcctcagggaactacagggagctcttcctggaaatctgccggagttgctctgcagtgctttgttgcagaatggcgccactacaaaaggcgcagatcgtaaagctgataaaattctcaaaagagcaccccattactctagccattggggatggcgctaacgatgtgtcaatgatattggaagcacacgtcggcataggagttattgggaaagagggacgccaagccgccaggaattccgattatgccatcccaaaattcaaacaccttaagaagatgttactggtgcacggacacttttactacatcaggatcagtgagctggtgcaatatttcttctacaaaaacgtctgtttcatattccctcaattcctataccagttcttctgtggattctctcagcagggtcggcgccaagaatgcccggcagctctggctcgagtgcatctcctggacgctcccgggactgtgtag

SEQ ID NO: 109037 - DNA, 3405 bp, Artificial Sequence
  Description of Artificial Sequence: Synthetic coding sequence
atggactgcagcttagtacgcacactggtccacaggtactgtgctggcgaagagaattgggttgactcacggaccatttacgtcggccaccgcgaaccgcctcccggcgccgaggcttacatcccccagagataccctgataacagaatcgttagctcgaagtacactttttggaatttcatccccaagaacctgttcgagcagttccgacgggtcgccaacttctactttctcatcatctttttagttcagttgatcatagataccccaacatcacctgtcacatctggcctgccactcttttttgtcattacagtgactgcaatcaaacaggggtacgaagattggctgagacacaaggctgacaatgctatgaatcagtgcccggtccacttcattcagcacgggaaactggtccgcaagcagtcccggaagctccgcgtgggggacatcgtcatggtgaaggaagatgagacatttccctgtgacttgatctttctctccagcaaccgaggcgacgggacttgtcacgttacgacagcttcactagacggggagtcaagccacaagacacactacgctgtccaagacacgaaggggtttcacacggaagaggacattggaggactccatgccaccatcgaatgcgagcagccccagccagacctctataagtttgtgggacgcatcaacgtttacagcgacctgaatgaccctgtcgtgagaccgcttggctcggagaacctgctgttgcggggcgccacgttaaaaaacactgagaagatattcggtgtggctatctacaccggtatggagacaaaaatggccctgaattatcagtccaagagccagaaacgcagcgcggtggaaaagtctatgaatgcttttctgatagtatatttatgtattctgatttctaaggctctgatcaatacggtgctcaaatatatgtggcagtcagaacccttcagagacgagccctggtataaccagaagactgagagtgagcgccagcggaacttattcttgaaggccttcacagatttcctggccttcatggtgctttttaattatattattccagtttcaatgtacgtgacagtcgaaatgcagaaatttttaggcagctactttatcacttgggatgaggatatgtttgacgaggaaaccggagaaggacctcttgtcaataccagcgatctgaatgaagaactcggccaggtggagtatatttttacggacaaaaccggcacccttactgagaacaacatggaattcaaggaatgctgcatcgaggggcacgtatacgtgccccacgttatctgtaacggccaggtgttacctgagagcagtggtatcgatatgatcgatagttctccatccgttaacggacgtgaacgggaggaattgttctttagagccttgtgcttatgtcacactgttcaagtgaaggacgatgactccgtcgatggacccagaaaaagccctgacggcggaaaatcatgtgtctacatatcatcgagccccgacgaagtcgcactggttgaaggggttcaacggttgggctttacctatcttaggcttaaagacaattacatggaaattttgaatcgagaaaatcacatcgaacggttcgaattactggaaatcctgagcttcgactccgtgcgacggcggatgtccgtcatcgtcaagagtgccactggcgagatttatctcttctgcaagggggcagactccagcatttttccgagagtgattgagggcaaagtggatcagatacgtgcccgcgtcgagagaaatgctgttgagggtcttagaacactctgtgtggcctacaagaggctaattcaagaggaatatgaaggaatctgcaagttgttgcaggcagccaaggtggccctgcaggaccgcgaaaagaaactggccgaggcttatgaacagattgagaaggacctaactctgcttggggctacagctgtggaggaccgattgcaggagaaggcggcagacacgattgaggccctccagaaagcaggaatcaaggtctgggtcctgactggagataagatggagaccgccgccgcaacctgctatgcctgtaagctgttccgaagaaacacccagcttcttgaactgacaacgaaacgaattgaagagcagagtctgcacgacgtgctcttcgagctctccaaaaccgtgttgaggcacagcggctccctgaccagggacaatctgagcggcttgtctgcagacatgcaggattacgggctaataatagacggagccgccctttcactgattatgaagccacgcgaggatggctcatccggaaattatagagagctgtttttagagatttgcaggtcctgctccgccgtcttatgttgccgtatggcgccactccagaaagcacaaattgtgaagcttattaagttcagcaaagagcatccaataacactggctatcggggacggcgcaaatgacgtcagcatgatactcgaggcccatgtcggaattggtgttatcgggaaggaggggcggcaggccgcccgcaactctgactacgcgattccaaagtttaagcacttaaagaaaatgttactggtccatggacacttctattatatcaggatctctgagttagtgcagtacttcttttataagaatgtatgcttcatattccctcaatttctttatcagttcttttgtggcttttctcagcagaccctatatgacactgcctacctgacactgtacaatatctcctttaccagtcttccaatcttgctttactctctgatggaacagcatgtgggtattgatgtcctgaagcgggacccaaccctttatagggacgtggcgaagaatgccctactacggtggcgggtctttatctactggactttactgggactgtttgatgcactcgttttctttttcggcgcgtacttcgtcttcgaaaatacaacagttacaagtaatggacaaattttcggcaactggacttttggcacactagtctttactgttatggttttcactgtgacacttaaattggctctggacacgcactactggacttggattaaccacttcgtaatttgggggtccctcctgttttatgtggtgttcagcctactttggggtggggttatctggccattcctcaattaccaaagaatgtattatgtatttattcagatgctatcctcgggccccgcttggttggcaatagtgctcctcgtgacaattagcctcctgccagacgttctgaaaaaggtgctctgcagacagctgtggcctactgccactgaacgggtccaaactaagtcccagtgcctgtcagtcgagcagtctactatatttatgctttctcagacttcctctagtctcagtttttag

SEQ ID NO: 109038 - DNA, 3534 bp, Artificial Sequence
  Description of Artificial Sequence: Synthetic coding sequence
atgtggcgctggatccgccagcagctcggattcgaccccccccaccagtcagacacccgcaccatttatgtggccaatcgttttccacagaatggtctttatacgcctcagaagtttatagacaaccgtattattagctccaagtatacggtctggaatttcgtccctaagaatctgttcgagcaatttcgacgagtggccaatttttactttctgatcatctttctcgtccagctgatgattgataccccaacaagtccagtcaccagtggcctgcctctcttcttcgtgatcactgttaccgccattaagcagggttacgaggattggcttaggcacaactcggataatgaagtcaatggggcccctgtgtacgtcgtgcgctccgggggtcttgttaaaacccggagcaagaacatcagagtgggtgatattgtacgcattgccaaggatgagatctttccagcagaccttgttctcctctcgtccgaccggttggacgggagttgtcacgtgacgactgcatctctggacggcgagactaaccttaaaactcatgtcgcggtgccggagaccgccctgctgcagaccgtggcgaatttggacaccctggtggccgtcatcgaatgtcagcagccagaggccgatctatacaggtttatggggagaatgatcattactcagcagatggaggaaatcgtccggcccctgggaccagaatctcttctgctgagaggcgccaggctgaaaaataccaaagaaatttttggcgttgcggtatatacagggatggagacaaagatggccctaaattacaagagtaagtctcagaaacggtcagccgtagagaaatctatgaataccttcttgatcatctaccttgttatccttattagcgaagccgtgatctctaccatcctgaaatacacctggcaggctgaagagaaatgggacgagccttggtacaatcaaaagaccgagcaccaaagaaattcatctaaaattctcagattcatcagcgacttcctggccttcttggtgctgtataactttatcatccccataagcctttatgtcaccgttgagatgcagaaattcctgggctccttttttatcggatgggatctggatctgtatcatgaggaatccgatcagaaagcccaggtcaacacctctgatctcaacgaggagttgggccaagtggagtacgtctttacagacaagacaggcacactcacagaaaacgaaatgcagttccgggaatgcagcatcaatggcatgaaatatcaggagattaacggacgcctggtgcctgagggcccaacaccagacagtagcgaagggaatcttagttacctgtctagtttgtcacacctgaacaacctttcacacttgactacttccagctcattccggaccagtcccgagaatgaaaccgaacttatcaaggagcatgatctgttttttaaggctgtcagcctgtgccatacagtccagatttcaaatgtccagacagattgcaccggcgatggtccctggcagagcaacttagcacccagtcagcttgagtattatgcctcatcccccgacgagaaggcgctggtcgaagctgctgcccgcattgggatcgtgtttattgggaactctgaggaaacgatggaggtaaaaactttgggcaagttggaacgttacaaactgttacatatcttggagtttgactcagatagaagacgaatgagtgttattgtacaggctcctagtggcgaaaagctgctgtttgccaagggggccgagtcttccatcctccctaaatgcattggaggcgaaattgagaaaacccggatccacgtggatgagttcgccttgaagggtctcagaaccttgtgtatcgcctaccgcaaattcacctctaaagagtacgaggagatagataaaaggattttcgaagctcgaacagccttgcaacaacgcgaggaaaaactagctgccgtgtttcagtttattgaaaaggacctcatactgctgggagctaccgccgtagaagataggcttcaagataaagtacgagagaccattgaagccctacgtatggcgggaataaaggtatgggtgctaaccggggataagcatgaaaccgccgtttctgtgtcgctgtcatgcggacatttccatcgaaccatgaacatccttgaattgattaaccaaaagagcgattccgaatgcgcagagcaactccgccagctggccaggagaatcactgaggaccatgtaatacagcatggtcttgtcgtagatggtacctctctgtctctcgcgctgagagaacatgaaaagctgttcatggaagtttgtcggaactgcagcgcagttctgtgctgcagaatggcccccctgcagaaagccaaggtgattaggctcatcaaaatttccccagagaaaccaataacactggccgtcggtgatggcgccaacgatgtatccatgatccaggaagcacacgtcgggattggtataatggggaaggagggccgacaggctgcacgaaattcagactatgcaattgcccggtttaaattcctttcaaagcttctgtttgtgcatgggcatttctactatattcggattgccacactcgttcagtacttcttctacaaaaatgtctgctttataaccccacagtttctctatcaattttactgcctctttagccagcagacgctgtatgactcggtgtatctcaccctttataatatatgctttacctcgcttcccatacttatctactctttgttggagcagcatgttgatccccatgtgctccagaataagcccacgctctatcgggacatctccaagaaccgtttgctaagcatcaaaacttttctttattggactatcctggggttcagccatgccttcatcttcttctttgggtcttacctactgattggcaaagatacctcattgctgggtaacggacagatgttcggtaactggacattcgggacgcttgtgtttacagtcatggtgatcactgtgaccgtaaagatggcacttgaaacacatttctggacctggattaaccacttggtcacctggggcagcattattttttatttcgtgttcagcttattctacggtggaatcctttggcccttcctgggctcgcaaaacatgtattttgtcttcatacagctgcttagttccggttccgcctggtttgcaattatactgatggtggtgacttgtctctttctggacattatcaagaaggtgttcgatcggcatctccatccgacttccactgaaaaggcacaactgaccgaaactaacgctggcatcaaatgtcttgactccatgtgctgctttccggagggcgaagccgcctgtgcctcggtgggccgaatgctcgaaagagtgattggccggtgcagcccaacccacatctctaggagctggtcggcctcagacccattttacactaacgatcgctccatcctgacattgagcactatggattcatctacctgttag

SEQ ID NO: 109039 - DNA, 315 bp, Artificial Sequence
  Description of Artificial Sequence: Synthetic coding sequence
atgtattttgtcttcatccaactgttaagcagtggatcagcgtggttcgcaatcatccttatggtagtgacctgtctctttctggacattatcaaaaaagtcttcgacaggcacctgcatccaaccagcactgaaaaagcacagatgtattccaatacagttgctctatccgacgagtttatcgcgctgcagcccctgtcaagggcccggaaccagctatctaagttacgttggaagaagatccgggtgcagagtgcacaacacatgaatctgttaaaagcatctactgagggacggactgttggtacttgttag

SEQ ID NO: 109040 - DNA, 4503 bp, Artificial Sequence
  Description of Artificial Sequence: Synthetic coding sequence
atggatccatccatgggggtcaacagcgtgacgatttcagtggaggggatgacatgtaacagctgcgtgtggacaattgagcagcagatcggcaaagttaatggtgtccaccatattaaggtctcactggaggaaaaaaacgcaaccattatctatgatccaaagctgcagacaccaaagacactgcaggaggctattgatgatatggggtttgatgccgtgattcacaacccagatcctttgcctgtgctcaccgatacgctttttctaacagttactgcttccttaacgctgccatgggatcacattcagagcacattgttgaaaactaagggggtcacagacataaaaatctacccgcagaagcgaacagtggctgtgactattatcccctcaattgtcaacgctaaccagatcaaagaactcgtgccagagttgtcactggatactggcacacttgaaaagaaatcgggcgcttgtgaagaccatagcatggctcaggccggagaagttgtgctgaaaatgaaggtggaaggaatgacgtgccatagctgcacttctaccatagaggggaagataggaaaactccagggagtacagcgcataaaggtgagcttggacaaccaggaagccacaatcgtctaccagccacacctgattagcgtggaagaaatgaagaagcagatcgaagctatgggcttcccagccttcgtcaagaaacagcccaaatatctgaagttgggcgccatcgatgtggaaaggctaaaaaacactcctgtcaagtctagcgagggctctcagcaacggtccccatcttatacaaatgacagcactgcaacgtttatcatagacggcatgcattgcaaaagttgtgtgtcaaacatcgaaagcacgctgagcgccctgcaatacgtgtcgagcatagttgtgtccttggaaaatcgctccgcaatcgttaagtacaacgcctcctcagtcacgccagagtctctcaggaaggccatcgaggcggtgagcccgggcctgtaccgcgtatcaattacctccgaagtggagtctacttccaattctcctagtagctcttcactccagaaaatccccctgaatgtggtttcccagccattgacacaggagacagtcatcaatatcgatggaatgacttgcaactcctgcgtgcagtccattgagggagtaatcagtaaaaagccaggcgtgaagtccataagagtaagcctggccaattctaatggtacagtggagtacgatcccttgctgacgagtccagaaaccctccggggagcaatcgaagatatggggttcgatgctaccctgtcagataccaacgaacctctcgtggtgattgctcagccgagcagcgaaatgcctctactaacctccactaatgagttctataccaagggtatgacgccagtgcaagataaggaagaggggaagaactccagtaaatgttacatacaggtgaccggaatgacctgcgcctcttgtgtagctaatatcgagagaaatttacggcgcgaagaggggatttatagcatcttagtcgccctaatggccggaaaagccgaagtgagatacaatcccgccgtgatacaaccccccatgatcgcagaattcatcagggagcttgggtttggcgcaacggtgattgaaaacgccgacgaaggggacggggttctcgagctggtcgtccggggaatgacttgcgccagttgtgtgcacaagattgagagtagcctcaccaaacacagagggattctgtactgttcagtggcactggctacaaacaaagcccacatcaagtatgaccctgagattatcggacctcgagacattatccataccattgaatcccttgggttcgaggcttctttggttaaaaaggaccgctccgctagccatcttgaccacaaaagagaaattaggcagtggcgccgctcatttctggtatcactgttcttctgcattcccgtgatgggactcatgatctatatgatggtgatggatcaccactttgccacattgcaccataatcaaaacatgtcgaaggaggagatgattaacctccattcctccatgtttctcgagagacagattctcccggggctgagtgttatgaacctgctcagttttcttctttgcgtgcccgttcagtttttcggcgggtggtacttctatatccaggcttacaaagccctcaagcacaagaccgccaacatggacgtgctcatcgtattggctacaacaatcgccttcgcgtactccctgattatcctacttgtggccatgtacgaacgcgccaaggtgaacccaataacctttttcgacactcctcccatgctatttgtgtttatcgccctcgggcgctggctggagcacatcgcaaagggaaaaacctcagaagcacttgctaagcttatcagcctccaggccacagaggctactatagtaacccttgacagcgacaacatcctgttaagtgaagagcaggttgacgtcgaactcgtgcagcgtggagacataatcaaggtggttcctgggggaaaatttcctgttgacgggagggttatcgagggacatagtatggtggacgaatcattaatcactggcgaggctatgcccgtggcaaagaagccggggtctacagtgattgcaggatccattaatcagaacggaagcctgcttatctgtgccacgcatgtgggcgcagacacaaccctcagccagattgttaaactggtggaagaagcacaaacctcaaaggcacccatccagcagtttgcagataaactgagtgggtactttgtcccctttatcgtatttgtgagcatcgccacattgctcgtctggatcgtgattgggttcctcaattttgagattgtggagacctactttccagggtataaccgatccattagccggacagagaccatcatccgatttgccttccaggcttcaatcacagttctgtgtatcgcttgtccatgtagtctggggttggcaacccccacggccgtgatggtcggaacaggtgttggtgctcagaatggtattctcatcaagggtggcgagcctctcgagatggctcacaaagttaaggttgtggtgttcgacaaaaccggaactataactcacggtacaccagtggtgaaccaggtgaaggttctcacagaaagcaaccggatttctcaccacaagatcctcgccatcgtggggactgctgaaagcaatagcgaacatccactgggcaccgcaatcacgaagtattgtaagcaggagctggacactgaaacccttggtacatgtattgattttcaggtggtccccggatgcgggatctcttgtaaggtgacaaacatagagggcctgctccataagaataattggaacatcgaagataacaatattaagaatgctagcctggtacagatcgatgccagtaacgaacagtcctcaacctcttccagcatgattatcgacgcccagattagcaatgcactgaatgcccaacagtacaaggtcctcatcgggaacagggagtggatgatccggaacggcctggttatcaataacgacgtgaatgacttcatgactgaacacgaacgcaaaggacgcaccgccgttctcgtggccgtcgatgacgagctgtgtgggttaatcgcaatcgccgacaccgtgaaaccagaagccgagctagccatccacatccttaagtctatgggcctggaggtcgtgttgatgaccggggacaatagtaaaacagctaggtccattgcgagccaggtagggatcactaaagtcttcgcagaagtcctcccaagccacaaagtagcaaaagtgaagcagttacaggaggaaggcaaaagagtcgccatggtcggagatgggattaatgattcacctgccctcgctatggcaaacgtggggattgcaattggaaccggaaccgatgtcgcgattgaagccgccgatgtcgtactcattcggaatgacttactggacgtagtcgcctctattgatctgagcagagaaacagtcaaacggattcggataaattttgtttttgctctgatatataacctggtcggaattccaatagccgccggagtgttcatgccaatcggcttggtgctgcagccctggatgggatctgccgctatggccgcgtcatcggtgtcggttgtgctgtcctcattgtttctgaagctgtaccggaaacccacttacgagagctatgaactgccggcgagaagccagattggacagaagtcaccctccgagatttctgtccatgtcggcatcgatgacaccagtcggaactccccaaaactggggctactggacaggatcgtcaactactcccgggcaagtattaacagtctattgtctgacaaaaggagtttaaacagtgtcgttacgtcagagccagataagcattcattactggtcggcgacttcagagaagacgacgacacagctctgtag

SEQ ID NO: 109041 - DNA, 4269 bp, Artificial Sequence
  Description of Artificial Sequence: Synthetic coding sequence
atggacccttccatgggcgtaaacagcgttaccatttccgtcgaaggaatgacctgtaacagttgtgtctggacaatcgaacagcagattgggaaggtgaacggagtgcaccacattaaagttagcctcgaagagaagaatgctactatcatttatgaccccaagttacagacccccaagacgctgcaagaagcaatcgacgatatgggcttcgacgctgtgatccataacccggatccactgccagtgttaactgacacactgtttttaacggttacggctagcctgacacttccctgggaccacatacagagcacacttttgaaaactaaaggggtgacagacatcaaaatatacccccagaagagaaccgtggctgtgactatcatcccgtccattgtcaatgctaaccaaataaaggagctcgtgccagagctcagtctggacaccggcacactggaaaaaaaatcaggtgcctgtgaggatcattctatggctcaggcgggagaagtggtcctaaaaatgaaggtggagggcatgacgtgccactcctgcaccagcactattgaaggaaagatcggcaaacttcagggagttcagcggatcaaggtctcactcgacaaccaggaggccacaatagtgtatcagcctcacttgattagcgtcgaagaaatgaagaagcaaattgaagctatggggttccccgcctttgtcaaaaaacagcctaaatacttaaagctgggcgccatcgacgtcgagcgcctcaagaacacccccgtcaagtcgagcgagggctctcagcagcgttctccatcatacacaaatgattcgaccgcaactttcattatcgacggcatgcactgtaagtcatgtgttagcaacattgagtccacactgtcagcactgcagtacgtgtcctccattgtggtgtccctggaaaacagaagcgctattgttaagtacaacgcaagcagtgtcacaccagagagtctccgaaaggctattgaggcagtaagccctggtttatacagggtgagcataacctccgaagttgaaagcacttctaactccccttccagctcatctcttcagaagatccctctcaacgtcgtcagtcagcccctgacacaagaaactgttatcaacatcgacggtatgacttgcaatagttgcgtccaaagcattgaaggagtgattagcaaaaagccgggagtgaaaagtattcgcgtctcactcgctaattccaatggaacagtggaatatgatcccctgctgacctcccccgagaccctcaggggcgctatcgaggacatgggcttcgacgccaccttgtccgatactaatgagccactggtggtcatcgcccagcccagttcagaaatgcccctgctaactagcacaaatgagttttatacgaagggtatgacacctgtacaggacaaagaagaaggaaaaaattcatcaaagtgttatatccaggttaccggaatgacatgcgcatcttgcgtagctaatatcgagaggaatttacgaagagaagaaggcatctacagtatcctggtcgccttgatggccggcaaggcagaggtgcgatataatcctgcagttatccagccccccatgatcgcagaatttatcagggaacttggattcggtgccaccgtgattgaaaatgcagatgaaggtgacggggtgctggagctggtggtcagagggatgacatgcgccagttgcgtgcacaaaattgaatctagcctgaccaagcatcgtggcatcttgtactgttccgttgcgctcgccaccaacaaggcgcacatcaaatacgacccagaaattatcggacctagagatatcatacatactattgagagcttaggatttgaagcaagcctggtcaaaaaagatcgttctgcgagccaccttgatcacaagagggagatcaggcagtggcgccggagtttcctggtgtctctttttttttgtatccctgtgatgggccttatgatatacatgatggtcatggaccatcacttcgcaacactgcatcataatcagaacatgagcaaggaggagatgataaatcttcactcatccatgttccttgaacggcaaattttaccaggcctcagcgtcatgaatctattatcctttctcctgtgcgttccagtccagggaaagacttccgaggctcttgctaaactgatctcgctacaagcaaccgaggctaccattgtaaccctggactcagacaacatactgctgagcgaagagcaggtggacgttgagcttgtacagcgtggggatataattaaggtggtgcctggagggaagtttccagtggacggtcgggtgattgagggccattccatggtggatgaatcccttataacaggggaggcaatgcctgtcgcaaagaaaccggggtcaactgtcattgcaggctccatcaaccagaacggttccttgcttatttgcgcgacacacgtgggtgccgatacaactctgtcgcagatcgttaagctcgtggaggaggcgcagacctctaaggctcccatacaacagttcgctgataagctgtccggatattttgtgcccttcattgtcttcgtttcaattgctaccctcctggtctggattgtgattggtttcctgaactttgaaatcgtagaaacttacttccccgggtataatagaagtataagtcggacggagaccattattagatttgcctttcaagccagcatcaccgtgctttgcatcgcatgcccatgctcactgggcctcgctacccccaccgcggtaatggtgggtacaggagtgggtgctcagaatggtattctgattaagggaggggagcccctggagatggcccacaaggtgaaggtcgtggtgtttgacaaaactggcaccatcacccatggcacacccgtagtcaatcaagtgaaggtgctaacagaatccaatagaattagtcaccacaagatcctggccattgtggggactgccgaatctaactctgaacatccgctcggcacggctattaccaagtactgtaagcaggaattagatacagagaccctgggtacctgcatcgattttcaggtcgtcccaggatgcggcattagttgcaaagtgaccaatatcgagggcttgctacacaaaaataattggaatattgaagataacaacatcaagaacgcctcactcgtgcagatagacgcatccaacgagcagagctctaccagctccagtatgatcattgacgctcaaatctcgaatgctctcaacgcccagcagtacaaggttctgatcgggaaccgggaatggatgattaggaatgggcttgtcattaataacgacgtaaacgacttcatgacagagcatgagcggaagggccgcaccgcagtgctggttgccgtggacgatgagttatgcgggctgatagcgatcgccgatactgtgaagcctgaggctgagctggctatccatattcttaagtccatgggactggaggtggttctgatgaccggagataacagtaagactgctcgatcaatagccagccaggtgggcatcactaaggtctttgcggaggtgctgccaagccataaggtcgctaaggtcaagcagctccaagaggagggtaagagggtcgccatggtaggtgatgggatcaacgactctcctgcgctggccatggctaatgtcggtatcgctattgggaccgggacggacgtcgctatcgaggccgccgacgtggttctaatcaggaacgatctgcttgacgtagtagcttccatcgacctctcccgggagacagtgaagcgcattcgtattaatttcgtgttcgctttaatttacaaccttgtgggaataccaatcgctgccggagtttttatgccaattggcttagtgctgcaaccatggatgggctccgcagctatggctgcctcttccgtgtctgtcgtactgtcctcgctgtttttgaagctctacagaaaacctacctacgaatcttacgaattgccagcacgttcacaaatcgggcagaagagcccctccgagatctctgtgcatgtcggcatcgacgatacaagccgcaattcccctaaacttggactgctcgatcgcatcgtgaactacagtagagcttccatcaatagcctgctttcagataagaggtccttgaacagcgtcgtcacttctgagccggataagcactctttgctggttggcgattttcgggaggacgacgatactgctctgtag

SEQ ID NO: 109042 - DNA, 264 bp, Artificial Sequence
  Description of Artificial Sequence: Synthetic coding sequence
gaatgtaatgaggagatcaaaatggacccttcaatgggcgtcaattcagtcacaatctccgtggagggcatgacctgcaattcttgtgtgtggaccatcgaacagcagatcgggaaggttaacggagtgcaccatatcaaagtgtcactggaggaaaagaatgccacaattatcttttatgcgcattggttcggctttgccgcacttgacggcatttgctcaaatggctgtttcatttgcttttgcagtacttttttcagctag

SEQ ID NO: 109043 - DNA, 1512 bp, Artificial Sequence
  Description of Artificial Sequence: Synthetic coding sequence
atggaccccagtatgggagtcaatagcgtcactatctcggtcgaagggatgacctgcaatagttgtgtgtggacaatagaacaacagattgggaaggttaacggggtgcaccacatcaaggtcaaggtcgtggtgttcgataaaacaggtacaatcacgcacggaacccccgtcgttaatcaggtaaaggtcctgactgagtcgaacaggattagccatcacaaaattcttgcaattgtgggcaccgccgagagtaacagcgaacacccgctcggaaccgcgatcaccaagtactgcaaacaggaacttgacactgagacactcgggacatgtatcgatttccaagtcgtaccgggatgtgggatctcctgtaaagtaacaaacatagagggtctgctgcataaaaataattggaatattgaggacaacaatatcaaaaatgcctctctcgtgcagatcgacgcctccaatgaacagagttccacctcttcctctatgatcatcgatgcccagatcagtaacgctctcaacgcgcagcaatataaggttcttataggcaacagggagtggatgattcggaatgggctggtaattaacaacgacgtcaatgattttatgacggagcatgaacgaaagggcaggaccgccgtacttgtggctgtggacgatgaactctgcggtctgatagccattgccgataccgttaagcctgaagcagagctcgcaatccatatactgaaatcgatgggcctggaggtggttctgatgacaggcgacaactctaaaacagccaggagcatcgcttcccaggtcggaatcactaaggtcttcgccgaggtgcttccttctcacaaagtcgccaaggtcaaacagctccaagaggagggcaagcgggtggcaatggtaggagacggtatcaatgatagcccggccctggctatggccaatgtgggcatcgctatagggacaggcaccgacgtggctattgaagctgccgacgtggtgctcattcggaatgatcttctcgatgtggtcgcttctatcgacctgtcgcgggaaaccgtgaaacggataagaattaattttgtctttgccctcatttataacttggtcgggatcccaatcgccgctggggtctttatgcctattgggctggtgctccaaccttggatgggatcagcagcaatggccgccagttccgtttcagtcgtcctctccagcctcttcttgaaactatatagaaaaccaacctacgaatcctatgagctccccgccagatctcaaattggccagaagagtccgtccgaaatcagcgtgcatgtggggatagacgacacatccaggaactcaccgaagctgggcctcttggacaggatcgttaactactcacgagccagcatcaactctctgctttctgataaacgcagcctgaattctgtcgtaactagcgaaccagataaacactcattgttggttggcgactttagagaggacgacgatactgcattgtag

SEQ ID NO: 109044 - DNA, 2049 bp, Artificial Sequence
  Description of Artificial Sequence: Synthetic coding sequence
cgtaaccaggagtgcaacgaggagatcaagatggatccttcgatgggagtgaactccgttacaattagtgtagaaggcatgacctgtaatagctgcgtctggacaattgagcagcagatcggcaaagtcaacggcgttcaccacatcaaagtctcactggaagagaagaatgctaccataatttacgaccctaagctgcagacccctaaaacactacaggaagccattgacgatatgggattcgatgcggttattcacaatcctgatcctcttcctgtgttgacggacacacttttccttacagttactgcctccctcacactgccgtgggaccacatccagtccaccctgctaaagacgaaaggagtcacagacatcaagatttacccccagaagcgcaccgttgctgtgaccatcataccgtcaatagtcaacgcaaaccagatcaaggagctggttcctgagctctctctggatacaggcactctggaaaaaaaatctggagcatgcgaggaccactctatggcacaggctggggaagtggtcctgaagatgaaagttgaaggcatgacctgccatagctgcacttccaccatcgagggcaagatcgggaagctccagggcgtccagagaattaaagtttctctcgacaatcaggaagccacaattgtctatcagcctcaccttataagtgtggaggagatgaaaaaacagattgaggccatgggttttcccgcatttgtcaagaaacagcccaaatatctcaagctgggcgccattgacgtagaaaggcttaagaatactccagtgaagagttcagaaggctcccaacaacgatctccctcttacacgaatgatagtaccgccactttcatcatagacggcatgcattgtaaatcttgcgtgagcaacatcgagtcgacgctttccgccctgcagtacgtgagtagtattgtggtgtccctggaaaaccggagtgcgatcgttaaatacaatgcatcatctgtgacacctgaatctctaaggaaggccatagaggctgtcagtccgggactatatcgtgtctccattacctccgaagtggaatccaccagtaactcaccatcgagctcaagcttacaaaaaattcccctgaacgtcgtgagtcagccactgacgcaagagacagtaataaacattgacggcatgacatgtaactcctgcgtgcagtctatagaaggggtgatctccaaaaaacccggcgtcaagtccatacgggtcagcctggctaactccaacggaaccgtcgagtatgaccctctgctaacaagccccgaaactttacgaggggcaattgaggacatgggatttgacgccaccctgagcgataccaacgagccactcgttgtaattgcccaaccctcctctgagatgccattacttacgtcgaccaatgaattctacacaaaagggatgacccccgtccaggacaaggaggaaggtaaaaactcttccaaatgttatatccaggtcaccggcatgacttgtgcttcctgcgtggccaacatcgaacgaaacctgaggcgagaggagggaatttattccatcctggtggccctcatggctggcaaagctgaggtgagatataaccccgcggtgatccagcctccgatgattgcggagtttattagagaacttgggttcggggcgacggtgatcgaaaatgctgatgagggggacggtgtactggagttggttgtcagggggatgacatgcgcctcatgtgtccataagattgagagctcattaaccaaacaccgaggtatcctttattgctcagtcgcactggctactaacaaagctcatatcaaatacgaccctgagatcattggacctcgcgatattatacataccattgaagtgtctgccaagaacttgtgcttctgtgtactcacctaccttatttctacgccagtcaaccacttttggtttgcaagtgaccggggaaatgagaaaaagtcaaatagcttcgagcatttcaagcaggacctaagtcagaacctgatgtag

SEQ ID NO: 109045 - DNA, 825 bp, Artificial Sequence
  Description of Artificial Sequence: Synthetic coding sequence
atggatccgagtatgggcgtgaatagtgtgacgatcagcgtggagggtatgacgtgcaacagctgcgtttggacaattgaacaacagattggtaaggttaacggcgtacatcatattaaggtctctctggaagagaaaaacgcgactatcatatatgatccaaagttacaaacccccaagacactgcaagaggccattgatgatatggggtttgatgccgtgatccataacccagatcctctcccagtactaacagacacactgttccttaccgtgaccgccagtctgacactaccgtgggaccatattcagtctacgcttcttaagactaaaggggtgacagatattaaaatttacccccagaagcggaccgtggccgtcaccataatccccagtattgtgaatgccaaccaaattaaggagctggtgcctgagttaagtctcgataccggaacccttgagaaaaaatcaggggcctgcgaggatcattcaatggctcaggctggagaggttgtgctaaaaatgaaagtggaaggcatgacctgtcattcatgcacctctacaattgaagggaagattggtaagctccaaggagtgcagaggattaaagtgagcctggacaatcaggaggcaactattgtctaccagccccacctgatctcagtggaggaaatgaagaagcaaatcgaggctatggggtttccggccttcgtaaagaagcaaccaaagtacttaaaactgggagcaatcgatgtcgaaaggctgaagaataccccggttaagtccagtgagggatcacagcaaagatccccttcctaccaatag

SEQ ID NO: 109046 - DNA, 546 bp, Artificial Sequence
  Description of Artificial Sequence: Synthetic coding sequence
atgagaccctcaggcacctgcgcctcgtgcggttctgatcccccccctccaacacaagtccccagttcccggaacgattgtggttctacagtgcctgacaatcccttcgtgcgtaccctgcctcacaccaccatgagcggacatcaactaccacccgcaggcacccagcggccgggaccagccgcctgtctagtgcctggctcccttcctagtctcccatcacagccaggtccctggggcgcactgggcacagcggccgctgagggaatgtcttgttctaacacccggactgccctcgagttcgccttgtttccaaaagagatgctactagggtcatggtacggttggggtttgagcctgtataggcggggccggtgtcaggactctgctcatccagaagaagacacgtgtccccacggggagggcgcacccgcacaggcaggtgagtcagtaccaagccagcagctgtgccaccacccagcaggcaattggggcggtttgtattgggtgattggcaaggccttctctttggcctggaattgctag

SEQ ID NO: 109047 - DNA, 642 bp, Artificial Sequence
  Description of Artificial Sequence: Synthetic coding sequence
atgagagttcggggacccgcgcgcctgattgcaagtggtgccaggctgttgctgcgaatgctgagcgccctgccaggatggggcccggcgcaccttcaacgccctctgctgggcccggccagctgtcttggaatccttaggccagcaatgactgcgcactctttcgctctgcccgtaattatttttaccactttctgggggctggtgggtatagccggtccttggtttgtcccaaaagggcctaataggggagtcatcatcacaatgctggtcgccacagccgtgtgttgctatttgctgtgtcctgcactgggcatgacagtggcaccactgagtttgaccacaccatcatccggcccgtcccctacccagctttgcctagttacatcaagtcttctcctggctcctagggaccctgaccctcagggcctgcccgggagctggaaatcatcacagagctcccagcctgctagggcgctcggatctccagggcactcttccggtaggggcgatgttctcctccagtatcctcactgctcaggcgtttgccctctttcacaaggggatgccgcaggtgagctagtgtgggttgggagcttccccttgcagacaggccagatgcccgggctctcaccatcatag

SEQ ID NO: 109048 - DNA, 495 bp, Artificial Sequence
  Description of Artificial Sequence: Synthetic coding sequence
atgacggcacactcttttgcactcccagtcatcattttcaccactttctgggggctcgtggggattgccgggccatggttcgtacctaagggacccaatcggggcgtcattattactatgcttgtggctacagcagtctgttgctacttgctttgccccgctcttggaatgacagtagcgccactgagcctcaccactccgagttctgggccctctccaacccagctgtgtttggtgacatcgtcactactgcttgcacctcgggatcccgacccccagggactgcctggtagttggaagagctctcaaagctctcagcccgcacgggccctgggctcgccaggtcactcatcaggacgaggggacgtgctcctccagtatccacactgttcaggcgtatgccctctctcacagggcgatgccgcgggcgaactcgtgtgggtaggctccttcccccttcaaacaggtcagatgccagggctgagcccttcttag

SEQ ID NO: 109049 - DNA, 393 bp, Artificial Sequence
  Description of Artificial Sequence: Synthetic coding sequence
atgcgggttcgggggcccgcccgtttgattgccagcggcgcccggctgctcctgcgtatgcttagcgcactgccaggatggggccctgcccacctgcagcgtcccctgctgggaccagcgtcctgcctgggcatcctccgtccggctatgacagctcactccttcgcactgcctgtaatcattttcaccacgttttggggcctcgtgggcattgcaggtccatggtttgtgccgaagggtccgaataggggagtgatcataacgatgctagtggcgactgcggtctgctgctacctgttttggctgattgctatcctcgcacagttgaaccctctgtttggaccccagctgaaaaacgagacgatttggtacgtgcgcttcctatgggagtag

SEQ ID NO: 109050 - DNA, 246 bp, Artificial Sequence
  Description of Artificial Sequence: Synthetic coding sequence
atgacggcccactcttttgcattaccggttatcattttcacaacattttgggggttggttggtattgccgggccatggttcgtccctaaaggaccaaatcgaggtgtcatcatcaccatgcttgtggccacggcggtttgctgctacctgttttggctgatcgctattcttgcgcagctgaatcccttgtttgggcctcagcttaaaaacgaaacaatctggtatgtacggtttctctgggagtag

SEQ ID NO: 109051 - DNA, 564 bp, Artificial Sequence
  Description of Artificial Sequence: Synthetic coding sequence
atgaccgcccatagcttcgccctgcccgtaattattttcaccaccttttggggccttgttggtatagctggcccctggttcgtacctaaggggcctaatcggggtgtcattatcacaatgctggttgccacagccgtgtgctgctacctgttttggttgattgccatccttgcgcaattaaacccattattcggcccccagctcaaaaacgagactatctggtgtcccgccctgggcatgaccgtggcacccttgtctcttacaacaccttccagtggtccaagccccacacagctgtgtctcgtcacatcctcactcctcctggctccaagagatcctgacccccagggcctgccagggagttggaaatcctcacagtcttcgcaaccagccagagctcttggttcaccagggcactctagcgggcgcggcgacgttttgcttcagtacccacattgcagtggagtgtgccctttatcacagggtgacgccgccggcgagctggtgtgggtgggcagcttccccctccagaccggccagatgcccggcctgtccccttcttag

SEQ ID NO: 109052 - DNA, 357 bp, Artificial Sequence
  Description of Artificial Sequence: Synthetic coding sequence
atggcctcacagagccaggggattcagcaactgctacaggccgaaaagcgagcggcagagaaggtaagtgaggctaggaagaggaaaaatcggcgcctgaaacaggcaaaagaggaggcgcaggcagaaatcgaacaatatcgactccagcgggaaaaagagtttaaggcgaaggaggccgccgcactcggctcccgggggagttgtagtacggaggtggaaaaggaaactcaggagaagatgactatccttcaaacgtattttagacaaaaccgcgatgaagttctagataacctcctcgcttttgtctgcgacatacgcccagagatccatgagaactatagaatcaatggctag

SEQ ID NO: 109053 - DNA, 357 bp, Artificial Sequence
  Description of Artificial Sequence: Synthetic coding sequence
atggcaagccagtctcaagggattcagcagctcctccaagccgaaaagcgagccgcagagaaggtagccgacgctcgcaagaggaaggccagaaggctcaaacaagccaaggaggaagcgcagatggaggtcgaacagtatcggcgagagagagagcatgagttccaatctaaacaacaggccgccatgggatcgcagggaaacctgtccgctgaggtggagcaggctactaggcgccaggtgcagggcatgcagtcttctcagcaacgaaatcgcgaaagggttctggcccaactgctgggaatggtctgcgacgtccgacctcaggtccatcccaattacaggatctccgcatag

SEQ ID NO: 109054 - DNA, 237 bp, Artificial Sequence
  Description of Artificial Sequence: Synthetic coding sequence
atggccagtcagtctcagggtatccagcagctcctacaggccgagaagcgggcagctgagaaggtggcagatgcaagaaaacgcaaagctaggcgtctgaagcaggccaccagacggcaggtgcaaggcatgcagtctagccagcagagaaacagagagagggtgctggcccagttactcggaatggtgtgcgatgtaaggcctcaggtgcatcccaactatcggatcagtgcctag

SEQ ID NO: 109055 - DNA, 357 bp, Artificial Sequence
  Description of Artificial Sequence: Synthetic coding sequence
atggcctctcagagccagggcatccaacagttactgcaggcagagaaaagggccgctgaaaaagtcgctgatgcacgaaagcgaaaagctcgccgactgaagcaggctaaggaagaggcacagatggaggtggaacagtacagacgcgagagagagcatgagtttcaatcgaagcagcaggcagctatggggagtcagggcaatctctctgccgaggtggagcaggccacgagacgccaggtgcagggaatgcagtctagtcagcaaagaaatcgggagcgggtgttagcccaactcctgggcatggtttgcgacgttaggccccaggttcaccctaattatcgaatttccgcctag

SEQ ID NO: 109056 - DNA, 477 bp, Artificial Sequence
  Description of Artificial Sequence: Synthetic coding sequence
ggtgggcaacagcatgcggtaccatgccctcatggcggccctggagggcagggacagccccgggcagaagccgccgggaccggccagggacatcgagggggccataggcctggcgctgtcgtgggtgcggcacagcacctgcatagaggcctcggagtggctggaggtggacctggaccagggccggccgttctccagactaggaaggcacggcggcttaaacaggcaaaggaagaggcacagatggaggtggagcagtatagaagggaaagagagcatgaatttcaaagtaagcaacaggccgccatggggagtcagggcaacctttctgctgaggtcgaacaggccacaaggaggcaagtccagggcatgcagtctagccaacaaagaaacagggaacgggtactggcgcagcttctgggcatggtttgcgacgtgagaccgcaggttcaccccaactatcgaattagtgcatag

SEQ ID NO: 109057 - DNA, 237 bp, Artificial Sequence
  Description of Artificial Sequence: Synthetic coding sequence
atggcctcacaaagccaaggcatccagcagctgcttcaagcagaaaagcgggctgctgagaaagtggctgatgccagaaagagaaaggctaggcggctgaagcaagccactcggagacaagtacagggaatgcaaagctcacaacagaggaaccgcgaacgggtgttggctcaactgcttggtatggtatgtgatgttcgaccccaagttcatcctaactatagaatttctgcgtag

SEQ ID NO: 109058 - DNA, 237 bp, Artificial Sequence
  Description of Artificial Sequence: Synthetic coding sequence
atggcatctcaatcacagggtattcagcagctgctgcaggctgagaaacgggcggctgaaaaagtcgccgatgctcggaagcgcaaggctcggagactcaagcaagctacccggagacaagtccagggcatgcagtcatcccagcagcgcaaccgcgagagggtccttgcccagttgctggggatggtttgtgatgtccgaccacaagtacaccctaactaccggataagcgcttag

SEQ ID NO: 109059 - DNA, 357 bp, Artificial Sequence
  Description of Artificial Sequence: Synthetic coding sequence
atggcgtcccagtcccagggtattcagcagctgctccaagcagaaaaaagggctgcagaaaaggtggctgacgcaaggaaaaggaaagcaaggcggttgaagcaggcaaaggaggaggctcaaatggaagtggaacagtaccgacgagagagagaacacgaattccaatccaagcaacaggcggccatgggttcgcagggaaatttgagcgccgaggtggagcaggcaaccagacgccaggtgcaaggaatgcagtcttcacagcagcgaaacagggaacgggttctggcgcagctgctgggcatggtctgtgacgtgaggccgcaggtccaccctaactaccgcatcagcgcctag

SEQ ID NO: 109060 - DNA, 237 bp, Artificial Sequence
  Description of Artificial Sequence: Synthetic coding sequence
atggcatcgcagagtcaggggatacagcagttgctgcaagcggaaaaacgggctgctgaaaaagtggccgatgcgaggaaaaggaaagctaggagactgaaacaggcgactcggaggcaggtccaagggatgcagagctcccagcagaggaatcgagagagagtgctagcgcagctcctcggaatggtctgtgacgttaggcctcaggtgcacccaaattacagaatctccgcgtag

SEQ ID NO: 109061 - DNA, 357 bp, Artificial Sequence
  Description of Artificial Sequence: Synthetic coding sequence
atggcaagtcagagccagggcattcaacagctgcttcaggccgagaaaagggctgcagaaaaagtggctgacgccaggaagaggaaggccaggagactgaagcaggctaaagaagaggcccagatggaggtggaacagtatcggagggaacgagagcatgaatttcagtcaaaacaacaggccgcgatgggatcccaggggaacctgagtgctgaggtcgagcaggcaacacgccgtcaggtgcaaggtatgcaatcatctcagcagaggaacagggaaagggttctcgctcagttgctaggcatggtttgtgacgtgagaccacaggtgcaccctaattaccggattagtgcctag

SEQ ID NO: 109062 - DNA, 237 bp, Artificial Sequence
  Description of Artificial Sequence: Synthetic coding sequence
atggctagccagtcacaggggatccaacaactgctgcaagccgagaagcgagccgcagagaaggttgccgatgctcgcaaacgtaaggcccgccgtcttaagcaggctactcggcggcaggtgcagggcatgcagtcaagccaacaaagaaatcgagaacgtgtcctcgctcaactgcttggaatggtgtgcgacgtgcggccccaggtgcaccctaactataggatatctgcctag

SEQ ID NO: 109063 - DNA, 237 bp, Artificial Sequence
  Description of Artificial Sequence: Synthetic coding sequence
atggcaagccagtcccagggcattcagcagttgcttcaggcagaaaagcgagccgcagagaaggtagcagatgcccggaagagaaaagcccgacgcctcaagcaagccaccaggcgtcaggtccagggcatgcaatccagtcagcaaaggaacagggaaagagtgttggcccaactgttgggaatggtgtgcgacgtccgcccccaagtgcaccccaattatcgtatttcagcttag

SEQ ID NO: 109064 - DNA, 357 bp, Artificial Sequence
  Description of Artificial Sequence: Synthetic coding sequence
atggcttcccaaagtcagggcattcagcagctgctgcaagccgaaaaaagagcagccgagaaggtggccgatgctagaaagcgtaaagcgcgtcggctaaagcaggccaaggaggaagctcagatggaagttgaacagtacagaagggagagggagcacgaattccagagcaagcagcaagcggcaatggggtcccaggggaatctgagtgctgaagtcgagcaggctacccgccggcaggtgcagggtatgcagagcagccaacaacgaaacagggaacgagttcttgcccagctgctgggaatggtgtgtgacgtgaggccccaggtgcatcctaactatcgcatttctgcctag

SEQ ID NO: 109065 - DNA, 237 bp, Artificial Sequence
  Description of Artificial Sequence: Synthetic coding sequence
atggcctcacaaagccagggaatccaacagttgctccaggcagaaaagcgcgcagcggagaaggtggcggatgccaggaagagaaaagctcgacgcttaaaacaggctacccggcgtcaggtgcagggaatgcaaagctctcagcaacgcaatagggagcgcgtgttggctcagcttctgggcatggtatgcgatgttcgacctcaggtacacccaaattacaggatttccgcttag

SEQ ID NO: 109066 - DNA, 357 bp, Artificial Sequence
  Description of Artificial Sequence: Synthetic coding sequence
atggcaagtcagagccaagggatacaacagcttctgcaggcagagaagagggcggccgagaaagtggcagatgcacgaaagcgtaaagcaagaagactcaagcaggccaaggaggaggcccagatggaggttgaacaatatcggagagaacgcgaacatgaattccagagtaaacagcaggcagccatggggtctcagggtaacctgtctgcagaggtggaacaggccacacgccgacaggtccaagggatgcagtcatcacagcagaggaatagagaaagagtgctggcacaactgttgggcatggtctgcgacgtgagaccgcaggttcatcccaactaccgcatttcagcgtag

SEQ ID NO: 109067 - DNA, 357 bp, Artificial Sequence
  Description of Artificial Sequence: Synthetic coding sequence
atggcttcacagtctcagggtatccaacagctccttcaggccgagaagcgggctgccgagaaagtagcggatgcgcggaagcggaaagcccgccgtttaaagcaggcaaaagaggaagcacagatggaggttgagcagtatcgccgagaaagagagcatgaattccaaagtaaacaacaggctgctatgggctctcagggcaacctatctgcagaagtcgaacaggcaactaggagacaggtccagggcatgcagagctcgcagcagcgcaaccgcgagagggtgcttgcacagctcctgggaatggtgtgcgatgtgcggccccaagttcaccctaattaccgcataagcgcatag

SEQ ID NO: 109068 - DNA, 234 bp, Artificial Sequence
  Description of Artificial Sequence: Synthetic coding sequence
atggaggtggaacaataccggagggagcgggagcatgagttccaaagcaagcagcaggcggctatgggaagccagggaaacctgtcagctgaagtggagcaagcaactcgcagacaggtgcagggtatgcaaagcagccagcagcggaatcgggaacgggtgctcgcccagctgctgggaatggtttgcgatgtaagaccacaggtgcacccaaattacaggatctcggcttag

SEQ ID NO: 109069 - DNA, 348 bp, Artificial Sequence
  Description of Artificial Sequence: Synthetic coding sequence
gtggagcctggaatccagcagcttttgcaggctgaaaagcgagccgctgagaaggtggcggatgctcgcaagaggaaggctcgcagactcaagcaagcaaaagaggaggctcagatggaggtcgagcaatatcggcgtgagcgggagcacgagttccagtctaagcaacaggctgctatgggatctcaaggaaatctgtctgcggaagtggagcaggctacccgaaggcaggtgcagggtatgcagagtagccagcaaaggaatagggaaagggttctggctcagctgctgggaatggtgtgtgacgtcagaccacaggtccacccaaactaccgcatttctgcctag

SEQ ID NO: 109070 - DNA, 468 bp, Artificial Sequence
  Description of Artificial Sequence: Synthetic coding sequence
atgtccgaatccaagtccggcccagagtatgcaagcttttttgccgtgatgggagcatctgcagctatggttttcagtgcactgggcgctgcatacgggacagccaagtccggtaccggcattgccgccatgtctgtgatgcggccggagcaaatcatgaaaagcatcatacctgtagtgatggcagggatcatagccatttacggcctagttgttgctgttcttatagccaactctctcaacgatgacattagcctctataaaagtttcctgcagttaggcgctggtctcagtgtgggtttaagcgggctagccgccggctttgccatcggcatagtgggcgacgcaggtgtcaggggaacagcacagcagcctcgcctcttcgtcgggatgattctcatcttgatttttgccgaagtgctggggctctacggactgatcgtggccctcattctctccacaaagtag

SEQ ID NO: 109071 - DNA, 477 bp, Artificial Sequence
  Description of Artificial Sequence: Synthetic coding sequence
atgtggtctaacctcggaatcgggctggccatctctctctcagttgtgggcgccgcttggggtatctatattaccggctcgagcatcatcggtggcggagtcaaggcccctcgcataaagacaaagaatctggtgtcaatcatattctgcgaggcggtagcaatatacggaatcataatggcaatagtgatatctaacatggccgaacctttttcagccactgatccaaaggccatcgggcaccgaaattaccacgccggttatagtatgttcggagccggcctgacagtgggccttagcaatcttttctgcggcgtttgtgtaggaatcgttggatccggagctgccctcgccgacgcccagaacccaagcttattcgtcaaaatcctgattgttgagatattcggcagcgccattggactatttggggtcattgttgcaatccttcagacttcccgcgtcaagatgggggactag

SEQ ID NO: 109072 - DNA, 129 bp, Artificial Sequence
  Description of Artificial Sequence: Synthetic coding sequence
gtggggtccggagcagccttggcggatgctcagaacccaagcttgttcgttaaaattctcatcgtagaaatttttgggtctctcgcatctctgggcagttccagccaattctttagaccacctgaatag

SEQ ID NO: 109073 - DNA, 759 bp, Artificial Sequence
  Description of Artificial Sequence: Synthetic coding sequence
atgacgggcctggcattactttactcgggagtgtttgtggcgttttgggcctgcgccctagccgttggtgaagccggctcatggagagccggtgccgccagccgcccctcgtggccaggccgaaatagcgctggaaagtggcccgctggaaacacaggcccaccacgcgcgctccatcccagactttggggcctcgcccctgccagggcttccgactctgataaaggtgatccggactttcagctgctcgaagaagggtttttgactgagacatccccatttatgtggtccaacctaggaatcggtctcgctataagcctgtctgtggttggggcggcttggggcatttatatcaccggctcctctatcataggtggaggggtgaaggcccctcgcatcaagaccaaaaacctggtgagcataatcttttgtgaagctgtggctatttatggaatcatcatggcaatcgtgatttccaatatggccgaacctttcagcgccaccgacccaaaggccatcgggcatagaaattatcacgccgggtatagcatgttcggcgcaggattgaccgtgggattgtcgaacctgttttgtggagtctgtgtggggattgtgggtagtggtgccgctctcgccgatgcacagaacccatcactattcgtcaagatcctgattgtagagatatttggatcagctattggactgttcggtgtgattgtggcaatcctgcaaacgtcccgcgtgaagatgggtgactag

SEQ ID NO: 109074 - DNA, 618 bp, Artificial Sequence
  Description of Artificial Sequence: Synthetic coding sequence
atgactggacttgctctgctgtacagcggtgttttcgtcgccttctgggcatgcgctctagctgtgggtgtgtgctatacgatcttcgacttgggctttcgatttgacgtggcatggttcttgaccgagacctctccctttatgtggtcaaaccttgggatcgggttggctatctcgttgtcagttgtgggagccgcctggggaatctacattacaggcagctcaattattggaggtggcgtaaaggcgccccgaattaaaacaaaaaatctggtttccatcattttctgtgaggccgtcgccatttatggtattatcatggcgattgttatttctaatatggccgaacctttctccgctactgatcctaaggctattggccacaggaactaccacgcaggttatagcatgttcggggcagggctgacagtgggattgtctaatttattctgcggcgtttgcgtgggaatagtaggttccggtgccgcattggcggacgcacagaatccgtctcttttcgtgaagattctgatcgtggaaatctttggatctgctattggcctgtttggagtcattgtcgctattcttcaaactagtcgggtaaaaatgggggactag

SEQ ID NO: 109075 - DNA, 261 bp, Artificial Sequence
  Description of Artificial Sequence: Synthetic coding sequence
atgtggtccaatctgggaataggcctggctatctccctctctgtggtgggggctgcctggggcatctatattacaggttcttcaattatcggtgggggcgtcaaggcaccacgcattaaaaccaagaatctggtatccatcatcttttgcgaagcagtcgcgatctacggtatcattatggccattgtgatcagtaacatggccgagcctttttcagcgaccgatcccaaggcaattggacaccgcaattatcacgcgtag

SEQ ID NO: 109076 - DNA, 477 bp, Artificial Sequence
  Description of Artificial Sequence: Synthetic coding sequence
atgtggtccaatttagggattggcctggcaatcagtctatccgtggtcggcgcagcgtggggaatttatattactggctcctcaatcatcgggggaggagtgaaggccccccggattaaaacaaagaatttagtctctatcatattctgcgaagctgtggccatctacggaatcatcatggctattgtgattagcaacatggccgaaccattctcagcaaccgatcctaaggctatcggccaccggaactaccacgccggttatagcatgtttggcgcgggcctgaccgtcggcctatccaatttattctgtggcgtgtgcgttgggatcgtcggatccggggctgctctggccgatgcgcagaaccccagtctatttgtaaaaattctgatcgtcgagatattcggatctgccattgggttgttcggggtcattgtggcaatcctgcagacctccagagtgaagatgggcgactag

SEQ ID NO: 109077 - DNA, 786 bp, Artificial Sequence
  Description of Artificial Sequence: Synthetic coding sequence
atgacaggcctcgccttactgtactcgggcgtatttgtggctttttgggcatgcgctctggcagtgggcgtttgctacaccatctttgacctgggcttccgatttgatgtggcgtggttcctgacagagacctcgcctttcatgtggtcaaacctagggattgggctcgccataagcttgagcgtcgtgggggccgcctggggcatctatataacaggaagctcaatcatagggggcggcgtgaaggctccccggattaaaacgaagaatctggttagtataatcttttgtgaagccgtggccatttacggtataataatggccatcgttatcagcaacatggccgaacccttctccgccaccgatccaaaagctattgggcaccgcaattatcatgcaggttacagcatgttcggcgccgggctgaccgtgggactttctaacttgttttgcggggtatgcgtgggtattgtggggtcgggagccgccctggctgacgctcaaaatccctcactgtttgtcaagatacttatcgttgagattttcggaagtgctatcggcctgtttggggtcatcgtggcgattctgcaagttatgaatcccttaggcaagccactgtgcccctgtccgcagccctcacttaccttgctactcgaaaagttgaagtgttccccctctctaccaataactatagactcacctaagcagctgccaccccctcactttcatcttcttgttttttcatacagagggtccctcttcctctcgctgatttggtgccactag

SEQ ID NO: 109078 - DNA, 681 bp, Artificial Sequence
  Description of Artificial Sequence: Synthetic coding sequence
atggcactgtcagacgccgatgtgcagaagcagattaaacatatgatggccttcatcgagcaggaagccaatgagaaggcagaagaaatcgacgccaaagccgaagaagaatttaatatcgagaaggggagactggttcagacccaaaggctgaagattatggagtactatgagaagaaggagaaacagatcgaacagcagaagaaaatccagatgtcaaacctgatgaatcaagctcgattgaaagtactcagggctagagatgatctgatcaccgacctactgaatgaagctaaacagcgtctcagcaaagtggtgaaggacaccactcggtaccaggttctgctggacggcctggtgctacagggtctctaccagctgctggaacccaggatgatcgtaaggtgtaggaagcaagactttcccctggtgaaggcagcagtccagaaggccattcccatgtacaaaattgcaaccaagaatgacgtcgatgtgcagattgaccaagaatcctacctgcccgaagacattgccgggggagttgagatctacaatggggatagaaagatcaaagtgtctaacactttagaaagcagactggatctaatcgcccagcagatgatgccggaagtcaggggtgccctcttcggtgcaaacgccaaccgtaagttcctggattag

SEQ ID NO: 109079 - DNA, 591 bp, Artificial Sequence
  Description of Artificial Sequence: Synthetic coding sequence
atggctctgtcagacgccgacgttcagaagcagatcaagcatatgatggcatttatcgagcaagaggctaatgagaaagcagaggagattgatgcgaaggcggaggaagagtttaatattgaaaaaggtcgcctggttcagactcagcgtctgaagatcatggaatactacgaaaagaaagaaaagcagattgaacagcagaaaaagattcagatgagcaacctgatgaaccaggctcggttaaaggtgctccgggcgagggacgacctcattaccggcctgtaccagctgctagaacctagaatgattgtgcgctgtcggaagcaggactttccactcgtgaaggccgctgtgcagaaagcaattcccatgtacaaaatagcaaccaaaaatgacgtggacgttcagatagatcaggaatcttatctccctgaggatatagccgggggcgtggaaatttataacggcgatagaaaaataaaagtgtcaaacactctcgaatctcggctggacttaatcgcccagcagatgatgccagaggttagaggagccctgtttggggccaacgctaaccgcaagtttttggactag

SEQ ID NO: 109080 - DNA, 615 bp, Artificial Sequence
  Description of Artificial Sequence: Synthetic coding sequence
atggctctgtctgacgccgacgtgcagaaacaagcggaggaagagtttaacatcgagaaaggaaggctcgtacagacacagaggcttaagattatggagtattacgagaagaaagagaaacagattgagcagcagaagaagatacagatgtcaaacctgatgaaccaggcgcgcctcaaggtgctcagggctcgcgatgatctgatcacagacctactgaatgaagcaaagcagaggctgtcaaaggtcgtgaaggacactactcgctaccaggtcctactagatggactcgtcctccagggtctctatcagctgctggaaccacgaatgatagtgagatgtagaaagcaagacttccccttggtgaaagccgccgtgcagaaagcaatcccaatgtacaagattgcgaccaaaaatgatgtggatgtacagatcgaccaggaaagttatctaccagaagatatagctggtggcgtcgaaatttacaacggtgaccgaaaaattaaggtatctaacactctggagagtcgactggacctgatagcacagcagatgatgccggaggtgcgcggtgctctgttcggggctaatgccaataggaagtttctcgattag

SEQ ID NO: 109081 - DNA, 1056 bp, Artificial Sequence
  Description of Artificial Sequence: Synthetic coding sequence
atgtcattttttcctgaactttattttaacgtcgacaacggatatttagagggtctcgttcgtgggctgaaggcgggcgttctttctcaggccgattacctaaacctcgtccaatgtgaaacactggaagacctgaaactgcacctccagtcgaccgattatggaaattttctcgctaacgaagcctctcctcttacagtatccgttatcgatgataggttaaaagaaaaaatggttgtggaattcagacatatgagaaaccacgcctatgagcccctggcatccttcctggatttcataacttacagctatatgatcgacaacgttattctgctgatcacaggcaccctgcatcagcgaagtatagccgaacttgtgcccaaatgtcatccactgggctcctttgaacaaatggaggcagttaatattgctcagacccctgccgagttgtataacgccattctggtcgatacacctctggccgctttctttcaggactgtatatcagagcaggatctcgatgagatgaacatcgaaattattaggaacactctgtacaaagcctatctagaatcgttttacaaattttgtacgcttctgggtggcactactgctgatgcaatgtgccctatcctcgaatttgaagccgatcgcagagcatttatcatcaccatcaatagttttggcacggagctcagcaaggaggatcgcgccaagttgttcccccattgtggtcgtctctaccccgagggactcgctcaactcgcacgcgcggatgattacgaacaggtcaagaatgtggcggactactatcctgaatataagttgctctttgagggcgcaggatcaaacccgggcgacaaaaccctggaggaccgttttttcgaacatgaagtgaagttgaacaaactcgcctttctcaatcagttccactttggagtattctatgcctttgtgaaattgaaagaacaggagtgccggaatattgtctggattgccgagtgtatcgcccagcggcaccgcgccaaaatcgataattacatacctattttctag

SEQ ID NO: 109082 - DNA, 825 bp, Artificial Sequence
  Description of Artificial Sequence: Synthetic coding sequence
atggtggtggaattcaggcacatgagaaaccacgcctatgaacctcttgcctcctttttggatttcataacttactcatatatgattgataacgtcatactgctcatcacaggcactctccaccaaaggagcatcgctgagctggtgccaaaatgtcaccctcttggtagtttcgaacagatggaagctgtaaacattgcacagactccagccgagctctacaacgcaatactcgttgatacacctctggcagcatttttccaggactgtatttccgaacaggaccttgacgagatgaatattgagattattcggaatacactctataaggcctatctggaatccttttacaagttctgtacgttgctgggcggcactacagctgacgccatgtgcccaatcctggagtttgaggctgaccgcagagcttttatcattaccattaattcatttggtaccgagttatcgaaagaggaccgtgcaaagttattcccccactgtggccgactttacccggagggtcttgcccagctggccagggccgatgactatgagcaggtgaagaacgttgcagactattatcccgagtacaaactgctgtttgagggagccggatccaatccaggggataagacactcgaagacaggtttttcgaacatgaggtgaagctcaataagctggcatttcttaatcaattccactttggcgtgttttacgcatttgtcaagctaaaggaacaagagtgtagaaatatcgtctggattgctgagtgcatagcccagcgtcacagagcgaagatcgacaactatatacccattttctag

SEQ ID NO: 109083 - DNA, 1179 bp, Artificial Sequence
  Description of Artificial Sequence: Synthetic coding sequence
atgtccttcttccccgagctgtacttcaacgttgacaatggatacttggaaggacttgttcgtggcttgaaagctggggtgctatcccaagccgattaccttaacctcgttcagtgcgaaaccctggaggacctgaagttgcacctccagagtactgactatggaaatttcctggccaatgaggcctctccactaaccgtcagcgtcattgacgatcggctgaaagagaagatggtggtggagtttagacacatgaggaaccatgcctacgagcctctcgcgtctttcctagactttatcactcaggagagcgaggctggaacccccgagggcccgggaaacatgccaaaactgggtagccgcccctctcctggccacaggccacctttcctgagggtgagtctgctgccttggccaccttcgagctattcctacatgattgataatgtgattctgcttatcacgggcacactccaccagaggtcaatcgccgagctcgtcccgaagtgtcacccactcggctcatttgagcagatggaggccgtgaacatcgcacagacccctgccgaactatataatgcaatcctcgtagatacccctttggccgcctttttccaggactgcatttcagaacaggaccttgatgagatgaatattgaaatcattagaaataccctgtacaaagcttacctggagagcttttacaagttttgcacattattaggtgggacaacagcagacgccatgtgccctatccttgaattcgaagctgacagacgggcctttattatcacaatcaacagtttcgggacagaattgagcaaggaagatcgagccaagctgtttcctcattgcggccgactatatcccgaaggcttagcacaactcgcgcgggccgacgactacgagcaggtgaagaatgtggccgattattaccctgaatataagttactattcgaaggagccggaagtaaccccggggacaagacattggaggatcgcttcttcgagcacgaggtcaagcttaataagttggcgttcctaaatcaattccactttggggttttctacgccttcgtgaaactgaaggagcaggaatgtcggaatatcgtgtggatagcggaatgcatcgcccaacgacatcgcgcaaagatcgacaactatatcccgatcttttag

SEQ ID NO: 109084 - DNA, 1149 bp, Artificial Sequence
  Description of Artificial Sequence: Synthetic coding sequence
atgaccgaattctggcttatttctgccccaggggagaagacctgccagcagacctgggagaaactgcatgctgcaacttccaagaacaataatctggcagtcacctctaaattcaacatccctgatctgaaggtcggcactcttgatgtactggttggtctgagcgacgaattggccaaattggacgcatttgttgaaggagtagtgaagaaggtcgctcagtacatggccgatgtactggaagactccaaagataaagtccaagagaatttgctagccaacggcgtggatctagtcacatatataacgagattccagtgggatatggcaaagtatcccattaagcagagcttgaaaaatatctcagagattattgccaaaggcgtgacacagattgacaacgatcttaagtcgcgtgcgtccgcatataataatctcaagggcaatctccagaacttagagcgaaagaacgccgggagcttgcttacgaggtccctggcggaaattgttaagaaagacgatttcgtgcttgactcagaatacctggtgaccctgctggtggtcgtgcctaaactcaatcacaacgattggattaaacaatatgagacccttgctgaaatggtggtgccacggtcctctaatgtgctgtcggaggatcaagactcttatctgtgtaacgtgacactgtttaggaaggcagtggatgattttcgacataaggccagagaaaacaaatttattgtgagagattttcagtacaacgaagaggagatgaaagcagataaggaagagatgaacaggctgtcgacggacaagaagaagcaatttggccccctcgtgaggtggctcaaagtgaacttttctgaggcattcattgcatggatacatgtcaaagccctcagagtttttgtggaaagcgttttgcgctacggcttacctgtaaatttccaggcgatgctgctgcagcctaataaaaagacgctgaagaagctacgtgaagtgctccatgagttgtataagcacctggacagttcggctgcagcgattattgacgcacctatggatattcccggtctgaatctgtcccaacaggagtattacccttacgtgtactataagatagattgcaaccttttggagttcaagtag

SEQ ID NO: 109085 - DNA, 1149 bp, Artificial Sequence
  Description of Artificial Sequence: Synthetic coding sequence
atgaccgagttctggcttattagtgcaccaggggagaagacttgccaacaaacctgggagaaattacacgctgcaacatcaaaaaataacaacctggcagtgaccagtaaattcaatatccctgacctgaaagtgggcacactggatgtcctggttgggctgagcgatgaactcgccaagttggacgctttcgttgagggcgtcgttaagaaggttgcgcagtatatggcggacgtactcgaggactcaaaggacaaagtgcaagaaaatctgttggcgaacggcgttgacctggtcacttatatcacccgctttcaatgggatatggctaaatacccaatcaagcaatccttgaaaaacatctctgagatcattgcaaagggtgtgactcagattgataacgatctcaagtcacgcgcctctgcgtacaacaatctcaagggtaacctgcagaatctggagaggaagaacgcaggaagcttgctaacacggagcctggccgagattgtcaagaaagatgacttcgtactcgatagcgagtacctggtcactctgctggtcgtggtgccaaagctgaaccacaatgactggattaaacagtatgaaaccttagccgaaatggtggttcccaggagcagcaatgttctgtctgaggaccaggacagctatctctgtaatgtaacactctttcggaaggctgtcgacgactttcgtcataaggccagagaaaataagttcatcgtcagagactttcaatacaacgaggaggaaatgaaggctgataaggaagagatgaataggctgtcaaccgataagaaaaagcaatttggccctctggtgagatggctcaaagtcaatttctcagaggctttcatagcgtggatccacgtcaaagcgctgagagtgttcgtggagtccgtgctccggtacggtctgcctgtcaactttcaggcaatgctcctacagccaaataagaagacccttaaaaaactccgggaagtgttacatgagctttacaaacacctggattcatctgctgcagccataatcgacgcccccatggatatacctggactgaatctgagccagcaggagtactacccctacgtgtactacaaaattgattgtaatctcttagagttcaagtag

SEQ ID NO: 109086 - DNA, 1053 bp, Artificial Sequence
  Description of Artificial Sequence: Synthetic coding sequence
atggcagtcttcgtcgtcttgctggctctcgtggccggtgtcctggggaatgagttttccatccttaagagcccaggcagtgtggtattcaggaacggcaactggccgattcccggtgagcgaattccagatgtagccgccttaagtatgggatttagtgtcaaagaggacctttcctggcctggtctggcggttggaaacctgttccataggccgcgggctactgtcatggttatggtgaagggggtcaacaaactcgcattgccccccgggtccgtgatctcctaccccctggagaacgctgtgcccttctcgctcgacagtgttgccaattccatccactctctgttttccgaagagaccccagtggttttgcagctggcgccgtctgaagagcgtgtctatatggtcgggaaggctaattccgtgtttgaggatctatcggtcactctgcgacaactgagaaaccgcctgttccaagaaaattcggtactctcgtctctgcctctaaactctttgagccgtaataacgaagttgaccttctcttcctctctgagttgcaggtcctccacgacatctcctcattactgtcgcggcacaagcacctggccaaagatcacagtccagacctctacagcctggagttggccggactcgacgagattggtaaacgctacggcgaggatagcgaacaattccgggatgcaagcaaaatccttgtcgatgccctgcagaaatttgccgatgatatgtatagcctgtacggtggcaatgccgtcgtggagctggttactgtgaagagcttcgatacatccctgattcggaaaacacggacgatactggaggctaagcaagctaaaaatcccgctagcccctataacttggcctacaagtataacttcgagtacagcgtagtgttcaacatggttctatggataatgatcgcccttgccctagctgtgattattacttcttacaacatctggaatatggatcctgggtatgattccataatctatcgtatgaccaatcagaaaattcgcatggattag

SEQ ID NO: 109087 - DNA, 732 bp, Artificial Sequence
  Description of Artificial Sequence: Synthetic coding sequence
tgatgccctgccggcccatttagggtcgcccctcagtgctgcgggcgtcgagggacaatggccgtattcgtggtgctcctggcacttgttgccggggttttgggaaatgaatttagcattctgaaatcccctggaagcgtggtttttcgaaacggcaactggccaatccctggtgagcggatccccgacgtggcggctctgtccatggggttttccgtgaaagaggacctctcctggcctggccttgcagtgggcaacctgtttcaccgccctagagccacagtgatggtcatggtaaaaggggtgaataagctggcgctccccccaggttccgtgatatcttaccccctcgagaacgtcgaccttcttttcctgtctgaacttcaggtattgcacgatatttcaagcctgctgtctagacacaagcacctcgcaaaagatcacagcccagatctttatagcttggagttggccggactggatgagattggaaagcgctacggcgaggatagcgagcagttccgcgacgcatctaagatccttgtagatgcattacagaaattcgcagatgacatgtacagtctttatggaggcaatgctgtggtggagttagtcactgtcaaaagcttcgatacatcgttaattcgaaagacacgaactattctcgaggccaagcaggccaagaaccctgcctcaccctataatctggcatataaatacaacttcgaatag

SEQ ID NO: 109088 - DNA, 612 bp, Artificial Sequence
  Description of Artificial Sequence: Synthetic coding sequence
gaatccgagagggttactagttcacggtgtggctgtcgaccttgcccagctggccctttcagagtcgcaccacagtgttgtggccggagaggaactatggcggtgtttgtggttttgttggccttagtagccggggtgctgggaaatgagtttagcatcttgaaaagtcctgggagtgtggtcttcagaaacggcaactggcccataccgggtgagagaatccccgacgtcgctgccctctcaatgggttttagtgtgaaagaggatttgtcatggccaggcctcgctgtcggcaatctcttccacagaccaagagcaactgtcatggtgatggtcaaaggcgttaataagcttgccctgccacctggctcagtgatttcatatcccctcgaaaacagggtttacatggtcgggaaagccaatagcgtgtttgaggacctgagcgtgactctgcggcagctgcgcaaccggttgtttcaggaaaatagtgtcctttcctcactgcccttgaactctctctcgcggaataatgaggtggatcttctgtttctgtccgagctccaggtactccacgatatatccagcctgctgagtcgccacaagcacctgtag

SEQ ID NO: 109089 - DNA, 780 bp, Artificial Sequence
  Description of Artificial Sequence: Synthetic coding sequence
tgagtacctcccgcccgctccgtcagcccacgcagcgctgccgccgctgccgccccctggctttgcctctcatgttcctggagatggtggcgtgatctcagctggccgggcctggcagtaggtaacttgtttcatcgcccgcgggcaaccgtgatggtgatggtaaaaggcgtgaacaaactggctctgccccccgggagcgtgatctcctatccactcgaaaatgcagtgcccttcagcctggattctgtggctaattcaattcatagccttttctcagaagagacccccgttgtcctgcagctcgccccttccgaagaaagagtctatatggtcgggaaagccaacagtgtgttcgaggatttaagcgtcacacttaggcagttgagaaatcggctcttccaggagaactcagtgctatcctcgctgcccctgaattctctgagcaggaacaatgaagtggatctgttgtttctgagcgagctccaggtgctccacgatatttcgagcctcttgtctaggcacaaacacctggcaaaagatcatagccccgacctgtatagcctcgagctggcggggttggatgagatcgggaaacggtacggcgaagacagcgagcagtttcgtgatgcctctaagatattggtcgatgcattacaaaaatttgccgatgacatgtacagtctgtacggggggaacgcggttgtggaacttgtgactgtaaagagcttcgacacctctctgatcaggaagaccagaacgattctcgaggccaagtag

SEQ ID NO: 109090 - DNA, 957 bp, Artificial Sequence
  Description of Artificial Sequence: Synthetic coding sequence
atggccgtgtttgttgtgctgctggccctggtcgccggcgtgttaggaaatgagttcagcatcctgaagagtccggggtcggtcgttttcaggaacgggaattggccaatccccggtgaaagaatacccgatgtagccgcactctcaatgggcttttctgtcaaagaggacctctcttggcccggacttgcagtggggaacctgttccatcgccctagagccaccgtaatggtcatggtgaaaggcgtgaacaagcttgccctccctcctggcagcgtcatctcttacccgctggagaaccgggtatatatggtagggaaagcgaacagtgtttttgaggacctgagtgtgactctgaggcagctgcgcaaccgactgttccaggagaattccgtgctgtccagtctccctctgaacagcctatcccgtaataacgaagtggatctactcttcctgtctgaactccaggtcctgcatgacatcagtagcctgctgagtcgacacaagcacctggccaaggaccattcacccgacctgtactctctcgaattggctggattagacgagattgggaagaggtatggcgaagacagtgagcaattcagagacgcttctaagatattagtggacgctctgcagaagtttgccgacgatatgtacagcctttatggcggcaatgccgtggttgagttggtgacagtgaagtcattcgatacttccctgatcaggaaaacgagaacaattctggaagctaagcaagccaaaaaccccgcctccccatataatctggcctacaagtataactttgaatactctgtagttttcaacatggtgctctggattatgattgctctggctctggcagtgatcataaccagttataatatttggaatatggatcctggttatgattctatcatatatcgtatgacaaatcagaagatccgcatggactag

SEQ ID NO: 109091 - DNA, 819 bp, Artificial Sequence
  Description of Artificial Sequence: Synthetic coding sequence
atggccgtgttcgtggttctgcttgccctcgtggctggggtgcttgggaacgaattctccatcctgaaaagccccggttccgtggtgtttcggaatggaaattggccgattccgggcgagaggatccccgacgttgccgctctgagcatgggcttctcagtgaaggaagacttgtcctggcccggcctcgccgtagggaacctattccaccgtccacgcgccacagtcatggttatggtgaagggtgttaacaaactggcgttgccccctgggagcgtgatcagttacccactggagaatgtggatttgcttttcctatccgaactccaggtcctccatgatatttcgtctttactaagtaggcataaacatctggcaaaggaccactcgccagatctttattctctggaattggccggcctggatgagatcgggaagcggtacggtgaggattcagagcagtttcgggacgcttcgaaaattctggttgacgctttacagaagttcgcagacgacatgtattctctttacggggggaatgccgtggtggagcttgtgacagttaagtcgttcgacacaagtctcataagaaaaacccggacgatcctggaagccaaacaggccaaaaatcctgcttccccatacaatctggcctataaatataattttgagtattccgtcgtgtttaatatggtgctctggattatgatcgcattggcccttgccgtgatcatcacgtcctataacatctggaacatggacccagggtacgattctattatatacaggatgacaaaccagaagatccgaatggattag

SEQ ID NO: 109092 - DNA, 498 bp, Artificial Sequence
  Description of Artificial Sequence: Synthetic coding sequence
atggccgtattcgtggttttgctggccctggtggccggcgtgctgggtaacgagttttcaatcctaaagtctcctgggagcgtagtttttagaaatggcaattggcctatccccggagagaggatacccgacgtggcagccctgtcgatgggcttttccgtgaaagaggacctctcatggccaggccttgctgtcggcaatctgttccacagacctcgcgccactgtcatggtaatggtgaaaggtgtgaacaaattagctctgccccctggaagcgtcatctcctaccctcttgagaacgccgtgccattctccctggacagtgtggccaactcaattcactccctttttagcgaggaaactcctgtagtgctgcagctagccccctccgaggaacgcgtgtacatggtcggaactatgaagctgacctgcagcttttttcttaactgcaaatgctacatgatttttcaggcttgctgtttggtgatttccatttag

SEQ ID NO: 109093 - DNA, 825 bp, Artificial Sequence
  Description of Artificial Sequence: Synthetic coding sequence
atggtgatggtcaagggcgtgaataagctcgctctcccccccggttcagtcataagttaccctctggagaatgccgtcccgttttcactggactccgtcgccaactcaattcactcgctcttctccgaagagacacccgtggtactgcaattggccccctccgaagaacgtgtctacatggtaggaaaagcaaattcggtgtttgaagacctgagcgttacattgcggcagctgagaaataggcttttccaggagaactccgtgttgtcctcgttacctcttaattccctgtctcgaaataatgaagtcgatctattattcctcagcgagctccaagtcctacacgatatctcctcgctcttgagtcgacataaacaccttgcgaaggatcattcccccgacctgtattcattagaacttgccggactggacgagattggcaaacggtacggcgaggactccgaacaatttcgggacgcttccaaaatccttgtggatgccttgcaaaagtttgccgacgatatgtactctctctacggcggcaacgccgtcgtggaactagtaactgttaagtctttcgatacaagcttaatccgcaagacccgaaccatactcgaagcgaagcaagccaagaatcctgccagcccttacaatttggcttacaaatacaattttgagtacagcgtggtttttaacatggtgttgtggatcatgatcgctcttgccctcgctgttatcattacttcctacaatatatggaatatggaccctggctacgacagcatcatctaccgaatgacaaatcagaaaatcagaatggactag

SEQ ID NO: 109094 - DNA, 2517 bp, Artificial Sequence
  Description of Artificial Sequence: Synthetic coding sequence
atgggagaactctttagaagcgaagagatgaccctggctcagctgtttctccaatcggaagcagcttactgctgcgtttctgagctgggcgagttgggtaaggtccagtttagggacctgaatccagacgtgaacgtgtttcagagaaaatttgtgaatgaggtccggaggtgtgaggaaatggaccgcaagctgaggttcgttgagaaagagatccgaaaagcaaatattccgataatggacacaggggagaacccggaggtgcctttccctcgagatatgattgatttggaggccaatttcgaaaaaattgaaaacgaactgaaggagatcaacacaaatcaagaagcgcttaagagaaactttctggagctgaccgagcttaagttcatactgagaaagacccagcagtttttcgatgaagcagagctgcatcatcagcagatggcagatcccgacctgctagaagaatcttcttcgctgcttgaaccgtctgagatgggacgaggcactccccttagactcgggtttgttgcaggggtgatcaatcgagagagaattccaactttcgagcgcatgctgtggagagtctgccgcggaaacgtttttctccggcaggccgaaattgagaacccactcgaagatccagtgaccggagactatgtgcataaatctgtatttatcatattttttcagggagatcagctgaaaaatagggtcaagaaaatctgtgaaggattccgcgcaagtctttatccttgtcctgaaacaccccaagaaaggaaggaaatggcttccggagtcaatacccgaatcgatgacttgcagatggtccttaatcaaactgaggatcatcggcagagagtgctgcaggctgcagctaagaatatccgggtttggtttataaaggtccgaaagatgaaagcaatctatcacactctcaatttatgcaatatcgatgtgactcagaagtgcttaatcgccgaggtgtggtgtcctgtgaccgacttagattccatccaattcgcactgagacggggcacagaacattcagggagcaccgtccctagcatcttaaaccggatgcagactaatcagacccccccaacatataacaagacgaacaagttcacctacgggtttcagaatatcgtagacgcgtacggcattgggacttaccgagagataaaccctgccccttatacgatcatcacatttcctttcctgttcgcggttatgtttggcgacttcggacatgggatactcatgaccctctttgccgtgtggatggttcttcgagagagcagaatcctatcacagaagaacgaaaacgaaatgttttctaccgtgttctccgggaggtatattattctgctgatgggggttttcagtatgtatactggactgatctacaatgattgtttttccaaatccctgaacatattcggttcctcctggagcgtcagaccaatgtttacatacaattggacggaagagaccctaagaggcaatcccgtgctccagctcaatcctgctctgcccggagtattcggcggcccctatcctttcggcatcgacccgatatggaatatcgctactaacaaattgacgttcctcaattccttcaagatgaagatgtccgtcatcctgggcatcattcacatgctgttcggagtgtcactctcactctttaatcatatatactttaaaaaaccattgaatatatactttgggtttatccccgagattatttttatgacctccctttttgggtacctcgttatactcatattctacaagtggacagcatatgacgcgcatacttctgaaaacgccccttcactccttatacacttcatcaatatgtttctgtttagttacccggaatcaggttacagcatgctgtatagtggacaaaaaggtatacagtgttttttggtggtagtggccctattatgcgtaccatggatgttactctttaagccactcgtgttgagacggcagtacctcaggagaaaacacttgggcaccttgaattttggaggcatacgagttggcaatggtccgaccgaggaagacgcagagataatccagcatgaccaattgtccactcattctgaggatgccgacgagttcgactttggcgatactatggtgcatcaggctatccatacaattgaatactgcctgggttgcatcagcaacaccgcaagctatttgaggctgtgggccctctccttggcccacgcacagttatccgaggtcctgtggacaatggtgattcacataggcctctccgtgaagtccctcgcagggggcttggtgctgtttttcttttttaccgcattcgctaccctcacagttgctatcctcctgatcatggaggggttgagcgccttccttcatgcattgaggttacattgggttgaattccagaataagttttacagtgggactgggtttaaatttctgccctttagctttgagcatatccgcgagggcaagtttgaggagtag

SEQ ID NO: 109095 - DNA, 2514 bp, Artificial Sequence
  Description of Artificial Sequence: Synthetic coding sequence
atgggcgagctgtttaggagcgaggaaatgaccctggcacagctctttctccagtcagaggccgcttattgctgcgtgtccgaacttggcgaactaggtaaggttcagttccgcgatctgaatcctgatgtcaacgtttttcagagaaagtttgttaacgaagtgcgaagatgtgaagagatggaccggaagcttagatttgtggaaaaggagattcggaaggctaacattcccataatggatacaggggagaacccagaggtcccctttccacgagacatgatagatcttgaggctaactttgagaagatcgagaacgaactcaaggagattaatacgaatcaagaggccctgaaaagaaacttcctggagttaactgagctgaagtttattcttaggaagacccagcaatttttcgatgagatggctgaccctgacctacttgaggaaagttcctctctacttgaaccttcagaaatgggccgcgggaccccccttagactgggtttcgtggccggggtgataaaccgcgaacgcattcctacattcgaacgaatgctgtggcgggtctgcagaggcaatgtgttcctcagacaggcggagattgaaaacccactagaggatccagtgacaggtgattatgtccacaaatcagtgttcattatttttttccaaggagaccaactgaaaaacagggtcaagaaaatatgtgaagggtttcgagcctctctttatccctgtcctgagaccccacaggaaagaaaggaaatggcgtccggagtaaatacacgaatcgatgatctgcagatggtcttgaatcagaccgaggaccatcggcagcgtgtgctgcaggctgccgcaaaaaatatccgcgtctggtttataaaagttaggaaaatgaaggccatttatcacacactgaatctatgtaacatcgatgtgacccagaagtgcctgatcgcggaggtctggtgcccagttaccgatcttgatagcatccagtttgccctgcggcgtgggacagagcactccgggtccacagttccctcaatattaaatcgtatgcagactaaccagaccccaccgacatataacaaaaccaacaaatttacgtacggctttcagaacattgtggacgcatacggaattggtacttaccgggaaattaacccggctccgtataccattataacatttcccttcttgttcgcagtgatgtttggcgactttggtcacggcattctgatgacgctgttcgcagtgtggatggttctgcgcgaatctaggattctaagtcaaaaaaatgaaaacgaaatgttttcaactgtcttttccggccggtatataattctgttgatgggcgtctttagtatgtacactggcctaatctacaatgattgtttcagtaagtctttgaatatcttcgggagctcatggtcagtcaggccaatgtttacctataactggacagaagagacactgcgcgggaacccagtcctgcagcttaacccagccctaccgggcgtttttggaggtccctaccctttcggaatcgaccccatttggaacatcgccaccaacaaattaacatttctgaacagttttaagatgaagatgtccgtgattttagggatcatccacatgttgttcggagtgagtttatctctcttcaatcatatctacttcaagaagcccctaaacatatacttcggattcattcctgagattatattcatgacgagcttgttcgggtacctagtaatcttgatattctataaatggaccgcttatgacgctcacacatccgaaaacgccccatctctcctaattcatttcattaacatgtttcttttcagctacccagaaagcggctactccatgctttactctggtcagaaggggattcaatgcttcttggtggtagtcgcactgctctgcgtcccttggatgctccttttcaagccgcttgttcttaggaggcagtatctgagacggaagcacttagggactctgaattttggagggatccgggtgggcaatgggcctacagaagaagatgccgagatcattcaacacgatcagctcagcacccactcagaagacgccgacgaaccctccgaggatgaggtgtttgactttggggacacaatggtacatcaggccattcacactattgagtactgtcttgggtgcattagcaacactgcttcctacctccgcttgtgggccctgtcactcgcccatgcccagttaagcgaggttttatggactatggtaattcacatcggcctgagcgtcaaaagtttagcgggcggcctggtcctttttttcttctttacggcgttcgcaacccttaccgtggctattctgctgataatggagggactgagcgccttcctgcacgccttgaggcttcactgggtggagtttcagaataagttctatagcggcacgggcttcaaatttctcccctttagttttgagcatatacgcgaaggcaaattcgaggagtag

SEQ ID NO: 109096 - DNA, 2496 bp, Artificial Sequence
  Description of Artificial Sequence: Synthetic coding sequence
atgggcgaattgtttaggtctgaggaaatgaccctcgcacagctctttcttcagtccgaggcagcctactgttgtgtgagcgagctgggggaactggggaaggtgcagttcagagacttgaatcctgacgttaacgtttttcagaggaaatttgtcaacgaggtcaggagatgtgaggagatggaccggaagctaagattcgtggagaaggagattcgcaaagctaacatccctatcatggataccggggaaaacccagaagttcctttccctcgagatatgatcgatctcgaagccaatttcgagaaaatcgagaacgagctgaaggaaatcaacaccaaccaggaagcactgaagaggaatttcctggagctcaccgaattgaagttcattcttcgcaaaacacagcaattcttcgatgagatggccgaccccgacctgctcgaagagagctccagtctgctagagccttccgaaatggggcggggtaccccactacggctgggcttcgttgctggggtgatcaatcgagagaggatccccacgttcgagagaatgctatggagggtatgccgcggcaacgtcttcctgagacaggctgagatcgaaaacccgttagaagacccagtcactggcgactatgttcataaatctgtatttattatcttctttcagggagatcaactgaaaaatagagtcaagaaaatttgcgaaggctttcgggcctctctgtacccctgccccgagactcctcaagagagaaaggagatggccagcggagtcaacactcgaattgatgatctgcagatggtgctgaatcagacagaggaccaccggcagagagtgctgcaggctgccgcaaaaaacatacgtgtgtggtttatcaaggtcagaaagatgaaagctatctaccatactcttaacctctgtaacatcgatgtaactcagaagtgtttgattgccgaagtatggtgtccggtgactgatcttgactcaatacagtttgctctgcggcggggcactgagcactctggcagtaccgtgccctccatcctaaatcgtatgcagaccaatcagacccctccaacatacaataaaacgaacaagttcacgtacggcttccagaacatagtggacgcttatggtatcggcacctacagagaaatcaatccagcgccctacacaatcattacttttccctttctgtttgccgttatgtttggcgactttggccacggcatactaatgaccctgttcgccgtatggatggtgctgagggaatctcgtattctcagtcaaaaaaatgaaaatgagatgttttctactgtcttctcaggaaggtacataatcctccttatgggagtttttagcatgtacacaggattgatatataacgactgtttttccaagtcactcaatatttttgggagtagctggtccgttaggcctatgttcacctacaactggacagaagagacattaaggggaaatccagtgttgcagctgaatcctgcgttgcctggggtcttcggaggaccttaccctttcggtatagaccctatctggaatatagccacaaacaaactcacttttcttaactctttcaaaatgaagatgagcgtgatcctgggtattattcatatgttgttcggtgtgagtctgagtctgttcaatcacatctactttaagaagccactgaacatctatttcggctttattccagaaatcatattcatgacctcactcttcggatatctggtcattctgatcttctacaagtggacagcctatgatgcccacacatccgaaaatgcaccctccctgcttatccactttattaacatgtttctgttctcatatccggaaagcggctactcaatgctgtactctggccagaagggaattcaatgctttcttgtggtggttgccctgttgtgcgttccatggatgcttttattcaagcctctcgtcctgcgtcgtcagtatctgcgcaggaagcacttggggacccttaacttcggcggaattagggtgggcaacggccctacagaggaggatgccgaaataatccagcatgatcagctatctactcatagtgaggatgcagacgaattcgactttggggatactatggttcaccaggctatccacaccatcgagtactgtctcggttgtatcagcaacaccgcctcctacctcagactgtgggctctctccttagcccacgcccagctgtccgaagtcttatggacaatggtgatccatattggtctgtccgtcaaatccctagccggcggccttgtcctgttcttcttctttacggccttcgctaccctgacggtggccatcctgctgatcatggagggcctctcggcatttctgcacgcccttcgactgcactgggttgaattccagaataaattttacagtgggaccggattcaagtttctacccttctcatttgaacacatcagagagggcaagttcgaggagtag

SEQ ID NO: 109097 - DNA, 2367 bp, Artificial Sequence
  Description of Artificial Sequence: Synthetic coding sequence
atgggagagctgtttcggtccgaggaaatgaccctcgcacagctcttcctgcaaagcgaagctgcttattgctgtgtgagtgagctgggggagctgggtaaggtgcaatttcgagatttaaatcctgacgttaatgtgtttcaaaggaagtttgtcaatgaggtccggaggtgtgaagaaatggataggaagcttagatttgtcgagaaagagatccggaaagctaatattccaatcatggacactggcgaaaaccccgaggttccatttccgcgagacatgatcgacctagagatggccgatcctgatctcctagaggagtcatcatctctcctcgagccctcagaaatgggcagagggacgcctttacgcctcggcttcgtcgcaggggtcatcaaccgggagaggataccaacttttgagagaatgctgtggcgggtttgccgcggaaacgtcttcttaaggcaagctgagattgaaaaccctctagaggaccccgtgacaggcgattatgtccacaagagcgtttttattatcttctttcagggggatcagctgaaaaacagagttaaaaaaatctgtgaagggttcagagccagcttatatccttgccccgagaccccacaggaacgcaaggagatggcatctggtgtgaatacaaggatcgatgatctccaaatggttctgaatcagactgaagatcacaggcaacgggttctgcaggcggcggccaagaatattcgagtgtggttcatcaaagtgcggaagatgaaggctatctatcacacactcaatctatgtaatatcgatgtgacacagaaatgccttatcgcggaagtatggtgccctgtgactgacctcgatagcatccaattcgcgcttcgtcggggaaccgaacatagtggatctacagtcccttcaatcctgaaccggatgcagacgaaccaaaccccacccacttacaataaaacaaacaaatttacctatggcttccaaaacatagtagacgcctatggcataggaacatatcgggagatcaatccagccccatacacgatcattacattccctttcctctttgcagtcatgtttggcgattttggccacggtatcctcatgacgctgtttgccgtttggatggtccttcgagagtccagaatcctgtcccagaagaacgaaaatgagatgtttagtaccgtttttagtggccgttacattatcttactcatgggcgtcttcagtatgtatactggactcatatacaacgactgcttctcgaagagtctgaacatttttggaagttcatggagcgttagaccaatgttcacttataactggaccgaagagacacttcgaggtaaccccgtgctccaactgaatccggcccttccgggcgtttttggcggtccctaccccttcggaatagatccaatttggaacattgcaaccaataaactgacatttttgaatagcttcaagatgaagatgagtgtgattctcgggataatccacatgttgttcggggtgtccctctctctttttaaccacatctacttcaagaagcccctcaatatttactttggcttcatccccgagatcatctttatgacgtctctgtttggttatttggtgatcctcattttttataaatggaccgcttatgacgcccacaccagtgaaaatgcgcctagcctcctgatccactttataaatatgttcctgttcagttacccggaaagcgggtactctatgctttatagtggacaaaagggcatccagtgtttcttagtggtggtagctctgctgtgcgtcccctggatgctcttgttcaagccccttgttcttcgtaggcagtacttgcggaggaagcatcttggcacactcaatttcggcggcatacgggttggcaacggccctactgaggaggatgcggagataattcagcatgatcaactctccacccacagtgaggacgccgacgagtttgacttcggtgacacaatggtgcaccaagccatccacaccatagagtactgcctgggctgcatttcgaacactgcttcataccttaggctctgggctctgagcctcgctcatgcacaactgtccgaggtgctctggaccatggtgattcatatcggcttgagcgtgaagtcgctagccgggggccttgtgctgtttttttttttcactgctttcgcaaccctgaccgttgctattctgctgattatggagggattaagcgccttcctgcacgcgcttcgtctgcattgggtggagtttcagaacaagttttatagtgggacgggctttaagttcctcccttttagtttcgagcacattcgcgagggtaagttcgaagaatag

SEQ ID NO: 109098 - DNA, 1452 bp, Artificial Sequence
  Description of Artificial Sequence: Synthetic coding sequence
atgcagaccaaccagacgccaccgacatataacaaaacaaacaaattcacttatggatttcaaaacatcgttgatgcctatgggatcgggacatacagggagattaaccccgccccttacacaattatcacgtttccattcttgtttgccgtgatgtttggcgactttggccacggcatcctgatgactctttttgcagtctggatggtcctgagagaatctcggatcctgtcacaaaagaatgagaacgagatgttctccactgtgtttagtggtagatacatcatcctgctcatgggtgtgttctctatgtatactggactgatttataatgattgcttttccaaatcccttaacattttcggctcctcctggtcggttcgacccatgtttacgtacaactggacggaggaaacccttagaggaaaccccgttctgcagctcaatccggctctgccgggggtcttcggaggcccctacccttttggaattgatcccatttggaacattgctacgaacaagctgacgttccttaactccttcaagatgaagatgagtgtaattctgggcattattcacatgctgttcggtgtgtccctgtcactgttcaaccacatatatttcaaaaagccgttaaatatctattttggcttcatccctgagatcattttcatgacgtccctcttcgggtacctggttatcctgatattctacaagtggactgcttatgatgcccatacgtctgaaaacgcaccatcacttctgattcactttataaatatgttcttgtttagctacccagagtcagggtattccatgctgtactccggccagaaagggatccagtgcttccttgttgtcgtcgccctcctttgcgttccgtggatgttgctctttaagccactcgtgctgcgtcgccaatatcttcgccgaaaacaccttggcacacttaactttggagggatccgcgttggcaatggtcccaccgaggaggacgccgagatcatccaacatgaccagctgtccacccactctgaggacgccgatgaacctagcgaggacgaggtcttcgactttggtgacaccatggtgcatcaagccatccatacgatcgagtactgcttgggctgcatctcaaacacagcatcctatctgcgcctgtgggctctgtcactcgcacacgcccagttatccgaggtgctctggaccatggtgattcacataggactgtcagttaaatcgctggctggagggctggtgttgttcttcttctttacagctttcgccacccttaccgtcgcaatcctgctgatcatggaaggcctctcggcattcttacacgctctgcgcttgcactgggtagaattccaaaataaattctacagcggcacagggttcaagtttctgcctttctcatttgaacacatcagagagggaaagtttgaggagtag

SEQ ID NO: 109099 - DNA, 2514 bp, Artificial Sequence
  Description of Artificial Sequence: Synthetic coding sequence
atgggcgagctgttcagatcagaggaaatgacacttgcgcaactgttcctgcagtctgaagctgcatactgctgtgtttccgaactcggagagctcggcaaagtccaattccgcgatctcaaccccgatgtgaacgtgtttcagcgcaaattcgtgaatgaagtccgcagatgtgaggagatggatagaaagctccgtttcgttgaaaaagagataaggaaggcaaatattcctattatggatacaggtgagaaccccgaagtaccctttcctagggatatgatcgatctcgaagctaatttcgaaaagatagaaaatgagctgaaagaaattaacacaaaccaggaggcattaaaacgaaatttcctggaactgactgagttgaaatttatattgcgaaaaacccagcagttttttgatgagatggctgatcctgaccttctggaggagagtagctcactgctggagccctccgaaatgggccggggaactcctctccgactcggttttgttgccggcgttatcaatcgggaaagaatccctactttcgagcggatgctctggcgggtgtgccgaggcaacgtgttcctgcggcaggcggagatagagaatcccctcgaggatcctgtgaccggagactatgtccacaagagtgttttcataatatttttccaaggagatcagctcaaaaatcgggttaaaaagatctgcgaaggcttcagggcttccctgtacccttgccccgaaacgcctcaagagcggaaagagatggcgtccggagtaaatacgagaatcgacgatttacagatggtgctgaatcagacagaggatcaccggcagcgagtcttacaggctgcagctaaaaatatacgggtgtggttcatcaaggtaagaaaaatgaaagcaatctatcatacattgaacctctgtaacatagatgttacacagaaatgtctaatcgcagaagtctggtgtccagttaccgatctggatagcatccagttcgccctgcggcggggtacagaacatagcggctcaaccgttccttccattctcaatcgtatgcagacaaatcaaacccctccgacatacaacaagaccaataagttcacttatgggttccaaaacatagtcgacgcctacggcattggcacatacagagagattaatccggctccttacaccataattacattcccgtttttgtttgccgtaatgttcggcgactttggacacggcattctgatgacgctgttcgcggtctggatggtactgcgcgaatcaagaatcttgtcacagaagaacgagaatgagatgttttccaccgtcttttctgggcggtacataatcctcctgatgggcgtcttttccatgtatactggcttaatttacaacgattgcttcagcaagtccctcaacatatttggtagcagttggtctgttcgacccatgtttacttacaattggacggaggaaactctcagaggcaatcctgtattgcagctgaatcccgccctgccaggtgtattcggcggcccttatccttttggcatcgaccctatttggaatattgcaacaaataagcttacatttcttaactcatttaagatgaaaatgtccgtgatcttaggaattattcacatgctgttcggtgttagcctctccctgttcaaccacatctatttcaagaagccgctgaatatttactttggcttcataccggagataattttcatgacaagccttttcggatatctggtgatcttgattttctataagtggacggcatatgacgcccacacctctgaaaacgctcctagtttgttgatccactttattaatatgtttctgttttcttacccagagtccggttattccatgctttattccggccagaaaggcatccagtgcttcctagtcgtggtcgcgctgctttgtgtcccatggatgttgctctttaagcctctggtgcttcgaagacaatatttgaggcgtaaacaccttggaacacttaatttcggaggcatacgggtgggtaatggtccaaccgaggaggacgccgagattattcagcatgaccagcttagtacccatagtgaagatgctgatgagccatcaacaagcgggcagttcgatttcggcgatactatggtgcaccaggcgatccacactatcgagtattgtctgggatgcataagcaacacagccagctatttacgtctgtgggccctgtctctggcacacgctcagctctcggaggtgctgtggactatggtgatccatattggactgagtgtgaagtctctggccggcgggctggtgctttttttcttctttacagcgtttgccaccctaactgtggccatactgctgatcatggaaggactgagcgctttcctgcacgcactgcgtcttcattgggtggaatttcagaataagttctactccgggacaggctttaaattcctcccattctctttcgagcacattcgcgagggcaagtttgaagagtag

SEQ ID NO: 109100 - DNA, 2571 bp, Artificial Sequence
  Description of Artificial Sequence: Synthetic coding sequence
atggggtctctgttccggagtgaaacaatgtgccttgcgcagctgttcctgcagtctgggaccgcctatgagtgcctgtctgcccttggggaaaaaggactggttcaattcagagacttaaatcagaacgtctcttccttccagaggaaatttgttggcgaagtgaaacggtgcgaagagctggaacgcatcttagtgtatctggtgcaggagatcaaccgcgccgacattcccctacctgagggggaggcctctcccccagccccacctctcaagcaggtcttggagatgcaggagcagcttcagaaactagaggtggaactcagggaagtgaccaaaaataaggagaaactgcggaagaatctgctggagttgatagagtatacccacatgctgcgggttacaaagacgttcgtgaagagaaacgtggagtttgagccgacttacgaggagtttccctccttagagagcgattctttacttgattacagctgcatgcagagattaggcgcaaagctcggtttcgtgagcggtctcattaaccagggaaaggtggaggccttcgagaagatgctgtggagggtttgcaagggctacaccatcgtctcctacgcagaacttgatgaaagcctcgaagatccagagactggagaggttatcaaatggtacgtcttcctaatctctttttggggagagcagatagggcacaaagtcaaaaaaatttgcgactgctaccattgccacgtgtatccctatccaaatacggccgaagaacgcagggagatccaggaggggcttaatactcgaatccaagatctctataccgtattgcacaagacggaagactaccttcgtcaggtactgtgcaaggccgctgaaagcgtttatagtagagttatacaagtaaagaagatgaaggccatctaccacatgttaaatatgtgttccttcgatgtcacaaacaaatgtttgatcgctgaagtttggtgtcctgaagccgatctgcaggatcttagaagggcgctggaggagggatccagagagtccggcgcgacaatccctagcttcatgaatatcatccccaccaaagagacacccccaactagaataagaacgaacaagttcaccgaaggatttcagaatatagttgatgcctatggagtcggttcttaccgagaagtcaatccagccttgtttactatcattacttttcccttcctgtttgccgtgatgtttggtgattttgggcacggttttgtgatgtttctgttcgctttattactggtgcttaatgagaaccaccctcgtttgaatcaaagtcaggagatcatgaggatgttctttaacgggcgttatatcctgttgctcatggggctgttttccgtgtataccggactgatttacaatgactgcttcagcaagtcagtgaacctcttcgggagcgggtggaacgttagcgctatgtacagcagtagtcaccccccggccgagcacaaaaaaatggtgctgtggaatgactcagtggttcggcataactccatcctccagctggaccctagtatacccggagtgttcaggggcccatatccgttagggatcgaccccatctggaacctcgcaacaaaccgcttgaccttcctcaatagcttcaaaatgaagatgagcgtgatactgggcatcatacatatgacttttggggtgattctgggcatttttaaccatctccactttagaaaaaagtttaacatttacctagtgagcatccctgagctcctttttatgctgtgcatttttgggtacctgattttcatgatattttacaaatggcttgtcttttctgctgagacgtcaagagttgcgcctagcatcctgatagagtttattaatatgtttctctttcccgcgagtaaaacgagcgggctttacacaggtcaggaatacgtgcagagagtgctgctggtggtcactgctctgtctgtgcctgtgctttttctcggaaagcccctgtttttgttgtggctgcataatggtcgaagctgctttggcgtgaatagaagcggctacacgcttatccggaaggacagcgaggaggaagttagtctgttgggatcccaggacatagaagaggggaaccaccaggtagaagatggctgtcgggaaatggcctgtgaggaattcaatttcggggagatccttatgacgcaagtgatccattccatcgagtactgtctgggctgtatctcaaacacagcttcttatctccgcctgtgggcactgtcattggctcacgcgcagctgtccgacgtactgtgggcaatgctcatgcgcgttggcctcagggttgacactacgtatggagtgctactgctgctcccagtgattgccctatttgctgtgctcaccatttttatcctgctgatcatggaaggcttgtcggctttcctgcatgccattcgcctccattgggtagaattccagaataaattctacgtaggggcaggcactaaatttgtgccatttagcttttccttactgagttccaagtttaacaacgacgattctgttgcttag

SEQ ID NO: 109101 - DNA, 1119 bp, Artificial Sequence
  Description of Artificial Sequence: Synthetic coding sequence
atgggctccctcttcaggagcgaaacgatgtgtctggcccagctgttccttcaatcaggaacagcctacgagtgtctgagcgcccttggcgaaaagggtctcgtccagttccgcgacctgaatcagaatgtatctagctttcagagaaagtttgtgggcgaagtgaagaggtgcgaggaactggagaggattctggtttatctagtacaggaaattaaccgcgccgacatccccttaccagagggagaggccagcccccccgcacccccgctgaaacaggttttagaaatgcaagaacaactgcagaaactggaggtcgagctccgggaggtgaccaaaaataaagagaaactgcgcaagaatctactggaacttatagaatacactcatatgctcagggtcacaaaaactttcgtgaaacggaacgtggaattcgagccaacatatgaagagtttccgtcgcttgagagcgattccctcctggactatagttgcatgcaacgtttaggtgcaaagttgggattcgtttcaggacttataaatcaggggaaagtggaagcctttgagaagatgttgtggcgggtctgcaagggctacaccatagtgagctacgccgagctagatgaaagcctggaggacccagagacaggcgaagtgattaagtggtacgtatttcttatttctttctggggcgagcaaatcggacacaaagttaaaaaaatatgcgattgctatcattgccacgtgtacccttaccctaataccgctgaagaacgacgggaaatccaggagggcttgaatacccggatccaagacctgtacacagtcctgcataaaaccgaagactacttgcggcaggtgctctgcaaagccgcagagagtgtgtactcccgagtcattcaggtgaagaaaatgaaagcgatttatcacatgctgaacatgtgtagcttcgacgtaacgaataagtgcctcatagccgaggtgtggtgtcctgaggctgatcttcaagatctccgcagggctttagaagagggttctgtgcgcctgccctcttctccgctgcctggaaccgaggaacgccttatggagctgattaattccgagaagaagagaaagtag

SEQ ID NO: 109102 - DNA, 2523 bp, Artificial Sequence
  Description of Artificial Sequence: Synthetic coding sequence
atggttagcgtatttcggagtgaagaaatgtgtctgtcccaattattcttacaagtagaagcggcctattgctgcgtcgccgagttgggcgagttgggtctggtgcagttcaaagacctcaacatgaacgtgaattccttccagcgaaagtttgttaacgaggtccgacgttgcgaatccctcgagcgcatcctgaggttcttagaagacgagatgcagaatgagattgtggttcagctgttggagaaatcgcccttgacacccctgccccgggaaatgatcacactggaaaccgtacttgaaaagctcgaaggcgagctgcaggaggctaatcaaaaccaacaggcactcaaacaatcttttctggagttgacggaactgaaatacctactcaagaaaacccaggatttctttgagacagaaaccaatctggccgatgacttttttaccgaggataccagcggacttctcgagctgaaggccgtacctgcgtatatgacaggcaaactgggatttatcgcaggcgtgataaatagggagaggatggcttccttcgagcggctactatggaggatttgtcgtggcaatgtgtatctcaagttttccgagatggatgcgccgctggaagaccccgtaactaaggaagaaatacaaaaaaacatctttatcatcttttaccagggtgagcagctgagacagaaaattaagaagatctgcgacgggtttcgcgctacagtgtatccatgtcctgaacctgctgtagaacgcagagagatgctagagtcggtcaatgttcgactggaagatttgattacggtgattacacagactgaatcccatagacaaaggctgctacaggaagcagcagctaactggcattcctggctgattaaggtgcaaaaaatgaaggcggtctaccatattctaaatatgtgcaacattgatgttacacaacagtgcgtaattgccgagatatggtttcccgtggctgacgcaactaggatcaaacgggctttagagcaggggatggaactgtctggaagttctatggcaccaatcatgacgacggtccagagtaaaacagctccacccacctttaacagaacaaacaagtttaccgctggcttccagaatatcgtggatgcttatggtgtaggttcctaccgcgagataaatccggcaccctacaccatcataaccttcccattcctgttcgcagtaatgttcggcgactgcgggcatggaactgttatgctgctggccgccttgtggatgatactcaacgagcgaaggctcctcagtcaaaagactgacaatgaaatctggaacaccttttttcatgggcggtatttaatcctattaatgggaatctttagcatctacacgggcctcatctacaatgattgcttcagcaaatctctgaatattttcggttctagttggtcagttcagcccatgttcagaaacggcacctggaacacacatgtgatggaagaaagcctctatctccagttagaccccgctatcccaggcgtctatttcgggaatccgtacccatttggcatcgatccaatctggaacctggctagtaataaattgacatttctgaactcttacaagatgaaaatgtccgtgatcctcgggatcgttcagatggtttttggcgtgatcctgtccctgttcaaccacatatattttagacggacgctgaatattatcctccagtttataccagagatgatctttatactgtgtctgttcggatatctagtgtttatgataatctttaagtggtgttgctttgatgtccacgtgtcccagcacgccccttccattctcatccactttataaatatgttcttgtttaattatagtgatagctccaacgccccgctgtataaacaccaacaggaagtgcagtccttttttgtagtgatggccctgatcagcgtaccttggatgctcctgatcaaaccctttatactcagagcatctcatagaaaaagtcagctccaggcctcaaggatccaggaggacgccaccgaaaatatcgaaggagactcctcgagcccttctagcaggagcggccagaggaccagcgccgacactcacggtgccctggacgatcatggcgaggaattcaactttggggatgtcttcgtacaccaggccatacatacaatcgaatactgcctgggctgtatctctaacaccgcctcgtatctgcgtctgtgggccctgagcttagcccatgctcagttgagtgaggtcctgtggacaatggtgatgaacagcgggctacaaacacgggggtggggcggaatcgtgggcgtgtttatcattttcgccgtttttgccgtcctgaccgtagctatcttacttatcatggagggtctgagtgccttcttacacgcactgcggctgcactgggtggaatttcagaataaattttatgtcggggacgggtataaattctctcctttttcatttaagcacattctggatggtactgcagaggaatag

SEQ ID NO: 109103 - DNA, 2523 bp, Artificial Sequence
  Description of Artificial Sequence: Synthetic coding sequence
atggttagcgtgtttaggagtgaggagatgtgcttgtcacagctcttcctgcaagtagaagccgcctactgttgcgtagcagagctgggtgagctgggcctggttcagtttaaggatctaaacatgaacgtcaatagcttccaaaggaagtttgtgaatgaggtgcggaggtgtgagagcctcgagaggattctccgcttcctcgaggacgagatgcaaaacgaaatcgttgtgcagttgctcgagaaaagtccactgacaccccttccgagggagatgatcaccttagaaaccgtgttagaaaagctcgaaggcgagttgcaggaggccaaccagaatcaacaggctctcaaacagagtttcctggaattgactgaactcaagtacctcctcaagaagacacaggattttttcgaaacggaaacaaatctggcagatgacttctttactgaagacacaagtggtctcctagagctcaaggctgttccagcttatatgaccgggaaactggggtttatcgccggggtaatcaacagggagaggatggcctcttttgaacgcctgctgtggcggatatgtcgaggcaacgtgtatctcaagttttccgagatggatgcaccacttgaagatccagtgacaaaggaggaaatccagaaaaacattttcatcatcttttatcagggggaacagctccgccagaagatcaagaagatctgtgatggattccgtgctacagtgtatccctgtcccgagcccgcagtggaaagacgggaaatgctggaatctgtcaacgtgcggttggaggatctcattacggtcatcacgcagacagagtctcatcggcaaagattgcttcaggaggcagccgcaaattggcactcctggctgataaaggttcagaaaatgaaggcagtctatcacattctgaacatgtgtaacattgatgttacacagcagtgcgtaatagctgagatctggtttcctgtggccgatgctactagaattaagcgggcactggaacaaggcatggaattgtctgggtcttccatggcacccattatgacaactgtgcagtccaagaccgcccccccgaccttcaacagaaccaataaatttaccgccggttttcagaacatcgtggatgcatacggcgtgggtagctaccgtgaaataaaccccgccccgtataccattatcacattcccctttctgttcgcagtcatgttcggcgactgtggacatggcactgtcatgcttctggctgctctgtggatgatcttaaatgagcgcaggctactctctcagaaaacggataacgaaatttggaacactttttttcacggacgatatctgattctactcatgggtattttcagcatctatacaggattaatctataatgattgtttctctaaatctctgaatatctttggaagcagctggtcagtacagccaatgtttcgaaacggcacctggaatacacacgttatggaggagagtctctacctgcagctagatcccgctatacccggcgtttatttcggcaacccctacccttttggaattgatccaatttggaatttagctagcaataagttgaccttcctcaatagttataagatgaaaatgagcgtgatcttaggtatcgtgcagatggtcttcggcgtgatcctctcattatttaatcacatctattttaggcggacactcaacataatcctgcaattcatccccgagatgatttttatcctttgtctgtttggatacctcgtttttatgattatctttaagtggtgctgcttcgatgtgcacgtatcccagcacgccccaagtatcttgattcactttatcaacatgttcctattcaactatagcgattccagcaacgcacccctttacaaacatcagcaggaagtccagtcattcttcgtggtgatggctctcatttcagtgccatggatgctgctgattaaaccgtttatcctccgggcctcgcacagaaaaagccagctgcaggcctctcggatccaggaagacgccaccgagaatatcgaaggagattcctcaagtccgtcctcccgcagtggccagagaaccagtgctgacacacacggcgctcttgacgaccacggtgaggagtttaattttggcgatgtattcgtccaccaggccattcatacaattgagtattgtctcggttgcatttcaaacactgcatcttacctgagattgtgggcattgtctctggctcatgcccaactgtccgaggttctgtggactatggtcatgaacagcggcctgcagaccaggggatggggcggtattgtgggcgtgttcatcatctttgcggtctttgcggttctaacggttgctatactgcttattatggagggactaagcgctttcttgcatgcactgcgtcttcactgggtcgagtttcaaaacaagttctatgtaggggatgggtataaattcagcccgttcagtttcaaacatatcctagacggcacagcagaggagtag

SEQ ID NO: 109104 - DNA, 2523 bp, Artificial Sequence
  Description of Artificial Sequence: Synthetic coding sequence
atggtgagcgtgtttcgctccgaagagatgtgcctctcccagttgttcctgcaggtggaagcggcttattgctgcgtcgccgaactaggggagctcgggctcgtgcagttcaaagatctgaacatgaacgtaaatagcttccagcgcaagtttgtgaatgaggtacgacggtgcgagtcacttgagcggattctgaggttcttggaagatgagatgcaaaatgaaatcgttgtacagctgctcgaaaagagccccctgacgcccctcccgcgtgaaatgataactcttgaaactgtcctcgagaaactggaaggggaactacaggaagccaaccagaaccagcaggccctaaagcagtctttcttggagctgactgaactcaaatacctgctaaaaaagacccaggatttctttgaaacagaaaccaatttggccgatgacttctttactgaagacacctcaggtcttttggaactgaaggctgtcccggcatatatgactgggaagctcggctttatcgccggagtcatcaacagagaacgcatggcatccttcgagaggttgttgtggagaatctgccggggtaatgtgtatttgaaattttcagaaatggatgcacccctagaagacccagtgacaaaggaagaaatacagaagaacatctttataatcttttatcaaggcgaacagctgagacagaagatcaaaaaaatctgcgatgggttccgggcgacagtgtatccgtgccctgagccagcggtggagaggagggagatgctggaaagtgtgaacgtgaggcttgaggacttgataaccgtcatcactcagacagaaagtcacaggcaaagattgctacaggaggcagcagcaaactggcatagctggctgatcaaggtacagaagatgaaggccgtgtatcatatcctgaatatgtgtaacatcgacgtcacccagcagtgcgtcatcgccgagatttggtttccggtggcagatgcaacccgtatcaagagggccctggaacagggcatggagctgtccgggagctctatggcgccaataatgacgactgtgcagtcgaagactgcccctccaacgtttaacagaaccaataagtttacagcgggatttcaaaacattgtcgacgcctacggcgttgggagttatcgtgaaatcaatcctgcaccgtatacaattattaccttcccgttcctctttgccgtgatgtttggggactgcggacatggcacagtcatgttactggctgccctctggatgatattaaatgagcggagactgttgtctcagaaaaccgataatgagatctggaatactttcttccacggaagataccttatcctgctgatgggcatcttctctatctacaccggactgatctacaatgattgcttttctaagtctctgaatatctttgggtcttcatggagtgtgcagcccatgttccggaacggaacatggaatacccatgtcatggaagaaagtctgtacctacaactggatcctgcgatccctggagtgtattttgggaacccatatccattcggaattgaccctatttggaatctggcttcaaataagctcacattcctgaactcttataaaatgaagatgtccgtgatcctgggcattgtccagatggtgttcggtgtgatactctctctgtttaaccacatctatttcagacgcactctgaatatcatcctccagtttatcccggagatgatttttatcttatgcctgtttggatatctcgtctttatgataattttcaaatggtgctgtttcgatgtgcacgtttctcagcacgccccttccatactcattcacttcataaatatgtttctttttaattacagcgacagttctaatgccccgctatacaagcaccaacaggaagtacagtccttttttgtggtaatggctctgattagtgtgccttggatgctgctaataaagccgttcatcctccgagcgagccacaggaagtcacagttgcaggcctcccgcatccaggaggacgctacagagaatatcgaaggggactcatcatccccttcttcccgctcaggacagcgcacaagtgcggacacccacggagccctggacgaccacggtgaggagttcaattttggtgatgtatttgtgcatcaggccatacataccatcgagtactgtctagggtgtatcagcaataccgcgtcctacctcaggctgtgggctctctctttggctcacgcccagctgtcagaagtcctgtggacaatggttatgaattcgggcttgcaaactcgcggttggggggggatcgtcggggtgttcatcatcttcgctgtttttgcagtgctgacggtcgcaatcctgctgattatggaaggcctatccgccttcctgcacgctctgagattacattgggtcgaatttcaaaacaagttctacgtgggtgatggatacaagttttcaccatttagttttaaacatattcttgacggcacggccgaggaatag

SEQ ID NO: 109105 - DNA, 3108 bp, Artificial Sequence
  Description of Artificial Sequence: Synthetic coding sequence
atggggaaggccgagaactacgagctgtactctgtggagcttggaccagggcctgggggagacatggccgccaagatgtccaaaaagaaaaaagcaggcggaggcggaggcaaacggaaagagaaactcgaaaatatgaaaaaagaaatggaaattaacgaccatcagcttagtgtagcagaacttgagcagaaataccaaacgtctgctactaaaggcctgagtgcgagtcttgcagctgagctgctcctcagagatggccctaatgcacttcgtcctccgaggggaacacccgagtacgtgaaattcgcccggcaactggccggcgggctccaatgcctgatgtgggtggccgcagcaatatgtctcatagcattcgccatccaggcatctgaaggggacttaaccactgatgataatctgtacctggcgatcgccctgattgctgtagttgtggtaaccggctgcttcggctattaccaggagttcaagagcactaacataattgcttcttttaagaatctggtgccgcaacaagctactgtgattcgcgatggagataagttccagatcaacgccgatcaattggtggtcggcgatctggttgaaatgaagggaggggaccgtgttcctgcagacatccgtatactggccgcccaaggatgtaaggtagataactcaagcttaaccggcgaaagcgagccacagacgcggagtcccgagtgtactcacgaatccccgctggaaactcgcaatatagcctttttttctaccatgtgtctcgaaggtaccgtgcaaggattagtggtgaacacgggcgaccggactataatcggaaggatcgcttccctggcgagcggtgttgagaacgagaagaccccgattgcaatcgagatcgagcattttgtcgacattattgcaggtctggccatattatttggtgctaccttcttcatcgtcgccatgtgcattggatacacattcttgagagcaatggtattttttatggccatagtcgtggcctatgtcccagagggcctcctggcaactgtgacagtttgcctgagtctgaccgccaagcgtctggcgtctaagaattgtgtggttaagaatctagaagcagtagagacgcttgggagtacatcagtgatttgtagtgataaaaccggtacgctgacgcagaacagaatgaccgtgtctcatctgtggttcgacaaccatatccatacagccgataccaccgaggaccagagtggacaaacattcgatcagtcttctgaaacctggagggcactgtgccgcgtgctgacactgtgcaacagggctgccttcaagagtgggcaagacgccgttcctgttcctaagcggatcgtcatcggagatgcctctgagacagctctgctcaaattcagtgagttaacactggggaatgccatgggctacagagataggttccctaaagtctgcgagattccatttaacagtaccaacaagtttcagttgagcattcacactttggaagaccctcgtgacccccgccacttattagtgatgaagggagccccggagagggtgctggagcgatgcagctcgatactcattaaaggacaggagctacctctggacgaacagtggcgtgaagcttttcagactgcttatttgagcctaggcggcctgggagagagagttctggggttttgtcaactgtacctcaacgaaaaggactatcctccaggctacgcctttgacgtggaggccatgaacttccctagttctggcctctgtttcgccggactggtgtccatgatcgatcccccgcgggctaccgtccctgatgccgtgctgaagtgtagaacagctggcatccgcgtgattatggtaacaggcgatcaccccattactgctaaagctatcgcagcctccgtgggtatcatctcagagggatccgagaccgtagaggatattgccgcgcggttacgcgttcccgtcgatcaggtaaaccggaaagatgcacgcgcgtgcgttattaacggcatgcagctgaaggacatggacccatcggagctggtggaagcgctgcggactcatcccgaaatggtctttgcccggacgtcaccgcagcagaaactagtaattgtcgagtcttgccagcgcctaggcgctattgtagctgtaaccggggatggtgtcaacgactctcccgccctcaagaaggccgatattggagtggccatgggcatcgctgggtcagacgcagccaagaatgctgctgatatgatattactggacgataatttcgcaagcatcgtaaccggagtggaacagggccgtttaatttttgataacctgaagaaaagcatagcatatacattaacaaagaatatcccggagctgacaccttacttgatctacataactgtgtccgtgccactccccctcggatgtatcacaatattattcattgaactctgtaccgacatttttccctccgtatctctggcctacgagaaggcagaaagcgacattatgcacctgagacccagaaatccaaagagggaccgtttggttaatgagccattagcagcctattcttacttccaaattggagctatccagagtttcgcaggctttactgattatttcactgcaatggcccaggagggctggtttcctctgctctgtgtaggcctgcgtgctcagtgggaagatcatcacctccaagacctccaggactcctatgggcaagaatggacctttggacaacgcctataccagcagtacacctgctacaccgtctttttcatttcgatcgaggtctgccagattgccgacgttctgattagaaagaccagacgtttgtctgcattccagcaggggttctttcggaacaaaatcctcgttattgcaattgtcttccaggtttgcattgggtgcttcctctgttattgtcccggaatgcctaatatcttcaatttcatgcccattcgcttccagtggtggttagtgcccctgccatatggaatactaatttttgtgtatgatgaaattcggaaactgggggtgaggtgctgccctggttcctggtgggaccaggaactgtattattag

SEQ ID NO: 109106 - DNA, 876 bp, Artificial Sequence
  Description of Artificial Sequence: Synthetic coding sequence
atggcagctctgcaagaaaagaagacatgtggacagcgaatggaggagttccagcggtactgctggaaccccgatactgggcagatgctcggccggacactaagccggtgggtgtggatcagcctgtactacgtagcattctacgtggtgatgacaggcctgttcgcgctgtgtctgtacgtactcatgcagactgttgacccatacactccagactatcaggatcagctgcggtcccccggggtcactctgcgccctgatgtctatggcgagaagggactggagatcgtgtataacgtatccgataatagaacttgggccgatcttactcagactctgcacgcttttctcgctggatattcacctgcagcgcaagaggatagcattaactgtacctctgagcagtacttcttccaggagagttttagagctccaaaccacaccaaattctcctgtaaattcacagccgatatgctgcagaactgctctgggctcgcagatcctaactttggatttgaggagggcaaaccttgttttatcataaaaatgaatcggattgtaaaattcttaccctccaacggatctgcaccaagggtggactgcgccttcctcgatcaaccacgtgagctcggacagcccctgcaagtgaaatactacccccctaacggcactttctctctgcactattttccgtattatggtaagaaagcacagccccattattcaaatccacttgtggccgcaaaactgctgaatatccctcggaacgctgaagtggccatcgtgtgcaaggtcatggccgagcacgtgacttttaataatcctcatgatccatatgagggcaaagtggagtttaagctgaagattgaaaaatag

SEQ ID NO: 109107 - DNA, 1290 bp, Artificial Sequence
  Description of Artificial Sequence: Synthetic coding sequence
atgcagcttaggaaccccgaactccacttagggtgtgccctcgcccttagatttctcgcactggtctcttgggacatccctggcgcacgcgccctcgacaacggacttgcccgaactcccacaatgggctggctgcactgggagcgcttcatgtgcaacctcgactgtcaagaagagccagacagttgcatcagcgaaaagcttttcatggagatggcggaactaatggtgtcggaagggtggaaagacgcgggttatgaatacttatgcattgacgattgttggatggcaccacaaagggactccgagggaaggttacaggccgaccctcaacggtttcctcacgggattaggcagcttgcaaactatgtccactccaaaggcctcaaactgggtatttatgccgatgtcggaaacaaaacctgtgcaggctttcccggcagttttggatactatgatatagacgcccaaactttcgctgactggggtgtggatttattgaagttcgatgggtgttattgtgatagtctcgagaatctcgccgatggatataagcacatgtccctggccttgaaccgaacagggagatctatcgtttatagctgtgaatggcctctttacatgtggccatttcagaagcccaactatacggaaatcaggcagtattgtaaccactggcgcaacttcgctgacatcgacgattcctggaagtctattaaatcaattctggattggacaagtttcaaccaggagcgcatagtcgatgtagcaggcccaggtgggtggaatgatcccgatatgttggtgatcggtaatttcggactgtcatggaatcagcaggtgacccagatggcactgtgggccatcatggcagccccactgttcatgagtaatgatttgagacacatatcaccacaggcaaaggcccttttgcaggacaaagacgtcattgctataaaccaggatcctctcgggaagcagggctaccagttgcgccagggggacaactttgaagtgtgggagaggcccttgtccgggctcgcatgggctgtcgccatgatcaacagacaggagattgggggtcctcgttcctacactatcgcggtggcatcactgggcaagggcgttgcttgcaaccccgcctgttttatcactcagctcctcccggtcaagcggaaactgggcttctacgaatggacatccagattacggtctcatatcaaccccacaggaactgttctactgcagctagaaaataccatgcaaatgagcctgaaagatctactttag

SEQ ID NO: 109108 - DNA, 3120 bp, Artificial Sequence
  Description of Artificial Sequence: Synthetic coding sequence
atgcatcagaagacgcctgagatttacagcgtggagctgagtgggaccaaggatatagtcaaaaccgataaaggcgatggcaaggaaaagtatcggggtctgaaaaataactgccttgaattaaagaaaaaaaatcacaaagaagagtttcagaaggagcttcatctcgacgaccacaagttatccaacagggagctagaggaaaagtatggaaccgacattatcatgggactctctagcaccagggccgcagagctgctcgcccgggacgggcccaatagcctgaccccgcccaagcagactccagagatcgtgaagttcctgaaacagatggtgggcgggttcagtattctgctctgggtgggggccttcctgtgctggatagcttacgggattcagtactcctccgataagagcgcttccctgaacaatgtttatttggggtgcgttctaggactggttgttatcctgacgggtatctttgcgtattaccaggaggcaaaaagcacaaacattatgtcctcatttaacaagatgattcctcaacaagctttggtgatccgcgacagcgaaaagaagactattccttccgagcagctggttgtcggggacatcgttgaagtaaaagggggcgaccagatcccagctgacatcagggtcctttccagtcagggctgccgtgtagacaacagctccctcaccggtgagagtgagcctcagccaagatcaagtgagtttacacatgaaaacccgttggagaccaagaatatttgcttttacagcacaacatgccttgagggaacagtgacaggtatggtgatcaatacaggcgacaggacgatcatcggccacatagcatctctagcttctggcgtggggaatgagaagacccccatcgccatcgaaatcgaacacttcgtgcacatcgtggccggtgtggccgttagtatcggtatcctgttcttcatcattgccgtgtcccttaaatatcaggtcctggatagcataattttcctgattgggattattgttgcaaatgtgccagaggggctcctggctactgtcactgtgaccctctcgctgaccgcgaaacgcatggcaaagaaaaactgcctggtcaaaaatctggaggcagtagagacgttaggaagcacctcgattatttgcagcgataaaaccgggacactgactcagaataggatgactgtcgcacacctgtggttcgataaccagatctttgtggctgatacatccgaggaccattccaaccaggtgttcgaccagagctcccggacgtgggcctcactttctaagatcatcactctgtgcaatcgggccgagtttaaaccggggcaggaaaatgtgcctattatgaagaaagcagtgataggagatgctagcgaaacagctctgctgaagtttagtgaggtgattctgggagacgtcatggaaatcagaaaaaggaacagaaaggtggctgagattcccttcaacagcacaaacaagttccaattgtcaattcatgaaatggacgatccacacggcaagcggtttctcatggtgatgaagggtgctcctgagagaattctcgaaaagtgctccaccatcatgatcaacggagaggagcaccctctcgacaagtctaccgcgaaaacttttcacactgcttacatggagcttggtgggcttggggagcgcgtgcttggcttttgccacttgtacctgcctgcagacgagttccccgaaacatattcatttgatattgacgctatgaactttcccacaagtaatctgtgttttgtcggtcttctctccatgattgatcctccgagatccaccgtgcccgacgctgtaaccaaatgcaggtccgcaggcatcaaggtcattatggtcacaggagaccacccgatcacagcaaaagccatcgccaagagcgtcggcattatatccgctaatagtgagaccgtggaggatatcgcccacaggctgaatattgcggtcgaacaggtcaataaacgagacgccaaggccgccgtggtcacagggatggagctaaaagatatgtcaagtgaacagctcgacgagattctggccaattatcaggaaatcgtgttcgcacgcacttcccctcaacagaaactgattatcgtggaagggtgccagcggcaggacgcggtggtggcagttactggagatggcgttaatgattccccggccctaaaaaaagcagacatcgggattgccatgggcatcgccggttcggacgccgcgaagaatgcagctgacatggtgctgctggacgacaatttcgcaagcatcgtcacaggggtcgaagaaggacgtctgatttttgacaacctcaaaaagactatagcctactcacttacaaagaatattgctgaactgtgccccttcctgatctacatcatcgtcgggctcccactgccaattggaaccatcacgatcttgttcattgacttaggcaccgacattatcccttccattgcgctggcctacgaaaaagccgagtctgacattatgaaccgcaagcctcgtcacaaaaataaggataggcttgttaaccagccgctggccgtatattcctacttacatataggcctcatgcaggcccttggagcctttctcgtttacttcacagtgtacgcccaggagggatttctgccgcgaactttgatcaacctacgagtggaatgggagaaggattacgtgaatgacctcaaagattcctacggtcaggagtggacaagatatcagagagagtacctggaatggacagggtatactgccttcttcgtggggattctggtccaacaaatagcagatctcataattcggaagacaaggcggaacagtatatttcagcaggggcttttcaggaacaaggtgatctgggtcgggatcaccagccagatcatcatcggcctgatacttagctacggtctgggttcagtgacagcgttaagctttaccatgctgagggcccagtactggttcgtcgcagttccccatgctatactcatctgggtatatgatgaagttagaaaactttttattcggttgtacccaggctcatggtgggacaaaaacatgtactactag

SEQ ID NO: 109109 - DNA, 3072 bp, Artificial Sequence
  Description of Artificial Sequence: Synthetic coding sequence
atgggcaaaggcgttgggcgtgacaagtatgagcccgctgcagtgtctgagcagggtgacaaaaaggggaaaaaaggaaagaaagatcgtgacatggacgagctgaagaaagaggtttctatggacgatcataagctgagcttagacgagctccaccggaaatatggaactgacctgagtagaggcctcacctcagccagggcagctgaaatcctggcacgcgatgggcctaatgctctgacaccacctccaacaaccccagagtggatcaaattctgtaggcagctgtttggcgggttctccatgctgctctggatcggcgccattctttgttttctagcctatagcatacaggcggcaactgaagaggagccccagaacgataacctctacctgggagtggtgctcagtgccgtggtcattatcaccggctgcttttcttattatcaggaggctaagtctagtaagattatggagtcttttaagaatatggttccccagcaagccctggtgatccgaaacggggaaaaaatgagcataaatgctgaggaggttgtggttggtgacttggtggaagtgaagggaggcgatagaatccctgccgatttaagaataatctcagcaaatggctgcaaagtggataatagctctctgacaggggaatccgaaccacagacacggagtccagatttcacaaatgagaaccctctggaaacacgtaacatcgcatttttcagtaccaactgcgtcgaaggcaccgccagaggaatcgtggtgtatactggagacagaactgttatgggccgcatcgcaaccctagccagtggtctggagggaggccaaacccctattgcggctgagatcgagcacttcatccacattatcacaggggtagcagtgtttctgggcgtgagcttctttattctttctctaatcctggagtacacatggctggaggctgtcatctttctcataggcatcattgttgccaatgttccggagggacttctcgccaccgtaactgtatgcctgacactcactgccaaacgtatggcaaggaaaaactgccttgtgaagaaccttgaagcagttgaaactctggggtcaacatccaccatttgcagtgacaaaaccggtacactcactcaaaaccgtatgaccgttgctcacatgtggttcgataaccagatacacgaggctgataccacagaaaaccaaagcggagtgagcttcgataagacatcggccacctggcttgctctctccaggatcgctggcctctgtaaccgggcagtattccaggccaaccaggagaacttgcccattctgaaacgagccgtagctggagatgcctcagaatctgcgctgcttaaatgcattgaattatgctgcggcagcgtcaaggaaatgagggagcgttacgcgaaaattgtcgaaattccgtttaacagcactaataagtatcagctgtccatacacaagaatcccaacacctcggagccacagcacctgcttgtaatgaaaggcgctccagagcggattctggatcgatgttcctcgatcctcttgcacggtaaagagcagcccctggacgaggaactgaaggacgcctttcagaacgcctatctcgagttaggcggcctgggtgagcgcgtcctgggcttctgtcatctgttcttacccgatgagcaattcccggaaggcttccagttcgacaccgacgacgtgaatttcccgatagacaatctctgcttcgtgggcctgatcagtatgattgatccaccccgcgctgcggttccagatgctgtggggaaatgcagatccgctggaattaaagttattatggtgacaggcgatcacccgatcaccgctaaggctatcgcaaagggtgtgggcattattagtgagggtaatgaaacggtggaagacattgcggcccgcctcaatatccccgtatcgcaggtcaacccccgagacgccaaagcttgtgtggtgcacggctcagacctcaaagacatgacctccgaacagctagacgatatcctcaaataccacaccgaaattgtgtttgctcgcacctctcctcagcaaaagctgattatcgtggaggggtgtcagcgtcaaggagccattgtagccgtaaccggcgatggcgtcaacgactccccagccttgaaaaaggcggatataggcgttgccatgggaattgccggcagcgacgtgagtaagcaggcagccgacatgatccttcttgatgacaatttcgcgagcatcgtgaccggcgtagaggagggccgtctcatcttcgacaatcttaaaaaatctattgcttatactctcacatctaacatcccggagatcaccccatttctgatattcatcatagccaacatcccgttaccactagggaccgtgaccatcctgtgtatagaccttggaacagacatggttccagcaatctccctggcttacgaacaagcggagtccgatatcatgaagagacagccacggaacccaaaaactgacaagctcgtgaacgagagactgatttctatggcctatgggcagatcggaatgatccaggccttaggagggtttttcacttatttcgttatacttgcagaaaacggtttcttaccaatccacttactgggactgcgggtggattgggacgacagatggatcaacgacgtggaggacagctatggacagcaatggacgtatgaacagaggaaaatcgtggaatttacttgccacactgccttcttcgtttcgatcgtggtagttcaatgggccgatctggtaatctgtaaaacccgaagaaactctgtattccagcagggcatgaaaaacaagattctgatttttgggctgttcgaggaaaccgcattagccgcatttctgtcctactgcccaggtatgggcgtggcacttagaatgtaccctttaaaacctacatggtggttctgcgcgtttccatatagcctgcttatttttgtgtatgatgaggttagaaagctgatcattcgacgacgacctggcggatgggtggagaaggagacctactactag

SEQ ID NO: 109110 - DNA, 2043 bp, Artificial Sequence
  Description of Artificial Sequence: Synthetic coding sequence
ggtaaggaagtggggcgggataagtatgagccagccgctgtaagcgaacagggggataaaaagggcaagaagggcaagaaggaccgggatatggacgaactcaaaaaggaggtgtcaatggacgatcataaactcagccttgatgagctgcaccgcaaatacggaaccgacctgtcccgaggattaaccagcgcccgcgccgccgagatactcgctagggacggaccgaacgctctgacccctccccccacaacacccgagtggatcaaattctgtagacaactgtttggggggttctccatgctcctttggattggcgcgatcctgtgcttcctggcttatagtatacaggccgccaccgaagaggagccacagaatgataatctctacctgggggtcgtcctgtctgccgttgtgattatcacaggctgctttagttattatcaggaagcaaagagctccaagattatggaaagcttcaaaaacatggtcccccagcaggctctagtcatcaggaacggagagaagatgtcgattaatgccgaggaggtcgtggtcggggatcttgtggaagtgaaaggcggggatagaattccggccgacctaagaattatttctgccaacggttgcaaggtggataattcatcactgaccggtgagtccgagccccagacacgctctcccgattttacaaatgaaaacccattggaaaccaggaacatcgcgttttttagcacaaactgcgttgagggtactgctcgcggaatagttgtatatacaggcgacagaacagtgatgggacggatagcaactctggcctctggcttagagggaggtcagacaccgatcgcagccgagattgagcattttattcatatcattacaggggtggctgtattccttggcgttagcttcttcatcctatctctgatcctggaatatacatggttggaagcggtgatttttctgattggcatcattgtagctaatgtgccggagggtctactggccactgttactgtttgcctgaccctcacagctaagaggatggcccgcaagaactgccttgtgaagaatttggaggccgtggagacgctgggcagcacttctacgatctgctctgataagaccggaaccctgactcagaatagaatgaccgtggctcatatgtggttcgacaatcaaattcacgaagcagatactacagaaaatcagtcaggggtgtcattcgataaaacatctgcgacatggctggctctctctcgcatcgctggactctgcaatagagccgttttccaggctaaccaggagaaccttcctatcctgaagcgcgcagtggccggcgatgcatctgagtccgcactgttgaaatgtatcgagctgtgttgtggcagtgtgaaggagatgagggagcgctacgccaagatcgtggaaatcccttttaacagtaccaataagtaccaattatctattcacaagaacccaaatacatccgagccccagcatctattggtgatgaagggggcaccggagcgcatcctggacaggtgctcctccatcctcctccacggcaaggaacagccattggacgaggaactcaaggacgcgtttcagaacgcctatttagagcttggcggtcttggagagcgtgtattaggcttttgtcacctgtttctgccagacgagcagttccccgaagggttccagttcgacaccgatgacgttaattttcccattgacaatctgtgcttcgtgggactcatctcgatgatcgacccgcctcgcgccgcagtgcccgacgctgtaggcaagtgcaggtccgccggcatcaaagttattatggtgacaggcgatcatcccatcacagccaaggctattgctaagggggtcggcataatctccgaggggaacgagccgatgtcacgtgggaagtcgtggtctagtccagctacacagcctagttctagtgtgtcttggtggtgcagcggccccacttggtcttccgtgcggcctggcggcattaggagttcttcacggggatag

SEQ ID NO: 109111 - DNA, 435 bp, Artificial Sequence
  Description of Artificial Sequence: Synthetic coding sequence
atggatgaattaaaaaaggaggtgtccatggacgaccataaactgtcattggacgaattgcatagaaaatacgggacagatctgtctaggggtctcacaagcgccagagcagccgagatattggcgcgggatggacccaacgccctgacacccccacctacaacaccagaatggataaaattctgcaggcaactgttcggtggtttctctatgctcctgtggattggcgccatcctgtgtttcttggcttactccattcaggctgccactgaagaagaaccccaaaacgacaatctgtatttgggagttgtgctatcagcggttgttatcatcactggctgcttctcatactatcaggaggccaagtctagcaagatcatggagtcctttaaaaacatggttccgcagcaggctttggtgattcgaaatggctag

SEQ ID NO: 109112 - DNA, 2979 bp, Artificial Sequence
  Description of Artificial Sequence: Synthetic coding sequence
atggatgagctgaaaaaggaagtgtcaatggacgatcataaattgagtctcgacgagctccatagaaagtacgggacagaccttagtcggggccttacatctgcacgtgctgccgaaatcctcgcacgggacggtccgaacgctttaacacccccgcccacgacacccgagtggatcaaattctgtcgccaactgtttgggggattctctatgcttctgtggattggcgcaattctctgtttcctagcttattccattcaagctgccaccgaagaggaaccgcaaaacgacaatctctacctcggagttgtcctgtcagcggtggttatcattacagggtgtttctcatattatcaggaggccaaaagctctaagataatggaatctttcaaaaatatggtccctcagcaagcacttgtaattcgcaacggcgaaaaaatgagcataaatgccgaggaggtggtggtgggcgacctggtagaggtgaaaggaggcgaccggattcctgccgacctgaggattattagtgctaacggatgcaaggtcgacaatagttccctcacaggagaatctgaaccccagacaaggagccccgacttcacgaatgagaatccgttagagacccgcaatattgccttcttctcaacaaattgcgtggagggcaccgcccgcggtatagtggtgtacacaggtgaccggactgtgatgggtcgcattgctacactggcttcaggactggagggcgggcagactcccatcgcagcagagattgagcatttcatccatataatcacgggggtggccgtattcctgggtgttagcttttttattctgagcctgatcttggaatatacatggctggaggccgtgatttttcttattggcataatagtcgcgaacgtgcctgaaggtctgctggctacggtaacagtctgcctgactctgactgctaagagaatggcgcgcaagaactgcctggttaaaaacctggaagccgtcgagacactcggatctacttcaaccatctgttctgataaaaccggtacacttacgcagaacagaatgaccgtggcgcatatgtggttcgataaccagattcatgaggcggatacaactgagaatcagagcggcgtaagtttcgataaaacatccgctacatggcttgcactctcccgcatcgctggactttgcaatcgtgccgttttccaagcaaatcaggaaaatttacccatcctcaagagggcagtcgcaggagacgcaagcgagtcagcgttgttgaagtgcattgagctctgttgtggaagcgtgaaagagatgagagaacgatatgcaaagatcgttgagattccattcaattccactaacaaatatcagctcagtatccacaaaaatcccaacacatcagagcctcaacacctgcttgttatgaagggggcaccggaacggatcctcgatagatgctcttctattctcctgcacgggaaggagcaacccctggatgaggaattaaaagacgcattccagaacgcgtacctagaattaggcggcctgggcgaaagagtgctcggattttgccatctgttcttaccggatgaacaatttcctgaagggttccagtttgacacagacgatgtgaacttccccatagacaacctttgctttgttggcttgatctcaatgattgaccctcctagagctgctgttcctgatgcagtgggaaagtgcagatccgcgggcataaaagttatcatggtcacaggggatcatcccatcaccgccaaagctatcgcaaagggggtggggattatcagcgaagggaacgaaaccgtcgaagatattgccgcccgtttgaacattcctgtcagtcaagtaaatcctcgagacgctaaggcttgtgtagtgcacggctcagatctgaaggatatgacttcagaacagttggacgacattctgaagtatcataccgagatcgtatttgcccggacgtccccccagcaaaagctgataattgttgaaggatgccagcggcaaggagctattgttgcagtgactggcgacggggttaatgactccccagctctcaagaaggcagatatcggcgtagccatgggaatagccgggtctgacgtgtccaaacaagcggccgatatgatcctccttgatgacaacttcgcctcaatagtcaccggtgtggaagagggtaggttaatcttcgataacctcaagaagtcgatcgcttatactttgacaagcaacatacctgagattacaccttttctgatattcatcatcgccaacataccactaccgctggggaccgtgacaattctctgtattgacctggggactgatatggtcccggcaattagtcttgcctacgagcaggcagaatctgacattatgaaacgccaacccaggaatcctaagacagacaagctggtgaatgagaggctcatttcgatggcctacggccagattggcatgatccaggccctggggggattcttcacctacttcgtcatactggctgagaatggattcctgccaatccatttgttgggtctgcgggtcgactgggacgacaggtggattaacgatgtagaggacagttatggacagcagtggacttacgagcagcgcaagatcgttgaattcacctgccacaccgcattcttcgtatcgatcgtggtggtgcagtgggccgatctggtaatctgcaagaccaggcgtaactcagtgttccagcaggggatgaagaacaagatattgatctttggccttttcgaagaaaccgccctcgccgcatttctaagttattgcccaggcatgggggttgccctgagaatgtacccattgaaacccacatggtggttctgcgcgttcccatactccctactgatcttcgtttacgacgaggtgaggaaactgattataagaaggcggcccggagggtgggtggaaaaagagacatactattag

SEQ ID NO: 109113 - DNA, 321 bp, Artificial Sequence
  Description of Artificial Sequence: Synthetic coding sequence
atggacgaactcaaaaaggaagtgagtatggacgatcacaagttgtcgttggatgaactccacaggaagtatggcaccgacctcagtaggggactgacgagcgcacgggccgcagagattctcgccagagatggtcccaacgcgctgacaccgccccctactacccccgaatggatcaaattctgtagacagctcttcggtggattttccatgttgctgtggatcggagcaatcctctgctttttggcctactccatccaggccgctacagaggaagagccgcaaaatgataacttatacctgggcgtggtactgagttag

SEQ ID NO: 109114 - DNA, 474 bp, Artificial Sequence
  Description of Artificial Sequence: Synthetic coding sequence
cgtcagccccggaacccaaagaccgacaagctggtcaatgagagactgatctctatggcatatggccagatcgggatgatccaggccttggggggatttttcacatacttcgtgatccttgcagaaaatggattccttcctatccatctcctgggacttagggtggactgggacgatcgctggatcaacgacgtcgaagactcttacgggcagcagtggacctatgagcagcgtaagatcgtcgagttcacttgtcacactgccttttttgtttcgatcgtggtcgtgcagtgggccgacctggttatttgcaaaacaagacgcaatagtgtgtttcagcagggcatgaaaaacaagatcctaatctttggcttattcgaggaaaccgccctggccgcctttctgtcatattgcccagggatgggcgtcgcactacggatgtaccctttaaaaaccttgacacagtatagttag

SEQ ID NO: 109115 - DNA, 480 bp, Artificial Sequence
  Description of Artificial Sequence: Synthetic coding sequence
atgaagaggcaaccaagaaaccccaagacagacaagcttgtaaatgagagactgatttctatggcttacggtcagattggtatgattcaagccctggggggattctttacctattttgtcatcctcgcagagaacggctttcttcctatacacttacttgggctgcgcgtggactgggatgatcgctggattaatgacgtggaagacagctatggacaacagtggacttacgagcagcgcaaaatcgttgaatttacctgtcacacagctttctttgtcagcatcgtcgttgttcaatgggccgatctcgttatctgtaagactaggaggaattctgtgttccagcaggggatgaaaaataaaatattgatatttggactgtttgaggagaccgctcttgccgcctttctctcgtattgcccggggatgggagtggccctgaggatgtatcccttgaagactctgacccagtattcttag

SEQ ID NO: 109116 - DNA, 3072 bp, Artificial Sequence
  Description of Artificial Sequence: Synthetic coding sequence
atggcgttcaaggtcggccgggataagtacgagcccgctgctgtttctgagcagggggacaagaaaggaaagaagggcaaaaaggatagggacatggatgaattgaaaaaggaggttagtatggacgatcacaaattgagcttagacgagctccaccggaagtacgggaccgacctgtcccgggggcttacaagcgcccgagccgcagagattctcgcacgagacggacccaacgccttgacccctccacctactaccccagagtggattaaattctgtcgtcagttgttcggaggattttctatgctcctgtggatcggcgccattctgtgcttcctggcctactcaatccaggctgccactgaagaagagccacagaacgataatctgtacctgggggtggtgctatccgctgtggtgattatcaccggttgctttagctactatcaggaagctaagagcagcaagatcatggagtcgtttaagaatatggtaccacagcaggctcttgtgattagaaacggggagaaaatgtccattaatgcagaagaggtggttgtcggggatctggtggaagtcaaaggcggtgatcgaatcccagcagacttaaggatcattagcgctaatggctgtaaagttgataatagctccctcacaggagaaagtgaaccacagacaagatctcccgattttactaatgagaatcccctcgaaaccagaaacattgcttttttttccactaattgtgtggagggtactgccagaggcatcgtggtctataccggagaccggactgtgatgggcagaattgccacccttgctagcggtttggaaggtgggcagacgccaattgctgccgagatagaacatttcatccatattatcactggagtcgccgtcttccttggagttagcttctttattttaagtctaattctggagtatacctggctcgaagccgtaatctttctgatcggaattatcgtagccaacgtcccggagggattattggccactgtgaccgtgtgtttgacacttactgccaagaggatggcccgaaaaaactgccttgtgaagaacctggaggccgtggagactctgggaagcacttccaccatctgttccgataagacaggtaccctcacgcagaatcggatgaccgtggctcatatgtggttcgacaatcagattcacgaagccgataccaccgaaaaccagtctggagtttcattcgacaaaacatccgctacgtggttagccctaagcagaattgctggtctctgcaaccgtgccgttttccaggccaaccaagagaacttgcccattctgaagcgagccgtggctggagacgccagtgagagcgcccttttaaaatgcattgagctctgctgtggcagcgtcaaggagatgcgggagagatacgccaaaatcgttgagattccctttaattctacaaacaagtaccagttgtccattcacaaaaaccccaatacatccgaaccacagcatctcctcgtaatgaagggtgcccccgagcgaattctcgataggtgcagttctatcttactgcatggaaaagagcagcctctggacgaagagcttaaggatgctttccagaacgcttacttggagctcggcgggttgggagaaagggtcttaggattctgccaccttttcctcccagacgaacagtttcccgaagggtttcaattcgataccgatgacgtcaatttcccaatagataacctgtgtttcgttggactaattagtatgattgatcctccacgagcagccgtgcccgacgcagtgggcaagtgtcggtccgcgggcataaaagtgatcatggttacaggcgaccatccgatcaccgcgaaggctatagcgaaaggagtgggtataatctccgaggggaatgagaccgtagaagatatcgccgcccgacttaacattcctgtgtctcaggtgaatcctcgagacgctaaggcctgtgtagtacacggctctgacttgaaggacatgacctccgagcagttagatgatatcctgaaataccacacggagatcgtcttcgctagaacatccccccagcagaagctgataatagtcgagggctgccagcggcaaggagcgatcgtggcagtcacaggggatggcgtgaatgactcaccagcactgaaaaaagccgacattggggtggccatgggtatcgccgggagtgacgtgtctaagcaggcagcagacatgatccttctggatgataatttcgcaagtatcgtcaccggggtggaagaagggcgattaattttcgacaacctgaaaaagtcgatcgcctatacgctcacttctaatattcccgagatcacacctttcttgatattcattatagccaacattcctctgccgctcggcaccgtaaccatactgtgcatcgatctcggcaccgatatggtcccagcaatctccttggcctatgagcaagccgaatctgatatcatgaaacggcagcccaggaatcccaagactgacaagctcgtgaatgagaggctaattagtatggcttacgggcaaattggcatgattcaagccttgggaggttttttcacctatttcgtgatattagctgagaacggtttcctgccaattcacctgctgggcctgcgagtcgattgggatgatagatggatcaacgatgtggaggactcttatggtcagcagtggacctacgagcagagaaaaattgtggaattcacttgtcacaccgcttttttcgtgagtatcgtggtcgtgcaatgggcggacttagtgatctgcaaaaccagaagaaatagtgtgttccagcagggcatgaaaaataagattctgatttttggcctgttcgaagagactgccctcgccgcttttttaagttattgccctggaatgggtgttgctcttcgaatgtatcccttgaagcctacctggtggttttgtgcgtttccttacagcctactgatcttcgtgtacgacgaggtaagaaagctgattattagacgtcggcctggtgggtgggtcgagaaggaaacatactactag

SEQ ID NO: 109117 - DNA, 3063 bp, Artificial Sequence
  Description of Artificial Sequence: Synthetic coding sequence
atgggcaggggcgccggtcgcgaatacagcccggccgctaccaccgccgaaaatggaggtgggaagaagaagcagaaggagaaagagctagacgaattaaagaaagaggtcgcgatggatgaccataaactgtctctggacgagctgggcaggaaatatcaggtcgacctctctaaggggcttactaatcagcgcgcccaagacgtgctcgccagagacggaccgaatgccctgacccctccaccgaccacccctgaatgggttaagttttgtaggcagctgtttggcgggtttagcatcctattgtggatcggcgccatactgtgtttcctggcctacggcatccaagcagccatggaagatgaaccatccaatgataatctctacctgggagtggtcctagctgcggttgttatcgtgacgggctgcttctcatattaccaagaagcaaagtctagcaagattatggatagctttaagaacatggtgcctcagcaggcccttgtcattagggaaggcgagaaaatgcagatcaacgccgaggaggtggttgtgggggatttggtggaagtgaaggggggagacagagtgccggccgacttgcggatcattagttcccatgggtgtaaggttgacaactcgagcttaactggggagtctgaacctcaaactcgttctcctgagttcacacacgaaaatccactggagacacgaaatatctgttttttcagcacgaattgtgtggagggtacagctcggggcatcgtcatcgcaaccggtgacaggacggtgatgggacgcattgcgaccctcgctagtgggctcgaggtcggcaggactcctatagctatggagatcgagcacttcatccagctgataacaggcgtggcagtgttcctaggagtatccttttttgtgctctccttgatcctgggatactcttggctggaggctgtgatttttctgatcgggattatagtcgcgaacgtccctgagggcctcctggcgaccgttaccgtctgtctgaccctgactgccaagcgtatggcgagaaaaaattgcctggtgaaaaatctggaggccgttgaaactctgggcagcacttcaaccatctgctcggataagacggggacactgacacagaacagaatgacagtggctcacatgtggttcgacaaccagatccatgaagctgacaccacggaggaccagtctggtgccacgtttgacaagcgcagccccacctggacagccctgtctcgcatcgccggactttgcaaccgcgcagtgtttaaggcgggacaggaaaatatcagcgtgtcaaagagagataccgccggagatgcgtctgaaagtgcactgttgaagtgtattgaattgtcctgcgggtccgttaggaagatgcgcgacagaaatcccaaagttgccgaaatcccctttaactctacaaacaagtaccagctcagcatccatgagagggaggacagtcctcagagccacgtgttggtgatgaagggggcacctgagcggattctcgaccgatgctcgacaatcttggtgcaaggcaaggagattcctctggacaaagaaatgcaggatgcattccagaatgcctacatggagctcggcggcctgggtgaacgtgttctcggcttctgccagcttaatctcccctccggcaagttccctagaggtttcaaattcgataccgacgaactgaatttccctactgaaaaattgtgctttgttggcctcatgtccatgatcgacccacccagagctgccgtgcccgacgcagtcggaaaatgccgttccgccggtatcaaggtgatcatggtaacaggggaccaccccatcaccgcaaaagccattgctaagggggtagggattatcagcgaaggaaacgagacagtcgaggacatcgccgcgcgcctaaatataccaatgagccaggtgaacccgcgtgaggcaaaggcatgtgttgtccatggttcggacctgaaggacatgacctcagaacagctggatgagatactgaagaatcataccgaaatcgtttttgctaggacgtcccctcagcagaagctaatcatagtcgagggctgccagagacaaggcgctatcgtggcagtgacgggtgacggggttaacgacagtcctgcactcaaaaaagctgacataggcattgctatgggtatttccgggtctgatgtcagcaaacaggcagcagacatgattttgttggacgacaactttgcctcaatcgtgaccggcgtcgaagagggcaggctgatctttgacaacttgaaaaaatctatcgcttacactttaacgtccaatatacccgaaatcacaccttttctactgttcatcattgccaacatccccctacctctgggtacagtgaccattctgtgtatcgacttggggaccgatatggtaccggccattagcctcgcatacgaagcggcagaatcagacataatgaagcgccaacccaggaatagccagaccgacaaacttgtcaacgagcgcttgatcagcatggcatacgggcagatcggcatgatacaggcactaggcggtttctttacttatttcgtgattttggcggagaatggatttctgccctctcgcctactggggattcggttggactgggatgaccgcaccatgaatgatctagaagattcatacggacaggaatggacctatgagcagagaaaagtcgtggaattcacttgtcacaccgccttctttgcttccatcgtggtggtgcagtgggcggatttaattatctgcaaaactcgtcgtaattccgtatttcaacagggtatgaagaacaaaatactaatctttgggctattagaggaaaccgcccttgccgccttcctctcgtactgcccagggatgggcgttgctctgcgcatgtaccctctcaaggtgacctggtggttctgcgcctttccctacagcctcctgattttcatttacgacgaggtgcgcaaattgattcttagaaggtatcccggtggatgggttgaaaaggaaacatactactag

SEQ ID NO: 109118 - DNA, 3030 bp, Artificial Sequence
  Description of Artificial Sequence: Synthetic coding sequence
atgggtagaggggccgggcgagagtacagtcccgccgccacaacagctgagaacggggggggcaaaaagaaacagaaagagaaggaactggacgaattaaaaaaggaggtggcgatggatgaccataagttgtccctggacgaacttggtcgaaaatatcaggtcgacctctcgaaggggctcaccaaccagagagcccaagatgttctggcccgtgatgggccgaatgcgctgacacccccacccactacccccgagtgggtgaagttctgccgtcagttgtttggaggcttctctatacttctctggattggcgccattctctgcttcctggcctatggcatacaggccgctatggaggacgaaccatctaatgataacctttatctaggcgtagtcttagctgccgtggtgatcgtgaccggatgttttagttattatcaggaagcgaagtcgtcgaaaattatggacagcttcaagaatatggtaccccagcaagccctggttataagggagggagagaagatgcagatcaacgcagaggaagttgtcgtgggtgatttggtggaggtaaagggtggagatcgggtccccgctgacctcagaatcattagctctcacggctgcaaggttgacaacagctctcttactggggaatccgaacctcagacaagatctcccgaatttacccatgagaatccactcgagacccggaacatttgctttttttcgacgaattgtgttgaggggacagccaggggcattgtgatcgctaccggagaccggacagtaatggggcgtattgcgaccctggcctcggggctggaggtggggcgcacaccgatcgcaatggaaattgagcattttatccaactgattacaggtgtggccgtgttcctcggcgtgagtttctttgtcctaagcctaattctaggctattcatggctcgaggctgtcatcttcctgatcggcattatcgttgcaaatgtgcctgagggcttgctggctacagtaacagtgtgcctgactttgaccgccaagcggatggccagaaagaactgtctggtgaaaaatcttgaggccgtggagaccttaggctccacttcgaccatctgctccgacaagactggtactcttacccagaatcgcatgaccgtcgcacacatgtggtttgacaatcagatacacgaagccgacacaaccgaagaccagtccggcgccacatttgataaaagaagtccaacgtggaccgcgctaagcagaattgccggcttgtgtaacagagccgtgtttaaagccggccaggaaaacatctctgtgtccaagagagatacagccggagacgcatcagagagtgccctcctgaagtgcattgaactgtcttgtggcagcgtgagaaaaatgcgggacagaaacccaaaagtggccgagattccctttaatagtacaaacaagtatcaattgtccatacacgaacgagaggattctccacagtcccacgtcctcgtcatgaagggcgctccagagcgcatcctggaccggtgttcaaccatcctggtccaggggaaagagatccccttggacaaggagatgcaggatgcctttcaaaatgcgtatatggaattgggggggttgggggagagagttttgggattttgccagttaaatcttccctctggcaagtttccacggggcttcaaattcgacactgacgagctgaattttcccaccgaaaagctgtgctttgtaggcttgatgtccatgattgatcctccacgggccgccgtcccagacgctgtgggaaaatgtcggtctgctggcatcaaggtcattatggttaccggggaccatccgatcaccgctaaggctatcgccaagggagtggggatcataagcgagggcaatgaaaccgtggaggacatcgccgcacgactgaacattcccatgtcccaggtgaacccccgcgaggcaaaggcctgcgtggtgcacggctcagacctgaaagacatgacaagcgaacagctggacgaaattctgaaaaatcacaccgagatcgtcttcgcccggacatccccacagcagaagctgataatcgtggaggggtgtcaacgccagggggcaatcgtcgctgtgaccggtgacggcgtgaatgatagcccagcattgaagaaggctgacatcggaatagccatgggtatctccggttcggatgtttcgaaacaagcagcggacatgatcctgctggacgacaacttcgctagtatcgtgaccggcgtcgaggagggccgccttatcttcgacaatttgaaaaaaagtattgcgtacaccctgacaagtaacattcccgaaatcaccccctttttactgtttattatcgctaacattccactaccactgggtaccgtgaccattctgtgtatagacctgggcacagacatggtgccagccatatcactggcctacgaggctgctgagtctgacatcatgaagcgacagcctagaaactctcagacagacaagcttgtcaatgagcggcttatcagtatggcctatggtcagatcggcatgatccaggccctgggggggttctttacgtacttcgtaattctggccgagaatggcttcctacctagccgtctgctgggaattcggctggactgggacgaccggacaatgaatgacctagaagatagctacggacaggagtggacatacgaacagcggaaagtggtggagtttacgtgtcacaccgctttcttcgccagcattgtggtggtgcagtgggccgatctcatcatttgtaaaacaaggcggaactccgtgttccagcaagggatgaagaacaagatacttatctttggccttcttgaggagaccgctcttgcggccttcttgagttactgtccaggtatgggagtggccctgcgcatgtatccgctgaatctcttgatattcatctacgatgaggtgcgaaagctgatcctgcggcggtaccctgggggctgggttgagaaggagacctactattag

SEQ ID NO: 109119 - DNA, 2172 bp, Artificial Sequence
  Description of Artificial Sequence: Synthetic coding sequence
atgctgtcctccgcactggccttgagtggagcgctggtcaagcgtctcaagcctcccaatggacactttattctgactgacacccacgatctcaacaccagtaagattgagcactctctgttcacggtttgtctcaccctcaccgccaaaaggatggcgaggaaaaactgtttagtcaagaacttggaggcagtagaaacattaggaagcacctcaaccatctgtagtgacaaaactggtacccttactcagaatcggatgacagttgcacacatgtggtttgacaaccagatacatgaagcagataccactgaagatcagagcggggctacctttgacaaaagaagtcctacatggacagcactgagccggattgcaggcctgtgtaaccgcgctgtgtttaaggccggccaagaaaacattagcgtatcaaagagggataccgccggtgacgcttctgagagtgcacttctgaagtgcattgagctctcctgtggctctgtgcggaaaatgagggacagaaatccaaaggtcgccgaaatccccttcaacagcaccaataagtatcagctcagcattcatgaacgggaggatagcccacagagccatgttttggtgatgaaaggggcccccgagcggatacttgacaggtgcagtacaatcttagtccaggggaaggaaatacccctcgataaggaaatgcaagacgcttttcagaacgcctacatggaactcggggggctcggagagcgcgtcctgggcttttgccaattaaacttgccatctggcaagttcccacgcggattcaaattcgataccgacgagctgaactttcccactgaaaagctgtgcttcgtgggccttatgagcatgatcgatcctcctagggcggccgtccccgatgcagtgggcaagtgccggtcagccggcattaaggttataatggtcacgggagatcacccgattaccgccaaggccatcgccaagggcgtgggtatcatctccgagggaaacgaaactgtggaagatatcgccgcccgactaaatatccccatgtcccaggtgaatccccgcgaggccaaagcatgcgtggttcacggcagcgacctgaaagatatgaccagtgaacagctggatgaaatcctcaagaaccacacagaaatcgtgtttgctagaacatcccctcagcaaaaattgattatcgtggaaggttgccagaggcaaggcgctatcgtcgcagtaaccggagacggcgttaatgatagtcccgccctgaaaaaagccgatattggaatcgcaatgggtatatccggtagcgatgtgagcaagcaggcagcagatatgattctgttagatgataacttcgcctcgatcgttactggagtggaagaggggcgccttatcttcgacaatcttaagaaatccatcgcatacactctgacctcaaacataccagagatcacccccttcctgctgttcatcatcgcaaacataccccttccgcttggaacagtgacaatcctctgcattgacctagggaccgatatggtccctgcgatttctttagcctacgaggccgctgaatccgacatcatgaaaagacagcccaggaacagccagaccgacaagttggttaacgaacgcctgatctctatggcatatggacagattgggatgatccaggccctggggggcttcttcacttactttgtgattctagccgagaatggcttcctgccctcaagattactgggaatccgattggactgggatgaccggactatgaacgatctggaggatagctatgggcaggaatggacgtatgagcagcgcaaggtcgtggagttcacttgtcacacggctttctttgccagcatcgtggtggttcagtgggccgatcttataatatgcaaaactcgccgaaactctgtcttccaacagggcatgaagaacaaaatcctgatattcggcctccttgaggagacagcactggcggccttcttatcatactgccctggcatgggagtagcgctgaggatgtaccctctaaaagttacatggtggttttgcgctttcccctactcattacttattttcatttacgatgaagtgaggaagttaatcttacgaaggtatcctggcggctgggtcgagaaagaaacctattactag

SEQ ID NO: 109120 - DNA, 2145 bp, Artificial Sequence
  Description of Artificial Sequence: Synthetic coding sequence
tgacaactcataactggcgtggctgtctttctgggcgtgagcttcttcgtgttatccctgatcttggggtacagctggcttgaggctgtcattttcttgattgggatcatagtagccaatgttcccgaagggcttttagcaactgtcaccgtgtgtctcaccctgactgctaaacgcatggccagaaagaactgtcttgttaaaaacctggaagccgtcgaaacgctgggcagcactagcacaatttgctctgataaaacaggcacattgacccagaatcggatgacagtggcacacatgtggttcgacaaccagatccacgaggctgacaccacagaggatcagagtggagccacttttgataaacgttcccccacttggaccgctctttctagaatcgctgggttgtgtaatcgagctgtcttcaaggccggtcaggagaacatttcagtctccaagcgcgatactgctggtgatgcctcagaatctgcccttctcaaatgtattgagttgagttgcgggagcgttagaaaaatgcgggaccgcaaccccaaggtcgccgaaatcccgttcaacagtaccaacaagtaccagctctctattcacgaacgtgaggactcaccccagagtcacgttttggtgatgaaaggagcccctgaacgcatactggaccgatgcagcacgatcctagtgcaaggaaaggagattcctcttgataaggaaatgcaggatgcgttccagaacgcctatatggagctgggggggctgggcgaacgggtgttagggttttgccagttgaacctgccatcaggtaagtttcctcgagggtttaaatttgacactgacgaactcaatttccctacagaaaaattatgctttgtgggtttaatgtccatgattgatcctcctcgcgccgcagtgcccgacgcagtgggaaagtgtcgaagcgcaggcataaaagtgattatggtcacgggcgaccatcccatcaccgccaaagcgattgctaagggggtggggattatcagtgaaggcaacgaaaccgtggaagatattgcagctaggcttaatatccccatgtctcaagtcaatccacgggaggcgaaggcctgtgtggttcacgggtccgatctgaaagacatgacctctgagcagcttgatgagatactgaagaaccacactgaaattgtgtttgctcgtaccagtccacaacagaagctgatcatcgtggagggttgtcaaagacaaggagctatagtcgctgtaaccggggatggagttaacgattctccggctctgaaaaaagctgacataggcatcgctatgggcattagcgggagtgacgtaagtaagcaggccgctgacatgatccttctggatgataattttgcctcaatcgtaactggagtcgaggagggacgacttatttttgacaaccttaagaaaagcatagcatatactctgacctcaaatatccccgaaatcaccccctttctgcttttcataattgctaatatcccactacctctcggaacggtgacaattctgtgtattgatctcggcacagatatggttccagccataagcctggcctacgaggccgccgaatccgacatcatgaagcgccaaccccggaattcccagaccgacaagttggtgaacgagaggctgatctcgatggcttatggccagatcgaaaatggctttctgcctagccgcctgctcggaatcaggctggattgggacgataggacgatgaatgatttagaggacagctatggccaggagtggacatacgagcagcggaaagttgtcgaattcacctgtcacacagcctttttcgcatccatcgtggtggtgcagtgggcggatttaatcatatgtaagacacgccgtaatagtgtgtttcagcaaggcatgaaaaataagatccttatttttggcctgctcgaggaaactgcgttggctgcattcctgtcatactgccctggcatgggcgttgccctgcgtatgtacccgcttaaagtgacctggtggttctgtgcgttcccatatagtctactgatattcatctatgatgaggttcgcaaactcatccttcgtcgctatccaggaggctgggtcgagaaagagacttactactag

SEQ ID NO: 109121 - DNA, 819 bp, Artificial Sequence
  Description of Artificial Sequence: Synthetic coding sequence
atggactctttcaagaacatggtgcctcagcaggcgcttgtcattcgagagggagagaagatgcagatcaatgccgaagaagtggtggtgggtgatttggtagaggtgaaaggaggggatcgagttccagcagatttgcgtattatttcaagccatgggtgcaaagtcgacaattcaagcctgaccggtgagagcgagccccagacgcgcagcccagagtttacgcacgagaaccctctggagactcggaatatctgtttcttctccaccaactgtgtcgagggaaccgctcgcgggattgttattgctacaggcgatagaaccgtgatgggccggatcgccactctggcgtccggacttgaggtggggagaaccccaattgccatggaaattgagcacttcatacagctcattaccggtgtggcggtatttctcggcgtttctttttttgtgctcagtcttatacttgggtattcctggttggaggccgttatcttcttaatcggaataattgtagccaacgtgcccgagggactcctcgccacggtaaccgtgtgcctgacacttaccgctaagcgcatggccaggaaaaattgtctggtcaaaaatctcgaggcagtggagacattaggatccactagtaccatatgttctgataaaactgggacactcacccaaaatcgcatgacagttgcccacatgtggttcgacaatcagatacacgaagctgatacgaccgaggaccaatcaggcgattgggtgttgcaaagaggttggatcggcctggaagaggcggaaggatcgggggtggttggttag

SEQ ID NO: 109122 - DNA, 3042 bp, Artificial Sequence
  Description of Artificial Sequence: Synthetic coding sequence
atgggtgacaagaaggatgataaggacagccccaagaaaaataagggcaaggaacgtcgggacctcgatgacctgaagaaggaagtggcaatgacagagcataaaatgagcgtggaggaggtgtgcagaaagtacaacaccgattgtgtacagggtttaacccacagtaaggctcaggaaattctcgcaagggatggcccaaatgcactgacccccccacctaccacccccgaatgggttaaattttgccgacagctgttcggaggtttttcaattctgctgtggatcggtgccattctgtgctttttggcatatggaattcaggctggtaccgaggacgacccgtctggcgacaatctctatttgggcattgtcttggctgctgttgtgatcataacaggatgcttctcatattatcaggaggccaagagctctaagatcatggaatccttcaagaatatggttccccagcaggccctggtcataagggagggggagaagatgcaggtgaacgccgaagaggttgttgtgggagacctcgtcgaaatcaagggaggtgacagagtgcctgcggatctgcgtataatcagcgcccatggctgcaaggttgacaactcctctcttacaggcgaaagcgaaccacaaaccagatcacctgattgtactcacgacaatccgctagagacaagaaacatcacctttttctccactaattgtgtggagggcactgctaggggcgtggtagtcgcgactggagaccggacagtgatgggcaggatcgcaactctggctagcggtctggaggttggtaagactcccatagcgattgaaattgaacattttatacagctcatcacaggggtcgctgtctttcttggtgtgtccttcttcatactgtctctgattttgggctacacttggttagaggccgtcatattcttgatcggtataatagtggctaacgtacctgagggtctgctagccacggtaacggtctgtctaacactgacagcgaagaggatggccaggaaaaattgtctggtgaagaatctggaggcagtggagactctcggtagtacgtcaaccatctgctctgacaagaccgggacgctcacacagaaccggatgacagtagcccacatgtggttcgataaccaaattcacgaagccgacactaccgaggaccagtctgggacatctttcgataaaagcagtcacacctgggttgctctcagtcatattgcaggtttatgcaaccgtgctgtcttcaagggcgggcaggacaacattccagtgctcaaacgggatgtagccggtgacgcgtcagaaagtgctttgttaaagtgcatcgagctgtcatccggttctgtgaagctgatgcgcgagcgcaataaaaaggtcgctgaaattccatttaactctacaaataaataccagctgagcattcacgagacggaagacccaaacgacaatagatatctcctcgtgatgaaaggggcaccagaacgaatcctggaccggtgttctaccatactcctccaaggcaaggaacaaccgttggatgaggagatgaaagaggcctttcagaacgcctatcttgagctggggggcctgggagaaagggtgctgggcttttgtcactattatctacctgaggaacaatttcccaagggctttgcttttgactgtgacgatgtgaatttcaccacagacaacctctgcttcgtgggactgatgtcgatgattgaccctccaagggctgcagtccccgatgcagttggaaagtgcagaagcgccggcatcaaagttattatggtgactggcgaccatccaataaccgccaaggccattgcaaagggcgtgggaataattagtgaagggaacgagaccgtggaggacatagctgcccgtctcaacattccagtgagtcaagtgaatccaagagacgctaaggcgtgtgttatccacggaactgacctgaaggattttactagtgaacagattgacgaaatcctccagaatcacaccgagattgtatttgcaagaacatcccctcagcaaaagctgatcatcgtagaagggtgccagagacagggcgccatcgtggcagtgacaggggatggcgttaacgacagccctgccttgaaaaaagctgacatcggtgtcgccatgggcatcgcaggctccgatgtatctaagcaagccgccgacatgatcctccttgacgataacttcgcatccatcgttacaggcgtagaagagggaagactgatcttcgataatcttaaaaagagcatagcatacaccctgacctctaacattcccgaaattaccccattcctgctcttcatcatggctaacattcccttaccattgggaaccattacaattctctgcatcgatttgggtactgacatggtccctgccatttccctggcatacgaggcagctgagtccgacataatgaagagacagcccagaaatcctagaactgacaaattagtgaatgagagacttatatccatggcatacggacagatcggcatgatccaggcacttggggggttcttttcctacttcgtgatcttggccgagaacggatttcttccagggaatttggtgggcatcagactgaactgggatgacaggacggttaatgacctggaggacagctacggacagcagtggacttatgaacaaagaaaggtggtagaattcacgtgccataccgcatttttcgtgagtatcgtggttgtccagtgggccgatctgatcatatgtaagactcgcagaaatagtgtgttccagcagggaatgaaaaataaaatcttgatcttcgggctgtttgaggagacagcattggcggctttcttaagttattgcccgggcatggacgtcgcactgcggatgtaccccctgaaaccaagctggtggttttgcgcgtttccatatagtttcttgatatttgtgtatgatgaaattcgaaagctgattctgcggaggaatcctggcggatgggtcgagaaagaaacctactattag

SEQ ID NO: 109123 - DNA, 2952 bp, Artificial Sequence
  Description of Artificial Sequence: Synthetic coding sequence
atgaccgaacataaaatgtctgtggaagaagtttgccgaaaatacaataccgattgcgtgcagggcttaacccacagtaaggcccaagaaatacttgcccgagacggtcccaatgccctcacacctccaccaactactccagagtgggtgaaattttgcagacagctgtttggcggatttagtatcttgctatggatcggcgcaattctgtgctttctggcctacggcatccaagcaggcacagaggacgacccatcgggcgacaatctgtacctgggaattgtgttggcggccgtagtcatcattacaggctgctttagttactaccaggaggctaaatctagtaaaataatggagagcttcaaaaatatggtgcctcagcaagccctggtcatacgggagggggaaaagatgcaggttaatgccgaggaggttgtagttggcgatcttgtcgagattaaaggcggcgaccgcgtgcctgcagacctgcgcattatcagcgcacatgggtgtaaggtcgataatagctccctgactggggaatcggaaccacagacgcggagtcccgactgtacacatgataatccgttagaaactcgcaatattactttcttctccacaaactgtgtggaaggcactgctcggggcgtggtcgttgccactggcgataggaccgtgatgggccgaatcgccacccttgctagcggtctcgaggtcggcaagacaccgatcgccattgaaatcgagcactttatccagttgattaccggggtggccgtcttcttgggcgtcagtttttttatcttatctttaatcctgggatacacatggcttgaagctgtgatcttcttgattggcataatcgttgctaacgtccctgaggggctgctggcaacggtgacggtgtgcttgaccctgaccgctaaaaggatggcacgtaaaaattgccttgtgaagaatttagaagccgtggaaacactgggctccacatcaactatctgttctgataagaccggcaccctcacccagaatcgcatgaccgtcgctcatatgtggtttgacaaccagatccacgaagccgatactacggaggatcagagtggaacatcgttcgataaatcatcccacacttgggtagctctgtcacatattgctgggctatgcaatagagccgtcttcaaaggaggccaggacaatatcccagttttaaaaagagacgtagctggcgatgcaagcgagtctgcactgttgaaatgcattgagttgtcctctggtagcgttaagctgatgcgcgagcggaataaaaaggtggcagaaatccctttcaacagtacaaacaaataccaattatcaatccacgagactgaagatcctaatgacaaccgctacctgctggtcatgaagggcgctcctgagaggattctcgaccgctgtagtacgatactccttcaaggtaaagagcagcccctggatgaggaaatgaaggaagccttccagaacgcatacctcgaactgggcggtctgggtgaaagagtcttaggcttctgtcactactatttgccagaagaacagtttcccaaaggatttgccttcgattgtgatgatgtgaattttactacggacaacttgtgtttcgttgggctgatgagcatgatcgatccaccgcgcgccgccgtgcctgacgcagtgggaaaatgccggtctgcagggattaaggtcataatggtgaccggagatcaccctatcacagcgaaggccatcgccaagggagtcggcataatttccgagggaaatgaaaccgtggaggacattgcagctcgtctgaacatccccgtgtctcaagtgaatccacgcgacgccaaagcctgcgtgatccacgggacagatcttaaggatttcacatccgagcaaatcgatgagatcctacagaaccacaccgagatcgtgttcgcacggacatcacctcagcagaaactgataatcgtcgagggctgccaacggcaaggagccatcgtggccgtaacaggcgatggtgtgaacgactcccctgccctcaagaaagccgacatcggcgtggccatgggcattgctggaagcgacgtgtcaaaacaagccgcggatatgattctgttagatgacaattttgcatctatcgtgacgggcgtcgaagagggccgtctcatatttgataatctgaagaagtccatcgcttataccctgacttcaaacatccctgagatcactcccttcttacttttcatcatggccaatatccccctgccgttgggaacaattacgattctttgcattgatctgggcacagacatggtccctgcaatctccctggcatacgaggctgctgaaagtgacataatgaaacggcaacctcgaaacccacgtaccgacaagttggtcaatgagcgactgatctcgatggcatacggccaaatcggaatgatacaagcactggggggatttttttcatacttcgtgatcctggccgagaacgggtttctgcctgggaatctggtaggaatcaggctcaattgggacgaccggactgtgaatgacctggaggatagttacggtcagcagtggacttatgaacagaggaaggttgtggaatttacatgtcacactgctttcttcgttagcattgtggttgtgcagtgggcagatctcatcatctgcaagactcgtagaaatagtgtgttccagcaggggatgaaaaataagatcctcatcttcggcctcttcgaggagacagcactcgccgcatttctgtcttattgtccgggtatggatgtcgcattaagaatgtacccactcaaaccttcttggtggttctgcgcttttccctactccttcctcatattcgtgtatgatgaaatcagaaaactgatcctcagaagaaaccccggcggatgggtggaaaaggaaacttattactag

SEQ ID NO: 109124 - DNA, 3681 bp, Artificial Sequence
  Description of Artificial Sequence: Synthetic coding sequence
atgggagacaagaaagatgataaagattcccctaagaagaacaaaggaaaggagcgccgggacttggacgaccttaaaaaggaagtggccatgacggaacataagatgtccgtcgaggaggtctgccggaaatacaataccgactgcgtccaaggattaacccattccaaggctcaagaaattctagccagagacggaccgaacgctcttacacccccaccgacaaccccagaatgggtgaaattctgccgtcaattatttggagggttcagtatcctgctgtggatcggcgccatcctttgcttcctggcctacggaatccaagccggcactgaggatgaccccagcggggataatttatatcttgggatcgtgcttgctgctgtggttattatcaccggctgttttagctattatcaagaagctaaatcaagtaagatcatggagtccttcaagaatatggtcccgcagcaggctctggtgatcagggaaggggagaaaatgcaagtcaatgcggaagaggtggtggtaggagatctagtagagataaagggcggcgaccgcgtgccagctgacctcaggatcatatccgcccatgggtgcaaagtagacaactcctccttaacaggcgaaagcgaacctcagacacgctccccagattgtactcacgataaccctctcgagacccggaacattacgttcttctctacgaactgtgtggagggcacagctaggggcgtggttgtcgccaccggggacaggaccgtcatggggcgaattgccacattggccagcggcctcgaagtaggaaagactcctatagcgatcgagatcgagcacttcatccagttaatcaccggagtggctgtctttctgggagtgtcttttttcatcctctctcttatcctaggctatacatggctggaggccgttatatttctgataggcatcatcgtggcaaacgttcctgagggattgttggcaaccgtaaccgtctgcctcaccctgacagccaaacgcatggcgcggaaaaattgcctcgtgaagaacttggaggccgtggagaccctgggctccacgtccacaatttgctccgacaagaccggaaccttgacacaaaaccggatgactgtagcacatatgtggttcgacaaccaaatccacgaggccgacacaaccgaagaccagtcaggcacatcattcgataagagctctcacacttgggtggccctgtcacatattgccggcctttgtaaccgggccgtcttcaagggaggtcaggataacattccagtgctgaagcgtgacgttgccggggatgcatctgagtccgccctcctcaagtgcatcgaactctcttctgggagcgtaaagttaatgcgggagcgaaacaaaaaagtggctgaaattcctttcaatagcaccaacaagtaccagctcagtatccacgaaaccgaggaccctaacgacaatcgttatctgttggtgatgaagggggccccagagcggattctggacaggtgcagcactattctgcttcagggaaaggagcagcccctggacgaggaaatgaaggaggcatttcagaatgcctatctggaactgggcgggttaggtgagagagtactaggattctgccactattatttacctgaggagcaattcccgaagggctttgcgtttgattgcgacgatgtaaatttcactacggataatctctgttttgtaggcctgatgagcatgatcgaccctccacgggcagctgttcccgatgccgtcggcaagtgccgtagcgctggcattaaagtgatcatggtcaccggcgaccacccaatcacggccaaagctatagccaaaggggtcggaatcatttcggagggcaacgagaccgtggaggacattgccgccagactgaatatccccgtgtctcaggtgaatccccgcgatgccaaggcctgtgttatccacggtaccgatctcaaggattttactagcgagcagattgatgaaatcctgcagaatcatacggaaatagtgttcgctcggaccagcccacagcaaaaactcatcattgtcgaagggtgtcaacggcagggtgccattgtggcagttaccggagatggtgtgaacgacagtcccgcactgaagaaagctgatatcggggtggctatggggattgccggatccgacgtatcgaagcaggccgcggacatgatattgctcgatgataactttgccagtattgttaccggggtagaagagggcagactgatatttgacaaccttaagaaatcaattgcttatacactcacctccaatatccccgaaatcacacctttcctgttgtttattatggctaatatccctctgcccctgggaactatcacaattttgtgcatcgatctgggcacagacatggtacccgctatatccttggcttacgaggcagccgaaagtgatattatgaaaaggcagcctcggaaccccaggactgacaagctagtgaacgaaaggcttatctccatggcctatggacaaatcggaatgattcaggcgctgggcgggttcttcagctactttgtgatcctggccgaaaacggttttctgccgggtaatctcgtgggaataaggctgaattgggatgatcggacagtgaacgatctggaagattcctatgggcagcagtggacctacgaacagcgcaaagttgttgagtttacttgccataccgcattctttgtcagcatcgtagtcgttcagtgggccgatctgattatatgcaaaacccggagaaattcagtgttccagcaggggatgaaaaataaaattctcatcttcggtctgttcgaggagacagcactggcagcctttctgagctattgtccgggcatggacgtggctcttagaatgtacccgttaaaaccatcgtggtggttttgcgcctttccctactcattcttaatatttgtgtacgatgagatccggaagttgattctaagaaggaacccagggggggaaggagcaagacagggttcccgcggcgggaggggcgcggccggctcacaggccgcagggcctcgccttccttccccttgttggatggccctacctccagggtcccattcaagcctgtcatcccatctgtctggccatcccttgtgtctactgacaggtctgtgtctttgtgggtttctggtctccttgccactgtgcccatcactgtgctgggcggcccgcctggcctgcctctcccccagcttgactctgtccctgtccttcttactttgcctatctaggctggggggagagggtaacctgttgctgaccagtgccccacctcatcgtccgagtttgcctagacctcccggacctggcccacctctgtccgttccccctatactgtatagcggtggcaggagccctttgttcctgtggccacacctggggccccatcccctgcattacttactgcccccacctctgtggctggcttctttaccctgcccaaaaccactgtcaagcctcttttccgtgtctgtaagccttccactactgacccccctctctatccctcctgcaccggctaccagcttgggctcttttttactgcctttctcaccaccagcggatgccatcagtggttctggacagctctccaacatttccgttggtcgggaatag

SEQ ID NO: 109125 - DNA, 444 bp, Artificial Sequence
  Description of Artificial Sequence: Synthetic coding sequence
atggggagtgggggttccgattcataccgcatagctaccagccaggataagaaggacgataaagacagccccaagaagaacaagggaaaggaaaggagagatctcgatgacctgaaaaaggaggtggcgatgacggagcataagatgagtgtcgaggaggtatgccgcaagtacaacaccgattgtgtgcaaggcttgacacactccaaagctcaggaaatactcgcccgcgatggcccgaacgcactaacaccaccacctacaacacctgagtgggtcaagttctgcagacagctgtttggagggttttcaatactgctgtggattggcgctattctttgcttcctcgcctacgggatccaggcaggcacagaggacgacccttccggcgacaacttgtacctgggtatcgtgctcgcagctgtggtgataataacagggtag

SEQ ID NO: 109126 - DNA, 2049 bp, Artificial Sequence
  Description of Artificial Sequence: Synthetic coding sequence
atgggaagaatcgccacactggcctccggactcgaggtcggcaaaacgcccatcgccattgaaatcgagcacttcattcagctcataaccggcgttgctgtctttcttggggtgtctttttttatcctgtccttgatcttaggttacacatggttggaggcggtgatcttcctgattggaattattgtggccaacgtcccggagggcctgctggctactgtgacagtgtgcctgactctgacagccaaaaggatggcgaggaaaaattgccttgtgaagaatctcgaggccgtggagaccctggggagcacaagcaccatttgttccgataaaacgggcacattgacacagaacaggatgacagtagcgcatatgtggttcgataatcaaattcacgaggccgacaccactgaggaccaaagcggtacaagcttcgacaagtccagtcatacctgggtggcgctgagccacatcgctggactctgtaaccgcgccgtctttaagggcggacaggacaacatacctgtgctgaagcgagacgtcgctggtgacgccagcgaatccgctctcctgaagtgtatcgagctgtcttccggctctgtgaagttgatgcgcgagagaaacaagaaagtggccgaaatcccctttaactccaccaataaatatcagctttctatccacgagaccgaagaccccaatgataatcgctacctgctggttatgaagggagcaccagagcggatacttgatcggtgttccacaattttgcttcaaggcaaagagcaaccccttgacgaggagatgaaggaggccttccaaaacgcctacctggaattaggtgggttaggggagagggtactcgggttctgccactactacttgcccgaagagcagttccccaagggtttcgcattcgactgcgatgacgtcaatttcaccaccgacaacctatgttttgtgggactcatgtccatgatcgatcctcctcgtgccgcggtgcccgacgccgtggggaagtgtcggagtgccgggatcaaagttatcatggtgacaggagatcacccaattacagccaaagccatcgctaagggcgtcggcatcattagtgaaggaaacgaaacagtggaggatatcgctgccaggcttaacattccagtgtcccaggtgaatccgagagatgccaaagcgtgcgttatccacgggactgacctgaaggactttacctcggagcagattgatgagatactgcagaaccacaccgagatcgtgtttgctagaacctcaccacagcagaagcttattattgtggaaggctgccaaaggcagggcgccatagtggccgtgactggcgatggagtcaacgattccccagcattaaaaaaagccgacatcggggtcgccatgggaatagccggaagcgacgtttccaagcaggccgctgacatgatcctgctcgatgataactttgcatcaatcgtgaccggagtggaagaggggaggttgattttcgacaacctcaaaaaaagtattgcctacacattgacctctaacatccccgagatcacaccctttttgttattcatcatggccaatattcctctacctctcgggacaattaccatattgtgtatcgatttgggtactgatatggtccctgctatatcccttgcctacgaagctgccgagtccgatatcatgaaacgccaaccacggaaccctagaaccgacaaactggtgaacgaaagattaatcagtatggcttacggacagatcgggatgatccaggctctcggtggtttcttctcctattttgtgatcttagctgaaaacggtttcctccctggtaatctcgtcggaatccgattaaactgggatgacagaaccgtgaacgacctcgaagattcctatgggcaacaatggacatatgagcagcggaaagtagtagagtttacctgccatactgcattttttgtgagtattgtggtggtccagtgggcagacctaataatatgtaaaactcgtagaactcgtagcagctcgagggcctag

SEQ ID NO: 109127 - DNA, 3075 bp, Artificial Sequence
  Description of Artificial Sequence: Synthetic coding sequence
atgggcggctgggaggaagagcgcaaccgccgagccaccgacaaaaaagatgataaggatagtccgaaaaaaaacaagggcaaggaacgcagggacttagacgacctgaagaaggaagttgccatgaccgaacataagatgtccgttgaagaggtttgtagaaagtataacacagactgcgtgcagggtctaacacattctaaagcccaagagatcctggcacgggacggtccaaatgcactgactcccccgcctaccacacctgagtgggtaaagttttgtaggcagctgtttggcggcttttcaatattgctctggattggcgcaatcctctgtttcctggcatacggcattcaggcaggcacagaggacgatccctcaggagataacctctacctcggcatcgtcctggcagctgttgtgataatcacaggctgctttagttattatcaggaggcgaaaagcagcaagatcatggagtcctttaagaacatggtcccccagcaggcactggtgattagagagggcgagaaaatgcaagtgaatgcagaggaggtggtggtgggggacttggtggaaatcaaggggggtgaccgagtccctgcagacctgagaattatttcagctcacggttgcaaagtcgacaacagctccctgaccggtgagtcagaaccacagacacgctccccggattgtacacacgataatccccttgaaacacgtaacatcacgttcttttctacaaattgcgtggaagggacagctcggggggttgtagtggctacaggcgatcggaccgtgatgggaaggattgctacccttgcctccggtctcgaagtgggtaaaacccccattgctattgagattgaacacttcatccagttgataacaggagtggccgtattcctaggcgtgtcattcttcatcctctcgttgatcttaggatacacatggttggaagctgttatttttctgatcgggatcattgtagcgaacgtgcccgaaggcttgttggctacagtgaccgtttgcctcaccctgactgccaaacgcatggcgcggaagaactgtctcgtgaagaacttggaggctgtggaaacccttggatctacatcaaccatctgttccgacaaaaccggaaccctgacccagaatagaatgaccgtcgctcacatgtggttcgacaatcaaattcacgaagctgataccacggaggatcagtcaggcacctcgttcgataaatccagtcatacttgggtggctttaagtcacattgcaggcctctgtaaccgcgccgtgttcaaaggcggccaagacaacattccagtcctgaaaagggacgtggccggagatgctagcgagtcagccttactgaaatgcatcgaactgagctccggttccgttaagctgatgagagaacggaataaaaaagtcgccgaaattccctttaatagcaccaataaatatcagctatctatccatgagactgaggaccctaatgacaatcgctacctgttggttatgaagggagcaccggagaggatcctggatcgttgcagtacgatactgttgcagggaaaggaacagccactcgatgaggaaatgaaagaagccttccaaaatgcatatcttgagctgggcggtctgggagagcgtgtgctcggattttgccattactatctgcccgaagagcagttccctaagggattcgcctttgactgtgatgatgttaattttacgactgataacctttgttttgttggtctgatgagcatgattgatccacctcgcgcggctgtgcccgatgccgtgggaaagtgtagaagcgccggaatcaaagttattatggtcacaggcgatcacccaatcaccgcaaaggctattgcaaagggggtcggtataatatccgagggcaacgagaccgttgaagacatcgccgctcgccttaacatccccgtgtctcaggtgaacccccgggacgctaaggcttgtgtaatccacggaacagatcttaaagactttacttcggagcaaattgatgaaattctacagaaccacactgagatagttttcgcccgtacttcaccacagcagaagcttattatcgtcgaaggatgccagaggcaaggagccatagttgccgtgactggtgacggcgtgaatgatagtccagctttgaaaaaggcggacataggcgtggccatgggtattgccggaagcgacgtttctaagcaggctgccgatatgattctactggatgacaatttcgcctctatcgtgaccggtgttgaggaaggccgactgatcttcgacaatctaaaaaaaagcattgcatacactctcacatccaacatcccggagattaccccgtttctcctctttatcatggcgaatattcctcttcccctcggtaccatcaccatcttatgtatcgacctcggtactgatatggttcccgctatctccctcgcttacgaagctgccgagtcagacatcatgaaaagacagcccaggaatccacgaaccgataagctggtgaatgagcggctcataagtatggcctatgggcagattggtatgatccaggcccttggtggctttttttcatatttcgtcatcctggctgaaaatggctttctccctggtaatctggtggggattcgcctgaactgggatgatagaaccgttaatgatctggaggattcttacgggcagcaatggacctatgaacagcgtaaagtagtcgaattcacatgccacacggcgttcttcgtgagcatagtcgtggttcagtgggcagatcttatcatatgcaagactcgccggaacagtgtgtttcaacagggtatgaaaaacaaaatcctgatttttgggctgttcgaagagactgcccttgccgcgtttctgtcatattgtccaggtatggatgttgctttgcggatgtatccattgaaaccctcctggtggttctgcgcattcccttacagcttcctcattttcgtttacgatgagatcaggaagttaatacttcgaagaaaccctggtgggtgggtcgaaaaagaaacctactattag

SEQ ID NO: 109128 - DNA, 3081 bp, Artificial Sequence
  Description of Artificial Sequence: Synthetic coding sequence
atgggctccggcggatccgacagctatcgcatcgcgacatctcaggacaagaaagatgacaaagacagcccgaagaaaaacaaaggaaaagaacgcagggacttggacgatctgaaaaaggaagtggcaatgacagagcacaagatgtctgtggaggaggtctgccggaagtacaacactgactgcgtccaaggactgacccactcaaaggcccaagaaatcctagccagagacggcccaaatgcgctcacacccccgcctacgacacccgagtgggtgaaattttgtcggcagctcttcggtggctttagcattctactttggattggggccatactgtgctttctcgcctacggtattcaggccggcactgaggatgacccttcgggtgacaatctctatctgggcattgtcttagcggcagttgtcatcattactggttgcttctcctattaccaggaggccaagagctctaagatcatggagtccttcaagaacatggtaccacagcaagctcttgtcatcagggagggagagaaaatgcaagtgaacgcagaagaagtcgtcgttggcgacctggtggagatcaagggtggcgatcgagtgccagctgacctcagaattatttctgcacatggatgcaaggtcgacaactcaagcctcacaggtgagtcagaaccacagacacgatctcccgattgtacccacgataatccactggagacccgaaatatcacttttttttcaactaattgcgtagagggcaccgctcgcggcgtcgttgtggctactggggacagaaccgtgatggggagaatcgcaactctggcttccgggctcgaagttggcaaaactcccattgcaatagaaatagagcattttatccagctaattaccggcgtggctgttttcttgggagtgagcttttttattctctcactgatactcggctacacctggctcgaagctgtgatctttctcattggcataatagtggcaaatgtgcccgaggggttgttggccaccgtgactgtgtgcctgaccctaactgctaaaaggatggcacgcaagaactgcctggtgaagaacctggaagccgtggagacgctggggtcaacatctaccatctgtagtgacaagactggcacactcactcaaaatcggatgaccgtggctcacatgtggttcgacaaccaaatccatgaagctgacactaccgaagatcagagtggaacaagctttgataagtctagccatacttgggttgcactctcccatatcgcaggactgtgtaaccgggcggtgtttaagggaggtcaggacaacataccggtgctgaaacgtgatgtcgccggggacgcaagtgaaagcgccctgttaaaatgcattgagctgagcagtggcagtgtgaagcttatgagggagcgcaataaaaaagttgctgagataccatttaacagcactaacaaataccaattgagcatacatgaaacggaggatcctaacgataacagatacctgctggtgatgaagggagcccctgaacgcatactggataggtgcagtactatcctgctccagggcaaagagcagcctttggacgaagagatgaaggaagcgttccaaaacgcataccttgaacttgggggcctgggggagagggttctcgggttttgccactattatctgcccgaagagcagttccccaaaggcttcgcattcgactgcgatgacgtcaacttcacaacggataatctgtgctttgtggggctcatgagcatgatagacccaccaagggccgccgtgccagatgccgtgggcaaatgccggtctgccggaattaaagtgattatggtgacaggcgaccacccaatcaccgcgaaggcgatcgcaaagggcgtcggaattatctccgaggggaatgagacggttgaggatatagcggcaagacttaacatccccgtgagccaggtgaatccacgcgacgccaaggcgtgcgtgatccatgggacggacctgaaagatttcacctcggagcaaatagatgagattctccagaatcatacggagatagtcttcgcacgcacctccccccaacagaagctcatcattgtggagggctgccagcgccagggtgccatcgttgccgtaaccggcgatggagtgaacgactcccccgctctgaaaaaagccgatattggcgttgcgatgggcattgctggctcggacgtaagcaaacaggctgctgacatgattctgttagacgacaattttgcttcaatcgttaccggggtcgaggaagggaggctgatattcgataacctgaagaagtctatcgcctatactttgacctccaacatccccgaaataaccccattcttgctgtttatcatggcaaatatccccctccccttggggacaatcacgatcttgtgtatcgatctgggcacagatatggtgcccgcaatcagtctggcttacgaggctgcagaaagtgacattatgaaacgtcagccaaggaatccccgcactgataagctggtgaacgaacggcttatatccatggcatatggccagattggaatgattcaggctctgggaggcttcttttcttatttcgtgatcctcgcagagaatggtttcttgccaggcaacctggttggtattcgattaaactgggatgaccgcacggtcaacgatctggaggactcttatggacagcagtggacttatgaacagcgtaaggtcgtggagtttacctgtcacaccgctttcttcgtcagcatcgtcgtggtgcagtgggccgatctgattatttgtaagacacggaggaattccgtgtttcagcagggtatgaagaacaagattctgatattcgggctgtttgaggaaactgcattagctgcttttctgagctactgccccggtatggatgtggccctaaggatgtacccactcaagccttcctggtggttttgtgccttcccgtattctttcttaattttcgtgtatgatgaaatccggaagctgattctcagaaggaatccgggcggctgggtcgagaaggagacatactactag

SEQ ID NO: 109129 - DNA, 3090 bp, Artificial Sequence
  Description of Artificial Sequence: Synthetic coding sequence
atgggcctctggggaaaaaaagggaccgtcgctccacacgaccaatcccctaggcgccgtccgaaaaaaggcctaatcaagaagaagatggtgaagagagaaaagcagaagagaaacatggaagagttgaagaaagaggtggtgatggatgaccataagcttacattagaggaactctccactaagtattctgtggacctgacaaaagggcacagtcaccagcgagctaaggagatactgaccagaggtgggcccaacacagtcactccccccccaacaactcccgaatgggttaagttctgcaaacagctgtttggcgggtttagcttgttactctggactggcgcaatactctgcttcgtggcttactcaattcagatctacttcaacgaggaacctaccaaagataatttgtatttaagcatcgtgctctctgttgtggttattgtgacaggttgtttctcttactaccaggaggctaagtcaagcaagattatggagtcattcaaaaatatggtgccgcagcaagccttggtgataagagggggggagaagatgcagatcaacgtgcaggaggtcgtgctgggagatctcgtggaaattaagggtggggatcgcgtgccggccgatcttcggctgatttcggcacaaggctgcaaggtggacaactcctctcttaccggcgaatctgagccccagtcacgcagcccagattttacgcatgagaaccctttggagacccggaacatatgtttttttagtacaaactgcgtcgaaggcaccgctaggggtattgtgatagcgaccggcgacagcaccgtgatgggccgcatcgctagcctgaccagtggactggccgtgggtcaaacccctatcgccgcagagatagaacattttattcatttaatcacggtcgtagccgtgttcctcggagtcacattctttgcccttagcctgttattgggttacggttggctcgaggcaattattttcctgattggcatcattgttgccaatgtgcctgagggtctcttagccaccgtcactgtgtgtttgaccctgacagccaagcggatggctaggaaaaactgcctcgtgaaaaatttggaggccgtggagactctcggcagcaccagtactatctgctctgataaaactggcacactaacccagaacaggatgacagttgcacatatgtggtttgacatgactgtctacgaagcagataccactgaagagcagacaggaaagacattcaccaagtcctctgacacttggttcatgctggctcgtattgcggggctctgcaaccgggcggattttaaggctaatcaggaaatcctccccatcgctaaaagggccaccaccggcgacgctagcgaatcagcactgctgaagttcattgaacagagttacagctccgtggcagaaatgcgggaaaaaaatcccaaggtagcagaaattccattcaatagcaccaataagtaccagatgagcattcacctacgagaggattccagccaaacacatgtcctgatgatgaaaggcgctcccgagaggatcttggaattctgcagcaccttcttgctgaatggacaggagtactctatgaatgatgagatgaaggaagccttccagaacgcctatcttgagcttggggggcttggcgaacgagtgcttgggttttgctttctgaatctgccatcatcgtttagtaaggggttcccattcaacaccgacgaaataaatttcccaatggacaacctgtgctttgtcggattgatctctatgattgaccctcctagggccgccgtgccggacgccgtgagcaagtgtagaagtgctggcatcaaagttatcatggtgactggggatcacccaataacagccaaagctatagccaaaggggttggcatcatcagcgaggggaccgagacagctgaggaagtcgcagctcggctcaaaatccctatcagcaaagtggacgcatcagcggctaaagccatcgttgtgcacggcgctgaactgaaggacatacagtctaaacagctagaccaaattttacaaaatcaccccgaaattgtattcgctcggactagtccccagcaaaagctgattatcgttgaaggttgccagcggctcggggcagttgtcgctgtcactggggatggcgtgaatgacagcccggcactcaagaaggcggacatcggaatcgcgatgggtataagtgggagcgatgtctctaagcaggcagccgacatgattctgctggacgacaactttgcatcaattgtgacaggagtcgaagagggacggctgatattcgacaacctaaaaaaatccataatgtacactctgacgagcaatattcccgaaattacgccattcctgatgtttataatcctgggaatccccctccctctaggcaccatcactatactgtgcattgatctcggtaccgatatggtgcctgcgatcagcctggcttatgagtccgcggagtcagatattatgaaaaggcttccgcgcaacccaaagaccgacaatcttgtaaaccacaggctgataggaatggcttacggccagatcggcatgatccaggccctggcaggcttctttacctactttgtgattttagcagaaaacggatttaggcccgtggatctcttgggcatacggttacattgggaggacaaatacctgaatgatctggaagactcatatggccaacagtggacctacgaacagagaaaggtggtggaatttacttgtcagactgcctttttcgtcacaatcgtcgtggttcagtgggccgacctaattatctcaaagacaagaagaaactcactctttcaacaaggtatgagaaacaaagtcctcatttttggtatcttggaggagactctgctggctgcatttctgtcctacaccccagggatggacgtggccctgcggatgtaccccttaaaaatcacgtggtggctgtgcgcaataccttattcaatacttatatttgtctacgatgagatccgcaagctgcttatccgccagcatccagacgggtgggtggaacgcgagacctattactag

SEQ ID NO: 109130 - DNA, 498 bp, Artificial Sequence
  Description of Artificial Sequence: Synthetic coding sequence
atgatacaggcgctagcaggattttttacttactttgtcatactggcagaaaatggctttagacccgtagaccttctgggaatcaggctccactgggaagacaaatacttgaatgatctagaggattcatacggccagcagtggacttatgaacagcgaaaggtcgtcgagtttacctgtcagaccgccttcttcgtcaccatcgtagtggtccagtgggccgacctcatcatatcgaaaacaagaaggaactcactttttcagcagggcatgagaaacaaagtgcttatttttggtatcctcgaagagacgcttttggcggcattcttatcctatacccctgggatggacgtcgcactgagaatgtaccctcttaaaatcacttggtggctgtgtgcaatcccatatagtatcttgatctttgtgtacgatgaaattcgaaagctgctgattaggcaacacccagacggatgggtggaaagagaaacatactattag

SEQ ID NO: 109131 - DNA, 888 bp, Artificial Sequence
  Description of Artificial Sequence: Synthetic coding sequence
atgggtaaacgtaaatgcagcccggcaagtcagtcactgtttctatttcagttccagaagatggaactgaagtttaagatcttactgttctatgtgatattctatggctgccttgctggtatttttatagggacgattcaggtcatgcttctcacaattagcgaattcaaacccacttatcaggaccgcgttgcaccacccggcctgacgcaaattccccagatacaaaagactgagattagttttcggcccaacgatcccaaatcctatgaggcctacgttttaaacatcgtcaggttcctcgagaaatacaaagacagcgcccaacgcgacgacatgattttcgaagattgcggggatgtacctagtgaacctaaagaacggggagacttcaaccacgaacgcggcgaaagaaaggtgtgtcgcttcaagctggaatggttagggaactgctctggcttgaacgatgaaacctacggttacaaggaagggaaaccttgcataatcatcaagctgaatagagtcctcggctttaaacctaaaccccccaagaatgagtctttggagacgtacccggttatgaagtacaatcccaacgtgctgcctgtacagtgcaccggcaagagggacgaagataaggataaagtggggaacgtggaatactttggattgggaaatagccctgggtttcctcttcaatactacccgtactatggtaagctgctacagccgaaatatctgcagccactgcttgccgtgcagttcaccaatttgaccatggacaccgaaattagaatcgagtgcaaggcctacggcgaaaatattggctattcggagaaagaccgcttccagggacggttcgacgtgaagattgaggtgaagagttag

SEQ ID NO: 109132 - DNA, 912 bp, Artificial Sequence
  Description of Artificial Sequence: Synthetic coding sequence
atggcccgagggaaggccaaggaggagggatcttggaaaaagttcatctggaattcagagaagaaggaattccttgggagaacgggaggctcctggtttaagatcctgctgttctatgttatcttttacgggtgccttgcaggcatctttatcggaaccattcaagttatgctcctcacgatctccgagtttaagcctacctaccaggatcgtgtggcaccccccggactgacacagattcctcagatccagaagacagaaattagttttaggcccaacgatccaaaatcttatgaggcctacgttctcaacattgttcgattcctggagaaatacaaggactcagctcaacgagacgacatgatttttgaagactgtggggatgtgccctctgagccaaaggaacgaggagacttcaaccatgagcgcggtgagaggaaagtatgtagattcaaactcgagtggctgggaaattgcagtggccttaacgacgagacttatggatataaggaggggaaaccttgcataatcatcaagctgaacagggtgcttgggttcaagccaaagccccctaagaatgaaagcctggagacctatccagtgatgaaatacaatcctaacgtcttacccgtgcagtgcactgggaaacgagatgaggataaagacaaggtaggcaatgtggagtactttggattgggtaattcccctgggttccccttgcagtactacccttactatggaaagctgttgcagccgaagtacctccagcccttgcttgccgtacaattcacaaatctcaccatggacaccgaaattcggattgagtgtaaagcttacggcgagaatattggatacagtgaaaaagatcgattccaaggacgatttgatgtcaagatcgaggttaagtcatag

SEQ ID NO: 109133 - DNA, 912 bp, Artificial Sequence
  Description of Artificial Sequence: Synthetic coding sequence
atggcccgcggcaaagctaaagaggagggaagttggaagaagtttatttggaacagtgagaaaaaagagttcctgggccggactggtgggagttggtttaagatcctgctgttttatgtcattttctacgggtgccttgctggtattttcataggaaccatccaagtgatgctgcttaccatcagcgagttcaaacctacataccaggaccgcgtggccccccccgggctgacccagataccacagatacagaaaaccgaaatcagttttcgcccaaacgaccccaagtcttatgaggcatatgtcttgaatatcgtgcgatttctagaaaagtataaggatagcgcccagcgagacgacatgatctttgaggattgtggcgacgttccatcagaaccaaaggagcgaggcgacttcaaccatgaacggggggaacgtaaggtctgccgctttaaactcgagtggctgggcaattgtagcgggttgaatgatgagacctatggttataaggaggggaagccttgcatcataatcaaactgaatcgggtgctgggatttaaacccaaaccgcctaaaaatgagagccttgagacctaccctgtgatgaagtacaatccaaacgtcctaccggtgcaatgtacgggcaagagggatgaagataaagataaagtagggaacgtggagtacttcggtctggggaactcccctggattcccccttcaatactatccctactacggcaaactgcttcagcctaagtacttgcaaccccttttagccgtgcaattcacaaatctgacaatggatacagaaatccggattgaatgcaaggcttatggtgagaacataggttattctgaaaaagacagattccaaggccgttttgatgttaagatcgaagtgaaatcctag

SEQ ID NO: 109134 - DNA, 744 bp, Artificial Sequence
  Description of Artificial Sequence: Synthetic coding sequence
atgctgctgactatctccgagtttaagcccacctatcaggatcgggtagcccctccgggtctaactcaaattcctcagattcaaaagaccgagatcagtttccgccccaatgacccaaaaagctacgaggcttacgtattgaacattgtgcggttcttggaaaaatataaggacagcgctcagcgcgatgatatgatttttgaggactgtggagatgtacccagcgaaccaaaagaaagaggcgatttcaatcacgagcgtggcgaaaggaaggtctgcagattcaagctggaatggctgggaaactgttccggcctgaacgacgaaacttacggttacaaagagggcaagccctgtatcataatcaagctcaatagggtgttgggattcaagccgaagccacccaaaaacgaatctctggagacctatcccgtgatgaagtacaatccaaacgtcctccccgtgcagtgtactggcaaacgtgatgaggacaaggacaaggtgggtaatgtggagtacttcggattggggaatagccctgggttccctctccagtattacccatactacggtaagttgctccagccaaagtacctgcaacccttattagccgtgcagtttactaacttgaccatggacaccgaaatcagaatagaatgcaaagcctatggagaaaatattgggtattctgagaaagaccgctttcagggaaggttcgacgtgaagattgaggttaaatcatag

SEQ ID NO: 109135 - DNA, 873 bp, Artificial Sequence
  Description of Artificial Sequence: Synthetic coding sequence
atggttattcagaaagaaaagaagagctgcggtcaagtcgttgaggagtggaaggagttcgtgtggaacccccgaactcatcaattcatgggaagaacgggcacgagttgggccttcattctactattctacctcgtgttttatgggttcctcaccgccatgttcacactgacaatgtgggtgatgctgcaaaccgtgtctgatcacaccccaaagtaccaggatcgcctggcaaccccaggcttgatgataaggcctaagaccgaaaatctcgatgtcatcgtcaatgtctccgacacagaaagctgggatcagcatgtgcagaagttgaacaaatttctggagccatacaacgattctatccaggcacagaagaacgatgtctgtcgcccgggccgctactatgaacagccagataatggggtattaaattaccccaaacgggcttgccagttcaacagaacacagcttggcaattgctcgggcattggagacagcacacactacggatattctacaggccagccctgcgtcttcatcaagatgaaccgtgtgattaatttctatgcgggcgcaaaccagtccatgaacgtgacttgcgcggggaagagagatgaggatgccgaaaacctggggaacttcgtcatgttccccgccaatgggaatatagacctcatgtattttccctattacgggaaaaaatttcacgtgaattatactcagccacttgtggcggtgaaatttttgaatgtaacccccaatgtggaagttaatgttgagtgccgaattaatgcagccaacattgccacagacgatgagagagacaagttcgccggccgcgtcgcgttcaagctgagaatcaataagacatag

SEQ ID NO: 109136 - DNA, 840 bp, Artificial Sequence
  Description of Artificial Sequence: Synthetic coding sequence
atgacgaagaacgagaaaaaaagcctgaatcaaagtttagcagagtggaagctgttcatttacaaccccactacaggggaattcctcggacggacagcgaagagctggggcctgatcctgctgttctaccttgtgttctatgggttcctagccgcactgttctcctttacaatgtgggtgatgctccagacactgaacgatgaggtgcccaaataccgcgaccaaattccgagtccaggattgatggtgtttcccaagccagtaaccgcattggagtatacgtttagtcgatctgaccccacctcatatgctggctatatcgaggaccttaagaagtttctcaagccatataccctcgaagagcagaagaatctcactgtctgcccagatggagctctgttcgagcagaagggaccagtttatgttgcctgccagtttcctatcagtctgcttcaggcatgttccggcatgaacgacccggattttggctattctcaaggcaacccatgcatcctagtgaaaatgaatagaattatcggcctcaagcctgagggagtgcccagaatcgactgtgtctcaaaaaatgaggacatccctaacgttgccgtatatccacacaacggcatgatcgatctgaagtacttcccatactatggaaagaagctgcatgtcggatatctccagcctctggtggcagtacaggtttccttcgcccctaataacactggaaaggaggttaccgtggagtgtaagatcgacggatcagcaaacctcaagagtcaggacgaccgtgacaaatttttgggcagagtgatgtttaagattacggcaagggcctag

SEQ ID NO: 109137 - DNA, 582 bp, Artificial Sequence
  Description of Artificial Sequence: Synthetic coding sequence
atgctgtcagaaggagacatcttattttcttctctcctgtcttctccatcgcttttctggccccccgggctgatcctactcttttatctggttttctatggcttcctggccgcattgttttcctttactatgtgggtcatgctccaaacactgaacgatgaagtgcccaagtacagagatcagatccctagccccggcttgatggtcttccccaaaccagtaactgcactggaatacactttctccaggagtgatccgacttcatatgcaggctacattgaggatttaaagaagtttctgaagccgtataccttagaagaacagaagaacctgacagtctgtcccgatggcgcattgtttgaacagaaagggcctgtctatgttgcctgtcagttcccaatcagcctcctccaggcatgctctggcatgaacgaccccgactttggctacagccaaggtaacccatgtatcctcgtcaagatgaacagaatcatcggactgaaaccagagggagtgcctcgaattgactgtgtttctaagacaaacaatgtcaaagatggaatgaagatctaccagatgtag

SEQ ID NO: 109138 - DNA, 2139 bp, Artificial Sequence
  Description of Artificial Sequence: Synthetic coding sequence
atggccttgcttgcaatgcatagttggcggtgggccgcagccgccgcggcattcgaaaaacggagacacagtgccatcctgattcgccccctcgtgagcgtgtccggaagtggtccgcaatggcgacctcatcaactgggagcacttggtacggcgagagcatatcaaatacccgaatctcttaaaagcattacctggcagcgcctgggaaaggggaactctgggcagtttctggacgctgcaaaagcactccaggtgtggcctctgatcgagaagcgcacctgctggcacggccatgcgggtggtggcctccatacagaccccaaggaaggtgccatgaatatcgtcgtgcccttcatgttcaaatatgctgtcgactctcttaatcagatgagcggcaatatgctgaacctctctgatgcaccaaatacggtggccacgatggcaacagccgtactgatagggtatggcgtgagcagagctggagcggccttctttaatgaggtccgcaatgccgtgttcggaaaagtggcacaaaatagtatcaggagaatagctaagaacgtttttttacatttgcacaatcttgatctcggttttcatctgtctcgccagacaggagcccttagcaaggctatcgaccgtggcactagaggtatttcgttcgtgctgagcgcgctggtttttaacctgttgccgatcatgtttgaagtgatgctggtgagcggagtgttgtactacaagtgcggagcacagttcgcactcgtgaccctgggcactctcggcacatacaccgcctttacggttgctgtgaccagatggcgtactaggttccggattgaaatgaataaggctgacaatgatgctggcaacgctgccatagattccctgcttaattatgaaaccgtgaaatatttcaataatgaacggtacgaagcacaacggtacgacgggttcttaaagacctacgaaactgcgagtctgaagtctacctctactctggcaatgctaaattttggccagtctgccatcttttcagtaggacttacagcaattatggtgttggccagtcagggaatcgttgccggaactctgaccgttggagatctggttatggtgaatggcctactgtttcagctttcattgcccctgaattttcttgggacagtttatcgggaaaccagacaggctctcatcgacatgaacacactcttcactcttttgaaggtcgatacacagatcaaggacaaggtgatggcgtctcctctccagataacaccacagacagccaccgtggcgtttgacaatgtgcatttcgaatacatcgagggacagaaagtactctcgggaatatcttttgaggtgcctgctggaaagaaggtggccattgtgggaggctccggcagtggcaagagtacaattgtgcgcttgctcttcagattttacgaaccccagaagggatccatatacttggctggccaaaacatacaggacgtttctctggagtcgctaagacgcgcggtgggcgtggtgcctcaagatgccgtcctgtttcacaatacgatctactataatctactctatggcaacatcagcgccagtccggaagaggtatatgcagtggcgaagctagctggcctgcatgatgccattttaagaatgccacacggatatgatacacaagtcggagaacgtggattgaaactgtccggcggcgaaaagcagcgggtagccatcgcaagagctattctcaaagatccgcctgtgatactgtatgacgaggctaccagttcactggacagtatcacagaggagaccattctcggtgccatgaaggacgtggtgaaacaccgtacaagcatttttattgcccatagactgagcactgttgttgatgcagatgagataattgtgcttgatcaaggaaaagtcgccgaaagaggcactcatcacgggttgctggctaacccccattctatttacagcgagatgtggcatacacaatcgagcagggttcaaaaccacgataaccccaagtgggaggccaagaaggagaatattagcaaggaggaggaacggaaaaagctgcaagaagagatcgttaattcagtcaaaggttgcggcaattgttcttgctag

SEQ ID NO: 109139 - DNA, 2046 bp, Artificial Sequence
  Description of Artificial Sequence: Synthetic coding sequence
atgcgcctgtggaaggccgtggtcgttacactggctttcatgagtgttgacatctgcgtgaccaccgctatttacgtattttctcacctggaccgaagccttctggaggacatcaggcatttcaatatctttgactctgtgctagatctgtgggccgcatgtctgtacaggtcatgtctgctgctgggggccacaatcggcgtcgccaagaacagcgcactgggccccaggaggttacgggcctcctggctagtcatcacattggtgtgcctgttcgtcgggatttatgccatggtgaagttgctgctcttctcggaagtcagacgacccataagggacccctggttttgggccctcttcgtgtggacgtacatctccctcggagcctcctttctactctggtggttgctgagcacagtacggcccggcacacaggcattagagcctggcgctgctaccgaggctgaaggttttcctggttcaggaaggcctcctcccgaacaggcctccggagcgacattacaaaagctcctttcctacacaaagccagatgtggccttcctggttgcagccagtttcttcttgattgtcgccgctcttggtgaaacgttcctaccttactacactgggagggcaattgacggaatcgtgatccagaagtctatggaccagttctccaccgccgtcgtcatcgtgtgtctgttggccattggctcctccttcgctgcaggtataagaggaggtatatttactctaatatttgcccgattgaacattaggctgcggaactgtctcttcaggagcctggtctctcaggaaacgtctttcttcgacgagaatcggaccggagaccttatcagcagacttacctcggacactacaatggtctcggatctcgttagtcagaatatcaatgtgttcctcagaaacaccgtcaaagtcactggtgtggtcgtgttcatgttctctctaagctggcaactgtctctggtgacctttatgggatttccaataatcatgatggtctccaacatctatggaaaatactataagaggttgtctaaagaagttcagaacgccctggcccgtgcctcgaacacggccgaggagacaatctcagccatgaaaacagttagatctttcgcgaatgaagaggaagaggcggaggtgtatttgcgaaaactgcagcaagtctataagctcaaccggaaggaagccgctgcatatatgtattatgtgtggggatccgggttgactctgctggtggtacaagtgtcaatattgtattatgggggccatctcgttatctctggccaaatgacctccgggaacctcattgcttttattatttatgaatttgttttgggtgattgtatggaatcagtggggtcagtctacagtggactgatgcagggcgttggggccgccgagaaagtgtttgagtttattgatcgtcaacctaccatggtccatgatggcagtcttgctccagaccacttggaaggccgggtggacttcgagaacgttaccttcacatatagaacacgtccccacactcaggtcctgcagaatgttagcttcagtcttagcccaggcaaagtcacagcacttgtcgggccaagcggctcagggaaaagctcttgtgtgaacatattggaaaacttctatcctttggagggcggcagagtactgcttgacggcaagccaatcagcgcttacgatcacaagtacctacacagggtgattagtctcgtgagccaggaacccgtgcttttcgcaagaagcatcacggacaacataagctatggactgcccacagtgccctttgagatggttgtggaggccgcccagaaagctaacgctcacggctttatcatggagctgcaggacggttacagcactgagaccggggagaagggtgcccagctctcgggcggccaaaaacagcgggtcgctatggcaagggctctcgtacggaatccccctgtgctcatcctggatgaggccacctctgcacttgacgctgagtcagagtaccttatctag

SEQ ID NO: 109140 - DNA, 2052 bp, Artificial Sequence
  Description of Artificial Sequence: Synthetic coding sequence
atgaggttgtggaaagccgtggtggtgacgctggcatttatgagtgtagacatatgtgtgactactgccatctacgtcttttctcatctcgatcggagcctgttagaagacatcagacattttaacatttttgatagcgtccttgatttatgggccgcatgtctctacagatcatgcctactcttgggcgccactatcggagtcgccaaaaattccgccctgggacctcggcgtctgagagccagttggttggtgataactctagtctgcctctttgtgggcatctatgcgatggtaaaactgctattgttttcagaagttcgcagacccatcagagacccctggttttgggccttgtttgtttggacatatattagcctcggggcctcatttcttctgtggtggctgctgtcaacggtccgcccggggacacaggcactggaacccggcgccgccaccgaggccgaggggttccccggatcaggacgccctcccccagaacaagcttcaggagcaactctacaaaagttgcttagctataccaagcctgacgtggcattcctcgttgctgccagcttctttctcatagttgccgcattaggagaaaccttcctcccttactacacaggccgggccatcgacggcattgtgatccagaaatcgatggaccagttttccacggcagttgtgatcgtatgtctgctcgcgatcggtagttcctttgcagcaggtattaggggcgggatttttaccttgatatttgctagactgaatatacggctacgcaactgtcttttccgaagcctggtgagccaggaaacatccttctttgatgagaataggactggcgaccttatttctcgccttaccagtgataccaccatggtttctgacctggtcagccagaatattaacgtcttcctcagaaacactgtaaaggtgacaggtgtggtagtcttcatgttttcgctttcctggcagctgtctttggtaacattcatgggttttccgatcattatgatggtgagtaatatctatgggaagtactacaagaggcttagcaaagaagttcagaacgcccttgctcgggcctccaatacagctgaggagactatctcggccatgaagacagtgcgctcttttgcgaacgaggaagaggaggccgaggtctacttacgtaagctgcagcaggtctacaaactgaaccggaaagaggccgccgcatatatgtactacgtatgggggagcggcctcaccctgctcgtggttcaggtgtcaatcctgtattacggaggccatctcgtgatctcagggcaaatgactagcggtaacctgatcgccttcataatctatgagtttgtcttgggagactgtatggagtctgtcgggtcagtatatagtgggcttatgcaaggagttggcgcagctgagaaggtctttgaattcatagacagacagcctaccatggtgcacgacggctctctggcccccgatcacctcgaagggagagtggacttcgagaacgtgacattcacctatcggacccgaccacacacacaggtgttacagaacgtttccttctccttatcccccgggaaggtcacagcactggtcgggcctagtgggtctggcaagagcagctgtgtgaacattctggagaatttctacccccttgaagggggaagagtgctgcttgatggaaaacccatctccgcatacgaccacaaatacttacatagagtcatctcgttggtcagccaagagcctgtcctcttcgctcggagcattacggacaatatcagctacggcctacctacggtgccctttgaaatggtagtggaggccgctcagaaggcaaatgcccacgggttcattatggaacttcaggatggctactccaccgaaaccggcgagaagggagcccagttgtccggaggtcagaagcagcgtgtggcaatggcgagggccttagtgaggaacccccccgttcttatcctggacgaggccacatccgcgttggacgccgaatcagaatacctgtgtgcaggttag

SEQ ID NO: 109141 - DNA, 300 bp, Artificial Sequence
  Description of Artificial Sequence: Synthetic coding sequence
atggcagcgccagccgagccttgcgctggacagggcgtctggaatcagacagaaccagagccggccgccaccagccttctatccctttgcttcctgcggaccgcgggggtgtgggtgccccccatgtatctgtgggttctgggacccatttatttactgttcatccatcaccacgggaggggctatctgcggatgagccctctgttcaaagcgaaaatggtcgcggccatccctggcagtcttgagcccggaaacgtgcggggcaggcagggaaccggatggaacctggtaaagtcctag

SEQ ID NO: 109142 - DNA, 372 bp, Artificial Sequence
  Description of Artificial Sequence: Synthetic coding sequence
atgccttctgccggaaccctaccatgggtccaggggatcatctgcaatgccaacaatccttgcttccggtacccgactccaggagaggcacctggcgtggttggaaacttcaataagtccattgttgcacggttgttctcagacgcacggcggctgctgctatacagtcagaaggacacatcaatgaaagatatgagaaaagtcttgagaactctgcagcagattaaaaagagctcgtctaatctgaagttacaagatttccttgtggacaatgagacattcagcggctttttgtaccacaatctttccctgccgaagagtacagtggataaaatgctccgagccgatgtcattctgcacaaggtatcttag

SEQ ID NO: 109143 - DNA, 6786 bp, Artificial Sequence
  Description of Artificial Sequence: Synthetic coding sequence
atggcgtgttggccacaattgagactactgctgtggaagaacttgactttccggaggcggcagacttgccagctgctgcttgaagtggcctggcccctgttcatttttttgatccttatttcagtgcgactatcataccccccatacgaacagcatgagtgtcatttccccaacaaagctatgccgagtgccggaaccctcccctgggtccagggaatcatttgcaacgcaaataacccatgctttcggtatcccacacctggcgaagcgcctggcgttgtcgggaatttcaataagagtatcgtggcccgcctgttttcggacgctagaagactcctgctgtactcccagaaagatactagcatgaaggatatgagaaaagtacttcggacattacagcaaatcaagaagagctcttccaacctgaagctccaggactttctagttgacaatgagactttttcgggcttcctgtaccacaacttgtctttacctaagagcaccgttgacaagatgttgcgagctgacgttatcctgcataaagttttcctccagggctatcagcttcatttaaccagcctgtgtaacggttcgaaatcagaggagatgatccaacttggagatcaggaagttagcgaattatgtgggctgcctcgcgaaaaactggccgctgctgagcgagtgcttcgctctaatatggacattttaaagcctattctgaggactctgaacagtacctctccatttccctctaaggaactggcagaggctactaaaacgctgctgcactctctcgggaccctggcccaggaattgtttagcatgcggtcttggtctgacatgagacaggaggtcatgttcctgaccaatgtgaattcatccagtagcagcactcagatctatcaggctgtatcccgtatcgtctgtggccatccagaaggtggcggcctcaaaatcaagagcctgaactggtacgaagataacaattacaaagcactgtttgggggcaacggtactgaggaagacgctgagacattttatgataattctaccacaccatactgtaacgatttgatgaaaaatctcgaatcatcaccgctctcgcggatcatttggaaggctctcaaacccttactggtggggaaaattctgtatacacctgataccccagcaacacggcaggttatggcagaggtcaataaaactttccaagaactggccgtgttccacgatctggaaggcatgtgggaggaactcagtccaaaaatctggacatttatggaaaattcgcaggaaatggacctcgttcgcatgcttctggacagccgcgacaacgatcatttctgggaacagcagttggatggtcttgactggactgctcaggatattgtcgcatttctggcaaagcacccggaggacgtacaatcctcgaacgggagcgtttacacttggcgcgaggcattcaacgagacaaatcaggctattcgcaccatctcccgatttatggaatgcgttaacctgaataagctcgaacccatcgccactgaagtgtggctgatcaacaagagcatggagctgttggacgaaagaaaattttgggccggcatcgtgttcaccggcatcacacccggaagtatcgaactccctcatcacgtcaagtacaagatccggatggatatagataacgttgaaaggaccaacaaaataaaagacggctactgggatcccgggcctcgtgctgacccatttgaggacatgcggtatgtgtgggggggcttcgcttaccttcaggatgttgtggagcaggccatcatcagagtgctgacgggaacggagaaaaagacaggggtgtacatgcagcagatgccgtacccctgctacgttgacgatatcttcttgcgggtcatgagccgcagcatgcctttgttcatgacactagcgtggatttattctgtggctgtgatcataaagggcattgtgtatgaaaaggaggcccgtttgaaggagaccatgagaataatgggcctcgacaattccatattgtggttttcctggtttatcagcagcctcatcccattgctggtgtctgctggactcctggttgtaatcctcaagctgggcaacctcttgccttacagtgacccctccgtggtgttcgtgtttctgagtgtgtttgcagtcgtcaccatcctccagtgtttcctgatcagcactctgttctcaagggccaatctggctgcagcgtgcggggggatcatctactttaccctctatcttccatatgttctgtgtgttgcatggcaggactacgtgggatttactctgaaaatcttcgcaagtttattaagcccagtcgcatttggcttcggatgtgaatattttgctctgtttgaggagcagggcattggcgtgcagtgggataacttgtttgagagtccagttgaggaagatggtttcaacctaacgacttctgtgtctatgatgctctttgatacctttctgtatggggtgatgacttggtatatcgaggccgtgtttcctggtcaatacggaatcccaaggccttggtacttcccttgtaccaagtcttactggtttggggaagagtcagatgagaagtcccatccgggcagtaaccagaaaagaatctcagagatctgcatggaggaggaacccacccatcttaaactgggggtgagtatccagaacctggtgaaagtctaccgggacggtatgaaagttgccgtggatgggttggctcttaacttctatgaaggccagatcacctctttcctgggccataacggggccgggaaaacaaccaccatgtccatactgacagggctgttccctcctacctccggcacggcctacatactggggaaagacatacgatccgaaatgagcaccatccgccaaaacctcggagtatgccctcagcacaacgtcttgtttgacatgctgacagtcgaagagcatatctggttctacgcccgcctcaagggtttgagcgagaagcacgtaaaagcagaaatggaacagatggctcttgacgtggggctcccctcgtctaaactgaagagcaagacctcacaactatcagggggtatgcagaggaaattgtccgtcgctctggcttttgtcggaggatccaaagttgtcattctagacgagccaacggctggcgtcgacccgtatagtcgcaggggcatctgggagctgctcctcaagtatcgccagggccgaaccatcatcttgagtacccatcacatggacgaagccgacgtcctgggcgatcgtatcgctataatcagtcacggcaaactgtgctgtgtgggatcatccctcttcttaaagaatcaattgggcacggggtactatctgaccctagtcaagaaggacgtggagtcatcactgtccagctgccgtaattcttctagtacagtttcctatctaaagaaagaggactcggtgagccagtcctctagcgacgccggtctgggctctgatcacgagagcgatactctgacaatcgacgtgtctgccatatcaaatctgatccgtaagcacgtttctgaagctcggctggtggaggatatcggacacgaactgacatatgtgctcccctatgaagccgcaaaagaaggggcattcgtcgagctgttccacgagatcgatgacagattatccgatctggggatctcatcttatggcatatccgaaactacactggaagaaatctttttaaaggttgccgaggaaagcggcgtggacgcagaaacctctgatggcacattgcctgcaagacggaatcgccgcgcgtttggtgataagcagtcctgcctgaggccgtttactgaggacgacgcagccgaccccaacgattcagatatcgatccagaatcccgggaaacggatctcttatcaggtatggacggcaaggggtcctatcaggtgaaaggttggaagctcacacagcagcaattcgtagcactactgtggaagcggctgctgattgcccgaaggtctagaaaggggtttttcgcccagatcgtgcttcccgccgtatttgtgtgcattgctttggtcttttccctgattgtgcctccattcgggaagtatcctagtctcgagctccagccatggatgtataacgaacagtacactttcgttagcaatgatgcgccagaagacacgggaacactcgaactgctgaatgccctgactaaggatccgggctttggtactcggtgcatggaggggaaccccattcctgataccccgtgccaagctggggaggaagaatggaccacagctcctgttcctcaaaccatcatggaccttttccaaaacgggaactggacaatgcagaacccgagtcccgcttgtcagtgcagcagcgacaaaatcaagaagatgttacccgtctgtccccccggagccggcggcctgccccctcctcagagaaaacaaaatactgctgatatcctacaggacctgacaggccggaacattagcgattacttggtgaagacatacgtacagataatcgcgaaaagcctgaaaaacaagatctgggtcaatgagtttcggtacgggggatttagcctaggggtctcaaacacgcaggccctgcccccaagccaggaggtaaatgacgcaatcaagcagatgaaaaagcaccttaagttggcaaaagactcaagtgccgacaggtttttgaatagtctcggcagatttatgacaggactggacaccaagaataacgttaaggtttggtttaataacaaaggatggcacgcaatttcaagttttctgaacgttatcaacaatgcaattttgagggctaacttgcagaagggagaaaatccgagccactacggtataaccgctttcaaccaccccctgaatctgaccaagcagcagctgagtgaggtagccttaatgacaacctcggtagacgtgctcgtctccatttgcgtgatcttcgccatgtcattcgtgcccgcatccttcgtggtttttttgattcaagaacgtgtgtcaaaggccaaacatctgcagttcataagtggggtcaagcccgtgatctactggctttctaatttcgtttgggatatgtgcaactatgtggtccctgccacccttgtaattataatcttcatctgtttccagcagaagtcatatgtatccagtaccaatctgccagtgctggccctgctcctgttgctgtacggctggagcatcacaccactaatgtaccctgcaagctttgtgttcaagatacccagcaccgcttatgtggtgttaacttctgtgaatctgttcattggaatcaatggatctgtcgcgacattcgtactcgagctctttaccgataataaacttaacaatatcaatgacattctgaagtccgtgtttctgatttttcctcacttctgcctgggccgcggcttgatagacatggtcaagaatcaggccatggcagatgcacttgagagattcggggaaaaccgattcgtctcgcccctgagttgggacttggttggtcgcaacttgtttgccatggctgtcgagggcgtggtcttcttcctgatcactgtgctgatacaataccgattctttatcagacctagacccgtaaacgccaagctcagccccctgaatgatgaggacgaggacgttagacgggagcgtcagcgcatccttgatggaggtggacagaatgatatcctggagataaaggaactcaccaagatataccgtcgcaagaggaaacctgcagttgacaggatttgcgtgggcatcccccctggggagtgcttcgggctactgggcgtcaacggggccggcaaatcctctacctttaagatgctcacaggggataccaccgtgacccgtggcgacgctttcctgaacaaaaattccatactgagcaacattcatgaagtccaccagaatatgggatactgcccccaattcgatgctataacagagcttttgaccggacgggaacacgtagaattctttgcattattgagaggggtaccggaaaaagaagttggcaaggtgggggagtgggctatccgaaagctgggcctggtcaagtatggagagaagtatgccggtaattactctggggggaacaaacggaagctgtcaacagctatggcccttattggcggcccgccggttgttttcctcgatgagcctacaacgggtatggacccaaaggcgaggagattcttgtggaactgcgccctgagtgtggtgaaagaaggccgctctgtcgtcctgaccagtcactccatggaggagtgcgaggccttgtgtactcggatggccatcatggtcaacggccggtttcggtgcctcggttcggtccagcatctgaagaaccggtttggcgacggatatactattgtggtccggattgccggatctaatcctgatttaaaacctgtccaggacttctttggcctggctttccccggatcagttttaaaggaaaagcacaggaacatgttacaatatcagcttccctcttcgctgtctagtttggcccggatcttcagtatactcagccagagtaaaaaacggttgcacatcgaagattattcggtgtctcaaacaacactcgaccaggtcttcgtgaacttcgctaaggaccagtctgacgatgatcacctaaaggatctgtcactgcataaaaaccagaccgtcgtggatgtggccgttctaacatcttttctgcaggacgagaaggtgaaagaatcttacgtctag

SEQ ID NO: 109144 - DNA, 1092 bp, Artificial Sequence
  Description of Artificial Sequence: Synthetic coding sequence
atggcttgctggcctcaactgaggctgcttctgtggaaaaatcttacctttcggagaagacagacctgtcagcttctgttggaagtagcttggcctctgttcattttcctgatcttgatttcagttagattaagctaccccccgtatgagcagcatgagtgtcatttccctaataaggccatgccaagcgcgggcaccctcccttgggtacaaggaataatctgtaatgctaataacccgtgcttccgctaccctacaccaggtgaagcccctggggtcgtggggaattttaacaaatcaatcgtcgcccgcctgtttagcgatgcccgacggctcctgctctacagtcagaaggataccagtatgaaagatatgaggaaagttttaaggactctgcagcagatcaaaaagagcagttcgaatctaaagctgcaggatttcctcgtggataatgagaccttcagcggcttcctgtaccataacctctctctgcctaaatccacagtggacaagatgctccgggcagacgtaatcctgcataaagtttttctgcagggatatcagctgcatttgacttcactgtgcaacggatcaaagagcgaggaaatgatccagctgggagatcaggaggtatccgaattgtgtggtttgccccgggagaaactcgctgctgcggagagggtactgcgctcgaacatggatattctgaaaccaattctcatggacgtaacgtgcgatgatattgcacacggccagctgacagtgcctaggtccgcagccgtagcagccacaggagatgccaagccaaatatgatgggcagggagacactgctcagcatttgcgccagtgtccccaaggtggaatttcacgaacgccatatactgaagcacttttctttttgcgtctgtgtgtcagtgagcctgtttcccgccaagggcatcgtgagcttttcttgggccagcttccgcatctgggtcctgtggaaggccgttttttggcaacacggggaatcaatggctgtttgggagggccagctggggctgggactgaacatcgcttttgagtacttcacttccatcgatgtcggatag

SEQ ID NO: 109145 - DNA, 4632 bp, Artificial Sequence
  Description of Artificial Sequence: Synthetic coding sequence
atgaacaagatggccctcgcctctttcatgaaaggaaggacagtgatcgggacccctgacgaagaaaccatggacatagagctgccaaagaaataccacgagatggtaggggtgatctttagtgacaccttctcttaccggttgaagttcaattggggatacaggatccccgtgattaaggaacattcggaatacactgagcactgttgggcaatgcatggggagattttttgttacctcgcgaaatactggttaaaagggttcgtggcatttcaagctgctatcaatgcagctatcattgaggtaacaaccaaccactccgtaatggaagagctgacctccgtcataggcattaatatgaagattcccccattcatcagcaagggcgagattatgaacgaatggtttcattttacctgtctcgtgtctttctccagttttatctatttcgcttcactaaacgtcgctagagagcgtgggaaatttaaaaaactgatgacggtgatggggctgagagagtcagctttctggttgagctggggactgacctacatttgttttattttcatcatgtccatatttatggccctagtcattacctccataccaattgtgtttcatactggctttatggtcattttcacactttacagtctgtacgggctgagtcttattgctctcgctttcctgatgagcgtgctcattaggaaacccatgttggctgggcttgctggattcctgttcaccgtattttgggggtgcctgggcttcactgtgctctaccggcagctgcccctttccctgggatgggtcctttcactgctcagccctttcgcctttaccgccggaatggctcagattacgcatcttgataattatttgtcaggcgttatattcccagatccgagcggggactcttacaaaatgatcgcgactttttttattttggctttcgacacgctgttttaccttatatttaccctgtatttcgagagggtcctgcctgacaaggatgggcatggtgactctccattgttctttcttaaatcatcattctggtctaaacaccagaatacacatcatgagatatttgagaatgagattaatcccgagcacagtagcgacgattctttcgagcccgtcagcccagaattccatggaaaggaagcaattaggattcgcaacgtgatcaaagagtataacggcaaaaccggcaaagtggaggcccttcaggggatcttcttcgacatctatgagggccagatcacagccattctgggccacaacggcgccggaaagtctactctgttaaatatcctgagcggcctgtccgtcagtacggaaggctctgcaactatttataatactcagctgtcagagatcaccgacatggaggaaattcgcaaaaacatcggattctgcccacagtttaatttccagttcgatttcttgactgttagggagaatctcagggtgtttgcgaaaatcaagggaattcagcctaaggaagtggagcaggaggtcaaacggatcatcatggagttagacatgcagtctatccaggatatcatagccaagaagctcagcggcggtcagaagcggaagctgacactcggcatcgccatattaggagaccctcaggtcttgcttctggacgagccaaccgccggcctagaccctttctctcgccatagggtgtggtctctgctgaaggagcacaaagttgatcgacttattctcttctctactcaatttatggacgaagctgatattttagccgaccgaaaggtgttcctttccaacggcaagttgaagtgcgcaggctctagcctttttctgaaacgcaaatggggaatcggctatcatctctctttgcaccgcaacgagatgtgtgatacggagaaaattacttctctcattaagcagcacattcccgatgccaaactcacgactgagagtgaggagaaactcgtgtacagccttccccttgagaagactaacaaattccctgatttgtactccgatttggacaagtgtagcgatcaggggatcaggaattacgccgtcagtgtcacatctcttaacgaggttttcttgaacctggaggggaagtcggccatagacgaaccagattttgatattgggaagcaggaaaaaattcacgtaacccgcaatactggagacgagagtgagatggaacaagtgttgtgttcccttccagaaaccaggaaggctgtgagctctgcggctctctggcggaggcagatctatgctgtggctacgttacgcttcttgaaacttagacgcgagcgaagggctcttctctgcttattactggtcctgggcatcgctttcatccctattattctcgaaaaaatcatgtataaggtcacgcgagaaacgcattgttgggagtttagcccttcaatgtactttctgtctttagagcagataccaaagactcccctaacatctctgttgatcgtgaataatacaggatcaaacatcgaagatttagtgcatagtctaaagtgccaggacatcgtactggaaattgatgacttccggaaccgcaacggcagcgacgacccaagttacaacggggcaatcattgttagtggcgaccagaaagactacagattcagtgtcgcatgcaacacaaagaagctgaactgctttccggttcttatggggattgtaagcaatgctctgatgggtatcttcaattttacggagctgatacaaatggagtcaacgagcttctcaagggatgacatcgtgttggacctaggcttcatcgacggttcaatatttctgctgcttataacaaactgcgtctcccctttcatagggatgtcatcaatttcagactataaaaagaacgttcaatctcagctgtggatatccggactgtggcctagcgcatattggtgcgggcaagccctggtcgacatacccttgtactttctcattctcttttccattcatttgatttattacttcattttcctcggcttccagttgagctgggagctgatgtttgttctggtggtgtgtattatcgggtgcgccgtgagcttgatctttttgacgtacgtgctgagctttatatttaggaagtggcgcaaaaacaacggattctggtctttcggattctttatcattttgatctgtgtgtccacaattatggtttctacccaatacgagaaactgaatttgatactctgtatgatctttatacccagcttcacccttctcggatacgtcatgctgctgatccagctcgatttcatgagaaacttggacagcttggataatcgaatcaacgaggtgaataaaacaatcttgttaactaccctgatcccctacttgcagagcgtcatctttctgttcgtaattcgctgcctggagatgaaatatggcaatgagataatgaataaagacccagtatttcgcatttcccctcgcagccgtgagactcatcctaaccccgaggaacccgaagaggaggacgaggacgtccaggccgaacgtgttcaggccgccaatgctcttacagcgcctaatttagaggaggaacccgtgattaccgccagctgtcttcacaaggagtactacgagaccaaaaagtcttgcttctctacccggaagaagaaaatcgctatccgcaatgtttccttctgtgtgaagaagggcgaggtgctgggcctgctcggtcataacggtgctgggaaatccacctctattaagatgatcaccggctgcaccaaacctaccgctggcgtagtggtattgcaggggtcacgtgcgagcgttagacagcagcacgacaacagtctcaaatttttggggtactgtcctcaggagaactctctatggcctaagttaacaatgaaggagcatctggagttgtacgctgcagttaagggtctcggtaaggaagacgctgcactgagcatctctagactcgtagaggcactgaaactccaggagcagcttaaggcccccgttaaaaccctgtcggaaggaataaaaaggaagttgtgctttgtgctctcaatactcgggaaccctagcgtggtgctgctggacgagcccttcaccggtatggaccctgaaggacagcagcagatgtggcagatcctccaggccactgtcaagaacaaggagcggggcactctactgaccactcattatatgtcagaggccgaagccgtgtgcgacagaatggcaatgatggtctctggcacacttcgctgcatcgggtccatccagcatcttaaaaacaaattcggtcgggactatctcttagaaataaaaatgaaagaacctacacaagtcgaagccctgcatactgaaatcctgaaattgtttccacaggcagcctggcaggagcggtacagcagcctgatggcatacaagttgccggttgaagacgtacatcctctaagcagagcttttttcaagttggaagcaatgaaacagacatttaatttggaggagtactctctatctcaggccactttggaacaggtgttcctggagctgtgtaaggagcaagaattgggcaatgtggatgataaaatcgacacaactgtggaatggaagttgctacctcaggaggacccctag

SEQ ID NO: 109146 - DNA, 1401 bp, Artificial Sequence
  Description of Artificial Sequence: Synthetic coding sequence
atgaacaagatggctttagcaagttttatgaaagggaggacagtcataggtactcctgatgaagagacaatggacatcgagctgcccaaaaagtaccatgaaatggtgggggtgatctttagtgacactttttcatatcgcctgaagtttaattggggttaccggattcccgtcataaaagaacattctgaatacacagaacactgctgggcgatgcatggcgagatcttctgctatctggcgaagtattggctgaaaggatttgtcgcttttcaggctgcaattaatgcggccataatcgaagttaccaccaatcattcggtgatggaggaactgactagtgtgattgggattaacatgaagattcctccttttatcagtaaaggggagataatgaacgagtggttccattttacctgcttggtctctttcagctcgtttatttactttgcctcccttaacgtggcaagggaaaggggaaagttcaagaaactgatgactgtgatgggactgagagaatccgcgttctggctatcctggggccttacctacatatgtttcatcttcatcatgagtatcttcatggctctagtgatcacatcaataccaatagtattccacacaggattcatggtcattttcactctctactcgctctatggactctccctgatcgctctcgcgttcctgatgagcgtgctgatccgaaagccgatgctggcaggcttggcggggtttctattcaccgtcttctgggggtgcctcggctttaccgtgctgtaccgccagctccctctgtcattgggttgggtcctatccttgctgtctccgttcgctttcacagctgggatggctcagatcacccatctcgacaactacctttcaggcgtgattttccctgatccttcaggcgactcctataaaatgattgctaccttcttcatactcgcattcgatacgctgttttatctgattttcactctctattttgagagagtcttacccgacaaagacggccatggtgattctccgttgttctttctaaaatctagcttctggagcaagcatcagaatactcatcacgagatcttcgagaacgagattaatcctgagcactcgagcgatgactcctttgagcccgtctcacccgaatttcatggcaaggaggccatccggataagaaatgttatcaaggaatacaacggaaagaccgggaaggttgaggctctccagggtattttctttgatatttacgaggggcagattacagcaatcctgggccataacggagccggaaaaagcaccctcctaaacatactgagtgggctttctgttagcacagaggggaaaaaaaactacaatggaattaggcacgcgaaacattcccgacactattgctag

SEQ ID NO: 109147 - DNA, 279 bp, Artificial Sequence
  Description of Artificial Sequence: Synthetic coding sequence
atgaataaaatggcgctggcatcctttatgaagggcaggaccgtcataggcacccctgatgaggagacaatggatatagagctccccaaaaaatatcatgagatggtgggtgtaatattcagcgacacattctcctaccgcctgaagttcaattgggggtacaggattcccgtcattaaagaacactctgaatacacaggacacaataagagcttttgcaatggtggtgtcgatatttcttactggaataaatatgaggatacaacatttcacttctag

SEQ ID NO: 109148 - DNA, 1359 bp, Artificial Sequence
  Description of Artificial Sequence: Synthetic coding sequence
atgaacaaaatggctctcgcatctttcatgaagggacgaaccgttattggcaccccggacgaggagaccatggatatcgagctgcccaagaagtatcacgagatggtgggcgtcattttctctgacaccttctcttatcgcttgaagttcaattggggttatagaattcccgtgatcaaggagcattccgagtacaccgagcactgctgggcaatgcacggtgagattttctgctacttagccaaatattggcttaaggggtttgtcgccttccaggctgcaattaatgccgccataatcgaagtgactactaaccattccgttatggaggagctgacctccgtgataggcatcaatatgaaaattcccccgttcatctccaaaggagaaattatgaacgagtggttccacttcacttgtctggtgagtttttcatctttcatctatttcgctagcttaaatgttgctcgggagcggggcaagtttaagaaattaatgaccgtgatgggacttcgggaatctgccttttggcttagttggggcttgacatacatatgcttcatttttattatgtccatctttatggctttagtgataacaagcatacccatcgttttccacactggctttatggtcatcttcaccctctacagcctatacggattgtctttgattgctctggcatttctcatgtccgtgcttataagaaaacccatgctagccgggttggcgggatttctattcaccgtgttttggggttgcctgggctttactgttctctaccgacaactcccccttagcctagggtgggttctgtccctactctctcccttcgcctttacagccgggatggcgcagatcactcacttggataattatctgtccggcgtcattttcccagacccctccggagactcctataagatgattgccactttctttatccttgctttcgataccctcttctatctgattttcaccttgtatttcgaacgggtgctgcctgataaggatgggcacggagattcccctctttttttcttaaagtcttccttctggagtaagcaccagaacacacaccacgaaatctttgagaacgaaataaatcccgagcactctagtgacgatagtttcgaacctgtaagccctgagttccacggtaaagaggcaataagaatccgaaatgtgatcaaagaatacaacggcaaaaccggcaaagtcgaggctcttcaggggagcgaggaacgcctgtgccccgcagctcacaggttacgctgtggtgagcggctttgtcccgcggctcatcatctgggatgcgaggagaggccttgccctgcagcgacacccagcggcaattag

SEQ ID NO: 109149 - DNA, 7788 bp, Artificial Sequence
  Description of Artificial Sequence: Synthetic coding sequence
atggctagcttgttccaccagctgcagatcctggtgtggaaaaattggctgggagtgaagcgccagcctctctggactttggtactcatcctgtggcccgtgattattttcatcatcctagccatcaccagaacgaaatttccaccaacagccaaaccgacgtgttacctcgcacctcggaatctgccatctacgggattctttccctttctgcagactcttctgtgcgatacggactccaagtgtaaggatacaccctacgggccgcaagacttactgaggagaaaagggattgatgatgcgctgttcaaggattctgaaatcctgcgtaaatcaagtaatttggacaaagattcttcgctgagcttccagagcacccaggtccccgagaggaggcatgcttctctggcaactgtgttcccaagccctagttccgatcttgagatcccaggtacgtacacctttaatggctcccaggtgctggccaggatcctagggctggagaagctactgaaacagaactcaacctccgaggatatccggcgagaactgtgtgatagctacagtggatatatagtagacgatgccttttcctggacatttttgggccggaacgtattcaataagttttgtctctccaacatgaccctccttgagagctcactacaggagctgaacaaacagttttcccagctgagtagtgaccccaacaatcagaagatcgtcttccaggagatcgtgcgaatgctgtctttcttctcccaggttcaggagcagaaggccgtctggcaactgctgagctctttccccaacgtattccagaacgacactagcctgtccaacctgttcgatgtgcttcggaaggctaattccgtgcttcttgtggtccaaaaagtgtatcctaggttcgccacaaatgaaggtttccgcacactgcagaagtctgtgaaacatttactgtacaccctagattccccggctcagggagacagcgataacatcacccatgtttggaatgaggatgacggacaaactctgtctccaagcagcctcgcggcccagttgcttatacttgagaactttgaggatgcactactgaatatctctgccaactctccatatatcccctatctagcgtgtgtgcggaacgtaacagacagcctggctagaggatcaccggaaaatctgagattactacagagtactatcaggtttaaaaagagttttctgcgcaacggcagttatgaggattatttcccccctgtgccagaagtgctaaaatccaaattgagtcaactccggaatttaaccgagttgctgtgtgaatccgaaacgttttccttgatcgaaaaatcttgtcagctttccgacatgtccttcggtagcttatgcgaagaatccgagtttgacctccagctgctagaagccgccgaactaggcacagagatagcagctagcctgttatatcacgataacgttatatccaaaaaggtgagggatctgttgacaggtgatccgagcaaaattaaccttaatatggatcagtttcttgaacaggccctgcagatgaactatctcgagaacattactcagttaatacctatcattgaagcaatgctgcacgtcaacaacagtgccgacgccagtgagaaacccggccagctccttgaaatgttcaagaacgtcgaggaactcaaggaggatctgagacggacgactggcatgagcaataggaccattgataagctactcgcaattcctatccccgataacagggcggaaattatctcacaagtgttttggctgcattcctgcgatacaaacatcactactcctaagctcgaggacgctatgaaggagttttgcaatctgtcactttctgaacgctcccgtcaatcctatctcattggtctgaccttgctgcactatctgaacatctataacttcacttacaaagttttctttccacggaaagatcagaaacccgttgagaaaatgatggagctgttcatcagactcaaggagatccttaaccagatggcttccggcacacaccctctgctggataagatgaggagcctaaagcaaatgcatctaccacgttcagtccctctgacacaagccatgtacaggtcaaatcgcatgaacaccccccagggatccttctccacaataagtcaggctctgtgtagccaaggaattaccaccgaatatctgactgctatgctcccttcgtcccaacgacccaaaggcaatcataccaaagactttctgacttacaagctgaccaaggagcagattgcctccaagtacgggattcctatcaatagtacccctttttgtttcagtctgtacaaggatataatcaacatgcctgcagggccagtgatttgggccttcctgaaacccatgttgctgggcaggatcctgtatgcaccctacaatcccgtgaccaaagcaataatggagaagagcaatgtgaccctgagacaactggcggagttgcgggagaaatcccaggagtggatggacaagtccccgctgttcatgaattcgtttcacttacttaatcaagctatccccatgttacagaatactctgagaaatccttttgtgcaagtatttgtcaagttctccgtcgggctggatgcagtcgaattgctcaaacagatagatgagctggatattctgcgactgaagttagaaaataatattgatattattgaccaactcaacacactttccagcctgactgtgaatatttcctcatgcgtcttgtacgaccgaattcaggccgctaaaaccatcgacgaaatggagcgcgaggcgaaacggctttacaaaagtaacgagcttttcggctccgtaatcttcaaactcccttctaatcggtcttggcaccgcggctatgactctgggaacgtgttcctgcctcctgtgatcaaatacacgatcaggatgtccttaaaaacagcccaaaccactcgctctctgaggaccaaaatctgggctccggggccccacaattccccatcacacaaccagatctacggcagagctttcatttatctgcaggattcgattgagagagccataatcgaattgcagactggtcgtaactcccaggagattgctgtgcaggtgcaggctatcccttatccctgttttatgaaggataactttttaacaagtgtgtcctatagcctgccaatcgttctcatggttgcatgggtggtatttatcgccgcttttgtcaaaaaactcgtgtacgagaaagatctgagactgcatgagtacatgaaaatgatgggcgtcaattcctgttcacatttttttgcgtggcttattgaatcggtcggatttttgttagtgaccatagttattctgatcatcattttaaagttcggcaacatcttacccaagaccaacggttttattctctttctgtatttcagtgattacagcttttccgtcatagccatgagctacttgatttcagtcttcttcaacaacaccaacattgccgcgctgatagggagtcttatttacatcatcgccttcttccctttcatagtactcgtgacagtcgaaaacgaattgtcgtacgtgctcaaggtgttcatgagcctcctttcccccaccgccttcagttacgccagtcagtacatcgcccgctacgaggagcaggggataggactccaatgggagaacatgtatacaagtcccgtacaggatgacaccacaagctttgggtggttgtgctgcctaatacttgcggactccttcatttattttctgatcgcatggtacgtgagaaatgtgttcccgggcacatatggcatggcagcaccatggtatttcccgatcctgccaagttactggaaggaacggttcggctgcgccgaagtgaaacccgagaaatcaaacggcctgatgttcaccaatataatgatgcagaacacaaatccatctgctagtccagagtacatgttttcctccaatatagaaccggagccaaaggacctgaccgtcggagtggccttacatggagtgacaaagatctatgggagcaaagtcgcagtggataatttgaatcttaacttctatgagggccacattacgagcctcttagggcctaacggggcaggcaagactaccactatctctatgctgacaggactgtttggtgcatccgcaggcactatctttgtgtacggaaaggacattaagaccgacctccacactgttcgtaagaacatgggagtgtgcatgcaacacgacgtactgttctcctatctgacgacaaaagagcatctcctgctttacgggtccatcaaagtgcctcattggacgaagaaacaacttcatgaggaagtcaaacgaaccctgaaagacactgggctttatagccatcggcataaacgcgtgggaacactctcggggggaatgaagcgtaaactgagtatttctatagcactgattgggggaagcagggttgttatattagacgaacccagtaccggagtggacccttgctcaaggagatcaatttgggacgtgatctccaagaacaaaacagcgcgcactattatactgtccacgcaccacttggacgaggccgaggtcttgagcgaccgtatcgcttttctggagcagggtggccttcggtgctgcggatcacctttctaccttaaagaggccttcggagatggatatcaccttaccctgactaaaaagaagtcgcccaatttgaacgcaaatgcagtttgtgatactatggccgtgaccgccatgatccagagccacctgcccgaagcctatctgaaagaggacattggcggggaacttgtttatgtcctgccgccattctccaccaaggtctccggggcttatctttcccttttgagggctctggataacgggatgggcgatcttaacatcggatgttatggcatatcagacactaccgttgaggaggtattcctgaacctcacaaaggaatcgcagaagaatagtgcgatgagcctggagcacctcacccagaagaagatcgggaatagtaatgcgaacggaatcagtacacccgacgatttaagtgtgagcagctccaactttactgaccgggatgataagatattgactaggggggagagactcgatgggttcggcctgctgctaaaaaagattatggcgatcctcataaaacgctttcaccacacacgtagaaactggaagggcctgattgcccaagtcatactacctatcgtttttgtgactacggccatgggcctgggaaccctacgcaattccagcaactcctatcccgagatccagatctcaccttcactgtacgggaccagcgaacagaccgctttctacgccaactatcatcccagtacggaggccctggtttccgccatgtgggatttccccggcattgataatatgtgtttgaatacctcagatctccagtgcctcaataaggactccctcgagaagtggaacaccagcggggagccgatcactaattttggggtgtgctcatgcagcgaaaacgtgcaggagtgtcccaaatttaactattctcctcctcatcgaaggacatactccagccaggttatttataatctgaccgggcagcgtgtcgagaattatctcatatcaacggcgaacgaattcgtgcagaagcggtacggtgggtggtcctttgggctccctttgactaaggacctgcggtttgatattaccggtgtcccagctaacagaacactggctaaggtgtggtatgaccccgagggatatcactccttaccggcttatctcaacagccttaataatttcctcctgcgggtaaatatgagcaagtatgatgccgccagacacggcattatcatgtattcccatccttaccctggcgtacaggaccaagaacaggccaccatttcctcgttgattgacatcttggtggctctgtctattctcatggggtactccgtaactacagcttcatttgtgacttatgtggtgcgtgaacaccagacaaaagctaaacagctgcaacatatctctggaataggcgtcacatgttactgggtgaccaattttatatatgacatggttttctatctggttcctgtggcattttccattggtattatagctattttcaagctccccgctttttattccgagaataacttgggcgccgtttcccttctgctcctcctctttgggtatgccacgttcagctggatgtacctactcgctggactcttccatgaaacaggcatggcattcatcacatatgtctgcgtgaatctatttttcgggatcaatagtattgtatcactctcagtggtctacttcctgtccaaggagaaacctaatgaccctaccctggagctgatcagtgaaaccctcaagcgcattttcctgatcttcccgcagttctgtttcggatatgggttgatcgaactgagccagcaacagagcgtccttgatttcctaaaagcgtacggggtcgagtaccctaatgaaacattcgagatgaacaaactgggggccatgttcgtggcactggtcagtcagggaactatgttcttttcactgaggcttcttataaatgaatccctgataaaaaagctgcgtctgttcttccgcaagtttaattcatctcatgttcgagaaactatcgacgaggacgaggacgttcgggctgaaagactgagagtggaatccggagctgctgagtttgacttggtgcagctttactgtctgaccaaaacctaccaactgatccataagaaaataatcgccgtcaataatatttcgataggcatcccagcgggcgaatgctttggcctgttaggagtgaatggggcaggaaaaactaccattttcaagatgttgactggagatattatcccgagttctggaaatattcttatcaggaataaaacaggcagtttaggtcacgtcgactcccacagttccctggtgggatattgtcctcaagaggatgcactggatgatctcgtgactgtggaggagcatctgtatttttatgccagggtccacggtatccctgagaaagacattaaggagacagtccacaagctgcttcgcaggttgcatcttatgccatttaaggacagagctacttcaatgtgctcatacggaacaaaacggaaactaagcaccgcccttgctctgattggaaagccatcgatcctgttactggatgagccgtcctcaggcatggaccccaaatccaagcgtcacctctggaaaattatctccgaggaggtgcagaacaagtgttccgttatccttacaagtcacagcatggaggagtgcgaagctctctgtacccggctcgcgatcatggtgaacggtaagtttcagtgcataggatcactgcagcacattaagtctaggtttggcagagggttcaccgttaaagtgcatcttaaaaacaataaagtgacaatggaaacccttacgaaatttatgcagctgcatttccccaagacatacttaaaggatcagcatttgtctatgttagaatatcatgtgcctgtgaccgccgggggagtggccaacatctttgacttgctcgaaacgaataagactgcgttgaacatcaccaatttcctcgtctcccagactactctggaagaagtctttattaattttgctaaggaccaaaagagttacgagaccgcagacacaagctctcagggcagcactatttccgtcgattcacaagacgaccaaatggagtcctag

SEQ ID NO: 109150 - DNA, 6834 bp, Artificial Sequence
  Description of Artificial Sequence: Synthetic coding sequence
atgtttacctatattaaaatcataacgagtggcgattctgataatattacccatgtgtggaatgaggatgacgggcaaacgctctctccgagtagcttagctgcccaactgctgatcctggagaattttgaggacgccctcttgaatatatcagccaattccccgtacatcccgtatctggcttgcgttagaaacgtgactgactctttagcacgcgggtcccctgaaaaccttcggcttctacaatccaccatccgcttcaaaaagagtttcctacgcaatgggagctatgaggattattttccaccagtccccgaagtcctgaagagcaaactgtctcaactgaggaatttaaccgaactgctctgcgaaagtgaaaccttctcgttaatagaaaaatcctgtcagctatctgatatgtcatttggcagtctttgcgaggagagtgagttcgatctgcaattattggaggccgctgaacttggaaccgagatagctgccagtctcttgtaccacgacaacgtcatcagcaaaaaggttcgggacttgctgacgggggaccctagtaagatcaacctgaatatggaccagttcctggagcaggcccttcagatgaactatctggagaacatcactcaactcatacctatcatcgaggccatgctgcacgtgaacaacagcgccgatgccagcgagaaaccgggtcagctcctcgaaatgtttaagaatgtcgaggaattgaaagaggacctgagaagaaccaccggtatgagtaatcgtactatcgataaactcctggctatcccaatacccgataatcgggctgaaataatttcacaggtgttctggctgcattcttgtgacactaacatcacgaccccaaagctggaagacgccatgaaggaattttgcaacctgtcactgagcgagcgaagcaggcaatcttacctcattggattgacactgctgcattatctcaacatctacaattttacgtacaaagtgttttttcctcggaaggaccagaaacccgtagaaaagatgatggaactcttcattagactaaaggagatcctgaaccagatggcatcgggcacccatcctctgctggacaagatgcgctcattaaaacagatgcatttaccccgctccgtacccttaacccaggccatgtacaggtccaatcggatgaatacaccacaaggatcattttctactatcagccaagcactgtgtagccaagggataaccaccgaatatctgacggcaatgctcccgtccagtcagcggcccaaaggtaaccacacaaaggactttctaacatataagctcacaaaggaacaaatcgctagtaagtacggcatccccattaattctacccccttctgcttcagtctttataaggacatcatcaacatgcctgccgggcccgtgatttgggcttttctaaagccaatgttgctcggccgaatcctgtacgccccgtataatcctgtgaccaaggcaatcatggagaaaagtaatgtgaccctgcgacaattagcagaattaagagagaagtcccaggagtggatggataaaagccccctgttcatgaatagttttcacctcctgaatcaggctattccaatgctgcagaacacccttcggaaccccttcgtgcaggtgttcgtgaaattttccgtcgggctggatgcggtggagctacttaaacagattgacgaattagacattctgagactgaagttggaaaacaacatcgacattatagaccaactgaacactctgagctccctcacggttaatatctcctcatgcgtgctgtacgaccgcatccaggctgccaaaacaatcgacgaaatggaaagagaagccaagcgactttataagtccaatgagttgtttggtagcgtgatttttaaactgccgagcaaccgctcatggcaccgcggttacgattcaggcaatgtctttctccccccagtaatcaagtatactattaggatgtctctgaagaccgcacagaccacacggtcactcagaacaaagatatgggctcccggcccccacaatagcccctcacacaaccagatttatggacgagctttcatatatttgcaggacagcattgagcgcgcaattatcgagctgcagaccgggagaaatagccaggagatcgcagtccaggtgcaggctattccgtatccatgctttatgaaggacaacttcctcacatcggtgagttattcactcccgattgtgctgatggtcgcttgggttgtgtttatagccgcctttgttaagaagctggtttatgaaaaagacctgaggctgcatgagtatatgaaaatgatgggcgtgaatagctgcagccacttttttgcttggttaatagaatctgtggggttcctgctggtcaccatcgtgatcctgattattatcctgaagtttggtaatattctgcccaaaaccaacggctttatactcttcctgtatttctcggactacagcttctctgtgatagctatgtcttacctcattagcgttttctttaacaacactaatattgctgcactaatcggatcacttatttacattatcgctttcttcccgtttattgttctcgttacagtagaaaacgagctgtcgtacgtcctcaaggtgtttatgagccttctgagcccaaccgccttctcgtacgctagtcaatacatcgccagatatgaagagcagggaatcggactgcagtgggagaatatgtatacatccccagtacaggacgacactaccagctttggctggctctgctgcttaattttggcagattcattcatttactttctcatagcatggtatgtccggaacgtatttcctggaacatacggaatggccgccccgtggtacttccccatcctcccctcctattggaaggagcgcttcggatgcgcagaggtgaagcccgagaagtcaaatgggttgatgttcacaaatatcatgatgcagaataccaacccatcagcgagcccggagtatatgttctcctccaacatcgaaccagagcccaaagacctgactgtgggagtggccctgcatggagtgactaagatttacgggagcaaggtggctgtcgacaacctcaatctgaatttttacgagggccacattacatcgcttctcgggccaaatggcgctggaaaaaccacaacaatctccatgttaaccggcctatttggagcaagtgcgggaacgatttttgtctatgggaaggatattaagaccgacctgcacactgtaaggaagaatatgggagtttgtatgcagcacgatgtgctgttcagctacctcaccaccaaagaacacttgctgctgtacgggagcatcaaggtaccgcactggactaagaaacagctgcacgaggaagtaaaacgaacactgaaggatacgggactgtactcacacagacacaagcgggtcggcacgctgagtggcggcatgaaaaggaagctcagtatctcaatcgcattaattggtggaagcagggtggtgatcctagacgagccctcaactggggtggacccatgtagtcgaaggtctatatgggacgtcattagtaagaataaaaccgcccggaccatcatcttgtcgacacatcacctggatgaggcagaggtgttgagcgaccggatcgcttttctcgagcagggcggcctccgctgttgtggaagcccattttatttgaaggaggcctttggggacgggtaccatttaacgctcaccaagaagaagtccccaaatctgaacgcaaacgcggtgtgtgatactatggccgtaactgccatgatacaaagtcatctccctgaggcatacttaaaagaagacattggtggagagctcgtatatgtactgcccccattctctactaaagtgagtggtgcctacctgtcccttttgagggccttggacaacgggatgggggatctgaatatcggttgctacgggatttctgacacgaccgtggaggaagtttttctgaacctgacaaaggaatcccaaaagaatagtgccatgtctttagagcacctgactcagaagaagatcgggaacagtaatgctaatggcattagcacacccgatgatctgtctgtgtcgtcttctaacttcaccgaccgggacgacaaaatactcactcgcggcgagaggttggacggattcggactcctgcttaagaaaatcatggcaattctaataaagcggtttcaccataccaggaggaactggaaggggctcattgcccaagtgattttgccaatcgtattcgtgactacagcaatgggtctgggtactttgaggaactccagtaatagttatcccgagatccagatctccccatctctctatggcacctcagagcagacagcattttatgctaactatcatccctcaaccgaagctctcgtctctgcgatgtgggatttccccgggattgataatatgtgcctgaataccagcgatcttcagtgtctaaataaagatagtctggagaagtggaatacctcgggggagcctatcacaaatttcggcgtatgtagctgttcagaaaatgtgcaggagtgcccaaaatttaactattctccaccacataggcggacctacagttcccaagtgatctataatctaacaggacaacgggtggagaactatcttatatccacggccaacgaattcgtgcagaaaagatacggggggtggtcttttgggcttccgcttacgaaggaccttcggtttgatatcacaggagtgcccgccaaccgaaccctggccaaagtgtggtatgaccctgaagggtatcacagcctgccggcctacctcaatagtctaaataattttctgctgcgggtgaacatgtcgaaatatgacgcagcccggcacggaatcatcatgtatagccacccttaccctggggtccaggaccaggaacaagcaaccatttcaagtctcatagacattctggtagctctgtcaattctaatgggctacagcgttactactgcttcctttgtcacctatgtcgtgcgcgaacatcagacgaaggcaaagcagttgcaacacatctctggcatcggggtgacatgttactgggtgacaaattttatatatgacatggttttctatctggtgccagttgctttcagtatcgggatcattgctatttttaagctgccggcattttatagtgaaaataatctcggcgctgtatcactcttgctcctgctttttgggtacgccactttctcctggatgtacctgcttgccggtctgttccacgaaacgggtatggctttcattacttacgtctgtgttaacctcttcttcggaattaactccattgtgagcctgtccgtcgtttacttcctgagtaaggagaagcccaacgacccgaccctggaattaatcagtgagacacttaagcgaatctttctgatttttcctcaattctgtttcggctacggactaatagaattatctcagcagcaatcagtattggactttctcaaagcctacggagttgagtaccctaacgagacattcgagatgaacaaactcggcgcaatgttcgttgcgttagtctcacagggcaccatgttcttctctttgcgcctacttatcaatgaatctctcattaagaagcttcgtctgttcttccgcaagtttaactccagccacgtgagggagactatagatgaagatgaagacgtgagggccgaacgactaagagttgagtccggggccgccgagtttgaccttgtgcagctgtactgccttactaaaacttaccagctgatccacaagaagatcatcgctgttaacaatatctccatagggattccagccggagagtgcttcggactgttgggtgtgaatggcgctgggaagacaacaattttcaaaatgctcacaggagatatcatccccagctcaggaaacattttaatccgtaacaaaactggatcactgggccatgtcgattcccattcaagtcttgttgggtactgcccacaggaggacgccttggacgatcttgtcactgttgaagagcacctgtatttttatgcacgcgtgcacgggatcccggagaaggacataaaggagactgtccacaagcttctgcgccgcctacacctgatgcccttcaaggacagagcaacgtcaatgtgctcttatggcactaagcggaagctctccaccgcactagccctaatcggcaagccaagtattttgctccttgatgagccatcttccggcatggaccccaaaagtaagaggcacctgtggaaaattatcagcgaagaggtgcagaataaatgtagcgtgatcctgactagtcactcaatggaggaatgcgaggcgctatgtactagactcgccattatggtgaacggtaagttccagtgcatcgggtctctgcagcatattaaatcgcgattcggccgaggatttaccgttaaagtccacctgaaaaacaataaggtcactatggaaacattgactaagttcatgcagctgcacttccccaagacttacttaaaggatcagcatctgtctatgcttgaataccacgtgccagtgaccgcgggaggcgttgcgaacatatttgatttgctggagacaaacaaaaccgcacttaacatcaccaattttctggtgtcacagactaccttagaggaggtttttattaatttcgccaaagaccagaaaagctacgaaaccgccgatacctctagccaaggctctaccatcagcgtcgacagtcaggacgaccagatggaatcttag

SEQ ID NO: 109151 - DNA, 15177 bp, Artificial Sequence
  Description of Artificial Sequence: Synthetic coding sequence
atggggcatgctggctgtcaattcaaggctttgctgtggaagaattggctgtgtcgcctgcgtaacccagtgctgtttttggcggaatttttttggccttgcattctttttgtgatcctaacagtactacggtttcaggagcctccacggtatagggatatctgttaccttcagcctcgagacctcccctcatgtggcgtcattcccttcgtccaatcccttttgtgtaacaccggaagtcggtgcagaaacttttcgtatgaaggatctatggaacaccatttccggctatccagatttcagacagccgccgaccccaaaaaggttaataacctggccttcctcaaagagattcaggatctggccgaggagatccatgggatgatggataaagcaaaaaacctgaaacgactgtgggtcgagagatctaatacaccggactccagttatggttcgtccttcttcaccatggacctcaataaaaccgaggaggtcatcttaaagcttgaaagcctccatcagcagccgcacatctgggatttcctgctgttactcccaagattgcatacttcgcacgatcatgttgaagatggaatggacgtagcagttaacctactgcagacgatcttgaactctctgatctcactggaggacctagactggcttccccttaatcaaaccttttcacaggtaagtgagctggtgctgaatgtgaccatctccaccttgactttcctacagcagcacggagtggcagtgactgagccagtgtaccacctctctatgcagaacattgtgtgggaccctcagaaagtacagtatgatttgaagtctcagttcgggtttgatgacctccacaccgagcagatcctcaattctagcgccgagctcaaagagatcccaaccgatacgagtctggaaaaaatggtatgtagtgtgctctctagcacttctgaagacgaagccgaaaagtgggggcatgtcggaggttgtcatcctaagtggtctgaggccaaaaattacctagtgcatgccgtcagttggctccgcgtgtaccagcaagtgtttgtccagtggcagcagggaagcctactgcagaagactctgacagggatgggccatagcctcgaggctctgcgaaaccagtttgaagaagaatcaaaaccttggaaggtagtagaggccttgcacaccgcgctattgctgttgaatgactccctgtctgcagacggacctaaggataatcatacatttccaaagatactgcagcacctgtggaagctgcagagcctcctccagaatttaccacagtggcccgctctgaaacggttcctgcagctcgacggggcattgaggaacgctattgcacaaaatctacacttcgttcaggaagtcttgatatgtttggagacctcagccaacgattttaaatggttcgagctgaaccaactcaagctcgagaaagacgtattcttctgggagcttaagcagatgttggccaagaatgccgtttgtcccaatggtcgattttccgaaaaggaagttttcctgccccctgggaactcctccatctggggcggtctgcagggcctgttgtgttattgcaacagctccgagactagcgtgctgaacaaattattgggttctgtcgaagacgctgaccgaatcctacaggaagtgattacctggcataagaatatgtccgtacttattcccgaagagtatctggactggcaagagctggaaatgcagctctccgaagcttctttgtcctgtaccaggctgttccttttgttgggcgccgacccatccccagagaacgacgtctttagtagcgattgcaagcatcaattggtgtctaccgtgatttttcacacactcgagaaaactcaattcttcttagagcaagcttactactggaaagctttcaaaaagttcattagaaaaacctgcgaggtggctcagtatgtgaacatgcaggagtccttccagaatcgtctcttggcttttcccgaggaatccccatgcttcgaagaaaacatggattggaagatgatatcagataattatttccagttcctcaacaacttactgaagtcacccacagcgagtatttcccgagctcttaatttcacaaagcatctgttgatgatggaaaagaagttacatacactggaagatgagcagatgaacttcctcctgtcctttgtagagtttttcgagaagttgctgctccccaacttatttgactcctcaatcgtcccatccttccactcactgccttcattaaccgaggatatcctcaatatctctagtctgtggaccaaccacctgaagtcacttaagcgtgacccctcggctacagacgcccagaagttgctggagttcggtaatgaagtgatctggaagatgcagacactcggctctcactggatcagaaaggagcccaagaatttgctacgtttcattgagttaatcctattcgaaattaatccaaagttgctcgagctttgggcttacggaatttctaagggcaaacgtgcaaagttggagaatttcttcaccctgctgaattttagtgtacccgaaaacgaaatcttatcaacttcttttaatttttcacagctgttccattcagactggccgaaaagcccagcgatgaatatcgatttcgttcgactgagtgaagccatcatcacgagcctgcatgaattcgggttcttggagcaggaacagatctccgaggctctgaacacggtctacgcaataaggaacgcatccgacctgttttctgcgctctccgagccccagaagcaagaggtcgataaaatccttactcatatccacctaaacgtgtttcaagataaggatagtgctctgctgcttcagatatactcttctttctatcgttacatctatgaactccttaatatccagtcgcgcggctcctccctgacttttttaacacaaatctccaagcacatcttggacattatcaagcaattcaactttcagaacatcagcaaggcgtttgcctttttgttcaagactgccgaagttctgggagggataagcaacgtgagctactgccagcagctgttatctatctttaattttcttgaactgcaagcacaatctttcatgagcaccgagggccaagagctcgaggtaattcatacaactctcaccggactgaaacaactccttattattgatgaggattttcgaatctcccttttccagtacatgtcccagttctttaattcatccgtggaggatttgcttgacaataaatgtctcatttctgacaataagcacataagcagtgtcaactattcaacttcggaggagtccagctttgtgtttcccctcgcacagattttttcaaacctgagcgcaaatgtgtcggtctttaacaagtttatgagtattcattgcacagtatcttggctccaaatgtggactgaaatctgggagaccattagtcagctctttaagttcgacatgaatgtgttcacgtccttacatcacggcttcacgcagctgctcgatgaacttgaagacgatgtaaaagtctcaaagtcttgccaggggattctcccaacccataatgtcgcacgcctgattctcaacctgttcaagaacgtaacacaggccaatgattttcacaactgggaggactttcttgatctacgcgacttcctggtcgcgctgggcaatgcccttgtgtcagtcaagaagttaaacctagaacaagtggaaaaatccctgttcaccatggaggctgcccttcaccagctcaaaacatttccgttcaacgagagtacctctcgggagtttctcaactcacttttggaggtcttcattgagttctcgtccacatctgagtatattgttcgaaatctggattccattaacgatttcctgagtaataacctcacaaactacggtgagaagtttgaaaatattattacagaactgagggaggcaatcgtattcctccggaatgtgtcgcacgatcgtgacctgtttagctgcgcggacatcttccaaaatgtgaccgagtgcatcctagaggatggcttcctctatgtgaataccagccaacgcatgttacggatccttgacacactgaactctaccttctcctccgagaacaccatatcttcacttaaaggctgtattgtgtggctcgatgtgattaatcatctctatctgttgagcaacagcagcttctctcaagggcatctccagaacattctcgggaattttcgagatatcgagaacaagatgaatagtatcctgaaaattgtcacctgggtactcaacatcaagaaaccactctgttctagcaatggcagccatataaattgcgtaaacatatatctgaaagacgtgacagattttctgaacatagttctcaccactgtgttcgaaaaagagaagaagcctaaatttgagatccttctcgcattactgaacgatagcaccaaacaggtgaggatgtccatcaataatctgaccactgattttgactttgcttctcaaagcaactggaggtacttcactgaactgatactgaggcccattgagatgtcagacgaaattcccaatcagttccagaacatatggttgcatctcatcaccttggggaaggagtttcagaagttggtgaaaggtatctacttcaacatcctggagaacaactcttcttcaaagactgagaaccttttgaacatctttgccaccagccctaaggaaaaggatgttaactccgtaggcaattctatttaccatcttgcctcctatctggcctttagtctcagccatgacctgcagaacagccccaagatcattatttcaccagagataatgaaggccactggactgggtatacagctcataagagatgttttcaattcccttatgcccgttgtccatcacacaagcccacaaaacgcagggtatatgcaagccttaaaaaaggtgacttcggtaatgcgaactttgaaaaaggccgacattgatctgctagtggatcaactggagcaggtctccgtgaatcttatggatttctttaagaatatttccagcgtgggtaccgggaacttggtcgttaatcttttggtgggcctgatggagaaattcgccgactcatctcactcttggaatgtaaaccacctactgcagctgtctaggctgttccccaaagacgttgttgacgcggtcatcgacgtttactacgtgctcccccatgctgtaagattactccagggcgttccagggaaaaacatcaccgaaggactgaaagacgtgtactcctttaccctgctgcacggcataacgattagtaatattaccaaggaagattttgccatcgttataaagattctgctcgacaccatcgagctcgtgtctgataagcctgacatcatctccgaagctctggcgtgcttccctgttgtttggtgctggaaccacactaattccggcttcagacagaattcaaagattgacccctgtaatgtccacggtctcatgagctcctctttctacggcaaggtagcctcaattcttgaccactttcacctgtctcctcagggtgaggatagtccttgctctaatgagagctcccgtatggaaattactagaaaggtggtctgtatcatacacgaattggtcgactggaactccatattgcttgaattaagcgaggtgtttcatgtcaacatcagtttagtgaaaaccgttcagaaattctggcacaagattttgccttttgtccccccttccatcaaccaaacccgagattctatctcggagttatgcccttctggcagcattaagcaggtggccttgcagatcatcgaaaaactgaaaaatgtgaactttaccaaggttacttccggagaaaatatattggataagttaagcagtcttaacaaaatcctgaacatcaacgaggatacagagacaagcgtgcagaacatcatctctagtaatctggagagaactgtacagctgatatcggaggactggagtctcgaaaagagtactcataacctgctcagcttgttcatgatgctgcagaatgccaacgtcacggggtcatcactggaggccctttccagctttatcgaaaagtctgagactccatacaactttgaagagctttggccaaaatttcagcagattatgaaggatctaacgcaagactttaggattcggcacctgctatccgagatgaataagggtatcaagtccatcaactccatggccctgcagaagatcaccctgcagtttgcccacttcctcgaaatcctcgattctccctcattgaagactctggagatcatcgaagatttccttctggtgaccaagaactggctccaggaatacgccaatgaggattactctcgcatgatcgagaccctgttcattcccgtgacaaatgagagcagtaccgaggatatcgcgttacttgctaaggcgattgccactttctggggtagtctcaagaatattagcagagctggcaatttcgacgtggcatttctgacccaccttctcaatcaggaacagctcaccaatttttcggtggtgcagttgctgttcgagaatatattaatcaatcttatcaataaccttgccgggaactcccaggaagccgcctggaacctaaatgacacagatcttcagatcatgaactttattaacctgatcctgaatcatatgcagagcgagacttctcgaaagaccgtgctgtccctgcgatctatcgtagacttcaccgagcagtttcttaaaacatttttcagcctttttctcaaggaggacagcgaaaataaaatatcgctgcttctgaagtattttcacaaagatgtgattgccgagatgtctttcgttcccaaagataaaatcctagaaatcctgaaactggatcagttcctgaccctgatgatccaggaccgcctcatgaatatattttctagtctcaaagaaaccatctatcacttgatgaagtcatcttttatactcgacaatggagaattctactttgatacgcaccaggggctcaagttcatgcaggacctttttaacgcgcttcttagggagacgtcgatgaaaaataaaacagaaaacaacattgactttttcactgtggtgtctcagctgttttttcatgtcaacaagagtgaggatttatttaagctgaatcaggacctcggctccgccctacacttggtgcgcgaatgttccacggagatggcccggctgctcgacactatcctgcacagtccaaacaaggacttttacgcactatacccaaccttgcaagaggttattctcgccaacctcaccgacctcctgttcttcatcaacaatagctttcctttgcgcaacagagcgaccctggaaattactaaaagattggtgggcgctatcagtcgagcctctgaggagtcccacgtgttgaagcctttactggaaatgtcggggactttggtcatgttgctgaacgattctgctgaccttcgcgacctggccacgagcatggactcaatcgtgaagctgttgaagttggtgaagaaggtgagcgggaaaatgagcactgtcttcaaaacccactttatcagcaatacgaaagactctgtaaagttcttcgatactctatatagcatcatgcagcagtccgtgcagaatctagtcaaagaaatcgccaccctcaagaagatcgaccactttactttcgaaaaaattaacgacctgttggtacctttcttggacctcgcgtttgagatgattggggtcgaaccctatatatcgagtaactccgatattttcagtatgtcgccctccatcctttcatatatgaaccagtccaaagatttcagcgacattctcgaggagattgcagagtttctaaccagcgtgaaaatgaacctggaagacatgcggtcactcgcagttgcgtttaataatgagactcaaacattctccatggattctgttaacctgcgagaagagattcttggctgcttggttcctatcaacaacatcaccaaccagatggacttcctctaccctaaccccatttcaacgcatagtggcccacaggatatcaagtgggagataatccatgaggttattccttttctggacaagatcttgtcacagaatagcacagaaatcggtagttttctgaagatggtgatttgtctgacactggaggccttgtggaagaacctgaagaaggacaattggaacgtgtcaaatgtcttaatgacctttacacaacaccctaacaacctcctgaagacaattgagaccgtgctggaagcttccagcggtattaagagcgactacgaaggcgatcttaataagtcactgtactttgacactcccctgtcacagaatatcacccaccaccagctggagaaggccatccataacgtgcttagccgcattgccctctggcgcaaaggattactgttcaataacagcgaatggataaccagcacacgcactctgtttcagcccttgttcgaaatcttcatcaaggccactacagggaagaacgtgacctctgaaaaagaggagcgaactaagaaggaaatgatcgatttcccctactcattcaagcccttcttctgtcttgaaaaatacctgggcggcctgtttgttctgaccaaatattggcagcagatccccctgactgatcaatcagtagttgaaatctgcgaagtttttcagcagaccgtgaagccatctgaagccatggagatgctgcaaaaagtgaagatgatggtggttcgagtgcttaccatcgtcgctgagaatccgtcttggaccaaagatatactctgtgccacactctcctgtaagcaaaatggaatccgccatcttatcctgtccgccattcagggcgttacactcgcccaggatcacttccaggagatcgagaagatatggagcagccctaaccaactaaactgtgagtcactaagcaagaacttaagctcgaccctcgaatcctttaaatctagtctggagaacgccaccgggcaggactgcacgagtcagccacggctggaaacagtacaacagcacctgtatatgcttgcaaagtctctggaagagacatggtcttccggcaacccaatcatgactttcctgagtaatttcacggtgaccgaggacgttaagattaaggatcttatgaagaacattacaaagctaaccgaggaactacgtagctcaatacagattagcaatgagaccattcatagtattctggaggctaacatctctcactcaaaagtgctttttagcgctttgaccgtcgctctttccggtaagtgcgaccaggagatactgcatttactgttgacattccctaaaggggaaaaatcttggattgcagctgaagaattgtgtagcttgcccggctccaaagtgtattccctcattgtgctgctgtcgcgaaacctggatgtgagggccttcatctataaaacactgatgccctcagaagccaacgggctgctgaatagccttttggacatagtgagtagtctgtccgcgctgctcgccaaagcacagcatgtctttgaataccttcccgagttccttcacacatttaagattactgccttacttgagactctggatttccaacaggtgtcccagaacgtgcaggctaggagcagcgctttcggctccttccagttcgtcatgaagatggtgtgcaaagaccaagcatcttttctgagcgatagcaatatgttcatcaacttgccacgggttaaggagctgctcgaggatgataaggagaaattcaacatccccgaagactccacccctttctgcctgaagttataccaggaaatacttcagctgcccaatggcgccttggtctggacatttctgaagcccattctgcacggcaaaattctttacactcctaatactcctgaaattaataaggtgattcagaaggccaattataccttctacatcgtcgacaagcttaagacactgtcagaaaccctgcttgagatgtcctcactgttccaacgcagcggtagtggtcaaatgtttaaccagctgcaggaggccctcaggaacaaattcgtgcgcaattttgtagaaaatcagctgcacatcgatgttgacaagctgaccgagaagctccagacgtacgggggactgctggacgagatgttcaaccacgccggagctggtcgattccgttttctgggctccattctcgttaacctgagtagttgcgttgccctaaatcgcttccaggctctgcaatccgttgacatcctggaaactaaagcacacgagcttctgcagcaaaattcattcctggcctccatcatcttcagcaactctttgttcgacaagaatttccggtctgaaagcgtcaagctgcccccacatgtgtcctacaccattcgaacaaacgtactctattccgttcgaaccgacgtggtcaaaaatcctagctggaagttccacccccagaacctgcccgcagacggctttaaatataattacgtttttgcccccctgcaggatatgatcgagcgggcaatcatcctcgtgcagacaggccaggaagcactggagcctgccgcacagacacaagccgcgccgtatccgtgtcataccagcgatctgtttctgaataatgtcggcttctttttccctctcataatgatgcttacttggatggtgtccgtagcatccatggtgcgaaaactggtctatgaacaggagatccaaatcgaagaatacatgcgtatgatgggagtccatcctgtgattcactttcttgcttggttcctcgagaacatggctgttctgacaattagctcagccacgctggctatcgttctgaagacctccggcattttcgcacactccaatacctttatagtatttctgttccttctggacttcgggatgagtgtggtgatgctctcgtatttactgtccgccttcttttctcaagccaacacagccgccctttgtacctcactggtgtacatgattagtttcctcccctatattgtgctactcgtgcttcataaccagctgagtttcgttaaccaaacttttttgtgccttctctccactaccgcttttgggcagggggtttttttcatcacatttctggagggccaggaaacggggatccaatggaacaatatgtatcaggccctagaacagggggggatgacatttgggtgggtatgctggatgatcctatttgatagttccctctactttctgtgtgggtggtacttaagcaacctgattcctggcacatttgggcttcgaaagccatggtactttccttttaccgcttcttactggaagtcagttggattcttggtggaaaaaagacagtactttctgagttcaagtctgtttttctttaatgagaactttgacaacaaagggtcttccctgcagaatcgggagggggagttagaaggctcagcacccggcgtcacacttgtgagcgttaccaaagagtatgaggggcacaaggctgtggtccaggacctgagtctgaccttctaccgagaccagataaccgcgctcctcgggacaaatggggccggtaagacgacaatcataagcatgctgactgggctccatccccccacgtcgggcacaataattattaacggcaagaacttacaaactgatctctctcgcgttagaatggaactgggtgtttgtccacagcaggacattctcctggacaacttgactgtgcgcgaacacctgttactgtttgctagcatcaaggccccacaatggacaaagaaggagctgcaccagcaggtgaaccagacgcttcaggacgtcgatctcacccagcaccaacacaagcagacccgtgctctgtccggcggcttgaagcgaaagctctctttaggtattgcattcatggggatgtcaaggacagttgttttggatgagccaaccagcggagttgacccctgcagccgccattccctgtgggacatattgctgaagtaccgggaagggaggaccattatctttactactcaccacctggatgaggccgaagccctctccgaccgggtggcggtgctgcagcatgggaggctgcggtgctgcgggccgcccttctgcctgaaggaagcctacggccaggggttaaggctgactctgacgcgccaaccctccgtgctggaagcccacgacctgaaggatatggcttgcgtcacttctctgatcaaaatctacatcccgcaggccttcctgaaggactcctcaggctccgagctcacctacacaatccctaaagacacagacaaggcgtgtctcaagggactcttccaggctcttgatgaaaatctgcaccagctccacctgactggatacggaattagtgataccacgctggaggaggtctttcttatgctgctccaagattctaataagaaatcccatatcgccctgggaaccgaatccgagctacaaaatcaccggcctacaggacatctgagcggctactgcggaagtttggctcgccccgccacagtgcagggtgtgcaattgttaagagcccaggtggcagccattctggcccgacgactgcgccggactctgagggccggaaaaagcactctagccgatctgctcctgccagttctatttgttgccctcgctatggggttattcatggttagacctttagctacagagtacccgcccctgaggctgactccgggccattaccagcgtgcagaaacatactttttcagcagcggcggggacaacttggatcttacccgagtcctgttacgcaagttcagagaccaggacctaccctgcgcagacctcaacccccggcaaaagaactccagctgttggcggacggatcccttttcccatccagaatttcaggacagttgcggatgtctgaaatgtccgaatcggtcagcctcagcaccctacctgactaaccatctgggtcataccctgctgaacctatctggattcaatatggaagagtacctgctggctccctccgagaaacccaggctgggaggatggagcttcggactgaaaatcccctccgaggcgggcggtgctaatggtaacatctctaagccccctaccctggccaaagtgtggtacaatcaaaaaggatttcatagtctaccttcttaccttaatcatctcaacaatcttattctctggcagcacttaccgccaacggtcgactggcgccagtacggcattaccctctattctcatccttatgggggcgccctgctgaataaagataagattcttgagtcaatacggcagtgcggcgtggcgctgtgcatagtactgggttttagcatcctctcggcctcaattgggtcctctgtagtgcgcgaccgcgttattggggccaaacgtctccaacacatttccggactaggctacaggatgtattggtttacgaactttctgtacgacatgttattctacctcgtgagtgtctgtttatgtgtcgccgtgatagtggctttccaactcaccgccttcacattccgaaagaaccttgcagcaactgctcttcttttgagcttgttcggctacgccacactcccatggatgtacctgatgtcaaggatcttctcatcaagtgatgtggctttcatctcatatgtgagcctaaatttcattttcggactctgcaccatgctcatcacgataatgcctcgccttctggcgataatctcaaaggctaagaatcttcagaacatatatgacgtgttgaagtgggtctttactatattcccacagttttgtctaggtcaaggcctagttgaactgtgttacaatcagattaaatacgatctgacgcataacttcgggatcgattcctacgttagccccttcgaaatgaatttcctggggtggatcttcgttcagttggcctcacaggggaccgtgttgctgctgctacgggtgctgctgcactgggatctactgcggtggcctcgcggccatagcacactgcaaggcaccgttaagtcttcaaaggataccgacgtggaaaaggaggaaaagagagtttttgaggggcgtacaaacggcgacatcctggtcttgtataatctgtcgaaacactataggagattctttcagaacattatcgcggtccaagatataagcttagggatcccgaaaggtgaatgtttcggactcctgggcgtgaatggcgcaggcaagtcaaccacgtttaagatgctgaatggagaagtatccttgacgagcggacacgcaatcattcgtacccccatgggggacgctgtggatctaagctcagcaggcacagcgggagtgctcatcggttactgtccgcagcaggatgcgctcgatgagctcttgacagggtgggaacacttgtattactactgctccctccggggcattccgcgtcaatgcattccagaggtggccggggacctgatccgtagactccatctggaggcccacgctgacaagcctgtggctacttattcaggaggtaccaagagaaaactgagtacagccctcgctctcgtgggcaagccagatatcctgctgttagacgaaccatctagcggcatggacccttgcagcaaacgctatctgtggcagactataatgaaggaagtgcgagaaggatgtgcagccgtgctgacctctcacagtatggaagaatgtgaggcactgtgtacccggttagcgattatggtgaacgggtccttcaaatgcctgggtagcccgcagcacatcaaaaatcggtttggggacggctacaccgttaaggtgtggttatgcaaggaagccaatcagcactgcacagtgagcgaccacttgaaactgtactttccgggaattcagtttaagggccaacacctcaatcttctcgagtaccacgtgcccaagcgctggggctgtcttgctgacctgtttaaagtcattgagaataacaagacttttctgaacataaaacactatagcattaaccaaaccactttggaacaggtttttataaactttgcctctgagcaacaacagaccctccaatctacactggacccatccactgacagtcaccatacccatcaccttcctatttag

SEQ ID NO: 109152 - DNA, 2367 bp, Artificial Sequence
  Description of Artificial Sequence: Synthetic coding sequence
atgggcctgttcatggtgcgacccttggcgaccgagtacccacccctgcgacttacccccgggcactaccagagggctgagacctacttctttcgcaagaattctagctgttggaggaccgaccccttttctcaccccgaatttcaggatagctgtgggtgcttaaagtgtcccaacaggtccgctagcgctccttaccttaccaatcatctgggtcacacactccttaatctttctggatttaatatggaggaatacttattggcccccagtgagaagccccggctgggagggtggtcatttggattgaagatccccagtgaggcaggcggagcaaatggtaatatttctaaacctccaaccctcgccaaagtgtggtacaatcagaaaggcttccacagtctcccctcttacctgaaccacctgaacaatctcattttgtggcagcacttaccccccaccgtcgactggcgacaatacgggatcacactatatagccatccatatgggggggcattattgaacaaggataagatcctcgaatctatacggcaatgcggcgtcgctctgtgtattgtgctggggttctccatcctgagcgctagtatcggatcaagtgtcgtcagagaccgggtgattggcgcaaaacggctgcagcatatctctggcttgggctaccgcatgtactggttcaccaacttcctctacgatatgctgttctacttggtgtcagtgtgcttgtgcgtggctgtcatcgtggcgttccagctgacagccttcacctttcgcaaaaatctagccgctaccgcattgcttctctcactttttggctacgcaaccttgccttggatgtatttgatgtctcggatcttttcctcttctgacgtggctttcatcagctatgtgagtctcaactttatttttggattatgcacgatgttgattacaattatgccccgactgcttgctataatcagcaaagcgaaaaatctgcagaacatctacgatgtcctgaagtgggtctttacgattttcccccagttttgcctggggcaagggctagtggaactttgctataaccagatcaaatatgatctcacgcacaacttcgggattgattcatatgtttctccattcgagatgaattttctcggttggatttttgtgcagcttgcatctcaaggaactgttctgctactcctgagagtgctgctccactgggatctgctccggtggccacgaggccattctacactacagggaacggtgaagagctcgaaggacacagacgtcgaaaaagaagagaaacgagttttcgagggtcggacaaatggcgatatcctcgtgctgtataacctctccaaacattaccggagattcttccaaaacattattgctgtccaggacatatctttgggaatcccaaaaggcgagtgcttcgggttgttgggcgtgaacggagccggaaagtctactacattcaaaatgcttaacggggaagtgagtctgacctctggccacgctatcatacgcactcctatgggcgacgccgtcgacttaagtagcgcaggcacagctggcgtgctgattggatactgcccacaacaggacgcactggacgagttgctgacagggtgggagcacctgtattactactgctctctgcgggggatccctcgccaatgtatcccagaggtggcgggcgacctcatccggcggctacatctggaggctcacgccgataagccagtggctacatacagcgggggcacaaaacgtaaactgtccaccgcactcgccctggttggcaaacccgatatcttgctcctggatgagccatcgtccggtatggacccttgctcgaagagatatctctggcagacaatcatgaaggaggtccgggagggatgtgccgctgtactgacttcgcactccatggaagagtgtgaagcgctgtgtaccagactcgctatcatggtgaatggctcattcaagtgcctaggatctccacagcacattaagaacagatttggcgacggctacactgtgaaggtgtggctctgtaaggaggccaatcagcactgtaccgtctctgatcacctgaaactgtattttcccggaattcagtttaagggtcagcaccttaatctgctggagtaccacgtccccaaaaggtggggatgtcttgctgaccttttcaaagttatcgagaacaacaaaacatttctaaacattaagcattactctatcaatcagacaacactagaacaggtgttcatcaactttgctagcgagcagcagcagacactacagtcaaccttggaccccagcaccgacagtcatcacacccaccacctgccaatttag

SEQ ID NO: 109153 - DNA, 7311 bp, Artificial Sequence
  Description of Artificial Sequence: Synthetic coding sequence
atgggtttcctgcaccagcttcaactcctcctgtggaaaaatgtgacactgaaacgacgctccccttgggttctagcttttgagatcttcatcccattggtgcttttttttattctgttaggcctgcggcagaaaaagcccacgatctcagtgaaggaagtcgcattttacactgccgctcctctcacatctgccgggatcctgccagtcatgcaaagtctgtgtcccgacggacagcgagacgagttcggatttctgcagtatgccaatagcacagtgactcagttgcttgaaaggctggaccgggttgtggaagaggggaacctatttgatcctgcccggcccagtctagggtccgagttagaagctctccgccagcacctagaggccttgtctgccggtcctggtacgtcaggcagccacctggatcggagcaccgtgtcttctttttccttggactccgtcgcacgtaacccgcaggagctgtggcggtttctgacccagaacctgagtctccctaactcaacggcgcaggcgctgttagcagcccgtgtagacccacccgaagtgtatcacctgcttttcgggcctagcagtgccctggattcacaatccggtctccacaagggccaagagccctggagccgactcgggggaaaccctctcttcagaatggaggaactgttgttagctcccgctctgttggagcaactcacttgtactcccggaagtggtgaactaggccgtattttgacagtgcctgaatcacagaaaggcgcactgcagggatacagagatgccgtttgtagcggtcaggcagccgcacgcgcccgaagatttagcggactgagcgcagaactgcgcaaccagctggacgttgctaaagtgagtcagcagttaggactggatgcgccgaacggatctgactccagccctcaggcgcctccgcccaggcggctccaagcgctcctgggggatctgcttgacgcgcagaaggtactgcaggatgttgacgtgctgtctgccctggcgctgctcctgccacagggagcttgtaccggacgaacacctggacccccagctagtggcgctgggggcgctgccaacggaaccggagcaggagctgtgatgggccccaacgcaactgccgaggaaggagctccatcagccgctgcactagccacaccagatactctgcagggccagtgttctgccttcgtgcaactgtgggccgggctgcaacctatcctgtgcggcaataaccgtaccatcgagcccgaggctcttcggcgcggcaacatgagcagcttgggttttacgagcaaggagcaaaggaacctgggacttctggtccacctcatgacatctaacccaaaaatcttatacgcgccagccggtagcgaagtggatcgagtcatcctgaaagccaacgaaactttcgcctttgtgggcaatgtgactcattacgcgcaggtatggcttaacatttccgccgagattagatcctttttggagcaagggcgattgcagcagcacctaagatggctgcagcagtacgtggccgaactcaggctgcatcctgaggcactgaacttgagtctggatgaactgccccctgcgttgaggcaagacaatttcagtctgcccagcggtatggcccttctccagcaactcgacactattgataacgctgcctgcggctggattcagtttatgagcaaggtttccgtggatatcttcaaaggattccatgacgaagagagtatcgtgaactacacccttaatcaggcttatcaggacaatgttaccgtgtttgcctccgtcatcttccagacacgtaaagatggctcacttcctcctcacgtgcactacaaaatcagacaaaatagcagttttactgaaaagactaacgaaatccggagggcttattggaggcctggccccaatacaggggggagattctattttctttatggatttgtttggatccaagatatgatggaaagggccattattgacacctttgtggggcatgacgtggtggaacctggtagctatgttcagatgtttccatatccatgttacactagagacgattttttatttgtaattgagcatatgatgccactctgtatggtcattagttgggtatacagcgtcgcaatgaccattcagcatattgtcgccgagaaggagcaccgcttgaaagaggtaatgaagaccatgggcttaaataacgctgtacactgggttgcttggttcattaccggatttgtgcagctctccatcagtgttactgctctgactgctatattgaagtatggccaggtactcatgcattctcacgtggtcattatctggctgtttctagctgtatacgcggtagccacaatcatgttctgctttttggtgagcgtcctatacagcaaggccaaactcgcctcagcctgtggcggtataatctactttcttagctacgttccctatatgtatgtggcaatccgcgaggaggtcgcccacgacaaaatcacagcctttgagaaatgcattgctagtctgatgtctacaacagcattcggcctgggaagcaagtattttgccctgtacgaggtcgcaggcgtaggaatccagtggcatacattttcacaaagtccagtggagggggatgactttaacttattgctggcagtgactatgctgatggtcgatgccgttgtttacggaatcctgacgtggtatattgaagccgttcaccctggtatgtatggccttcctagaccctggtattttcctctccagaagtcatactggcttggcagcgggcgcaccgaagcctgggagtggagctggccatgggcccgtaccccacgattgagcgttatggaggaggatcaggcatgtgccatggagagccggcggttcgaggaaaccaggggaatggaggaagagccgacccacctacccctggtggtgtgtgtggacaagctgactaaggtgtataaggacgacaaaaaacttgcacttaacaaactctcattgaatctgtacgaaaaccaagtggtcagctttctggggcacaatggggccggaaaaaccacaaccatgtcgatacttactggtctctttccccccacttccggatcagccaccatctatggccacgacattaggactgaaatggatgagattcgcaagaatcttggaatgtgcccccagcataatgtcctgtttgacaggctaaccgtggaggagcatctctggttctacagccgcttgaagtcaatggcccaggaagaaatacgtagagagatggacaaaatgattgaggacctcgaattatccaacaagcggcactcactggttcagacactgagtggcggcatgaaaaggaagttatccgttgcaatcgctttcgtcggaggctcccgggccataattctggatgaacccaccgcaggggtcgatccatacgcccgccgggcaatctgggacctcatcctgaaatacaagcctggccgcactatcctcttgtccacgcatcacatggacgaagcagacctgcttggggaccgtattgcgattatttcccacggcaaactaaaatgctgcggaagtcccttattcctcaaagggacctatggcgatggatataggctgacactcgttaagcgtccagcagagcctggagggccacaagaacctggactagcgagtagtccccctggtcgagcccccttgtctagctgctccgaactgcaagtctcccaatttatccgtaagcatgtggcatcgtgcctgcttgtgagcgatacgtccaccgagctctcttatatcctgccgtctgaagctgccaagaaaggcgcttttgaacggttgttccaacacttagaaaggtcactggacgccttacatctctcctctttcggcctgatggacaccacccttgaggaagttttcctcaaggtgagcgaggaggaccagagcctggaaaactcagaagccgatgtaaaagagtccaggaaggacgtattgcctggcgctgaagggcctgcctcaggagagggccatgcgggtaacctggcccggtgttcagagctgacacagtctcaggcatccctgcagtcagcctccagcgttggatccgccagaggtgacgaaggcgctgggtacaccgacgtgtacggagattaccgaccgcttttcgataatccgcaggaccctgacaatgtgtcccttcaggaagtcgaggctgaagccctcagtagggtcgggcaggggtcacgcaagttagatggggggtggctgaaggtgcgccagttccacggtctgttagtgaaaaggtttcactgcgccagacggaacagcaaagccttgttttcccagatcctactgcccgcatttttcgtctgcgtagcgatgactgtcgcattgtctgtgccagaaataggtgacctacccccactggtcctgtctccatctcagtaccacaactacactcaaccaagggggaactttatcccttacgctaacgaagaacgaagagagtacaggctgcgcttatcaccagatgcctcaccacagcagctggtgagtacattcaggctgccaagcggggttggggccacatgtgtcctcaaaagccctgccaatgggtcacttgggccaactctgaacctgtctagcggcgagtcaagactcctcgcagctagattcttcgactctatgtgtctggagtcttttactcagggactcccactctctaacttcgtcccaccgcctccttcacccgctccctctgactctcctgctagcccggacgaagacctgcaagcatggaacgtttccctaccccccactgcgggcccagagatgtggacctccgctcctagtttgcccagactggtccgagagcctgtgcgctgtacatgcagcgcacaagggactggattcagttgtccctcttcagtaggcggacatcctccacaaatgcgggtcgtgacaggcgacatactgacagacattaccggtcacaacgtgtctgagtatttattgtttacctctgacagatttcgcttacaccgatacggtgcaattactttcggtaacgtgctgaaatccatacctgcctcctttggtactagggccccacctatggtgcggaagatcgcagttagaagagccgcacaggtattttacaataataagggctatcatagtatgccaacgtatcttaacagcctgaataacgcgattcttcgcgccaatctcccaaagtctaaaggaaaccctgctgcatatggaatcacggtgactaatcaccccatgaataaaacttccgccagtctttcgttggattacttactgcaaggcacagacgttgtgatcgccatctttattatcgtagctatgtcttttgtccccgcttccttcgtggtttttcttgtggccgaaaagtccactaaagcaaagcatctccagtttgtcagcggctgcaaccctattatatactggttggccaactacgtctgggatatgttaaactacctagttcccgccacttgttgcgtcattattttgtttgtgttcgacctgcctgcctacacctcgcccaccaattttcccgctgtcctgagcctgttcctcctgtacggatggtcaatcactcccataatgtaccctgccagtttctggtttgaagttccctcctccgcctatgtttttcttatcgttattaacctgttcatcggaataacagctacagtggctacgtttctgcttcagttgtttgaacacgataaggacctgaaggtggtcaactcatatctgaagagctgctttctgatttttccgaattataatcttggacacggcctgatggagatggcctacaatgagtatatcaatgagtattatgcaaagataggccagtttgataagatgaagtcccccttcgaatgggacatcgtgactaggggccttgtagccatggcagtggagggcgtggtcggttttcttttgaccatcatgtgtcaatacaacttcttaaggcgcccccagcgcatgcccgtttccacaaagcctgttgaagacgacgtggacgtggcatcggaacgtcagagagtgcttcgtggagatgccgacaacgacatggtcaaaatcgagaacctgaccaaggtgtataagtcccggaaaattggtagaatcttggccgtggatagactctgcctgggagtccggcccggggaatgttttggtctgctgggggtgaatggcgccggaaaaacatcgacttttaaaatgctaacaggtgatgagagtaccaccgggggcgaagcattcgttaacggccactcagtgcttaaggaactcctacaggtccaacaaagtctcgggtattgtccacagtgcgatgccctcttcgatgagctaaccgctcgagagcacctgcaactgtacacacgactccgcggtatctcttggaaggatgaagcccgcgttgtgaaatgggccctagaaaaactagagctcactaaatatgccgataagcctgcaggcacgtacagcggcggcaacaagaggaagctgagcactgcaattgctctgatcggctatcctgcttttatcttcctcgacgaacccactaccgggatggatcccaaagctaggcgcttcctgtggaacctgattttggacctgataaagacaggcaggtccgtggtactgaccagtcactctatggaggaatgcgaagccctctgtactaggctggccatcatggtaaatgggagattgcgttgcctggggtccatccaacatctgaagaaccgcttcggcgatggatatatgatcactgttcggaccaagagctcccaaagcgtgaaagacgtggtgcgtttttttaatagaaactttcccgaggccatgctgaaggagagacatcacactaaggtacaatatcagctgaagtcggagcacatcagcttagcccaagtgttttctaaaatggagcaggtgagcggtgtcttagggatcgaggattattccgtgtcacagactaccctggacaatgtctttgtgaattttgccaagaagcagtcagataacctcgagcagcaggagactgagcctccatctgctctgcagtcacctctgggatgcttgctctctctcctccgaccacggagcgcaccgacagaactgcgcgcacttgtggctgatgaacccgaggatcttgacacagaagatgagggattaatctccttcgaggaggaaagggcgcaattaagcttcaacacggacaccctctgttag

SEQ ID NO: 109154 - DNA, 7311 bp, Artificial Sequence
  Description of Artificial Sequence: Synthetic coding sequence
atggggttcctgcaccagcttcagcttctgctgtggaagaatgtgacactgaagagaagatccccatgggttctcgccttcgaaatctttattccattggtattatttttcatactgttggggttgcgccagaaaaaaccaacgatctcagtaaaggaggtctccttctacacggctgcccctctgacctctgctgggatcctcccagtcatgcagtctctatgcccagatggccagcgcgatgaattcggatttctccagtacgcaaattcaaccgtgacacagctcttggagcgcttggaccgggtggtagaggagggcaacctgttcgaccctgccagaccatcactgggctccgagctcgaggcgttgagacagcacctggaggctctgtcagctggtcctgggactagtggttcacatctcgacaggtcaaccgtgagctccttttcacttgatagcgtggcccgtaatccccaagaactatggaggttcctaacacagaacctgtctctgccgaattccacggctcaggccctgctggccgctcgcgtagaccctcccgaggtgtatcatctgctgttcgggcctagctctgcgctggattcccagtctggcctgcacaaggggcaggagccttggtccaggctgggtggcaaccccctgttccgcatggaggagctgctcttggcccccgcccttctggagcagctgacctgcaccccaggttccggggaactggggcgcatattgacagtcccagagtcacagaagggtgctctacaaggatacagagacgctgtgtgctccgggcaggcagcagccagggcccgccgattttctgggttgtcagcagagctgagaaaccagcttgatgtggctaaggtgtcccagcaactgggtctggatgccccaaatggcagtgattcatctccacaggcacctcctcctaggaggttacaagccttgctcggtgacctcctggatgcccagaaggtgctacaggacgtggatgtgctttccgctcttgccttgctcctgccccagggggcctgcactggaagaacccctggcccacccgcaagcggggcgggcggcgctgctaacgggacaggggccggcgctgtcatgggcccaaacgctacagccgaagaaggcgccccatccgctgcagctctggcaacgcccgatactctgcaaggacaatgcagcgcctttgtgcaactgtgggccggccttcagcccatcctgtgcggtaacaataggactattgagcccgaggcgctgagacggggcaatatgtccagtctgggcttcacttccaaggaacagcggaacttggggctgctggtacatctgatgactagtaaccccaaaatcctctacgctccggcaggctcagaagtcgatagggtgatccttaaagccaatgaaaccttcgctttcgtgggcaacgtgactcactatgcccaggtttggttgaatatcagcgctgaaatccggtccttcctcgaacaaggccgccttcaacagcacctgagatggctgcagcaatatgtggccgaactgcgcctgcatcctgaagctctcaatctgtcgcttgacgagctgccaccggcccttcgacaggataacttcagcctgccatccggcatggcactcctgcagcagctcgacaccattgataatgctgcttgtggttggatccagtttatgtctaaggtgtccgtggatatcttcaaaggattccacgatgaggaaagcatagttaactatacactcaaccaggcctatcaggataatgtgacagttttcgcctctgttatctttcagacgcgcaaggacgggagtctaccgccacatgttcattataaaatcagacagaactcatcattcaccgaaaagaccaatgagataaggagggcatattggcgccccggaccaaataccggcggacggttctacttcctttacgggttcgtgtggatccaggatatgatggagagggcaatcatcgacactttcgttggccatgacgtggtggaaccaggctcttatgtccaaatgtttccttacccctgttatacaagagacgacttcctcttcgtcatcgagcacatgatgccactgtgtatggtcatcagctgggtctatagcgttgcaatgacaattcaacacatagtggccgagaaggaacatcgcctgaaagaggtgatgaagaccatgggtctaaataatgccgtgcattgggtcgcttggtttattaccggatttgtgcagctgagcatatcagtgaccgcactgaccgccattttgaaatacggtcaagtacttatgcattcccacgtcgtaattatatggttatttctggccgtatacgcagttgcaaccatcatgttctgcttcctggtatccgtgttatacagcaaggcgaaattggcctctgcatgtggaggcatcatctatttcctgtcatatgtgccatatatgtacgtcgcaatccgcgaggaggtggcccatgacaagatcaccgcctttgagaaatgtatcgcttccctcatgtccacaactgcgttcggcttgggtagtaagtattttgctctgtatgaggtggccggagtggggatccagtggcacacattttcccagtctccagtcgaaggagatgatttcaatctgctgcttgcagtgacaatgctgatggtagatgccgtggtatacggaatactcacttggtacattgaagctgtgcatccaggtatgtacggtctgccgaggccctggtacttcccattgcaaaaaagctactggctcggctctgggcgaactgaggcttgggagtggagctggccttgggccagaacacctcgactgagcgtgatggaagaggatcaggcctgtgcaatggaaagtagacgcttcgaagagacaaggggcatggaagaggagccgacacacttacctctcgtggtgtgtgtggacaaattgacgaaagtgtacaaagacgacaaaaagctggctctgaacaaactgtctctcaatctgtatgagaaccaggtagtctcctttctgggccataacggcgctgggaagacaacaactatgtccatcctcaccggcctgttccctcccactagtggcagtgcaactatctatggccatgacatacgaaccgaaatggacgaaatccggaagaacttaggtatgtgcccacagcataatgtgctctttgataggctaaccgtggaggaacatctgtggttttattccagactgaagagcatggcccaggaggagattcgcagagagatggataaaatgatagaagacctggagctatcgaacaagcgccatagcttagtccagacgctttcaggcggtatgaagagaaaactgagcgtggctatcgccttcgtgggtggttcaagggcaatcatcttagacgaacccaccgccggggtggatccctatgcaaggcgggccatctgggatctgatcctgaaatataagccaggaagaacgattttgttgtccacccaccacatggatgaagcggatctgctgggcgatagaattgcaattatcagtcacggaaaacttaaatgttgtggttcccccttattcctcaagggtacatatggtgacggttatcgattgacgttggtgaaacgtcctgctgaacctggcggcccacaggagcctggtctggcgagtagccccccaggccgagctcccctaagttcctgtagcgagttacaggtgtcacaattcatccgcaagcatgtggcatcatgccttctggtgtccgatacatcaacagaactgtcttacatcctgccatctgaagctgccaagaaaggggcgtttgagaggctgtttcagcatctagagaggagcctcgacgcccttcatctgtcatctttcggccttatggacaccactttggaggaggtgttccttaaggtctccgaagaagaccagtcactagagaacagtgaggcagacgttaaggagtcaaggaaagacgtgctccccggagcagaaggaccagcctctggcgagggccacgccggtaacttggccaggtgttcagagcttactcagagtcaagcttctctccagtcagcttcgtctgtcgggagtgctcggggtgacgagggggcaggttatactgacgtgtacggagactatagacctttattcgacaacccgcaggacccggacaatgtaagcctccaggaggtggaggcagaagctctaagtcgggtgggccagggtagccgaaagctggacggagggtggttgaaagttcgccagtttcacggactgctcgtgaaaaggttccattgcgcgcgccggaattctaaagcgttatttagccagatattgttaccagcattctttgtttgtgtggccatgactgttgctctttccgtccccgagattggagatttacctccactcgtgttgtctccatcccagtatcataactatacccagcctcgcgggaattttataccatacgccaacgaagaaagacgggagtatagattgagactgtcaccagacgctagtccccaacagctggtgtccacgttccggctgccttcaggcgttggggctacatgtgtcctaaagtctcccgcgaatggatccctgggccctacactgaacctgtcctcaggcgagagtcgcctactcgccgccagattctttgactctatgtgtctcgaatccttcacccaaggtctaccactgtcgaatttcgtccctcctccgccctcccctgcaccttctgacagccctgcttctccagacgaagacctgcaggcctggaatgtttcgttacctcccactgccgggccggaaatgtggaccagtgctcccagtctgcccagacttgtaagagagcccgtgcggtgtacatgttctgcacagggcacaggtttctcttgtccaagctctgtcggcggccaccctcctcaaatgcgagtagtcactggagatattctcaccgacatcaccggacataatgtctccgagtatctgctcttcacatctgatcgttttcgattacacagatatggtgccatcacgtttggcaacgtcctgaaaagcatcccagccagtttcgggacacgcgcaccgcccatggtacggaaaatcgccgtgcgacgagcagcacaggtgttctacaataacaagggctaccactctatgcctacataccttaattctctcaacaatgctattctcagggccaatttacctaagagcaaaggtaatcccgctgcctacggaatcacagtgacgaaccatccaatgaacaaaacttccgctagcctttctttggactacctgcttcaaggcacagacgtggtcattgccattttcattatcgtcgcaatgtctttcgttccagcaagtttcgtcgttttcctggtcgccgagaagagtaccaaggccaaacatttacaattcgtttcaggctgcaatccgatcatctactggcttgcaaactatgtgtgggacatgcttaactacctggtgcctgctacatgctgcgtgataattctttttgttttcgacctgcctgcctatacgtccccaacaaattttcctgctgttttgtcactgtttctgctgtacggctggagcattacaccaattatgtatcccgcttctttttggttcgaggtgccatcttccgcgtacgtgtttctgatcgtgatcaatctgtttattgggatcaccgccaccgtcgcaacttttctcctgcagttatttgaacacgacaaagacctcaaagttgttaacagctacttgaaaagctgttttcttatcttcccgaactacaacttaggccacggacttatggagatggcctataatgaatatataaacgaatattacgccaagattggccagttcgacaagatgaagtccccgttcgagtgggatatcgtcactcggggcctggtggcaatggccgtggagggggttgtcgggttcctactcaccataatgtgccaatataactttctgcggagaccacaaaggatgcccgtaagtaccaagcctgtggaggatgacgtcgatgtggccagcgagaggcaaagggtgctccggggagacgctgataatgacatggttaaaatcgaaaatctgaccaaagtctataagtcaagaaagataggccggatccttgcagtcgatagactgtgcctcggcgtgagacccggtgaatgcttcgggctgttaggagtcaatggcgccgggaaaaccagtacctttaaaatgctgaccggcgatgagagcaccactggtggggaagccttcgtgaatgggcattccgttctgaaggagcttttacaggtgcaacagtctctcggctactgccctcagtgcgacgctctgtttgatgaactaaccgccagagaacatctgcagctctatactcgccttaggggaatctcttggaaggacgaagccagggtagtgaaatgggccctagagaaactcgagctgacgaagtacgcggataagcccgctggtacatattcgggcggcaacaagcgaaagcttagtacagccatcgcgttaatcgggtaccctgcgtttattttcctggacgaacccacaacaggaatggatccgaaggctaggaggttcctctggaaccttattctggacctaattaaaaccggtagaagcgtggttcttacttcccactccatggaggagtgcgaggccttgtgtactaggctggcaatcatggtgaatggtaggctccgctgcctggggtccatccagcacctgaagaaccgctttggtgatggatacatgatcaccgtccggaccaaatctagccagtccgttaaggatgtggtgcgctttttcaataggaacttccccgaggcgatgttgaaggaaagacatcacaccaaggtgcaataccagttgaaatctgagcatatttcactggcacaggtcttcagtaaaatggaacaggtttcaggcgtcctaggcattgaagattacagcgtaagtcaaactacactggataacgtgtttgtcaattttgctaagaagcagagtgataatctggaacaacaagaaacagagccacccagcgccctgcaaagtcccttgggctgcctattgtctctgctgcgccccagatccgcacctacagagcttagggctctggtggcggacgagcccgaagatctcgacacggaggacgaagggttgataagcttcgaggaggagagggcgcagctgagttttaatactgataccttatgctag

SEQ ID NO: 109155 - DNA, 7401 bp, Artificial Sequence
  Description of Artificial Sequence: Synthetic coding sequence
atggggcggaaaacgtccagagtgcagcagggtccgcccaggtctcctgcatgttccgcccacggtgaacgttcctggggcctggagttccccccctttcggtggttgctgggtatagcgggccgcacacacctggcggccctgccacccttccagtgggtactggctttcgagatctttatccctcttgtcctgttcttcatcctcctcggtcttaggcagaaaaagccaaccatcagcgtgaaggaggtggccttttacacagctgcacctttgacgtcggctggcatcttgccagtaatgcagagcttgtgtcccgatggtcagagggacgaattcggattccttcagtatgcaaattcgacagtcacacaactgttggagcgcctggacagagtggtggaagagggtaacctgtttgatccggcaagacctagtctgggcagcgaacttgaggctttgcggcagcacctggaggctctgtctgccggacccgggaccagcggaagtcacctggaccgctcaacggtgtccagcttcagtctggactctgtagccagaaacccccaggagctctggaggtttcttacacagaatctgagcctgcccaacagcacagcgcaggcactgctcgccgccagggtcgatcccccagaggtgtaccacctgctgttcggcccaagttcggccctggactcgcagagtggccttcataaggggcaggagccctggtctcgcctgggcggcaatccattgttccggatggaagagctcctactggctccggctctgctggagcaactgacctgtacaccgggttctggagagttgggaaggatcctcaccgtcccggaatctcagaaaggcgcgctgcaggggtatagagacgccgtgtgtagcggacaggccgctgctcgcgccagacggttctccggactctcggcggaactccggaatcagcttgatgtcgctaaggtgtctcagcaactgggccttgatgctccaaacgggagcgactcatctccacaagccccccctcccaggagacttcaggccctcttaggagacctgctggacgcccagaaagtgctgcaggacgtggatgtcttaagcgcactcgccctgctgctgccacagggcgcctgcacagggaggaccccaggcccccccgcaagtggcgccggaggggccgccaatggtaccggcgcaggagctgtcatggggcccaacgcaactgctgaagagggtgctccctccgcggccgcactggcaacacccgacacactgcagggtcagtgttctgctttcgtgcagctgtgggcaggcctccagccaattctgtgcggaaataaccggacaatagaacctgaagctttgagaagagggaatatgagttctctgggctttacatctaaggaacagcgcaatctggggctgttggtccacctgatgacctcgaatcccaagattctttacgcccctgcgggatccgaagttgacagggtgatcctgaaagcgaacgaaactttcgcctttgtggggaatgtgacgcactatgcccaggtctggctgaacatttcagctgagattcgcagttttttggagcagggcagactccaacaacacctgaggtggttgcaacagtacgttgctgaactccgactgcacccggaggccctaaatctgagcctggacgaactgccccctgcgctccgacaggataactttagtttgccatcgggcatggctcttctgcagcagctcgacactatcgacaatgccgcctgcgggtggatccagtttatgtctaaggtatctgttgatatttttaaggggttccacgacgaggagtcaatagtaaactacaccctgaatcaagcctaccaggacaatgtgacagtgttcgccagcgtgatcttccagacacggaaggacggctctctccccccccacgtgcactacaagatccgccagaactcctcttttacagagaagacaaatgagattcggcgagcctactggagacccggtcccaatacagggggcagattttatttcctatacggctttgtgtggatacaggatatgatggaacgtgcaatcatcgacacattcgttggccacgatgtggtcgaacccggatcttatgttcagatgttcccatacccttgctacaccagggatgacttcctgtttgtaattgagcatatgatgccactctgtatggtaatttcttgggtgtacagcgtagctatgacaattcagcatattgtggcggaaaaggagcatagactcaaggaagtgatgaaaaccatgggactgaacaacgccgtgcattgggtcgcttggtttatcaccgggttcgtgcagctcagcatttcagttactgctctcactgccattctcaaatacggacaggtgttgatgcacagccatgtcgtgataatctggctgtttctcgcagtctacgcagtggctaccattatgttctgctttctggtatcggtgctgtattctaaggccaaactagccagcgcatgtggcggcataatatatttccttagttatgttccctatatgtacgtggccatcagggaggaggtggcccacgataaaataaccgcttttgaaaaatgcatcgcttcactgatgagcactactgcctttggtctcggaagcaagtacttcgctctttacgaagttgcaggggtcggaatacagtggcatacattcagtcagagcccagtcgaaggcgacgatttcaatcttctccttgcggtcaccatgcttatggtggacgctgtagtgtacggcattctcacctggtatatcgaggccgtccacccaggcatgtatggactgccccgaccctggtattttcccctccagaagtcctactggttaggatctggccgcaccgaggcgtgggagtggagctggccgtgggctaggacacctcgactcagtgtaatggaggaggatcaagcctgtgccatggagagccgacgctttgaagaaacacgcggcatggaggaggaaccaacccacctgcccctggtggtatgcgtggataagctgacaaaggtgtacaaggatgataaaaaactggcactcaacaagctgtccttaaatctttatgagaatcaggtggtgtcgttccttggtcataatggcgccggaaaaacaacaacgatgagcatactcacgggactgtttccacctactagcggatcagcaactatctatggacacgatatacgcaccgagatggatgaaatccggaaaaatctggggatgtgtcctcaacataatgtgctctttgacagattgactgtcgaagagcacttgtggttctatagcaggctgaagtccatggcacaggaagaaattcggcgagagatggacaaaatgattgaagacttggagctctccaataagagacattccttggtgcagaccctttcgggggggatgaaacggaagctttccgtggccatcgcctttgtagggggctcccgagctataatcctggatgaacccactgccggcgtggacccgtatgcgcggcgagccatctgggatcttatactgaaatacaagcccggaaggactatacttctgagtacgcatcacatggatgaggccgacttgctgggggatagaattgcaatcatatcacatggcaaactgaagtgctgtggcagcccattgttcttgaagggtacttacggtgatggttacaggctgacgcttgtaaaacggcccgctgagcccggtggcccacaggaaccaggtcttgcttcatcgccccctggacgcgccccactgtcttcctgctcagaactgcaggttagccagttcatccgtaagcatgtggcctcttgtcttctggttagtgacacatccactgaattgtcttatattctgccctctgaggcagctaaaaagggcgctttcgagcgactgttccagcacttggaacggtcactggacgctctgcatctgtcaagcttcggactgatggacacaacattagaggaagtcttcctgaaagtgagcgaagaagaccaatcactggagaattccgaagcagatgttaaagaaagccggaaagacgtgcttccaggtgcagagggccccgccagcggcgaggggcacgcaggaaatctggctcgttgttccgagctcacccaatctcaggcttctctccagagtgcgtcatcagtgggcagcgctaggggagacgagggcgccggctacactgatgtgtatggagattacaggccactgtttgataatccccaggatccagacaatgtgtccctgcaggaagtcgaggcagaggccctgagccgtgtcgggcagggctcccggaaactagatggaggttggctcaaggttcgtcaattccatggcctgctcgtgaagcggtttcactgcgcccgccggaattcaaaggccctgttctcccaaatacttctacccgcattttttgtctgcgtagccatgacggtggctctttcagtacctgaaatcggcgatctcccacctctagtgctgtccccctcccaataccataattatacacagccaaggggtaacttcattccctacgctaacgaggagcgtagggaataccgattgaggctaagtccagacgcatcaccccagcaacttgtgagtaccttcaggctccctagcggcgttggggccacgtgcgtgctgaaatccccagcaaacggaagcctgggccccactttgaacctgtcttccggggagagccgtctgttggccgcgcgcttttttgattctatgtgcttagaatcctttacgcagggattgcccctgtcgaacttcgtcccacctcccccatctcctgcacccagcgactcacctgccagtcccgacgaggacctccaagcctggaacgtctctctgccgcccaccgctggaccagaaatgtggacctcagcaccgagcttgcctagacttgtaagagaacctgtgcgctgcacttgcagtgcccaaggaaccggcttctcatgcccttccagtgttgggggccatccgccacagatgcgggttgtcacaggggatatcctgacagacataaccggccacaatgtctctgaatacctgctgtttacatcagatcggtttcgtctacacaggtacggcgctataacattcggcaacgtgctgaagagtatcccagcctccttcggaacccgcgctccacccatggtacggaagattgccgtccgacgcgccgctcaagtgttttataataacaaaggctaccactccatgccgacataccttaattcactgaataacgccatcctacgtgcaaacctcccaaagtccaaggggaacccagcggcatatggtatcacagtgactaatcacccaatgaacaagacatcagccagcctcagcctagattacctgcttcaggggactgatgtagttatcgccatatttattattgtcgccatgtcattcgtgcccgcgtcattcgtggttttcctggtggccgagaagagtacaaaggcgaagcatctccagttcgtgagcgggtgtaacccaattatctactggctggccaactatgtctgggatatgcttaactatctggttcctgctacttgctgcgtcattatcttgtttgtgtttgatctccccgcttacacctcccctacgaacttcccggcggtcctgagtttgttcctcctgtacggctggtctataacacctataatgtacccagcgagcttctggttcgaggtgccgtccagcgcctatgtctttctgatcgtcatcaacctgttcatcggaattaccgccaccgttgctactttcttactgcagttgtttgagcacgacaaggacttgaaagtcgtgaatagctatctgaagagctgtttcttaatttttcccaattataatttgggtcatggcttaatggagatggcatataatgagtacattaacgagtattatgcgaaaatagggcagttcgataagatgaaatcaccatttgaatgggacattgtcacacgcgggctggtcgcgatggctgtggaaggagtggtgggcttccttctgactataatgtgtcaatacaatttcctgagaaggcctcagcgaatgcctgtgtccaccaagccggttgaggatgacgtggatgtggcgagtgaaaggcagcgtgtgctgcgaggagatgccgacaacgacatggtcaaaatagagaacttgaccaaagtgtataaatcccgcaaaattggacgaatcctggcagttgatcggctgtgcctaggcgttcggccaggcgagtgctttggtcttctgggagtgaacggcgccggaaaaacctctacttttaagatgctgactggagacgaatcaacgacaggaggggaggcattcgtcaatggccacagtgtgctcaaggaactactgcaagtgcagcagtctctgggctactgcccccaatgcgacgccctgttcgacgagctaaccgcccgggaacaccttcagctatacactagactacgtggaatttcttggaaggatgaagcccgggtagttaagtgggctctggaaaagctcgaactgacaaaatatgctgataaaccggctggaacttactctggaggcaataagcgaaaactcagcacagcaattgcactaatcgggtacccagccttcatatttctggatgagccgacaaccggaatggatcccaaagcacggcggttcctgtggaacctgatcttggatctcatcaagaccgggcgcagtgtggtgcttacatcacatagcatggaggaatgcgaggcactatgtacgagacttgctattatggtgaacggacgtctacgttgtctcggctcaatccaacacctgaagaacagattcggagacggctatatgatcacggttcgtaccaagagtagccagtccgtgaaagacgtggtgcgattcttcaatcggaacttcccagaagcgatgcttaaagagagacaccataccaaggtccagtatcagttgaaaagcgaacacatcagcctggcccaggtgttttctaagatggaacaagtgtccggggtcctgggtatcgaggactactctgtgtctcagactaccctcgacaatgttttcgttaacttcgccaagaaacagtctgataacctcgagcagcaagagaccgaacctccaagcgccctgcaatctcctttagggtgcctgttatctctgttgaggcctaggtcagctcctaccgaacttcgagcattggtcgccgatgagccagaggatttagacaccgaggacgagggactaatctccttcgaagaagaacgcgctcagctgtcctttaacaccgacactctctgctag

SEQ ID NO: 109156 - DNA, 7308 bp, Artificial Sequence
  Description of Artificial Sequence: Synthetic coding sequence
atgggctttttgcaccagctgcagctcttgctatggaagaatgttaccctgaaaaggagatccccatgggtgctcgcatttgagatcttcatcccactggtattgtttttcatcctcttgggactcagacagaagaagcccaccatatccgttaaggaggcattttacacagccgctccactgacaagcgctggtatcctgcccgtgatgcaaagcttgtgtcctgatgggcagcgcgatgagtttggattcctgcagtacgccaacagtacggtgacacagctcctcgagaggttagatagagtcgtagaggaggggaacctttttgaccccgcaagaccctcactcgggagcgagctcgaggcattacgtcaacacctggaggcgctttcagccggacccggcacttccgggtctcatctggataggtccacagtgtcctctttctccttggacagcgtggccaggaatccccaggaactttggcgattcctgactcagaaccttagcctgccgaattcaacggctcaggcgctcctggctgcacgagtggatcctcccgaggtttaccacctactcttcggcccttcaagcgccctggactctcaatccggactgcataaagggcaagaaccttggtctcgtttgggcggaaatcctctgtttaggatggaggagttgctgctcgcacccgccctgttggagcagttgacatgcactccagggtccggtgaactggggagaattctgactgtaccagaatctcagaagggcgctctgcaggggtacagagacgccgtttgtagtggccaggcggccgcccgagcccggagattcagtggcctaagtgctgaactgagaaatcagctggatgtggccaaagtgtctcaacaattgggtctagatgcaccgaatggttccgactccagtccccaggctcccccgccgcggcgattgcaggctctgctcggagacctgttggatgctcagaaggtgctccaggatgttgacgtcttgtctgctctggctctgctgttgcctcaaggagcttgtacaggcagaactcctggcccacctgcatcaggagctggcggagctgcaaatggaactggcgcaggcgccgtgatgggccctaacgcaacagctgaggagggggccccttccgctgctgccctggctacacccgatacgctccaagggcagtgcagcgcgtttgtgcagctttgggccggcctccagcctatcctgtgcgggaacaatagaacaattgagcccgaagccctgcggcgcggtaatatgtcctctttgggattcactagtaaggaacagaggaacctgggcctactcgtccacttgatgacaagcaacccgaagattctgtacgctccggcaggttctgaagtggatcgggtcattctcaaagccaatgaaactttcgctttcgtgggcaacgtgacacattacgcacaagtctggttgaatatctctgcggaaatccgaagctttttagagcaaggacgcctacagcagcacttgcgttggctgcagcagtacgtcgcagagctcaggctccaccctgaggccctgaacctgagtctcgatgagctgccgccagctctccgtcaagacaacttcagtctgccgtccggcatggcgctgctgcagcagctcgacaccatagacaacgcggcctgtggatggatccagttcatgtctaaggttagcgtggatatttttaaggggtttcatgacgaggagtcaatcgtcaactacactctcaatcaggcgtatcaggacaatgtaacggtcttcgcttccgtgatcttccaaacaaggaaggatggatccctgcctccccacgtgcactataaaattcgccaaaacagtagcttcactgagaagaccaatgagattagacgggcatactggcgcccagggccaaatacagggggcagattttatttcctgtacggattcgtctggatccaagacatgatggaaagagccataatcgacacatttgttgggcatgatgtggtagaacctggatcctacgtacagatgttcccttatccgtgttacacacgggatgatttcctgtttgtgattgagcatatgatgccattgtgcatggtgatttcctgggtctatagcgtggccatgacaattcaacacatcgtggccgaaaaagagcatcgcttgaaagaagtgatgaagacgatggggcttaacaacgctgttcactgggtcgcatggttcatcaccggtttcgtccagttgtccatctcagtgaccgcactgacagccattctgaagtacggtcaagtactgatgcacagccacgttgtcatcatctggctgttcctggccgtctatgccgtggctacaatcatgttttgttttctcgtatccgtgctctactccaaagctaagttggcctccgcctgcggaggaattatctatttcctgtcatacgtaccctatatgtatgttgccataagggaggaggtggctcacgataagataacagcttttgagaagtgcatcgcctctcttatgtctactacagcattcggcttgggttccaaatatttcgcgctgtatgaagtggcaggagtgggcatccagtggcataccttcagccagtcacccgtcgagggggatgatttcaatctgttgttggccgtgactatgctgatggttgatgccgtggtttacggtattttgacctggtacatcgaggcagttcaccctggcatgtacgggctgcctaggccatggtactttcccttgcagaagtcttactggcttggctcgggtcgtaccgaggcctgggaatggtcttggccctgggcccgcactcctaggctctccgtgatggaagaggatcaagcatgtgccatggagagcagaagattcgaggaaactcgcggaatggaggaggagccaacacacttaccgcttgtggtctgcgtggacaaactgactaaggtatataaagatgacaaaaagctggcactgaacaagttgtctctgaacttgtacgaaaatcaagtagtctcattcctgggccacaacggcgccggcaaaaccactaccatgtctatactcactggcctctttccaccaacatcaggatccgccactatatatggtcacgacatacggacagaaatggatgaaattagaaaaaatcttggcatgtgccctcagcacaatgtcctgtttgatagattgactgtcgaagagcacttatggttctatagtcgactcaagagcatggcccaggaagaaatccggagggaaatggacaaaatgatcgaagacttggagctgtctaacaaaaggcacagtcttgttcagacactcagcggcgggatgaagcgcaagctctcagtcgctatcgcctttgttggagggtctcgcgccatcatcctggacgaacccacagcaggggtcgacccctacgctaggcgggcgatttgggacctcatccttaagtataagccagggaggactattcttctctccactcaccatatggatgaggctgatttgttaggagatcggattgccattatttcccatggcaaactaaagtgctgcggatcgcccctcttcctgaagggaacatatggcgatggatatcgccttacactggtcaagaggccagccgagcccggcggcccccaagagcctgggctggcctcgagtcctccaggccgagctcctctgagctcttgctccgagctgcaggtttctcaatttattagaaagcacgttgccagctgtctgctcgtctcagacactagtaccgaattgtcctacatcctaccctcggaagccgccaagaagggcgcatttgaaaggctctttcaacacttggagcgttctctggacgcactccacttaagttcttttggcttaatggataccaccttggaggaagtgtttcttaaagtgagcgaggaagaccagtcccttgaaaactccgaagcagacgttaaagagagcagaaaggatgtgctccccggggcagagggccctgcatcaggtgagggacatgcgggaaatctcgccaggtgcagtgagctcacacagagtcaagcttctctgcaatcagcatccagcgtaggctcagctcggggggatgagggagccggttacacagacgtgtatggggattatcgacccctttttgacaaccctcaggaccccgataacgtcagcttacaggaagtggaggccgaagcactgtctcgggtcggtcaggggtcgcgcaagttggacggcggatggctgaaggtgagacaattccacggacttctggtgaaacgattccattgtgctagaaggaacagtaaggccctcttttcccagattctgctgccggcattcttcgtctgcgtggccatgacggttgctctttcagtgcccgagattggtgatcttcctccactggtcttgtctccttcacagtatcataactatacacaacctcgagggaacttcataccctatgccaacgaggaacgaagagagtatcgcctccgtctttcccccgatgcctcccctcagcagctagtgtcaacttttcggttaccctctggagtcggcgcaacatgtgtccttaaatcaccagccaatggcagcctcggccccacacttaacttgtcaagtggagaatcgagactgttagctgcccggttcttcgactctatgtgcctcgaatccttcacccagggcctgccgctgagcaattttgttcctccgccacccagccccgcgcctagcgatagcccagcctctcctgacgaggacttacaggcatggaacgttagtctcccccccacagctggcccagaaatgtggacgtcagccccgtctctccccaggctcgtcagagagcccgtgagatgcacgtgttcagcacagggcaccggcttctcttgccctagttcagtgggcggtcatcccccccagatgcgcgttgttacgggggatatactgaccgacatcaccgggcacaacgtctccgagtacttactgttcaccagcgaccgcttcaggctccaccgttacggcgccatcacctttggcaacgttctcaagtccattccagcgtcgttcggtactcgagctcctcccatggtacgcaaaatcgcggtgaggcgtgccgcacaggtgttttataacaacaaaggctaccatagcatgcccacatacttaaactctcttaataacgccatcctaagggcgaatcttcctaagtcaaaaggaaatcccgctgcctatgggatcacagtcacaaaccatcctatgaataaaacaagtgctagcctctctctcgattacctgctccagggcaccgacgttgtaattgctatattcatcattgttgccatgtcctttgtacccgcctcgtttgtcgtgttcctggtggcagagaagtccacaaaggctaaacatctgcagttcgtgtcgggttgtaaccctataatttattggctagcaaactacgtttgggacatgctgaattacctggtgccagcaacatgttgtgtaattatattgtttgtttttgacctgccggcgtacacgtctcctaccaactttcccgctgtgcttagtctgtttctcctgtacggatggtctattactcccataatgtatccagcaagcttctggttcgaggtcccatctagtgcatacgtctttctgatagtgattaacctgttcatcgggattaccgcaacagtagccactttccttctgcaattatttgagcacgacaaggatctgaaggtagttaacagctacctgaagtcatgctttctgattttccctaattataaccttgggcatggtctgatggaaatggcatacaacgagtacataaacgaatattatgcgaaaatcgggcagttcgataagatgaagtctccattcgagtgggacattgtcaccagggggcttgtggcaatggcagttgagggggtggtgggctttctgctgaccattatgtgccagtacaatttcctgagacgccctcagcgcatgccagtgagcactaaacctgttgaagatgatgttgacgttgcttcagaacgccagcgcgtgctccgcggcgatgcagataacgacatggtgaaaatcgaaaatctcacaaaagtgtacaagagccgcaaaatagggagaatactggccgtggaccgactgtgtctgggagtcaggccgggcgaatgttttggcctgttaggggtgaacggggcaggaaagacaagtactttcaaaatgctcaccggggatgaatctactacaggtggagaggcctttgtcaatggtcatagcgtcctgaaggaactgttgcaggttcagcagagcctgggttattgtccacagtgcgatgctctgttcgatgagttgacggcccgcgaacatctccaactgtatacaagattaagagggatttcctggaaagacgaagcgagggtggttaaatgggcccttgaaaagctcgagttaactaaatacgcagacaaaccagctgggacctattcaggaggcaataagcgaaagctaagcacagctatcgccctcattggctatcctgcctttatcttcctagatgagcctacaactgggatggacccaaaggcgcgcaggttcttatggaatctgatcttagacctcatcaagaccggccgctccgtggtgttgacaagccactccatggaagagtgtgaagctctctgtactagactggccattatggtgaacgggaggctgcgctgtcttggcagcattcagcacctcaagaaccggttcggtgacggatacatgataacagtacgcacaaaatcatctcagtccgtgaaagatgtggtgcgctttttcaatcgaaacttccccgaggctatgctgaaggagcgtcaccacaccaaagtgcagtatcagctgaagtccgaacatatttccctggcacaggtatttagcaaaatggagcaggtttctggtgtactgggtatcgaagactattccgtgtctcagaccaccttggataatgtctttgtgaacttcgccaagaaacaatctgataatttggagcaacaggagactgagcctcccagtgccttgcaatctccactggggtgcctgctgagcctgctgagacctcggtcggcccctaccgaactaagggctctggtagcggatgagcccgaggacctggatacggaagacgaagggctgattagctttgaagaggaaagagctcagctttctttcaacacagacacgctttgttag

SEQ ID NO: 109157 - DNA, 591 bp, Artificial Sequence
  Description of Artificial Sequence: Synthetic coding sequence
atgctgactggtgacgagagcaccaccggtggggaagcattcgtcaatggacattctgtattgaaggaattgctgcaggtccagcagtccctgggatactgccctcagtgcgacgcactcttcgacgagctcactgctcgcgagcacctgcagttatatactagattaagaggaatttcatggaaggacgaggcccgggttgtcaaatgggccttagaaaaactggagctgacaaaatacgcagataagccggcgggcacctatagtggcggtaataagcggaaactgtctacagcaattgccttgataggctatcctgcatttatcttcctggacgagccaaccactggcatggaccccaaggcccggcggttcctatggaatctcatactggatttaatcaagacaggtcgaagcgtcgtgctgacctcacactcaatggaggagtgtgaggccctttgcacccgccttgcaataatggagcggtcacccgctgtacctggccagcatcccgcacccgaagaacctgtatggagatggctgcacgatcatggtgcggaccaggagcagcctgaatgtgagggcaggtag

SEQ ID NO: 109158 - DNA, 5115 bp, Artificial Sequence
  Description of Artificial Sequence: Synthetic coding sequence
atggcagtgctacggcagttggcactcctgctgtggaagaattacactctccaaaaacgcaaagtgttggtgaccgtcctggaactgtttctcccattgctgttcagcggcatcctgatttggctaaggttaaagatccagtcggagaacgtgcccaacgcaacaatctacccggggcagagcatccaggagctgcctctctttttcaccttccctcctcctggggatacctgggagctggcatacatcccaagtcactccgacgccgccaagacggtgaccgagaccgtccggcgggctttagttattaacatgagagtgagaggcttcccaagcgaaaaagactttgaggattacatcaggtacgacaactgctccagctctgtactcgctgcagttgttttcgaacatcctttcaaccacagcaaagagccactacctctggccgttaagtatcatctgaggttttcttacactagacgtaattatatgtggacacaaactggcagcttcttcttgaaggagaccgaaggatggcatactacatctctgtttccactatttcctaaccctggacctcgagagccgacatcccccgacggtggagaaccagggtatattagagagggttttctggctgttcagcatgccgttgatcgcgctatcatggaataccacgcagacgcggctacacggcaactgtttcagagactgaccgtcaccattaaacggttcccctatccacccttcatagcggatccattcctggtggcaatacaatatcagctgccactgctactcctgttgtcctttacctacaccgctttgacgattgcaagggcagtggtgcaggaaaaggagagacgactgaaggaatatatgcgcatgatggggctttctagctggttacactggtctgcttggttcctgctgttcttcttgtttctgctcatcgcagcgtcctttatgacccttctgttttgtgtgaaagttaagccgaatgtggccgttctctccagatccgatccctccctggtattagcctttctgttgtgcttcgctattagcactatatcattctcctttatggtaagcaccttcttctctaaggcaaacatggccgctgcctttggcggcttcctgtacttcttcacatacattccttactttttcgtggcaccgcgttacaactggatgactctgagccagaaactctgttcctgcttactttcgaatgtggccatggccatgggtgcccaattgattggcaaatttgaggccaaaggcatggggattcaatggagggacctgttatcgcctgttaacgtcgatgacgacttttgctttggtcaggtgcttggcatgctactgctggattcggtgctttacggcttagtcacatggtatatggaggccgtgttcccaggtcagtttggagtgcctcagccctggtatttttttattatgccctcatactggtgcgggaaaccacgtgcagtggccgggaaggaggaggaagacagtgaccccgaaaaagccctcagaaacgagtatttcgaggctgaacccgaggacctagtagccgggattaagatcaagcatctgtctaaggttttcagagtcggtaacaaggatagagctgccgttcgcgacctgaatctgaacctctacgagggacagatcaccgttctgctcggccacaacggcgcaggcaagacaacaactttaagcatgctgaccggcttatttccccctacctcaggccgcgcctatattagcggttacgagatttcacaggatatggttcaaataagaaagagcttagggctctgcccccagcatgacatcttgttcgataacctcactgttgcagagcatctttacttctacgctcagcttaaaggactgagtagacagaagtgccctgaggaagtgaagcagatgttacacattatcggcctggaggataaatggaacagccggtcacgatttttaagcggagggatgcgacgtaaacttagcattggaatcgctctgatcgcaggcagtaaagtgctcattttagacgagcccacatctgggatggatgcgatttcgaggagagcaatctgggacctgctccagcgacaaaaaagtgaccgaaccattgtgttgactacacactttatggacgaggcagatctgctaggtgacagaattgccattatggctaagggggaactgcagtgctgcggcagctctctctttctgaaacaaaagtacggcgccgggtaccacatgactcttgtgaaggaaccacattgcaatcctgaggatattagtcaactagtgcaccaccacgttccaaatgccactctcgagtccagtgctggagctgaattaagtttcatccttccacgtgaatcaacacaccgttttgaggggctctttgccaagctggagaaaaagcagaaggagttgggcatcgcctcttttggggcctcaatcacgactatggaagaagtctttctgcgcgttggcaagctagtcgattcttctatggacattcaggccatccagctgccagcattgcagtatcagcacgaaaggagagcttccgattgggccgtggatagcaatctgtgcggggcaatggacccgtctgacggaattggcgcgttaatcgaggaggaaaggacagccgtaaaattaaataccggattggccctgcactgccagcagttctgggctatgttcctcaagaaggcagcctactcctggagggaatggaagatggttgctgctcaggttctggtacctctcacttgcgtgactttggcactgctggcaatcaactattccagtgaactcttcgatgaccctatgctcagacttactctgggtgaatatgggagaactgtagtgcccttcagcgtaccgggaactagccagctgggccagcagttgtccgagcacttaaaggatgcgttgcaagcggaaggacaagagccccgtgaagtgctaggcgacttagaggaatttctaatattcagagcctccgtggaaggaggaggttttaatgagcgctgtctggtagcggcaagctttcgggacgtcggtgagcgcaccgtggttaacgcgttgtttaacaatcaagcataccacagccctgcgacagcccttgccgtggtggataacttgctgtttaaactcctgtgcggcccccatgcttctatcgtggtctcgaatttcccccagccaaggtcggccctccaagctgctaaggatcagtttaatgagggacgaaaaggcttcgacattgccctgaatctgcttttcgcaatggccttcctggctagcacattctctatcttagcagtctcagagcgtgcagtacaggccaagcatgtgcagttcgtaagtggggtgcatgtggcttctttctggctcagcgcgctgctctgggatctcattagcttcctgatcccttctctgcttctcctggtggtgtttaaagctttcgacgttcgggcattcacaagagatggccacatggccgacacccttttactgcttctgctctatggctgggcaattatcccactcatgtaccttatgaattttttttttcttggcgctgctactgcatacacccgtctgaccatcttcaatattttgtctggaatcgccacctttctgatggtgacaataatgaggatccctgctgtgaagctggaagagttgtccaaaactctcgatcacgtgtttctggtcttgccaaaccattgtttaggaatggcggtaagttcattttacgaaaattatgagacacggcgctattgtacctcgtccgaggtcgctgcccattattgtaagaagtacaacattcaataccaggagaatttctatgcatggagcgcccctggcgtcggaaggtttgtcgcttctatggctgctagtggctgtgcctacttaatactcttgttcctcatcgagactaacctccttcagcggcttcggggaattctctgtgccctccgcaggcgaaggactctaacggaactttatacccgcatgccagttctaccagaggaccaggacgtggctgatgaacggacacgtatcctggccccttcccccgattctctcctgcatactccactgataatcaaagagctgtcaaaggtatatgaacagagagtaccactacttgccgtcgaccggctgtccttggctgtgcagaagggtgagtgcttcggattgctcgggttcaatggggccggaaaaacgacgacgtttaaaatgctcacaggtgaggaaagcttaaccagcggggacgctttcgtcggcggtcaccggattagtagcgacgttggaaaagtgaggcagaggatcggctattgcccccaattcgacgcccttctggaccacatgaccggtagagagatgctggtcatgtatgcccgtctcagaggaatcccagagcgacacattggtgcctgcgtggaaaataccctgaggggtttgctgcttgagccgcatgcaaataagctggttcggacctatagcggagggaataagcgcaagctctctactggaattgctctaattggggagccagcagtgatattcctcgacgagccttccaccggcatggaccccgtggccagacggctgttgtgggatacagttgctcgtgcccgcgagtcaggcaaagccattatcatcacgagccattctatggaggagtgcgaggccctatgcacacggctagcaattatggtccagggtcagttcaagtgcctaggttcaccacagcaccttaaaagcaaatttggttccggatatagtttgcgtgccaaagttcagtctgagggacagcaggaggctctggaagagttcaaagccttcgtggacctcacttttcccggaagtgtcctcgaggatgagcaccagggaatggtacactaccacctaccaggtagagacctcagctgggccaaagtgtttggaattttggagaaggccaaggagaaatacggagtagacgattactctgtgtcccagatcagtctagaacaggtgtttctctctttcgctcacttacagccaccgaccgcagaggagggtcgctag

SEQ ID NO: 109159 - DNA, 5127 bp, Artificial Sequence
  Description of Artificial Sequence: Synthetic coding sequence
acggctccaccaccctctccatcgcttccactgcaggatagggcagcgacatcggcccatctggcacttttcacactatcatttcagagtaccttcctgctgtttcccgctggctgctccgcctacctgaatctgctgcgcccaccgacctccctggcagccctcggcgtgcctttttccaaaaccatggctgtgttgcgccaacttgctctactgttatggaagaattacacgcttcagaagcgaaaggtgctggtcacagtgctggagctcttcttgccattgctttttagcggcatattgatatggctgagactcaagatccagagtgaaaacgtgcctaatgcaactatatatccagggcagtctatccaagagttgcccctgtttttcacatttcctcctcccggggacacgtgggaacttgcttatatcccctcacactctgatgcagctaagactgtaaccgagacagtacgacgagcgctcgttattaatatgcgcgtccggggtttccccagtgagaaagattttgaagactacatccggtatgacaattgctcaagtagtgtcctggctgctgttgttttcgagcatcccttcaaccacagcaaggagccgcttcccctggccgtcaaataccacctccgattctcctatacacgaagaaattacatgtggacacagacaggctccttctttttaaaagaaacagaggggtggcatacgaccagcctcttccccctgttccccaatcccggccccagagaacccacctcccccgacgggggcgaacccgggtacatcagggaaggattcctggccgtgcagcacgccgtggatcgggctatcatggagtatcatgcggatgcagccacccgacagttgttccagagactgacagttaccatcaagcggttcccctaccctcccttcatagctgatccattcctagtagccattcagtatcagctgcccttgctgttattgctctcattcacctatacagcgctgacaattgcaagagcagtcgtgcaggaaaaagagcggcgcctcaaggagtatatgcggatgatgggattatcctcgtggctgcattggagcgcctggttcttgctttttttcctgtttctgcttatagccgccagttttatgaccctgttattttgtgtgaaagtcaaacctaacgtggctgtgctttcccggagcgatccgtccctggtgctggcctttcttctgtgttttgcgatcagcaccatctcttttagtttcatggtgagtacatttttctctaagggaatggggatacaatggcgggacttgctgtcacccgttaacgttgatgatgacttttgtttcggtcaggttctcggaatgcttctgctagacagtgtgctgtatggcctcgttacatggtacatggaggccgtgttccctgggcagtttggtgttccacagccctggtattttttcattatgccttcctactggtgcggaaaaccgcgggccgttgcagggaaagaggaggaggactctgaccccgaaaaagccctcagaaatgagtattttgaagctgagcctgaggatctagtggccggtatcaaaatcaaacacttgagcaaagtgtttcgtgtcggaaacaaggaccgggcagctgtaagagacctgaacttgaacctgtacgagggtcaaattacggtgctcttgggtcataacggagcagggaaaacaacaactctctctatgctcactgggttatttccgcctacgtccggcagggcttatatcagcggttacgaaatatctcaggacatggttcagatcaggaagtcacttggtctgtgtcctcaacatgatatattgtttgacaatctgaccgtggcagagcatctgtatttctatgcacagctcaagggtctctctcgccaaaagtgccccgaagaggtcaaacaaatgttgcatatcataggattagaagacaagtggaactccaggagtaggtttctctctgggggcatgcgccggaagcttagtatcgggattgcactaattgccgggtccaaggtgttgattctcgacgagccgacatctggcatggacgcaataagtcggagggcgatttgggacctgctgcagagacagaagtccgatcgtaccatagtgctgaccacacatttcatggacgaggctgatcttttaggggatcggatcgccataatggcgaagggcgaactgcagtgttgcgggtccagtctttttctcaagcagaagtacggggccggctaccatatgactctggtgaaggaacctcactgcaacccagaggacattagccagctggtgcatcaccatgtgcccaatgccaccctggaaagttccgccggagccgaactgtcgtttatactgcctcgggagtcaacccatcgcttcgagggtctgtttgcaaagctcgaaaaaaaacagaaggaactgggtattgctagtttcggagcaagcattaccacaatggaagaagtgttcctgcgcgttggcaaactcgtggatagctccatggacattcaggctatccaattgcccgccctgcagtatcagcacgagaggcgagcatcagattgggccgtggattccaatctttgcggggctatggaccccagcgacggaataggagcactgatcgaggaagaacggacagccgtgaagctaaatacaggactggccctgcactgtcagcagttctgggcaatgttcctgaagaaagccgcctacagttggagagagtggaagatggtcgctgcccaagttctggtgcctcttacatgcgtgacattggctctcctcgctattaattacagctctgaacttttcgatgatcccatgcttaggctaacactgggagagtacgggcgtactgtagtaccatttagtgtgcctggcacctctcagctgggtcaacagctgagtgagcacttaaaagatgctctacaggcggaagggcaagagcctcgcgaggtgctcggggatcttgaggaattcctaatctttagggccagcgtggaaggcggcggatttaacgaaagatgcctggtggcggcctccttccgggacgtgggcgaacgaaccgttgtaaatgccttgttcaataatcaggcataccattctcccgccacagctctcgccgtggtggacaatttgctctttaagctcctctgtggcccacacgcctccattgtggtatccaacttcccacaacccagaagtgctctgcaggctgctaaggaccagtttaacgaaggccgtaaaggattcgatatcgctctgaatctgctcttcgccatggccttcctcgcatccacattctctatcctagccgtgtctgaacgggctgttcaggctaagcacgtgcagtttgtttcaggggtccatgtggccagtttctggctgtcagctctgctttgggatttgatcagcttcctaatacccagcttacttctgctcgtggtgtttaaagctttcgacgttcgggcattcaccagggacgggcatatggccgacacacttcttcttctgctactgtacggttgggccatcatccccctgatgtacctgatgaactttttttttctaggggccgcaacagcttacaccagactaactatcttcaatattctttccggaatcgccacgttcttaatggtcaccatcatgcgtatccctgctgtgaaactcgaagaactgagtaagaccctcgaccacgttttcctcgtcctgcctaatcattgtctaggaatggccgtgagcagtttctacgaaaactacgagaccagaaggtactgtacctcatcggaagttgctgcccactactgcaagaagtacaatatacagtaccaggaaaacttctacgcatggagcgctcccggcgtaggcagatttgtcgccagtatggcagcttccggatgcgcttacctgatcctactgtttttgattgagactaatctgctccagcgcctgagaggtatcctgtgcgcacttcggcggaggcgaaccctcaccgagttgtacacgagaatgcccgtcttaccagaggatcaggacgtggcagatgagcggacccggattttagccccttctcccgactccttattgcatacaccccttataatcaaagaactgtcaaaggtatatgagcagcgcgtcccgcttctcgctgtggatagactatctttggcggtgcaaaaaggggagtgtttcggactgcttgggttcaatggagcaggcaagactaccacatttaagatgctcaccggtgaagagtcactgacatcaggggacgccttcgttgggggccaccgcatttcatctgatgttggcaaggtgcgtcaacgaatcgggtattgtcctcagtttgacgccctgctggaccacatgactggccgcgagatgctggtgatgtacgcgcgcctgcgcggtatccctgagcggcacatcggcgcctgcgtggagaacacgctaagggggcttctgttagagccacacgctaataaattggtgcgtacttacagtggaggtaataagaggaaacttagcactggcatcgccctgattggagagccagctgtgatcttcctggacgaaccttcaacagggatggatcccgtcgcaaggcgcttattgtgggataccgtggcccgtgccagagagagcggaaaggctataatcatcacctcacactccatggaagagtgtgaagcgttgtgcacccgcttggccataatggtccaaggtcagttcaagtgcctcggctctccccagcatttaaagtccaagtttggtagcggttattctctgcgagccaaggtccagtccgaggggcagcaagaagcactggaggagttcaaagcattcgtggatttaacgttcccgggttcggtgctcgaagatgagcaccagggtatggttcattatcacctgcccggcagagacttaagttgggctaaagtgtttggcatactggaaaaggccaaggaaaagtacggggtggacgactattccgtgagtcagataagtctcgagcaggtgtttctcagttttgcccacctacaaccccccacggctgaggagggcagatag

SEQ ID NO: 109160 - DNA, 6822 bp, Artificial Sequence
  Description of Artificial Sequence: Synthetic coding sequence
atgggctttgtacggcaaatccagcttttattgtggaagaactggaccctgcgaaagcggcagaagatccgctttgtggtcgaactcgtttggcccctgtccctgtttttggtgctgatttggctgaggaacgctaatcctttgtattcacaccatgagtgccatttcccgaacaaggccatgccctctgccggcatgttaccatggctgcaagggattttctgcaatgttaacaacccatgttttcaatctccaactccaggcgaatctcctggtatcgtgtccaactacaataacagcattttggctcgcgtgtatcgggatttccaggagctcctgatgaacgcccccgaatcacagcatctgggtcgaatctggacagagctgcacattctgagccagttcatggacaccttgcgaacgcacccagagcgcattgcaggacgcggaataaggatccgcgacatcctgaaagacgaggagacacttaccctgttccttattaagaacatcggtctctccgactcggtcgtttacttgcttattaacagccaggttaggcccgagcaattcgcacacggggtgccggatctggccctcaaggacatcgcctgctccgaggctttgctggaaagattcattattttcagtcagcgaagaggggctaaaacggttaggtatgccctttgctctctatcccagggcaccctccagtggatcgaggatactctgtacgctaatgtggatttctttaaactgttcagagtccttcccacgctgctggatagccggtcccagggtataaatttgcggtcttggggcggcattttaagtgacatgagtccccgaatccaggagttcatacatcgcccatctatgcaggatctgctgtgggttactaggccactcatgcagaatggagggccagagaccttcaccaagctcatgggaatcctcagtgaccttctgtgcggatacccagagggcgggggctcacgcgtcctttcattcaattggtatgaagataacaattataaggctttccttgggattgattctactaggaaggaccccatctattcttacgatcgccggaccactagcttctgcaatgccctaatccagtcactggagagtaaccccctgaccaaaattgcctggagggccgccaagccactcctgatgggcaagatcctgtatactcctgattcaccagcagcccgccggatcttaaaaaacgcgaactctacttttgaggagctcgagcacgtgcgtaagcttgtcaaagcttgggaagaagtaggcccgcaaatctggtacttcttcgataactctacccagatgaacatgatccgcgatactcttggcaacccgaccgtgaaagacttcctgaacaggcaacttggggaagaagggatcactgccgaggccattttgaactttttatataaggggcctcgtgaatcccaggcagacgacatggctaacttcgactggagagacatatttaacataaccgatcgaaccctgcgcttagtgaatcagtatctcgagtgcttggtacttgataaattcgagtcatacaatgatgaaacacaactcactcaaagggccctgtcactgttggaggaaaacatgttttgggcaggagttgtgtttccagacatgtacccatggacttcctccctcccaccacatgtcaaatacaaaatcagaatggacattgacgttgtggaaaaaacgaacaaaatcaaagatcgctactgggacagcgggccacgcgccgatcctgttgaagattttagatatatatggggagggtttgcctacctgcaggatatggtggaacagggtattactaggtcccaagtgcaggctgaagcccccgtggggatctatctgcagcagatgccttatccctgcttcgtggacgattcttttatgattatcctgaatcgatgtttccccatctttatggtcctagcctggatctacagtgtctctatgacggtaaaaagtatagtgttggaaaaggagttgaggctcaaggagaccctgaagaaccagggagtgtcaaacgccgtgatttggtgtacctggttcctcgatagtttctccatcatgagtatgagtattttcctcctgacaatcttcatcatgcacgggaggattttgcactactcagacccatttatactcttcctctttctcttagccttttccacagctacaatcatgctctgcttcctgctgtcaacatttttttcaaaagcatctctagcagccgcgtgttccggggtgatctactttaccttatacctacctcatattttatgctttgcatggcaagacaggatgactgccgaactaaaaaaagctgtgagcctcttgtctcccgtggcgttcggcttcggcaccgaatatttagtcaggtttgaggaacagggcctggggctgcagtggtcgaacataggcaattcccccactgagggcgatgaattttcttttctcctttccatgcaaatgatgctattagatgccgctgtatacggactgttggcttggtatcttgatcaggtgtttcccggagattatggcaccccgttaccttggtactttctcctgcaggagagctattggctcggtggagagggatgtagcacgagagaagaaagagccctcgaaaagacagagcccctcaccgaggaaaccgaagatcccgaacatcctgaaggcatacatgactcttttttcgaaagagaacacccgggctgggtgccaggcgtgtgcgtgaagaacttggtcaagatcttcgagccatgcggacggccagcagttgatagactgaacatcacattctacgaaaatcagatcactgcctttctgggtcataatggtgcagggaagacgaccacactgtcaatcttgactggccttctgccacctacgtccggcactgtgctggtgggggggagggacattgaaacttcattggacgcggttcgccaatctctcggcatgtgcccacagcacaatatcctcttccaccatctgaccgtggctgaacacatgctgttttacgcacagttgaaggggaagtcacaagaggaggcacagctcgaaatggaagccatgctggaagacacaggcctacaccacaaacgaaatgaggaagcccaggacctgagcggaggaatgcagaggaaactgagcgtggccattgcctttgtcggggacgcaaaggtggtgattctggacgagccgaccagcggcgtcgacccatattcacgccggtcgatctgggacctgctcctcaagtatcggagcggccgaaccatcatcatgtccactcatcatatggatgaagcagatctgctcggcgatcgcattgcaatcatcgcacagggcaggctctattgcagcgggacccctctgttcctgaagaactgcttcggcacaggtctgtacctgacactggtgcgaaagatgaagaatatccagtcccagcgtaagggatcggagggtacctgtagctgcagctccaagggtttttcaacaacatgccccgcccatgtggacgatttgactcccgaacaggttctggatggcgatgtgaatgagttgatggacgtggtgctgcatcacgtcccagaagccaagttggtcgaatgtattggccaggaactgatctttctgctgcccaacaagaatttcaagcaccgggcctacgcatcactctttcgagaactcgaggaaaccttggcggatctcggcctctcatccttcggaatcagtgacacccctcttgaagaaatctttttgaaggtgaccgaggattctgatagtggcccactcttcgcaggaggcgcccagcagaaacgcgagaatgtcaatcccaggcatccctgtctggggccccgggaaaaagcaggacagactccacaagacagtaacgtgtgttcaccaggggctccagctgcccaccccgagggccaacctcccccggaacccgagtgccctggaccacagctgaatactgggacgcagctcgtgctgcaacatgtgcaggccctgctggtgaagcggttccagcacactattaggtctcataaggatttcctcgcccagattgtcttgccagctacattcgtgtttctcgccctcatgctgtccatagtgatcccgcccttcggtgagtaccccgccctaacccttcatccttggatttatggtcagcagtacacatttttttcaatggacgaaccaggaagcgagcaattcactgtgctcgccgacgtccttctgaataagccgggtttcggcaatagatgtctgaaggaaggctggcttcccgaatatccatgcgggaactccacaccttggaaaaccccatcggtgtctccaaatattactcagctgtttcaaaagcagaaatggacccaagtgaaccccagcccctcatgtaggtgcagcacacgagagaaactgacgatgctaccagagtgtccagaaggtgccggcggactgcctccaccccagaggacccagagaagcacagagatcctgcaggacttaacagacagaaacatttcagactttctggtgaaaacttatccagcattaatccggagctctctgaaaagcaaattttgggttaatgagcagagatatggcggaatctctatagggggcaagctgcccgtcgtcccgattacgggggaagctctcgtgggattcttatctgatcttggtcggatcatgaatgtgagcggcggccctatcacacgagaagcaagcaaggaaatccctgattttttaaagcacttagaaaccgaggacaacattaaggtttggttcaataataaaggatggcacgctcttgtaagcttccttaacgtggcccataatgctattttgcgggcgagtcttccgaaagaccggtcacctgaggaatacgggatcacggtgatctcccaaccactcaatctgaccaaagaacaattatcagagataactgtccttacgaccagtgtggatgcagtggtggcaatctgtgtgatctttagcatgtcatttgttccggcatcgtttgtcctgtaccttatacaagagcgggtcaacaaatcgaaacacttgcaattcatctcaggtgtcagcccaaccacatactgggttacaaacttcctgtgggatatcatgaactacagtgtctccgctggcctggttgttggaatcttcatcggctttcagaaaaaggcttataccagccccgaaaacctcccggcgctggtggcgctactcctgctgtatggctgggcagtcatacccatgatgtacccggcgtcctttttgttcgatgttccaagcacagcatacgttgcactgtcctgtgctaacctctttatcggcattaacagttccgctatcacattcattttagagctttttgaaaataacagaactttgcttcgattcaacgcagtgctccgaaagctgctgattgtatttcctcatttttgtttaggaagagggttaatagatctagcactgagccaggcggttactgatgtgtatgcgcggtttggggaagagcactccgcgaacccatttcactgggatctcataggcaagaatctttttgccatggtggtagaaggcgtggtgtattttctgctgacccttctggtgcaacgccacttcttcttaagtcagtggattgctgaaccaaccaaggagcctattgtcgacgaggacgacgatgtggctgaggagcgacagagaattattacaggtggcaacaaaacagatatacttcgcttacacgaattaaccaagatctatcccggcaccagcagtccagccgttgaccggctgtgtgttggcgtgcgccctggcgaatgctttggactgctgggagtgaatggcgcaggcaaaacgaccacgttcaagatgctgactggagatactactgtgactagcggagatgccaccgttgcgggtaagtcaattctgacgaacatcagcgaagttcaccagaatatgggatactgtccccagtttgatgccatcgacgagctcctgactggacgagagcacctttatctctacgccaggctgcgaggcgtgccggcagaagaaattgagaaagtcgctaactggagtataaaaagccttggcctcaccgtttacgccgattgcctggcaggtacctactcaggcgggaacaaacggaagttgagcaccgccatcgcactaattggatgccctccgcttgtcctgctcgacgaacctacaaccgggatggatcctcaagcccggaggatgctctggaacgtcatcgtatctatcatccgggaaggccgcgcagtggtcttgacttcccactcaatggaagaatgcgaggccctctgtaccagattggctatcatggtgaagggggcatttaggtgtatgggcacaatccagcacttgaagtcgaaattcggtgacggctacatcgtgaccatgaaaattaagtctccaaaagatgatctgcttcccgatctgaaccccgtggaacagttctttcagggtaatttcccagggtccgtgcaacgcgaacgtcactacaatatgcttcagttccaggtcagttcttcctcactcgctcgcatttttcagttgctgctctcacacaaggactctcttctcattgaagagtactctgtgactcagactacactagaccaggtcttcgtcaacttcgccaagcagcagactgagagtcacgacctgccactacaccccagggcagcaggcgcgtctcgccaagcccaggactag

SEQ ID NO: 109161 - DNA, 2940 bp, Artificial Sequence
  Description of Artificial Sequence: Synthetic coding sequence
atggggttcgttcgacaaatacagttgctcctgtggaaaaactggactctccgaaagcggcaaaagatccggtttgtggtagagctggtgtggcccctttcgttatttctagtgctgatctggctccggaatgcgaaccccttatactcacatcacgagtgccacttccccaacaaggctatgccatctgccggaatgcttccttggctgcaaggtattttctgtaatgtgaataacccatgctttcagagcccaacacccggcgagtcccctggtatagtgagcaactataacaattcaattctggccagggtttacagggatttccaagagttactgatgaacgcacctgaaagtcaacacttgggacgtatttggaccgagcttcatattctctcacagttcatggatacacttagaacccatcctgaacggattgcggggaggggaattcggattcgtgatattctgaaggacgaggagaccctgaccctgttcctaattaagaacatcgggctttcggactccgtcgtgtacctcttgatcaacagccaagtgaggcccgaacagtttgcacatggtgtcccggacttggcactgaaagacatcgcttgcagtgaggccttactagaacgctttattatcttctcccagaggcgaggagctaagaccgtgaggtatgccctgtgctcccttagtcagggtaccctgcagtggattgaagacacattgtacgctaatgtcgacttctttaaactgtttcgcgtattacccaccttactcgactcacggtctcaaggcatcaatctccgctcgtggggaggcatcctttcagatatgagcccacggatccaggaatttatccataggccttctatgcaagatctgctctgggtaactcgccctttaatgcagaacggcgggcccgagactttcacaaaactgatgggaatcttgtcagacctcctatgcggctatccagagggaggtgggtcccgagtattgagtttcaactggtatgaggacaacaactataaggccttcttggggattgattccacccgaaaagatccaatttattcctatgacagacgcaccacatctttctgtaatgccctcattcagtccctggaaagtaacccccttacgaagatcgcttggcgagccgcaaaacctttactgatgggcaaaatcctatataccccagatagtcccgccgctagacgcatcctgaaaaatgccaattctactttcgaagagctggagcacgtgaggaagctggtcaaagcgtgggaggaggtgggcccacagatctggtacttctttgataactctacccaaatgaatatgatccgcgatacactgggcaacccgacggtaaaggattttctcaaccgccagctgggcgaggaagggattaccgctgaagcaatcctgaattttctgtataaaggcccccgtgaaagtcaggccgatgacatggccaactttgactggagagacatcttcaatattactgatcgcacgctgcggttagtgaaccagtacctagaatgcctggtgctagataaattcgagagctacaatgacgaaacacagctgacacagagagctttatctctcctggaggagaatatgttttgggctggggtagtttttccagacatgtacccgtggacctcttcactgccccctcacgtgaaatacaagatccgcatggacatcgacgtggtggagaagacaaacaagatcaaagacagatattgggactccggtccaagagcagacccggtagaagactttaggtacatctgggggggcttcgcgtacctccaggacatggtggaacaggggatcacccgtagtcaggtccaggcagaagcccccgtgggaatatatctgcagcagatgccatacccctgcttcgtcgacgattcattcatgattatcctaaatcgttgttttccaattttcatggtcctggcgtggatttactctgtgagcatgaccgtcaagagtattgtgcttgaaaaggagctccggctcaaagaaacattaaaaaatcagggagtcagcaatgctgtcatctggtgcacctggtttctggattctttctctataatgagcatgagtatctttcttcttaccatattcatcatgagcctcctttctccggtggcattcggctttggaacagagtacctcgtgcggttcgaggagcagggccttggcctccagtggtccaatatcgggaatagtcccaccgaaggcgacgagttctcattcctcctgagcatgcagatgatgttactcgatgcagcagtgtatggcctgcttgcctggtatctggaccaggtctttcccggggactatgggacgcccttaccctggtactttctgctgcaggagtcttactggttgggaggggagggttgttctacacgcgaagagagggcccttgaaaaaacggaacctctgacggaagagactgaggatcctgagcaccctgagggaattcacgactccttcttcgagagggagcatccaggctgggtgccaggcgtatgcgtaaagaatttggttaagatcttcgaaccttgtggcagacccgcagtcgaccgtctaaacatcacattctacgaaaatcagataactgccttccttggtcacaacggtgcgggcaaaaccacgactttcagcgctggagcccctctatccagcaagggaccggaacggcatttgcttcgtggagaacatggacccccatggttccctaaagagcagcagacacggactagccagggagctgctaatccacgcgacaccgtgtttaagagctttggggaaccccaagaaggcacaacggcttgcacgccttgtgatggaatgttctcacgcgcggttcagtgtgaatggaatgtgggccctgtgcccttctag

SEQ ID NO: 109162 - DNA, 1179 bp, Artificial Sequence
  Description of Artificial Sequence: Synthetic coding sequence
atggtcgtggagggcgttgtttacttcctcctgacactcctggtccagcggcatttcttcttatctcagtggatcgccgagccgacaaaggaacctatcgtagatgaggacgacgacgtggctgaagaacgtcagagaatcataacaggggggaacaagacagatatcttacgcctccatgagttaaccaagatatatcccggcacttcttcacccgctgttgacaggctctgcgttggagtgcgcccaggagagtgttttggcctgcttggagtgaatggggctgggaagaccacaacgtttaaaatgctgacaggcgacaccacggtcaccagcggcgacgccactgtggccggcaaaagtatactaacgaacatcagcgaggtgcatcagaacatggggtactgtccccagtttgatgcaatcgacgagctgctcaccggacgggagcacctatatctatacgcacgattgcggggcgttcccgcagaggagatcgagaaggtggcaaattggtctataaaaagcctcgggctgaccgtctatgccgattgcttggccggaacttatagtggaggcaacaagagaaaactctcaacagcaattgctcttattggctgtccccctctggtgctgttggacgagcccaccactggcatggatccgcaggcaagacgcatgctgtggaacgttatcgtgtccattatacgagaagggcgggccgtggtcttgacaagtcattccatggaggaatgtgaagcgctctgtacacggttagctattatggtcaagggcgctttcagatgcatggggacaattcagcatctaaagagcaagttcggagacggatacatcgttacaatgaaaattaagagtcctaaggatgacttgctgcccgatctgaacccagtggagcagtttttccagggtaatttccccggaagcgtacagcgcgagcggcattacaacatgctgcagttccaggtgtctagtagctccctagcccggatatttcaactgctcctcagtcataaagactcactgttgatcgaggagtactccgtgacacagactaccttggatcaagtgtttgtgaacttcgctaaacagcagaccgagtcccatgacttgcctttacatcctcgagctgctggtgcctcacggcaggcccaggactag

SEQ ID NO: 109163 - DNA, 1632 bp, Artificial Sequence
  Description of Artificial Sequence: Synthetic coding sequence
atgatgatgaattatagtgtgtccgctggactcgtcgtcgggatttttattgggttccagaaaaaggcttatacaagcccagaaaaccttccagcgctcgtggctctgctgttactgtacggatgggccgtcatcccaatgatgtaccccgcttcttttctgttcgatgtcccatcaactgcatatgtggctctatcttgtgctaatttgttcatagggattaactctagcgcaatcacgttcatattggaactgttcgaaaacaacagaactttattgcggttcaatgcggtgctacgaaagttgttgatagtgttcccccatttctgcctcggtcgcggcctgatagacctcgccctctcccaggcagtgaccgatgtttatgcgcgattcggcgaggagcattcggctaatccgttccactgggatctaataggaaaaaatctattcgcaatggtggtggagggagtggtgtatttcctcctgaccttactggtccaaaggcatttctttctctcccagtggatagccgagcccacgaaggagcccatcgtggacgaggacgatgatgtggccgaggagcgacagcgcatcatcaccggaggcaacaagaccgacattctccggctgcatgagctgacaaagatctaccctggcacgagcagtccggctgtcgatcggttatgcgtgggtgtccgccctggagagtgttttggcctactgggcgtgaatggcgccggcaagaccacaactttcaagatgctcaccggtgacacaacagtcacctctggggatgccactgtcgccgggaagtccatcctgacaaacatttccgaggtacaccaaaacatggggtactgtccccaatttgacgctattgacgaactgctgacaggtcgcgaacacctctatttatacgctcgcctgcgaggcgtacccgctgaggaaattgagaaggttgccaactggtctatcaagtctctcggtttaacggtttacgccgattgcttggccggcacctacagtggaggcaataaaaggaagttatccaccgcgatcgcactaattggatgcccacctctggtcctcctggatgaaccaacaactggaatggatccccaggcgcggcggatgctgtggaatgtgatcgtctctattatcagagagggtagggccgtagtcctcacgtcacacagtatggaggaatgcgaggccctgtgtaccagactcgcaatcatggtcaaaggcgcttttcgatgtatggggactatccagcaccttaagagcaaattcggagacggttatatagtgacaatgaagattaagtcacccaaggacgaccttctgcccgatcttaacccagtggaacaattcttccagggtaattttcctggatctgtgcagcgagagaggcattataacatgttacagttccaagtcagtagctcctctctcgcgcggatattccagttacttctgtctcacaaggacagtttgttgattgaggagtatagtgtgactcagactaccctggaccaagtgttcgtaaactttgccaagcagcagaccgaaagtcacgacctcccattgcaccccagggctgccggtgcaagcagacaggctcaggattag

SEQ ID NO: 109164 - DNA, 3198 bp, Artificial Sequence
  Description of Artificial Sequence: Synthetic coding sequence
atggacgtcgtgcttcatcacgtgcctgaagcaaagctggtggagtgtattggccaagaactcatctttttactgccaaataagaatttcaaacacagggcctacgcgtccttattcagggagctagaagaaaccctagcagatctgggcctgtcgagcttcggcatctccgacacaccacttgaggaaatattcctgaaagtgacagaggacagcgatagtggtccactgttcgccggcggcgcgcagcagaaaagggagaatgttaacccacgacatccatgcctgggtccaagggaaaaggccggccagacgcctcaggatagcaacgtttgctcacctggggcacctgctgctcatcctgagggccagccacccccagagccggagtgtcccggcccccagcttaacacaggtacgcagctggttctgcagcatgtccaggcattacttgtgaagcggttccagcacacaatccggtcacacaaagactttttagcacagatagtattgccagcaacctttgtgtttctggcactcatgctgagtatcgtcatacctccctttggagagtaccctgcactgaccctacatccttggatttatggccagcaatacacctttttctccatggatgagccggggtctgaacagtttacagtgttagccgacgtgctgctgaataaaccaggctttgggaaccgctgcttgaaagagggttggttgcctgaatatccatgcggtaactcgacgccttggaaaacaccatccgtttcacccaacatcacccagctgtttcagaagcaaaagtggacgcaagtcaacccctccccttcttgtcggtgctccaccagggagaagctgacaatgttgcctgaatgccctgagggcgctggaggcctgcccccccctcagcgcacccagcgcagcactgaaatactgcaggaccttaccgaccgtaacatttcagactttctggtgaagacctaccctgcgctcatcagatcgagcttaaagagcaaattttgggtcaatgaacagcggtacggtggaatcagtatcggcggtaagctgcccgtggtgccaattaccggagaggcccttgttggattcttaagcgacctgggtcggattatgaatgtatccggaggaccaattacccgggaggcctcgaaagagattccagactttctaaagcacttggagaccgaggacaacataaaagtctggtttaacaacaagggttggcacgctctggtgtcttttttaaatgtcgcacacaatgctatcttgcgcgcttctctccccaaagaccgcagtccggaggaatacggtataaccgtcataagccaaccgctgaatctgacgaaagagcagttgtcggaaattaccgtgctaacgacctccgtcgatgctgtcgtggccatttgtgtgattttcagcatgagttttgtccccgcaagctttgtgctttacctaatacaggagagagttaataagagcaagcaccttcagtttatttccggtgtaagtccaacgacgtactgggtgacaaatttcctgtgggacatcatgaactattccgtgtcggccggtctagtggtgggaattttcatcggctttcaaaaaaaagcatacaccagtcccgaaaatttgcctgctctggtggcattgctcttattatatgggtgggccgtgatacccatgatgtatccggcctcttttctgttcgacgtgccctccaccgcatacgtggccctgagctgcgccaacctgttcataggtatcaactcttccgctatcactttcattctggaactgttcgagaataaccgcacattgctcaggttcaatgcagtcctaagaaaattgctaatcgtgttcccacacttctgcctagggaggggactgatcgacctggccctctcacaggccgtcaccgacgtgtacgccaggttcggcgaagagcattctgcaaatccctttcactgggacctgatagggaagaaccttttcgccatggtcgtggaaggagttgtgtacttcctgttaaccctcctggtccaacggcactttttcctgtcccagtggatagccgaacccacaaaggagcctatcgttgatgaagatgacgacgtggccgaagagcgtcagaggatcatcactggtgggaataagacagacatcttacgtttgcacgaattgactaagatatacccagggaccagttcccctgccgtcgacaggctttgtgttggagtaagacccggagagtgctttggactcctgggtgtgaacggtgctggtaaaaccacaactttcaagatgctcacaggagacactacagtgacgtccggtgacgccaccgtcgccggtaaatccattcttactaacatctcagaggtccatcagaatatgggctactgtccacagttcgacgcaatagacgagttgctgacaggacgggagcatctgtatttgtacgctagattgaggggtgtgccggcagaggagattgagaaggtggcgaactggagcatcaaaagcttgggcctgactgtgtacgccgattgcctcgccggaacttattctggggggaataagagaaagcttagcactgccattgcgcttatcggctgcccacccctcgtcttgttagatgaacctaccaccggcatggatcctcaagcaagaagaatgctttggaatgtgatcgtgagcatcatcagggaaggcagagccgtcgtcctgactagccatagcatggaggagtgcgaggcactgtgtactaggcttgctatcatggtcaaaggcgcctttcggtgcatgggcacaatccagcatctgaagtcaaagttcggggacggatacatcgttaccatgaagattaagtctcccaaagacgacctcctgcctgatttgaaccctgtggaacagtttttccagggcaattttccaggaagcgttcagagggaaagacattataacatgctgcagttccaggtgagcagcagctccctggctcggatctttcaactgttgctgagccacaaggattccttgcttatcgaagaatattccgtgactcagacgacccttgatcaggtcttcgtgaattttgccaagcagcagaccgaatcacacgacttacccctgcatccccgcgccgccggcgctagcaggcaggcccaagattag

SEQ ID NO: 109165 - DNA, 4929 bp, Artificial Sequence
  Description of Artificial Sequence: Synthetic coding sequence
atgtctacagccattagggaagtgggggtctggagacagacccggaccctactgctcaagaactatctgataaaatgcaggaccaaaaagtcgtctgtccaggaaattttgtttcctctcttctttcttttttggctgatattgatttccatgatgcacccaaacaagaagtatgaagaagtgcccaacatcgagctgaatccaatggacaaatttacgttgtccaacctgatactgggatataccccagtgaccaatatcacctcttccataatgcagaaagtctcaaccgaccacttaccggacgtgattataacagaagaatacaccaacgagaaagagatgctgacctccagcttgtccaagccttccaatttcgtcggtgtggtctttaaggactcaatgtcatacgaacttaggttttttcccgacatgattcccgtgtcatcaatctacatggattctagggcgggctgttctaagtcttgcgaggccgcacagtactggagctccgggttcactgtgttacaagccagcatcgacgcagctataatacaactcaaaacaaatgtcagcttgtggaaagaactggagtccacaaaagcggtgataatgggagagacagccgttgttgaaatagacactttccccagaggcgtgatcctgatttatctggtcatagctttctctccattcggttatttccttgccatccacattgtagcggaaaaggagaagaaaatcaaagagtttctcaagatcatgggcttacacgacacggcattctggctgagttgggtgctcctgtacaccagcctgatcttcctaatgtccttactaatggctgttatagctaccgcttcgctgctgtttccacaaagttcatcgatcgtgattttcttgttatttttcctatacgggctgtcgtccgtgttttttgccctgatgctgactcccctgttcaaaaaaagcaaacatgtgggcatcgtggagttttttgtaacagtggcattcggcttcattggcctgatgatcattctcatcgaatcctttccaaagtcgctggtctggttatttagccctttttgtcactgcacatttgtgattggcatcgctcaggtcatgcatctggaggactttaatgagggagcaagtttttctaatctaactgccggcccataccctttgatcatcaccattattatgctgactctgaacagtatcttctatgttctgctggctgtgtatcttgaccaggtcattccaggtgagttcgggcttcggaggtcatcattgtactttcttaagccctcttactggagtaagtctaaacgtaactatgaagagctaagtgaaggtaatgttaatggaaacatttctttttccgaaattatagaacccgtttcctcagaatttgtcgggaaggaggctattcgcatatctggcatccagaagacttacaggaagaaaggtgaaaacgtggaggcattgcggaatctctccttcgatatctacgaagggcagatcactgcactactgggacatagtggcaccggcaaatcaacattgatgaatatcttgtgtggcttgtgtccaccctcggatgggtttgcatcaatatacggtcatcgagtctcggagatcgacgagatgttcgaggcccggaaaatgataggtatatgtccacagctcgatatccatttcgatgtgctgacagttgaggagaatctcagtattctggctagtataaagggcatccccgcgaataacatcattcaggaggtccagaaagtgctgcttgacctagatatgcagactattaaggataaccaggccaaaaaactttctggaggtcagaaacgcaagcttagtctcggcatagcggtgttggggaacccaaagatcctccttctagacgaacctacagctgggatggatccttgttcgaggcacatcgtgtggaatttgctcaaatatcgcaaagctaaccgtgtgaccgtgtttagtacacacttcatggatgaggccgacattctggctgaccggaaagccgtgattagccagggcatgctgaaatgcgtgggaagtagcatgttcctgaagtccaaatggggcatcggttacaggctttccatgtacattgacaagtactgtgctacggagagtctgtcatctctggtcaagcagcacatccccggggccaccctgctgcagcagaacgatcagcagttagtgtactccctccccttcaaggatatggataaattttcaggactgttctcggcccttgactcacattcaaatcttggtgtgatttcatatggcgtgagtatgactacactcgaggatgttttcctcaaactggaggtggaggccgaaatcgatcaggccgactactcagtatttactcaacagccacttgaggaggagatggattccaaatccttcgatgagatggagcagagtcttttaatactgagcgaaactaaggcagctctggtgagcaccatgtctctgtggaagcagcagatgtacactatcgccaagttccacttcttcactctgaagagggaatccaagtctgtgcgatccgtgttgctgttgctgctgattttctttactgtgcaaatatttatgtttcttgtccatcactcatttaaaaacgctgtggtcccaattaagctggtgcccgacctttatttccttaagccaggcgataaaccccacaagtataaaactagcctgctgctgcagaattccgcggattccgatataagtgacttgatatccttttttacatctcagaatatcatggttaccatgattaacgacagcgattatgtttcggtcgcaccccactcggcggcgctgaacgtgatgcactctgagaaggattacgtttttgcagcagtctttaacagcacgatggtctactcccttccaatcttagttaatattatctcaaactattacctctatcacctcaatgttaccgaaaccatacaaatatggtctaccccgttcttccaggaaataaccgacattgttttcaagatcgagctatactttcaggcagccttactggggattattgtgaccgctatgccgccctatttcgctatggagaatgctgaaaaccataaaataaaggcctatacgcagctgaaactgagcgggctcctaccctccgcctactggatcggccaggccgtggtcgatattcctctcttcttcatcatcctgatactaatgctgggcagcctgcttgcctttcactatggtctctacttctatacggtgaagtttcttgccgtggtcttctgcctgatcggatatgtccctagcgttatcctctttacgtacatcgccagtttcacgttcaaaaaaatcctgaataccaaagagttttggagttttatctatagtgtagccgctctggcctgcattgcaataaccgagatcactttttttatgggctacaccattgccactattctgcactacgctttctgtatcatcattcccatatatcccctgcttggatgtttaattagcttcatcaagatttcctggaaaaacgtccgaaaaaatgtggatacctataacccctgggaccgtctctcagttgctgtgatatcgccttacctgcagtgtgtgctgtggatcttcttactccagtactatgagaaaaagtatggggggaggagcattcgcaaggatcccttcttcagaaatctgtccaccaagtcaaagaataggaagctccccgaaccccccgataatgaggatgaggacgaagatgtcaaagcagagaggttgaaagtcaaggaactcatggggtgtcagtgttgtgaagagaagccctccatcatggtctctaatcttcacaaggagtatgacgacaaaaaggacttcctgttgagtcggaaagtgaagaaggtggccaccaagtacattagcttttgtgttaaaaaaggtgaaatcctgggtctactgggacccaacggcgccgggaagagtactataataaatattctggtcggcgatattgagcccacctccgggcaagtcttcttgggagattactcatctgagacatccgaagacgacgacagccttaaatgcatgggctactgtccccaaatcaatcctttatggccggataccactctgcaggaacattttgaaatttacggcgccgtgaaaggcatgtccgcatctgatatgaaagaggttatttctagaataacccatgccctcgatttaaaagagcacctacaaaaaaccgtgaagaagttgcctgcaggcattaagagaaagctgtgcttcgcgctgtctatgctggggaatcctcagattacccttctggacgagccgtctactgggatggatcccaaagcaaaacagcatatgtggagggccatccgaactgctttcaaaaaccgcaagagagccgcaatactcaccactcactatatggaagaggctgaagctgtgtgtgaccgggtcgccataatggtgagcggccagctgaggtgtatcggtacagtacagcatctcaagtctaaattcggaaagggctattttctggagattaagctaaaggattggattgaaaatctggaggtggataggcttcaacgggagatccagtacatattccctaacgcaagtcggcaggaatccttctccagcatcttggcatacaagattcccaaggaagatgtgcagtctctatctcagtcgttctttaaactcgaagaggccaagcatgctttcgctatcgaggaatactcattctcccaggctaccctggaacaggttttcgtcgagctgacaaaagagcaggaggaggaggataacagttgcgggaccctgaatagtaccctgtggtgggagaggacacaagaagaccgcgtcgtattctag

SEQ ID NO: 109166 - DNA, 4932 bp, Artificial Sequence
  Description of Artificial Sequence: Synthetic coding sequence
atgtctaccgccattcgggaagttggagtttggagacaaacgcgaactctgttgctgaaaaattacttgattaagtgcagaacaaagaagtcttccgttcaggagattctgttcccattatttttcttgttttggctcatcttgatctccatgatgcatcccaacaaaaaatacgaggaggtgcccaatattgaactgaatccaatggacaagtttaccttgtctaatctgatacttgggtacacgcccgttactaatatcaccagcagcatcatgcaaaaagtgagcactgatcacttgcccgacgtgatcattacggaggagtatacaaatgagaaagaaatgctcacatcaagcctgagtaaacctagcaattttgtgggagtggtgtttaaggacagtatgagctacgagttgcgattttttcccgacatgattcctgtgtcatctatctacatggactctagagcaggatgttctaaaagttgcgaagctgcccagtactggagttccgggttcaccgtgctgcaggcgtcgatcgatgctgccatcattcaattgaaaactaacgtatctctttggaaagaactggagagtactaaggcagtgattatgggtgagacagctgtcgtggagatcgatacttttccacgaggtgtaattctgatttacctcgtgattgcctttagccccttcggatacttcctggctatacatatcgtggcggagaaggaaaaaaaaatcaaagagttcctcaaaatcatgggactgcacgacactgcattttggttgtcctgggtcctgctgtatacaagtctgatttttctcatgagtctcctcatggccgtcatagcaacagccagcctgctcttcccccaaagttcctcaatcgtgatcttcttgctgttctttttgtacggtttaagtagcgtgttcttcgctctgatgctcacaccgctattcaaaaagagcaagcacgttggcatcgttgaattcttcgtaaccgttgcttttggctttatcggactgatgattatcctgatcgaatcgtttcctaagtccttggtgtggttgttttcaccattttgccactgtacatttgtcatcggcatcgcccaggttatgcacctggaagacttcaatgagggcgctagtttctcaaatctgaccgcagggccgtaccccctgatcatcactattatcatgctgacgctgaattctattttctacgttcttttagctgtgtacttggatcaggtcatacccggcgagttcggccttagaagatcaagtctctacttcctcaaaccctcttactggtccaagtctaaacggaactacgaggagcttagcgaggggaatgtaaacggcaacatcagtttttcagaaattatagaacccgtttctagtgagtttgtcgggaaagaggctatccggattagtggcatacagaaaacttaccggaaaaagggagagaacgtggaggccttaagaaacttatcattcgacatctatgaggggcagattactgcgctcttggggcactctggcaccggtaagagcaccttaatgaatatactgtgtggactctgccctcctagcgacggctttgcaagcatctatggtcaccgagtgtctgagatcgatgaaatgttcgaagcccggaaaatgatcggcatatgcccacaactggatatccacttcgacgtgctgaccgtggaagaaaatctatcaattcttgcctctatcaaaggcatccccgcaaataacatcattcaggaagttcagaaggtgctgctggatctggatatgcagaccataaaagataaccaagccaagaaattgagcggcggacagaagaggaagctatctctgggtattgccgtgctcggtaaccctaaaatcctgctgctggacgagcctaccgctgggatggacccttgttctaggcatatcgtgtggaatctgctgaaatacagaaaggcaaaccgggtgaccgtcttcagcacacacttcatggacgaggctgacatccttgcggaccgcaaggctgtgatatcccaagggatgcttaaatgcgtcggcagcagcatgtttctcaagagcaaatggggtattggctatcggttatcaatgtacatcgacaagtattgcgccacagagtctctgagcagtctggtgaagcagcacatccctggggctaccctcctacagcagaatgaccaacagttggtctattctttgcccttcaaggatatggacaaattttcgggtctattctcagctctggacagccactcaaaccttggcgtaatatcctatggggtgagtatgaccactctcgaagacgtatttctgaaactggaggttgaagccgaaatcgatcaggccgattactccgtgtttacacagcagcctcttgaggaggaaatggactcaaagtcatttgacgaaatggaacagtcattactcattctctctgagaccaaagcagccctcgttagcactatgtcattgtggaagcaacagatgtacacaatagcgaagttccattttttcacgctcaaaagagagtcaaaatctgtccgcagtgtgctgctgctgctgctgatattcttcaccgtgcagatctttatgtttctggttcatcactcctttaaaaacgccgtcgtgcctattaagctagtgccagacctgtactttctgaagccgggtgataaaccccacaaatacaagacatcactgctgctgcagaattctgccgccgacagcgatattagcgacctgatcagcttctttacatcgcagaatattatggtaacaatgatcaacgattccgattacgtgagtgtggctcctcacagcgcggcgttgaacgtcatgcatagcgagaaagactacgttttcgcagcggttttcaacagcacaatggtgtactccctgcccattctcgtgaatattattagcaattattacctatatcacctgaacgtcacagagaccattcaaatctggagcactcccttttttcaagaaattacagacattgtgtttaagatagaactttacttccaggccgccctgttaggtataatagttacagccatgcccccctatttcgctatggagaatgcagagaaccataagattaaagcttatacccaactgaagctctcgggcctcctgcccagcgcttactggattggtcaggccgtggtcgacatccccctcttctttatcattctgattctaatgttaggcagtcttttggccttccactacgggctgtacttctacacggtgaaattcctagccgtggtgttttgcctgatcggctatgtgccatcagtcatcctgtttacgtatatcgcgtctttcactttcaagaagatcttgaacaccaaagagttctggtctttcatatattccgtcgccgcattggcctgcatcgctatcacggagatcacattctttatgggctatactatcgcaaccatcttacattacgccttttgtattatcataccaatctaccctctgctgggctgtttgatctcattcatcaagatcagttggaagaacgtaaggaaaaatgtagatacatacaacccttgggatcggctcagcgtagctgtcatttccccatatctacagtgtgtcctgtggatttttctcctacaatattatgaaaaaaagtacggaggaagatctattaggaaagaccccttcttccgcaacctgtccacaaagagcaagaatcgcaaactgcccgagccgcctgataatgaagatgaggatgaagatgtaaaagcagagcgactcaaagtgaaggaactcatgggctgtcagtgttgtgaagagaagccttcaatcatggtgtctaatctgcataaagaatacgacgacaagaaagactttctcctgagccgcaaagtcaagaaggtagctaccaaatatatcagtttctgtgttaaaaaaggagaaattctgggtttgcttggtccaaatggggctggcaaatccacaatcattaatatcctggttggcgatatagagccaacctcagggcaagtctttctgggcgactactcctccgagacgagcgaggatgacgattctcttaagtgcatgggatattgtccccagatcaacccgttgtggcctgatactaccctccaagagcacttcgagatttacggggcagtcaaaggcatgtccgcctcagacatgaaggaggtgatctcaagaattacccacgcattggaccttaaggaacatctccaaaagacagtcaagaagctgccagcagggatcaagcggaagctctgctttgccttatctatgctaggaaatccacagatcaccctactggatgagccgtccactgggatggatccgaaggctaagcagcatatgtggcgcgccatccggaccgctttcaagaacagaaagcgggcggctatcctgactactcactacatggaagaggcggaagccgtttgtgaccgcgtggccattatggtgtccgggcaattacgttgtataggaacagtccaacatctgaagtccaaatttgggaaaggctattttctggaaatcaaactgaaagactggatcgagaatctggaggtcgacaggctgcaaagggagatccaatacatctttcctaacgcatctagacaggaaagcttttcttccattctagcatacaaaattccgaaagaggatgttcagtctctgtctcaaagctttttcaagttggaggaggcgaagcacgcgttcgctattgaggagtacagtttttcccaggccacccttgaacaggtgtttgtagagctgacgaaggagcaggaggaggaagataactcatgcggcacgctgaactcaaccctgtggtgggaaaggacccaggaggaccgagttgtcttttag

SEQ ID NO: 109167 - DNA, 4854 bp, Artificial Sequence
  Description of Artificial Sequence: Synthetic coding sequence
atgaatatgaaacaaaagagtgtataccaacagacaaaagcgctgctttgcaagaactttttaaaaaaatggagaatgaagagagagagcctgttggagtggggattatccatcctgcttggtctttgcatcgctctgtttagctcctccatgcggaacgtacagttcccagggatggcgccacaaaatctggggagggttgacaaatttaattcttcatcgctgatggtcgtttatacacccatctctaacctcactcagcagatcatgaacaaaaccgctctggcacccttgctgaagggtacgtctgttataggcgctcccaacaagacccatatggacgagatccttctggagaatctcccgtatgccatgggaattatcttcaacgagaccttcagctataagctgattttcttccagggatacaattctcctctgtggaaggaagacttcagcgcacattgctgggatggttacggggaattttcttgcacactgacaaaatactggaatagggggttcgtggcgctacagactgctataaacaccgcaatcatcgagataacgaccaatcaccccgttatggaggagctcatgtccgtaacggccatcactatgaaaacgctgccttttatcaccaaaaatctgttacacaacgaaatgttcatcctgttttttctgcttcacttttcgcccctggtatattttattagccttaacgtgaccaaagaacggaaaaagtctaagaaccttatgaagatgatgggccttcaggacagcgcattttggctgagctgggggcttatctacgccggattcatcttcattataagtatctttgtcacgatcatcattacctttacccaaattattgtaatgacagggttcatggttatatttatcttgttcttcctctatggcttatccctagtggctctagtgttcttgatgtcagtcttactgaagaaagctgtccttaccaatctcgtggtctttctactgacactgttttgggggtgcctggggtttacggtgttttacgagcagttgccatcttccctagaatggatcctcaacatctgttctccctttgccttcactactggcatgatccaaattataaagctcgactataatctcaatggggtgattttccccgacccgtcaggagactcttacaccatgattgcgacattcagcatgctcctgctggatgggctgatctatctgctgctcgcgctctactttgacaagatccttccatacggggacgaacgacactattcgcctctgttctttctgaacagctcctcgtgcttccaacaccaaaggacaaacgcaaaggtgatcgagaaagaaattgatgctgagcacccctccgacgattactttgaaccagtggccccagagttccagggcaaggaagctatcaggattagaaacgtgaaaaaagaatacaagggaaagtccggtaaggtggaggctctaaagggactgttatttgatatatacgagggccagattactgccatcttgggccactccggtgctggcaaatcttccctcctgaacattctcaacggcctctctgtgcctaccgagggtagcgttaccatatacaacaaaaacctcagcgagatgcaagaccttgaagaaatccgcaagatcaccggagtttgtccccaattcaacgtccagtttgacatattgacagttaaagagaacctgagcttgtttgccaagataaaaggcatccacctgaaggaggttgagcaggaagtccagaggatattgctggagctagacatgcaaaatatacaggacaatctagccaaacacctgtccgagggccaaaaacggaaactaacattcggtatcaccatcctgggcgatccccagatcctccttctcgatgaaccaactacaggcctggaccccttttcacgtgatcaggtctggtctttgttgagggagaggcgtgcggaccatgtaattttattttcaacccagagcatggacgaagctgacattttagccgacagaaaggtcataatgtccaacggcagacttaagtgtgctggatcttccatgttcctaaagaggaggtggggccttgggtatcacctgtcccttcaccggaatgagatttgcaatcccgaacagatcacttccttcatcacacaccatatccccgatgccaagctgaagaccgagaacaaggagaagctggtgtacacactgcccctcgagcgcacaaacaccttcccggatttattctcggatcttgacaagtgtagtgaccagggagttacaggttacgacatcagtatgagtactctaaacgaggtgttcatgaagctcgagggccagtctactatcgaacaggattttgagcaagtcgagatgataagggattccgaatccctcaacgaaatggagctggctcactccagcttctccgaaatgcaaactgcggtttcagatatggggctgtggagaatgcaggtctttgcaatggcccgcctgcgattcttgaaattgaagcgccagacgaaagtcctgttgacactgctccttgtgttcggcattgccatcttccctctcatagttgagaacattatgtacgctatgctgaacgagaaaatagactgggaatttaaaaatgaactatactttctgagtcccggacagttaccccaggagccacgtaccagcctgctgattatcaacaacactgagtccaacatcgaggatttcatcaaaagtctgaaacaccaaaatattctgcttgaggtcgatgactttgagaatcggaacgggaccgacggattatcctataacggggcaattattgtgtccggcaaacagaaagattatcgattcagtgtggtctgtaatacgaaacgtcttcactgctttcctatcctgatgaacattatttctaacgggcttctgcagatgtttaaccacacacagcacataagaattgagtcatcaccctttcctctgagtcatattggtctgtggacaggtcttcctgacggttcttttttcttgtttctggtcttgtgcagtattagtccctacattaccatgggaagtattagtgactataagaaaaatgcgaagtctcagctgtggattagtgggttatacacctcagcttactggtgcggtcaggccctggtcgatgttagcttttttattcttatcctgctactaatgtacctcatcttttacatcgaaaacatgcagtatcttcttattacatcccaaattgtgtttgctctcgtaatagtgacacccggctacgccgccagcttggttttttttatctacatgattagctttatcttcaggaagagaaggaaaaactctggcctctggtccttctattttttctttgcctctactatcatgttctcaataactctgatcaatcattttgatctttcaatattgatcacgaccatggtgctggttccctcatacaccctcctgggcttcaagacgtttctggaagttcgcgatcaggagcactaccgcgagttccccgaagccaatttcgagctaagtgcaaccgattttctggtatgtttcatcccctacttccaaacactgttgtttgtctttgtgctgcggtgtatggaactaaaatgcgggaaaaaacgtatgaggaaggacccagtgtttagaatctctccacagtcaagagatgccaagcctaacccggaggaaccaattgacgaagacgaggacatccagacggagaggattagaacagccactgccctgactaccagcatcctggatgaaaagcccgtcataatcgcctcatgcctgcacaaggagtacgctgggcagaaaaaatcctgcttctcaaagaggaaaaaaaaaatcgccgcccgaaacatatcattctgcgtacaagaaggagaaattcttgggctgctgggtccgaacggagctggtaaatcctcttctatccgtatgatatctggcattactaaaccaaccgccggagaggttgaattaaaggggtgcagcagcgttcttgggcacctagggtactgcccccaggagaatgtgctgtggcccatgttgaccctgagggaacatctggaggtctatgcagcagtgaaaggactgcggaaggcggacgccaggctcgctatagctcgactggtcagcgcctttaaattacacgaacagctgaacgtgccagtgcagaagctgaccgccggaattacacggaaactctgttttgttttgagtctgctgggcaattccccagttttgttattagatgagccaagcacagggatagaccccacaggccaacaacagatgtggcaagcaattcaggccgtcgtgaaaaacaccgagaggggagttctgttgacaacacataatttggctgaggctgaggcactctgcgatcgcgttgcaatcatggtatctggcagactaagatgtatcggcagcatccagcacttaaaaaataagcttgggaaggattacatcctcgaattgaaggtcaaggagacaagtcaggtcacgctagtgcatacagagattcttaagttatttcctcaggccgccggtcaggagcggtactccagccttctgacatataagcttccagtggctgatgtttacccactcagtcaaacatttcacaaactcgaggctgtcaagcacaatttcaatctggaagagtactccctgagccagtgtaccttggagaaagtttttcttgagttatctaaggaacaggaggtgggaaacttcgacgaggagatagacactaccatgcggtggaagcttctgcctcacagcgatgaaccgtag

SEQ ID NO: 109168 - DNA, 1434 bp, Artificial Sequence
  Description of Artificial Sequence: Synthetic coding sequence
atgttttctattaccttgatcaaccactttgacttgagcatcctcatcacaacaatggtgctggtgcctagctatacgcttctcggcttcaagacattcctcgaggttagggaccaggagcactatcgcgaattcccagaggccaattttgagcttagtgccacagatttcttagtctgtttcattccatacttccagacacttctctttgtgttcgtgcttcgctgtatggaacttaaatgcggtaaaaaaagaatgcgaaaggaccctgtgtttagaatctctccccagtccagagacgccaaacctaatcctgaagaaccaatcgatgaggacgaggatatccaaactgagagaatacgaacagctacagcactcacgaccagtattctggatgagaagcctgtcatcattgccagctgtctccacaaggaatatgcggggcagaagaagagctgcttctccaaacggaagaagaagattgctgcaagaaatatttccttttgcgtacaggaaggagagatactagggctgctgggccccaacggcgcaggcaaaagtagctctatacggatgatctcgggcattacaaaaccgaccgccggtgaagtcgaactgaaaggttgtagttccgttctagggcatctggggtactgtcctcaagagaacgtgctgtggcctatgcttacattgcgggagcatttggaggtttacgcagcagtgaaggggctaagaaaggccgacgctaggttagccattgctcgcctggtgtctgcctttaagcttcatgagcagcttaatgtccctgtacagaagctgacggccggcattactcggaagctctgctttgttctgtccctactggggaacagccccgtactgcttctggacgaaccctctactggaatcgacccaacagggcaacaacaaatgtggcaggccatccaagctgtggtgaagaacaccgagcggggcgttctactcaccacccataacttggccgaagcggaggccctgtgcgacagggtggccatcatggtgtccggcagattgcgctgtatcggctctattcagcacctgaaaaacaaacttggaaaagactacattctggagttgaaagtgaaggaaaccagccaggttactcttgtgcatactgagatactcaaattatttcctcaggcagctgggcaggagcgatattcatcccttttgacttacaagcttccagtagccgatgtttacccgctgtcccagacctttcacaagctagaagccgttaaacacaatttcaacttggaagagtacagtttatcacagtgtacactcgagaaggtgttcttagagctgagcaaggaacaggaggtaggtaacttcgacgaggaaatcgacacaactatgcgctggaaactcttgccgcatagcgacgaaccatag

SEQ ID NO: 109169 - DNA, 6441 bp, Artificial Sequence
  Description of Artificial Sequence: Synthetic coding sequence
atggccttttggacccagctgatgttactgctgtggaaaaactttatgtaccgtcgcagacagccggtccaactgctggtggaattactgtggcccctctttctgttttttatcttggtcgccgtccggcactcccaccccccactggagcaccatgaatgccacttccccaacaagcctctgccaagcgccggaacggtgccttggctacaggggctgatatgtaacgttaacaacacgtgtttccctcagctcacaccaggggaagagccaggtagattgagtaattttaatgacagtctggtctcacgtctcctagctgacgccagaacggtcctgggtggtgcttccgcacataggaccctggcgggcttgggtaagctcatagccaccttacgggccgccaggtccaccgcccagccacagccgaccaagcagtcaccactggagcccccaatgctcgacgtggctgagctgctcacatccctcctgagaaccgaaagtctcggcctagccctgggacaggcccaggaacccctacacagcctcctggaagctgccgaggacctcgcccaagaattgctggctttaaggagtctcgtagaactcagggctctgcttcaacggcctaggggcacgtccggacctctggagttgctctcagaagcactttgcagcgttagagggccatcatcaaccgtgggcccctcgctgaactggtacgaggcttctgatctgatggaactggttggacaggagcctgagagcgccctcccagacagcagtctgtcacccgcgtgcagcgagttgataggtgccttggattcacatccactttccagactgctatggcggagactcaaacctctgattctcggtaagctccttttcgcacctgatacaccgtttacacggaagctcatggcccaggtcaaccgaactttcgaggagctgacactgctcagggacgtgcgtgaggtgtgggaaatgcttggccctaggatctttaccttcatgaatgacagctccaatgtggctatgttgcaacgccttctgcagatgcaagatgaaggcagacggcagccccgccccgggggccgagaccacatggaggcgcttagaagttttttggaccctggctccggaggatacagttggcaggatgcccatgctgatgtggggcatctggtgggcacgctcggccgagttaccgagtgcctatccctggacaaactggaggccgctccctcggaggcagcccttgtgtccagggccctacaactcctggccgaacaccggttctgggccggagttgtgttcctggggcctgaggacagttctgacccgactgaacacccgacccccgatctgggtccgggacatgtgcgaataaagatacggatggacatcgacgtggtgacaagaactaacaagatccgggaccgattctgggaccctggtccggctgccgacccgctcaccgacctccgctacgtctggggcgggttcgtttatctgcaggacttagtcgaacgtgctgctgtgagggttttgagcggcgctaatcctagggccggcttatacctgcaacagatgccatacccatgctacgtggatgatgtgtttttaagggtgttgtcgagaagtttgccattgttccttacactcgcctggatttacagtgttacactgactgtgaaggccgtggtgcgggagaaggaaaccagactgcgggataccatgcgcgcaatgggtctcagcagagcggtgttgtggttgggatggttcttgagctgtctggggccattcctcctgtctgctgcccttcttgtcctggtgctgaagctgggcgatattctgccatatagtcaccccggcgttgtcttcctgttcctagccgcttttgcagtggctactgtgacacagagctttctgctgtctgcctttttttcaagagccaacttagccgcagcgtgtgggggactggcctatttttccctatacctgccctacgttttgtgcgtggcctggcgagacagactaccagctggcggccgggtggcggcatcactcctctctcccgtggcattcggcttcggctgtgaatccctggcactgttagaggaacaaggcgaaggtgcacagtggcacaacgttggaacacgaccgactgccgatgttttctccttggcgcaagtgtctggcctccttttgctcgatgctgcattgtacgggctggcgacctggtacctggaggcggtttgtcccggacagtatggaatccctgagccctggaacttcccctttcgccgctcctattggtgcgggccacgtcccccgaagtcgccagccccttgccctacccccctggatcctaaagtgcttgtggaagaggcaccaccaggcctaagcccaggagtttcagtgcgtagtctcgagaagaggttccctgggtcaccccaaccagccctacgcggtctctcactcgacttttatcagggacacatcactgccttcttgggtcacaacggagccggtaagaccactacgttgagcattttgagtggactcttccctcccagtggaggaagtgcctttattctgggacacgacgtgagaagtagcatggcagccattcgcccgcacctgggagtatgcccacaatataacgtccttttcgacatgcttacagtagatgagcacgtgtggttctatgggcggttaaagggtctgagtgctgcagtggtgggaccggaacaggaccggctcctgcaggatgtaggcctcgtctccaagcaatctgttcagacacgccatctttctggtggcatgcagcggaagttaagcgtggcaatcgcatttgtcgggggctcacaggtggttattctggatgagcccaccgccggtgtcgacccggcatcccggagaggtatttgggagctgctcctcaaatacagggaaggacgaacacttatcctgtcaacacatcacctggacgaagccgagttgcttggcgaccgcgttgccgttgtggctggcggacgcctgtgctgttgcggatcaccgctcttccttcggcggcacctcggaagcgggtactacctcaccctggtcaaggcacggcttccattgacaacaaacgagaaagccgacaccgatatggaaggctcggtggacaccagacaggagaaaaagaacggctctcagggctcccgggtgggaacccctcaactgctggcactcgttcagcactgggtccccggggcacggctggtagaggagctaccccacgagctggtcctggtcttaccctatacaggcgcccacgacggttcatttgctacactgttcagggagctggatacgcggctggccgagctccggctgaccggctacggaatcagtgacacctccctggaagagatatttctgaaagtcgtggaagaatgtgctgcggatacggacatggaggacggcagttgcgggcaacacctgtgcaccgggatcgctggccttgacgtaacactcagactgaagatgcccccccaggaaacagcccttgagaatggcgagccggctggatctgcacccgagaccgatcagggcagcggtcccgatgccgtgggacgcgttcagggttgggccctaaccaggcagcagctccaggcattactgcttaagaggtttttgttggcccggagatctcggcgagggctcttcgctcagattgtgcttccagcccttttcgtcggcctcgccctggttttcagcctgatagtccccccctttggccactaccccgccctgcgactgtcccctacaatgtatggcgcacaggtgagcttcttcagtgaagatgccccgggggatcccgggagggcccggttgctagaagcactccttcaggaagctggtttagaggagcccccagtccagcattcatctcatcggttctccgcacccgaggttcccgcagaagtggccaaggtgctggcctctggaaactggactcccgaaagtccttcacctgcctgccagtgtagcagaccaggcgctagacgcctgctgccagattgtcctgcagctgcaggagggccccctcctccgcaggctgtcaccgggtccggtgaagtggtgcagaatttaacaggtagaaacctttccgatttcctggtcaagacttatcctaggctggtgcggcaaggcctgaaaacgaagaagtgggtcaacgaggttcggtacggcgggttctctttaggcggacgcgacccaggccttcccagtggacaggagctgggacgtagcgttgaagaactgtgggcattgttaagtcctctgccaggaggcgcactggaccgtgtcttgaagaacctaacagcttgggcccacagccttgacgcacaggattcgttgaaaatttggttcaataacaagggatggcacagcatggtcgcctttgttaaccgcgcatcaaacgctatcctgcgtgcccatcttcctcccggacctgctagacacgcacactctattaccacattaaatcatccactgaatcttacaaaggagcagcttagcgaaggcgctctcatggcgtcgagcgtcgatgtgctggtgagtatttgtgtggtgttcgcaatgagcttcgttccggcgtccttcacccttgtgctgatcgaggaaagagttacccgagccaagcatctgcagctgatgggcggactgagtccaactctgtactggctgggcaactttctttgggatatgtgcaattacttggtgccagcttgtattgtggtgctcattttcttggcgttccagcagagggcttatgtcgctcctgccaatctgccggcactgcttctgcttctgctactgtatggctggtctataacacccctgatgtaccccgcttcttttttcttctctgtgcctagcacagcgtacgtagtgttgacctgcatcaacctgttcattggcatcaacggctcaatggcaacgtttgtcctagaacttttcagtgaccaaaaactgcaggaggtctctcggatcttgaaacaggtgtttttaattttcccccacttctgtctgggacgagggctgatcgacatggtgaggaatcaagccatggccgacgccttcgagaggctcggtgatcggcagttccagtctcctcttcgatgggaggtggttggcaagaacctgcttgcaatggtgatacagggcccactcttcctgttgtttaccctgctgctccagcataggtcccagctgttaccgcagcctcgggtcagaagtctgccccttctgggggaggaggatgaggatgtcgctcgcgaacgtgaacgcgttgtgcaaggggccacacagggcgacgtactagtacttcgaaatcttaccaaagtgtacagaggtcagcggatgcccgccgtggaccgcctgtgccttggaatccccccaggtgagtgctttggcttacttggcgtgaacggcgctggaaagacatccaccttccgcatggtgaccggtgacaccttggcctctagaggtgaagccgtcctggcgggccactccgtggctagggagccttctgccgctcacctgtctatgggatactgcccacaaagcgatgctatcttcgagctgctgactggccgcgagcacctcgagcttctggcccggttgcgtggggtgcctgaggcgcaagttgcccagacggctggcagcggactggcccggctcggcctgagttggtacgccgatcgccctgccggtacctactcaggtggtaataagcgcaagctggccacggccctcgcactagtcggggacccagccgtggtttttttagatgaaccaaccactggcatggacccttccgcacggcgattcttgtggaattcactcctcgcggttgtccgggaaggcaggtctgtgatgctgaccagccatagcatggaggagtgcgaagccctctgctcccgcctagcaattatggttaatggaaggtttcgatgtttgggcagcccacagcacttaaagggtaggtttgctgccggccacaccctgactttgagggtacccgcagctcgtagccagcccgccgctgccttcgtggcagctgaatttcctggagccgaacttcgcgaggcacatgggggccgcttgagattccagttacctccagggggacgctgtgctctagccagagtattcggcgaactggcagtgcacggagctgaacacggagttgaggactttagtgtgagccaaaccatgctggaggaggtgttcctgtactttagcaaggatcagggcaaggatgaagacacggaggagcaaaaggaggcgggagtgggcgttgaccccgctcccggccttcaacatcccaaacgcgtgtctcagtttctcgacgacccatctacggcagaaacagtcctctag

SEQ ID NO: 109170 - DNA, 6441 bp, Artificial Sequence
  Description of Artificial Sequence: Synthetic coding sequence
atggccttttggactcagctgatgctcctgctgtggaaaaattttatgtatcgaaggaggcagccggtgcagctgctggtggaactgttatggcccctcttcctttttttcattctcgtggccgttagacatagccacccccctctcgaacatcatgaatgccactttccaaacaaacccctacctagtgctggcacggtgccctggctgcagggccttatctgtaatgtaaataatacatgtttccctcaactcacacctggagaagagccagggcgactgagtaacttcaacgattccttggtaagcaggctgctcgccgacgcccggaccgtcttaggcggggcctccgcccataggacactggctggcctgggcaaactaatcgcgacattaagagccgcaagatcaacagctcagccccagcctaccaaacagtcacccctcgaaccccccatgttggacgtggctgagctgctgacaagtcttttgagaaccgaaagcctagggttggccttaggccaggcacaggaacctttacacagccttctggaagccgctgaggatcttgcacaggaactgctcgctcttaggtccctggtggaactccgggctttactgcagcgcccgagaggcaccagcgggcctctggaactgctgtctgaggctctctgctcagtgcgcggccctagctcgacagtggggccaagcctaaattggtacgaagcgtctgatctgatggaattggttgggcaggagcccgagagcgctctccccgacagcagcttgtccccagcctgcagtgaactgatcggggcacttgactcacacccacttagtcgacttttatggcgtagactgaaacccctgatcttgggcaaactactgtttgcccccgatactccattcactagaaagctgatggcccaggtgaaccggacatttgaagagctcaccctattgagggacgtgagagaggtgtgggaaatgctgggaccgcggatctttaccttcatgaacgattcctcgaacgtggcgatgctccaacgcctcttacagatgcaggatgaagggcggcggcagccccgccctgggggccgcgatcatatggaagccctgaggtcctttctcgaccctggtagcggaggatactcctggcaagatgcgcatgctgacgtcgggcatctcgtcggaacactgggcagggtgacggaatgcctgtccctggataagctagaggccgccccttccgaggctgctttggttagcagggctctgcagctcctggcagagcatcgtttctgggccggagtggtttttctcgggcctgaggactccagcgaccccaccgagcaccctacacctgacttaggccccggccacgtccggattaaaatacggatggacattgatgttgtgacacggactaataagatccgagaccgtttctgggatcctggaccagccgcagacccactgaccgacctgcgatatgtctggggggggttcgtgtatctgcaggacctggtcgaaagggctgcagtgagagtcctgtccggcgcaaatcctagggccggactgtatcttcaacaaatgccatacccatgttacgtggatgacgtcttcctccgggtcctctcccggagcctccctctcttcctcacgcttgcctggatttatagcgtaaccttgaccgtgaaagcagtggtgcgggagaaggagaccagattacgggacaccatgagggcaatgggactttcgcgagccgtgctgtggctggggtggttccttagctgtctgggcccatttctgctgtctgccgctctgctggttctggtcctgaaactcggagacatcctgccatacagccacccgggcgttgtgtttttattcttggcagcctttgctgttgccacagtgacccagtcctttctgttgtcagctttcttcagtagagcaaatctggccgcagcctgtgggggcctggcctacttttcgctctacctgccatacgtgctctgcgtggcctggcgcgacaggctgcctgccgggggcagggtggccgcttctttgctatcaccggtcgcattcgggtttgggtgtgaatctctggctctcttagaggaacaaggtgagggcgcccagtggcacaatgttggaacccgacccactgctgatgtcttttctctggcccaggtctctggcctcctactcctggatgctgctctatatggactggccacctggtatctcgaagcggtgtgtccgggccagtacgggatcccagagccttggaatttccctttccgccggagttattggtgcggacctcgtcctcccaagagtccagcaccatgccccaccccactcgaccctaaggtgcttgtggaggaggcacctcccggactgagcccaggagtcagtgtgaggtctctggaaaagaggtttcccggcagcccccaacctgccctcagaggtctcagcctggacttttaccagggccacatcaccgctttcctcgggcataatggggccggcaagactacaaccttatccatactgagtggactcttccccccgtcgggcggcagtgctttcattctcggacatgacgtgcggtcctccatggctgcaatcaggccccacctcggagtttgcccacagtacaacgttttgtttgatatgctcacggtcgacgagcatgtctggttctacggacgcctgaaaggcttatctgccgcagtcgttggtcctgagcaagatcggctgctgcaggacgttgggctggtatctaagcagagtgtgcagactagacatttatccggtggaatgcaaagaaagctgagcgtggccattgcatttgttggaggaagccaggtcgtaatcctggacgagccaacagcaggcgtggatcctgcatctcgacgagggatatgggagctactgttgaagtacagggagggcagaactcttatactgtctacccatcatctggatgaggccgaacttctgggggatcgcgttgcagtggtggccggagggcgcctgtgctgttgcgggtctcctctgtttctgcgaagacatctgggtagcgggtactacctgacgcttgtgaaggctcggctgccattgacgacaaacgagaaagcggatacggatatggaggggagcgtggatactagacaggagaagaaaaatgggtctcaagggtctcgtgtgggaacgccccagcttcttgccctggtgcaacattgggttcctggcgcccgtcttgtcgaggaattgccccacgagctggtcttggtgctgccctatacaggtgctcatgatggatctttcgccacattatttagggagttggatacacgactggcggagctccggcttaccggatatggtatttcagatacttccctggaggaaatttttttaaaagtggtggaggaatgcgctgccgataccgacatggaagatgggagttgcgggcagcatctgtgtactggcatagcaggccttgacgtcacgctccgattgaaaatgccaccacaggagactgccctggagaatggagaacccgctggctcggcccccgaaacggaccagggcagcggacctgacgccgtgggacgggtacaaggatgggcccttacgagacaacagctccaggcattgctcctgaaacggtttttgctagcgcggaggtccaggagagggctattcgcacagatcgtcctgccagcgcttttcgtggggcttgcccttgtgttttccctcatcgtgcctccattcggtcattaccctgccctgaggctttccccgacaatgtacggcgcccaggtgtcctttttcagcgaggacgcaccaggcgatcccggccgcgcccgactgttagaagcattgctgcaagaggccggcctcgaggaacctcctgtgcaacacagcagccatcgcttcagtgctcctgaggtcccagccgaagtggccaaagtgttagccagtggcaattggacgcccgaatctccatcacccgcatgccagtgctctcgccctggagcccggcggctcctgcctgattgccccgccgcagcaggggggccacctcctcctcaagcagtaaccggctctggcgaagtggttcagaacctgaccgggcgcaaccttagcgacttcttggttaaaacctacccacgactcgtgagacaggggctgaaaacgaagaagtgggtgaacgaagtgagatacggaggcttctctctgggggggcgggatccagggctgcccagtggccaggagttgggacgcagtgtagaagagctttgggcactgctctctccactaccggggggtgccctggaccgggtcctgaagaatctgaccgcctgggcccactctctggatgctcaggactctttaaagatatggttcaataataaaggctggcacagtatggttgcttttgtgaatagggcgtccaacgccatcctgcgcgcccaccttcccccaggccctgcgcgccacgcccatagcattaccacgctgaaccatccgctgaacttgactaaagaacagctttccgaaggcgccttgatggcctcttcagtggatgtactggtgagcatttgtgtggtgttcgctatgagcttcgtgcccgcaagcttcactctcgtattaattgaggaaagagtaactagggccaagcacctgcagcttatgggcggactgtccccaaccctttattggctaggaaattttctgtgggatatgtgtaattatctcgtgcctgcttgtattgtcgtgctgatcttcctggcgttccagcaacgtgcctacgttgcccccgccaatctgccagcactgctgttactgctacttttgtacggatggtctatcacgcctctgatgtaccccgccagctttttcttctctgtgccctcgactgcttatgtggtgctgacctgtatcaacctgtttatcgggataaacggatctatggctacattcgttttggaactcttctccgaccaaaaattacaagaggtttccaggattctcaagcaggtgtttctgattttcccgcacttctgcctgggccggggccttatcgacatggttcgaaatcaggcgatggccgacgctttcgagagactcggcgacagacagtttcagtcccctttacggtgggaggtagttggaaagaatctgctggctatggtaatacagggccccttattcctcctgttcactctgctgcttcagcacagatctcagcttctaccacagcctcgcgtccggtctttgcctttattgggggaggaagatgaggatgttgcccgcgaaagggagagggtagtacagggagccacccagggggatgttttagtgctaaggaacctgactaaagtttatagagggcaaagaatgcctgcagtcgaccggttatgtctggggatcccgcctggagaatgttttgggctgttgggcgtaaacggagcggggaagacatccacatttagaatggtcactggcgacaccctcgcttctcgcggagaagcagttctagcgggccactctgtggcaagagaaccgtctgctgcacatctgagcatggggtactgcccacagtcagatgccatctttgagctgcttacaggacgggaacacctggaactcctggctcgcctgcgaggcgtgcccgaggctcaggttgcccagactgctggaagcgggctggcaaggctgggcctgagctggtatgccgacagacctgccggaacctattccggggggaacaaaaggaagctggccacagctctggcacttgtgggcgacccggccgtggtctttttggacgaacccaccaccggcatggatccgtccgcccggcggtttctgtggaacagcttactggccgtggtaagggaagggaggagtgtcatgctcacttctcactcaatggaggaatgtgaggctctgtgcagcaggctagccataatggtcaacgggcggtttcggtgtctgggatctccacagcaccttaaaggtagattcgctgcaggacacacactgacccttagggtgccggctgccaggtcacaacccgcagctgctttcgttgcagccgaatttccaggagccgagctccgagaggcacatgggggccgactgcgcttccaacttcctccaggcgggaggtgcgcgctggccagggttttcggagaactggcagtgcacggagccgagcacggcgttgaggatttctctgtcagccagaccatgcttgaggaagtattcctgtatttcagcaaggatcaggggaaagatgaggatacagaggagcaaaaagaagcaggggtgggtgtagaccccgctcccggtctgcagcatcctaaacgggtcagccaatttcttgatgatccctccactgccgaaaccgtcctatag

SEQ ID NO: 109171 - DNA, 495 bp, Artificial Sequence
  Description of Artificial Sequence: Synthetic coding sequence
atggctttctggacccagctcatgctgctgttatggaaaaattttatgtatcgccgccggcagccggtgcagctgttagtggaactgctctggcctctttttctcttcttcatcttggtcgcagtgagacatagtcacccgcccctggagcaccatgagtgccacttccctaataaaccgttaccctcagccggaacagtgccctggttacagggcctcatttgcaatgtgaataatacgtgttttccgcagctgacccccggagaggagcccggccggttaagcaattttaacgatagcttagtgagtcggctgctagcagacgctcggaccgtcctgggcggtgcctccgctcaccgaacgctagctggcctgggaaagctcatagcaacgcttagagcggcacgcagtacagcacagccccagccgacgaaacagtctccacttgaaccacctatgctggacgttgcggaactgcttacatccctgctgtag

SEQ ID NO: 109172 - DNA, 4746 bp, Artificial Sequence
  Description of Artificial Sequence: Synthetic coding sequence
atgcgtaaacgtaaaatttcagtgtgccaacaaacatgggccctactctgtaagaattttctcaaaaagtggcgaatgaagcgggagagcttgatggagtggctgaatagcttgctgcttctgctctgcctctacatatatccacacagtcaccaggtgaatgatttttctagtcttcttaccatggatctcggcagggtggacaccttcaacgagtctcgattctccgtcgtctacacaccagttaccaacacaacgcagcaaatcatgaataaggtagcctctaccccttttctcgcgggcaaggaggttctgggcttaccagacgaagagtcaatcaaagaatttactgcgaattaccctgaagaaatcgtacgcgtgacttttaccaacacttactcataccacctcaaatttttattaggccacgggatgccagcaaaaaaggaacacaaggaccacacagcccattgctatgagaccaatgaggatgtctattgtgaagttagtgttttctggaaagaggggtttgttgccctccaggcagctatcaacgcagctatcattgaaatcacgactaaccactccgtaatggaagagctgatgtctgtcactggcaagaatatgaagatgcacagcttcattggtcaatcaggcgtcatcacagatctgtacctatttagttgcatcatttcctttagctcatttatttactatgcttccgtcaacgtcacaagggagcgcaagagaatgaaagcgttgatgaccatgatgggcctccgcgattctgccttttggttgagctggggtttgttgtacgctggctttatttttatcatggccctgttcctagcactcgtcatccgtagcacccaatttatcattctgtctggcttcatggtggtgttctcactgttcctactgtatggcttgagcttggtggcactggcgtttctcatgagcatactggtaaaaaagagctttctaaccgggctggtggtgtttctgttaaccgtattttgggggtgtttgggctttacctcactctatagacacctgcccgctagcctggaatggatcctgtctctgctctctcccttcgctttcatgcttggcatggcccaattactgcatctcgactatgacctaaattccaacgccttccctcacccttccgacggatccaacctcatcgtcgccacaaactttatgctggcattcgacacctgcttgtacttggcattggccatatatttcgagaagatcctgcctaatgaatacggtcaccggcgtccgccactgttcttcctgaagtcctcattctggtcccagacccagaagacagatcatgtagcactggaggacgagatggacgcagatccgagcttccatgactcgtttgagcaagcccccccagagtttcagggcaaagaagcgataagaatccggaatgtgaccaaggagtacaagggaaagcctgacaaaattgaggcccttaaggatctagtgttcgatatttacgagggacagatcaccgctattttaggccatagcggggccggtaagtccaccctcctcaatatactatctggactctctgttcccacaaagggaagcgtgacaatctataataacaagcttagtgagatggcggacctggaaaatctcagcaaactgacaggcgtttgtccacagtctaacgttcagttcgacttcctgacagttagggaaaatcttcggctgttcgccaaaatcaagggcatccttcctcaggaggtagacaaggagatatttcttttggatgaaccaaccgctgggctggatccattctccagacaccaggtgtggaacttgctgaaggaacggaaaaccgacagggtgatcctgttttccactcagttcatggacgaggcagacatcctggctgaccggaaagtttttctgtcccaaggtaagctcaagtgcgccgggtcttcactctttttaaagaaaaagtgggggatcggataccacctttcccttcaacttaacgaaatttgcgtggaagaaaacattacgtcgctggtgaagcagcacatccctgacgccaagctatcagcaaagagcgagggcaaacttatttacaccctccctcttgaaaggacaaacaagttcccagagctgtataaagacttggactcatatccggacctggggattgaaaattatggcgtgagcatgacgacactcaacgaggtgttcctgaaattagagggaaaatccacgatcaacgaaagcgacatcgcaattttgggggaagtgcaggccgagaaagccgatgacaccgagcggctggttgaaatggagcaggttctgtcgagcctgaacaaaatgagaaagacgataggaggtgtggctctgtggaggcagcagatctgtgcaatcgcgcgggtgaggcttctcaaactgaagcacgagcggaaggccctgcttgccctgcttttgatcctcatggcaggcttttgcccgctcctcgtggaatatacgatggtaaagatttaccagaacagttacacgtgggagctgtctccgcatctctacttcctggcacccggtcagcagccccacgaccccctgactcagttactgatcattaataagacaggcgccagcatcgatgacttcattcagagcgtggaacatcagaatatcgcactggaagtggatgcctttgggactcgcaatggaacggatgatccaagctacaatggggccatcacagtctgttgcaacgagaagaactacagttttagcctggcctgtaatgctaagcggctcaattgctttcccgtactgatggatatcgtgagcaacggtctgctcggcatggtgaaaccctccgtgcacattagaactgaacggtcgacattcctggaaaacggtcaagacaaccctatcgggtttctggcgtacatcatgttttggctggtgctaacctcttcctgccccccttatattgctatgagctcaatagacgactacaagaatcgggctcgctctcagctgcgcatcagtggtttgagtcccagcgcttattggtttggacaagctcttgtcgatgtatctctgtacttcttagtctttgtgttcatatatttgatgtcttacatctccaattttgaagatatgctgcttacgataatccacataatccagattccttgcgcagtgggctacagcttttctcttattttcatgacctacgtgatctctttcattttccggaaggggcgcaagaactcaggtatatggagtttctgtttctacgtggtgacagtattcagcgtggccgggttcgcgttctcaatttttgagagtgatatacccttcatcttcaccttcctgattccacctgccactatgataggctgcctcttcctgtcatcacatctcctgttctcaagcttattcagtgaggaaagaatggatgtccaaccgttcttagtgtttctgatcccctttctgcactttattatcttcctgttcactctgagatgtctggagtggaagttcggtaaaaagtcaatgagaaaggaccctttcttccgtatctctccgcggtcctctgatgtctgtcagaatccagaggagccggaaggagaggacgaagacgtacaaatggaacgggtccggacagccaatgcgctgaatagcaccaacttcgacgagaagcctgtgatcattgccagttgcctgaggaaggagtatgcaggcaaacgcaagggctgtttctccaagcggaagaataagattgcaacgcgcaatgtgagcttctgcgttagaaagggcgaagtgctgggactgctgggacataacggggccggaaaatcaactagcattaaagtgatcactggcgatactaagcctaccgccggccaggttctgctaaaagggagcggtggaggggacgcgttagagtttttgggctattgccctcaggaaaacgccctgtggccaaacctgaccgttcgacagcatcttgaagtgtacgcagccgtcaagggcctacgcaaaggcgatgctgaagtagctataacaaggctcgttgacgccctaaagttacaggaccaactgaaatcccccgtcaaaacattaagtgagggcatcaagcgaaaattgtgctttgtgttgtccatacttggtaacccttctgtagtgttgttggacgaacccagcaccggaatggaccccgaggggcagcagcagatgtggcaggccattagggccacattcaggaacacagaacggggcgctttgctgactacccactatatggctgaagccgaagcagtctgcgacagagttgcaattatggtatcaggccggctgaggtgtatcggcagtatccagcacttgaagagcaaattcgggaaagattatctcctggaaatgaaagtcaaaaacctggcacaagtcgaaccactgcatgcagagatccttcgcttgttccctcaggcggctcggcaggagagatacagctctttgatggtctacaagctgcctgtcgaagacgtgcagcccttagcgcaggccttctttaagttagagaaggtgaaacagtcatttgacctcgaggagtattccctgtctcaatctaccttggagcaggtcttcttggaactcagcaaagaacaggaactgggggatttcgaggaggacttcgaccccagcgtgaaatggaagttgctgcctcaggaggaaccttag

SEQ ID NO: 109173 - DNA, 801 bp, Artificial Sequence
  Description of Artificial Sequence: Synthetic coding sequence
atgaggaaaaggaagatcagtgtgtgtcaacagacatgggccctactatgcaagaactttcttaagaaatggcgtatgaaacgagagtccttgatggagtggttgaattccctgttactacttctatgtttgtacatctatccccactcacaccaggtgaacgacttcagcagtttactgaccatggatctcgggcgagtcgatacattcaatgagagcaggttttccgttgtgtatactcccgtgacaaataccactcagcagattatgaacaaggtcgcctctacccccttccttgcagggaaagaagtgctggggttgccagacgaagagtccattaaagagttcactgctaactacccagaagagatcgtgcgcgtcacattcaccaatacatacagttatcatctcaaatttcttctgggtcacggaatgcccgcaaagaaggagcataaggatcacacggcccactgctatgaaactaacgaagatgtgtactgtgaggtgtcagtattctggaaggaaggtttcgtggccttgcaggcagctatcaacgctgccattatcgagattactacaaatcactctgtcatggaggaattgatgagtgtgaccgggaagaacatgaaaatgcattctttcattgggcagagcggggtcataacggacctctacctcttctcatgtatcatcagcttcagcagctttatctattacgctagcgttaatgtgaccagggaacgcaagagaatgaaagcccttatgactatgatggggttaagggactccgctttctggtag

SEQ ID NO: 109174 - DNA, 4866 bp, Artificial Sequence
  Description of Artificial Sequence: Synthetic coding sequence
atgagaaagcgcaagatcagtgtgtgccagcaaacatgggctctcttatgcaagaactttctcaaaaaatggaggatgaaacgcgaaagtcttatggaatggctcaacagcctcctcctgttactgtgcctgtatatctaccctcattcacatcaggtcaatgacttctccagccttcttactatggacctggggagagtagatactttcaatgagtcgcggttttctgtggtttacactcccgttactaatactacacaacagatcatgaataaggtcgcctccactccgtttctggccgggaaggaagttctgggtttgccggacgaagaaagcattaaggagttcaccgcaaactacccagaagagatcgtccgggttacgtttactaatacatattcctatcaccttaaattcttgctcggtcatggcatgcccgctaaaaaagagcacaaggaccatacggcccactgctacgagaccaatgaggatgtgtattgtgaggtgtccgttttctggaaagaaggatttgtcgcacttcaggccgccatcaacgcggccatcattgagatcactacaaatcactccgtgatggaggagctaatgtcagtgacagggaaaaacatgaagatgcacagcttcattggtcagagcggcgtcatcaccgatttataccttttttcctgcatcatttcttttagcagttttatttactacgcctccgtaaacgtgaccagagaacgaaagagaatgaaggcacttatgactatgatgggattgagggatagtgctttctggctctcatggggtttgctctacgctggattcattttcatcatggccctcttcctggccctcgtgataaggagcacccagttcatcatcctttccggattcatggtggtgttttccttgttccttctgtacggcttgtcacttgtcgcattggcctttctcatgtccatcctagtgaagaagagctttcttactgggctggtggttttcttgttaactgtgttttggggctgcctagggtttacttctctctaccgtcaccttccagcaagcctggagtggattttgtcactgctttccccattcgctttcatgctgggaatggcgcagctacttcatttggactacgacctaaattcgaacgcgttccctcacccctcagacggctcaaacctcatcgtggccaccaactttatgcttgccttcgacacctgcctataccttgctctggccatttattttgaaaagatcctacccaatgaatacggtcatcgacggcctcctctgtttttcctcaaaagcagcttttggagccagacccagaagactgatcacgtcgctctggaagacgaaatggacgctgaccccagctttcacgattcttttgagcaagcacccccagaatttcagggcaaagaagcaatcaggatccgcaacgtcactaaggagtataagggaaagccagacaaaattgaagcactaaaggacttagttttcgatatatacgaagggcaaattacagctatcctgggccactccggtgcaggaaaatctaccctgctgaacattctgagtggtctgtcagtaccaactaaaggctctgtgaccatctacaataataagctgagcgagatggccgaccttgagaatcttagcaaactgaccggcgtgtgtccacagagcaacgtgcaatttgacttcttgactgtgcgagagaatctcagattgttcgccaaaattaagggtattctccctcaggaagtggacaaagagattcagcgggtgctgctagagctggaaatgaaaaatattcaggatgtgctggctcagaatctgagtggcggccagaagagaaagctgacttttggcatagccatcctgggtgatccgcagattttcttgctggacgagcccacagcagggctggatcccttctctcgccaccaggtctggaacctcttaaaagagaggaaaacagatcgggttatcctgttttcgacccaattcatggacgaggccgatatccttgccgataggaaggtgtttttatcccaggggaaactcaaatgtgccggctcctcactgttcctgaagaagaagtggggcatcgggtaccacctgtccctccagctgaatgaaatttgtgtagaagagaacatcacatcactggtgaagcaacatatccctgacgctaaattatctgcaaaatcagaggggaaactaatttacacattgccattagagaggactaacaagtttcctgagctttacaaagacctggactcctaccccgatcttggcatcgaaaactacggggtgtctatgacaacgctgaatgaggtctttctgaagttagaaggtaaaagcacaataaatgagtccgacatcgcgattcttggtgaggtccaggccgagaaggccgatgatactgagcgcctggtggagatggaacaggtattgtcctcgttgaacaagatgcggaagacaatcggcggtgtagccctttggcggcagcaaatctgcgctattgcaagagtccggctactgaagctgaagcacgaaagaaaggccttgctagcactgttgttaattctgatggccgggttttgccctcttctggtggaatacacaatggtgaagatctatcaaaacagttatacatgggagctgagcccgcatctgtactttctcgcccccggtcagcagccacatgatcctttgacccagctcctcatcatcaacaagactggagctagtatcgatgactttatccagtccgttgaacaccagaacattgccctagaggtcgacgcattcgggacaaggaacggcaccgacgatccctcatacaacggagctattacagtttgctgcaacgagaagaactatagtttcagccttgcctgtaatgcaaagcgcctgaattgctttcccgtcctgatggacatcgtttctaacgggctcctagggatggtaaagccaagcgtgcatatccgtaccgaacggagcacttttctggaaaacggtcaggataaccccatcggattcctggcctacattatgttttggcttgtgctcacatctagttgcccaccctatatcgccatgagcagtatcgacgattataaaaaccgggcacgcagccagttgcgaatcagtgggctgtcaccctctgcttactggttcggtcaggccctagtggacgtgtcactttacttcctggtgttcgtttttatttacctcatgtcatatatctcaaactttgaggacatgctactaaccatcatccacattatccagattccatgcgcggtcggctattctttttcccttatttttatgacatatgtgatcagtttcattttccgcaaaggtcggaagaattccggtatttggagcttctgcttctacgttgtgacggtgttctcagtggcaggttttgctttctccatattcgagtcagacattccattcatttttacttttctgatccctcccgccacaatgattgggtgtcttttcctgtcctcacacctgttattttcttccctcttcagcgaagaacgtatggacgttcagccctttctcgtgtttctcatccctttcctgcacttcataatcttccttttcacgctccggtgcctcgagtggaagtttggaaagaagtcaatgaggaaggatcctttttttcgaatttctccgagaagcagtgatgtatgtcagaatcctgaagagcccgagggcgaagacgaggatgtccagatggagagggtcagaacagccaatgccctcaacagcacgaactttgacgagaaaccagtcatcatcgcttcctgcctgcggaaagagtatgcgggcaagaggaaagggtgtttttccaaaagaaagaacaagatcgcaactcgcaacgtctccttttgcgtgaggaagggggaggtgctcggtctgctggggcacaacggcgcgggaaaaagtacgagcattaaggtgatcacaggagacacgaaacctacagccggacaagtcctgttaaagggaagcggcggtggtgacgctttggagtttttgggctactgccctcaggagaatgccctttggcctaacctgactgtgcggcagcatctggaagtttatgccgccgtgaagggacttcgcaaaggggacgctgaggttgcaattacccgcctggtggacgccctgaaattgcaagatcagttgaaatcgccagtgaagacactctccgaaggcatcaaacgcaagctctgtttcgttttaagcatacttggaaaccctagcgttgtattgttagatgagccaagtacaggcatggaccctgaagggcagcaacagatgtggcaagccatacgagccacatttcggaataccgaacgcggagccctcctgacaacccactatatggccgaggccgaagcagtgtgtgacagagtcgccatcatggtttcaggacggttgcgatgcatcggctcaatacagcacctcaaaagcaaattcggtaaagattaccttctggagatgaaagttaaaaacctggcacaagtggaacctttgcatgcagaaatactgcggctgttcccacaagcagcgcgtcaggaaaggtacagcagcctcatggtgtacaagctgcccgtggaggatgtgcaaccactggctcaggcctttttcaaactcgagaaagtgaaacaaagctttgatctggaagaatacagtctcagccagtcaacgttggaacaggttttcttggaactgtctaaggagcaggagctgggcgactttgaggaagacttcgacccttcagttaagtggaaactcctgccccaggaggagccctag

SEQ ID NO: 109175 - DNA, 3312 bp, Artificial Sequence
  Description of Artificial Sequence: Synthetic coding sequence
atggacctagggcgagtggacacttttaatgagtctcgcttcagtgtagtgtacacacctgttaccaacactacacagcagattatgaacaaggtggcttccactccattcctggccggcaaggaggtgctggggctccccgatgaagaatctattaaggagttcaccgcaaattatccagaggaaatcgtgcgcgttacctttactaatacgtatagctatcacttgaagttcctactggggcacggtatgcccgctaagaaggagcacaaagatcatacagcgcattgttatgagactaatgaagatgtgtattgtgaagtctcggtgttctggaaagaaggtttcgtcgccttgcaggccgcaatcaacgctgctatcattgagatcaccacaaaccactctgtgatggaggaattaatgtcagtcacagggaagaacatgaagatgcactcttttattggccaaagtggcgtgatcaccgacctgtacctcttctcgtgcatcatctcctttagctccttcatctactatgccagtgtgaacgtgactagagagcgaaagcgtatgaaagcattgatgacaatgatgggcctgagagacagcgccttttggctgagttggggcctgctgtatgcgggcttcatattcatcatggcgctcttcctggccctggttattcgaagcacccaattcattatcctaagcggcttcatggtggtgttctccctgtttctgctttacggtttgtccctcgtagcccttgcttttctgatgagcattctggtgaagaagagcttccttactggcctggtcgtattcctcctaacggtgttttggggatgcctgggattcaccagcctctacaggcatctccctgctagtctggagtggattctgagcctgttgtccccatttgctttcatgctcggaatggctcaactgctgcacctcgactatgaccttaattcaaatgcttttcctcacccgagcgacggatccaatctgatcgtagctacaaacttcatgctggcctttgatacttgcttgtatctggccctggctatatattttgaaaaaattctgccaaacgagtatggccacagacgaccacccctcttttttcttaagtctagcttctggtcgcaaacacagaaaaccgatcacgtcgccctcgaagatgagatggacgcagacccttcttttcacgattcattcgagcaagctcctccagagtttcagggcaaagaggccatcagaattcgcaacgtaaccaaggagtataaggggaagcccgacaaaattgaggctcttaaggacctggttttcgacatttacgaaggacagatcaccgccatccttgggcattctggtgccggtaagtccaccttgctgaacattctcagtggactgagcgtgcctaccaaaggaagtgttacaatctataacaacaaattgtccgaaatggctgatcttgagaacctgtctaagctgacaggtgtttgtccacaatcaaatgttcagttcgactttcttaccgtccgggaaaacctgcgcctcttcgcaaagatcaagggcatcttgccacaggaggttgataaagagatccagcgcgtgctcctcgagttggaaatgaagaacattcaggacgtactcgcccagaatctttccggcggccaaaaacgaaaattgacatttggaatcgccatcctgggagacccgcaaattttcttgcttgacgagcccactgccgggttagaccccttcagtcgccaccaggtctggaaccttctgaaagaaagaaagaccgatcgcgttatcctttttagcacacagtttatggatgaagctgatattcttgcggatcgaaaggtgttcctctcacaggggaagctgaaatgtgctggatcctcactctttcttaaaaagaagtggggcattggttatcatttgagtctgcagctgaacgagatctgcgtcgaagaaaacattacgagcttggtcaaacagcatattcccgacgccaaattatctgcaaagtctgaaggaaagctaatttatacactaccactggaacggacaaataaatttccagagctctacaaggatctagacagctatccagacctgggcatcgagaattatggcgttagcatgacaacacttaacgaggtgtttctgaaattggagggcaaaagcactatcaatgagtccgatatcgccattttgggtgaggtgcaggcggagaaggcagatgacaccgagagacttgttgaaatggagcaggttctgtctagcttaaataagatgcggaagaccattggaggcgtcgccttatggcggcagcaaatctgcgcaatagccagagtccggcttctcaagctgaagcacgaaagaaaagctcttctggcgttgctgctcattctcatggccgggttttgcccacttctggttgaatatacaatggtcaaaatttatcagaatagctacacgtgggagctctccccccatctctatttcctcgccccaggacagcaacctcatgatcctttaacacagctgctgatcatcaacaaaaccggcgcttccatagacgacttcatacaatcagtggagcaccagaatatcgcactggaggtggatgcgttcggcacaagaaatgggaccgacgatccttcttataacggcgctattactgtttgttgcaatgaaaaaaattatagctttagtctcgcttgcaatgccaaaaggctcaactgttttccggtcctcatggatattgtctccaacggtctgctcgggatggtgaagccatctgtgcacataaggaccgaacggtccaccttcctggaaaacggacaggacaaccctattggcttcctcgcttacatcatgttttggctggtccttacttctagctgccccccatacatcgctatgtcctccatcgatgactacaaaaacagagccagaagtcaactccggattagcgggttgagcccgtctgcctactggtttgggcaggcactcgtggacgtctctctatactttctggtattcgtgttcatctatttgatgtcctacataagcaacttcgaggacatgttactcaccattattcacataatccaaataccttgcgcagtgggttactcattctcattgattttcatgacatatgtgatttccttcatctttagaaaagggcgtaagaactcaggcatttggtccttctgcttttacgtggttagcatattcctggtggacgtgtattgtatttatttgatctataatagtgaactgatcctatag

SEQ ID NO: 109176 - DNA, 471 bp, Artificial Sequence
  Description of Artificial Sequence: Synthetic coding sequence
atgttgggtatggcccagctgctgcaccttgactacgatctgaacagcaatgcctttccccatccaagcgacggatcaaaccttatcgtcgcgactaactttatgctagccttcgacacttgtttgtacctggctcttgcaatttattttgaaaaaattctgcctaatgaatatgggcatagacgcccacctctgttcttcctcaaatctagcttctggtcccagacacagaaaaccgaccacgtggcgctggaagatgaaatggacgctgatccatccttccacgacagcttcgaacaagccccccccgagtttcagggaaaggaggctatcaggatcagaaatgttacaaaagaatataagggcaagccagataaaatcgaggctctcaaagatttggtctttgatatctatgaggggcaaatcaccgcaattctggttacagtggagcttgagtcacagcactgctag

SEQ ID NO: 109177 - DNA, 4875 bp, Artificial Sequence
  Description of Artificial Sequence: Synthetic coding sequence
atgtcgaagagacggatgagcgtggggcagcagacctgggccctgttatgcaagaattgcctgaagaaatggcgcatgaagaggcagacccttctggaatggttattctctttcctcctggtattattcctctacctgttttttagcaacctgcaccaggtgcatgacactccacagatgagcagcatggaccttggcagagttgacagctttaacgacactaactacgttatcgccttcgcacccgagtctaagacaacacaggagatcatgaacaaggtcgcttcagccccttttctgaaaggtcgcactatcatgggttggcctgacgaaaaatcaatggacgaactggatcttaactactctatcgacgccgtcagggtgatctttaccgacacattcagttaccatctcaagttcagctgggggcacaggattcccatgatgaaggagcaccgagaccactcagcgcactgccaggcagttaacgaaaaaatgaagtgtgaaggctcagagttctgggagaaaggattcgtggcgttccaggccgcaatcaatgcagccataatcgagatcgccactaatcacagtgttatggagcagctcatgtctgtgactggagttcatatgaagatcctgccctttgtcgcccagggcggagtcgctaccgacttcttcattttcttctgcattatttcattctctacattcatttactacgtctcagttaacgtgactcaagaacgacagtacatcactagcttaatgaccatgatgggtctccgggaaagcgccttctggctgagctggggactcatgtacgcaggatttatcctgatcatggccacactgatggctctgattgttaagtccgctcagatcgtcgtgttaaccggttttgtgatggtgttcacactgtttctactttatgggttgagcttaatcacacttgctttcctcatgagtgtgctcatcaagaaacccttcctgacaggcctggtggtgttcctcctaatcgttttctggggcatcttgggatttcccgcgttatatacacgattaccagccttccttgaatggacactctgtttgctgtcaccctttgctttcactgtgggtatggcccagctaattcacttagattatgatgtgaacagtaacgctcacctggatagtagccagaatccctatctgattatagctactctcttcatgctggtgttcgatacactgctatacctcgtcttgaccttgtatttcgataagattcttcccgccgaatatggccatcgctgttcccccctgtttttcctcaagtcttgcttttggttccagcatggccgcgctaatcacgttgtacttgagaacgagacagactccgaccctacccctaatgattgctttgagcctgtcagccctgaattttgcggtaaagaagcgattcgcatcaagaaccttaagaaagaatacgcggggaaatgtgaacgtgttgaggctctgaaaggtgtcgtcttcgatatttatgaaggacagattaccgctttactggggcactctggagccggcaagacaaccctgctcaacattttgtccggcctgagcgtgcctacctcagggtcagtgacggtgtacaaccatacactcagcagaatggctgacattgaaaatatttctaaattcacgggcttctgtccccagagcaacgtacaatttggcttccttactgtgaaggaaaatttgaggctgtttgcgaagattaagggcatcctccctcatgaggtggagaaagaagttcagcgcgtagttcaagaactcgaaatggaaaacattcaggacatcctggcccaaaatctgtccgggggacaaaatcggaaactcacattcggtattgctatccttggagacccacaggtgctgctattagacgaacccaccgcaggtcttgacccgcttagccgccatcgaatttggaatttactcaaggagggaaaatcagaccgcgtcatcctgttttcaacacagttcattgacgaagccgacatccttgccgataggaaagtcttcatcagcaatggcaaactcaagtgcgcaggcagctctctgttcctcaagaaaaagtggggtatcggataccatctgtcactgcatttaaacgagaggtgtgatcccgagagcatcaccagtcttgttaagcaacatatatccgacgcaaagcttacagcacagtcagaggagaagttagtttacattctacccctagaaagaaccaataagttcccggagctgtatcgagaccttgaccggtgcagtaaccagggaattgaagactacggagtgtctatcacaactctgaacgaagtctttctgaaactggagggtaagtcaacaatagacgagtctgatattggaatctgggggcagctgcagacagatggcgcaaaagacataggatctctagtcgaacttgagcaggtcctgagctcatttcacgagactcgcaagactatcagcggagtggccttgtggcgccagcaggtgtgcgctatcgcaaaggtgagatttctgaagctgaagaaggagcggaaatccctctggactattctcctccttttcgggataagcttcatcccccagctgcttgaacatctgttctacgagtcttaccagaagtcctacccctgggagctctcacctaatacatacttcctctcccccggccagcagcctcaggaccctttaacccatcttttggtgattaataaaacagggtctaccatcgataatttcttacattcactccggagacaaaatatcgctatcgaggttgatgctttcgggactaggaatggcaccgatgaccctagctataatggcgccatcattgtttctggggacgaaaaggatcacagattctcgatcgcttgtaataccaagcggctaaattgcttccctgtgctcctggatgtcatctctaacggcctgctgggtatttttaattctagtgagcacatccagacggatagatcaactttctttgaagagcacatggactacgaatatgggtatcgctccaacacgttcttctggatcccaatggccgccagctttacgccctatatagctatgtcatctatcggagactacaaaaaaaaggctcacagtcagttgaggatctctgggctctatccgtccgcctactggttcgggcaggcattggtcgatgtttcactatatttcctcatcctgttactgatgcaaattatggattatattttttccccagaggaaatcattttcatcatacagaatctactgattcagatattgtgttcgatcggttacgtgagttccttggttttcctgacctatgttattagttttatctttaggaacggcaggaaaaattccggcatctggtccttctttttcctgatcgtcgtaatcttttctatcgtggcgacagacctgaacgagtacgggtttctaggattgttcttcggtacgatgcttatccccccattcacgcttatcggatctctgtttattttctctgagatttctcccgactcaatggactacctcggtgcttcagaaagtgagatcgtatacttggccctgctgatcccctacctgcatttcttaatcttcctgtttattctccggtgcttggaaatgaattgcaggaagaagctcatgcggaaggacccggtgttccgcatcagccctagatcaaacgccattttcccaaaccccgaagagccagaaggagaggaagaggacatccagatggagaggatgcgaaccgtcaatgcaatggcagtgcgggacttcgacgagacacccgtgataatcgccagttgtcttagaaaggaatacgccggtaagaagaaaaactgtttttctaaacggaaaaagaagatcgctacacggaatgtttcattttgtgtcaaaaaaggggaagtgatcggactgctcggccataatggagcaggaaaaagcactacaatcaaaatgattactggggacactaaacctaccgctggacaggttatccttaagggctccggcggaggagagcctcttggttttttaggctattgccctcaggaaaacgcgctgtggccgaacctgacagtgcgtcaacaccttgaagtgtatgccgccgtcaagggactcaggaaaggagacgctatgatcgctattacccgattggtggatgcgctgaaattgcaggaccagctgaaggccccagttaagacactttcagaggggatcaagcgcaagctgtgtttcgtgctatccatcttgggtaacccctctgtggtactgctggatgagccgagcacaggtatggatccagaggggcagcagcagatgtggcaggtcatccgagccacctttcgtaataccgaaaggggcgcattactgactacgcattacatggctgaggcagaggccgtgtgtgatagagtggctattatggtgagcggccgtcttagatgcatagggagcattcagcatctgaaaagtaagttcggcaaagactacctcctagagatgaaactaaagaacctcgcgcagatggaaccactacacgcggaaatcctgagactgtttccacaggcagcacagcaggaacgattctcaagtctaatggtgtataaattaccagtggaggacgtccggcctctcagtcaggcctttttcaaactggaaattgttaaacagagcttcgacttagaggagtatagcctttcccagtcaactctggaacaggtgttcctggagctgtcaaaggagcaagaacttggcgatctggaggaggactttgatccatccgtgaagtggaagcttctgctgcaggaggagccgtag

SEQ ID NO: 109178 - DNA, 4308 bp, Artificial Sequence
  Description of Artificial Sequence: Synthetic coding sequence
atgagcaagagaaggatgtccgttggtcagcagacttgggcactgctctgtaaaaattgtctgaagaagtggcgcatgaaacggcagacacttctggagtggttgtttagcttcttactggtgctatttctgtacctattcttctctaacctgcaccaggttcatgacacaccccagatgtcctcaatggatcttggccgggtggactcgttcaacgacaccaactatgtaatcgcattcgctccagagtccaaaaccacacaggagatcatgaataaggttgcctcggcccccttcctgaaaggcaggaccatcatggggtggcctgatgaaaaaagcatggacgagttggatctgaactactccatcgatgcagtcagggtgatatttaccgataccttcagttaccacctgaagttttcgtgggggcaccgaatacctatgatgaaagagcatcgagaccactcagcccactgccaagcagtgaacgagaagatgaaatgtgaaggcagcgaattctgggagaaaggctttgtggcattccaggccgccatcaacgcagccataatcgagatagctacaaaccactctgtaatggagcagctcatgtctgtcacgggagttcacatgaagatccttccattcgtagcgcagggaggggtagccacagacttcttcatttttttctgcataataagcttctcaactttcatatattacgtgagtgtgaacgtgacacaagagcggcagtacattacgagcctgatgacaatgatggggctgcgggaaagcgctttctggctctcctggggacttatgtacgcgggttttatcctaattatggcaaccttaatggccctcatcgtgaagtccgcacaaattgtagtgctgacagggttcgtgatggtgttcacccttttcctgctgtacggacttagtctcatcactctggctttcctcatgagtgtcttaatcaagaagccttttttgaccgggctggttgtgtttcttctgattgttttttggggcattctgggatttcctgccctctatactcggctgcctgctttcctcgagtggacactctgtctcctgtctccattcgcattcactgtcggcatggcccaattaatccacctggattacgatgtcaattccaacgctcacctggattcgagccagaacccttatctcattatcgctaccctgttcatgttggtcttcgataccttgctgtatctggtgttgacgctctactttgacaagatcttgccagctgaatatggtcatagatgctcgccgttgtttttcctcaagagttgtttttggttccaacacggccgtgctaaccatgtggttttagaaaacgaaaccgactctgaccctactccgaatgactgtttcgaacccgtctccccagagttttgcgggaaagaggcgatccggattaaaaacctaaaaaaggagtatgctggcaaatgcgaacgggttgaagcgttgaagggtgtggtcttcgacatttacgaaggacagataacagccctcctcggacattcaggcgccggcaagactaccctgctgaacatactgtctgggcttagcgtgcccactagcggatctgtcacggtgtacaaccacacactgtctaggatggccgacattgaaaatatcagtaaatttaccggattctgcccccagagtaacgttcagttcggatttctgaccgttaaggagaatcttaggctgtttgcaaaaatcaaggggatcctgcctcatgaagttgagaaagaggttcaaagggtcgttcaggagctggagatggagaacatccaagacattctggcccagaatctctcgggtggacagaacaggaagctgaccttcggaattgccatcttgggtgatccccaggtgctcttgcttgatgaacctacggcaggacttgacccactctctaggcatagaatatggaatcttctcaaggaaggcaaaagcgatcgggtgatcctgtttagtacccagttcatcgatgaagctgacatcctggccgacaggaaagttttcattagcaatgggaagttaaagtgcgcaggctcttcgctgtttttgaagaagaagtggggcatcggatatcacctttccctccacctgaatgaacggtgcgatcccgaatccatcacctccctggtaaaacagcatatcagcgacgctaagctgaccgcccaatcagaagagaagctggtgtatatactgccgctagagaggacaaacaaattccctgagctatatagggacctcgataggtgcagtaaccagggcattgaagactacggtgtctccattaccactcttaacgaggtattcttgaagcttgaaggtaaatctacaatagatgagagtgatatcggaatctgggggcagctgcaaaccgatggtgccaaggacatcggttcactagtggagctggaacaggtgctatccagctttcacgagacgcggaagacaatcagtggtgtggccctgtggcggcagcaagtgtgcgctattgccaaagtgagatttctcaaactaaaaaaggagagaaaaagcctctggactattcttctcctgtttggcatatccttcatccctcaactgctagagcacctcttttatgagtcgtaccagaagtcatacccgtgggagctcagtcccaacacctacttcctcagtcctggacagcagccacaggaccctctcactcacctgttggttattaacaagacggggtctacaattgacaatttcctgcattcactccgaaggcaaaatattgcgatcgaggtcgacgcattcggcacacggaacggaaccgatgatcctagctataacggggctatcatcgtgtccggggacgagaaagaccaccggttcagtattgcttgtaatactaagaggttgaactgttttccagttcttctggacgtcatctctaatgggctactagggatcttcaatagcagcgaacacatacagaccgacagatccactttctttgaggaacatatggactacgaatatggttatcgatctaacaccttcttctggattcccatggccgcatcttttaccccctatattgccatgtcctctatcggagattataaaaagaaggcccactcccaactgagaatctccggactctatcctagtgcttattggttcggtcaggcgcttgttgatgtgtccttatattttcttattctgttattgatgcagatcatggactatatcttcagtccggaggaaattatattcatcatccagaaccttcttatccagatcctgtgtagtattggctacgtgagttcacttgtgttcctgacatacgtgatctcgtttatatttcgcaatggaagaaagaacagcggcatttggagcttcttctttctaatagtggtaattttcagcatcgtggccacagacttgaatgagtacggcttccttggcttgttcttcggaacaatgttgatccctccatttaccttaattggatcactgtttatttttagtgaaatatcacctgactccatggactatctgggcgccagcgagagtgagatcgtctacttggccttgcttatcccttacctgcactttttgatcttcctctttattctgcgttgcttggaaatgaactgtagaaagaagctcatgaggaaggacccagtttttcgcatctcaccacgctcaaacgccatcttccctaatcccgaagagcctgaaggagaggaggaggacatccaaatggaacgcatgcggactgttaatgctatggccgtgcgggacttcgatgaaacaccagtaataattgcaagctgtctgcggaaagaatacgccggcaagaagaaaaattgttttagcaaacggaaaaaaaagatcgccacaagaaatgtatccttttgcgtaaaaaaaggggaagttataggtctattgggccacaacggggccgggaaaagcaccacaatcaaaatgatcacgggggacacaaagccgaccgccggccaggtcattctcaagggctccggtggcggagaacctcttggatttctgggatactgtccccaggagaatgctctatggccgaatctcacagtccggcagcacctggaggtatatgccgcggtcaagggcctgcgtaaaggtgatgcaatgatcgccattacacgccttgtagacgctctaaagctgcaggatcaattgaaggcaccagtgaagaccttatccgaagggatcaaaagaaaagccggtgatagcggccatctgtag

SEQ ID NO: 109179 - DNA, 3423 bp, Artificial Sequence
  Description of Artificial Sequence: Synthetic coding sequence
atgagcgtcgggcagcaaacgtgggctctgctgtgtaagaactgcttaaagaaatggcgaatgaagcggcagaccttgctagaatggctctttagtttcctgctggtgcttttcctgtatctgttcttttctaacctccatcaagtccacgacaccccgcagatgagctctatggacctcgggcgggtagactctttcaacgataccaactacgtgatagcgttcgccccagagagtaaaactacccaggaaatcatgaataaggtagctagcgctccatttctcaaggggaggaccattatgggctggccagatgagaagtctatggatgaactcgatctgaactacagcatagacgccgtcagagtcatttttactgatacattcagttatcatctcaaattcagctggggtcaccgcatccccatgatgaaggagcacagggaccactcagctcactgccaggcagttaacgaaaaaatgaagtgcgaaggttccgaattctgggagaaaggcttcgtcgctttccaagccgctatcaatgcagctatcattgaaattgcgacaaaccattccgtaatggaacagcttatgagtgttacaggtgtacacatgaagatacttccatttgtagcgcaggggggagttgcgaccgacttttttatattcttttgtataatctccttctcaactttcatttactacgtgtccgtgaatgtgactcaggaacgtcagtacataacaagcctgatgactatgatgggtctcagggaatccgcattttggctgtcttgggggctcatgtacgctgggtttatcctcatcatggcaacacttatggctctgattgtgaaatctgcacagattgttgttctcaccggcttcgtgatggtcttcactctctttcttttgtacggactcagcctaattacactggcctttctgatgtctgtcttgataaaaaaacccttcctgactgggttagtggtattccttctcatcgtcttctggggaatcctgggatttcctgctctgtacactaggctccccgcttttctagaatggacgctgtgtctcctctctccttttgcttttactgtgggcatggctcagctgatccatctggattacgatgtcaatagcaacgcacacttggattcttcacagaatccatatttaatcatcgccacactcttcatgctcgtgtttgacaccttgctgtacttagtcttaacgctgtactttgacaaaatcttgcccgccgagtatgggcaccggtgttctcccttattcttcctgaagtcttgtttttggtttcagcatggccgggccaatcacgtggtgctggagaacgagacagatagtgacccgacacctaatgactgctttgagccagtctcgccagagttctgtggtaaggaggccatccgcataaagaaccttaaaaaggaatatgctggaaaatgcgagcgggtggaggctctcaagggcgtggtgttcgacatctatgagggccagataacagctcttttaggccacagcggcgccggcaagactaccctgctgaatattctcagcgggctgtccgtaccgacatcaggatcggtgactgtgtacaaccacacactgtccagaatggcggatattgaaaacattagcaaatttacagggttctgccctcagagtaacgtgcagtttgggttccttaccgttaaagaaaatctgagactgtttgctaaaattaagggcatcctgccgcatgaagtggagaaagaagtgcagcgagttgttcaggagctggagatggaaaacatccaggacatacttgcacagaatttaagcggaggccagaacaggaaactgacctttgggattgctatccttggcgacccacaggtactcctcctcgacgaaccaacagccgggctggatcctctcagtcgacaccgcatatggaacctactcaaagaggggaagagtgaccgcgttatcctcttttctacacagttcatagacgaagcggacatactggcagaccgcaaggtgttcatcagcaacggtaagctaaaatgcgccgggagttcactatttctgaagaagaagtggggcattggttatcatctgagtttgcatctgaacgaaaggtgtgatcccgagtccataacctctctggttaaacagcatattagcgatgccaagcttaccgctcagtcagaagaaaagttggtctacatacttcccctggagagaacaaacaaattccctgagctttaccgagatttggatagatgctccaatcagggtatcgaggattacggagtatccatcaccactctgaacgaagtcttcctaaagctcgaaggcaaatccacaatcgatgaaagtgatattggaatctgggggcaattgcagacagacggcgccaaagacatcggatcactcgtggaattagagcaggtgcttagttcctttcatgagactagaaagaccattagcggcgtggccctttggcgccagcaggtgtgcgctatagccaaggtgcgctttctgaagctcaaaaaggagcgcaagtcactgtggaccatccttctgctgttcggaatcagctttattcctcagctactggagcacctcttttatgaatcataccagaaatcatacccttgggaactgtcacccaacacttactttctgtccccgggacagcagcctcaggaccctcttacccatctcttagtgataaacaagacgggatctacaatcgataatttcttacattcactccggagacagaatatagcgatcgaagttgatgcatttggaactagaaacggtacagatgatcccagctataatggagctatcatcgtctctggtgatgagaaagatcaccgattctctatagcctgcaacacgaaaagactaaattgctttccggtcctgctggatgtaatttctaatgggctcttaggcatcttcaattcctctgaacacatccagaccgaccgcagcacattttttgaggagcacatggactacgaatacggctacaggtctaacaccttcttctggatcccaatggcagccagttttacgccctacattgctatgagctccatcggagattataagaaaaaggctcactcccagctgcgcatttcaggcctgtacccgagtgcctactggttcgggcaggcgctcgtcgacgtctcactctactttctgatccttctgttgatgcagattatggactacattttctcccccgaggaaattatttttataatccagaatctgctgattcaggtcgttatcttttcaattgttgctaccgacttaaatgaatatggattcctgggtctgttctggcatcacgtaaatacgagccttcacatcgattggttatctatacattttttttag

SEQ ID NO: 109180 - DNA, 2217 bp, Artificial Sequence
  Description of Artificial Sequence: Synthetic coding sequence
atgcggggaccccctgcttggcccctccgtcttctcgagcctccctcgccagctgagcccgggcggttgctgccagtcgcttgcgtgtgggcagcagcgagcagagtcccaggctcgctcagccctttcacagggctgagacctgcacgcctgtggggtgccggtccagctctcctgtggggcgtgggggccgccaggcgttggcgcagcggatgcaggggcggcggtccaggcgcctcccggggcgtgttaggcctggcccggctgttgggcttatgggccaggggccccgggtcttgccgatgcggcgctttcgcaggtcccggtgcgcctagattgccccgtgcaagattccctgggggtcccgcggctgcggcctgggcaggagacgaagcctggagaagaggcccggcagctccacccggggacaagggaaggctccgtcctgcggccgccggtctgccagaagccagaaagctcctaggtcttgcctaccccgagaggaggagactcgcagccgctgtcggttttctcaccatgtccagtgtcatcagcatgagtgctcctttctttttgggcaaaatcatcgacgtcatatatactaaccccacggttgactatagcgataacctgacaagactgtgcttgggtctgtctgccgtgtttctctgcggtgcggccgctaacgcgattcgagtgtaccttatgcaaacctctgggcagagaatcgttaataggctgagaactagtctgttctcctcgatactgcggcaggaagtcgcatttttcgacaaaaccaggactggtgaactcattaaccggctctcttccgataccgcgctcctgggcagatctgtaactgaaaatcttagtgacggcctccgggctggcgcacaggccagcgtcggcatttccatgatgttctttgtctctccaaacctggcgacctttgtgctgagtgtcgtcccccccgtgagcattatcgccgtgatatatgggcgatacttgcgcaagctgaccaaagtaacccaggattccctagcccaggctactcagctggcggaagaaaggattggcaacgtgagaacggtgagggccttcgggaaggagatgacagagatcgaaaagtacgcatcaaaggttgatcacgtgatgcagctcgccagaaaagaagccttcgcccgtgccggcttcttcggggccaccggtctgtccgggaatttgatcgtgctaagcgtactctataaaggcggcttgctgatgggcagcgctcatatgacagtaggcgagctgtcatccttcttgatgtacgcgttctgggtgggaatttccatcggcggcctcagtagtttctacagcgaactgatgaaagggctgggagcaggcgggaggctgtgggaactactcgagcgcgagcctaaactgccatttaatgaaggcgtcatattgaatgagaagtctttccagggggcgttggaatttaaaaacgttcatttcgcctatcctgctagaccagaagtgccaattttccaggacttttccctgtctatcccatctggatcagttaccgccctggtcggtccgagcggctccggaaagtccacagtgctttctctgcttctgaggctgtacgacccggcctcagggaccatcagtctggatggtcacgacatcagacaactgaacccagtatggctacgcagcaagatcggcactgtgagccaggagcccattctgttctcctgctccatcgccgagaatatcgcctacggagcagacgatccaagcagcgttaccgccgaggaaattcagagggttgccgaagtcgcgaacgctgttgcctttattcggaacttccctcaggggttcaataccgtggtcggggagaagggagtgctgttgagcggaggccagaagcagcgaatcgccatcgctcgcgccctgctgaaaaacccaaagatactgttactggatgaagccacctcagctctcgacgcggaaaacgagtacctcgtacaagaggcacttgatcgcctcatggacggacgaacggttctggtgatcgcccaccgcctgtcaaccatcaaaaacgccaacatggttgccgtgctggatcaagggaagatcacagagtacgggaaacatgaggagctgctctccaagccaaatgggatctataggaagcttatgaataagcaatccttcatctcagcttag

SEQ ID NO: 109181 - DNA, 2529 bp, Artificial Sequence
  Description of Artificial Sequence: Synthetic coding sequence
atggtcactgttggcaattattgcgaggctgaagggccagtgggccctgcttggatgcaggacggattatccccctgtttctttttcacactggtgccgtctaccaggatggccctgggcacgttagccctggtgctggccctgccttgcagaaggagggagcgccctgccggcgctgactctctgtcttggggcgccggtccccgcatctcaccctatgtgcttcagctactattggccactctgcaggcggcactgcctcttgcgggcctggcaggacgtgtgggcacagctcgcggggcgcccctgcctagttatttactactcgcttccgtgctggagtctctggccggggcctgcgggctgtggttacttgtagtggagagatcccaggcacggcaaaggctggccatgggaatctggattaagttccggcactccccagggctcctgctgctctggaccgtagccttcgccgcggaaaaccttgctctggtgtcgtggaatagtccccagtggtggtgggctcgcgctgatctcggtcagcaggttcagtttagcctttgggtcttaagatatgtcgtgagtggcggcctctttgtcctcggcctctgggctcctggattgcgcccccaaagttacacattacaggtgcatgaagaagatcaggacgtggagagaagccaggtccgatctgcagcacaacaatccacctggcgtgattttggcagaaaattgcggttgttgtccgggtatctgtggccccgaggctcccctgccctccaattggtggttctgatctgcttgggactcatgggactcgagcgtgccctcaatgtgttagtccccatcttttacagaaatattgtgaacctgctgaccgagaaggccccctggaattctcttgcctggaccgttacctcatatgtttttttgaaattcttgcaagggggcgggacagggtccacaggctttgtgagcaacctcaggacattcctgtggatccgggtccaacagttcacctcacgtcgcgtggaacttctgatcttctctcacctccacgagctttccctgcgatggcacctagggaggaggacaggcgaggtcttaaggatcgccgaccgcggaacgtcttcagtgactggcctgctgtcttacttggtgttcaatgtgattccgacactggcagacattattattggcattatatatttctccatgtttttcaacgcctggttcggcctgattgtcttcctgtgtatgtccctatacttaacactgactattgttgtcaccgagtggcggactaagttccgcagagcaatgaacacccaagaaaacgccacgcgggcgcgcgcagtggattctctactgaacttcgaaactgtcaaatactacaatgccgagagctacgaggtggaaaggtaccgtgaggctatcatcaagtaccagggtctggagtggaagagctcagctagtttagtcttgctcaatcagactcagaatttggtgatcggcctgggcctgcttgccgggtctcttctgtgtgcatatttcgtgactgagcagaagctgcaagtgggcgattatgtgcttttcggaacttacattatacagctctatatgcccttgaattggttcggcacatactaccgtatgattcagacaaacttcattgatatggagaacatgtttgatctcttgaaagaagaaactgaagtgaaggacctccccggtgcgggacccctgcgcttccagaaaggacggattgagtttgagaacgtgcattttagctatgctgacggacgagagaccctgcaggatgtgtccttcacagtgatgcctggacaaaccctcgcattggtgggcccctctggggcggggaagtcaactatcctccggctcctttttagattctatgatattagcagcggctgcatacggatcgatggacaagatatcagccaagtcacccaggctagcttgcgatctcacataggcgtggtaccacaggataccgtgctgttcaatgacactatcgctgacaacattcgatatggcagggtcacagcaggcaatgatgaggttgaagcggccgcgcaggccgcaggcattcacgacgccataatggcatttccagagggataccgaactcaggtgggagagcgcggactcaaactctctgggggggaaaaacagagagtggcaatcgcccgtacgatccttaaggctccagggatcattctgctggacgaagcgaccagtgccttagataccagtaatgaacgggccattcaggcttctttggccaaggtctgtgccaatcgcaccacaatcgtggtcgcacatcggctctctaccgtggtcaatgccgatcagattctggtgattaaagatgggtgcatcgtggaacgtggcagacatgaagctttgctgagtcggggcggagtctacgccgacatgtggcaattgcagcaggggcaagaagagaccagtgaggatacaaaaccgcagactatggaacgctag

SEQ ID NO: 109182 - DNA, 636 bp, Artificial Sequence
  Description of Artificial Sequence: Synthetic coding sequence
atggttacagtgggcaattactgtgaggcagagggacctgtcggccccgcctggatgcaggacggactttcgccttgctttttttttaccttggtgccctccacccgcatggccctgggtaccctcgcgctggtcctggctctgccctgtcggagacgggagagacctgccggtgccgatagcctctcctggggcgccgggccccgaatcagtccatacgctctccccgggggaccccattgtcaggccatctacttttggcccccctgttggagagtgtggcccgcaccggttgcctgcggctgcctgagctggtctggggctcggcacggatcggtgtggcagtgggcgtcgggctcctcatcagggaccgccctggtttcttgctccagtggtctgtggagactacagctgaggacatggccctggtgtttaggcaccgcccacagcggtgggggacaaggccaaacgtgggcttcccgattcagtctggcctgcggatgctgcggtatgtggtcccttgaagggtgtttgagctgggtttccggcccacttgattttgtgccgagcccaattcactgcagattcatgaagcgcacaaagatgtggaagggggcctcagaactcgcagactag

SEQ ID NO: 109183 - DNA, 2391 bp, Artificial Sequence
  Description of Artificial Sequence: Synthetic coding sequence
atggtgaccgtgggcaactattgtgaggccgagggccctgtcgggcccgcatggatgcaggacggactgagcccatgcttctttttcacactcgtgccttctaccagaatggcgctgggaacactcgccctggtcttagctctcccctgccgccgccgtgagagaccagccggggcagatagtctgagctggggcgccgggccaaggatcagtccctacgttttgcagctactgctggcaaccctccaggcagccctgcccctcgctggacttgctgggagagtgggcacagcacgtggggctcctcttccatcttacctcctcctagcaagtgtgctggagagcctcgccggcgcatgtggactgtggctgctagtggtcgaacgatctcaggcacgccagcggctcgctatggggatttggatcaagttcagacatagccccggtctccttctactctggacagttgccttcgcagctgagaatttggccctggtgtcatggaacagcccccagtggtggtgggcgcgcgccgatctcggacaacaggtgcgatccgccgcacaacagtctacttggagagacttcgggcgcaagctaaggctcctttccggttacctgtggcctaggggctcccccgccctccagctggtcgtgctgatctgcctgggtctgatggggctcgagagagccctcaacgtcttggtaccgatcttttacagaaatatcgtgaacctcctgacagagaaggccccttggaactctctggcctggacagttacttcttatgtgttcctgaaatttctgcagggcggcggtactggttctaccggatttgttagtaacctccgcacattcttgtggattcgggtacaacaattcacttcgcgccgggttgaactcttaattttctcacatctccacgagttatcgttgcggtggcatttgggcaggaggacaggcgaagttctacgtatcgccgaccgagggacatcaagcgtgaccggcctcctgagttacctagtgtttaacgtgatcccaacactcgccgacatcattatcggaatcatttactttagcatgttcttcaacgcttggtttggactgatagtgtttctttgtatgagtctatacctgacccttaccattgttgtgacagaatggcgcacaaagtttcgcagggcaatgaatacccaggagaatgctacccgggcccgcgcagttgactctctcttgaattttgagactgtaaagtactataacgccgaaagctacgaggtggagcggtatcgtgaggctattatcaaataccagggacttgaatggaaaagctccgcgagcctggtgctgctaaaccagactcagaacttggtcattgggcttggactcttagcaggtagtctcctttgcgcctactttgtcactgaacagaagctccaggtaggggactatgtgctgtttggcacttatatcatccaactgtacatgccattgaactggttcggcacctattaccgcatgatccagaccaacttcattgatatggagaacatgttcgatcttctgaaggaggagaccgaagtgaaagacctgccgggcgccggcccccttcggttccaaaaaggtagaattgaattcgagaacgtccacttctcttatgcggatggacgcgagaccttgcaggatgtaagtttcacagtgatgcctggtcagaccttggccttagtaggaccctccggtgcgggtaagagcacaattctcaggctattattccgattctatgatatttccagcggatgcatccgtatcgatgggcaggatataagtcaggttactcaggcatccctcagatcccatatcggggtcgtgccccaagacaccgtcttatttaatgacaccatcgccgataacattagatatggccgagtaacagccggaaacgatgaggtcgaggccgccgctcaagccgccggcatccacgacgccatcatggctttcccagaagggtatcggacccaagttggcgaacgaggcctgaaactttctggtggagagaagcaacgggtggctatcgcacgcacgattctgaaggcccccggaataatactgctggatgaggcaacttccgccttggacacgagcaatgaaagggctatccaggcatccctcgccaaagtctgtgcaaatagaacaactatcgttgtggcacaccggttaagcactgtggtaaacgcagatcagatcctcgtgataaaggacggctgtatagtggagcgtggaagacatgaggccctgctgtcaaggggtggagtttatgcggatatgtggcagctgcagcagggccaggaggagactagcgaggacacgaaaccgcagaccatggagagatag

SEQ ID NO: 109184 - DNA, 2262 bp, Artificial Sequence
  Description of Artificial Sequence: Synthetic coding sequence
atggcactgctggccatgcattcctggcggtgggccgccgccgcagctgctttcgaaaaacggaggcattccgcaatcctgattcgccccctcgtgtctgttagcggtagcggacctcaatggagaccacaccagctcggggccctgggtaccgcccgagcatatcagcagattcctgaatcattgaagtccatcacttggcaacggttagggaaaggcaactccggtcagttcctggacgccgctaaggctctgcaagtgtggcccctgatcgagaaacgcacctgctggcatggccacgccggcggcgggctgcacaccgatccaaaggaggggctgaaggatgttgacactcgtaagattattaaggccatgctttcctacgtatggcccaaggacaggccagacctgagggcaagagttgctatatcactgggatttttggggggagccaaagcaatgaatatagtggtcccctttatgttcaaatatgccgtcgattctctcaatcagatgtcaggtaatatgctgaacctgtccgatgcacctaacacggtggcaaccatggcaacagcggtcctcataggatatggggtgtcacgtgccggagctgcgttctttaacgaggtgaggaatgcagtgtttggtaaggtcgcccagaattctataaggagaatcgccaagaatgttttcctacacctgcacaacctcgatttggggttccacctcagtcggcagactggcgccctctccaaagctatagacaggggcaccaggggaatttctttcgttctctccgctttggtttttaacctgctccccatcatgttcgaagtgatgctagtgtccggcgtgctctactataaatgcggcgcccaatttgcgcttgtgacactgggaactctcggcacctacactgcattcacggttgcagtgacaagatggcggacaaggtttagaatcgagatgaataaggccgacaacgacgcagggaatgccgctattgactcccttcttaactacgaaaccgtcaagtattttaataacgaacggtacgaggcacagcgctatgatgggtttctcaagacctatgagactgcctctttgaaatctactagcaccttggcaatgttgaatttcggccagagtgctattttctccgtgggcctgactgcaattatggttctggcaagtcagggaatcgtcgccggcacgctgactgtcggggacttggtgatggtgaacggcttgctattccagctgagtctgcctctgaactttttgggcaccgtgtacagggagaccaggcaggcactcatcgatatgaatacactgttcacattgcttaaagtcgatacccagatcaaagacaaagttatggcatctcctctgcagatcacaccccagaccgcaacagtggcattcgataatgtgcatttcgagtacatcgagggccagaaggttctcagcggtatctctttcgaggtgccagctggaaaaaaggtggcaatcgttggcggatctggcagcgggaagtcgaccatcgttcgtctactgttcagattttacgagccccagaagggaagcatctatcttgccggccagaacatccaggacgtatcacttgaatctctgaggagggctgtcggagtcgttccgcaggacgccgtcttgtttcacaacacaatttattacaatctcctctatgggaatatcagtgccagtcccgaagaagtgtatgcagttgccaaactcgcaggactgcacgatgcaattctacgtatgccccacggatacgacacccaggtcggagagcgtgggctaaaactgagtggtggagagaagcaacgggtcgcaatagcgcgagcaattctaaaggaccctcccgtaatcttatacgatgaggctacttcctccttggatagtatcactgaggagactattcttggggccatgaaagacgtagttaagcacagaaccagtatcttcatagctcatagactatccactgtagtggacgccgacgagatcattgtccttgaccagggcaaggtagcagaaaggggcacgcaccatggcctgcttgctaaccctcacagcatctatagtgagatgtggcacactcagtcaagtagagtgcagaaccatgacaacccaaagtgggaggcgaagaaggagaatatcagcaaggaagaggagagaaaaaagttacaagaggaaatcgtcaacagcgtcaaagggtgtggcaattgctcttgttag

SEQ ID NO: 109185 - DNA, 2259 bp, Artificial Sequence
  Description of Artificial Sequence: Synthetic coding sequence
atggcattgctggccatgcacagctggcggtgggcagcagccgccgcggccttcgaaaaaagacggcacagcgctatcctgattcgccccctcgtcagcgtgagcggaagcgggcctcagtggcgtccacaccagctaggagcattagggaccgcgagagcctatcagattcccgagtctctgaagtctatcacttggcagaggcttggtaaaggcaacagcggccagttcttggacgccgccaaggccctccaggtctggccgctcattgagaagcggacgtgctggcacggccacgccggtggcgggctgcatactgaccctaaagagggcctgaaggatgtcgatacccgtaagattatcaaggctatgctcagttacgtctggcccaaagacaggcccgacttacgggctcgcgtagccatcagcctgggattcttaggaggggctaaggctatgaacatagttgtgccttttatgttcaagtacgccgtggactccctgaatcagatgtctgggaacatgctcaatttgtctgacgcaccgaataccgtggccactatggccacagccgtactgatcggctacggcgttagtagggctggagctgccttctttaacgaagtcagaaacgccgtgttcggcaaggtggctcaaaactctattcgtcgcatcgctaagaacgtctttttgcacctccacaatcttgatctggggtttcacctctcgaggcagacgggggctctgtccaaagccatcgatcgaggcactcgtggtatctcctttgtgttgagtgccctcgtgttcaaccttctgcctatcatgttcgaagttatgctcgtgtctggggtgctgtattacaaatgcggggctcagttcgccctagtcactttaggaactctgggtacctacactgcctttacagtcgcagtcactcggtggcgcaccaggtttcgcattgagatgaacaaggctgacaacgacgccgggaacgccgccatcgatagccttctgaattacgagaccgtgaagtatttcaacaatgagcgctatgaagctcagcggtacgacgggttcctgaagacctacgaaacggcatctctcaagtcgactagcactcttgccatgctgaacttcggccagtccgcaatcttcagtgtcggtctcactgccatcatggtgcttgcctctcagggcatagtggctggaacacttactgtcggtgacctggtaatggtcaatggcctcttatttcagctctcactccccctcaatttcctcgggaccgtttaccgggagactcggcaggcattgatcgatatgaacactctgttcaccctgctcaaggtagatacccagatcaaggacaaggtgatggcatctcccctccagattacccctcagacggcaacagtggccttcgataatgtgcatttcgagtacattgagggtcaaaaagtgctgagcggcattagcttcgaggttcccgcgggcaagaaagtggccattgtgggaggcagtggatctggcaagagcactatcgtccgactgctgtttagattctacgaaccacagaaaggatccatctatctcgccggccagaacatccaggacgtcagtttggaaagtctgagacgcgccgtgggcgtggtgccgcaggacgctgtgctctttcacaatacaatttattacaatttgctgtacggcaatatcagtgccagccccgaggaagtctacgcggttgcgaaacttgcagggttgcacgacgccattctgcgaatgccacacggctatgatactcaggtcggcgagaggggccttaagctctccggaggcgagaagcagcgcgtcgctatcgcccgtgccatactgaaagatcctcccgtcatactgtacgacgaagcaacgagcagtctcgacagtatcaccgaggagaccatccttggcgcaatgaaggacgtggtaaaacaccgcactagcattttcatagctcacaggctctccactgttgtggacgctgatgagatcatcgtcctggaccaaggaaaggtggctgagaggggaacacatcacggccttctcgcaaaccctcattcaatttattccgaaatgtggcacacccaaagcagccgagtgcaaaaccatgacaaccccaaatgggaggccaaaaaggagaatattagcaaagaagaagaacggaaaaaactccaggaggagattgtgaattcagtcaaaggatgcggtaattgttcttgttag

SEQ ID NO: 109186 - DNA, 2109 bp, Artificial Sequence
  Description of Artificial Sequence: Synthetic coding sequence
atggcccttctcgcaatgcattcctggaggtgggccgctgctgcagctgccttcgagaagcgtagacactccgccatattaatcaggcccctggtctcagtgagtggttccggaccacagtggcgaccacatcagctcggtgcactaggaaccgccagggcttatcaggccctgcaggtatggcctcttattgaaaagcggacctgctggcacggccatgcaggaggcggactgcacacggaccctaaagaaggcctgaaagatgtagatacacggaaaattatcaaagcaatgctgtcttatgtgtggccgaaagacagacctgatctgagagcccgtgttgcaatctcgctcgggtttctagggggggccaaagctatgaacattgttgtgccgttcatgttcaagtatgctgtggatagccttaaccaaatgtccggaaacatgctgaatctgtctgacgcccccaatacagtggccactatggctacagccgtgctgattggatatggggtgtccagagcgggagcggcatttttcaacgaagtgcggaacgcagtgttcgggaaagtcgctcagaattctatcaggcgcattgccaaaaacgtcttcttgcatctacacaacctggatctgggcttccatttgtctcgccaaacaggcgccttatcaaaagcaatagaccgaggcaccagggggatctcatttgtgctcagcgctctggtcttcaatcttctaccgatcatgttcgaggttatgctggtatcaggtgtcctctattacaagtgcggggcacaattcgcgctggttactcttggtaccttagggacttacactgcatttactgtggctgtgactcgttggcgtacccggttccgcatcgagatgaataaggctgacaacgatgccggcaacgcggctatcgactctttgctcaactacgagaccgtgaaatatttcaataacgagaggtatgaagcacagcgttacgatggattccttaaaacatacgaaaccgcatccctgaagagcacctccactctggctatgctgaactttggccagtctgccattttttcagttggcctgactgctattatggtcctggcctcccagggaatagtggctggaactctgacagtgggtgacttggtcatggttaatggactgctgtttcagctgtcccttcctctgaatttcttgggtaccgtttatcgcgaaaccaggcaggccttaattgacatgaatacgctcttcacattgctgaaggtcgatacccagatcaaagataaggtcatggcatctcccctgcagatcaccccccaaacagccactgtagcattcgacaatgtgcattttgagtacattgagggacagaaggtgctttccggcatctcgtttgaagttcccgcagggaaaaaagtggccatcgtgggcggatcaggatcgggaaaatcaaccatcgtgcgactgttgtttcgattttatgagcctcagaagggatcgatttacctagccggccagaacatccaagacgtgagcctcgaaagcttgcggagggcggtcggcgttgtcccgcaggacgccgtactgtttcacaataccatttactataacctgctgtacgggaacatcagtgctagccccgaggaagtctacgccgttgcgaagctggccggtctgcacgacgccattctccgtatgccacatggatatgatactcaggtgggagagagaggcttaaagttgtcgggcggcgagaagcagagagtcgcaatagcccgggcaattctgaaagacccccccgttatcctgtacgacgaggccacatcatcactggattccataaccgaggagaccattctgggggctatgaaggatgtagtgaaacatagaacctccatcttcattgcacaccgactgtccaccgtggtggacgcggacgaaatcatagtcctagaccagggcaaggtggccgaacgggggacccatcatgggctgctggccaaccctcattcgatctatagcgagatgtggcacacccagtcctcaagggttcagaaccacgataatccaaagtgggaggcaaagaaggagaacatctcatag

SEQ ID NO: 109187 - DNA, 2181 bp, Artificial Sequence
  Description of Artificial Sequence: Synthetic coding sequence
atggcactactggccatgcactcttggcgttgggctgccgctgctgccgccttcgagaagagacgtcacagtgccatcctaatccggccgctcgtctcggtgagcggcagtggtccacagtggaggccgcaccaattaggggccctcgggacagcccgggcataccaggctctccaagtttggcccctgattgagaaacgcacttgctggcatgggcatgcgggcggaggactacacactgatcccaaagaaggcctcaaggacgtagacacgcgaaaaatcatcaaagccatgttgtcctatgtgtggccaaaagatcgcccagatcttagagctcgggtcgccatttcattaggctttctcggaggggcaaaggccatgaatatcgtcgtcccatttatgttcaagtacgctgtggacagcttaaaccaaatgagcggcaacatgctgaacctcagtgacgctcccaacaccgtagctacaatggccaccgctgtgctgatcggatatggcgtgtctcgcgccggggctgccttttttaacgaggtcagaaacgctgtgttcgggaaggtggctcagaacagcatccggcgcattgccaaaaatgtgttccttcatctgcacaatttggacctcgggtttcacttgagccgtcaaactggcgcattgtcaaaggcgatcgaccgaggcactagaggcatctcattcgtcctcagtgctttggtgttcaacctcctcccgattatgttcgaggtaatgctggtgtccggtgtactctattacaaatgtggggcacagtttgccctggtgactttaggcactctggggacctacactgcattcaccgtagctgtgacacggtggcggaccagatttaggatcgagatgaataaggcggacaatgatgccgggaatgccgcaattgacagcctactgaactacgagactgtgaaatacttcaacaacgaacgctatgaggctcaacgatatgacggatttctaaaaacatacgaaacagcgtccctgaaatccacctctaccctggccatgcttaactttggacagagcgccatttttagtgtggggctgacagctatcatggtgttggcaagccagggaattgttgcaggtacattgacagtgggcgaccttgtgatggtcaacggccttctgtttcagctctccctccccttaaacttcctgggcacggtgtaccgtgaaacaagacaggcgctcattgatatgaacaccctgtttacactgctcaaagtggatactcaaatcaaggacaaggtgatggctagccccctccagataactccccaaaccgctacagttgcttttgataacgtacactttgaatacattgaaggacagaaggtgctcagtggaatatccttcgaagttcccgctggaaaaaaagtggccatcgttggtggaagcggcagtggaaaaagcactatagtgcgtctgttgttccgattctatgaaccacaaaaaggctcaatatacctcgccgggcagaacatccaggatgtcagcctggagtccttgcgtcgcgccgtgggggtggttcctcaggacgcggtcttgtttcacaacacgatatactacaaccttctttatggtaacatcagcgcatcaccggaggaggtctacgcagtggccaagttagctggattgcacgacgcaatcctaaggatgccacacggctacgatactcaggtgggcgaacgcggactgaagctctccggaggagagaagcagcgcgtagctatcgcccgagcaatcctgaaggatcctccagtgatactctatgacgaagcaacttcctccctggacagcattaccgaagagaccatccttggggccatgaaagacgtggttaagcaccgcacaagcattttcattgcccacaggctgagcactgtggttgacgcagacgagataattgtgctggatcaagggaaggtggcagaaagaggcacccaccatggcctgctggcaaaccctcatagcatttacagcgaaatgtggcacacacaaagttcaagggtgcagaatcacgacaatccaaaatgggaggccaagaaggagaatataagcaaagaggaggagagaaaaaaactgcaggaggagatcgtgaattcagtgaagggatgtgggaattgcagctgctag

SEQ ID NO: 109188 - DNA, 2208 bp, Artificial Sequence
  Description of Artificial Sequence: Synthetic coding sequence
atgttagtgcacttattccgagtcgggatccgcggaggtccttttcccgggcgcttactaccaccccttcgcttccagaccttctctgcagttagaaatacctggcggaacgggaagacaggccagcttcataaagcggaaggggagtactcagatggatatcgaagctcatctctgttacgcgctgtggcccacctccgcagtcagctgtgggctcatctcccacgcgctcccctggccccaagatggtctccatcggcctggtgctgggttgggggagcactgctgggccctatggtgcttagcaagcacccacatctgtgtttggtcgctctctgcgaggctgaggaggcaccaccggcatcatccacaccacacgttgtcggctcccgcttcaattggaagctcttctggcagttcctgcatcctcacttactcgtgctcggggtcgccgtggtcctggcgctgggtgccgcgctcgtcaacgtgcagatccccctgctactcggccaactcgttgaggtcgtggcaaaatatacccgtgatcatgtgggatcgtttatgacagagagccaaaatctgagtactcatttgctaattctgtacggcgtgcaaggcctgctgaccttcggatatcttgtcctcttaagtcacgtgggcgaacgaatggccgtcgacatgagaagggcgttgttctctagcctgcttagacaggatatcaccttctttgacgctaataaaaccggccagctggttagtcggctgactacagatgtccaggaatttaaatctagcttcaaattagtaatcagtcaggggcttcggagttgcacacaagtcgccggatgccttgtaagcctctccatgcttagcactcggctgacgctcctgctgatggtggctactcccgccttaatgggcgtcggtacacttatgggcagtggcttgagaaagctaagtaggcaatgtcaggaacagattgcaagggcaatgggcgtcgctgacgaagccttaggcaacgtccggaccgtgcgcgcttttgccatggaacaaagagaagaggagcggtacggggcggagctcgaagcctgtcggtgtagagctgaggagctcggccggggcattgcgctgtttcaggggctgagtaacatcgcctttaattgtatggtgctcggcactctctttataggtggaagcctggtggcggggcagcaactaaccggcggggacttgatgagctttctggtggcatctcagaccgttcagcgttctatggcaaaccttagtgtcctttttggccaggtggtgcgtggcctctctgcgggcgctagggtattcgaatatatggcgctcaacccttgcatccccctctcaggaggttgttgcgtgcccaaagagcaactgagaggctcagtgacgttccaaaacgtctgtttcagttatccttgccgtccaggatttgaggtgctgaaagattttaccctgaccctgccccctggtaaaatcgttgctctcgtcggacagagcgggggcggtaagaccacagtcgcctcgctcttagaacgcttctacgatcctacggcaggtgtagtgatgcttgacggtagggatttaagaacattagacccgagctggctgcgaggccaggtcgtgggttttatcagccaggagccagttctgttcgggacaaccattatggagaatatccgcttcggcaagctcgaagcaagtgacgaggaagtctacacagctgcccgtgaggcaaacgcccacgagtttattacctccttccctgagggttataataccgttgtcggggagaggggtacaacattgtcaggtggtcagaagcagagactggccattgcgcgagccttaatcaagcaaccaactgtcttgatcttagatgaggcgacaagcgccttggacgctgaatctgagcgcgtcgtacaggaggcgctggatcgagcttctgctggccggaccgtcctcgtcattgcgcatcgactgtccacggtgagaggcgcacattgcattgtcgtgatggcggacggacgggtctgggaggcggggacgcacgaggagctcctgaagaagggtggactgtacgcagagctgatccggaggcaggctctggacgccccaaggacagctgctcctccgccaaaaaaacccgagggtcccagatcccaccagcacaaaagctag

SEQ ID NO: 109189 - DNA, 1404 bp, Artificial Sequence
  Description of Artificial Sequence: Synthetic coding sequence
atgctcgttcacctttttcgtgtcgggatccgggggggaccgtttcctgggcgcctgctccctcctttacgcttccagacgttttcagccgttaggaggctattgcggctgcagccacgggtgtcccagaaggaaggtaccctcggggtgagcgaccatgcccagtccgccctgcccacgggtggacccctctcctggccttggagatatagcgatgggtatagatcctcgagcttgcttcgcgccgttgctcatctgagatctcagttgtgggcccatctgcctagagcacccctggcgccccgttggtccccgtctgcatggtgttgggtgggcggagctctgctgggtccgatggtactatccaagcatcctcacttgtgtctggttgccctatgcgaggccgaggaagctccacctgcctcctccacaccccatgtggtaggctcgagatttaactggaagcttttttggcagttcctacatcctcatctcttggtgttaggcgttgccgttgtgttggctttaggggccgcgctggtgaacgtgcagatcccacttctcctcggccagttagtggaagtcgtcgcaaaatacactcgggaccatgttgggtctttcatgaccgagtctcagaatctgtctacccatctgcttattctgtatggggtgcaaggtctcttgacattcgggtatctggtgctcctgtcccacgttggggagagaatggccgtggatatgcgcagggccctgttttcaagcctgttaaggcaggacatcactttctttgacgctaacaagacagggcagcttgtaagcagacttactacagacgtgcaagagttcaaaagctcgttcaaactggtcataagccagggacttcgctcatgcacacaggtcgcgggctgcctagtgtctctgtctatgctcagtacccgtctgacgttgctgctcatggtggccaccccagccctaatgggtgtcgggacactaatgggtagcggtcttaggaagctctctagacaatgccaagagcagattgctcgggctatgggggtcgctgacgaagcactcggaaatgttagaacggtgcgggcttttgctatggaacagcgtgaggaagaacgttacggcgctgagctggaggcttgtaggtgtagagcagaggaactcggcaggggcattgccctgtttcagggtctttccaatatagctttcaactgcatggtcctgggaactctctttattggcggcagcctcgtggcaggccagcaactgactgggggagacttgatgtccttcctggttgcctcacagaccgtgcagagacaagtccacgggcagccattatgccctgtctgggcaggaggccccggagcagagtgtagatgccccggcctgtag

SEQ ID NO: 109190 - DNA, 2157 bp, Artificial Sequence
  Description of Artificial Sequence: Synthetic coding sequence
atgttggtgcatttattccgtgttgggattaggggtggcccgttcccaggaagactactgccacctcttcgtttccagacattttctgcagtccggtactccgacggctacagaagctccagcctgctgagggccgtcgcgcacctgcgaagtcaattatgggctcacctgccaagggcacctctggccccccgatggagccccagcgcctggtgctgggttgggggagcactcctggggcccatggttttgtctaaacatcctcacctttgcctcgtcgccctatgcgaggccgaagaggctcctcccgcctcatccaccccccacgtcgtcggatcgcgctttaactggaagctattttggcagttcctgcatccacacctcctcgttttaggagtcgccgttgtcttagctctgggcgcagccctcgtgaacgtgcagattccactgttgctgggacagctggtggaggtggtcgccaaatacacccgggatcatgtcggctccttcatgacggagtctcagaacctgtctacccatctgctgatcctgtacggagtgcagggcctgcttacgttcgggtacctggtgctactgtctcacgtgggggaacgaatggctgtggatatgagaagggcccttttcagttcactgcttaggcaagatattactttttttgacgcgaacaaaaccggccaactggttagcagactgaccactgacgtacaggaattcaagtcatcctttaagttagtgatcagccaggggctgcgatcctgcactcaggtagctggttgcctggtaagtttgtccatgctctctactcggctgacactcctgctgatggtggctaccccagctctaatgggcgtgggcaccctgatgggcagtggactgcgaaagttatcaagacagtgtcaggaacagatcgcccgcgctatgggggtcgccgacgaggctttaggcaacgtcagaacagttagagcttttgccatggagcagagagaagaggagcgttacggggcagagctggaagcttgtcgatgtcgtgctgaggagctgggacgtggcatcgccctctttcaaggcctctctaacatagctttcaattgtatggtgcttgggaccttgttcatcggcggctctctggtggccggccagcagttgacaggtggcgacctgatgtccttcctagtggcttcgcagaccgtacaaaggagtatggccaacctctcagttctctttggacaggtggtgcgaggtctctcggcaggagcacgggtcttcgagtacatggctctgaacccgtgcatccctctctctggaggatgttgtgtgcctaaggaacagcttcgcggctctgtgacttttcaaaatgtgtgcttcagttacccgtgtcggcctgggttcgaggtcctcaaagactttacgttgaccctcccccctgggaagatcgtagctttggttggtcagagtgggggcggcaagaccaccgtcgcctcccttttagagaggttttacgatcctactgccggggtcgtgatgctggatggccgggaccttcgtactctggacccatcctggctgcggggccaagtcgtgggcttcatctcgcaggaaccagtcctttttggaaccacaattatggagaatataaggtttgggaagctcgaggcaagtgatgaggaagtctatacagccgcccgtgaagcaaatgcccacgagttcattacgtcctttccagaggggtataacaccgtagtcggtgagcggggcactactctcagtgggggccagaagcaaagactggcaatcgccagggccttgatcaagcaacccactgttctaatcttagacgaggcaacctcggcgctcgacgcagaatctgaaagagttgttcaggaagcgctggacagggcaagtgcaggtaggaccgttttagtaattgcacaccgtcttagcaccgtccgaggagcccactgtattgtagtgatggctgatggacgggtttgggaagcaggaacgcacgaggaacttttgaaaaagggtgggctgtatgcagagcttatccgaaggcaggccctggatgcgccacggacggctgctccgcccccaaagaagcccgagggtccacggagtcatcaacataaaagctag

SEQ ID NO: 109191 - DNA, 2106 bp, Artificial Sequence
  Description of Artificial Sequence: Synthetic coding sequence
atgctagtacacctctttagggtggggatcaggggcggtccattccccggcaggctcttgccccccttacgattccaaactttctcagccgttcgctactctgacgggtaccggagcagctcactgctgcgggcagtggcccatcttcggtcccagttgtgggcccatctgcctcgagccctgctggggccaatggttctcagcaaacacccacatctttgcttggtagctctgtgtgaggcagaggaggccccccctgcgtccagtacaccgcacgtggtcggcagcagatttaactggaagcttttttggcagttcctccacccacacctgctcgtgcttggggtggccgtggtgcttgccctaggtgcagcactggtcaatgtccagatccccttgttgttaggacagctggtggaggtggtcgcaaagtatacccgggaccacgttgggtcttttatgactgaaagccagaacctgagtactcacctgttaatattatacggcgtgcaggggctgctgacgttcgggtacctggtgctcctctcccacgtcggggagcgcatggctgtagatatgcgtcgagctctcttcagtagcttgcttcgtcaggatataacttttttcgacgcgaacaagacagggcagctggtgtccaggctcaccacagatgtccaggagtttaaaagctccttcaagcttgttataagccagggactgagatcctgcacccaggtggccgggtgtctcgtgtccctttctatgctgtcaaccaggctgactttgcttttgatggtggctacacctgcgctcatgggggtggggaccttgatgggcagtggcttgcgaaagctgtctcgccaatgtcaggagcagatagcccgggcgatgggcgtggctgatgaagccctgggaaacgtccgtacggtccgggcattcgcaatggaacaaagggaggaggagcgatacggcgctgaactggaggcatgcagatgccgcgccgaagaactgggtagaggtatcgccctcttccaaggcctgtctaacatcgccttcaattgtatggtactggggaccctgttcattggtggatctctggtagcagggcagcagctgactggaggcgatctcatgtccttcctggtggctagtcagactgtgcagaggtcaatggccaatctcagtgttctgttcgggcaagttgtgcgaggactaagcgccggcgcgagagtttttgagtatatggccctgaatccctgtatcccacttagcggcggctgttgcgttcctaaggagcaactgagaggatccgttacctttcagaatgtttgcttcagctacccgtgtcgcccaggttttgaagtgcttaaagacttcacacttaccctgccccctgggaaaatcgtggcgttagtgggacagtccgggggaggaaagaccactgtcgcctctttgctggagcgcttctacgaccctacagccggcgtcgtgatgttggatggtcgggatctacggacactggacccaagttggctgcggggccaggtggtgggctttatatcccaggagccagtgctcttcggcacaacaataatggaaaacattcgatttggcaagctggaggccagtgatgaggaagtttacactgctgcgagagaagccaacgcccacgagttcatcaccagttttcctgaggggtacaacaccgtggtgggtgagaggggcaccactctctcaggagggcagaaacagcgcctggctattgcgagagcgttaatcaaacagcctactgtactgatcctcgatgaggcgacctcagccctggacgctgaaagcgaacgcgtggtacaggaggcactcgatagagcatctgccggtaggacagtgctggtcatcgcccatagactcagtaccgtacgcggagcacactgcattgtcgtcatggctgacggtagggtgtgggaagccggcacacacgaggaattgctgaagaaggggggactatatgcggaattgattagacgccaggcattggacgccccaaggaccgccgcccctccacccaaaaagcccgagggccctaggtcccatcagcacaagtcctag

SEQ ID NO: 109192 - DNA, 1296 bp, Artificial Sequence
  Description of Artificial Sequence: Synthetic coding sequence
atgctagtgcacctcttccgggttggaatccgaggcggtcccttcccgggtcgcctattgccccctctccgctttcagacatttagcgccgtgaggtatagtgacggctacagatccagttccctgcttcgcgctgtggcacatctcagaagccagctgtgggcacatctcccccgggcccccctcgccccaagatggtcgccttctgcttggtgctgggtcggaggcgcactactgggacccatggtcctatctaaacaccctcacctctgtctggttgcactctgtgaagccgaggaggcccctcctgctagcagcacacctcatgtggtgggtagccgatttaattggaagcttttttggcagtttttacaccctcatcttctcgtgctgggcgtggctgtcgttctggcattgggtgccgccttggtcaacgtccagattccactcctcctagggcagttggtggaagttgtggccaagtatactcgggatcacgtcgggtcttttatgacagagtcacagaacctctccacccatttgctgatactttatggtgtgcaggggttgctaacatttggatatctcgtcctcctaagccatgtcggagaacgcatggcggttgacatgcggcgtgccctgttctcatcgttgctcaggcaagacatcacattttttgacgccaacaaaactgggcaactagtctcacgtctgacaacggatgtgcaggaattcaagagctccttcaagctcgtgattagccagggacttcggtcatgcacccaagttgccggctgtctggtgtcattaagtatgctcagcacccgcctgaccctcctgctgatggtggcgactcccgctctgatgggagttggtacgctcatgggaagcggtctccgaaagttgtcgagacagtgccaagaacagattgcccgcgccatgggggttgccgacgaggccctgggaaacgtacggactgtgagggctttcgctatggagcagcgcgaagaggaacggtacggcgccgagctcgaagcctgtcgctgtagagctgaggagctcgggcggggaatcgccctgttccagggattgtctaatatcgcctttaactgtatggtcctcggtacactgtttataggcggcagcctggtagcgggtcagcagctcaccggcggagatctcatgagctttcttgtggctagccagacagtccagtccttcctgcgtgtggctccctgccccaacagcctgccactccaggccgtaacattccatgcctggaaggatcatccgtag

SEQ ID NO: 109193 - DNA, 2082 bp, Artificial Sequence
  Description of Artificial Sequence: Synthetic coding sequence
atgctggtgcacctgtttcgcgttggcattaggggagggcccttccctggccgcctgttaccacccctccgattccaaaccttctctgctgtccggtattctgacggctacaggtctagctctcttttaagggctgttgcacacctcagatcccagctctgggctcacctgccacgggctccactggcccctcggtggtctccttccgcttggtgctgggtcggaggcgcattgttaggtcctatggtgctgtctaaacatccccacctttgtttggttgcgctctgtgaggctgaagaggcccctccggcgagtagcactccgcacgtcgtggggagccgcttcaattggaaattgttctggcagtttcttcacccacacctgctagtgctgggggtggcagtggtgctggccctgggtgccgccctggttaatgttcagatcccactgttacttggccaattggtggaagtggtggcgaagtacacacgggaccacgtggggtcctttatgaccgagtcgcaaaatttgagcacacatctgctcatcctgtacggggtgcagggactcctaacatttgggtatctggttctgctaagtcatgtgggcgaaagaatggccgttgatatgcgtagggcactgttcagcagcctgttacgccaggacataaccttttttgatgctaataagaccggacagctggtgtcgcgcctcacaacggacgtgcaggaattcaaatcctctttcaaactggtgatcagccagggtttgcgtagttgtacacaggtcgctggctgtttggtgagtctctccatgctgtcaacccgcctgactcttctgttgatggtcgctaccccggcgctcatgggcgttggaacgctgatgggcagtggattacgaaagttgtctcggcagtgtcaggagcagatcgcccgtgctatgggcgtagccgatgaagcactggggaacgtccgtaccgtaagggctttcgccatggagcagcgggaggaagaacgctatggagccgagctggaggcttgtcggtgcagggccgaagagcttggacgcggaatcgctctcttccagggcctgtccaatatcgccttcaattgcatggttctgggaactctgttcattggaggtagcctggttgccggccagcagctcacaggaggcgatcttatgtcgtttctcgtcgccagccagaccgtacaaagatccatggcaaatttgtccgtgctattcggtcaggtggttagaggcctgtcagctggcgccagagtcttcgagtatatggcactgaatccttgtattcccttgtcagggggatgttgtgtgcctaaggagcaactccgcggaagcgtcacttttcagaatgtatgcttttcatatccctgccgacctggattcgaagtattaaaagactttacccttactctgccacctggcaagattgtggccctggtgggccaaagtggggggggcaagaccacagtggcgtctctcctagagcgcttttatgatcctactgcaggggtcgtgatgctcgacggacgagacctacggaccctggatccgagctggctgagagggcaggttgtgggcttcatcagccaggaacctgttctgtttggcactacgatcatggagaacattcggttcggaaagctagaggcaagtgacgaggaggtctataccgccgcacgagaagctaacgcccacgagttcatcacctccttcccagaaggatacaacactgtagtgggcgaacggggcaccactctctctgggggccagaagcagcgccttgccatcgcaagggctctgattaaacagcccaccgtactgatcctggacgaggccacttccgccctcgatgccgagtcagaaagggtggtgcaagaggcgttagacagagcatctgctggacgcaccgtgttggctggaacgcacgaagagcttttgaagaaggggggactttacgcggagctgataaggaggcaggccttggacgcccctcgcacagctgctccccctcctaaaaagcctgagggaccacgttcccatcagcataaatcgtag

SEQ ID NO: 109194 - DNA, 1893 bp, Artificial Sequence
  Description of Artificial Sequence: Synthetic coding sequence
atgagggtgaagcttctcctccctgccgcgcccgtgctgcctcggcagcatgcaggcgctttcatctccggacgggactcgggctggccaatccctcgccaagcggctaccgcacctccccttccagacatcctgtcctgccagctcgcattaggcgccgctttggtgaatgtacagatacccctactgcttgggcagctagtcgaggtggtagcgaagtacactcgggaccacgtggggagtttcatgacagagtcccagaacctgtctacgcacctgttaatcctgtacggtgtgcagggcctgctgactttcggctacctggttctgctgtcccacgtgggagaaagaatggccgtcgacatgcgacgcgccctgtttagctctctgctgagacaggatatcactttctttgacgcaaataaaacaggccagctggtttcacgcctcaccaccgacgtacaggagttcaaatccagctttaagttagtgatcagccaaggacttaggtcttgtactcaggtggcggggtgcctggtgagtctatccatgctgagcacaagactgacactgctgttaatggtggcgacgcctgctctcatgggagtgggaacactgatgggcagcggcctgcgaaaattatctagacaatgtcaggagcagatcgcgcgagccatgggcgtagcagacgaggcactgggcaatgtgcgcacagtcagagctttcgctatggagcagagggaagaggagagatatggcgcggagctagaagcctgtcggtgcagggcagaagagctcggccggggaatcgccctctttcagggcctgagtaacatcgcctttaattgcatggtgctcggaacattgtttataggcgggtccttggtggccgggcaacagttgaccggcggggatctgatgagctttctggtggcctcccagactgtacagcgatccatggcaaatctatctgtgttatttggacaagtcgtaagaggattgagcgctggtgctagggtcttcgaatacatggctcttaatccttgcattcctcttagcgggggctgttgtgttccgaaagaacaactccgcgggtccgtgacgttccagaatgtctgtttctcatatccttgccgtccaggttttgaggtcctcaaggactttacactgaccctccctccaggaaagattgtggccttggtaggccagagcggcggaggcaaaaccacagttgctagtctcttagagcgtttctatgaccctaccgctggggtcgttatgctagacggacgggaccttcggaccctggacccttcctggctgaggggacaagttgtgggcttcatttctcaggaaccagtgctgttcggcaccaccattatggaaaatatacgtttcggaaaactcgaggccagtgacgaggaagtgtacacagcagcgcgagaagccaatgcgcacgagttcatcacttcattccccgaaggttacaatacggtggtcggcgaacgagggactactctcagtggcggccagaagcagcgtctcgccatagctagagcactgataaagcagccaaccgtcttaatcctggacgaagctacttcagctttggatgcagagtctgagcgtgtcgtgcaggaggcgctggatagagcctctgctggtaggaccgtgctcgtgatcgcacaccgcctgagtaccgttcggggtgctcactgtatcgtggttatggctgacggccgtgtttgggaggcgggcacccatgaagagctgttgaaaaagggcggattatacgccgagctcattcgtcggcaggcccttgatgcccccaggacagctgctccgccaccaaaaaagcctgagggaccacggtcccatcaacataagagctag

SEQ ID NO: 109195 - DNA, 2301 bp, Artificial Sequence
  Description of Artificial Sequence: Synthetic coding sequence
atgcggctgtggaaggctgtcgttgtcacgcttgcttttatgtcggtggacatctgtgtgacaacggccatttatgtcttctcgcacctggatcggtccctccttgaagatatcaggcattttaatattttcgactccgtgctcgatctgtgggcggcttgcctgtaccgttcttgcctgctcttaggggccactatcggggtcgccaagaactcggcccttggcccacgtcggttgcgggcctcatggctagttatcacactggtgtgtttgtttgttggtatctacgccatggtaaaactgctgctgttttcagaggtacgcaggccgattagagacccttggttctgggctctcttcgtgtggacctatatcagtctcggggcctcttttctcctatggtggctgctctccactgtgcggcctgggacgcaggctttggagcccggagccgcaactgaagccgaaggttttccaggatccggaaggccaccgccagagcaggcgtctggtgcaacactccagaaactgctgtcctacacgaagcctgatgtcgcgtttttggttgctgcatcatttttcctgatcgttgctgcgctgggcgaaacatttctgccgtactacacaggaagggccatcgatggaatcgtcatccagaagtccatggaccaattttccaccgcggtggtcattgtctgtctactagctatcgggtcctctttcgcggctgggatccgcggcggaatatttactcttatctttgcccgactcaacattaggctaaggaactgccttttccgcagtctggtgtctcaggaaacatcattttttgacgaaaaccggaccggggatctgatcagccggctgacaagcgacacaacgatggtgtccgatttggtgagtcagaacatcaatgtgttccttcgtaacaccgtgaaggtgactggtgttgtggtcttcatgttcagcttatcatggcagctaagtctggtgacatttatgggcttcccgattatcatgatggtgtccaatatttatggtaagtattacaagcgtctgagtaaggaggtgcagaacgccctggctagagcctctaataccgctgaggagaccatatccgcgatgaagacagtgagatcctttgccaatgaggaagaggaagccgaagtatatctgcgtaagctccagcaagtctataaactaaaccgtaaagaagcagcggcctacatgtactatgtctgggggagtggattgacactgctcgttgtgcaagttagtatcctgtattatggcgggcacttggtcattagcgggcagatgacatcaggcaatctcattgcctttattatttacgaatttgtgcttggggactgcatggaaagcgtcgggtccgtttacagtgggctgatgcagggcgtgggggcagctgaaaaagtgtttgaatttatagatagacaacccaccatggtgcacgacggctcgcttgccccggaccatttggaggggcgagtggatttcgagaacgtgacattcacgtaccgaaccaggccgcacacacaggtcttgcagaacgtcagttttagtctgtctccagggaaggtgaccgcactcgtggggccctccggttctgggaaatcgtcttgtgtgaatatcctggagaatttttaccctttagaggggggccgggtactgttggatggaaagcccatttcagcatacgatcacaagtacctgcatagagtcatttctcttgttagtcaagagccagttttattcgctaggtctattactgacaatattagttacggactgccaacagtccctttcgagatggtcgtggaggccgcccaaaaggcaaatgcccatggctttattatggagctgcaggacggttacagcactgagactggggaaaaaggggctcaactgagcggcggccagaagcagcgggttgcaatggctagagctctggtgaggaatcccccggttctcattttagacgaggctacctccgcactggacgccgaaagcgaatatctgattcaacaggcaattcacggcaacttgcagaagcacacagtactcatcatagcacacaggctctccactgttgaacacgcacatctcatcgtggtgctggataaagggagggtcgtgcagcaaggaacccatcagcagctgctggcccagggtggactgtatgcgaagctggtgcagcgacaaatgctcggactgcagcccgccgcagatttcactgccggacacaacgaacctgttgcgaatggcagccataaagcctag

SEQ ID NO: 109196 - DNA, 2172 bp, Artificial Sequence
  Description of Artificial Sequence: Synthetic coding sequence
atgcgcctctggaaggccgtcgtggtcacattggccttcatgtcagtggatatttgcgtaaccactgcgatttacgtgttcagtcacttggatagatctctgctcgaagacattaggcacttcaatatctttgattcagtgttagacctgtgggccgcttgtctgtataggagctgtctgctgctgggtgccaccatcggcgtcgctaagaattctgcactgggaccgaggcggctgagggccagctggctggtcatcacactggtgtgcctgttcgtcgggatatatgcgatggtaaagctgcttttgttctccgaagttcgacggcctataagggacccatggttctgggccttatttgtgtggacatacatttctctgggggcatccttcttgttgtggtggctgttgagtacggtgcggcctggcactcaggccctcgaacccggagccgcaactgaagccgagggatttccaggaagtggtcgacccccacccgaacaggcttctggagcaacactccagaagctgctgagttataccaaaccggacgtggctttcctagtggccgcctcctttttccttattgtagctgcactcggtgagaccttcctaccatactatacaggtagggctattgatgggatagtgatccagaagtccatggatcaattttccactgcagttgtcatcgtgtgtttattggctattgggtcctcttttgccgcaggaatccgcggaggaatcttcaccttaatcttcgctcgcttgaatatacgactccgtaactgccttttccggagccttgtgtcccaagagacctccttctttgatgaaaaccgcacgggggatctgataagccgtttgacaagcgatacaacgatggtgagcgacctcgtgtcacagaacattaatgtctttttgcgcaacacagtgaaagtgacgggggtggtggtgtttatgttttctttgtcatggcaactctcactggtgacctttatgggatttcccataatcatgatggtgtctaacatctacgggaagtattataagcgtctgagtaaggaagtgcaaaatgctctggctcgggccagtaataccgccgaggagaccatctctgcgatgaaaacggtgcgatcctttgcgaacgaggaagaggaggcagaggtatatctgagaaagctccaacaagtgtacaaattaaacaggaaggaggccgctgcctacatgtactacgtatgggggtcagggtccgtgggaagcgtgtactctggattaatgcagggtgtcggggctgctgagaaagtctttgaattcatcgaccgacagcctactatggttcacgacggcagtctggcacccgatcacctggagggtcgcgtcgacttcgagaatgtgacttttacatacagaactcgcccccatacccaggtgctgcaaaatgtctccttcagcctgtctcccggaaaggtgactgctcttgtgggaccctcagggtcgggtaagtcaagctgcgtcaacattctcgaaaatttctaccctctagagggcgggcgtgtactgttggatggaaaaccgatatccgcatatgatcacaagtacttgcatcgagttatcagtctggtgtcccaggagccagtactcttcgcccggagcatcacggataatatctcatacggactaccgacagtgccatttgagatggtcgtcgaagccgcacagaaggccaacgcccacgggttcattatggaactgcaggatggatacagtacggagaccggggaaaagggagcgcagctgtccggtggtcagaagcaaagagttgccatggcccgagctctagtgcggaacccacctgtgctcatcctggacgaagccacatcagccttggatgccgagagcgagtacttgattcaacaagcaatccacgggaaccttcaaaaacacacagtgttgattatcgcccacagactgtctactgtcgaacacgctcacctcattgtggtgctggataaaggacgcgtagtacagcaagggactcaccagcagctgcttgctcagggggggctgtatgccaagctggtccagagacagatgttgggtcttcagcctgccgccgacttcacagctggtcacaatgaacccgttgccaacggtagtcacaaggcctag

SEQ ID NO: 109197 - DNA, 2301 bp, Artificial Sequence
  Description of Artificial Sequence: Synthetic coding sequence
atgagactatggaaggcagtcgtagtgacactcgcctttatgtctgtggatatctgcgttacaacggcgatctacgttttcagtcacctggacaggtcgttactggaagacattcgccactttaatatttttgattccgtacttgacttgtgggctgcgtgtctctatcggagttgccttctgttgggggctactattggcgtggctaagaattcggctcttggacctcgtcggttgagagccagctggctggtgattactctcgtatgtctgttcgtgggtatctacgcgatggtcaaactactgctgttctctgaagtgagaaggcctatccgcgacccttggttctgggcactattcgtctggacgtacataagtttaggtgcttcgtttcttctgtggtggctgctttctacggttagacccggtacgcaggcgctggagccaggagccgctaccgaggcggagggcttccccggaagtggaagaccccctccagagcaggcctctggtgcaacgcttcaaaagcttctgtcatatacaaaaccggatgtggcctttctcgtggccgcttctttttttttaattgttgcagcactgggggaaactttcctgccatattatacggggcgcgctatcgacggaatcgtgattcaaaagagtatggaccagttttcaacagctgtggtaatcgtgtgtctcctggcgattgggtcctcatttgccgcgggcatccggggcggaatctttacgctgatttttgcaagacttaacatccgcctgcgcaattgcctttttcggagtcttgtctcacaggaaacatcatttttcgatgagaaccggacaggggatcttatctcaagattgacaagcgatactacaatggttagcgacctcgtctcacagaacatcaatgtattcttgcgaaatacagtgaaagtgacaggagtagtggtcttcatgttcagtctgtcctggcagctcagtctagttacgttcatggggttccccattatcatgatggtttctaacatatatgggaagtactacaaacgactgtctaaagaggtgcagaacgctctcgctcgcgcgtccaacacggctgaggaaactatttccgccatgaagaccgttcgcagttttgcaaatgaggaggaagaggcagaggtctacctgaggaagttgcagcaagtgtacaaattaaaccgcaaagaagccgcggcctatatgtattatgtctggggctccggcctgactctgttagtggtccaggtctctattttgtactatggcggccatttagtgatatccggccagatgacaagcggtaacctcattgccttcattatatatgagttcgtactgggcgattgtatggagagcgtcggctctgtgtactccggattaatgcaaggtgtcggcgcggccgagaaggtgtttgaatttattgatcgccagcctaccatggttcacgacgggagcctcgcccctgatcatctggaaggacgggtagactttgaaaatgtgacgttcacatatagaacaaggccacacacccaggtgctccagaacgtgtctttctctctgagccccggcaaggtgactgccctggtgggcccctccggaagtgggaagagcagttgcgtgaacattctggagaatttttatcccctggaaggcgggcgggtacttctggatggaaaacctataagtgcctatgaccacaagtatcttcacagggttatcagcctcgtgtcacaggagcccgtgctgttcgcccgcagcattactgataatatcagttacggcttacccactgtacccttcgagatggtcgtggaagcagcgcagaaagctaacgctcacggctttatcatggaactgcaggacggttattctaccgagacaggagaaaagggtgcacagctgagcgggggacagaaacaacgggttgctatggcgcgggcactggtccggaatcctccggtgcttatcctggacgaggcgactagcgcactggacgcagaatcagagtacctcattcagcaagctatccatggcaaccttcagaaacatacagtcctgataattgcccacagactgtccacagtagagcatgcccacctgatcgtagttctggacaagggacgagttgtgcagcaaggaactcaccaacagctgctggcgcagggggggctgtacgcaaagctggtgcaacgccagatgttgggcctccagcctgcagctgatttcaccgctggtcacaatgagcctgtggctaacggtagtcataaggcctag

SEQ ID NO: 109198 - DNA, 2310 bp, Artificial Sequence
  Description of Artificial Sequence: Synthetic coding sequence
atgcggctgtggaaggcagtggtggtcaccctggccttcatgtctgtggatatctgcgtgacgacagctatctatgtgtttagccatctggacagatctcttctcgaggatattagacacttcaatatcttcgatagtgttctggatctgtgggcagcctgtctgtatcgtagctgcttgctactgggtgcgaccattggcgttgctaagaatagtgccctcggcccacgacggctgcgggcctcctggctcgtgatcaccctcgtctgtctgtttgttggcatttacgctatggtaaaactgctgctgttttccgaggtccggagaccgatacgagacccttggttttgggccctgttcgtttggacatacatttctctgggtgcatcctttctgctttggtggttactgtccactgtgagaccaggtacacaagccctggagcccggcgccgctaccgaggccgagggctttccaggatccggaagacccccacctgagcaggcctccggtgcaacactccaaaagctcctgagctataccaagccggacgtagcttttctggtggcggctagcttctttttgatcgtcgccgcactcggagagacatttcttccttattacaccggcagagcgatcgatgggattgtgatccaaaaatctatggaccagttcagtaccgccgtagtgatcgtgtgcctgcttgctattggatccagcttcgcggcaggcatccgtggaggtattttcacgctgatttttgccaggctcaatattcgcttaagaaactgtttgttccgatctttagtttctcaggagacttccttttttgatgagaatcgaactggtgacttgatcagtagactcacctccgacacgacaatggtgtctgacttggtcagccaaaatataaacgttttcttgcgcaataccgtgaaggtgaccggagttgtggttttcatgttttctctgagctggcagctctctttggtcacatttatgggcttccccataataatgatggtgtccaatatttacggtaaatactataagagactgagcaaggaggtccagaacgcactggctcgggcttccaatacagctgaagaaaccatctcagcaatgaaaacagtgaggtcctttgccaatgaggaagaggaagccgaggtctatctgcgcaagctccagcaggtttacaagcttaatcgcaaagaggctgccgcatacatgtattacgtctgggggtccggccttacattgctggttgtccaggtttctattctgtattatggcggccatttggtgatctcaggacaaatgacctccggaaacctcatcgctttcataatttacgagttcgtgctcggtgattgtatggagtccgtcgggagtgtttattctgggctgatgcagggggttggcgccgctgagaaggtgttcgaatttattgatcggcaaccaacaatggtgcacgatggaagtctcgcccctgaccatttggaggggagagtggattttgaaaatgttacatttacgtaccgaacccgaccacacacccaggtgctccagaatgtgtctttctcgctatcacctggcaaggtgaccgccctcgtaggaccaagcggttcagggaagtcttcctgtgtcaatatcctggagaatttttatcctctggagggtggtcgggtgctcctggatggaaaacccatttctgcctacgatcacaaatatctgcatcgcgtaattagcttagtctctcaggagcccgtgctgttcgcacgaagcataaccgacaatatcagctacgggttgcctacagtgccattcgagatggttgtggaagcagcgcagaaagccaatgctcatgggttcatcatggagctgcaggacggatattcaactgagactggcgaaaagggagctcagctgtcagggggccagaaacagcgcgtcgcaatggctcgcgccctcgtgcgcaacccacccgtcttaatcctcgatgaggccactagcgctctagatgcagaaagcgaatatctgagtccccagatccagcaagcgatccatggaaacttacagaagcacaccgtcctcatcatcgcccaccggctctcgacggtcgagcatgctcacctcatcgttgttctcgataaaggcagagtagtgcagcagggcacgcatcaacagctgctggcacagggaggactttacgcgaaactcgtccagcgccaaatgttaggactgcagcccgcggccgatttcaccgcgggccacaatgaacctgtagctaatggctctcacaaggcctag

SEQ ID NO: 109199 - DNA, 2112 bp, Artificial Sequence
  Description of Artificial Sequence: Synthetic coding sequence
atgcgcctctggaaggccgtggtggtgacccttgcatttatgtctgtggacatttgcgtgacaacggctatttacgtttttagtcacctggatcgcagtctgctcgaagacattcggcacttcaatatctttgactctgtactcgacttgtgggccgcctgtctgtacagatcttgtctgttactgggggcaacaattggtgtggccaagaactccgcactcggcccaagacggctgcgggcctcatggttagtgataaccctggtgtgtttgtttgtagggatttatgcgatggtaaagctgttgctcttctctgaggtcaggcggccaatcagagacccatggttttgggcgctgttcgtgtggacatacattagcctgggcgcttcctttctgctttggtggcttctgtcaaccgtgagacctggaactcaggccctagaacccggcgctgcgactgaggccgaagggtttcccggaagtgggcgtcctcctcccgaacaggcgtctggggccaccttacagaaactcctgagctataccaagcctgacgtcgcctttctggttgccgcttccttcttcctgattgttgcagctcttggcgaaacattcttaccctactacacgggaagggccatcgacggcatcgtgatccagaagtcaatggaccagttttccaccgccgttgttattgtgtgtctcctggctattggatccagcttcgccgctggcatcaggggaggcatttttacattgatattcgcccgactcaatatcagactgcgcaactgtctgtttcgcagtctggttagccaggagacctctttctttgatgaaaacaggacgggagatctcatatcccgactgacatctgatacaacgatggtgtccgatctcgtctctcaaaatattaatgtatttctaagaaataccgttaaggtgacgggggtggtggtattcatgttctcactgagctggcagctatcactggtgaccttcatggggttcccaatcatcatgatggtgagcaatatatacggtaagtactataaacgtctgtctaaggaggtgcagaatgcgctggctcgggcctcgaatacagcagaggaaacaatctctgccatgaaaaccgtgcggtcgtttgccaacgaggaagaagaggctgaggtctacctgagaaagcttcagcaggtctataagctaaaccggaaggaggctgcagcttatatgtattacgtgtggggcagtggcctgaccttacttgtggtacaggtcagcattctttattacgggggccacttggtgatttccggacagatgacatccggcaaccttattgccttcatcatatacgagtttgtgctgggcgactgcatggagaacgtcagtttttcactgtccccaggaaaggtgaccgctctggtcgggccctctggcagtggcaaatcatcctgcgtaaatatcctggagaatttctatcccctggagggcgggcgcgtcctgttagatggcaagcccatttctgcatacgatcataaatatttacacagagtaattagccttgtgtcacaagaacctgtgctgttcgctagatctattaccgacaacatttcttatggcttacccacagtgccattcgaaatggttgtggaagcagcacagaaagctaacgcccatgggttcatcatggagctgcaggatggctactcaacagagaccggggaaaagggagcccagctgtcgggcgggcagaagcagcgagtcgcgatggcaagggccttggtgcggaatcctcctgtcctgatcctggacgaagccacttcagccctcgatgcggagagcgaatacctgattcagcaagcaatccacggcaacctgcagaaacatacggttcttatcatagcccataggctgtctacagttgagcacgcccacttaatcgttgtgcttgataaaggtagagttgtccagcagggtacccaccagcaactgttggcacagggtggactgtatgccaaacttgtccagagacagatgctaggcctgcaacccgccgctgattttacagcaggtcataacgaaccagtggctaatggatcacacaaggcttag

SEQ ID NO: 109200 - DNA, 2301 bp, Artificial Sequence
  Description of Artificial Sequence: Synthetic coding sequence
atgcgattgtggaaagctgtcgttgtaacactcgcgtttatgtcggttgacatatgtgtgacaacggccatctatgtgttctcacatctggacaggtcattgctagaggacattcggcatttcaatatattcgacagtgtcctcgacctttgggccgcatgcttgtaccgcagttgtctcctgctgggggcgaccatcggagttgccaagaactcggcacttggccccaggcggctgagagcctcctggctagtgattacacttgtgtgcctgttcgtcggaatctacgccatggtcaaattattgctgttttcagaggtgaggcgccccataagggacccttggttttgggccttatttgtgtggacttatatcagtttaggagcttcgtttctgctgtggtggttgctgtcaacagtgagacccgggactcaggctttagaacctggcgcggcaactgaagccgaaggattccctggttctgggcgccctcctcctgagcaggcaagtggcgctacgttgcaaaagctgctctcttacaccaagcctgacgtcgccttcctggtggctgcgtccttcttccttatcgttgccgctctgggcgagacatttcttccctactatacaggccgcgccattgatgggatcgtaatccaaaagagtatggaccagttctcgaccgctgtggtaatcgtgtgtcttctggctattggcagcagttttgctgcgggaattcgtgggggtatattcacacttatcttcgcccgcctgaacatcaggcttcgaaactgcctattcagatcattggtatcccaggagacttcattttttgacgagaatcgcacaggcgacctcatatcccggctcacttctgataccaccatggtgagcgatttagtgagtcagaacattaacgtcttcctgagaaatacagtgaaagtgacgggggtggtcgtgttcatgttctctctgtcttggcaactatctttggtgacttttatgggctttcccatcatcatgatggtttcaaacatttacgggaaatattacaagaggttatctaaggaagttcagaacgcactcgcccgagcctctaataccgccgaagagacaatttcagccatgaaaacagtgcggtcgttcgcgaacgaagaggaagaggctgaagtctacctgcgcaaactgcagcaggtgtacaagctcaaccgcaaggaggcagctgcatacatgtattacgtgtggggatctggcctgacactcttggtggtgcaggtgtctatcctgtactatggagggcacctggtcatctccggccagatgacgagcggaaatttaattgccttcattatttatgaattcgtcctgggcgactgtatggagtctgtcggaagtgtatattctggcctaatgcagggtgtgggagctgctgaaaaagtttttgaatttatcgataggcaacccacgatggtgcatgatggatccctcgccccggaccacctcgaaggtcgggtggactttgagaatgtcaccttcacctacaggacaagaccacatacacaagtcctgcagaatgtatccttctccctctctccaggtaaagtcacggctctggtaggcccctcaggaagcggaaagagcagctgcgtgaatatcctcgagaacttctatcccctcgagggcggacgcgttctcctagatggaaagcctatctcagcctatgaccacaagtacctgcaccgagtgatctctctcgtctctcaggaacctgtcctctttgcaaggagcatcaccgacaacatcagttacggcctgccgaccgtcccatttgaaatggtagtggaagcggcacagaaggcaaacgcgcacggcttcatcatggaactccaggatgggtacagcactgaaactggggagaagggagcacagctgtctggcgggcaaaaacagagggtcgccatggctcgcgccctggtgcgcaatccccctgttttgattcttgatgaggccacgagtgcgctcgacgccgaaagtgagtaccttatccaacaggcaattcacgggaacttgcagaagcataccgtgctcattattgcacaccgcctctccacggtcgaacacgcacatctgatcgtggtattggacaaaggaagagtggtccagcagggcacccatcagcaattattggcgcaaggcggcctgtacgctaaactcgtccagagacagatgcttgggctacagcccgcagccgatttcaccgcgggtcacaatgaacccgtcgctaacgggtcccataaagcttag

SEQ ID NO: 109201 - DNA, 4395 bp, Artificial Sequence
  Description of Artificial Sequence: Synthetic coding sequence
atgtgtctgctggtgttcccgctagtcccgaggtcccctgactatatccttccgtgcagcccaggctggagacttcgcttagccgcttcatttcttctctctgtattccccctcctggacttgctgcctgttgccctgccgccgggggctggccccggccctatagggctcgaggttcttgcaggctgcgttgcagcagtggcatggatatcccatagcttggcgttgtgggtactggcccacagcccacatggccattcacgaggccccctggccctggctcttgtggcgctactacctgcacccgccctggtcttgactgtcctctggcactgccagcgcggcacccttttaccaccacttctccccggaccgatggcccgcctgtgcctgctcatattacagttagcagcgctattagcctatgcattaggatgggccgctccaggcggtcctagggaaccatgggctcaagagcccctcttacccgaagaccaggagcccgaggtcgccgaggacggtgagtcatggctgagccgcttctcctacgcttggctggccccgctcctcgcccgaggggcctgcggtgagttaaggcagccccaggatatttgtagattgcctcaccgactgcaaccgacgtatctggctcgagtatttcaggctcattggcaggagggagcacggctctggcgagcactctacggggccttcggaaggtgctatctggccctcgggctgctgaagctggtgggcaccatgcttggattttcagggccgttattgctcagccttctcgtgggattccttgaggagggtcaggagccactctctcatgggctcctgtatgccctggggttggccggtggcgccgtcttgggcgcggtattacagaatcagtacggttacgaggtctataaagtgaccttgcaggcccgtggcgccgttctcaatatcctgtactgtaaagccctgcaactgggaccctctcgacctccaaccggcgaggctctcaatctgctgggtacagactctgagagacttcttaacttcgcagggtctttccatgaggcttggggcctgccactccagctggcaattacactttacttgctctatcagcaggtcggcgtggcctttgtcggcggcctgatactggctcttctgcttgtgccggtaaacaaagtgattgccacccgaatcatggcaagtaatcaggaaatgctccagcataaagacgctagggttaaattagtgacggaacttttgagcgggatcagagtgattaaattttgcggatgggagcaggcactgggtgctcgcgtggaggcatgcagagcacgggagttaggcagactcagagtgataaagtatctcgacgcagcctgcgtgtacctctgggccgccttgccagtcgttataagcatcgtgattttcatcacctacgtcctaatgggacatcagctgaccgccaccaaggtcttcacagcactggccctggtgagaatgttgatccttccattgaataatttcccttgggtcatcaacggcttgctggaggctaaagtatcactggaccgaatacaactgtttcttgatctgccaaatcataatccacaagcgtactactctccggactgcggcagactcggcgctcagatcaagtggttactttgttctgacccccccgcagagccctctaccgtgctggaattgcatggggccctattctcctgggatcccgtgggcacctcattagaaacctttatctctcatctggaagtgaagaagggaatgctggtaggcatagtggggaaagtcggttgcggaaagtcctcattgctcgcggctatagccggggagttacaccgtctgaggggtcacgtggccgtgaggggtcttagtaaaggatttggacttgcaacgcaggaaccatggatccagttcgcgacaattcgggataacatcttgtttggaaagacttttgatgcgcagctgtataaggaggttctggaagcttgcgcccttaatgacgacctaagcatattaccggcaggcgaccagaccgaagtgggcgagaagggcgttacactcagtgggggccagagagcccgcattgccctcgcacgtgctgtgtaccaggaaaaagaattgtatttactcgacgacccactcgccgctgtggacgccgatgtggctaatcatctattacatagatgtatcttgggcatgctgagctacaccactcgactcctatgcacccataggaccgagtatctggagagggcggacgctgtgttactgatggaagcaggtcgtctgatccgcgcaggcccccccagcgaaatattgcccctagtccaggccgttcccaaggcttgggccgagaatgggcaggaatctgactcagccaccgcccagagcgttcaaaacccagaaaagacgaaagaaggtctcgaggaggaacagagtacgtctgggcggttactccaggaggaaagcaagaaggagggcgctgtagccctgcacgtgtaccaggcctattggaaggccgtcgggcaaggccttgctctggcgattctgttctctctactactaatgcaggctacacgaaacgccgctgactggtggctgtctcactggataagtcagttgaaggccgaaaactctagccaggaggcacagccctcaaccagtcccgcatccatgggactgttctcaccgcagctcctgctcttttcccccggtaatctatatatcccggtgtttccattaccaaaggcagccccgaacgggagctccgacattcggttctacctgacagtgtatgccactatcgccggcgtgaattctctctgtaccttattgcgggctgtgttattcgctgcaggtacactccaagccgctgcgaccctgcacaggaggcttctacatagggttctcatggcgcctgtgaccttttttaatgccacccccacaggccgcatcctgaatcggttctcctcagacgtggcatgcgcagacgatagccttcccttcatacttaatattttgttggccaacgctgccggcctgctgggccttttagccgtcctcgggtctggcctgccttggctgttgctgctgctgccccccttgagcatcatgtattatcacgtgcagaggcactaccgcgccagttctcgcgagctacgaagattaggcagcttaacattgagcccactgtactcacatttggccgataccctggccggattgtccgtattacgcgctaccggtgccacttataggttcgaagaggaaaacctgagacttctggagctcaatcagcgctgccagtttgcaaccagtgcaacgatgcagtggctggacattagactccagctgatgggggcagcagtggtatcagcgatagccggaatcgctctggttcagcatcaacagggcctggccaatccgggattggtaggcttgtcattatcctacgccttatcattaaccggcctgcttagcggcctggtgtcttcctttacccagaccgaagcaatgttggtttccgtggagagactggaagaatacacctgcgacttgcctcaggagccccagggacaacccttgcagctgggtactggatggctgactcagggaggtgtggaatttcaagacgtagtgctagcttaccggcctggcttgccgaatgctttggatggcgtgacattctgcgtgcagccgggtgaaaaactgggaatcgtgggtagaacagggtccggtaaatcttctctcctgctcgtgctctttcgtctcctggagccctcctctggaagagtcctgctggatggggtggatacctctcagctcgagctggcccagctccgaagccagctcgccattatcccccaagaaccctttctgttttccggaaccgtgcgcgagaatctggatccgcaagggctacataaggacagagccctgtggcaggcgctgaaacagtgccacctgtcagaagtgatcacttcgatgggcggcctcgatggcgaactgggcgaggggggacggtctttgtctctgggacaacggcagttgctctgcttagctagagccctgcttactgacgccaaaatactgtgcattgatgaggcgaccgcctctgtagaccagaagactgatcagctgctgcaacagacaatttgcaaacggtttgccaataagactgtcttaactatcgcccaccgccttaacactattctcaacagtgaccgagtacttgtgctgcaggccggcagagtagtggagctggactcccctgctacactgcggaaccagccgcactcactctttcagcagctccttcagagtagtcagcaaggagtccccgcttcgctcgggggcccttag

SEQ ID NO: 109202 - DNA, 4479 bp, Artificial Sequence
  Description of Artificial Sequence: Synthetic coding sequence
atggagcgactgctggcacagctgtgtgggagctcagctgcgtggcctctgccactgtgggaaggagatacaactggccactgcttcacacagctcgtcctgtctgcccttccacacgctctcttagccgtgctctctgcctgctacctgggtacccctagatccccagactatatcttaccctgttcaccaggatggaggctgaggttggcagctagcttcctgctgtcggtctttccgctgttggaccttctgcccgtggcactgcctcctggcgctggacccgggcccattgggctggaagtcctcgctggctgtgtagcggcggtagcttggatctctcactccctggccttatgggtcctggcccattccccccatgggcactccagaggacctctcgcactcgccctagtggctctcttgcctgccccggcactggttctaaccgtgttatggcactgtcagcggggcaccctgctgccccctctactccccggccccatggcgaggctgtgtctcctcatactgcaactggcagctctcttagcctacgctctgggctgggccgccccgggcggcccaagagagccctgggcccaagaacctctgttaccggaagaccaagagcccgaagtggccgaggacggagagtcgtggctatctagattttcgtatgcgtggctggctccgctgttagccagaggcgcctgcggtgagcttcgccagccacaagacatctgccgcttgcctcacagactgcagcccacctatctggcaagagtctttcaagcccattggcaggaaggggcccgcctgtggagggccttgtatggagcctttggccggtgttaccttgcgctgggcttgttaaagcttgttggcaccatgctaggtttcagtgggcctctcttactctcgctgctcgtggggtttttggaagagggacaggagcctctgagccacggactcctatatgccctaggcttggccgggggtgcggtgctcggcgcagttctgcagaaccagtacggatacgaggtctataaggtgaccctgcaggctcggggcgccgtcttgaacattctgtattgcaaagccctgcagcttgggccttcccgccctcccaccggcgaggccctaaacctgctggggacagatagcgagaggctgctcaactttgctggttccttccacgaggcctggggcctcccactacagctggcaataaccctgtacctgttatatcagcaggtgggcgtggccttcgtggggggtttaattctagccctactgctggtcccagtcaataaggtcattgccacgaggatcatggcctctaaccaggagatgctacagcataaggacgccagggtgaagcttgtcaccgagctcctttcagggatcagagttataaaattctgcggttgggagcaagccctcggagcacgggttgaggcttgtcgggcgcgcgaactcggccggttgcgtgtaatcaagtatcttgatgccgcctgtgtatacttgtgggccgcccttcccgtggtgataagcattgttattttcatcacatatgtgctgatggggcatcaactaaccgcaaccaaagtctttactgcactagccctcgttagaatgcttattctgcccctgaataatttcccctgggtgatcaacggattgctagaagctaaggtatccctggataggattcaactatttctggacctgccaaatcataaccctcaggcctactattcaccagacccgcccgcagaaccatccactgtactggaactccacggagccctgttctcctgggacccggtggggacctccctggagacattcatttcacacctggaggtgaaaaagggcatgttagttggaatcgtgggaaaggtaggatgtggcaaatcaagtctcctggccgccatcgcaggggagctgcacagattgcgcggacacgttgccgtgcgcgggctaagtaagggatttggcctagcaacacaggagccttggattcagttcgcaacaattagagacaacatcctctttggcaagaccttcgatgcccagctgtataaggaagtgctggaagcatgtgcccttaacgatgatttgtcaatcctcccagcaggagaccaaacggaggttggagagaaaggtgtgacgctgtccggggggcaacgggcgcggatagccctcgcccgagctgtctaccaagagaaagaactgtatctacttgacgatccgctcgcggccgtagacgcagatgtcgcaaaccatctgcttcatcggtgcatcttggggatgctgtcttataccacccggcttttatgcactcaccggactgagtatctcgagcgggcggatgcggtgctgttaatggaagcaggcaggctgatccgtgctggcccaccaagtgagatcctgcctctggtccaagcagtaccgaaagcttgggctgagaatggccaggaatccgacagtgccactgctcagagtgtgcagaaccccgaaaaaacgaaggagggactagaagaagagcagagcacttccggcaggctgttacaggaggaatcaaagaaagagggcgcagtagctcttcatgtctatcaggcttattggaaagccgtgggacagggacttgcactggcaatcctgttcagtctgctgctgatgcaagcaacacgcaatgcggccgattggtggctgtctcactggatcagtcagctgaaggctgaaaactcttctcaagaagctcagccttcaacatcgccagcctcaatgggtctgttttcaccccaattgctcctgttctcgccgggcaatctctatatcccagtattcccgctgcctaaggccgcacctaatggcagttccgacattcgattttacttgacagtctatgccaccatcgccggcgtcaacagcctctgtacgctcttaagagccgtcttatttgctgcaggtacacttcaggcagcagcgaccctgcaccgccggctcctccaccgcgttctgatggccccagtgaccttctttaatgccactcctactgggagaatcctaaatcgcttttcatctgatgtggcctgcgccgatgatagtctccccttcatcttgaacatcctcttggccaatgccgcaggactccttggtctcctggctgttttggggagtggtctgccatggctgttgcttctgctgccaccgctttctatcatgtactaccacgtccagagacattatcgagcctcttcacgagagctgcgccgattgggtagcctaaccctgagccccctttattctcatctggccgacacactcgccggcttaagtgtgctgcgggccactggagccacttacagattcgaggaagaaaatttacggctgctggagctcaatcaaagatgccagtttgccacttctgcaaccatgcaatggctggacattagactccagctcatgggagcggccgttgtgagtgccattgcaggtatcgcgctagtgcagcatcagcaaggtctggccaacccaggattggtggggctgtccctaagctacgctctctccctgacgggactgctgagtgggttggtgtccagtttcactcagacggaggccatgctggtgtcagtcgaaagactcgaggaatacacatgcgacctgcctcaggaaccacaaggtcaacctctgcaattggggaccggctggctgacacagggcggtgtcgaattccaggacgtggtccttgcctatagacctgggctcccgaacgccctggacggcgtcaccttttgtgtgcagcctggtgaaaaactgggcatcgtggggcgcactggctctggcaagagttccttactcttggttctgttccgactgctggaaccgagtagtggacgggtacttttggacggggtggacacatctcagctagagttggcccagttacggtcccagctcgccatcatcccgcaggagccattcttattctcaggaaccgtcagagagaaccttgatccacagggactccataaagacagagcattgtggcaggccctgaaacagtgccacctgagcgaggtgataacttccatgggaggcttggacggggagctgggagaaggcggcaggtcattgtcactgggtcagcggcagttgctgtgcctggcgagggcgctgctcacagacgctaagatcctgtgcatcgacgaggcaacggcttctgttgaccagaaaaccgatcagctactccaacagacaatctgcaagcgattcgccaacaaaacagtgttaacaattgcacataggcttaacaccatcctcaattccgaccgagtcctagtcctgcaggccggtagagtagtcgagctggattcgcctgccacactgcgcaatcagccacattctctgtttcagcagcttttacaatcaagtcagcagggggtgcctgcctcgctcggaggcccttag

SEQ ID NO: 109203 - DNA, 4035 bp, Artificial Sequence
  Description of Artificial Sequence: Synthetic coding sequence
atgacaagaaagcggacatattgggtgccaaattccagcgggggacttgtcaatcggggcattgacattggcgatgatatggtcagcgggttgatctacaaaacatatacactgcaagatggaccttggtcccagcaggagcgaaatcccgaagccccaggtagagccgccgtgcctccttggggaaaatatgacgctgcactacgaaccatgattccattcaggcccaaaccacggtttcctgccccacagcccctggacaatgcaggcctcttctcatacctgacagtgagttggttaacgccactgatgatccagtcgttgcgctcccggcttgacgaaaacactatcccccctctgtccgttcacgatgcctctgacaagaacgtgcagaggttacatagactgtgggaggaggaggtgtctagacgcggtatcgagaaggcctcggttttgctcgtgatgctgaggtttcagcggactcgcctcatctttgatgccctgctaggcatttgcttctgtatcgctagcgttctaggacccatattgatcattccaaaaatcttagagtattccgaggagcagcttggtaatgtggtccatggggtcggcctttgctttgcacttttcctgtcggaatgcgttaagtccctgtctttttcctcatcctggataatcaaccaacgcactgcaatccgcttccgtgccgctgtcagctcttttgcctttgaaaaactgattcagtttaaatcggtgatccatataacaagcggagaagctattagcttctttacaggggacgtcaactacctctttgaaggtgtctgttacggtcctctggtcctcatcacttgcgcctccctagtgatctgttcgatcagtagttatttcattattggctacacagcctttattgcgatcctgtgctatctacttgtattcccccttgcagtcttcatgacccgcatggcagtgaaggctcagcaccacacttccgaggtctccgaccagaggataagggtaaccagtgaggtcctgacttgcatcaagttgatcaagatgtatacttgggagaaaccatttgccaagattatagaggacttgcgtcggaaagagcgcaaactgctggagaagtgtggactggtgcagtcattaacatctatcactctgttcatcatcccaaccgtagccaccgctgtgtgggttctgatccatacatccctgaagttaaagctcaccgctagtatggcttttagtatgcttgcgagccttaacctgctgaggttgagcgtgttcttcgtgccgatagccgtaaaaggactaactaactccaagtctgcagttatgaggttcaagaagtttttcctgcaggaaagtccagtgttctatgtccaaaccttgcaggatccctctaaggctttggtcttcgaagaagcaacactctcatggcaacagacatgccccgggattgttaacggcgccctcgaactggaacgcaacggtcatgcaagcgagggcatgacacgaccgagggatgctctaggaccagaggaggaaggcaattcgttgggccccgagttgcataaaatcaatctagtcgtaagcaaaggcatgatgctgggcgtgtgtggaaacactggaagtgggaagtccagtcttttgtcggccattctagaggagatgcatctgcttgagggtagtgtgggggtgcagggctccttggcctatgtgccgcagcaggcctggatcgtctcagggaacataagggaaaacattctaatgggaggcgcctacgataaagcccgatacctccaagttctccactgttgcagtctgaaccgcgacctcgagctattaccctttggggacatgacggagattggtgaaagaggcctgaacctgagtggggggcaaaagcagcggattagtctggcccgagctgtctactccgatcgacagatttatttgctggacgaccccctgagcgctgtggacgctcacgtggggaagcacatttttgaagagtgtataaaaaaaacgttgcggggcaagaccgtcgtcctggtgacacaccaacttcagtatttggaattctgcggccaaatcatcctgctggaaaacggcaagatctgcgagaatggcacccacagtgaattgatgcagaagaaagggaagtatgcacagcttattcaaaaaatgcataaggaagctacgtctgacatgctgcaggataccgccaaaatcgcggagaagcctaaagtcgagtcacaggcgctcgctacctccctggaggaatccttaaatgggaatgctgtccccgagcaccagttgacgcaagaagaagagatggaagaaggcagcctgagctggcgcgtgtaccaccattacatccaggcggctggcggctacatggtgagttgcattatttttttctttgtcgttttaatagtcttcctcactattttctcattttggtggcttagctattggcttgaacagggttcgggaacaaacagctcccgggaaagcaatggaaccatggcagatcttgggaacatagccgataaccctcaactttctttttaccaacttgtgtacggcttaaacgctcttctgctgatctgtgtcggagtatgctctagcggcattttcacaaaggtaacccggaaagcctctacagccctgcacaacaaattgttcaacaaggttttccgatgcccgatgtcgttcttcgacactattccaattggccggctcttgaactgctttgctggcgatctcgaacagttggaccaactgctgcctatcttcagtgagcagtttctggtgcttagtctgatggtcatagctgtgctgcttatcgtcagtgtactttctccatacatcttactgatgggcgccataatcatggttatatgctttatttattacatgatgttcaaaaaggccattggcgtctttaagcggcttgaaaactactcacggagccccctgttttctcacatcctcaattccctgcagggcctctccagcattcacgtctacggaaaaaccgaggactttatctcacaattcaagcggctcaccgatgcacagaacaattaccttctgttgttcttaagcagtacccggtggatggccctcagactggagatcatgacaaatctggtgactttggccgttgccttatttgtggctttcgggatctcttcgacaccctattcgtttaaggtcatggctgttaacatcgtgcttcaactggcctcttctttccaggcaaccgcacggatcggactggaaactgaagcacagttcacagccgtcgagcgtatccttcagtacatgaaaatgtgtgtgagcgaggccccactacatatggagggcacctcgtgtcctcagggctggcctcagcacggcgagataatatttcaggattatcacatgaaatatcgggacaacactccaaccgtgctgcacgggatcaacttgacaatcagagggcacgaagtcgtaggtatcgttgggcgcaccgggagcggcaagtcttcgctgggcatggccctttttcgcctcgtcgaacccatggccggccgtatcctgatcgacggggttgatatctgctcgataggtctggaagacctcagatctaagctcagcgtcattccccaagacccggtactgttgtctggtacaatccgctttaatttagatccgttcgataggcacaccgatcaacaaatctgggacgccctggaacgaacctttttgacgaaagccattatcttgatcgacgaagccaccgctagtatagatatggagaccgacaccctcatccagcggactatcagggaggccttccagggatgcacagtcctcgtcatcgcgcatagggttactaccgtgcttaattgcgaccacattctcgtcatgggtaatggcaaagttgtcgagttcgacaggccagaggtgctgcgaaaaaaaccaggctccttatttgcagctcttatggctactgctacctcgtcactgcgatag

SEQ ID NO: 109204 - DNA, 4149 bp, Artificial Sequence
  Description of Artificial Sequence: Synthetic coding sequence
atgacacgcaagcgcacctactgggttcccaactcaagtggggggctagttaataggggcatagatatcggggatgatatggtgtcaggactcatttataagacctacaccctccaggacggaccatggtctcagcaggaacgtaatcccgaggcccccggaagggcagctgtccctccctgggggaaatacgatgctgcacttcgaacaatgatccccttccgccccaaacccaggttccctgctcctcagccactggacaacgcgggcttgttcagttatctgacagtgagctggctgaccccactgatgattcagtccctgcggagccgcctcgatgagaacactatcccccctctgtccgtgcatgatgctagcgacaaaaacgttcagcggttgcatcgattgtgggaagaagaggtcagtagacgcgggattgaaaaggcgtcggtgttactggtaatgcttagattccagcggacccgcctgatatttgatgcacttctgggcatttgtttttgtattgcctccgtgttgggccccattttgatcatcccgaaaatactcgagtattcagaagagcaactgggtaatgtggtgcacggcgtgggcctctgtttcgctctgtttctgtctgagtgcgtgaaatcgctctctttttcaagcagctggataataaaccaaaggacggcaataagatttagggcggcagtaagcagcttcgctttcgaaaagctcatccagttcaagagcgtgatacatattacatctggcgaggcaatcagcttttttactggggatgtgaattatctgttcgaaggagtctgttacggtcccttagtgcttataacttgcgcctcgctggtcatttgctccatctcgtcctacttcattataggatataccgctttcattgcaattctgtgctatctgctggtgttccctctggcggtcttcatgactagaatggccgtcaaagcccagcatcacacctctgaagtgtccgatcagcgcatccgggtgacgtcagaggtgctcacctgcatcaagcttattaagatgtacacctgggaaaagcccttcgctaaaatcatcgaggacctgagacgaaaagaacgcaagctcctcgagaagtgtggcttggtgcagtccctaacgagcattactctgtttatcatccctactgtggccacagctgtctgggtgcttattcacacgagcttgaagctcaagttgaccgccagtatggcattcagcatgctggcctccctaaacttgctccggctgagtgtgttttttgtgcccattgctgtgaagggccttaccaactccaagagcgccgtaatgcgctttaaaaaattttttcttcaagagagccccgtgttttatgtgcagacgcttcaggacccgagtaaagccctagtgttcgaggaagcaactctgtcctggcaacagacatgcccgggcattgtgaacggcgctctggagctagagagaaatgggcacgcctccgaaggaatgactagaccccgcgatgctcttggaccagaagaagagggcaatagtttaggccccgagttacacaagataaacctcgtggtgtcaaagggaatgatgctcggagtgtgcggaaataccggaagtggcaagtctagccttctgtctgctattctcgaagagatgcacttgctcgaaggctcagtgggtgtgcagggttcactggcctatgtcccacaacaagcctggatcgtgtcagggaacatcagggagaatatcctgatggggggggcctacgacaaagctcggtacctccaggtgcttcactgttgctcactcaatagagatctcgagctgctgcctttcggcgatatgacagaaataggggaacggggattgaacctctccgggggtcagaaacaacgcatttcactagcccgcgctgtatactctgataggcagatctacctgctggacgatccattgtcggcagttgacgcacacgtcggaaagcatatatttgaggagtgcattaagaaaacattgcgcggaaagacagtggtgctggtaacacatcagctacagtatctggaattctgcggccaaattatcctgctggaaaatggcaaaatttgtgagaatggcacgcactctgagctaatgcaaaaaaaagggaagtacgcacagctaattcagaagatgcataaggaggccacgagcgatatgctacaagacaccgccaaaatcgccgagaaacccaaagtcgagtcccaagccttggccaccagtctagaggaatcactcaatggcaatgccgttcctgagcaccagctgacacaagaggaggaaatggaggagggatccttgtcctggcgagtgtaccaccactatattcaagccgccgggggttatatggtgtcctgcatcatatttttttttgtggtgctgatcgtcttcctgaccattttctcattttggtggttgagctattggctggaacaaggtagtggaacaaatagcagccgagaatccaatgggacaatggctgatctcggaaacattgcggataaccctcaactgtcattttaccagctcgtctatggcctcaatgcgctgctcttgatatgtgtaggagtatgctcttccggtatatttaccaaagtgacaaggaaggccagtaccgccctgcataacaagttattcaacaaggtgttcaggtgtcccatgtcttttttcgataccatcccaattgggcgacttctgaactgctttgccggagatctcgagcagttggaccagttgttacccatttttagcgaacagttcctggtgttatctttaatggttatagctgtcctcttaatcgtttccgtgttaagcccctacatactactcatgggggcaataatcatggtgatctgcttcatctattatatgatgtttaagaaggctatcggcgtcttcaaaaggctcgagaactattctcggtcccctctgttttctcacatattaaacagtctgcagggtctctcctccatccatgtgtacggaaagactgaggacttcatctcccagttcaaaaggttgacagacgctcaaaataattacctgttgctgttcctctcttccacgaggtggatggctctgcgactggagattatgactaatcttgtaaccctcgccgtggcgctattcgtggctttcgggatttctagtactccctacagttttaaggtgatggcagtcaatattgtactgcagctggcctcaagcttccaggctaccgcccggatcgggctcgagacggaagcccaattcaccgctgtcgagagaatcttgcagtacatgaagatgtgcgtttcagaggcgcccctgcacatggagggtacatcgtgtccacagggctggccacagcacggcgagatcatcttccaggattatcacatgaagtatcgtgataatacaccaacagtgttgcatgggattaatctaaccattaggggccatgaagtggtggggatcgtcgggcggactgggagtggaaagtcctcattgggtatggcactgtttcgactggttgagccgatggctgggcgtatcctcatcgatggcgttgatatctgtagcatcggccttgaagacttgcgttcaaagctcagcgtgatcccccaggaccccgtgctcttatctggtacaatccggtttaatctggaccccttcgaccggcacacagatcagcaaatctgggacgctttggagcggaccttcctgacgaaggctatctccaagttccctaagaagctccatactgatgtggtggagaacggtggcaacttctccgtgggcgagagacagctgctgtgtattgccagggccgtgctgcgaaacagcaagatcattctgatcgacgaggccacagcaagtatcgatatggaaacagatacactgattcaaaggaccatacgggaagcgttccagggctgcaccgtgctggtcatcgcacatagggtgacaacagtcctcaattgcgatcacatcctggtaatgggaaacggaaaagtggtggagtttgaccgtcctgaagtcttgagaaagaagccaggctccctgtttgcagcgcttatggcgaccgccaccagctctctgaggtag

SEQ ID NO: 109205 - DNA, 4149 bp, Artificial Sequence
  Description of Artificial Sequence: Synthetic coding sequence
atgacacggaagcgaacctattgggtgcccaacagtagtggcgggctggtgaatcggggaatcgacatcggagacgacatggtctccggattgatctataagacatatactctgcaggatgggccgtggtctcagcaggaaaggaatcccgaagcacccggacgcgccgccgtgcctccttggggcaaatacgacgctgcactgcgcaccatgattccgttccgacccaaacctagattccccgctcctcagccactggacaacgccggactgtttagctacttaaccgtaagctggctgaccccattgatgattcagtctctccggtctcgcctggatgaaaacacaatccctcctctatccgtgcatgacgcctcagacaaaaatgtgcagcgtctgcaccggctgtgggaagaggaggtgtcccgacggggcattgagaaagcaagcgtgttattagtgatgctgaggtttcaacggactagactgatctttgatgcacttttgggcatatgcttctgcattgcgtcagtgcttggccctatcctgatcatccctaagatattggaatattccgaggaacaactaggcaacgtggtacatggagtaggtctgtgcttcgctctctttctcagcgaatgtgttaaaagcttgagcttctcttcaagctggatcattaaccagcggaccgctattagatttagagccgctgtgtcctccttcgcatttgagaagctgatccagtttaagagcgtgatccacatcacatcgggagaggctatcagcttctttaccggagacgttaactatctttttgaaggagtctgttatggcccgctcgtgctgatcacttgcgccagcttggtgatttgctccatctcaagctatttcatcattgggtacaccgcctttattgctattttgtgttatctgctagtttttcctctggctgtattcatgacgcggatggccgttaaggcccagcaccatacaagcgaagtttccgaccagcggattcgtgtcactagcgaagtgctgacttgtattaagctcattaaaatgtacacctgggagaagccgttcgctaaaattatagaagatttgaggcgaaaagagcgaaagctgcttgaaaagtgcggcctcgtgcagtccctgacaagcatcacactgttcatcatcccaacagtcgcaactgccgtgtgggtgctgatccatactagcctcaagcttaaactgaccgcttcaatggcattttctatgctggctagcctgaatctgctccgactttcagtcttctttgttcccatcgcggtgaaaggtttgaccaattcgaaatcagccgtgatgagattcaagaagttcttcctccaggagtctcctgttttttacgtgcaaacactgcaggaccccagcaaagccctggttttcgaagaagccaccctctcttggcagcagacctgcccgggtattgttaacggtgctttagagctagaacgcaacggccacgcctccgaggggatgacaagaccaagggatgccctgggccctgaagaggaagggaattcgctgggaccagagctgcataagatcaatttagttgttagtaaaggcatgatgctcggcgtgtgtgggaacacaggatctggcaagtcttccttgctcagtgcaattttggaagaaatgcatctgctggaagggtccgtgggagtccagggctcactcgcctacgtgccgcagcaagcctggatagttagcggcaacataagagagaacatcttaatgggcggcgcatatgataaagccagatacctgcaggtactccattgttgctccttgaaccgtgacctagaactcctaccctttggggacatgaccgagattggagagaggggcctgaacctctccgggggccagaagcaacgtattagtctggcgcgcgcggtgtacagcgacaggcaaatttacctgctcgacgaccccctgagcgctgtggacgctcacgtcggaaagcatattttcgaagaatgcataaaaaaaactctgaggggaaagacagtggtgcttgtaacacaccagcttcagtacctagaattttgtggccagatcattctgctggagaacggaaagatctgcgagaatggcactcacagcgagctgatgcagaagaaaggaaagtatgcccagctcatacagaaaatgcataaagaggcaacgtctgatatgctgcaggacaccgctaaaatcgctgaaaagcccaaagttgagagccaggccctcgccaccagcctcgaggaatctctgaatggcaacgcggtacctgaacaccagctaacacaggaagaggagatggaagaaggctccctgtcatggcgcgtgtaccatcattacatccaggccgctggcggctacatggtgagttgcattatcttcttctttgtggtgctcatcgtattcttgactatcttttccttctggtggctgagttattggctcgaacaggggtctggcactaatagttctcgggagtctaatggcacaatggccgacctaggaaacatagccgacaatcctcagcttagcttctatcagcttgtatacggactgaacgccttgcttctaatctgcgtgggagtttgcagcagtggcatcttcaccaaagtcacacgaaaggcttctacggccctgcataacaaattattcaataaagtattcagatgtcccatgtccttcttcgacactatcccaatcggcaggcttctcaactgtttcgctggtgatctggaacagttggaccagctgctacccatatttagcgagcagttcctcgtgctcagtctgatggtgatcgcagtgctgctcatcgtgtcagtcctaagtccatacatcttgctaatgggcgcgataatcatggtgatttgttttatatactacatgatgttcaaaaaggcgatcggcgtgttcaaacgtttggagaattacagccggtctcccttgttcagccacatcctgaatagtcttcagggcttgtcttctatacatgtgtatggtaaaaccgaggattttatctcccagttcaaacgtctgaccgatgcacaaaataactacctgctgctgtttctgagctcaacccgttggatggctctcaggctggagattatgaccaacttggtgactttggctgtggcgctttttgtggcttttggcatctcctctaccccgtacagctttaaagtcatggctgttaacattgtgttacagttggcttcctcgttccaggctaccgctagaattggccttgagaccgaggcgcagtttactgccgtcgaacgtatccttcagtatatgaagatgtgtgtttctgaagcaccgctccacatggaaggaacctcctgtccacaggggtggcctcagcacggggagattatctttcaggattaccatatgaaatatagagataatacacccactgtgctgcacgggataaacctcactattaggggacacgaagtagttggaatagtgggtaggacagggagcggaaagtcttctcttggaatggccctgtttcgtttagtggagccaatggccgggcgtatcctcattgatggtgtggatatttgcagcattgggctagaggacctgaggtccaagctgtcggtaataccacaggaccccgtgctgctgtcaggaacaatccggttcaatctcgacccatttgaccggcacacagatcagcagatctgggacgccctcgagcgaacattcttaaccaaggccatttctaagttcccgaagaagttgcacaccgacgtggtggaaaacggaggtaacttcagtgttggagagcggcaattattgtgtattgctcgtgcagtcttgcgtaattcaaagatcattctcatagacgaagccactgcttcgattgacatggagacagatacactgatccaacgcaccatccgagaagcattccaggggtgtactgtgcttgtgatagctcaccgagtgaccacggtgctcaactgcgatcatatactggtgatgggtaatggtaaagtggtggagttcgaccgccctgaggtgttacggaagaagcccgggtcgctgttcgctgccctcatggctaccgctacgtcctccttgaggtag

SEQ ID NO: 109206 - DNA, 4149 bp, Artificial Sequence
  Description of Artificial Sequence: Synthetic coding sequence
atgacgaggaaaagaacctactgggtgcccaacagcagcggcggacttgtcaatcggggcatcgacataggggatgacatggtgagcgggctgatctacaaaacatacaccttacaggacgggccctggagtcagcaggagcgcaaccccgaggcacccggacgggccgcagtccccccgtggggaaagtatgacgctgccttaaggactatgatccctttccggcccaaacctcgcttccctgctcctcagccactggataatgcgggcctcttctcttatttgacagtgtcttggttgacccccctgatgattcagagcttgaggagccgcctggacgagaatactatcccacccttatccgtccacgatgccagtgacaaaaacgttcagcggctgcaccgactttgggaggaagaggtatctcgaagaggcattgagaaagcctctgtgctactcgtgatgttgcgctttcagcggacccggctgatattcgatgcgctcctgggcatttgcttttgtattgcttctgtcttaggccccatcctgattatcccgaagatcctggagtactctgaagaacagctcggcaatgttgttcacggggttggactgtgctttgcactgttcttatcggagtgtgtcaaatctttaagcttttcttcctcttggattattaatcagcgaacagctatccgatttcgggcggccgtgtcttctttcgcgttcgagaaacttatccaattcaaatccgtgatccacatcacatccggtgaggcaatcagcttctttacaggggatgtgaattatctttttgagggtgtatgttacggccccttagtactgatcacgtgtgcctcccttgttatatgttcgatcagttcctattttattattggttatacggcctttattgcgatcctttgttatctgctggtctttcccttggccgtgttcatgacccggatggctgtcaaggcccagcatcatacctccgaggtttccgaccagaggatcagggtaacaagcgaggtgttaacatgcataaagctaatcaagatgtacacttgggagaaaccattcgcgaagataatcgaagatttgaggcggaaggaacgcaaactgttggaaaagtgcggcctggtccaatcgctgacaagcatcactctcttcatcatcccaaccgtcgcaacagccgtgtgggtgctgatccatactagtcttaagttgaaactgaccgccagcatggcctttagcatgctcgccagcctgaatttgctacggctttccgtgtttttcgtgccaatagccgtaaagggtttgacaaatagtaagtcggcagtgatgaggttcaagaagtttttcctgcaggaatccccagttttttatgtgcaaacactgcaggatccatccaaagcgcttgtgtttgaagaagcgaccctttcttggcagcagacttgccccgggattgtgaatggagccctggagctggaaaggaatgggcatgcaagtgagggcatgacgcgcccgcgagacgctcttggaccagaggaagaggggaacagccttggcccagaactccataaaattaacttggtcgtctcaaagggaatgatgttgggtgtctgcggcaacactggcagcgggaagtcatccctgctgagcgccatccttgaagagatgcacctgttggaagggagcgtgggggtccagggctctctcgcatacgtccctcagcaagcatggatcgtttcaggcaacattcgcgagaatatcctgatgggcggggcatacgataaagccagataccttcaggttctgcactgttgttcactgaatcgcgacttggaactgctgccattcggagatatgacagagatcggtgaaagagggctgaacctgtcgggtgggcagaagcagaggataagtctggccagggcggtgtacagtgatcgacagatttaccttttagacgacccgctgagtgctgtggatgcccatgtggggaaacacatttttgaggaatgcatcaaaaaaaccttacgcgggaagacagtggtccttgttacacaccaattgcagtatctggagttctgtggccagatcattctccttgagaatggaaagatctgtgaaaatggcacacatagcgagctgatgcagaaaaaaggtaaatatgcgcaactgatacagaaaatgcataaagaggccacctcagatatgctacaggacaccgccaaaatcgcggagaagcctaaggtggagagtcaggcactagctacaagtctggaagaatctctgaatggaaatgcagtaccggaacaccagctaacccaggaagaggagatggaagaaggatctctgagctggcgggtttaccaccactatatccaggccgcgggtggctatatggtgagctgtataatattttttttcgttgtgctgatagtgttcctcacaatattttcattctggtggttaagttactggctggaacaaggctccggcaccaacagcagcagggaaagcaatggaactatggccgatctcggcaacatcgccgacaacccccagttgtcgttctaccagcttgtctatgggttgaatgcgctcctcctcatttgtgtaggagtttgttcgagcggaatcttcacaaaggtaacaagaaaagcaagcacagctctccacaataaacttttcaacaaagtgttcaggtgtcccatgtctttctttgacacaattccaattggtcggctgttaaattgctttgccggcgaccttgaacagcttgaccagctgctgcctatattttcagagcagtttctcgtcctcagtcttatggtcatcgccgtgctgctgattgtttccgtcctttcaccatacattctgttgatgggggccattatcatggttatctgtttcatctattacatgatgtttaagaaggccatcggggtttttaagcggctggagaactattcccgctcgccgctattttctcatattctgaacagcctgcaaggtctttcatcgatccacgtttatgggaagacagaagatttcatctcccagttcaaaaggctgacagacgctcagaataattacctgctcttgttcctgtcaagcactcgatggatggcgttaaggctggaaattatgaccaatcttgtgactcttgccgttgctcttttcgttgctttcggcatttccagcacaccctacagctttaaggtgatggcagtgaatattgtgctccaattggcttcttccttccaggccaccgcgagaatagggctggagactgaagcccagttcaccgccgtagagagaatcctacagtacatgaagatgtgcgtcagtgaagcccctctgcacatggagggaacgagttgcccacaaggatggccccagcacggggagatcatcttccaagactatcatatgaagtatagagacaacacacccacggtgctccatgggataaacttgaccattagaggacacgaagtggtaggcatagtggggaggactggcagcggtaaatcgagtttggggatggccttgttccgactggtcgaaccaatggcgggtagaatcttaatcgatggcgtcgatatctgcagcatcggactcgaagacttgcgatctaaactctctgtaattccccaggaccctgtgttgctgtctgggactattaggtttaatcttgaccccttcgatcgacacacggaccagcaaatatgggatgcactggagcgcactttcctgaccaaggccatatcaaagtttcccaagaagctccatacggatgtggtcgaaaatgggggcaactttagcgtcggggaaaggcaactcctatgcattgctcgggcagtgttgcggaactccaaaattatcttgatagatgaagccacggctagcatcgatatggaaacagacactctgatccaaaggacaatcagagaagccttccaggggtgtaccgtgttggtgatagctcacagggtaaccaccgtgttgaattgtgaccacatcctggtgatgggcaacggcaaggtggtcgagttcgacagacctgaggtgctaaggaagaaacctggctcgctgttcgccgccctaatggctaccgccacctcgagcttgagatag

SEQ ID NO: 109207 - DNA, 2268 bp, Artificial Sequence
  Description of Artificial Sequence: Synthetic coding sequence
atgactaggaaacgaacctactgggttcccaattccagcggggggcttgtgaatagggggattgatatcggggacgacatggtgagcgggctgatctataaaacatacaccctccaggatgggccgtggagtcagcaagaaagaaaccccgaagctcctggcagagccgctgttcccccatgggggaaatacgacgctgccctgcgtacgatgattcctttccgacccaagcccagattcccagctccgcaaccgcttgacaatgccgggctgttctcttacctgacggtctcctggttaaccccgctgatgatccagagtctccgcagtagattggatgagaataccatccccccattgtccgtgcacgatgcttccgacaaaaatgttcagcggttgcaccggttgtgggaagaggaggttagccgcagaggcattgagaaggcctcagtgctgctcgtgatgctgcgctttcaaaggaccaggttgatcttcgacgcgctcttaggaatttgcttctgcatcgcgagcgtgctcggacctatacttataatcccaaaaatcctggaatacagtgaggagcagctgggcaatgtggtccatggagtcggcctctgcttcgctctcttcctgtcagaatgtgtcaaatctctgtcattctcgtcttcatggattataaaccaaaggacagccattcgattcagggctgccgtgagctcatttgcatttgaaaagttgatccagttcaaatctgtgatccacatcacaagcggggaagctatttcattttttaccggtgacgttaattatctgttcgagggggtatgctacggacctctggtgctcatcacctgcgcatccttagtgatctgctccatctcatcatattttattatcggatacactgcattcatcgcgatcctttgttacctattggtttttcctctcgccgtcttcatgaccagaatggctgtcaaggcccaacaccacacaagcgaagtgtcagatcagaggattagagtcactagcgaggtcttaacctgcatcaagcttatcaagatgtatacttgggaaaagccattcgcgaagattattgaagatctgagacgaaaagagagaaagctacttgaaaagtgtgggttggtgcagagtcttacttccatcaccctcttcattatccccacagttgcgacagcagtgtgggtcctgattcatacgagtctgaagctgaagcttaccgcctcaatggcattttccatgctggcgagcctgaacctgctgcggctgtcagtcttcttcgtgcccatagctgtgaaaggcctcactaattctaaatccgcagtgatgcggttcaagaagttctttctccaggagtccccagttttctatgtacagacattgcaggatccgtccaaggctctggtgtttgaggaagctacgttgagctggcaacagacttgcccaggcattgtcaatggagcgctcgagctcgagcggaatggacacgcttctgaaggaatgacacgcccgcgtgatgcgctggggcccgaggaggagggtaattctcttgggcctgagctgcacaaaatcaacctggtggtctctaaggggatgatgctgggcgtgtgcggtaacaccggaagcggcaagtcatcacttctctcagcaatcctcgaggagatgcacctgcttgagggtagcgtgggggtccagggttccttagcttatgtgccccagcaggcctggatcgtatctggtaacattagggagaatatcctaatgggaggggcttacgacaaagcaaggtacttgcaggtgttgcactgttgtagcctgaaccgagacctcgagctgctccccttcggcgacatgactgagattggtgaaagaggacttaatctatccggcggccagaaacaacggatttcccttgcaagagccgtgtactctgaccgccagatttacctgttggacgaccccctttccgccgtggacgcccatgttgggaaacatatttttgaagaatgcatcaagaaaacgctgcgtggtaagacagttgttctagtcacccaccagcttcagtacttggaattctgcgggcagatcatcctactcgagaatgggaagatttgcgaaaacggaactcactccgaactgatgcagaagaaggggaaatatgcccagttaatacagaaaatgcataaagaggctacttcatgtaggtccatctcctcccacaggaggcgcaggtggaagaaggcgccctag

SEQ ID NO: 109208 - DNA, 4080 bp, Artificial Sequence
  Description of Artificial Sequence: Synthetic coding sequence
atggtcggggaaggcccctacctcatctctgacctggaccagagagggaggcgacgcagcttcgccgagagatacgatcctagtctgaaaactatgatccccgtccgaccatgtgcacgccttgccccgaatcctgtggacgacgccggactcctgtcctttgccacattctcttggctgactcccgtgatggtaaaaggctaccgccagcggcttaccgtggacacgctgccaccattgtctacctatgacagtagtgatactaatgccaaaaggtttcgggtgctgtgggacgaggaggtggcccgggttggccccgagaaagccagtctgtctcacgtggtctggaaatttcagagaacccgggtattgatggatattgtagctaacatcctgtgtattatcatggccgccattggccctgtgatcctcatccatcagattctacagcagacagagagaacatcgggcaaggtctgggttggcattggcctctgtattgccctctttgcgaccgaattcacaaaagtgtttttctgggccctggcctgggctataaattaccgcacggccattcgtttgaaggttgcgttgtccacactcgtatttgaaaacctggtttcctttaagaccttgacccacatttcagtgggtgaagtgttgaatattttgagcagcgattcctattccctcttcgaggcagctttgttctgccctctgcctgccacaatccccatacttatggtattctgtgctgcatacgccttttttatcctcgggcccacagccctgattggaatcagcgtctatgtgattttcatcccagtacagatgtttatggctaagctcaactccgctttccgcagaagcgcaattctcgtcactgataaaagagtccagacaatgaatgagttcctgacatgtatccgcctcatcaaaatgtatgcttgggagaaaagcttcaccaataccattcaggacatcagacggcgcgaaagaaagttgttagagaaggccgggtttgttcagtccggaaactccgcattagccccaatcgtatccacaatcgctatcgtcttaaccttgtcgtgccacattctgctgaggcgcaagctcaccgctcccgtggccttctccgtgattgcaatgttcaatgtgatgaaattttctattgcgattttaccattctctatcaaggccatggctgaagctaacgtaagcctgcggcggatgaagaagatactcattgacaaatctcccccatcctacattacacagcctgaggatccggataccgtgttattgcttgctaatgccactctcacctgggaacacgaagccagtaggaagagtacgccgaagaagctacagaaccagaagagacatctttgcaaaaaacagagatctgaggcatactccgagaggtcgcctcctgctaagggggcaaccggtcccgaagagcaatccgattccctgaagagcgtgttgcactctataagtttcgtggttcgaaaggggaaaatcctaggcatatgcggcaacgttggaagtgggaaaagctcacttctggcagcactcctcggtcagatgcaactgcagaaaggcgtcgtggccgttaatggaactctggcctacgtcagtcagcaggcgtggatatttcacggcaatgtccgcgagaatatcctgtttggggagaaatatgaccatcagaggtaccaacatactgtcagagtctgcggactgcaaaaagacctgagtaatcttccctatggcgacttaactgagattggggaaagggggctgaacctatctggcggccaacgtcagagaattagcctggcccgcgctgtgtattccgacagacagctctacctactggatgaccccctttctgccgtggatgcccacgtgggtaaacatgtattcgaagaatgcattaagaagacattaagagggaaaaccgtcgtcctcgtcacccatcagctgcagttcctggaaagctgcgatgaggttattctgttagaggacggagaaatttgtgaaaaaggcacacacaaagaactgatggaggagagaggaaggtatgctaagctcattcacaatctaagggggctgcagttcaaagatcctgaacacctctataacgccgcgatggtggaggcttttaaagaaagccccgcggaaagggaggaggatgctggaataatagtgctggcgcccgggaacgagaaggacgaaggaaaagagagcgaaacaggtagtgagtttgtggatactaaggttccagaacaccagctgattcaaactgagagccctcaggagggcacagtgacatggaagacttatcacacttatattaaggctagtggtgggtacctcctttctctttttactgtgttcctctttctgttgatgattggaagtgcagcgttctccaactggtggttgggtctctggttggataaaggcagccggatgacttgtggtccgcaggggaatcgtacaatgtgtgaagtgggggccgtacttgcagacattggccagcacgtctaccaatgggtttatacggcgagcatggtgtttatgctcgtgttcggggttacaaaagggttcgtgtttactaaaaccaccttgatggcctctagcagcctgcacgataccgtgttcgacaaaatcctaaagtcaccaatgagtttcttcgataccacaccaaccggacggctaatgaaccggttcagcaaggatatggacgaactggatgtccggctgccatttcatgccgagaatttcctgcagcagttcttcatggtggtcttcatcctggtgattcttgccgcagtgtttccagctgtgctgctagtggtagcatccctagctgtgggcttttttatccttctgcgcatatttcatcgcggagttcaggaactcaagaaggtcgagaatgtgtcacggtccccctggtttactcatatcacaagctccatgcagggcttaggtattatccatgcttatggaaagaaagagagctgtatcacataccaccttttgtattttaactgcgctctgcgatggttcgcactcaggatggatgttctgatgaacattctgacattcactgtggcccttttggtgacactgagtttcagttctatctcaacatcttcgaagggtctctctttatcatatattattcagttaagcggccttctccaagtctgcgttagaaccggaactgaaactcaggccaaatttacaagcgtcgaactactccgagagtacatttcaacttgtgtgccagaatgtacacacccactgaaggtcggtacttgccccaaagattggcccagccgcggagagatcacctttagggattatcaaatgcgctatcgggataacacgcccctcgtgctggattctctgaatctgaacatccagtctgggcagactgtcggcatcgttggaaggaccggatctggtaagagcagcctgggcatggcgctgttccggcttgtcgagcctgcctctggcaccattttcattgacgaagtcgacatctgtatcctcagcctcgaagatctaaggaccaagctgactgtcatacctcaggatccagtgctctttgtgggtaccgtgagatacaaccttgatccgttcgagtcacatactgatgagatgctctggcaggttctcgaacggacctttatgcgagacacgatcatgaaactgccggagaaacttcaggctgaggtgactgaaaacggtgagaacttctccgtcggcgaaagacaattactgtgcgtcgctagggctttgctgagaaattccaaaataattcttctggatgaggccacagcgtctatggactccaagaccgacaccctggttcaaaacaccatcaaagacgcttttaaagggtgcaccgtgttgaccattgctcacagattgaatacagtgttgaactgtgaccacgtactagttatggaaaacggcaaggtgatcgagtttgataaacctgaggttctggccgagaaaccggatagcgcctttgccatgctcttagcagcagaagtgagactgtag

SEQ ID NO: 109209 - DNA, 1902 bp, Artificial Sequence
  Description of Artificial Sequence: Synthetic coding sequence
atggtcggtgagggaccctacttgataagtgatctcgaccaacgtgggcgacggcgaagcttcgccgagagatatgaccccagtttgaaaacaatgattcctgtgcggccttgtgcgagactggcccccaatccggttgacgacgctgggttgttatcttttgccactttctcttggctgacgccagttatggttaaggggtaccgacagagattgactgtggacacactgcccccactctctacctatgacagctcagacaccaacgccaagagattccgagtgctttgggatgaggaggttgcccgggttggccccgagaaggcttctctgtcccatgtggtatggaaattccagcggacaagggtgctgatggacatcgtggctaatatcctttgcattattatggcagctattggaccgacagtcctgattcaccagatactccagcagacagaaaggacctccggtaaagtgtgggttggtattgggttgtgtatcgcgctgtttgctaccgaatttaccaaggtgtttttctgggctctggcctgggccataaattaccgtaccgcaatccgcctcaaggtggcactcagcaccctagtgtttgagaaccttgtctccttcaagacgctaactcatatctcagtgggggaggtactcaatatcctcagtagcgactcttacagcctcttcgaggcagccttgttctgcccactacccgcaacgatcccaatcctgatggttttctgtgcggcttatgcatttttcatacttggccccacagccctgatcgggattagcgtgtacgtgatctttatccccgtccaaatgttcatggccaaactgaacagtgcctttcgaaggtcagctattctggttactgataaaagagtgcagactatgaatgagtttttgacatgtattaggctcataaaaatgtatgcctgggagaagtccttcaccaacaccatccaagacatccggcgacgtgaaaggaaattgctggagaaagctggatttgttcagagtggaaattcagccctcgctcccatcgtaagcaccattgccattgtcctaacactctcctgccacatactactccggcgaaaactaacagcgccagtggcattttccgtaatcgccatgttcaatgttatgaaattttcgattgccatactgcccttctcaattaaggcaatggcagaggccaacgtgagccttcgcagaatgaagaagatcctaatagataaatctccacctagctatatcacccagcccgaagatcctgataccgtgcttctgttggccaatgccacgctgacatgggaacatgaggcctcgaggaagtcaacccccaaaaagcttcagaaccaaaaaagacacctctgcaagaaacagcgcagcgaagcctattcagagaggtctcccccagctaagggagccactggacccgaggagcaatccgactcgcttaagtctgttctgcatagcatatcttttgtcgtgcgcaagggcaaaattcttgggatctgcggcaatgtgggaagtgggaagtcttccttactagcagctttgcttggacagatgcagttgcagaagggagtcgtcgcagtgaatggtactcttgcatatgtgagccagcaggcgtggatatttcatggcaatgtaagagaaaatatcctttttggcgaaaaatatgatcaccagcggctgggttcaggtgcaagcacatccctcggtggccgcgggcgcgggctggcttggcccgccctaagtacacccacagtgtcttcaacttgttggacaacaccatgtagaccttggacccctacttggggatccacatccctaaggtcagccttacgccgacgaagtggcgaacggcagtcaagttggtag

SEQ ID NO: 109210 - DNA, 2808 bp, Artificial Sequence
  Description of Artificial Sequence: Synthetic coding sequence
atggttggagaaggcccctatctgatcagcgacctggaccaaaggggacgcagacgttcctttgcagagaggtatgacccttcgttgaaaacaatgatccctgtccggccgtgcgcacgccttgcccctaatcctgtggatgatgccgggctcctcagcttcgccacattctcatggctaacccccgtaatggtcaagggatacaggcagcggctgaccgttgacaccctgccccccctttcaacatatgacagctctgacactaacgccaaacgcttcagggttctgtgggatgaggaagtcgcgcgcgtcgggcctgaaaaagcttccttatctcatgtagtatggaagttccagaggacccgcgtgctgatggatattgtagctaatatattgtgtattatcatggccgcaattggacctaccgttctaattcaccagatcctgcagcagaccgagcggacatccggaaaggtatgggtgggaattgggttatgtattgccctattcgcaacagagttcacaaaagtgtttttctgggcattggcctgggcgatcaactataggactgctattcgactcaaagtggctctgagcacactagtgttcgagaacctcgtcagcttcaagactctcacccatatctccgtaggagaggtgttgaatatcctgtcctcagattcctattctttattcgaggccgctctcttttgccctcttcctgctacaatcccaattctgatggtgttttgcgccgcctacgcttttttcatcctgggtcccaccgccctcatcggcatctctgtttatgtgatcttcattccagtgcagatgttcatggctaagctgaactcggccttcagaagatccgctattctggtaaccgataagcgcgttcagacgatgaacgaattcctaacgtgcatccgtctgattaagatgtatgcgtgggagaagtccttcaccaataccatacaagatataaggcggcgcgaaagaaagcttctggaaaaagctggattcgtgcagtccggaaacagcgcgctcgcaccaattgtttcaaccatcgctatcgtgctgaccttgtcatgtcacatcttgctgcggcgcaagttgaccgcccccgtagccttctccgtgatcgctatgttcaacgtgatgaagttcagtatcgcaattctgcccttttcaattaaggccatggcggaagctaacgtgagtctgcgcagaatgaaaaaaatattaatagacaagagccctccttcatacatcacacagcccgaggaccccgataccgttctgctgctcgccaacgccacactgacctgggaacacgaagcctcccggaagtccaccccaaaaaaacttcagaatcagaaaaggcacctgtgtaaaaagcagcgcagcgaggcgtactctgagaggtcaccccctgctaagggagctacaggccctgaagaacagtcagacagcctgaaaagcgttctgcacagcattagtttcgttgtgaggaaaggcaaaatcctgggcatttgtggaaatgtcgggtcagggaaatctagcctacttgcagcactcctgggccagatgcagctgcaaaaaggagtggtagcagtgaatgggaccctggcatacgtgagccagcaggcatggatttttcacggcaacgtaagggagaacatcttgttcggtgaaaagtacgaccaccagcggtatcagcatacagtgcgcgtgtgtggcttgcagaaagacttgagtaacttaccttacggcgatttgacagagatcggcgaacgcgggctgaacctgtcggggggtcagagacagaggatatcacttgctagggctgtgtactccgacagacagctgtacctgctggatgacccactatctgcagtagatgcacatgtgggaaaacatgtgtttgaagagtgtattaagaaaacacttaggggaaaaactgtggttctggttacccaccaacttcagtttctagaaagctgcgatgaggtgattttgttagaggatggggagatatgtgagaaaggtacccacaaggaacttatggaggagcgaggtagatatgcaaaacttatacataatcttcgggggctccagttcaaggaccccgaacatctttacaatgccgccatggtcgaagctttcaaggagagcccagccgagcgcgaagaagatgccgtattagctcccggaaatgagaaagatgagggcaaggagtctgaaaccgggtcggagtttgtggacacaaaggttccggaacatcagttgatccaaacggagtcacctcaggaaggaacggttacctggaagacgtaccacacatacattaaggccagcggcggatatctgctgtccttgtttactgttttcctcttcctgttgatgattggtagcgccgcattcagcaattggtggctgggtctgtggctggacaaaggtagtagaatgacatgtggtccacagggcaatcggaccatgtgcgaagtgggcgctgtactagcggatataggacagcacgtctatcaatgggtgtatacggcaagtatggtcttcatgctggtcttcggagtgacaaagggatttgtattcacaaaaaccacactgatggcatcctcatcgctgcacgatacggtcttcgataaacactttccacagagatctcctggcgctcaggagggaggggagtgccagcctgtaaccctcgtgcaccctcatcacctacttcacgcaggaccaggacatcactcccggctgtggcaggagggagagttacatcacctggtgtag

SEQ ID NO: 109211 - DNA, 2793 bp, Artificial Sequence
  Description of Artificial Sequence: Synthetic coding sequence
atggttggtgagggtccatatcttatctcagatctggatcagagaggtcgaaggagatccttcgccgagagatacgatccttccctgaagaccatgatccctgtcaggccctgcgcgagactggcccccaaccctgttgatgacgctggcctgctttctttcgcgactttctcctggttgactcccgtaatggtgaagggatacaggcagagacttactgtcgacacactacctcccttgagcacatatgattcttccgataccaatgccaagaggtttcgggtcttgtgggatgaagaggtggccagagtcgggcctgagaaagctagtctctcccacgtcgtctggaagttccagcgcacccgagtcctcatggatattgtcgccaacatcctgtgcattattatggctgcaataggtcctacagtgctaatacatcagatcctgcagcagaccgaaagaacctccggaaaagtgtgggttgggattggcctctgcattgcgttatttgcaacagaatttacaaaggtgttcttctgggctttagcttgggccattaattacagaacagcaattagactgaaagtggctttatccactctggtgtttgaaaacctcgtttcctttaagaccctgacccacatctctgtgggggagatgttcatggccaagttgaattctgccttcagacgatccgccatcctggtgactgataaaagggtacagactatgaacgaatttcttacctgcattaggctgataaagatgtatgcctgggagaaatctttcactaatactatacaagatatcaggaggagggaaaggaaactgctcgaaaaggcagggttcgtgcaaagcggaaactccgctctcgccccgatcgtaagtacaattgctatagtgcttacacttagttgtcacattcttctgcggcgtaaactcacggcccctgtggcgttctctgtgattgcaatgtttaatgtcatgaagttctctattgctatactgccttttagtattaaagccatggccgaggcaaacgttagcctgagaagaatgaagaaaatacttatcgataagagtcctccgagctacattacacaacccgaagatcctgatacagtactcttgctcgccaacgctacactcacttgggaacatgaggcctctcggaagagtacgcctaagaaattacaaaatcaaaagcgacatttgtgtaagaaacagcgatcagaagcgtactcagagaggagcccacccgccaagggggcaaccggccccgaagagcagagcgactctcttaagtctgtgcttcatagtatttcctttgtggtccgaaaagggaagattctgggcatttgcgggaacgtgggctcgggcaaatcctctctgctcgccgctctgctgggtcagatgcagctccagaagggagtagttgctgtcaatgggacgctcgcttatgtcagccagcaagcctggatttttcacggcaacgtccgcgaaaacatcttgtttggggaaaagtatgaccatcagcgctaccagcatacagttcgggtgtgcggactccagaaggacttgagcaacctgccatacggagatctgacagagattggagaaaggggcctgaatctgtccggcggccagagacagcgaatttctctagccagagccgtgtactccgacaggcagctatatttgcttgacgatcctttgtccgctgtagatgcacacgtagggaaacatgtgtttgaggaatgtattaagaagactctgcgcggaaaaaccgtcgttctcgtgacgcaccaactgcagttccttgagtcttgtgacgaggtgatcttgctggaggacggagaaatctgtgaaaagggtacacacaaggagctgatggaagagcgcggacgctatgcgaagctcatacacaacctgaggggcctccagtttaaagacccagagcatctctataacgctgccatggtggaggctttcaaagagagtcctgccgagcgggaagaagacgccgggattattgtgccagagcaccaattgatccaaaccgaaagcccgcaggaaggcaccgtcacttggaaaacttaccatacatatatcaaagccagcggtggataccttcttagcctctttaccgtctttctgtttctcctgatgataggctcagctgccttttcaaactggtggttggggttgtggctagataagggctcgagaatgacctgcggcccccagggaaacaggactatgtgcgaagtgggagccgtgctggctgacataggccagcatgtgtaccagtgggtgtatacagcctccatggtgtttatgcttgtctttggggttactaagggttttgtctttactaagaccactctcatggctagtagttcccttcacgataccgtgttcgacaagatcttaaaaagtcccatgtccttcttcgataccacgccgacggggaggcttatgaacagattttcaaaggatatggatgagctggatgtgcgactgccttttcacgccgagaactttctccagcaatttttcatggttgtgttcattttggttattttggctgccgttttcccagccgtgttgctggttgtagcctcgttggcggtaggtttcttcatcctgctaaggatatttcaccgaggagtccaggagctcaaaaaggttgagaatgtctcccggagcccctggtttactcacatcaccagcagcatgcagggcttagggataatacacgcttatggcaaaaaggagtcttgtatcacgtag

SEQ ID NO: 109212 - DNA, 321 bp, Artificial Sequence
  Description of Artificial Sequence: Synthetic coding sequence
atggtgggagaaggaccttatttgatttcggacctagaccagcgaggtaggcgcagatcttttgctgagcgatacgatccctccttaaagacgatgattcctgtccgaccatgtgcccgtctggctcctaatcccgtggacgacgcaggcctcttgagctttgctaccttcagctggcttactcccgtaatggtcaaaggttaccgccaaaggctcacagtcgatacgctaccacctctgtccacctatgacagctccgataccaatgccaagaggtttagagtgctgtgggacgaggaggtcgctcgggtgggaccttag

SEQ ID NO: 109213 - DNA, 858 bp, Artificial Sequence
  Description of Artificial Sequence: Synthetic coding sequence
atggtgggcgaggggccatatttgatctctgatctcgaccaaagaggacgcagacggtcgtttgccgagcggtacgatccatcactgaaaaccatgattccagtacggccttgtgcaaggctggcccctaacccagtggatgacgccggtctcctgagctttgctactttctcctggctgactccagttatggttaagggctatcggcagcgcctgactgtggacacactgccacccctaagcacttatgattcctcagataccaacgcgaaaagattcagagtcctgtgggacgaagaagttgcacgggtgggaccagaaaaagcttctctgtcccacgtggtgtggaagtttcaaagaacacgggttttgatggacatagtcgcgaacatattatgcatcattatggccgcaattggacctacggtgcttattcaccagatcttgcagcagaccgagagaacctctggcaaagtctgggtggggattggcctgtgcattgcattgtttgctacagagttcactaaagtcttcttctgggcactggcctgggccataaattaccggactgctataagactaaaggtggctttgagtacgttggtttttgaaaacctagtttctttcaagactttgacccatatctcagtaggagaggttctcaatatcttaagttcagactcttattcactcttcgaagcagcattattctgtcccctgcctgctacaatacctatcctcatggtgttttgcgcggcttacgcatttttcatactcggcccgaccgccttaatcggcatctccgtatgcctgtggcctagcagtatccagctatcagagggacaacagttttggtag

SEQ ID NO: 109214 - DNA, 882 bp, Artificial Sequence
  Description of Artificial Sequence: Synthetic coding sequence
atgctggaaaagttttgtaactccacattctggaattcatcgttcctcgactccccagaagccgacctgcccctctgcttcgagcaaacagtgctggtgtggatcccactgggatatctctggctattggccccatggcagctgctgcacgtgtacaagtcaagaaccaagcgatcttccaccactaaactgtacctcgcaaagcaagtttttgtgggattcctcctcatcctggccgccattgaactggcccttgtgctgactgaggactccgggcaggctactgtacccgccgtcagatataccaaccctagtctctaccttggtacctggctccttgtgcttctcatacagtacagtaggcaatggtgtgttcagaagaactcttggttcctctctctgttttggatactttcaatcctttgtgggaccttccagtttcagactttgattcggacactcctccagggagacaactcaaaccttgcatattcgtgcctatttttcatttcttacggatttcaaatcctcatcttaatttttagcgcgtttagcgagaacaatgagtcatccaataacccctcttctatcgcgagctttctctcttcaataacctacagctggtatgattccatcattctaaaaggatacaaacggcctctgaccctcgaggacgtgtgggaggtcgatgaggagatgaaaactaaaaccttagtgtctaaattcgagacccacatgaaaagagaactccagaaggcccgccgtgccctgcagaggcgacaggaaaagagcagtcagcagaactccggcgcccgcctgccaggacttaacaaaaatcagagtcagagccaggacgcacttgtgctcgtcacatttccgtag

SEQ ID NO: 109215 - DNA, 4638 bp, Artificial Sequence
  Description of Artificial Sequence: Synthetic coding sequence
atgctagagaagttctgtaatagtacattctggaactctagtttcctggattcgccagaggctgatctgcccctctgtttcgagcaaactgttctggtgtggattcccctcggctacctctggctcctcgccccatggcagttgctccacgtgtataagtcccggacgaaaaggagcagtacaacgaaactatatcttgctaaacaggtgtttgtagggttcctgctgatcctcgccgccatagaactggcactcgtcctgacggaggatagtggccaggccacggttcccgccgtcagatatactaatccctccctctacctcggcacttggttactcgtcctcctgatccagtacagtagacagtggtgtgttcagaaaaattcttggttcttaagcctgttttggattctgtctatcctctgcggcacttttcaatttcaaactctgatccggacactcctgcaaggcgacaacagcaatttggcttatagttgtctgttcttcattagctacggatttcagatcctaatcctgatttttagcgcgttctctgaaaacaacgagagcagtaataatccctcctctatcgcatcatttctctccagcatcacttatagctggtacgactctatcatcctgaagggctacaaaagacctctgacattagaggatgtctgggaggtggacgaagagatgaagaccaaaaccttggtaagtaagtttgagacccacatgaagcgagaacttcaaaaagcccgaagagcgctgcaaagacgtcaagagaagagctcgcagcagaacagtggagcccgactgcccggcctgaacaagaaccaaagccagagccaggatgccttggtcttggaagacgtggagaaaaagaagaagaagagcggaactaaaaaggacgtgcccaaaagctggttgatgaaggcactgttcaaaacattttatatggtgctcctcaagtcttttctgttgaagctggtgaatgacatttttacctttgtctcgcctcagctgttgaagttactgatctctttcgcttctgatcgagatacatatttatggattggatacttgtgcgccatactcctgttcaccgctgcactgatccagtcgttttgcttacagtgttactttcagctctgctttaaattgggggtgaaggtgcgaacggctattatggccagtgtatacaaaaaggccctcactctttcaaatctggcacggaaggagtacactgtgggcgagactgtgaacctgatgtcagtcgacgcgcaaaagctgatggatgttactaacttcatgcatatgttatggtcctctgtattacagatagtcttgagcattttttttttgtggagggagctggggcctagtgtgctggctggggttggagtcatggtccttgtgataccaatcaatgcgatcctttccaccaaatcaaagactatccaggtgaaaaacatgaagaacaaagataagcggctaaagataatgaatgagatcttgagcggtatcaaaatcctaaaatattttgcatgggaacctagctttcgtgaccaggtgcaaaacctgaggaagaaagagctgaagaacctgctggccttcagccagcttcagtgtgttgtaatcttcgtgttccagctgacccctgtcctcgtgtctgtggtgaccttctccgtttacgtcctggttgactcaaacaacatactggatgctcagaaggccttcacctcaatcaccctctttaatatcctccgtttcccactctccatgctccctatgatgatttcaagtatgctccaagcaagcgtttccaccgaaagactggaaaagtaccttggcggcgacgacttggatacctcagccatccgccatgactgcaatttcgacaaggcaatgcagttcagtgaggcttcctttacttgggaacacgacagtgaggccacagtgagagacgtgaatcttgacattatggccggtcagcttgtggcagtcattggtcccgtgggttctggcaaatccagcctgatctccgccatgctcggcgaaatggaaaacgtgcatggtcatatcacaattaagggcaccactgcatacgttccccagcagagctggatccaaaacgggacaattaaagacaacatcttatttggtaccgagttcaacgagaaaaggtaccagcaggtgctggaggcctgcgcattactgcctgacctggagatgttacctgggggcgacctagcagagattggtgagaaaggcattaacctctcggggggacagaagcaacgcataagcctcgcccgcgctacttatcagaacttagacatatacctgcttgatgatcccctctccgctgtggacgcacacgtcggcaagcacatcttcaacaaagtgctcggccctaacggcttgttgaaaggtaaaacgagactcctggttactcattcaatgcatttcctacctcaggtcgatgagattgttgtactcggaaacggtactatagtggaaaagggtagctacagtgcactgctagcaaaaaagggagagtttgcaaagaaccttaaaaccttcctacgtcacaccggtcccgaggaggaggcaactgtgcacgatggctcagaggaagaggacgatgactacggccttataagttcggtggaagaaattccagaagatgctgcttccatcaccatgcgcagggagaactcatttcgacgcacgctctctaggtcttctcgatctaacggaaggcacctcaagtcactccggaactctctaaaaacccggaacgtgaacagtctgaaagaagacgaggagttagtcaaaggtcagaagctgattaagaaggaatttattgagacgggcaaggtgaagttttccatctatctggaatatttacaagctatcgggcttttctccatcttcttcatcattctcgcctttgtgatgaattctgtcgcattcatcggtagcaatctgtggctctccgcctggaccagtgattcaaaaattttcaacagcactgactatcctgccagtcagcgtgacatgagagtcggtgtctacggcgcgctcggcctggctcaaggaattttcgtctttatagctcatttctggtctgcctttggcttcgtccacgcttccaatattcttcacaaacagttgctgaacaatatcttaagagcacctatgcgcttcttcgacaccaccccaacagggcgtatagtgaaccggttcgccggtgacatcagcaccgtcgatgacacccttccccagtctctgcggagctggattacctgtttcttgggcattatctctaccctggtgatgatttgcatggcgacccccgttttcacgattatcgtcatccccctgggcatcatctacgtatcagtgcaaatgttctatgtctcaacaagcaggcagcttaggcgtctcgacagtgttacaagatcccccatttattcgcactttagcgagaccgtgtccggcctccctgtgatccgggctttcgagcaccagcaaaggttcctgaagcataatgaagtgcgtatagacaccaaccaaaagtgcgtattctcctggattacctcaaatcgttggttggccatccgcctggagctagtgggaaatctcacggtattcttcagtgcgttgatgatggttatttaccgagacacactgagcggcgatacagttggtttcgtgctctcaaatgctcttaatattacccaaacactgaactggcttgtgaggatgactagcgagatagagaccaacattgtggctgtggagaggattactgaatatacaaaagtagagaacgaagccccgtgggtcactgacaaacgcccccccccagattggccgtctaagggcaagatccagtttaataattaccaggtaaggtatcggccagagctagatctggtgctacgcggtattacctgcgacatcggcagtatggaaaagatcggggtcgtgggaagaacaggtgcaggcaaatcaagcttgacaaattgtctcttccggatcctggaagctgcgggcgggcagataattattgatggagtcgatattgccagcatcggcctccatgaccttcgagagaagctgacaattatcccccaggatccaatccttttctctgggtcgctgcgcatgaacttagatccattcaacaactactccgacgaagaaatttggaaggccctcgagttggctcacctgaaatccttcgtggcctccttgcaactgggcctctctcacgaggtaaccgaggctggaggaaacctgtcaattggccagcggcagctgctgtgtctgggacgcgcactactgcgaaaaagcaagatattggtcctcgacgaggcaacagccgcagtcgatctggaaaccgacaacctgattcaaacaaccattcaaaacgaatttgcccactgcaccgtcattaccattgcgcacaggttgcacactatcatggacagtgataaagtcatggtcttggataatggcaagattatcgagtgtgggtccccagaagaacttttacaaataccagggcctttctattttatggcgaaggaagcaggcattgagaatgtgaacagtacgaagttctag

SEQ ID NO: 109216 - DNA, 4584 bp, Artificial Sequence
  Description of Artificial Sequence: Synthetic coding sequence
atggacgccctctgtgggtccggagaactggggagtaaattctgggattcaaacttaagtgtgcacaccgaaaatcctgacctcactccgtgttttcagaatagcctactcgcttgggtgccgtgtatctatctgtgggtcgccctcccatgttaccttctttatctgagacaccactgccgggggtacattatcctgtctcatctgtccaaattgaaaatggtactaggcgtgctgctgtggtgtgtcagctgggcggacctgttctactctttccacggactcgttcacgggcgagctcctgccccagtgttctttgtcaccccgctggtcgtgggagtgaccatgctcctcgccaccctgctgatacagtatgagcgcttacaaggggtccagagctcaggagtgctcatcattttctggtttctctgtgttgtgtgtgcaattgtgccgtttagaagcaaaattttgctggccaaagctgagggcgaaatcagcgacccgttccgtttcaccacgttctatatccacttcgcccttgtgctcagcgccctcatcttggcctgcttcagagagaaaccccctttcttcagtgccaagaatgtggacccgaacccctaccctgaaacctccgctggatttttatcccggctttttttttggtggtttacaaagatggccatctatggctatcggcatcctctcgaggagaaagacttgtggtccctgaaggaggaggaccgaagccagatggtagtccagcagctccttgaggcatggaggaaacaggagaagcagaccgcccgccacaaggcctccgctgctcccgggaaaaacgccagcggagaagatgaggtgctgctaggtgcacggccaaggcccaggaaaccctcctttttgaaagccctgctggctaccttcggatcttcgtttttgatctccgcttgtttcaagttaatccaggatcttctgtccttcatcaatcctcaactgctgagcatattgatccgttttatctcaaaccctatggccccttcatggtggggcttcctggtcgccggacttatgtttttatgttccatgatgcaatcactgatactccagcattattaccactacatattcgtgacgggggttaaatttagaaccggaataatgggcgttatttacagaaaggccctggtgatcaccaacagtgtcaaacgcgcgtccaccgtcggcgaaatcgttaatctgatgagcgtagatgcgcagagatttatggatctggcccccttcctgaatctcttgtggtctgctcctcttcagataatcctggcaatctacttcttatggcagaacctgggaccgtctgttctcgcaggagtcgcattcatggtgctcctcataccacttaacggcgccgttgctgtcaagatgcgagctttccaggtcaaacagatgaagctgaaggactcgaggattaaattgatgagcgagattctcaacgggattaaagttctgaaactgtacgcctgggaacccagtttcttgaaacaagttgagggtattcgccagggcgagctgcaactgctcaggacggccgcttacctgcacaccacaacaacctttacctggatgtgttcccccttccttgtgactcttatcacactgtgggtctacgtgtatgtggatcctaacaacgtattagacgcagagaaagcgttcgtgagtgtgagcctgttcaacattctgagattacctctgaacatgttacctcagttaatttcaaacctaacccaggccagcgtgtccctcaagcggatacaacagttcctgtctcaagaagaactcgacccccagtcagttgagcgcaagactatctcacctggctacgccattacaatccacagtggtacgtttacatgggcccaggatctgccgccaactctgcactcgttggacatccaggtgccgaagggggccttagtcgcagtggtggggcccgtgggctgcggcaaaagcagccttgtctcagcactgctcggcgagatggagaaacttgaaggaaaagtccacatgaaaggcagtgtcgcctatgtccctcagcaggcatggatccagaattgcaccctacaggaaaatgtgctgtttggaaaagccctcaatcccaagcgctatcaacagaccctggaggcatgtgccctcctggctgacttggagatgctccccggcggtgatcagaccgagatcggggaaaaagggatcaatctgagcggaggccagcggcagcgggtgagcttggctcgggcagtgtactccgatgccgatatcttcctgctggatgacccactgagcgccgtcgattctcacgtagcaaaacacatatttgatcacgttattgggcctgagggggtgttagccgggaaaacgagggtcttagtgacccacgggatttcatttctcccccagaccgatttcattattgtgttggccgatggacaagtgagtgagatgggtccgtaccctgccctcctgcagcgcaatgggtcctttgcaaattttctctgcaactatgcgccggatgaagaccaaggccatttggaggacagctggacagcgctcgaaggggccgaagacaaagaagctctgctgattgaagataccctgagcaaccatacggacttaaccgacaatgatcccgtgacatatgtcgttcaaaaacagttcatgcggcaactctcggcactcagttctgacggcgaggggcagggaagacctgtgccgcgccggcacctggggccctccgaaaaagtgcaggtcacggaggccaaggcagatggggccctaacgcaggaggagaaggctgcaattggtaccgtcgaattgtccgtcttctgggactacgccaaagctgtgggattgtgtaccaccctggcgatttgtctcctgtatgtgggacagagcgcggccgccataggggccaacgtttggctgtctgcttggaccaatgacgccatggctgactctaggcagaacaacacttcactccgattaggggtatacgccgcgctggggatactccaagggtttctcgttatgttggccgcaatggccatggcagcaggcggtatacaggcggcacgggtgcttcaccaggccctgttgcataacaagatccgaagcccccagtcttttttcgatacaaccccctctgggagaattctcaactgtttttcgaaagacatctacgttgtcgacgaggtgttagcccccgtgattttgatgctgctcaactctttctttaacgctatctcaacccttgttgtgatcatggcaagcacaccactctttacagtagtgatcctgcccctcgcagtgctgtacactctggtacagaggttctacgctgccacctctcgccaactaaaacggcttgagtcagtgagccgttcacctatttactctcattttagcgaaacagttaccggcgcctctgtcatccgggcctacaacaggtcgcgcgattttgaaattatttccgacacgaaagtggacgccaaccagaggagttgttacccatacataatttctaaccggtggctgtcgatcggtgtggagtttgtagggaactgcgtggttctcttcgccgctttgtttgcagttattggcaggtcctcacttaacccagggctggtggggctcagtgtgagttactctttacaggtcaccttcgctttaaattggatgatccggatgatgagcgatctcgaaagtaatatcgtcgctgtggaacgcgtgaaggagtacagtaaaaccgagacagaagcaccatgggtagtcgagggctcaaggccgcccgaagggtggcctcccaggggcgaagtggagttccgtaattacagcgttcgctacagacctgggctcgaccttgtacttagggatctgagtttacacgtgcatggcggggagaaagttgggatagtcgggcgtacaggcgccggaaaatcaagcatgacactctgcctgttccggatcttggaagcagccaagggggaaatccgcatcgatggacttaatgtggcagatatcggtttacacgacctgcggagccagctgaccatcattccacaggatccaattcttttcagcggaacactgcgtatgaatttagacccattcgggtcttattcagaagaggatatttggtgggctctcgagttgagccatctacacacattcgttagttcacagcctgccgggctggactttcagtgttctgaaggaggggaaaatctgtcggtagggcagaggcagttagtctgcctggctcgcgctttgttacgcaaaagtcgaatactggtcctggatgaggctaccgccgctattgacctggaaacagacaacctcatccaggccactatcaggacccaattcgatacctgcactgttcttacaattgctcacaggctgaatactattatggactacacccgggtcctcgttctggacaaaggggttgtggctgagtttgattctccagcgaacctcattgccgcacgtggaatcttttatggcatggcgcgtgacgccggtcttgcttag

SEQ ID NO: 109217 - DNA, 1719 bp, Artificial Sequence
  Description of Artificial Sequence: Synthetic coding sequence
atggatgcattgtgtggttccggtgagctaggatccaagttctgggacagcaacctgagcgtgcatactgaaaaccctgatctcaccccatgtttccagaatagcctcttggcctgggtcccgtgcatctacctgtgggtggctctgccttgttaccttttgtatcttcggcatcactgtagagggtatataatcctaagccatttgtctaagctgaaaatggtcctgggagtcctactctggtgcgtgtcctgggccgatttgttttatagttttcacggcctggttcatggcagggccccagctccagtgtttttcgtcacaccactggtagtcggcgttactatgctacttgccaccctcttaatccaatacgagcgcttgcagggggtgcaatctagcggagttctgattattttttggttcttgtgcgtcgtctgtgccattgtgccatttcgatcaaaaatcctcctggccaaagccgagggggaaatttcggaccccttcaggtttacgactttttatatacactttgccctggtgctctccgctctcatcttagcgtgctttcgcgaaaagccaccctttttcagtgctaaaaatgtagacccaaatccatatcctgagacaagcgccggatttctgtctcgtttatttttttggtggttcacaaaaatggccatctatggataccggcatcccctggaagagaaggatctatggagtttgaaagaggaagaccggagccaaatggtggtgcagcaattattggaagcatggcgaaagcaggaaaagcagacagctcggcacaaagcatccgcagctcccggaaagaacgcttccggggaggacgaggtgctgctgggcgctagacctcggcctagaaaaccttccttcctaaaagccttgctcgccacattcgggtccagcttcctgatatctgcctgcttcaaactgatccaagatcttcttagttttattaacccccagctattgtccatcctaattagattcatctcaaatccaatggctccttcttggtggggattcctcgtagcaggcctgatgtttctctgtagtatgatgcaatcactgattttgcagcattactaccactacattttcgtaaccggcgttaagtttcgcaccggcattatgggcgtgatctatagaaaagctctggtcattactaatagcgtcaagcgtgccagcaccgtcggggagatcgtgaacctcatgagcgttgatgcacagcgctttatggatctggcaccttttctgaatctgctatggagcgctcccctgcaaattatacttgcaatttatttcctttggcagaatctcgggcccagtgtactagccggggttgcctttatggtgctgctgatccctctgaacggcgccgtcgccgtgaagatgcgggcatttcaggtgaaacagatgaaacttaaagatagcaggataaagctcatgtccgagatattgaatgggatcaaggtccttaaactgtacgcttgggagccttcttttctcaagcaggtggaaggcatccggcaaggcgagctccagttgttaaggaccgcagcctatcttcataccacgactactttcacctggatgtgcagcccattccttgttcggctaggcaccggtttaggtccctgcctgcaaggatctggatgcccaggtatggcgagagcacactggaccctgccatag

SEQ ID NO: 109218 - DNA, 3717 bp, Artificial Sequence
  Description of Artificial Sequence: Synthetic coding sequence
atggacgccctctgcggttccggcgagctcggatctaaattttgggactcgaatctcagtgtgcacacggagaatccggatctgactccgtgctttcaaaacagcctgttagcctgggtgccatgtatatacttgtgggtggctctgccttgctacctgctgtatctgagacatcactgtcgaggatacatcattttgagccatcttagtaagctgaagatggtcctcggtgtgctgctatggtgcgtgtcttgggcagacctgttttatagcttccatggcctagtgcatggtagggctcccgcaccagtcttctttgtcactccgctggttgtgggagtcacaatgctattagcaaccttgcttatccagtacgagcgcctgcagggagtgcagtcgtctggggtgctgattattttttggttcctgtgtgtagtgtgcgctattgtgcctttccgttcgaagatactcttggctaaggctgaaggagaaatttcagacccattcagatttacaaccttttacatacacttcgccctggtgctgtcagcattgatactggcgtgtttcagagagaagcccccattctttagcgctaagaacgtagaccccaatccataccctgagacctctgccgggttcctttcccgcctgtttttctggtggtttacgaaaatggctatctacgggtaccgtcaccccctcgaggagaaggatctgtggtcgctcaaagaagaagatagatcacagatggtagtgcaacagttgctggaggcttggcggaagcaggaaaaacagactgctcggcacaaggcttctgccgctcccggaaaaaacgcttcgggggaggacgaggttttgttgggggcaagaccaaggcccagaaaaccttcttttctgaaggccctcctggcgaccttcggctcttctttcttaataagcgcttgcttcaagctcatccaggacctgctgagctttatcaacccccaactgttgagcatcttaattagatttatttcaaatcccatggctccttcatggtggggatttttagttgctggcttaatgtttctgtgttccatgatgcaatccctgatactgcagcactactaccactatattttcgttacgggtgtgaaatttaggacagggatcatgggcgttatttatcggaaggctctcgtgattaccaactcagttaagagggccagtaccgttggagaaatcgtgaatttgatgtctgtggatgcacagaggttcatggatcttgccccgttcctgaacctgctgtggagtgcacccctgcagataattctcgccatatactttctgtggcaaaatctggggcctagcgtcctggcgggcgtggccttcatggtgttgctcatccccctgaatggggctgtggcggtcaaaatgagggccttccaggttaaacagatgaaactaaaagacagccgaattaagctgatgagtgagatcttgaatgggatcaaggtcctgaagctgtacgcctgggagccatcttttcttaagcaagtcgagggcatccgccaaggtgagctccagctcttgaggaccgcagcttatctccacacaactacaaccttcacctggatgtgcagtccttttcttgtgactctcattacgctctgggtgtatgtctacgtggaccctaacaacgtgctggacgctgagaaggctttcgtttcggttagtctgttcaacattctgcgactccccctgaacatgttgcctcagctgatctcaaacttaacccaggcatctgtcagcctgaagcgtattcaacagttcctgtctcaggaggaactcgacccccagagtgtggaacggaaaactatttcacctggttacgccattacgattcacagcggaacattcacttgggcccaggatctccctcccactcttcatagcctggatattcaggtccccaagggcgccttggtggccgttgtaggaccagttgggtgtgggaagagctccctggtcagtgcactgctcggcgaaatggaaaaattggaaggcaaggtccatatgaagggatcagtggcttatgttccccagcaagcctggattcaaaactgtaccctgcaggagaatgtgttattcgggaaagccttaaacccaaagaggtatcagcagaccctggaggcttgtgccctactggccgacctagagatgctgccagggggcgatcaaacagagatcggggagaaaggcattaatctttcaggagggcagcgacagagagtgtccctggcgcgggcggtgtattcagatgcagacattttcctcctagatgaccccctcagcgcggtagactcccatgttgccaaacacatttttgatcacgttattggaccagaaggcgtgctcgcaggcaaaactagagtactcgtgacccatggaattagctttcttccccaaaccgactttatcatcgtgctggcagatggacaggttagcgaaatgggcccttaccctgctctgctccagaggaatggaagcttcgccaacttcctttgtaattacgcccccgacgaggatcagggccaccttgaagattcatggacggccttggagggggcagaggacaaagaggcactgttgatcgaggatacgctgagcaaccatactgaccttaccgataacgacccagtcacctatgttgtccagaaacaattcatgcggcagttgagcgccctgagctctgacggcgaggggcagggcaggcccgtgccgaggcgccacctcggaccgtccgagaaggtccaggtaaccgaggcaaaagctgacggggctttgacacaggaagagaaagctgcaattggcactgtagaactctcggtgttctgggactatgcgaaggctgtcggattgtgcactacactggccatatgcctgctgtacgtcgggcaatccgccgctgctattggagcaaatgtttggcttagcgcctggacgaatgatgccatggccgatagtcggcagaataataccagtctgagactgggtgtttacgcagccttgggtattctccaaggttttttggtcatgctcgcggcaatggctatggctgccggggggattcaggccgcccgggtcctccatcaggctttgctgcacaacaaaatccggtccccacagagtttctttgatacgacgccatcagggcgcatcctgaactgctttagtaaggacatatatgtcgtggacgaggtacttgcacctgtgattttgatgcttttaaattcattctttaacgcaatcagtacgctggttgtaatcatggcttccactcctctctttaccgtcgtgatcttgcctcttgcggtgttgtatactctcgtgcagaggttttatgccgcaacgtcgcgccaattgaagcggctggagtccgtgagcaggtctcctatatattcacatttcagcgaaaccgtaactggtgcctctgtcatccgcgcttacaataggagcagagacttcgagataatctctgacaccaaggttgacgctaaccagcggtcctgctatccctacatcatttcgaatagatccgaggccgctagtcttgctccgtgttcttcgcgcaactcccaacaggccctctggtgcagtgggtcactgtccctgctctccccgaagcaaaaaaccggaccagctctccctctcccacacttcctgttgatttag

SEQ ID NO: 109219 - DNA, 3978 bp, Artificial Sequence
  Description of Artificial Sequence: Synthetic coding sequence
atgttacccgtataccaggaagtcaagccgaatcccctgcaggacgctaacctttgcagcagggtgttcttttggtggcttaacccgctcttcaaaatcgggcacaagagaagacttgaagaggatgacatgtatagcgtgctgccggaggacaggagtcagcatcttggcgaggaactgcagggattctgggataaagaagtgctcagggcagaaaatgatgcccagaagccttcactcacccgggctataataaagtgttactggaaatcttaccttgtactcggaatttttaccctgattgaggagagcgcgaaagtgatccagcccatttttttgggtaagatcataaactactttgaaaactacgacccaatggattcagtagccttaaacacggcatatgcctatgctactgtgctcacattctgcacgctcatattggcaatcctgcatcatttgtacttctaccacgtccaatgcgctgggatgaggcttcgagtggcaatgtgtcacatgatttacaggaaggcactacgtctgtcaaatatggctatgggtaagactaccacaggacaaatagtaaatcttttatcaaatgacgtcaacaagttcgaccaggtgacagtcttcctgcactttctatgggccgggcccctccaggctatcgcagtaaccgccctattatggatggaaataggaatctcctgtttggctggcatggctgttctgattattttgttaccactccaatcttgcttcggaaaactgttctccagcctccggtcaaagaccgccacattcactgatgcccggattcgaaccatgaatgaggtgatcactggaatacgcattattaagatgtacgcctgggagaagtcattttcaaatcttattaccaatctccgcaagaaagagattagcaagatactccgaagttcgtgcttgcgtgggatgaatttagcctctttcttttcagcttccaaaataatcgtgttcgtgacgtttacaacgtacgtcctgttagggtccgtaatcaccgcatcacgtgtgttcgtggccgtaactctgtacggagccgttagacttacagtgactcttttttttccctctgcgatcgagagggtatctgaagctattgtcagtattaggcgcatccagacattcctccttctcgacgagatttcccagcgcaatagacagctacccagcgacggcaaaaaaatggtgcacgtacaggacttcaccgctttctgggacaaggccagcgagacccccacccttcagggactctcatttacggtcaggcccggtgaactgttggctgtggtgggccccgtgggagccggtaagtcaagccttttgtccgctgtgcttggcgaactggcccccagccacggtctggtgagcgtgcacggacgcatagcttatgtgtcacaacagccctgggtcttttctgggacactccggtcgaatattcttttcgggaaaaagtacgaaaaggagcgatacgagaaagtaattaaggcctgcgcactgaagaaggacctgcagcttctcgaggacggcgaccttactgttatcggggacagaggaactaccctctcaggcgggcagaaggcaagggtgaacctggccagagcagtttatcaagacgccgacatctaccttcttgacgacccattgtccgccgtggatgccgaagtatctaggcatctttttgagttatgtatttgtcagatccttcatgagaagattaccattctggtgactcatcaactccagtaccttaaagccgcgtctcaaattctgattctgaaggacggtaaaatggtgcaaaaagggacatacacagagtttttgaaatcaggaatagactttggtagtctgctgaaaaaggacaatgaagaatccgaacaaccacctgtacccgggacaccaaccctcaggaatcgcaccttcagtgagtcgagtgtgtggtctcagcagagcagccgccctagcctgaaggatggggccctggagtcccaggataccgagaacgtccccgtcactctatcagaggaaaacagaagcgaaggaaaggtggggttccaggcctataaaaactactttagagccggcgcccattggatcgtgttcatcttcctcattctgctcaacaccgccgcacaggtggcttacgtgctgcaggactggtggttgtcatattgggcaaataagcagtcaatgcttaatgtcacggtgaacggcggagggaatgtcaccgagaagctggacctcaattggtatctaggcatctattctgggttaacagtcgcgaccgtgctgttcggaattgcccgttcactcctcgtcttttacgtacttgttaactcctcgcaaaccctccataataaaatgttcgagtcgatcctgaaggcccctgtgctattttttgaccggaatcccattggccgcatactgaacagattttccaaagatatcgggcatctggatgatctgcttcctcttacttttctcgatttcattcaaactcttctgcaggtggtcggcgtagtctccgtcgccgtggcagtgattccttggattgccattcccctcgtgccactcgggattatcttcattttcctaaggcggtattttctggagacctctcgagacgtcaagcggcttgaatctacaactcgctcgcccgtgttcagccatttaagtagctctctacagggactgtggaccattagagcctacaaagctgaggagcgctgccaggagttattcgacgcccatcaggacctccattccgaggcttggtttctgtttctcacaacatccaggtggttcgccgttcgtctagatgcaatctgcgccatgttcgtgattattgtggcctttggatccctgattcttgccaagaccctggacgccgggcaggtcggcctggctctgtcctacgcgttgacactgatgggcatgtttcagtggtgcgtgcgacagagtgccgaggttgaaaatatgatgatcagcgttgaacgggtgatcgagtatactgatctcgagaaagaagcaccctgggagtatcagaaacgaccccccccagcctggcctcacgagggcgtgattatcttcgataatgtaaacttcatgtattcgccggggggcccgcttgtactgaagcatctgaccgcccttataaaatctcaggagaaagtcggaatagtaggaagaacaggagccgggaagagcagcttgatctctgcgctttttcgtctctccgagccggagggtaaaatatggattgacaaaatccttacaaccgaaatcggactacatgacctgcggaagaaaatgtctattattcctcaggagccagtcctgttcacaggcacaatgcgcaaaaacctagacccattcaacgagcatactgacgaagagctttggaatgcgttgcaggaagtccagctcaaagagaccatcgaagatctgccggggaaaatggacacagagctcgccgagtccgggtcgaattttagcgtcggtcagagacagctggtgtgcttagcacgtgcaattcttagaaagaaccagatactcattatcgacgaagctaccgctaatgtcgacccgcggacagacgaactgattcagaaaaaaattagggagaagtttgcccattgcaccgtgcttactattgcacacaggctgaacaccatcatcgatagcgataaaattatggtgctcgatagcgggagattgaaagaatatgatgagccatacgtcttattacagaacaaagaatctctgttctataagatggtgcaacagctcggaaaagccgaagctgccgctttgacagagactgcaaaacaggtgtacttcaagagaaattaccctcacattggtcacacggatcatatggttaccaatacaagcaacgggcaaccatctacattaacaatttttgaaactgccttgtag

SEQ ID NO: 109220 - DNA, 3837 bp, Artificial Sequence
  Description of Artificial Sequence: Synthetic coding sequence
atgctgccagtttaccaggaggttaaaccaaaccctcttcaggatgccaacttatgttcacgcgtgtttttttggtggctcaatcctctgtttaaaatcggccacaaaagacgattagaggaggatgacatgtatagcgtcttgcctgaggaccggtcgcagcacttgggtgaggagcttcaggggttctgggataaagaagtactgagagcagagaacgacgcacagaagccttcactaacccgcgcgattattaagtgctactggaagtcatatctcgtgttgggcatcttcacgctgattgaggaatctgctaaggttatccagcctatcttcctaggcaagattatcaattattttgagaattatgaccccatggattccgtagcactgaatacggcctacgcttatgctactgtccttactttctgtacactgattctggccattcttcatcatctgtatttctatcatgtgcagtgtgctggcatgcgcctcagggtcgccatgtgccatatgatctatcgtaaggccctgcgtctctcaaacatggctatgggtaagacaactactgggcagattgtcaacctgctctccaatgatgttaacaagtttgatcaggtcaccgttttcctgcatttcttgtgggccggccctctgcaggcaatcgctgtaactgccctcttgtggatggaaattggaataagttgcctagccgggatggcagtattgataatcctgttaccactacaatcttgcttcggcaagctttttagctcccttcgatctaaaaccgctacgtttactgacgctcgaattaggaccatgaacgaggtgattaccggtattcgaatcattaaaatgtacgcctgggaaaagtcctttagtaatctgatcactaacctgaggaagaaggaaatcagtaaaatcctgagatccagctgcttacgaggcatgaatctagctagcttcttttccgctagtaaaattatcgtattcgtaacctttactacttatgttctactgggttcagtaattaccgcctcacgcgtgttcgttgccgtgaccctgtatggcgcagtgcggctcacagtaacgctcttctttcctagtgcaattgagagagtctcagaagccattgtgtcgattcgacgtatccagacattcctgctgctggacgaaatatctcagaggaaccggcagctcccatcagacggcaagaaaatggtccatgtgcaggatttcacagctttttgggacaaggctagcgagaccccaaccttgcaggggctgagtttcacagtccggcctggagaacttctggcagtcgtgggacctgtgggtgctggcaaatcatcactgctgtccgctgttttgggagagttggcccccagccacgggctggtgtccgttcatggcaggatagcctacgtctcacagcaaccgtgggtatttagtggtactcttagatccaacatactctttggaaagaaatacgagaaggagcggtacgaaaaagtcataaaagcttgtgccctgaagaaagacttgcaactcctggaagatggagatctgacggtgataggcgatcgaggcacgaccctatctggaggtcagaaggccagggtgaacctggccagagccgtgtaccaagacgctgacatttacttattggacgaccccttgtctgcagtggacgctgaggtcagcaggcacctgttcgagctgtgtatttgccaaatccttcatgagaaaattaccatcctggtcacccaccagttgcagtatctgaaagccgcttcccaaatccttattctgaaagacggaaaaatggtacagaagggtacttataccgaattcctgaagagtggcatcgacttcggaagcctactgaaaaaggataatgaggaatcagagcagcctcctgtgcccggaacaccaaccctgcgaaatcgcaccttttccgagtcatccgtatggtctcagcagtcctcaagaccatcactgaaggacggggccctcgagtctcaagatgtcgcatacgttttgcaggactggtggctctcttactgggcgaataagcagtccatgctgaacgtcacggtgaatgggggaggaaatgtgaccgagaagctagatttgaactggtaccttgggatatattctgggctcaccgtggctacagttctgttcggaatcgctagatccctgctcgtgttctacgtgctagtcaattcctctcagaccctgcacaataagatgtttgaatctattctgaaggcaccagtgttattctttgatcgcaacccaatagggcgtatcctgaaccgtttctcaaaggacataggccacttagacgaccttcttcccctcacgtttctcgactttatccagaccctgctgcaagtcgtgggggtcgtcagtgtggcagtggctgtgatcccctggatagctatccctttggtccccctcgggatcattttcatcttcctgaggcggtattttctggagacgagtagagacgtgaaacgactggagtcaacaacacgttccccagtattttcccatctctcctcgagtcttcaggggctgtggacaatccgcgcctataaggctgaagaaagatgtcaggagctcttcgatgctcaccaggacctccattctgaggcctggttcctttttctgactacttctcggtggtttgctgtgcgactcgatgcgatttgtgcaatgttcgtgattattgtggccttcggatcactgatcctggctaagactctggatgcgggccaggtgggactggcgttgtcatatgctctgactctgatggggatgtttcagtggtgtgtcagacagagcgctgaagttgagaacatgatgatcagcgttgaaagagtgattgagtataccgatctggagaaggaagccccctgggaataccaaaaacgcccacctccagcctggccccacgaaggtgtgattatcttcgataacgttaactttatgtacagccccgggggcccgctggttctgaaacacctcaccgctctgattaagtcgcaggaaaaagtcgggattgtgggacgaaccggcgctggtaaatctagcctgatctcagcgctgtttcgcctgagtgaacctgaaggcaagatttggattgataagatcctgacgacagagattggtcttcacgaccttcgcaaaaagatgtctatcattccccaggaacccgttttgtttaccggcacaatgagaaaaaatcttgatccatttaatgagcacacagatgaagaactctggaatgccctacaggaagttcagctcaaggagacaattgaagacctgccaggcaagatggacaccgaactggcggaaagcggctcaaatttcagcgtcgggcagaggcagcttgtgtgtttagcacgggccattctccggaagaatcaaatactgattattgacgaggctactgctaacgtcgaccctcggaccgacgaattaatccagaagaaaatcagggaaaaatttgcccattgcactgtgttgacaatagctcacaggctgaatactatcattgacagcgacaaaatcatggtcctggactctggccgcttgaaggagtacgacgagccctacgtccttctccagaacaaggaaagcctcttctacaagatggtgcagcagcttggaaaggccgaagcagcagcattgacggagaccgcaaagcaggtatactttaaacgaaattaccctcacattggacatactgatcatatggtgaccaatacatccaatgggcaacctagtacactgactattttcgagaccgctctgtag

SEQ ID NO: 109221 - DNA, 2580 bp, Artificial Sequence
  Description of Artificial Sequence: Synthetic coding sequence
atgttgccggtgtaccaagaggtgaagccaaatcctttacaggacgcgaatctttgttcacgggtcttcttttggtggcttaaccccctgtttaaaataggccacaaacgccggctggaagaggatgatatgtattccgtgcttcccgaggacaggtctcagcatcttggcgaggaattgcagggtttctgggacaaagaggtgctacgggccgagaatgatgctcaaaagccaagcctcacccgtgctatcattaagtgctactggaaaagctacctagttctcggcattttcaccttgatcgaggagtccgcaaaagtcattcagcccatcttcctcggaaaaataatcaactattttgagaattacgatccaatggactctgtggctctgaataccgcctatgcatacgccaccgtgttgaccttctgcacactgatactcgcaattcttcatcacttatatttctatcacgtgcagtgtgcaggcatgagactgcgcgtggcaatgtgtcacatgatttataggaaggctctgaggttaagcaacatggccatgggtaaaacgacaacaggccagattgtcaatcttctgtccaacgacgtcaacaagttcgaccaagtgactgtatttctccattttctctgggcaggccccctgcaagcaatagccgtcaccgccctgctctggatggagatcggcatttcctgtctggcgggcatggcggttcttatcatcctgctcccactgcagagctgctttggcaagctgttctccagtctccgaagcaaaactgccacattcacggacgcgcgcatccgaactatgaatgaggtaatcaccggcatcaggatcattaagatgtacgcttgggagaaatcttttagcaacctaatcacaaaccttcgcaagaaagaaatcagtaaaattcttcgctcttcctgcctaagaggcatgaatttggcgtcgtttttctctgcatcaaagattatagtgtttgttaccttcactacttacgttctcctgggtagcgtcatcactgctagtcgggtttttgtggctgtcacgttgtatggtgccgtacgtttaactgttacccttttttttccctcggcaattgagcgagtgagtgaggcaattgtgtccatccgccgcatccagactttcctcctgctcgacgagatatcccagcggaatcggcagcttcctagcgacggtaagaaaatggtgcacgttcaagactttacggccttctgggacaaagccagcgagacgcccacacttcagggactatcgtttacagtgcgccccggagagttactcgccgtggtcggcccagtgggcgcaggcaaaagttctttattgtccgcagtgctaggcgaactcgcaccatcacacgggttggtatccgtccatggtcgcatcgcttatgtctcgcagcagccttgggtatttagcgggactctccggagtaacatcctctttggcaagaagtacgaaaaagagaggtacgaaaaggtgataaaggcgtgtgctttaaagaaggatctccagctgctggaggatggggatctcacggtaattggagacagagggactaccctctccgggggccagaaggcccgcgtgaatctcgccagagcagtttaccaggacgcagacatctatctgctggacgaccctctgtccgccgtcgacgctgaagtctcacgacacttgtttgagctgtgcatttgccagatactgcatgagaaaatcacgatccttgtgacacaccaactgcagtacctaaaagcagcaagccagatcctgattctgaaagatggcaagatggtgcaaaagggtacatacaccgaatttttaaagtcggggatagattttggaagccttctcaaaaaggacaacgaggagtctgaacagcctcctgtccctgggacccccacacttcggaacaggaccttttccgaatcgtccgtttggagccagcaaagtagcaggccctctttgaaggatggggctctggaatcccaggacaccgaaaatgttcccgtgacactgtcagaagaaaaccgaagtgagggcaaagtcggctttcaggcatacaagaactatttcagggccggagcccattggattgtttttatctttctgatcctccttaacacggcggcccaggtcgcatacgtgctgcaggattggtggctgagctactgggctaacaaacagagcatgctgaatgtcaccgtgaatggcgggggtaacgtgactgagaagctcgaccttaattggtacttaggtatttactccggattgaccgtcgctactgtcctgttcggcattgcaaggtccctgctggtcttttatgtgcttgtcaatagttcccagacactccacaataaaatgttcgagagcatcctgaaagctcctgttttgttctttgaccggaaccctatcggacggattctgaacaggtttagcaaagacattggccacctcgacgatctgctgccattgactttcctcgatttcattcagagatgggatctggccgtgctgtcttggctggtgagtaattcctag

SEQ ID NO: 109222 - DNA, 2355 bp, Artificial Sequence
  Description of Artificial Sequence: Synthetic coding sequence
atgctgccggtttaccaggaagttaaaccaaaccctttgcaggatgcgaatctctgctcgcgcgtcttcttctggtggctcaacccgctgtttaaaattggacacaagaggcgccttgaagaggacgacatgtattctgtactccccgaggacaggtcgcagcatctgggggaggagctacaggggttctgggacaaagaggtactgcgggctgagaatgacgctcaaaaacctagtctgactcgggcaattatcaaatgttattggaaatcgtacctcgtgctgggtattttcacactcatagaagccttgagactttcaaatatggccatgggtaaaaccacaacggggcaaattgtgaatttgctgtcaaacgatgtgaataagttcgaccaggtgactgtgtttctgcactttttgtgggcaggccccctacaggcaatcgcagtgacagccctcctgtggatggaaatcggaatctcttgtcttgccggcatggcagtattgattatcctgctgcctttacaatcctgctttgggaaactcttctccagtctgaggtctaaaacagctacgttcaccgacgccagaatcaggacaatgaacgaagtcatcactggcatacgtattattaagatgtacgcttgggaaaaaagtttctccaatcttataaccaatctacgcaagaaggaaatttccaagatcctgcgcagttcatgcctgcggggcatgaaccttgcttcatttttctcggcctccaagatcattgttttcgtgaccttcaccacatacgtcctgctgggctccgtaatcacggcctctcgggtgtttgtggccgtcaccctgtacggggccgtgaggctgaccgtgacactgttttttccctccgcgattgaaagagtgagcgaagccatcgtttccattcgcagaattcagactttcctgctcctcgatgagatcagtcagagaaacagacagctaccgtcagatgggaaaaagatggtccacgttcaggatttcacagccttctgggataaagcaagtgaaacaccgaccctccaagggctatcattcacagtgcggcccggtgagttgcttgccgtagtgggccccgtcggcgcagggaagtcctctcttctgagtgcagtcttgggtgagctggctccaagtcatggcttagtgtccgtgcacggacgtatcgcctatgtgtcccagcaaccgtgggtgtttagcggcacccttagatctaacatcctgttcgggaagaagtacgaaaaggagaggtacgaaaaagtgatcaaagcctgtgcactgaagaaggacctgcagctattggaagatggagatctgacagttatcggggacaggggtactacactgagtggtggacagaaggcacgagtaaacctagctagagcagtgtaccaggacgctgacatctaccttctggacgatccactgagcgctgtcgatgccgaggtctctcgccacttattcgagttgtgtatttgccagatcttgcacgagaaaatcacaatcttggttacccaccaactgcagtatctaaaagccgccagccagattcttattctaaaagatggcaagatggtacagaaaggaacttacactgaatttcttaaatccggcatcgactttggaagtctcttaaaaaaagataatgaagaaagtgaacagccaccagttcccggcacaccaacacttcgtaacagaacgttcagcgaaagcagcgtatggtcccagcagtcctctcggcctagcctgaaggacggagccttggaatctcaggacacagaaaacgtcccggtgactctgagcgaggaaaataggtccgaaggcaaggtaggattccaggcatacaagaactatttcagagcaggcgctcactggattgtgtttattttccttatacttctgaacaccgccgcgcaggtggcctatgtcttacaagactggtggctgagttactgggccaacaagcaaagtatgctcaatgtgacggtcaacgggggtgggaatgtgaccgagaaactggacctcaattggtatctgggaatctactcagggttaacagtggcgaccgtactgtttgggatagccaggagcctgctcgtgttttatgttttagtcaactccagccagactttacacaataaaatgttcgagagtatactgaaagcgcctgtcctattctttgaccgcaacccaatcgggcgtatcctgaatcgcttctccaaggacatcgggcatctcgacgatctcctccccctcacattcttggattttatacagcgatgggatctcgccgtgctctcatggctggtttcaaattcctag

SEQ ID NO: 109223 - DNA, 75 bp, Artificial Sequence
  Description of Artificial Sequence: Synthetic coding sequence
atgctacctgtctaccaggaagtcaagcccaatccactgcaggatgcgaatctttgctcgagagtatttttctag

SEQ ID NO: 109224 - DNA, 4185 bp, Artificial Sequence
  Description of Artificial Sequence: Synthetic coding sequence
atgaaggacatcgacatcggtaaggagtatattattccctcaccggggtaccggagcgtgcgagaacggacctcgacgtcaggcacgcatagggatagggaggatagcaagttcagacgcacccgccctctggaatgccaggacgccctcgagaccgccgcccgcgccgaaggcctgtccctggatgctagcatgcacagtcagttaaggattctggacgaggagcatcccaaaggaaagtaccatcatgggctgtccgcactgaaacctatacgcaccacctcaaaacatcagcatccggtggacaatgcgggcctattctcttgcatgaccttctcctggctgagttccttggctcgggtggctcataagaagggcgaattgtctatggaagacgtatggtccctaagcaaacatgagtcgtccgacgtcaattgccggcgcctcgaaagactctggcaggaagagctaaatgaagtgggcccagatgccgcctcacttcgtagggtcgtgtggattttctgcagaaccaggctgatcctgtccattgtttgcctcatgattacccagctggccggatttagtgggccagcctttatggtcaagcacctcttggaatacactcaggctaccgagtcaaaccttcagtactctttactgctcgtgctcggccttctgttgactgagattgtgaggtcttggtctctcgccctgacctgggccctgaactaccgaactggggtccgcttaaggggcgcaattctcaccatggccttcaagaaaattctgaagttaaagaacattaaggaaaagagtctgggggagcttatcaacatttgcagcaacgacggtcagcgcatgtttgaagctgcagcagtggggagcctgctggcaggagggccggtggtggccattctgggaatgatctataatgtgatcatccttgggccaactggattcctcggttccgcggtgttcatcctattctaccctgccatgatgttcgcaagtcggttgacagcctattttaggcggaaatgtgtggcggcaaccgacgagcgggtgcaaaaaatgaatgaagtgctgacctacattaagttcattaagatgtacgcatgggtcaaggcttttagccaatctgtgcagaagatccgggaagaagaacgaagaatactcgagaaggctggctacttccaaagcattacagtgggtgtcgcaccaattgtggtggtgatagcctcggtagtgacattctccgtgcatatgacactcgggttcgacctaacggccgctcaggcattcaccgtcgtgaccgtttttaacagcatgacctttgcactgaaggtcaccccatttagtgtgaagtcacttagcgaagcctctgtagcggttgataggttcaagagcttgttcctgatggaagaggtgcatatgatcaaaaacaagccagcgtccccccatatcaagattgagatgaagaatgcaacattggcctgggactcatcgcacagctctatacagaacagtcctaagctgactccaaaaatgaagaaggacaaacgcgcttctcggggaaaaaaggagaaggtgagacagctgcagcggaccgaacatcaagcagtgctggccgaacagaaaggccacctgttgctagattccgacgagaggcctagtcccgaagaggaggaaggcaaacatatccacctgggccacctgcgcctccaaaggacattgcatagtatcgatttggagatacaggaggggaagctggtcggtatatgcgggagtgtgggttcaggcaaaacatccctcattagcgccattctgggtcaaatgacccttctcgaggggagcatcgccatttccgggacctttgcttacgtagcccagcaggcatggattctcaatgccaccctgcgtgacaacatcctgttcggcaaggaatacgacgaagagcgctacaacagtgttctaaactcctgttgcttacggcctgacctggcaatcttaccgagctccgaccttaccgaaattggcgagaggggggccaatctctccgggggccagaggcagagaatcagtcttgctagagccttatacagtgaccggagtatttatattctcgatgacccactatcagctttagacgcccacgtgggtaatcatattttcaatagcgccatcaggaaacacctcaagtccaagaccgtgctatttgtgacacatcagttgcagtatctggtagattgtgatgaggtaatctttatgaaagaaggatgcatcacagagaggggaacgcacgaagagctgatgaacctgaatggagactatgcaacaatatttaacaatctccttctgggcgagaccccacccgttgaaataaattcaaaaaaagaaacaagcggctctcagaaaaagtcccaggataaagggcccaagactggttcagtcaaaaaagaaaaggccgtcaagccagaggagggccaactggtgcagttagaggagaaaggccagggctccgtcccctggagcgtgtatggggtttatattcaggccgctggaggacctctcgcttttctcgttatcatggccctctttatgcttaatgtgggtagcaccgctttttccacgtggtggctgagttactggatcaaacaaggctccggaaacaccaccgtgacccggggcaacgaaacatccgtgagcgatagcatgaaggataatccacatatgcagtattatgcgtctatttatgctcttagtatggctgtgatgctcatactgaaggctatccgaggcgtggtatttgtgaaagggaccctgagagcatcctccaggttgcacgatgagctttttcgcaggattctgcggtcccccatgaagttttttgacacaacccccactggccgcattctgaacaggttctccaaggatatggatgaagtggatgttcgtctacccttccaggccgagatgttcatccagaacgtcattctggtgttcttttgcgtgggcatgattgcaggcgtttttccttggttcctcgtcgccgtcggccccctggtgattctgttctcagtgctgcacatcgtcagtagataccaggagcttctcgacgacaaccaggcgcccttctttttgtttacatgcgcaatgcgctggctggctgtccgactagacctcattagtattgcattaattaccactactgggctgatgatcgttctgatgcacgggcaaatcccacctgcctacgcaggactggccatatcttacgcggttcagctgaccgggttattccagtttacagtgcgtctggcttcagagaccgaggcccggtttactagcgtagaaagaatcaaccattatatcaagacactgtcactcgaggcaccagcacggattaaaaacaaggcacccagccctgattggccacaggagggcgaggtcaccttcgaaaacgccgaaatgcgctatcgcgaaaacctgcctctcgtcctgaaaaaagtgagttttaccatcaaaccaaaggagaaaatcgggattgtcggaaggactggaagtggcaaatccagcctgggcatggccctctttcggctcgtagaactgagtggaggctgtatcaagatcgatggcgtgagaatttctgacatagggcttgcagatctgcgttccaagctgtccattatacctcaggagccagtcctgttctctggcaccgtgcggtcaaatctcgaccctttcaatcagtacactgaggaccagatctgggacgctctcgagcgtacacacatgaaggaatgtattgcccaattgcccctcaaattggagtcagaggtgatggaaaacggggataacttctctgtgggagaaagacagctgctttgtatcgcgagagcactgctgcgacactgcaagatcttaatcttggacgaagctaccgcagcgatggacaccgaaactgatctgctgatccaggagactatccgcgaagccttcgcggactgcacaatgttaaccattgcacaccggctgcacaccgttctgggatctgataggatcatggttctagcccaagggcaggtcgtggagttcgatactccttcagtccttttgtctaacgactcttctcgcttttatgctatgtttgctgccgctgaaaacaaagtagcagtgaagggttag

SEQ ID NO: 109225 - DNA, 4314 bp, Artificial Sequence
  Description of Artificial Sequence: Synthetic coding sequence
atgaaggatatcgacatcggtaaagagtatatcattcccagtcccggttacaggagtgtgcgagaacgaacctccacttcaggcacacacagggatcgcgaggattccaaatttagacggacgagaccactagaatgtcaggacgctcttgagacagccgcccgggctgagggcttatccctcgatgcttccatgcattctcagctgcggatactggatgaggagcaccccaaaggtaagtaccaccatggactatcagccttgaaacctatcagaacaaccagcaaacaccagcaccctgtggacaacgcaggcttgttttcctgtatgacattttcctggttaagcagcctggcaagagttgcgcacaagaaaggcgagctgagcatggaggacgtttggtccctcagcaagcacgagtcgtcagatgttaattgtaggcgtctggagagactgtggcaggaggagttgaacgaggtcggacccgacgccgcctcactgcggcgcgtggtctggatcttctgcagaacgcggctcatactgtctatcgtctgcctgatgataacccagcttgcaggtttctcaggaccagccttcatggttaagcatctgttggagtatacccaagcaacagagagcaatctacagtacagtctgctgctggtgcttggactgctcttaacggagatagtgaggtcctggtccctggcgctcacctgggcactcaactacaggacaggagtccgccttcgaggggcaattttgaccatggccttcaaaaagattttgaagctcaaaaacattaaggaaaagagtctaggcgaactcatcaacatctgctcaaacgatgggcaacgtatgttcgaagcagcagcagtcgggtccctgcttgctggggggcccgttgtggctattctggggatgatctacaacgttatcatcttaggaccaaccggattcctgggatctgccgtgtttattttgttttatccagccatgatgtttgcttccagactgaccgcctactttcggcggaaatgcgtcgctgccacagacgaaagggtgcagaagatgaacgaagtgctgacctacatcaagttcatcaagatgtacgcatgggtaaaggcctttagtcaatccgtgcaaaaaatacgcgaagaggaaaggagaatcctggagaaggccggatactttcagagcataaccgtcggagtagcacccatagtcgttgtaattgccagcgtcgtgaccttctctgtgcatatgaccctgggttttgacctgacggctgcacaggctttcaccgtcgttacggtgtttaatagcatgacctttgctctgaaagttacacctttttcagtgaagtcactttccgaggcaagtgtggcggtcgacagattcaagtccctttttctgatggaggaagtgcatatgataaaaaataagccggcttccccacatattaagatcgagatgaagaatgccactctcgcttgggactcatctcactcgtcgattcagaacagcccgaaactgacacccaaaatgaaaaaagacaagcgcgcctctagaggaaaaaaggaaaaagtgaggcaattgcagcgtacggagcaccaggcagtgctcgcagaacagaaggggcacctcctgctcgactccgacgaaaggcctagccccgaggaagaggagggcaagcatatacacctaggacatttgcgtttacagcgaactctccactccattgacctggagatccaagagggaaagctggtgggtatctgtggatctgtcggatcaggtaaaacttccttgatctcagcgatcctaggacaaatgactctgctcgagggtagtattgcaattagtggtactttcgcatacgtcgctcagcaggcctggatcttgaatgcaacccttcgcgataatattctcttcggaaaggagtatgatgaagagcgctacaacagtgtgctgaattcatgctgcctccggccagacctagcgatcctccctagcagtgacctgacagagatcggggaacggggggccaatctgtctggtggacagagacagcggattagcctggccagggctctatatagcgacagatcaatctacatcctcgatgatcctctttcagccctggatgcccatgtggggaatcacatcttcaacagcgctattcgtaaacatctgaaaagtaaaaccgtgctgttcgtaacacaccagcttcaataccttgtcgactgcgacgaagtgatcttcatgaaggagggctgcattacagagcgcgggacacatgaagagctgatgaacctgaatggagattatgccacaatttttaataacctgctgttgggggaaacaccaccagtagagatcaattcgaagaaagagacaagcggttcacagaagaagagccaagacaagggcccaaagacgggaagcgtgaaaaaggagaaagcagtcaagccagaggaaggacaactggttcagctcgaggagaagggacaaggaagcgtgccatggagcgtgtatggcgtgtatattcaagccgcggggggtcctctcgcctttctcgttatcatggcccttttcatgctcaacgtggggtctactgccttcagtacttggtggctctcttattggatcaagcaggggtccgggaatacaactgttactcggggcaacgaaaccagcgtttccgattctatgaaggacaatcctcacatgcagtattacgcttccatttacgccttgtctatggctgttatgttgattctcaaagccattcgtggcgtggttttcgtgaaagggaccttacgtgctagctcccgcctgcacgatgagctgtttaggcgaattcttcgaagcccaatgaagttttttgatacaaccccaacgggacggattcttaatagattctccaaggacatggatgaggtagatgtcagactcccatttcaggctgagatgtttatccagaacgtgatactggtgttcttttgtgtcgggatgatcgccggtgttttcccgtggttcctggtggcagtgggacctctggtaattctgttctccgtcctccacattgtctccagggtccttattcgggaactgaagaggttagacaatatcacccaaagcccattcctctctcacatcacctccagcatccaaggactggccacgatccatgcgtataacaaaggccaggagtttctccacaggtatcaggaattacttgatgataatcaagctccctttttcctgttcacatgcgccatgaggtggcttgctgtgcgcctggacctgatcagcattgccttgatcaccacgactgggctcatgatagttctgatgcacggccagatcccgccagcgtacgccggactggctatttcatatgccgtgcaactcacaggattatttcagttcacagtccgtttggcatctgagaccgaggcccggtttacctcagtcgaacggataaaccactatatcaaaactctgagcctcgaggcgcctgcaaggatcaagaataaagctccatcacccgattggcctcaggaaggagaagtgacctttgagaacgccgagatgagataccgcgaaaacttacctctggtattgaaaaaagttagcttcacgatcaagcccaaggaaaaaatcggaattgtgggacggaccggtagcggtaaaagctctctgggaatggctttgtttagactggtggaactttccggcggatgcatcaagatagacggggtacgcatctctgacataggtctggcagatctcaggtctaagctgagcatcatacctcaggaacccgttctgtttagtgggacagtgagatccaatttagacccttttaaccagtacactgaggatcaaatctgggatgcattggaacggacacacatgaaagagtgcatcgcgcagctccctctcaagttggaatcagaggtgatggagaatggggataactttagcgtgggggagcgccagcttctctgcattgcaagggccctgctgagacactgcaagattcttatcctggatgaggcaacagcggccatggatacagagactgatttgttaatccaggagactatcagggaagccttcgctgattgtacgatgctcaccattgctcaccggctgcatacagttttgggatcagaccgaataatggtcttggcacagggccaggtggtggaatttgatacaccatctgttctgctgtccaacgactcaagcaggttctacgcgatgtttgccgccgctgagaacaaggtcgctgtgaagggatag

SEQ ID NO: 109226 - DNA, 627 bp, Artificial Sequence
  Description of Artificial Sequence: Synthetic coding sequence
atgaaggatattgacattggaaaagagtacatcattccatctcccggataccgctccgtcagagaaaggacctcaacctctgggacccatagagatagagaagactccaaatttagaaggactagacctctggagtgccaggacgccttagagaccgctgcgagggccgaaggcctctctcttgatgcatccatgcactcccagcttaggattctggatgaagaacacccgaagggcaagtaccatcatggactgtcggcattaaaacctataagaactacatcaaaacaccagcacccagttgacaatgccgggctctttagttgtatgaccttcagttggctgtcctcgctggctcgggtggcgcacaaaaagggagagttgtccatggaggacgtttggtctctgtcgaaacacgagtcaagtgatgtcaactgcagacgattagagaggttatggcaggaggagttgaatgaggtgggtcctgatgctgccagcttgagaagggttgtctggattttttgccgaacccggctcattctctccatcgtatgtcttatgatcacgcagctggcagggttttcaggtccaaactttcaggatggttgcatcttgaggtcagaatag

SEQ ID NO: 109227 - DNA, 2511 bp, Artificial Sequence
  Description of Artificial Sequence: Synthetic coding sequence
atgcatagccagctgaggatcctggatgaagaacaccctaagggaaagtatcatcacggcctgtctgccctgaagcctattaggacaaccagcaagcatcagcaccctgtggacaatgcggggctcttttcatgtatgactttttcgtggctgtctagcctggccagagtagcccacaagaaaggcgaactctccatggaagatgtgtggtcactgtcaaagcacgaaagcagcgacgtgaactgccgccgcctggaacgattatggcaggaggagctgaacgaggtgggccctgacgccgctagccttaggcgagtcgtgtggattttctgccggaccaggttaattctctctatagtgtgtcttatgatcacacagctggctggattctcgggtcctgcctttatggtcaaacatctgttagaatatactcaggcaactgagagcaacctacaatatagcctcctactggtgctcggcctgttgttaaccgagattgtcagatcctggtcactcgccctcacctgggccctgaattataggactggggttagattgcgcggcgccattctaaccatggcttttaagaagatcctcaagctgaaaaacataaaagaaaagtctttaggcgagttaattaacatttgctcaaatgacggccagcgcatgttcgaagcagcagccgtgggttctctcctggctggcggacctgtcgtcgcaatcctcggcatgatctataatgtgatcatcctcggacctactggtttcttgggaagtgctgtctttatactcttctacccagcaatgatgttcgccagccgcctgacagcttacttccgcaggaagtgcgttgccgccaccgatgaacgagtgcagaagatgaacgaagttcttacctatattaagttcatcaaaatgtatgcctgggtcaaagccttcagtcagtccgtccaaaaaattagggaagaggagcgcagaattttggaaaaggcgggatactttcaatccatcactgtgggagtggcccctatcgtggtagtgattgccagtgtggttaccttcagcgtccacatgaccctgggctttgacctgacagcagcacaggccttcacggtggttaccgtattcaactcaatgacattcgccctgaaagtcacccccttctccgtgaaatctctaagcgaagcttctgtcgccgtggaccggttcaaaagtctgttcctgatggaagaggtacacatgatcaaaaacaaaccggcatcccctcatattaaaatcgaaatgaagaatgcaaccctagcctgggacagctcacactcctcaattcagaattccccaaagctgaccccaaagatgaaaaaggacaaacgggcaagccggggtaaaaaagagaaggttcgccagctgcagcgcacagaacatcaggccgtcctggcagagcagaagggacacctgctgctggactctgacgagagaccttctccagaggaggaggagggcaagcatattcatctgggacatctccgactgcagcgtaccctgcattctatcgaccttgagatacaggagggtaagctcgtgggtatttgcgggtctgttggcagtggcaaaacctcactgataagtgctattctaggtcaaatgacactgctggagggctccatagccattagcggtaccttcgcctacgtggcacagcaagcatggatcttgaatgccacactgagagacaacatactgttcggaaaggagtacgatgaggaaaggtataacagtgtcctcaatagctgctgcctgaggcctgacctggccatcctcccctcctccgatctgacggagatcggcgagaggggcgcaaatctgagtggtggccaaaggcagcgcatctcactggcccgagccctctattccgaccgtagcatttacatcttagacgatcccttgtcggcgctcgacgcccacgtgggcaatcatatattcaattctgccattcgcaaacatctcaaaagtaaaaccgtgctatttgtgacgcaccagctgcagtatcttgttgactgcgatgaagtcattttcatgaaagaaggatgcatcaccgagagaggcacccacgaggaactgatgaacctgaacggcgactacgccactattttcaacaatttgctcctaggcgagacccctccggtggaaattaactccaagaaggaaaccagcgggagccagaaaaagtcgcaggacaaaggccccaaaaccggtagtgttaagaaggagaaggccgtgaaacccgaagaagggcagctggttcagctggaggaaaaaggtcaggggtccgtcccttggtctgtgtacggccaccccggctgctggggacctctgggcatccccggatactatggcccgttccacgccgagtgtcgtcaacacagactccagcatcttgttgtcgaactgttagatcaggcccgcaagagagagcaccactgtgatagtagggaacgcgacctgggcgaatag

SEQ ID NO: 109228 - DNA, 678 bp, Artificial Sequence
  Description of Artificial Sequence: Synthetic coding sequence
atgaaggacatagacatcggtaaggaatatataattcccagcccaggatatcgttccgttagggagcgcacgtctacctcaggcacccaccgagacagggaggacagtaaattccgcagaacacggccccttgaatgtcaggacgcactagagacagccgcgagagccgaagggctttctctggacgcaagcatgcacagtcagctgcgtattttagacgaggaacacccgaaaggcaagtaccaccacggactgagtgcgttgaagcctattagaacaacgtccaagcaccagcaccccgtggacaacgctggtctgtttagttgtatgactttttcatggctctcctccctggctagagtggcccacaagaagggtgagctgtctatggaggacgtgtggagcctaagtaagcacgagtcaagcgacgtaaactgtcggaggcttgaacggctgtggcaggaggagctaaacgaggtgggccctgatgccgctagtctgcgcagggtggtatggatcttttgtcgcactaggctcatcctcagcatcgtgtgcctcatgataactcagctggctgggttcagcggacctcctagctttggggattgtagcatctcagcagaggtttgtggcaaccgattgcactgcaccgctattctattatcatgcttcacatag

SEQ ID NO: 109229 - DNA, 696 bp, Artificial Sequence
  Description of Artificial Sequence: Synthetic coding sequence
atgaaggacatcgacatcgggaaagagtacattatcccgagcccagggtatagaagtgtgcgtgagcgtacttccacttctggtacccaccgggatcgcgaagattccaagtttcggcggacaaggccactcgaatgtcaggatgccttggagaccgccgcacgcgccgagggccttagcctcgatgctagtatgcacagtcaactcaggatcctggacgaagagcatcctaagggcaaatatcaccatggcctgtccgcgctgaagccgatcaggaccacttctaagcaccagcacccggttgataacgctggcctgttcagttgtatgactttttcttggctatcatctctggcccgcgtggcccacaaaaagggagagttatcaatggaggacgtgtggtccctgtctaagcatgaaagttccgatgttaactgtcgtcggctagagcggctatggcaggaggagttgaatgaagttggccccgatgcggcgagcctgagaagagtggtgtggatcttctgtagaacacggctgattctcagtattgtgtgtctgatgatcactcagcttgcggggttcagcggcccagtgtcaagcaatcaccccttccggcagagccccggggcacgacctagaccagcgctcactctcctgttctgctgcaggggatgcgctcaactgtgggcccgctag

SEQ ID NO: 109230 - DNA, 444 bp, Artificial Sequence
  Description of Artificial Sequence: Synthetic coding sequence
atgaaggatattgatattggtaaagagtatattattccctcacctgggtacagaagcgtgcgggagcgcacgagtactagcggaacacacagagacagggaggactccaagttccggagaacacggcccctggaatgccaggatgcccttgaaactgcagcccgagccgagggtctctctctcgacgcttcaatgcattctcagctgcgcatcttggatgaggagcacccgaagggcaagtaccaccatgggctgtctgctcttaagccaataaggaccaccagcaagcaccagcaccctgtcgacaacgctggtctgttttcatgtatgaccttttcgtggctgtcttcactggcacgagtcgcccataagaagggggaactgtccatggaggacgtatggagtctctctaaacacgagtcatccgatgtcaactgcaggtag

SEQ ID NO: 109231 - DNA, 639 bp, Artificial Sequence
  Description of Artificial Sequence: Synthetic coding sequence
atgaaagatatcgatattggcaaagagtatattataccctctcctgggtaccgctcggtaagggagagaactagcacctcaggtacacaccgggaccgagaggattctaagtttcggcgcactagaccgctggagtgtcaggacgccctcgaaactgcagcccgagccgagggactgagcctggatgcgagtatgcattcccaactgcgcatccttgatgaggaacacccaaagggaaagtaccaccacgggctctctgctctaaaaccaatcaggactacatcgaaacaccagcatccagtggacaacgctggtctgttctcgtgtatgaccttcagttggctaagttccttagcccgcgtggcccacaagaagggagagctctctatggaagacgtgtggtcattgtctaaacacgaatcctctgatgtaaactgcaggcgcctggagaggctttggcaggaagagctgaacgaggtcgggccagatgccgcatccctccggcgtgtcgtgtggatcttctgtcgcacacggctcattctctccattgtttgcctcatgataacccagctagcaggcttttccggaccacttgcgtggtgttgtcaggaccttgacctcgggggagtgagcctgtag

SEQ ID NO: 109232 - DNA, 1530 bp, Artificial Sequence
  Description of Artificial Sequence: Synthetic coding sequence
atgcagagctggagtcgggtgtactgtagcttggcaaagaggggccattttaaccgcatctctcacggactgcagggtttgagcgctgtgccactgcggacatacgccgatcagcccatcgatgcagacgtgacagtgattggcagcggacctggtgggtacgtggcagcgatcaaggcagcacaactgggctttaaaaccgtctgtatcgagaaaaacgaaacgttgggaggtacctgtctgaatgtagggtgcatcccttctaaggctttgctcaataacagtcactactatcacatggcccacgggaaggattttgcctcccgtgggattgagatgtcggaagttcgtctgaacttggacaagatgatggaacagaaaagcaccgccgtaaaagcactaactggtggcatcgcccacctcttcaaacagaataaagtcgtgcatgtcaacggctatggcaagattactggaaaaaaccaagtcactgctacaaaagccgacggggggactcaggtgatcgacaccaaaaacattctcattgcaacgggctctgaagtgactccttttcccgggatcaccatcgacgaagatacaattgtgagctcgacaggcgccctctcgctgaaaaaggtccctgaaaagatggttgttattggcgcgggagtgattggtgtagaacttggtagcgtgtggcagcgactgggtgccgacgtgaccgcagtcgagtttctcgggcacgtgggtggagttggaatagacatggagatctcgaagaattttcaaaggatccttcagaaacagggtttcaagttcaaacttaacaccaaagtcacaggagcaaccaaaaaatcagacggcaaaatagacgtgtctatagaggctgccagtgggggtaaggccgaggtgatcacatgtgacgtgctgctggtttgtattggacgccggcccttcaccaaaaacctggggctggaagagttgggcattgagctggacccccgggggagaatacccgtgaacactcgctttcaaaccaagatacccaacatctacgcgataggcgatgttgtcgccggtccaatgctcgcccataaagcagaggacgaggggatcatctgcgttgagggcatggccgggggggctgtccacattgattacaactgtgtgccatccgtgatctatacccaccccgaagtggcttgggttggaaagagcgaagaacaactcaaggaggaaggcatcgagtataaagtggggaaatttccatttgccgccaactctagagcgaagacgaatgccgacacggatggtatggttaaaattctagggcagaaaagtactgaccgggtgctgggagcccatatcctgggccctggtgccggtgagatggtcaatgaagccgcactggcactggaatacggggccagctgcgaagatattgcccgcgtatgccatgcacatccgacgttaagcgaggccttccgtgaagctaatttggccgcatcttttggaaagtcaataaatttttag

SEQ ID NO: 109233 - DNA, 4512 bp, Artificial Sequence
  Description of Artificial Sequence: Synthetic coding sequence
atggcggccccagccgagccatgcgctggacagggcgtgtggaaccagaccgagcccgagcctgcagccacgtccctgctcagcctgtgctttctgcgcacagcaggcgtctgggttcctccaatgtacctctgggtgctaggcccaatttatctactcttcattcaccatcacggccgggggtacctgagaatgagcccactctttaaggcaaagatggttttaggttttgcactcattgtcctgtgtacttcctcagtggctgtggccttatggaaaattcagcaggggacacctgaggcaccagagtttctgattcaccctacggtgtggctgacaacaatgtcattcgcagttttcctgattcatactgaaaggaaaaagggagttcaaagcagcggcgttcttttcggctattggttgctgtgttttgtacttcctgcgactaacgctgctcagcaagcgagtggggcaggatttcagagtgaccctgtacggcacttgtcaacttatttgtgcctatccctggtggtcgctcaatttgtgctgtcctgcctggctgaccaaccaccctttttccccgaagatccgcagcaatctaacccctgccccgaaaccggcgcagcctttccctccaaagccactttctggtgggtgtctggactcgtttggcgcggctataggcgccccctgcggcctaaagacttgtggtcactcgggcgcgagaatagcagcgaagagctggttagcaggctggagaaagagtggatgagaaaccgttctgctgcaagacgacataacaaagctattgcttttaagaggaaaggagggtccggaatgaaggcccccgagacagaacctttcctgcgccaggaaggttcgcaatggcgccccctgctaaaagcgatctggcaggtttttcactcaacattcctgctgggtaccctctctctaattatttctgacgtctttaggtttaccgtaccgaaactgttgagcctcttccttgaattcattggcgaccctaagcccccggcatggaaggggtacctgctcgccgttctcatgtttttgagcgcttgcctacaaactctatttgagcagcaaaacatgtacagactgaaagtgctccagatgcggctgaggtctgctatcacagggctcgtgtatcgaaaggtactggcccttagctcggggagccgaaaagctagcgcagtgggggacgtcgtcaacctcgtgtcggttgatgtgcagagactgacggaatcggtgctctatctcaatggcttgtggctccccttagtatggatcgttgtgtgctttgtctacctgtggcaactcctcgggcctagcgcgcttacagcaatcgccgtttttctatccctgttacccttgaactttttcatatctaaaaaaagaaaccaccatcaagaggagcagatgcgccagaaggactcacgagcacgccttacctccagcatactcaggaactctaaaacgatcaagttccacgggtgggagggtgccttcctcgaccgggtactcgggatcagaggacaggagctcggcgctctgcgaacgtccggattgctgttttcagtgagtttggtttcctttcaggtctccacattcctggttgccttggtggtattcgccgttcacaccttggtggctgaaaatgctatgaacgctgagaaggcatttgtgactctgactgtgctgaacattctcaacaaagctcaggctttcctcccattttccattcacagccttgtccaggcccgggtcagctttgacaggctggtgactttcctttgtctcgaggaggtcgaccctggagtggttgacagttccagcagtggcagtgccgctggaaaggactgtattacaatccactctgccacatttgcttggtcccaagaatctccgccatgcctgcaccgaattaatctcacagtccctcagggctgccttctagcagttgttggacccgtgggcgctggtaaaagcagtctactgagcgcgctgctgggagagctttcaaaggtggagggattcgtctccatcgagggcgccgtcgcatatgtgcctcaagaagcctgggtgcagaatacttctgtggtcgagaatgtctgttttggacaggaactggacccaccttggctggagcgagtcctggaggcctgtgcattacagcccgacgtagatagtttcccagagggaatccatacttccattggcgaacagggcatgaatctgtcaggagggcagaaacagcggcttagcctggcacgggccgtgtatcgcaaggccgccgtctacctcctggatgaccccctggccgcgctcgacgctcacgtgggacaacacgtgttcaaccaggtaatcggtccaggtggtttgcttcaagggaccacacgcatactcgtcacccatgcattgcacattcttccacaggccgactggattattgtcctggccaacggggctatcgctgagatgggtagttatcaggagctcctgcagcggaaaggtgctctgatgtgtttattggatcaggccaggcagccaggtgaccgtggcgaaggggaaaccgagccaggcacttctacaaaagaccccagagggaccagcgcggggcgcaggcctgaactgagacgggagcggtccataaagtcagttccggagaaggacagaaccactagcgaagcccagactgaagtgcccctcgacgaccccgacagggccggctggcccgccggaaaagattctattcagtacggccgcgtcaaagcaacggtccacttagcttacctgagagccgtggggacccccttgtgcctctatgccctctttctcttcctgtgtcagcaggtcgccagcttttgcagaggctactggctgtcactgtgggcagatgaccccgctgtggggggtcagcaaacccaggccgccttgaggggaggaatttttggcctgctcggctgccttcaagccattggcttgtttgcctccatggccgccgttttgctggggggcgctcgcgccagccgactgctctttcagaggctcctctgggatgtcgtgcgaagcccgatttcctttttcgagagaaccccaattgggcacttacttaacagattctcaaaagaaaccgacacagtggacgtggatatccctgacaagttgaggtctctgttaatgtacgcctttggcctgctcgaggtttctttagtggtagctgtcgcaactcctctggcaacggtggcaattctgcccctgtttttgctctatgccggcttccagagcctgtacgtcgtctcctcctgtcagctacggagactcgaaagcgcttcttattcttctgtgtgttctcacatggccgaaacatttcagggcagcacagtagttagagcctttaggacccaggcacccttcgtcgcacagaacaatgctcgagtggatgagagtcaacggattagcttcccgagactggttgccgaccggtggttggccgctaacgtggaactcctcgggaacggcctggtgttcgccgcggccacgtgcgcagttctgtccaaagcacatttgtctgcaggcctggtgggcttctcggttagtgcagcccttcaagtgactcaaacgctccagtgggtagtccggaactggaccgatctggaaaactccatcgtcagcgtggaacggatgcaggattatgcctggacaccaaaagaggcgccctggcgcctcccaacgtgcgcagcccagccaccatggccacaaggggggcagatcgaatttagagatttcggcctcagatacaggccagagctgcccctggcagttcaaggcgtaagttttaaaatacatgctggtgagaaggtggggattgtaggacggaccggggctggaaagtcatcactggcttcgggcctattgagactacaggaggcggctgaggggggtatctggatcgacggagttcccatagcgcacgtggggctccacaccctgcgatccagaatctctattattcctcaggaccctattcttttccccgggtcattgcgaatgaatctggatctgcttcaggagcattcagacgaggccatttgggctgccttggagacagtccagctgaaggcactagtggcatccctgccaggtcagcttcagtacaaatgtgcagataggggcgaagatctttctgtaggtcagaagcaactcttgtgtctggcaagagctctcctgaggaagactcagatcctgatcctggacgaagcgaccgccgcggtcgatcccggaaccgaactgcagatgcaagccatgcttggcagttggttcgctcagtgtactgtactgctcatcgcccaccgattgcggtctgtgatggattgtgcacgggtgttggttatggataagggtcaggtggccgagtctggctctcctgcacaattattggcacagaaggggttattttaccggctggcccaagagagcggcctggtgtag

SEQ ID NO: 109234 - DNA, 2616 bp, Artificial Sequence
  Description of Artificial Sequence: Synthetic coding sequence
atggcagctcctgctgagccttgcgccggccaaggtgtgtggaaccagacagagcctgagcccgctgccacttcactgctgtctctctgcttcttaaggacagcaggtgtatgggtgccacccatgtacttgtgggttctagggccaatttatctgctgtttatacaccaccacggccggggctatcttcgcatgagcccactctttaaggctaagatggtgctgggcttcgcgttgatcgtgctgtgtacttccagcgtagcagtagccctctggaagattcagcaggggacgccggaagctccggaattcctgattcaccctaccgtgtggctgacaaccatgtccttcgccgtcttcttgatccacacagaaagaaaaaagggcgtccagagcagcggagtgcttttcggctattggctgctctgttttgtacttcctgccactaacgcagctcagcaggctagcggagccggattccaatctgaccccgtccgacatctctccacctatttgtgcctcagccttgtggtggcccagtttgtgctcagttgcctcgccgaccagcctcctttcttcccagaagacccccaacagtcaaatccatgccctgaaacaggggccgcctttccatcgaaagccactttctggtgggtctctggtctggtttggcggggctacagaagacctctacgcccaaaggatctgtggagcctgggacgggaaaattcatctgaggaattagtatctcgactggaaaaagagtggatgaggaatcgatcagcggcacgaagacataacaaagccattgcctttaaaaggaaaggcggcagtggaatgaaagctccagagaccgaaccatttctgaggcaggaggggagccaatggcggcccctattaaaagctatttggcaggtatttcatagtactttccttttggggaccctgagtctaattatcagcgacgtatttagatttacggtgccgaaattgctaagcctgtttctggaatttatcggtgatccaaaacccccggcgtggaaaggatacctgttggccgtgttaatgtttctgtcagcttgtttacagacactgtttgagcaacaaaacatgtacagactgaaagttctgcagatgcgactcagatccgcgatcaccggtctggtgtatagaaaagtgctcgccctgtcttcaggaagtcgaaaagcttccgcagtgggcgacgttgtgaacctggtctctgttgatgtccagcgtttgaccgaaagcgttctttacttgaatggactgtggcttcccctggtgtggattgtagtatgcttcgtatacctttggcagctgttggggcccagcgcgctaaccgcaatcgcagttttcctcagcctgcttcccttgaatttttttatatcaaagaagcgaaaccaccaccaggaagagcaaatgcgccagaaagatagccgcgcccgcctgaccagctcaattttgagaaactctaagacgatcaaatttcacggctgggaaggagcctttctggacagagtgttaggcattaggggacaggaactgggagcactgcggacatccggcctgttattctccgtttcactggtctcattccaagtttcgacctttctggtggcactcgtagtgttcgccgttcacactttggtagccgaaaacgctatgaacgcggaaaaagcattcgttactctgaccgttctcaatattctgaacaaggcacaggcgtttttgccattttcgatccactccctagtacaggcaagggtttcattcgatcgcctcgtgactttcttgtgtcttgaagaggtagatcccggcgtggtagattcctctagctccggcagcgccgcagggaaagattgtatcacaattcacagcgccacatttgcttggtcacaggagtcgcctccatgcctccataggatcaaccttacggtgcctcaggggtgcctgctcgctgttgtgggccctgtgggcgctggcaaatcaagtctgttaagcgcgcttctcggcgagctgagtaaggtggaggggttcgtctctatagagggggctgtagcctatgttccccaggaggcctgggtgcagaacacttctgtggtggagaatgtctgtttcggacaggaactagacccaccctggttggaacgcgtattggaagcttgcgcacttcaacccgacgtcgactcattcccggaaggcatccacacatcgatcggcgagcagggaatgaacttaagtggaggccagaagcagcgcctttcgctggcaagagcagtgtataggaaagccgccgtttatcttctggatgaccccctggccgctttagatgcccatgtaggccaacacgtctttaaccaggtgattgggcctggggggctcctacagggcacaaaacagaatctggggcctgcaccaagaacccctgaagcaccactgcaggctggcggcccatcacttgatgcccgaggcccaagtagccagtcactgcgcaggaccgtgccccttcaaaagccacgacaacgattcttgtggatgacgctcactggtcaggatggccaacaggaacgcacggcgagtaacacggcagggtag

SEQ ID NO: 109235 - DNA, 2019 bp, Artificial Sequence
  Description of Artificial Sequence: Synthetic coding sequence
atggccgcccccgcggaaccctgtgccggacagggtgtgtggaatcagacagagccggaacctgcggctacatctctgttatctctgtgttttctgagaaccgcgggcgtgtgggtcccacctatgtacctgtgggtgctgggcccaatctacctcttgtttatccatcatcacggaaggggatatctgagaatgagcccactttttaaggcaaagatggtggcagccatcccaggctctttagagcctggcaacgtgcttggtttcgctctgattgtgttgtgtaccagttcagttgccgtcgccttatggaaaatccagcaaggaacccctgaggctccagagtttctcattcatcccaccgtttggctgacaaccatgtccttcgccgtattcctgatccatacagagaggaaaaagggcgtccagagctctggcgttttgttcggttattggctgctgtgctttgtcctacccgctacgaacgctgcgcaacaggcatcaggtgcaggctttcaaagcgaccccgtgcggcacttatctacctacttgtgtctgtcactagtggtcgcgcagtttgttctgtcctgtctggccgaccagccaccattctttccggaggacccacagcagtccaacccatgcccagaaacgggcgccgcatttccgtcgaaggccactttctggtgggtgtctgggctagtgtggcggggatatcggcggcctcttagaccaaaagatctgtggtcccttggccgggagaactcttctgaggaattagtatctaggttggagaaagaatggatgcgtaacagatccgccgcccggcgccataacaaggccatagcattcaagcggaaggggggctccggcatgaaggctcccgaaacggaacctttcctgcgccaggagggcagccagtggagaccgttgttgaaggcaatttggcaggtgttccacagcaccttcttacttggcaccctgagtctgattatctctgacgtgtttaggtttactgtacccaagctgctgtctctctttctggagtttatcggggatcctaaaccccccgcatggaagggctatcttctggcagtgctcatgttccttagcgcgtgcctccagacactgtttgagcagcagaacatgtaccgtctgaaagtgctgcagatgaggctgcgttccgcaatcacaggcttagtataccgcaaggttcttgccctgtcatctggttctcggaaggcctcagctgtcggagacgtggttaatctagtttccgtggatgtccagcgcctgactgagtcagttctgtatctgaacgggctgtggctcccacttgtctggatagtggtctgtttcgtgtacctgtggcagctccttggaccatccgctctgaccgcaatcgctgtgttcctgtcacttctgcccctcaattttttcatatcaaagaagagaaaccatcatcaggaagaacaaatgcggcagaaagactcccgagcccggctgacatcgtcaattttgagaaatagtaagaccatcaagtttcatggatgggaaggggctttcctggatagggtcttgggtattcggggccaagaacttggcgcactgaggacaagcgggctccttttctccgtctctttggtgagcttccaggtctctaccttccttgtcgcccttgtggttttcgccgtgcataccctagtggccgagaatgccatgaatgccgagaaagccttcgtgactttaaccgtgcttaatatcctcaacaaggcccaggcgttcctgccattctccattcacagtctagtgcaggcccgcgtgtcctttgatagattggtgactttcctgtgccttgaggaagtagatcctggcgtggtggattcttcatcttccggatccgcagccggcaaggactgcattacaatccactccgctaccttcgcgtggtcccaggaaagccctccctgcctgcaccgggtgttgctatatcacgctggctggtctgctatggcctag

SEQ ID NO: 109236 - DNA, 4650 bp, Artificial Sequence
  Description of Artificial Sequence: Synthetic coding sequence
atgtcactgtcgttttgcggtaacaacattagtagctacaatatcaatgacggagtgttgcagaacagctgcttcgtggatgcactgaacctcgtgcctcacgtatttttactgttcataacattccctatcctgttcataggatggggatcccagtcaagtaaagtgcagatccaccacaacacatggctgcacttccccggtcacaacctgcgatggattcttacctttgccttgttgtttgtgcatgtttgcgagattgccgaagggattgtgtctgattcccgtagggagtcccgccacctgcatctcttcatgcccgccgttatgggctttgtggccaccaccaccagcatcgtatactaccataacatcgagacctcaaacttccccaagctgctactggcactcttcctgtattgggtgatggccttcatcactaagacgatcaagctggtcaagtactgccagtccggcctggatatttctaatcttaggttctgcatcactggcatgatggttattctgaacgggctgctcatggcagtagaaattaatgtgatcagggtgagaaggtatgtttttttcatgaacccccagaaggttaagccccccgaagatttacaagacctgggggttcggtttctccagccgttcgtgaatctgttgtccaaagcaacctattggtggatgaacacactcattatctccgcccacaagaaaccgatagatttaaaagccataggcaagctcccaattgctatgagggctgtgacgaattacgtgtgcttgaaggatgcctacgaggagcagaaaaaaaaggttgccgaccaccctaatcgcaccccttctatatggctcgctatgtacagggctttcggacggccaatcctgctgagctcaaccttcagataccttgcggacttacttgggttcgccgggccactgtgcatatccggtatagtccaacgcgttaatgagacacagaatgggaccaacaacacaacagggatttctgaaaccctgagctcaaaggagttcctagagaacgcatatgtcctggcagtgttgctttttttagctcttatcttacagcggacctttctgcaagcaagctattatgtgactattgaaacaggtataaaccttaggggagctctactcgccatgatatataacaagatcctgcgactctctacctcaaacctttctatgggcgagatgaccctgggacagattaacaatctggtagctattgaaacgaatcagctcatgtggtttctttttttgtgcccaaatttgtgggctatgccagtgcaaataatcatgggcgtgatactcctctataatttactaggctcctctgcgctagtgggggcagccgtgattgtgctcctggcacctattcagtacttcatcgccactaagctagccgaagcccaaaaaagtacgttagactacagcacagagaggctcaaaaagactaacgagatcttaaagggaattaaactgcttaaactctacgcatgggaacacatcttttgcaaatccgtggaagaaactcgaatgaaagaactctcttcccttaagacctttgccctgtatacaagccttagcatattcatgaatgccgctattccaatcgcagccgttcttgccacttttgtaactcatgcctatgcctccgggaacaatttgaagccagccgaagcatttgcctcactgagcctatttcatatcttagtgactcccctgtttctgctgtcgaccgttgttcgctttgctgtcaaagcaattatctccgtgcagaaactaaatgaatttcttttgtcggatgagattggcgacgattcatggcgaacgggcgaaagtagcctgcccttcgaaagttgtaagaagcacactggcgtgcagcccaaaactatcaaccgtaagcagccaggcaggtaccacctggattcatacgaacagtcaaccaggcgcctcaggcctgctgaaaccgaggacatagccatcaaagtgacaaacgggtactttagctggggctcgggccttgctacgctttctaacattgacattcgaatacctaccggacaattgactatgatcgtgggccaagtgggatgcgggaagtcatccttgttgctcgcaattctgggggagatgcagactctagaggggaaggtgcactggagcaatgttaatgaatcagaacctagctttgaagccaccagaagccgaaacaggtactctgtggcctacgctgcacagaaaccttggttgctgaacgccaccgtcgaggaaaatatcacattcggaagcccgtttaacaaacagcggtataaggcagtcacagatgcctgcagtctgcagcccgatattgaccttttgccttttggggatcaaaccgaaatcggggagagggggattaacttgtccggagggcagcgacagcgcatctgcgtggcccgcgcactctaccagaataccaatatcgtgtttctggacgatccattttctgcactggacatccatctctcagatcacttgatgcaggagggcattttgaaattccttcaggatgacaaaaggacactcgtactggtcactcataaattacaatatttgacacacgcagactggattatcgcaatgaaggatggatccgtgctcagggagggcactctgaaagacatccagactaaagatgtggaactgtacgagcactggaagacgctgatgaacagacaggaccaggagctggagaaagacatggaagcagatcagaccacattagaacggaaaacgctcagacgtgccatgtacagccgagaagccaaggctcaaatggaggatgaagacgaggaagaagaggaagaggaggatgaggacgacaacatgtctactgtaatgcggctcaggacaaaaatgccttggaaaacgtgttggcggtatttaacctccggggggttttttcttctgatcctaatgattttctccaaacttttgaaacactcagtgatagtggccattgattattggctggccacttggaccagcgagtactctattaacaatacaggaaaggctgatcagacctattatgttgccggcttcagcatcctatgcggcgcaggcatctttctatgcctggtcaccagtcttaccgtggaatggatgggcctgaccgcggcaaaaaacctccatcacaacctgttgaataagatcattctgggacccatccgcttcttcgatacaactcccctgggcctcatactcaacaggttctctgccgatacgaatataatcgatcagcatatccccccaactctcgaaagtcttacaaggagcaccctgctgtgtctctctgcgataggcatgattagctacgccacaccagttttcctcgtggctctgctcccgcttggtgtggctttctatttcattcaaaaatactttagagtagccagcaaagatctgcaggaactcgatgactcgacccaactgccactactttgccacttttctgagacagccgagggcctgactacgattcgagcctttcgtcacgaaaccagattcaagcaacgcatgctcgagctgacagatacaaacaacattgcctacctatttttgtctgccgcaaaccgatggcttgaggtgaggactgactacctcggggcgtgtatcgttctaaccgcctccattgcctctatcagtggatcatcaaacagcgggttagttggactggggttgctgtacgccttgactattacaaattatctgaactgggtggtacggaacttagccgatctggaggtccagatgggcgccgttaagaaggtcaacagcttcctaacgatggaaagcgaaaactatgaaggtactatggaccccagtcaggtaccggaacactggccccaggaaggggagatcaagatacacgatttgtgtgtccggtacgaaaacaatctgaagcctgtgctcaaacatgtgaaggcttacatcaaacctgggcaaaaggtggggatttgtggcaggacaggaagtgggaaatcttcccttagtttagcctttttccgtatggtggacatttttgatggcaagatcgttattgatggaatagacattagtaagctgcctttacacaccttgcggagccgcctgagcattatccttcaggatcctatcctgttctcgggttcaattaggtttaatcttgaccccgaatgcaagtgcacagatgatcggctttgggaagcgttggagattgcacaactcaaaaatatggtcaagtccctgcccggcgggttggacgccgtggtcacggagggaggcgaaaacttctccgtgggtcagcggcagctgttctgtcttgcccgcgctttcgttaggaagtccagtatcctcatcatggatgaggctaccgcttccatcgatatggccacggagaacatccttcagaaggtagttatgaccgcattcgccgacaggactgttgtgaccattgcccacagagttcacactattctcacggccgatctagtgatcgtgatgaaacggggcaatattcttgaatacgacaccccagagtccctgctggcgcaggagaatggtgtattcgcctctttcgtgcgagccgatatgtag

SEQ ID NO: 109237 - DNA, 4650 bp, Artificial Sequence
  Description of Artificial Sequence: Synthetic coding sequence
atgagcttatctttctgcggaaataatatctcgagctacaacattaacgacggggtgttgcagaactcatgtttcgtcgatgcattaaacctggtccctcatgttttcctactgttcatcactttccccatcctcttcattggctggggttctcagtcttcaaaggtgcagatccatcacaacacttggttgcattttccaggccataaccttaggtggatactcacattcgctcttctgttcgtgcacgtgtgcgagatcgctgaaggcattgtttccgatagtcggcgggaatctcggcacctccatctctttatgcccgctgtgatgggcttcgttgctactaccacatccatagtctattaccataacatagagacatccaacttccctaaactactgttggccctgtttctctactgggtgatggccttcatcaccaagaccatcaagttggttaaatactgccaatcgggcttagacatatctaatctgaggttctgcatcactgggatgatggtgatccttaatggactactcatggccgtggagattaacgtcataagagtacgcaggtatgtgtttttcatgaatcctcagaaagttaaaccccccgaagacctccaagatctaggggttcggtttttgcaacccttcgtgaacctcctatctaaggcgacctactggtggatgaacactctgatcatatcagcccacaaaaagccgatcgacctcaaagcaatcggcaaacttccgatcgccatgcgagctgtgacaaactatgtttgtcttaaggacgcttatgaagaacagaaaaaaaaagtggccgaccatcccaataggacgccctctatttggctcgctatgtacagggctttcgggcgccccatcctcctgagttccacgttccgctatctggctgacctactggggtttgccgggcccctgtgcatctctggtattgtgcagagggtgaatgagacgcagaatggaaccaataatacgacggggatctcagaaactctcagcagcaaggagtttctggagaacgcttacgtccttgcagttctgctgttccttgccctgatcctacagcggacattcctccaggcaagttattacgtcaccatcgagacagggatcaatttgagaggagcactcctggccatgatttacaacaagatcctcaggctatcaacgtctaacctgagcatgggagagatgactttgggccaaataaataatctggtggccatcgaaacaaaccagctcatgtggttcctctttctgtgtcctaacttgtgggcgatgccagtgcaaatcatcatgggcgtgattttgttgtataatcttctgggctctagtgccctagtgggagctgccgttattgtcctgctggctcctatccagtatttcattgccactaagctggcagaggcacaaaagtccaccctggattactcgaccgaacgactgaaaaagaccaacgaaatcctgaaggggatcaagttgctgaaattgtatgcttgggaacacatattctgcaaaagtgtggaagagacaagaatgaaggagttgtccagtctgaagacttttgccctctacaccagcctgagcatttttatgaatgctgcgatccccatcgcagccgtgctggccacttttgtgactcatgcttacgcctcaggaaacaatctcaagcccgcagaagctttcgcttcgctctctctgtttcatatactggtcactcctttgtttcttctcagcacagtcgtccgctttgccgtgaaggccatcatttccgtgcaaaagttgaacgaattcctactgtctgacgagataggcgacgacagctggagaactggagaatctagcctacctttcgaatcatgtaagaaacatacgggagtccagcctaaaacgattaaccggaagcaacccgggcggtatcacctggatagttacgaacagagcacgaggcggctgcggcctgccgagactgaggacatcgctataaaggttactaatggctactttagctggggatccggactcgctactttgagtaacatagacatccgtattcccacgggacagctcacgatgattgttggccaggtgggctgtgggaagtcaagccttcttcttgccatactcggagagatgcagaccctcgagggcaaagttcattggagtaacgtcaacgaatctgagcctagtttcgaggcgaccaggtctcgtaacagatacagtgtagcttacgctgcccagaagccttggctgcttaacgcaaccgtcgaagagaacatcacttttggatctccgttcaacaaacagagatataaagctgtgactgacgcttgtagcctgcagccagacattgatctgctgccattcggcgatcagaccgaaatcggagaacggggtattaacctttccggcgggcagcgccagaggatctgtgtggctagagcactttaccagaatactaacattgtcttcctcgatgacccctttagtgcgctcgacatccatttaagcgatcatctgatgcaagaaggaatcctgaagtttctccaggacgataaaaggaccctagttctcgtcacccacaaactgcagtacttgacccatgcagattggattatcgcaatgaaggatggctccgttctacgagaaggcacattgaaagacattcagaccaaggatgtcgaactctacgaacactggaagactttgatgaaccgccaggatcaggaattggagaaggatatggaggcagatcagaccaccctggaacgaaaaacactacgtagggccatgtactcccgggaggccaaggcacagatggaagacgaggacgaagaagaggaggaagaggaagatgaggacgacaatatgagcaccgtgatgaggctgcgaactaaaatgccctggaaaacctgttggaggtacttgacaagcggtggattcttcctgcttatcctgatgatattctcgaaattgctcaagcattctgtcatcgtggcgattgactactggctcgctacttggaccagtgaatacagcattaacaatacgggaaaagcggaccagacatactatgttgctggcttctccattctgtgtggggcaggcattttcctgtgtctggtcacgtcccttacggtggaatggatgggcttgactgctgcaaagaatctccatcataatctgctgaacaagatcatactgggacccatccgattcttcgacacgaccccgcttggactgatcctcaatagattctcagccgatactaatatcattgaccaacatatccctccaactcttgagagtctgacgaggtcaaccctcctctgcctaagcgctatcgggatgattagctatgcgacacccgtgttcctggtcgccttactgccactgggcgtcgcgttctacttcattcagaaatatttcagggtagcatcaaaggacctgcaggagctggatgactcaacccagctgcccctgctgtgccattttagcgagacagccgagggactgactacgatcagggctttccgccatgagacacgatttaaacagagaatgctggagctcaccgacaccaataatatcgcatatctgttcctgagcgccgcaaataggtggctcgaggtgaggaccgactatctgggggcatgcatcgtccttaccgcttcaatagcttctatttcaggctctagcaattccggactggtcgggctaggccttctgtacgccctgaccatcacgaactatctcaactgggtcgtgcgcaacttggccgatctggaagtgcagatgggcgctgtcaaaaaggtgaatagctttctaactatggaatccgaaaactatgagggcacaatggacccctcacaggtgcccgaacactggcctcaggaaggggagataaagatccacgacctgtgtgtgagatatgaaaacaaccttaagcccgtcttgaagcatgtcaaggcatacataaaacctggccagaaggtgggaatttgcggcaggaccggctccggaaaatcctctttgtccctggccttctttagaatggtggacatcttcgacgggaaaatagtgatcgacggtatcgatattagtaagctccccctgcacactttacgttcacggctttctataatcctccaggatcctatcttgttttccggctctatccggttcaaccttgaccccgaatgcaaatgtacagacgaccggctctgggaagcacttgagattgctcagctcaagaatatggttaagtcgttgcctggaggtcttgacgctgttgtgaccgaagggggcgagaatttcagtgtcgggcagcggcagctcttctgtctggcacgcgcattcgttcgtaaaagcagcatcctgattatggacgaagcaaccgcctccatcgatatggcaactgagaacatactgcagaaggtggtcatgaccgcctttgccgacagaaccgtagttacaatagcacatcgagtttcctccatcatggacgctggcctagtcctggtcttctctgaaggcattctagtggagtgcgacaccgtgccgaacctgctggcccataagaacggcctgttttcaaccttggtaatgactaataagtag

SEQ ID NO: 109238 - DNA, 450 bp, Artificial Sequence
  Description of Artificial Sequence: Synthetic coding sequence
atgtcactttctttctgcggaaataatatcagttcttataacataaatgatggagtgttgcagaacagctgctttgtggacgctctgaatttagttccacacgtgtttctattatttattacgttccctatactgttcataggatgggggtcacagtcttccaaagtccaaatccatcacaatacctggctgcatttcccgggccataatttgcgctggattctcactttcgccctcctgttcgttcatgtgtgcgaaattgccgagggaatagttagcgattcacggcgcgaatcacgtcacctgcacttgttcatgcctgcagtgatgggctttgtggctacgacgacttcgattgtgtattatcataacatcgaaacaagtaacttccctaaattgttgttaggattcagtcatcacgagtcaaagtcttgctatcagcactcttag

SEQ ID NO: 109239 - DNA, 4542 bp, Artificial Sequence
  Description of Artificial Sequence: Synthetic coding sequence
atgtccctgtcattctgcggaaacaatatttcatcttataatattaacgacggcgtgctgcagaactcctgttttgtcgacgctttgaacctcgtgcctcatgtgtttctgttatttatcacctttcctattttatttatcgggtggggttcccagtcaagcaaggtgcagattcaccacaatacctggctgcatttcccaggacacaaccttcgatggatccttacattcgctctgctgttcgtgcacgtgtgcgagattgctgagggcatcgtgtccgattcaagacgtgagagccgacacttgcatctatttatgcctgcagtgatgggattcgtggcaaccaccacgtctattgtctactatcacaatatcgaaacatcaaatttccctaagctgttgctggccttgttcctctattgggtcatggcctttattaccaagaccatcaaactggtcaaatattgccagtctggtcttgacattagcaacctgcggttctgtatcaccggaatgatggtgatactgaatggtctgcttatggcggttgaaatcaacgtcattagagtgcggaggtacgtgttttttatgaatccccagaaggtaaaacctccagaagatctccaggacctgggtgtgagattcttgcaaccattcgtgaatttattgtcaaaggcgacttattggtggatgaacactctgatcatcagtgctcacaaaaagcctattgatctgaaagccatcggcaaactcccaatcgccatgcgggctgtgactaattacgtctgtctcaaagacgcttatgaggagcagaaaaagaaggtagccgaccaccccaatagaacaccgtcgatttggcttgcgatgtaccgcgcctttggccggcccatcttactgagcagcacatttcggtatttggcagacctccttggattcgcagggcctctctgcatctcaggaattgtgcagagggtaaacgaaacacagaacgggactaataatacaactgggatttctgagacactcagctcaaaagaatttttagaaaacgcctatgttctggccgttctcctgtttcttgccctcatcttgcagagaaccttcctccaggcctcatattatgtcaccattgagacaggaataaacctaagaggggccctgctggctatgatttataacaagatcttgaggctgagcacttcaaatctgtctatgggcgaaatgactctgggccagattaacaaccttgtggctatcgaaaccaaccagctgatgtggtttctttttctgtgtccaaatctttgggccatgcctgtacagatcataatgggtgtgatcttactttacaacctattggggtccagcgcattggtcggcgccgccgtgatagtgctgttagcgcccatccagtacttcattgccacaaaattggcggaggctcagaaatcaacgctggactatagcacagaaaggctcaagaaaacgaatgaaatcctcaagggcatcaagcttttaaaactatacgcctgggaacatattttctgcaaatccgttgaagagaccagaatgaaagaactgagctcactgaagacatttgctctctacaccagtttgtcaatctttatgaatgctgcgatccctatcgcggctgtcctcgcgacattcgtgacccacgcctatgcgagtggcaacaatttgaagcctgctgaagctttcgcctctttgagcttgtttcacatattggtgactcccctgttcctcctgtcaacggtggtacgcttcgccgtgaaggctataatttcagttcagaagctgaatgaatttcttctgtccgatgaaatcggcgacgatagctggagaactggggagtcatctctcccttttgaatcgtgcaagaagcacacgggggttgttacaaacggctacttctcgtgggggtccgggcttgccaccctgtcaaacatcgatattcggatccctaccggacagctcactatgatcgtcggccaagttgggtgcggaaaaagctctctgctgctagcaatactcggagaaatgcagactctggaagggaaagtacactggtctaatgttaatgagtccgagcctagttttgaagccaccaggagccggaacagatatagtgtggcctatgctgcccagaaaccctggctcctgaacgccaccgtcgaagagaacatcaccttcggtagcccgttcaataaacaaaggtataaagcggtgaccgatgcctgctctctacagcctgatatcgatttactgccatttggagaccagactgagatcggggagcgaggaatcaacctaagtggcggacagaggcaaaggatttgtgtggctagagcgctatatcagaacacaaatattgtgttcctcgatgacccattttctgccctggatatccatctcagcgaccatctgatgcaggaaggaatcttgaaattcttgcaggatgataagagaaccctggtgttggtgacccataaacttcaatacctgacccacgctgactggattatcgctatgaaagatggaagtgtactgagggaaggcaccctcaaggatatacaaacaaaagatgtggaactctatgaacattggaaaactctgatgaaccgccaggatcaggagcttgaaaaagatatggaagccgatcagacaaccctggagaggaagactttaagacgagctatgtactcgcgtgaggctaaagctcagatggaagatgaagatgaggaggaagaggaggaggaagacgaggatgacaacatgtctaccgtgatgcgtctgcgcacaaagatgccatggaagacctgttggaggtacctgacttcaggcgggtttttcttactgatcctcatgattttcagtaaactgctcaagcatagcgtcatagtggcgatcgactattggcttgcgacctggacttctgaatattccattaacaacaccggaaaggcagaccagacttattacgtggctggattcagcatcctgtgtggtgccggaatattcctttgtttagtaactagccttactgtggaatggatgggcctaaccgcagccaaaaatcttcatcataaccttcttaataaaattatcctgggtccaattcgattttttgacaccacccctctaggactcattttgaacaggttctccgccgacactaatataatcgaccagcacataccacctaccctcgaatcccttaccagatctacgctactatgcctcagcgctatcggaatgatctcttatgccactcccgttttcctggtggctcttttgccacttggtgtggctttctatttcatccagaaatatttcagagtggcttccaaagatctgcaggaactggacgattctacccaactgccgctgctgtgccacttctcagaaacagctgagggcctgaccaccatccgcgcgtttaggcatgagacacgcttcaaacaaaggatgttggagctgaccgataccaataacattgcctacctctttctgtcagcagccaatcgctggctcgaagtcaggacagattatctgggggcatgtattgtgttgaccgcctcaatcgcctccatatccggctctagcaatagtggactggtggggttgggtttgctttacgcactcacaattaccaattatctcaattgggtcgtgcgcaacctggccgatctcgaggtgcaaatgggggctgtgaagaaggtgaacagctttctgactatggagagcgagaactacgagggcactatggatccaagccaggtgccagaacattggcctcaggaaggcgaaatcaaaatccacgatctatgtgtgcgctacgaaaacaacctgaagcccgtgctcaagcacgtgaaagcatatatcaagccgggccagaaggttggtatctgtggccgaaccggtagcggcaagagttccctcagtcttgccttttttcgcatggtggatatttttgacggaaagatcgtgatcgatgggattgatattagtaaattgcccttacacactctccgatcacgcttaagtatcattcttcaggatccaatcttatttagcgggagtattcgcttcaacctcgaccctgaatgtaaatgtaccgacgataggctgtgggaagccctcgagattgcccagttgaaaaacatggtgaagagcctgcccggagggctggacgcagtggttactgaaggcggcgagaatttctccgttggccagcgccagctgttctgcctcgctagggcattcgtgaggaagagctcaatccttatcatggacgaagcaacggcatcaatcgacatggctacggagaatatcctgcagaaggtggtcatgactgcatttgcggataggacagtcgtcacaattgcgcaccgcgttagcagtattatggacgccggtctcgtgctggttttctcagaggggatcctagtagaatgcgataccgtgccgaacctgttggcccataagaacggtctcttcagcacactggtcatgacaaacaagtag

SEQ ID NO: 109240 - DNA, 1386 bp, Artificial Sequence
  Description of Artificial Sequence: Synthetic coding sequence
atgcagagggtgaacatgatcatggcagagtccccaggcctgattaccatatgcttgcttggctacctgcttagcgccgagtgcaccgtgtttctggaccatgagaatgctaataaaatcttgaaccgcccaaaacgctacaacagcggcaagctcgaagaatttgttcagggtaacctggagcgagagtgcatggaagagaagtgtagtttcgaggaagcgagggaggtctttgagaataccgagaggactactgaattttggaaacagtacgtagatggggaccagtgtgaaagcaatccttgccttaacgggggaagctgcaaagacgatatcaattcatatgagtgttggtgtccattcgggtttgaaggaaaaaattgtgaattggatgtgacctgtaatataaaaaatggacgctgcgagcagttctgcaagaacagtgctgacaataaagttgtttgcagttgtaccgaaggctaccgtcttgcagaaaatcagaagtcttgtgaacccgccgtccctttcccatgcgggagagtttccgtctctcagacaagcaagctgactcgggccgaaactgtctttccggatgtagactatgtgaactctaccgaagccgaaacaatcctcgacaatataacgcagtctacacagtcctttaatgattttacacgggtagtggggggtgaagatgctaagcccggtcagtttccttggcaggttgtgttaaacggaaaggttgatgccttctgtgggggcagtattgtaaacgaaaagtggatagtcactgccgcgcactgcgtggagacgggcgtcaagataactgtcgtggcaggcgaacataatatagaagaaacggagcacactgaacagaagcgaaacgtgatcagaattatccctcaccacaactataacgcagcgattaataagtataaccacgatattgcccttctagagctggacgaacccctcgtcctaaatagctacgtgacacccatctgcattgcggacaaggagtacactaacattttcctgaaattcggatccgggtatgtcagcggatggggccgggttttccataaaggccgatccgccctggtcctccagtatttacgggtcccactggtggatcgagcgacttgtcttcggtctactaaatttaccatctataacaatatgttctgtgccggatttcacgagggaggccgtgactcctgccaaggcgactccggcgggcctcatgtgacggaggtggagggcacctctttcctcaccgggatcatttcatggggagaagagtgcgctatgaagggaaaatacggaatttacactaaggttagccggtatgtgaactggatcaaggagaaaaccaagctgacgtag

SEQ ID NO: 109241 - DNA, 684 bp, Artificial Sequence
  Description of Artificial Sequence: Synthetic coding sequence
atggatggcagactcaggaatcccgatcagtccctcacagaagacgttgttgcttttgctgcctcagttgctcacctttattcaaatttaacaaaaccactcctagatgtggctgtcacatcctatacactcctccgcgccgctcgttccagaggcgccggcacagcgtggcctagcgcaatcgccgggctggtggttttcctgactgctaacgtgctgagggctttcagtcctaaatttggcgagttagtcgccgaagaggctaggagaaaaggggaattgagatatatgcatagccgtgtggtagcaaactctgaagagatcgccttttatggtggccacgaagtagagctggctcttctgcagcggtcttatcaggatctagcgagtcagatcaatcttatactgctggagagactgtggtacgtgatgctcgagcagtttctcatgaagtatgtgtggagtgcttccggcctgctgatggtggccgtccctatcatcaccgctacaggctacagcgagtctggggaaacccagggatcaaaacgcatccaagccagagggcttagtcctatcccactgggtgcagagctcacacgagcgcagcttagccagcctgccgcccatttttgctgcagagggcatcgaggcccagcagccagcttagatgcttttaggggctag

SEQ ID NO: 109242 - DNA, 672 bp, Artificial Sequence
  Description of Artificial Sequence: Synthetic coding sequence
tgactatttagcactgtggccgcgcccttttatctgcccgcatcttccgtagggggattccacctcttcatcgtggcgtctaccgatgccgaggccgtcaaaaaggccgctcttgagaagaaagaggaggagctcgtctctgagagaacagaagcttttacaattgctcggaatctgctcaccgccgcggcggatgcaattgagcgcataatgagcagctacaaagaagttacagaattagccggctacactgcacgggtacatgagatgtttcaggtttttgaggacgttcagagatgtcattttaaaagaccaagggagttggaagacgcccaggcaggatccggtactatcggaagaagtggggttcgcgtcgaggggcctttgaaaatcaggggacaagtggttgacgtggagcagggcattatctgcgagaacattccaattgtcactccaagcggcgaggttgtcgtcgcctcccttaacattagggtggaagagggcatgcacctgttgattaccggccccaatggttgcgggaagtcatccctgtttcggatcttgggcggactttggccaacctacgggggggtgctttataaacccccacctcagcgaatgttctacataccccagaggccctatatgagcgtgggatccctgcgtgactag

SEQ ID NO: 109243 - DNA, 2223 bp, Artificial Sequence
  Description of Artificial Sequence: Synthetic coding sequence
atgactcacatgctcaacgccgccgcagaccgggtaaagtggactcgtagcagcgccgccaagcgggccgcatgcctcgtcgccgctgcctatgcccttaagacactctaccccatcattggaaagagactcaaacagtccgggcacgggaaaaagaaggctgcggcatatccggctgccgagaatacagaaatccttcattgtacagaaactatatgtgagaagcccagtccaggggtgaacgctgactttttcaagcaactgcttgagctgcggaaaattctctttcctaagttagtgacgacagaaaccggttggctctgtctccacagcgtagcgctaattagcagaacctttctgtccatttacgtcgcgggtctagatgggaaaatcgtgaagagtatcgtcgagaagaaacctagaacatttattatcaagctcattaaatggctgatgatcgctataccagctacttttgtaaatagcgctatcaggtacctggagtgcaaattagccctggcctttagaacccgcctggtggaccatgcatacgagacttacttcactaatcagacgtactataaagtgattaatatggacgggagattggcgaaccccgatcagagcttgactgaagatattatgatgtttagccaatcagtagcacacctgtatagtaacctgactaaaccgattctcgacgttatgcttacttcttatacactgatccaaacagcaacatccagaggagcaagtcctatcgggcctacgttgcttgccggtctggtcgtgtatgccacggctaaagtcctcaaagcttgctctccaaagttcggcaagctggtggctgaagaagcacaccgaaaagggtatttgcgttacgtccatagtaggatcatcgccaatgtcgaggagattgccttttacagagggcataaagttgagatgaaacaactgcaaaaaagctacaaggctctagccgatcaaatgaacctcattctaagtaaaaggttatggtatattatgatcgagcagttcctcatgaaatatgtgtggtcaagctcaggactgatcatggtggccatccctataatcacagctacaggattcgcggacggcgaggacggccagaaacaggtgatggtctctgaacgtacggaggcattcaccactgctagaaacctccttgccagtggagctgacgctatagagaggataatgagttcttataaggaggttacagaactggctgggtatacagctcgagtttataatatgttctgggtttttgatgaggtgaagcgcggtatctacaagcgcacagctgtcatccaagagtctgagtctcacagtaaaaacggcgccaaagtggagctgcctttatccgatacacttgccattaaaggaaaagtcatcgacgtggaccacggcataatctgcgagaatgtgcccataattacaccagccggcgaagtggtggcatccagactgaacttcaaagtagaggaggggatgcatctgcttataaccggtcccaacggttgtggaaagagctccctgttcagaatactctccgggctttggccagtgtacgaaggtgtgttatacaagccaccacctcagcacatgttctacattccacaacgcccctacatgagtttgggtagcctgcgggatcaggtgatctaccctgattctgtagacgacatgcacgacaagggctacacggaccaggatctcgaacgaatcttacacaacgtgcatctctaccatatcgtgcaaagggagggcgggtgggacgcagtgatggactggaaagatgtgctgtcaggcggggagaagcaacgaatgggcatggcccggatgttctaccataaacccaaatacgcgttgttggatgagtgtacctccgcagtatcaatcgacgtggaggggaagatctttcaggcggccaagggagcaggcatcagcctgctctccatcactcatcgaccgtccttgtggaaataccacacccacttactgcagttcgatggagagggaggttggaggttcgagcaactggacactgctatacgtctgaccttaagtgaggagaaacagaaactcgaaagccagttggccggcatccccaagatgcaacagcgcctgaatgaactgtgcaagatcctgggagaagattctgtgcttaagacaatcaaaaatgaggatgaaacgagctag

SEQ ID NO: 109244 - DNA, 711 bp, Artificial Sequence
  Description of Artificial Sequence: Synthetic coding sequence
atggccgccttttctaagtacctcacggccagaaactccagtctagccggagcagcctttttactactctgcctgcttcacaagcgaagacgagcacttggcctgcacggtaaaaaatccggcaaaccgcctctgcagaataacgagaaagagggcaagaaggaaagagctgtcgtggacaaggtgttcttttctcgcttgattcagatactcaagattatggtgcccaggaccttttgcaaggaaaccggttatttggtgcttatcgctgttatgctggtgtcgagaacgtactgcgatgtgtggatgatccaaaacggcacacttattgaaagtggcattataggcagatcacgaaaagatttcaaacgatatctcttaaacttcatagcagcaatgcccctgatttcccttgtcaataattttctcaaatatggtttgaatgagcttaaactttgctttcgcgtgcggttgactaaatacctgtatgaggagtacctgcaggccttcacatattataaaatgggcaaccttgacaatcggatcgctaatccagaccagttattaacgcaggatgtggaaaagttctgcaatagcgtcgttgacctctattcaaacctgtccaagccattcctcgacattgtgctctacattttcaagctgacctctgcaattggagcgcaggtgttaggcaaaatcctctggcattag

SEQ ID NO: 109245 - DNA, 1980 bp, Artificial Sequence
  Description of Artificial Sequence: Synthetic coding sequence
atggccgccttttcaaaatatctgaccgcgcgcaactcctcccttgccggagctgcatttctcctgctgtgcctgctacataagcgccggagggccctaggtctgcacgggaaaaagagcggtaagcccccactgcagaacaacgagaaagagggcaaaaaggaacgggccgttgttgataaggttttctttagccgcctgatccaaattctcaaaatcatggtaccaagaactttttgtaaggaaaccggctatttggttctgatcgctgttatgctggtgtctcgtacttactgtgatgtgtggatgatccagaatggcacactcattgaaagcggcatcataggaaggagtaggaaggactttaagcgatacctcttaaatttcatagctgcaatgcctctcataagtttagtgaataattttctgaagtacggcctaaacgagttaaagttatgctttagggtgcgcttgaccaaatacctctacgaagagtacttacaggctttcacatactacaagatgggcaacctggataacagaattgccaatccggaccagctcttgacccaggacgtagagaagttttgtaattcggtagtcgacctgtactccaacttgtctaaaccctttctggatattgttctgtacatttttaagcttacttcggcaatcggagcccaaggtccggcgtctatgatggcatatctggtagtttcgggcctgttcttaacaaggcttcgcagacccataggtaagatgactatcacggagcaaaagtatgaaggggagtacaggtacgtgaattctcgactgattactaacagcgaggaaattgccttttataatgggaataagagggagaaacagacggtacactctgtcttccgaaaactggtcgaacatcttcacaattttattctgtttcgcttttccatgggctttatcgacagtatcatcgccaaatatctggctacagttgtgggatacctggttgtctccagacccttcttagatttgtcacatcctaggcatctgaagagcactcactccgagcttctggaagattattaccagtctgggcgaatgctgctgagaatgtctcaggctctcggaagaattgtgctagctggaagagaaatgactaggctcgcgggtttcacagcgaggatcacagagctcatgcaggtcctgaaggatttaaaccacgggaagtacgaacgtacgatggtcagccagcaggagaaagggatcgaaggtgtccaagtaataccactcattccaggggccggcgaaataattatcgccgacaacataatcaagttcgaccacgttcccctggctaccccaaatggcgatgttttgattcgagatctcaattttgaggtcagaagcggagctaatgtcctgatttgcggaccgaatgggtgcgggaagtccagcctatttcgcgttttgggggaactctggccccttttcggtggcagattgaccaaacctgagagagggaagctattctatgtgccccagagaccgtacatgacactggggacgctccgcgaccaggtcatttatcccgatggcagagaggatcagaaacgaaaagggatctccgacctcgtcctgaaggagtacctggataatgtgcaactgggacatatccttgaacgggagggaggctgggatagcgtgcaggattggatggacgtgctcagcggcggtgagaagcagagaatggcgatggctcggctgttctatcacaagccacagttcgcgattctggatgagtgtacatctgctgtaagcgtagatgtagaaggctacatctacagccattgtcgaaaagtgggtattactctcttcacggtatcccacagaaagagtttgtggaaacatcatgagtactatctgcacatggatggcaggggcaactacgaattcaagcagatcaccgaagataccgtcgagtttggcagttag

SEQ ID NO: 109246 - DNA, 1650 bp, Artificial Sequence
  Description of Artificial Sequence: Synthetic coding sequence
atggcagctttcagcaaatatctgactgctcgcaactctagtctggctggcgccgcctttcttctcctgtgcttactgcacaagcggcgaagggcactaggcctccatgggaagaaatcagggaaacctccgctccagaacaatgagaaggagggcaaaaaagagcgtgccgttgtggataaggtgttcttttccagactgatccaaatcttaaaaataatggttccacggacattctgtaaagaaacggggtatctggttttgattgcagttatgttagttagcaggacctattgcgacgtgtggatgatccaaaacggcaccctcatcgaatcaggaatcattgggaggtcacgcaaggattttaaaaggtatcttctgaatttcatcgctgctatgccattaatttcgttagttaataacttcctcaagtatggactgaatgagcttaagctgtgcttcagagtgcggcttaccaaatacctgtacgaagagtatctgcaggcctttacgtactataagatgggaaatctcgacaacagaatcgcgaatccagaccagctcctgactcaggacgtggagaagttttgcaatagcgttgtggatttgtattccaacttgtccaagccatttttggacatagtcctgtatatctttaaattgactagtgccatcggcgcgcaaggtcctgcctctatgatggcctacctggtcgtttcaggactcttcttgacccgccttaggcgacctatcggcaagatgactattactgaacagaagtatgaaggcgagtaccggtatgtgaatagtcgattaatcaccaactcattcactgcaagaatcactgagctcatgcaagtcctgaaagacctgaatcatgggaagtacgaaaggaccatggtgtcccagcaggaaaagggaatcgagggagttcaggttatcccccttatcccaggcgccggggagataattatcgccgacaacattataaaattcgaccacgtgcccctggccactccaaacggcgatgtgctgatcagagacttgaatttcgaagtcaggtctggagcaaacgtgctcatttgcgggccaaacggatgtggcaagtcatctctgtttagggttctgggagagctgtggccactctttggaggccgtttaacaaagcccgagcggggaaagctgttctatgtcccacagaggccctatatgacactgggaaccctgcgcgaccaagtcatctaccctgatgggcgcgaggaccagaagagaaaaggtatatctgatcttgtgcttaaggagtatttggacaacgtgcaactcggacacatcctggagagggagggcggctgggattcggtgcaagactggatggatgtgttgtctggaggggaaaagcagaggatggcgatggcacggctgttttatcacaagccccagttcgcgatactggatgagtgtacttcggcggtctctgtcgatgtggagggctatatttacagtcactgccggaaagttggaatcaccctgtttacagtgagccataggaaatcattgtggaaacaccatgagtattatctgcacatggacggacgaggcaattacgagttcaaacagatcaccgaagataccgtggagtttgggtcctag

SEQ ID NO: 109247 - DNA, 2052 bp, Artificial Sequence
  Description of Artificial Sequence: Synthetic coding sequence
atggcagcctttagtaagtatttgacggctcgcaattcgagcctggctggcgctgcatttctgttactctgcctgctgcataagcgccggagagcacttggattacacggttattttatggaaacctggcgggagaaatcggatgaagtaatgggagaacttacagatcatgtgacccattgcaagaaatctggcaagccccccctgcaaaacaatgagaaggagggtaaaaaggaaagagcagtggttgataaggtctttttttccagactcattcaaattctgaagatcatggtgcctaggacattctgtaaggaaactggctacctcgtactgattgccgtgatgctggttagtaggacatattgtgatgtttggatgatccagaacggaaccttgatagagtctggtatcattggccgttctcgcaaagattttaagagatatctgttaaacttcattgcggctatgccgctgatctctttagtgaacaatttcctcaaatacgggcttaatgaactaaaattatgtttcagagtgcgtctcacgaagtatttatatgaagaatacttgcaggcattcacatattataagatgggcaacctggacaatcggattgctaatccagatcagctgcttacccaagatgttgagaagttttgcaactcagttgtcgatctctactcaaacctaagcaagccctttttggacatcgtgctgtacatctttaaactgacatcagcaattggtgctcaaggccccgcctctatgatggcgtacctggtggtgagcggcctgtttctgaccagactcaggcgccctatcggtaaaatgaccataacagaacaaaagtacgagggcgaatatcgatatgttaacagccggcttatcacaaacagtgaagagattgcattctacaatgggaacaagcgagaaaagcagaccgtccattccgtgtttcggaagctcgtggaacacctccacaactttatcctcttccgattctccatgggatttatcgatagtataatcgccaagtacctcgcaacagttgtaggatacttggttgtgtcccgcccctttctagatttatcccaccctagacacctgaagtcaactcattccgaattgctcgaggactactatcagagcggacgcatgctgcttcgtatgagccaggctcttgggcgcattgtccttgccgggagggaaatgacccgccttgccggatttactgcaaggatcacggagctgatgcaggttctgaaggacctcaaccatgggaaatatgaaaggaccatggtgtcacaacaggaaaaggggatagaaggcgtacaggtgattcctttgatacctggggcgggggaaataatcatagccgataatatcataaaattcgaccacgtaccacttgctacacccaatggggatgtcctaatccgggatttgaacttcgaagtgagaagcggcgcaaatgtattgatttgcggacccaatggttgcgggaaaagtagtttattcagagtgctgggtgagctctggccactctttggaggcaggctgacaaaacccgagcgcggcaagctgttctatgtcccacagcgaccatacatgaccctagggactcttcgcgatcaagtaatttaccccgacgggagagaggatcaaaagcggaaaggcatatctgacctggttttaaaggagtatttagacaacgtccagttagggcacatattggaaagagaaggcggctgggactccgttcaagactggatggacgtcctcagtggcggagaaaagcagcgcatggcaatggcccggttattttatcataagccacaattcgccatcctcgatgaatgtacttcagctgtgagtgtggacgttgaagggtatatttacagtcattgcagaaaggtgggaatcactctattcactgtatcccacagaaagtcattatggaaacatcacgaatattacctgcacatggacgggcgaggaaactacgaatttaagcaaatcactgaagacaccgtcgagtttggtagctag

SEQ ID NO: 109248 - DNA, 1761 bp, Artificial Sequence
  Description of Artificial Sequence: Synthetic coding sequence
atggtacctcgcaccttctgcaaagagaccggttatctggttctcattgcagtcatgttggtgagcaggacatattgcgacgtttggatgatacagaacggcacactgatcgaatcgggcatcatcggccggtcgcgaaaggacttcaaacggtacctgcttaattttatcgcggccatgccccttatctctctggtgaataactttttgaagtatggtttaaatgagcttaagttgtgttttagagtcagattgaccaaatacttgtacgaggagtacctccaagcttttacatattacaagatggggaatctcgataaccgaatcgcaaaccccgatcaattgcttacacaagatgtggaaaagttctgtaacagtgtagtcgacctgtacagcaacctaagcaagccattcctcgacattgtcctctacattttcaagttgacgtcagcaataggggcccagggaccagccagtatgatggcttatctcgttgtttctggcctgttcctgactcgcctgagaagacctattggcaaaatgacaattacggagcagaaatacgagggtgagtatcgatacgttaactcccgcttgatcacgaacagtgaggagattgcgttctataatggtaacaagcgtgaaaaacagactgtccactccgtatttagaaaactcgtcgaacacttgcacaatttcatcttattcaggttttccatgggctttattgactctatcatcgcaaagtatctagccaccgtggtaggttacctggtcgtcagtcgccctttcctagacctgagccatccgaggcacttgaaatccactcacagtgagctgttggaggattactaccagagcggtcgtatgctgcttaggatgtcccaggccctgggtagaattgtcttagccggaagggaaatgaccagactggccggtttcactgcacggatcaccgaactgatgcaagttcttaaagatctaaatcacgggaagtacgagaggacaatggtgagtcagcaggagaaagggatcgaaggcgtccaagtgatccctctcatccctggcgccggcgaaataatcattgcagacaatattatcaaattcgatcacgttcctctcgctacacccaatggagatgtgttgatccgggacctcaacttcgaggtgcgcagcggtgccaacgtgctgatttgcggtccaaacggatgcgggaagagctcgctgtttcgtgtgctgggcgagctttggcccctcttcggaggacgactcaccaagccagaacggggcaaactcttctatgtgccccagcggccctacatgacgctaggaacactacgcgatcaagtgatatacccagacgggcgggaggaccaaaaacgtaaagggatatccgatctggtccttaaagaatacctcgataacgtacaactcgggcacatcctggagcgagagggtgggtgggacagcgtccaggactggatggatgtgttatcaggaggggaaaaacagaggatggcaatggctcgtctcttttatcataagccacagtttgccatactggacgaatgtacgtctgctgtcagcgtagatgtcgagggttacatctactctcactgtagaaaagtgggcataactctctttaccgtgtctcacagaaagagcttgtggaaacaccacgaatattatctccatatggacggaaggggcaattacgagtttaaacaaataacagaggacacagtggagtttgggagctag

SEQ ID NO: 109249 - DNA, 1467 bp, Artificial Sequence
  Description of Artificial Sequence: Synthetic coding sequence
atgctgattgttctgaactcaacgcttaaatctttcgaccagtttacatgtaacctgctgtacgtctcctggcggaaagatctcacagaacacctgcataggctctacttccgtggacgcgcctactacactctgaatgtgttaagagacgatatagacaaccccgaccagcggatctcacaggatgtggagagattttgtaggcagctgagttcaatggctagtaagttgattatctccccctttacactggtgtactacacttaccagtgtttccagtctaccggctggctgggacccgtaagcattttcggctacttcatactgggcacagtggttaataaaacactgatgggccctatagtgatgaagctggtacaccaagagaaactggagggcgatttcagagccggccacgtcgaacacatgcgcacagaccgacgcctccaaaggttgttacagactcaacgggaactcatgtcaaaggagctatggctgtatataggaattaatacctttgactatctcggatctattctaagctatgtggttattgcaattcccatctttagcggagtctacggggacctgagccctgctgagttgtcaacactcgtctcaaagaacgcctttgtctgtatttaccttatatcatgcttcactcaactaattgatttgtccaccacactcagcgacgtggccgggtacactcatcgaatcggccaactcagagaaacgttacttgacatgagcctgaagtctcaggactgtgaaatactaggcgaaagcgaatggggattggacacacccccaggatggccagcagctgagccggcagacacagctttcctgctcgagcgcgtaagcatctctgcgccttcttccgacaaacctctaatcaaggatttaagccttaagatttcagaaggacagtctctgctcatcactgggaacacaggcaccgggaagacatctttgcttcgcgtactaggtggcctgtggactagcactcggggtagtgtgcaaatgctgaccgattttgggccacacggagtactcttcctgccacagaagcccttctttactgatgggacccttcgggaacaagtcatttaccccctcaaggaagtataccccgattccggctccgcagacgatgaaaggattctcaggttcctggaactggctgggctgtctaatctggtggctcgtactgaaggcctcgaccagcaagtggactggaactggtacgatgtgctctccccaggtgagatgcaacgtttatcattcgcaagattgttctacctacagcccaagtatgcggtgctggatgaggcgacctcagctttgacagaggaggttgagtcagaactctaccggatcgggcagcaacttggaatgacatttatttccgtgggtcacagacagagtctggagaaggtcccggtgctcacaaggatggcctag

SEQ ID NO: 109250 - DNA, 1821 bp, Artificial Sequence
  Description of Artificial Sequence: Synthetic coding sequence
atggcagtcgccggccctgcccctggtgccggagccaggccacgcttggacctgcagtttttgcagagatttctgcagatcctgaaagtcttgttcccgtcatggtcttcacagaatgcgctgatgttcttgacacttctttgcctaacactgctcgaacagtttgtgatctatcaagttggcttaataccgtcccagtattatggcgtgctgggtaacaaagatctcgaaggcttcaaaacgttaaccttccttgccgtgatgttaattgtgcttaactcgaccctgaaaagtttcgaccaattcacatgcaaccttttatacgtgagctggaggaaggacttgacagagcacctacatcgactatatttccgtggtagggcatactatacacttaacgtcctgcgagatgatatcgacaatcctgaccagaggatttctcaggacgtggagcgattttgtagacagctgtcctctatggcatcgaagctcatcatctctccatttaccctggtctactacacttaccaatgctttcagtctaccgggtggttggggcctgtcagcatctttggatattttatcctgggcaccgtcgtgaacaagacactgatgggccctatagtgatgaagctggtacaccaagagaagttagagggcgatttccgttttaagcatatgcaaattcgggtgaatgccgaaccggcggccttctatcgcgctgggcacgtggaacacatgcgaacagaccgccgcctgcagaggctgctacagactcagagggagctgatgtctaaggaactttggctgtacataggaatcaacacatttgactatctgggcagtattctctcttacgtcgtgatagccatcccaattttttccggagtgtacggagatctctccccagctgagcttagcactcttgtcagtaaaaatgctttcgtgtgcatttatctgatctcatgcttcacacagctgatcgacctgagcactaccctctctgatgtggccggatacactcacagaatcggacagctgcgggagaccttgctggatatgagcctgaaatctcaggattgtgaaattttaggggaaagtgaatggggcctagacaccccgcccggatggccagccgccgagcctgctgataccgccttcttgctggaacgcgtttccatctctgctccgtcctccgacaagcctttaattaaggacctatccctaaagatcagcgaggggcagagcctgttgataactggcaatactggcactggaaagacttcactcttgcgcgtgctaggaggtctgtggacttcaacacgcggaagcgtgcaaatgctaacagactttgggcctcatggcgttctttttttaccacaaaaaccgtttttcaccgatggaacattacgcgaacaggtcatctatcccctaaaagaagtctatcctgattctggatcggccgatgatgagcgcatccttcggtttcttgagctcgccgggctctcaaatctggtcgcacgaaccgagggtttggaccagcaggtggactggaactggtacgacgtactgagccctggagagatgcagcgattgagcttcgctcggcttttttacctgcagccgaagtacgcagtcctcgatgaagctacaagtgccctcactgaggaggttgaatccgaactgtaccggatcggtcagcagctcggcatgacatttatatcggtgggacatcggcaaagcctcgaaaagtttcatagtctggtcctgaaactgtgcgggggcggcagatgggaattgatgagaataaaagtggagtag

SEQ ID NO: 109251 - DNA, 297 bp, Artificial Sequence
  Description of Artificial Sequence: Synthetic coding sequence
atgagatccttgctgctgtctacagtgggcatcaatacctttgattatctgggcagtattctgtcatacgtggttatcgctatacccatattcagcggagtgtacggcgacctttcccccgccgaactgtctactttggtgagcaaaaacgcctttgtgtgtatctacctcatcagctgcttcactcaactcattgacttatctaccactctgtccgatgtcgccggctacactcatagaattgggcagcttagggaaacacttctcgacatgtcactgaaaagtcaggactgttag

SEQ ID NO: 109252 - DNA, 1800 bp, Artificial Sequence
  Description of Artificial Sequence: Synthetic coding sequence
atggccgataaactaactagaatcgccattgtaaaccacgataaatgtaagccaaaaaagtgtcggcaagagtgcaaaaagtcttgtcctgtggtgaggatgggcaaactgtgcattgaggtgacccctcagtcaaagattgcatggatctctgaaacactgtgtattggctgtggcatttgcataaagaaatgcccatttggcgccctgtctattgttaatctgccttctaatctggaaaaggaaaccactcaccggtactgcgctaatgcattcaagcttcacaggctgccaattcctcgccccggggaagtactggggctggtaggaactaatggaattggaaagtcaactgccttaaaaattcttgcggggaaacagaaacctaatcttggcaagtatgacgacccacccgattggcaggagatactgacatattttcggggcagtgagctacagaactactttacgaagattctggaggacgatcttaaggcaattataaaaccgcagtacgtggatcaaattccaaaggccgccaagggtacagtgggttcaatcctcgacagaaaggatgagactaagactcaggctattgtatgccaacagttggatctgacccacctgaaggagcggaacgttgaagatcttagcggcggagagcttcagaggtttgcctgtgcggtcgtgtgtatccaaaaggctgacatctttatgtttgatgaaccatcctcctatctggatgttaaacaacgactcaaggcagcaattaccattcgaagcttgattaatcccgatcgctacattatcgtggtagaacacgatttgtcagtcttggattaccttagcgatttcatctgttgcctgtatggcgttcctagcgcttatggagttgtgaccatgccattttctgtcagagaagggattaatatatttctggacgggtatgtgccaacagaaaacctgaggttcagggatgctagtctggtctttaaagtagcagagacggccaacgaagaagaggtgaagaagatgtgtatgtataagtacccaggcatgaaaaaaaaaatgggggaatttgaactggccatcgtggccggggaattcacggatagcgagattatggtcatgttaggcgagaacggcacaggcaagacgacattcattcgaatgttggcaggacgtctgaaacccgacgaaggcggcgaagtgccggtccttaacgtgagctacaaaccgcagaagatatctcctaagagcaccggttccgtccgccagctgcttcatgagaagattcgggacgcctacacccatccacagttcgtgacagatgtgatgaaacctctgcagatagagaatatcatagatcaggaagttcagaccctctcaggaggtgaactgcagagagtggccctggctttatgcctggggaagccagcagatgtgtacttaatagacgagcctagcgcatacctagattccgaacagcgcctcatggctgctcgggtggttaagaggttcattctgcatgccaaaaaaactgcctttgtcgtggagcatgattttatcatggctacctacctagcagacagggttatcgtgttcgacggcgtgccgagcaaaaataccgtggccaactcgccacagacgctcctggccggaatgaacaagttcctatcgcagctggagatcacattccggcgtgaccccaacaattaccgcccacgcatcaataagttgaattcgatcaaagacgtggaacagaagaaatccggaaactactttttcttggatgactag

SEQ ID NO: 109253 - DNA, 633 bp, Artificial Sequence
  Description of Artificial Sequence: Synthetic coding sequence
atggcagataagttaacacggatcgcaatagtgaatcacgacaaatgcaagccaaaaaagtgcagacaggaatgtaaaaaaagttgtcctgtggtaagaatgggtaaattgtgtatcgaggtaacgccccagtcgaagatcgcctggatctcagagaccctgtgcatcggctgtggcatctgtatcaagaagtgccctttcggggctttgagtatcgttaacttgcccagtaatcttgaaaaagagactacccatagatactgtgccaatgcctttaagctgcaccggctgcctatacccaggcccggagaagttctgggcctagtgggcactaatggcatcgggaagtctacagccctgaaaatcctggctggcaaacaaaagccaaacttaggcaagtatgacgatcctccggattggcaggaaatcctgacatatttccggggcagtgagctccagaactatttcaccaaaattttggaagatgacctcaaagcgatcatcaagccacaatacgtggaccaaatacctaaggcggctaagggcaccgtgggctccattctggatcggaaggacgaaactaaaactcaggcgattgtctgtcagcaactggatttaacccaccttaagtag

SEQ ID NO: 109254 - DNA, 2538 bp, Artificial Sequence
  Description of Artificial Sequence: Synthetic coding sequence
atgcccaaggcccctaaacagcaaccgcctgaacctgagtggatcggcgatggagagagcacgagcccatctgacaaggtggtgaaaaagggcaaaaaggacaagaagatcaaaaaaaccttttttgaggaattggcagtggaggacaagcaagctggagaagaggaaaaagtgttgaaagagaaggagcagcagcagcagcaacagcaacagcaacagaagaagaaacgtgataccagaaaagggcgtcgcaaaaaggacgtagatgacgatggcgaggagaaagagctcatggaaaggctgaagaaacttagcgtgcccacttccgatgaggaagacgaggtccctgccccaaaacctagggggggtaagaaaacaaagggtgggaacgtgttcgcagccctcattcaggaccagtctgaggaagaggaggaagaggagaagcacccgcctaagcctgccaagccagaaaagaataggattaacaaagccgtctccgaggaacaacagccggccctgaagggaaagaagggcaaagaggaaaagtccaagggtaaggccaaacctcagaacaaatttgcagcactggataatgaagaggaggataaagaagaggagatcattaaggaaaaagaaccacccaagcaaggtaaggagaaagctaagaaggcagaacaaggcagtgaggaggaaggagaaggagaagaggaagaggaagagggtggcgagagcaaagctgacgacccttacgcccatctctccaaaaaagagaagaaaaaattgaaaaagcaaatggaatacgagcggcaggtcgcatcccttaaagctgcgaatgctgccgagaacgactttagtgtctcacaggccgagatgtcgtccagacaggcaatgttggagaacgctagcgacataaagctggagaaattctctatttccgctcatggcaaggaactgttcgtgaacgcagatctgtacattgtggccggcagacggtatggtttagtaggacccaatggcaaggggaaaactacactcctaaaacacatagccaatagggccctatcgattccacccaacattgacgttctgctttgcgagcaggaggttgtagcggacgagactcctgcagttcaggctgtgctgagggcggacacgaaaagactgaagctgctggaggaagaacgccgcctgcaaggacagctggagcagggggacgacactgctgcagaacggctcgagaaagtgtatgaagagctgcgagccaccggagctgctgcagctgaagccaaggcgaggagaattctcgccgggctcggtttcgatcctgaaatgcagaaccgccctacacagaaattttcaggcggttggaggatgcgcgtgtccctggccagagcgctgtttatggagcccaccctcttaatgcttgatgagcccaccaatcatctcgacctgaatgctgtcatctggcttaacaactatctgcagggctggcggaagactcttctaattgtgtcacacgaccagggttttttggatgacgtctgcaccgacattatccacctcgacgcacagcggctccattactacagagggaactatatgacatttaaaaagatgtaccagcagaagcagaaagagctcctcaagcaatatgagaaacaagaaaaaaaactcaaagagcttaaagccggcggtaaatccactaagcaagccgaaaaacaaaccaaggaagctctgacacgcaagcagcagaaatgccgccgcaagaaccaggacgaggagtctcaggaagcacctgaactcctgaaacgccccaaggaatatacagttaggtttacctttcctgacccgccccctctgtctccaccagtgcttggactccacggagtgacattcgggtatcagggccagaaaccgctgttcaaaaacctggattttggcattgacatggactcccgaatctgtattgtgggaccaaacggggtaggcaaatcaaccctgcttctgctcctcactggcaagctaacacccacacacggagagatgagaaagaaccatagactgaaaataggattttttaaccagcagtatgcagagcagttgcgcatggaggagacccccacggagtacctccaacggggattcaatctgccatatcaggacgccaggaagtgcttgggaaggttcgggctggaatctcatgcccataccatccagatctgtaaattatctgggggacaaaaggctcgggttgtttttgccgagctagcttgccgggaacccgatgtgttaattctggatgaacccacaaacaatttagacatcgagtcgatagatgcactaggtgaagcaataaatgagtacaagggagcagtgatagttgtttctcacgatgccaggcttatcaccgagaccaattgtcagttatgggtggtagaggaacagtctgtatcacagatcgacggagattttgaagactacaaacgggaagttctcgaagcgttaggtgaggtcatggtgagtcggccaagagagtag

SEQ ID NO: 109255 - DNA, 2424 bp, Artificial Sequence
  Description of Artificial Sequence: Synthetic coding sequence
atgccaaaggccccgaaacagcagccgcctgagccggaatggatcggggacggggaaagtactagccctagcgacaaggtggtgaagaaaggcaagaaagataagaagattaaaaaaactttctttgaagagctggccgtagaagacaagcaggctggcgaagaagaaaaggtgcttaaagagaaagaacaacagcaacaacagcaacaacagcagcaaaagaagaagcgcgacaccagaaagggccgaagaaaaaaagatgtggatgacgatggcgaggaaaaggagctcatggagcgcttaaagaaattgtctgtcccaacaagtgacgaggaagacgaagtcccggctcccaagccccgtggaggcaagaagaccaaggggggcaatgtatttgccgcactcatccaagaccagtctgaggaagaggaggaagaagagaaacacccccctaagccagcaaaaccagagaaaaacaggatcaacaaggccgtgagtgaggaacaacaacctgcgctgaaaggaaagaaggggaaagaggagaaaagcaagggaaaagccaaaccacagaacaagttcgccgccctggataacgaggaggaagacaaagaggaagaaattatcaaggagaaagagcctccgaaacagggtaaggagaaggccaagaaggcggagcagatggagtacgagcgccaggttgcctcgctcaaggcagccaacgctgcggagaatgacttctcagtcagtcaggcagaaatgtcaagccgccaagcgatgttggagaacgcctccgacattaagctggagaagtttagtattagcgcccacggtaaggagctttttgtgaatgccgacctctacatagtggccggtcgtagatacggactggtaggtcccaacggaaaggggaaaacgacgctactcaagcacatagccaatagagcactgtctataccacccaacatcgatgtcttgttgtgcgagcaagaggtagtggcagatgagacccccgctgtgcaggccgtgttgagagcagacaccaagcgactgaagttgttagaagaggagagacggctgcaaggacagctcgaacaaggcgacgatactgccgcagagaggctagaaaaggtctatgaggagttaagggccaccggcgccgctgccgctgaggcgaaagctaggcggattctggctggacttggctttgaccccgagatgcagaaccgccccactcaaaagtttagcggggggtggaggatgagggtgtcactcgcaagggctttgtttatggagccgaccctactgatgctagacgaacccacaaatcatttggacctcaacgccgttatctggctgaataactatctccaaggctggcgaaagacactgttaatcgtgagccatgatcagggtttcctggacgacgtatgcactgacatcattcacctagacgcccagagattgcactactaccggggtaattacatgacattcaagaaaatgtaccagcagaagcaaaaggaactgttgaagcagtatgaaaagcaggaaaaaaagcttaaggaactgaaagctggtggcaaatcaacgaagcaggcggagaagcagactaaagaggcgctcacccgcaaacagcaaaaatgtagaagaaagaaccaggatgaagaaagtcaggaagcccctgagcttctgaaaagacctaaagagtatactgtgcgctttaccttccctgatcctccccctttaagccctccagtcctgggcttgcatggcgtcaccttcggctatcagggacagaaacccctctttaaaaatctggatttcgggatagacatggacagtcggatctgtattgttgggccaaacggagtcgggaagtccactcttctgctactcctcactggcaagctgacgcctacccacggcgagatgaggaaaaatcaccggctgaagattggcttcttcaaccaacaatatgctgagcagctgcgaatggaggaaaccccaactgagtatttgcaacggggctttaacctgccctaccaggacgcacgcaaatgcctgggacgttttggcctcgagtcccacgctcataccattcagatttgtaaactgtcaggggggcaaaaagcacgagttgtgttcgccgaacttgcttgtcgcgagccggacgttctgattctggacgagccaaccaacaacctggatatcgaatcgattgacgccttaggtgaggccatcaatgaatataagggtgccgtgattgtggtaagccatgacgcacgcttgataaccgagacaaactgccagctttgggtcgtggaagagcagtctgtgagccaaatagacggtgattttgaggactacaaaagagaggtcctggaagcccttggagaagttatggtatcgaggcctcgtgagtag

SEQ ID NO: 109256 - DNA, 2424 bp, Artificial Sequence
  Description of Artificial Sequence: Synthetic coding sequence
atgccaaaggccccaaaacagcagcctccagagcccgagtggatcggcgacggggagagcacttccccttccgacaaggtggtgaagaaaggcaagaaggataaaaagattaagaaaacattctttgaagaactggccgtcgaggataagcaggccggcgaggaggagaaagtcctaaaagagaaggaacaacagcagcaacagcagcagcagcaacagaaaaagaagagagacaccagaaaaggtcggcgcaaaaaagatgtggatgatgatggggaagagaaagaactgatggagagattaaaaaagctttcggtgccaacatctgatgaagaagacgaagttcccgctcctaagccacggggcggtaagaagaccaaggggggtaatgtgttcgctgccttaattcaggaccaaagcgaagaggaagaggaggaggagaagcacccccctaaacctgctaagccagaaaaaaaccggatcaataaagccgtgagtgaggaacagcagccagctctgaaggggaaaaagggaaaagaagaaaagtccaagggcaaagctaaaccacaaaacaaattcgccgctctagataacgaagaggaggacaaggaggaggaaattatcaaagagaaagagccgccaaaacaagggaaggagaaggcaaagaaagcagagcaaatggagtacgaacggcaagtcgcttcacttaaggctgctaatgccgccgaaaacgacttcagcgtgagtcaggcagagatgtcatccaggcaagccatgctggagaatgcctccgatattaagctcgaaaaatttagcatttccgcgcacggcaaggagctcttcgtcaacgccgatctgtacatcgtggccggccgcagatacggcctggtaggtccaaacgggaaaggaaagacaaccctgctgaaacacatcgcaaacagggcactttccatccctcctaacatagacgttctgctgtgtgagcaggaagtcgttgccgatgagacaccagccgtgcaagccgtgttgcgcgctgacaccaaacgtttgaagctattggaagaggaacgtaggctacagggacaacttgaacagggggatgatacggctgccgagcggttagaaaaggtctacgaggagctgagggccacgggcgcagccgccgccgaggcaaaggcgcgcaggatcctagcaggacttggctttgatcccgagatgcagaaccgccccacgcagaagtttagtggggggtggcgcatgcgtgttagcctggctcgagccctgtttatggaacctacgctattgatgctggatgagccaacaaatcatctagatcttaatgctgtcatttggctcaacaattaccttcagggatggcggaaaactcttctgatcgtgtcacatgatcaaggcttcctggatgatgtgtgtactgacatcatccatctcgacgcccaacgtctccactactatcgcggaaactatatgacctttaaaaaaatgtaccaacagaaacagaaggaactgctcaagcagtacgagaagcaggaaaagaaactcaaagaactgaaggcgggaggcaagtcaaccaagcaggcagagaagcagactaaggaagcacttacacggaagcagcagaaatgcagacgtaaaaaccaggatgaggagtctcaagaggctcctgaactcctaaaacgccccaaagagtacacagtccggttcacctttcctgaccctccccccctgtccccccccgtgctgggcttacacggcgttacctttggataccaaggtcagaaacccctcttcaaaaacctcgattttgggatcgatatggactcgaggatctgcatcgtggggcccaatggcgtcgggaagtcaaccctgctgctgctgctgacagggaagttaacacctacccatggtgaaatgcgcaaaaaccatagactgaaaatcggcttcttcaatcagcagtacgctgagcaactccgaatggaggaaacgccgactgagtatcttcagcggggctttaacctgccgtatcaggatgcgagaaagtgccttggtaggtttggactggagtctcatgcccatactatacagatatgtaagttgagcggcgggcagaaggcaagggtggttttcgctgagctggcctgccgggagcctgatgttttgatcctggatgagcccactaataatttagacatcgagagtattgatgctctcggcgaggccatcaacgagtacaagggcgcagtgattgtggtgagccatgatgccaggttaattaccgaaactaattgccagctgtgggtggtggaagaacagtcagtatcacagattgacggagacttcgaggattacaagcgagaggttttagaagctctaggtgaggtgatggtcagccggcctcgggagtag

SEQ ID NO: 109257 - DNA, 2538 bp, Artificial Sequence
  Description of Artificial Sequence: Synthetic coding sequence
atgccaaaagcaccaaaacagcagccccctgaacctgaatggatcggagacggcgagagcacctccccaagtgacaaggtcgtgaagaaagggaaaaaagacaaaaagataaagaaaacgttcttcgaagaactcgccgttgaggacaaacaagcaggcgaagaagagaaagtgcttaaggagaaagagcagcaacagcagcaacaacagcaacagcagaaaaaaaaacgagacacacggaagggaagaaggaagaaggacgtggatgatgacggagaggagaaggaactgatggaacgcctcaagaaactgtctgtgcccacaagcgacgaggaagatgaagtgcctgctcccaaaccgcggggaggaaagaagaccaaaggtggcaacgtctttgcagctctgatccaggaccagagtgaagaggaggaggaagaggagaagcatcccccaaagcccgcaaagccagagaagaaccgaataaacaaggctgtttctgaggaacagcagcctgccttaaaaggaaaaaaaggcaaagaagaaaagagcaaagggaaggctaagccccagaacaagtttgccgcattagataatgaagaggaggataaggaagaggagattattaaggaaaaggaaccccctaaacagggcaaagagaaggccaagaaggcagagcagggctctgaggaggagggcgagggcgaggaagaggaggaggagggaggggagagcaaagcagacgacccctatgcacatctgtcgaaaaaagaaaagaagaaacttaagaaacaaatggagtatgagaggcaggtcgcaagcctgaaagccgctaatgccgcagagaacgatttctcggtgtcccaggctgagatgtcttccaggcaggcaatgctagagaacgcaagtgatataaaattggaaaaattttccataagcgcccacggtaaggagttattcgtcaatgccgacctgtatatagttgcaggccgcaggtacggtctggtcggccctaacggaaaaggtaaaacaaccctgctgaagcacatagctaaccgcgcccttagcattccacccaatattgatgtgttgttatgtgagcaggaagtagtggctgacgagactccagcagttcaggcagttctcagagccgatacaaaaagactgaagctactcgaagaggagcgaaggctccaagggcaactagaacagggggatgatactgcagccgaacggctcgagaaggtgtatgaggaactgcgagcaaccggagccgcggcggcagaggccaaagctcgtaggattctggctgggctcggctttgatcccgagatgcagaatcggcccacccaaaagttttctggcggctggagaatgcgggtgtcactcgccagggccctgttcatggagcctactttactcatgctggacgaacctaccaatcacctggatttgaatgcagtgatctggctgaacaattatctgcaagggtggcggaaaacactgctcattgtaagccatgaccagggattcctggacgacgtgtgcaccgacataattcatctggatgcccagaggcttcactattatcgtgggaactacatgacattcaaaaagatgtaccagcaaaagcaaaaggagctactgaaacaatatgaaaagcaggagaagaagctgaaagaattgaaggctgggggcaagtccacaaaacaagcagaaaagcagaccaaggaggctcttacacgtaagcagcagaagtgccgcaggaagaaccaagatgaagaatcccaggaagccccagaactcctgaagcggcccaaagagtacactgtccgttttaccttccccgatccccctccactttcgccaccggtgttgggcctgcatggcgtcacatttggataccaaggacaaaaaccccttttcaagaatctggactttgggatcgacatggactcgcgaatatgcatagtgggccccaacggggttggaaagagcacacttctgctgctgctcactggcaaactgacgccaacacacggcgaaatgaggaagaatcaccgcctcaaaatcggctttttcaaccagcagtacgcagaacagctgagaatggaggagaccccaaccgagtacttacaaaggggatttaatcttccctaccaggacgcccggaagtgtcttggtcggttcggattagagtcacatgctcatacaatacagatttgcaagctaagcgggggacagaaagcccgcgtggtgttcgctgagctggcctgtcgcgaacccgacgtgcttatcctagatgaacccacaaataaccttgatattgaatccattgatgccttgggcgaagcgatcaatgagtacaagggcgctgttattgtcgtttctcatgatgctcggttgataacggagactaactgccagctgtgggtcgtcgaagagcagagcgtgagccagatcgatggagacttcgaagactataaacgcgaggtcctcgaagctctgggggaagtgatggtgagtagaccccgggaatag

SEQ ID NO: 109258 - DNA, 717 bp, Artificial Sequence
  Description of Artificial Sequence: Synthetic coding sequence
atgcccaaggctccgaagcaacagcctcccgagccggaatggatcggagacggggaaagcacatccccaagcgataaagtagtgaaaaaaggcaaaaaggataagaagattaaaaaaaccttcttcgaggaactcgctgttgaagataaacaggctggcgaggaggaaaaagtcctgaaggagaaggagcaacagcaacagcagcagcagcagcagcagaagaagaaacgtgacactagaaagggtaggcgcaagaaagacgtggacgatgacggagaagagaaggaattgatggagcgcttgaagaagttgtccagaggtttcaatctgccttatcaggatgccaggaaatgtttaggacgatttgggctcgaaagtcatgcccatacaatacagatctgcaagctttcaggcgggcagaaagcaagagtcgtcttcgccgaactcgcctgcagggagccagacgtcctgattctggacgaacccactaacaatctggacattgaaagtatcgacgccctgggagaagccatcaatgaatataaaggagctgtcatcgtcgtgtctcacgatgccagattgatcaccgagaccaattgtcagctctgggtcgtggaggaacagagcgttagtcagattgacggagactttgaggattacaagcgcgaggtgttggaggccctaggggaagtgatggttagtagaccacgtgaatag

SEQ ID NO: 109259 - DNA, 2424 bp, Artificial Sequence
  Description of Artificial Sequence: Synthetic coding sequence
atgccaaaagccccaaaacagcagccccccgagccggaatggattggggacggcgaaagtaccagcccttccgataaagtcgtgaagaagggcaagaaggataaaaaaattaagaagacgttttttgaggagctggccgtggaagacaaacaagcgggggaagaagaaaaagtgttaaaggagaaggagcagcaacaacagcaacagcaacagcagcagaagaaaaagcgtgatacacgcaaaggtcggcgtaaaaaagacgtcgacgacgatggtgaagagaaagaactgatggagaggctcaagaagctctccgtgcccactagcgacgaggaggatgaggttcctgcacctaagccaaggggcggcaagaaaacgaaaggaggaaatgttttcgctgctttgattcaggatcagtcggaggaggaagaggaagaggaaaaacacccccccaaaccagccaagcccgagaaaaataggatcaacaaagccgtgtctgaggagcagcaacctgcactgaaaggcaagaagggcaaagaggagaagagcaagggcaaagcaaaaccacaaaataagttcgctgctctggataacgaggaggaagataaggaggaagaaatcataaaggagaaagaacctcctaagcagggcaaagaaaaggctaagaaggccgagcagatggagtatgaacggcaggtcgcatcattgaaggctgccaatgccgcagaaaacgatttcagtgtgagtcaggcagagatgagttccagacaggcaatgctggaaaacgcatctgacattaaactggaaaagttcagcatctcggctcacgggaaagagctattcgtcaacgcagacctctacattgtagccggacggcggtacggcctcgttggccctaacggcaagggtaagaccaccctgctgaaacatatagccaatagggctctcagcattcctccaaatatcgacgtacttctgtgtgagcaggaagttgtggccgacgaaacgccagccgtccaggccgtgctgcgggctgacacgaagaggcttaagcttctcgaggaagaaagacgccttcaggggcaattggagcagggtgatgacactgcagccgaacgcctagagaaggtatacgaggagttgcgtgccacgggagctgcagcagcagaggccaaagcccgcaggatactggccgggcttggtttcgatccagagatgcaaaacaggccaacgcagaagttctcaggtggctggcgcatgagggtctctctagctagggccctattcatggagcctaccctgctaatgctggacgagccaacaaatcacctggacctcaacgccgtgatctggctgaacaactatttacaagggtggagaaaaacccttttgatcgtatcacatgaccaagggttcctggatgatgtgtgcacagatattatccatctggatgctcaacgtttgcattattacaggggcaactatatgacttttaagaaaatgtatcagcagaagcagaaagagcttttgaagcagtatgagaagcaggagaagaagctgaaggagttaaaggccggtggaaagagcactaagcaagccgagaaacaaacaaaagaagctcttacgaggaagcagcaaaaatgccgccggaagaaccaggatgaagaatctcaggaagcgcccgaactcctgaagagacccaaggaatacacggtgcgcttcacatttccagatccccctccactatccccacccgttctggggcttcatggcgtgacctttggataccagggtcagaaaccactttttaaaaacctggatttcggcattgacatggactcccggatctgcattgtcggacctaacggggtaggaaaaagcactctgctcttgctgctgacaggaaagctgactcccactcatggtgagatgagaaaaaaccataggctgaagattggctttttcaatcagcaatacgctgagcagctacgcatggaggaaacacctacagaatacctgcagcgcggatttaacttgccttaccaggatgcccgaaaatgcctaggaaggttcggactggaatcgcacgcccacacgattcagatttgcaaattgtctggcggacagaaggcccgggtagtgttcgccgaactggcatgtcgggagccagacgtactgatactagatgaacctacgaataacctcgacattgagagcatcgacgccctaggggaagcaataaatgaatacaaaggtgctgtgatcgtcgtttctcatgatgccagattgattaccgagactaactgtcaactttgggttgtggaggagcaatctgtgtcccagatcgatggcgactttgaggactacaagcgcgaggtcttggaggccctcggtgaggtcatggtatctcggccacgtgagtag

SEQ ID NO: 109260 - DNA, 717 bp, Artificial Sequence
  Description of Artificial Sequence: Synthetic coding sequence
atgcccaaagccccgaaacagcagccccctgagccggagtggatcggcgacggggagtcaacttctcctagtgataaggtcgtgaaaaaaggtaagaaagataagaagatcaagaagactttcttcgaggagcttgcagtggaggataagcaggctggagaagaggagaaagtcctgaaggagaaagaacagcagcagcagcagcaacagcagcagcagaagaaaaaacgggatacacgtaaagggcggagaaagaaagacgtcgatgacgatggtgaggagaaagaactcatggagcgattaaaaaagctgagccgcggcttcaatctgccataccaagatgcccgtaagtgcctcgggagatttggtctggagagccacgcacacaccatccagatctgtaagctttccggcgggcagaaggcccgtgtggtcttcgccgagctcgcttgtcgcgagcccgacgtcttgattctggacgaacccactaataatctggacatcgagagcattgacgccttaggagaggctattaacgaatataaaggtgcggttattgtggtgtctcatgacgcccgcttgatcaccgaaaccaactgtcaactgtgggtcgttgaggagcagagtgtcagtcagatcgacggagatttcgaggactataaacgggaagtgctggaggcactgggagaggtcatggtgagccggccgcgagagtag

SEQ ID NO: 109261 - DNA, 1023 bp, Artificial Sequence
  Description of Artificial Sequence: Synthetic coding sequence
atgcctaaagcgcccaagcagcaacccccagaacctgagtggatcggcgacggagagagcaccagcccctctgacaaggttgtgaaaaaggggaagaaggataagaagatcaagaaaacattttttgaagaactggcagttgaagacaagcaggcaggggaagaggagaaggtactgaaggaaaaggaacagcaacagcagcagcagcagcagcagcagcagaaaaagaagcgggacaccagaaaaggacgacgtaaaaaggacgttgatgacgacggggaagaaaaagagttaatggaaagactcaagaaactgtctgtacctaccagcgacgaagaagatgaggtgccagcccctaaaccacgcggtgggaagaagaccaagggggggaatgtgtttgccgcgctgatccaggaccagagtgaagaagaggaagaagaggagaaacatccccctaagccagcgaaaccagagaaaaacaggatcaataaagctgtatccgaggagcaacagccagccctcaaagggaagaaaggcaaagaggagaagtccaaaggaaaggccaagcctcaaaacaagtttgcggcgctggataacgaagaagaagataaagaagaggagatcattaaggagaaggaacctcctaagcagggcaaggaaaaagccaaaaaagccgagcagggctctgaagaagaaggagagggggaggaagaagaagaagagggaggagagagcaaggcggatgatccatacgcccacctgtccaagaaggaaaaaaagaagctgaagaaacagatggagtacgagaggcaagttgcctctttgaaagcagcgaacgccgcagaaaatgacttcagcgtgagccaggcagaaatgagctctagacaggctatgctcgaaaacgcttccgacataaagctagaaaagtttagcattagcgcacacggtaaagagctcttcgtgaatgcagatctatacatcgtggccgggcggcggtacggccttgtgggccctaatgggtag

SEQ ID NO: 109262 - DNA, 2538 bp, Artificial Sequence
  Description of Artificial Sequence: Synthetic coding sequence
atgccgaaagcaccaaagcagcaaccccccgagccggaatggatcggcgatggggagtcgacctctccatccgataaagtcgttaagaaggggaagaaggacaagaagatcaaaaagacattcttcgaagaactggctgttgaggacaagcaggccggcgaagaagagaaggtgttgaaagagaaggaacagcagcagcagcagcagcaacagcagcagaagaagaaaagagatacacgcaaagggagaaggaagaaagacgtggacgatgatggggaagaaaaggaactgatggaaaggctgaaaaaactgagtgtccccacaagcgacgaagaggacgaagtgcctgcacccaaaccaaggggtgggaagaagacaaagggaggcaatgtctttgcagccctgattcaagatcaaagtgaagaggaggaagaggaagaaaaacacccaccaaaacccgctaagccagaaaagaatcggatcaataaagccgtatccgaggaacagcagcccgccctgaagggcaaaaaaggcaaggaggagaaaagcaaaggaaaggcaaagccccaaaacaaattcgccgcactcgacaacgaagaagaagacaaagaagaagagataatcaaggagaaggaacctcccaagcagggaaaagaaaaagccaagaaagcagaacaagggagtgaggaggaaggcgagggggaggaagaggaggaggaaggcggggagtccaaggcagatgacccttacgcacacttatccaagaaagaaaagaaaaagcttaagaaacagatggagtatgaacgacaagtcgcctcactcaaggcagcgaacgccgccgaaaatgatttctcggtgagtcaggcagaaatgtctagccgacaggccatgttagaaaacgcttccgacataaagctggaaaagttctccatcagtgctcatggtaaagagctgttcgtcaatgccgatctgtatatcgtcgccggcaggcgatatggcctggtgggaccaaacggtaaaggaaaaactacattactgaaacatatagctaatagagccctaagtatcccaccaaatatcgacgtgctgctatgtgagcaagaagtcgtcgctgatgagacacctgctgtccaagcagtgctcagggccgatactaagcgtctgaagcttctggaggaggaacggagactgcaaggccagctcgagcaaggagacgacacagccgccgaaaggttagaaaaggtttacgaagagctgagagccaccggagcagcggccgcagaggccaaggctcgtagaatcctggctggtctagggttcgacccagagatgcagaatcgacccactcagaagttcagcgggggttggagaatgcgggtctccttggcgagagctcttttcatggaacccaccctgttgatgctcgatgagcctactaatcatttggatctaaacgccgtaatttggctcaacaattaccttcaaggttggagaaagaccctgctcattgtcagtcacgatcagggttttctggacgacgtctgcactgatatcattcacctcgacgcccagcgactccattattaccgtggcaattacatgacctttaagaagatgtatcagcagaaacaaaaggagcttctcaagcagtatgagaaacaggagaaaaagctgaaggagctaaaggctggtggcaaatctacgaaacaagccgaaaagcaaactaaagaagccctcacaagaaagcaacaaaagtgtcggaggaagaatcaagatgaagaaagccaagaagcacccgaattactcaaaaggcctaaggaatataccgtgcgttttacatttcctgacccgccacccttatctccgcccgtcctcgggctccatggcgttaccttcggatatcaaggccagaagcccttgtttaagaatctggactttggcatagatatggacagccgcatatgcattgttggtccaaatggagtcggcaaaagcaccctgctgttgctgttaaccggcaagttaacacccacgcacggggaaatgaggaaaaaccatcgcttgaaaataggcttttttaaccagcagtatgccgaacaactccgaatggaggagactcctaccgaatacctgcaacgggggtttaatctgccctatcaggacgcccgtaagtgcctcggcagatttgggctggagtctcacgctcatacaattcaaatatgcaaactatcaggcggacaaaaggccagagtcgtattcgctgagttggcttgcagagagccagacgtattgatacttgatgaacctactaataatttagacatagaaagcattgatgccctgggtgaggcaataaatgaatataaaggcgccgtgatcgtggtctctcacgacgctcgcctgatcactgagacaaattgtcaactgtgggtggtggaggaacagtccgtaagtcaaattgatggcgactttgaagactataaacgcgaagttctggaagccctgggtgaagtcatggtttctagaccccgagagtag

SEQ ID NO: 109263 - DNA, 2424 bp, Artificial Sequence
  Description of Artificial Sequence: Synthetic coding sequence
atgccaaaggcccctaaacagcagcctcccgaaccggagtggataggagatggcgagtcaacatctccttcagataaagtggtgaagaaaggaaaaaaggataagaagattaagaagactttctttgaagagctggcagttgaagataagcaagctggggaagaggagaaagttttaaaagagaaggagcaacagcagcagcagcagcaacagcagcagaaaaagaaaagagatacacgaaagggtcgtcgtaaaaaggacgtcgacgacgatggcgaggaaaaagagctgatggaaaggcttaaaaagctctcagtgcctacttccgatgaggaggacgaggtaccagcccctaagccgcggggagggaagaaaaccaaaggcggcaacgtgtttgctgcccttatacaggaccagagcgaggaggaagaagaagaggaaaaacatcctccaaaacctgcaaagcctgagaagaaccgtattaacaaagcggtgtctgaggagcagcagccagccctcaaaggaaaaaaagggaaggaggagaagtcaaagggaaaagcaaagccgcagaacaaattcgctgctctggacaacgaagaggaagacaaggaggaagaaattattaaggagaaggagccacctaagcaggggaaagaaaaggctaagaaggccgagcagatggagtatgaaaggcaggtggcatccctcaaggccgctaacgccgctgagaacgatttctctgtctcccaggccgagatgtcatcacgacaggcgatgctggaaaatgcctctgatatcaagctcgagaagttttcgattagcgcccacggcaaggagctcttcgtcaacgcggacctttacatcgttgctggcaggcgctacgggcttgttgggccaaacggcaaaggtaagacaaccttgttgaaacacattgcaaacagggccctgtccatacctccaaacatcgacgtcctgctatgcgagcaggaggtcgtggcagacgaaactcccgctgtgcaggctgtactgagagctgacactaagcgtcttaaactgcttgaggaggagcgcaggctccaaggccagctcgaacaaggagacgatacagccgccgaacgcttggagaaagtctacgaggagctacgtgcgacgggcgcagctgcagctgaagctaaggctaggcgcatcttggccgggctgggctttgaccctgaaatgcagaatcgaccgactcaaaagttcagtggaggttggcggatgcgggtgagtctggctcgcgccctgttcatggaacctaccttgttgatgctcgacgaacccaccaatcatcttgatctgaatgctgtcatttggcttaacaactacctgcaagggtggcgaaagacgctcttaattgtgtcccacgatcaaggatttctggacgatgtatgcaccgacattatccacttagacgcccagcgcctgcattattatcggggcaactatatgacatttaaaaagatgtaccagcagaaacaaaaggagttacttaagcaatacgagaagcaggagaaaaagttgaaggagctgaaggcgggcggcaaaagcaccaagcaggccgaaaagcagaccaaagaagctctgactcggaaacagcaaaagtgcagacgaaaaaatcaggacgaggaaagccaagaagcgccagaattgctcaagcggccaaaagaatacacagtgagatttacatttcctgacccccccccgctctctccccccgtcttgggcctgcacggggtcactttcggttaccaaggacagaagcctctttttaaaaacctggattttggaatcgatatggatagcaggatctgtatcgtgggcccaaacggggtgggaaagtccacgttactcctgctgttgaccggtaagctgactcccacccacggagagatgaggaagaaccacaggctcaaaataggtttttttaatcagcaatatgctgagcaactgaggatggaggaaacgccaactgaatacctgcagaggggctttaacttgccatatcaggacgccaggaagtgtctcggtcgattcggtcttgaatcgcatgctcacacaattcaaatttgcaaattgtcagggggtcagaaagccagagtggtttttgcagagcttgcctgccgggagccagatgttctgatcctggatgaaccaaccaacaatctggatatagagagcattgacgcgctgggcgaagcaatcaatgagtataagggtgcggttatagtggtctcgcacgatgcgagacttattaccgagactaattgtcaactgtgggtagtagaggaacagagcgtgagtcaaattgacggagactttgaggactataaacgagaggtactagaggcgctgggggaagtgatggtgtctagaccaagagagtag

SEQ ID NO: 109264 - DNA, 2424 bp, Artificial Sequence
  Description of Artificial Sequence: Synthetic coding sequence
atgcccaaggctcctaaacaacagccgccagagcccgaatggatcggagatggcgaatccacgagtccaagtgacaaggtggtgaaaaagggcaagaaagacaagaagataaagaagacattctttgaggagttagccgtggaagacaagcaggcgggagaagaggagaaggttttgaaagaaaaagagcagcagcaacagcaacagcagcagcagcagaagaaaaaacgagacactagaaaaggcagaagaaaaaaggacgtggacgacgacggcgaggaaaaagagttgatggagaggttgaagaagctgagcgtgccaacatccgacgaagaggatgaggttccagccccaaaaccacggggaggaaagaaaactaaaggtggcaatgtttttgcggcgctgatccaggatcagagcgaggaggaagaagaagaggaaaagcacccccccaaacctgccaagcctgagaagaacaggattaataaagcagtgagcgaggagcagcaacctgccctgaagggcaagaaaggaaaagaggaaaaatcaaaggggaaagccaaaccccagaacaagttcgctgctttggataacgaagaggaggataaagaagaggagattataaaagagaaagagcctccaaagcaggggaaggaaaaggcaaagaaggctgaacagatggagtatgagcgccaggtggcctccctcaaagcggctaatgccgcagagaacgatttcagtgtatcacaggctgagatgtcatcgagacaggccatgctggagaacgcttcagacatcaagctcgaaaaattctctatcagtgctcacggcaaggaactcttcgtaaatgcggatttgtacattgtggctggcaggaggtacggtctggtgggtccgaacgggaaaggtaaaaccacgcttctcaagcatatagccaatcgagctctgtccattccccccaacattgacgtgcttctttgtgaacaagaagtggtggccgatgaaacccctgccgtccaggctgtgctgagggctgataccaagaggctgaagttgcttgaagaggagcgacggctacaaggccagctggaacagggagatgatacggcagccgagagactggagaaggtttatgaggaattgcgcgccacaggcgccgctgctgccgaggctaaggcgaggagaatcctcgccggcctcgggtttgaccccgagatgcaaaaccggccaacgcagaagttttccggaggctggcgaatgagggtcagcttagccagagccttgtttatggagcccacccttcttatgctcgacgagccaaccaatcacctggacctaaatgccgtgatctggctcaacaactatttgcagggttggcgcaagacccttctcatcgtgtcacacgaccagggctttttagatgacgtgtgcacagatattatccatcttgacgcacagagactgcactactatcggggcaactacatgacgttcaaaaaaatgtaccagcagaagcaaaaagaactgctaaaacaatacgaaaagcaggaaaagaagctaaaagaactcaaagctggtggaaaaagtacaaagcaggctgagaaacagacaaaagaagctctgaccagaaaacagcaaaagtgtcgccgcaagaaccaagacgaggaatcccaagaggcacccgagctcctcaagagacctaaggagtatacagtgaggtttacctttccggacccgcctcccctctcccccccggttctcggccttcatggagtaacctttggttatcaaggtcagaagcctctcttcaagaaccttgactttggcatcgatatggatagccgcatctgtattgtgggacccaacggagtagggaagtcaaccctgttgctcctgctgaccggaaaactcactccaactcacggcgagatgcgtaaaaaccaccggctgaaaatcggtttttttaatcagcagtacgctgagcagctgagaatggaggagactccgaccgagtacctccagaggggttttaacctgccctaccaagacgctcgcaagtgcctcggccgctttggccttgagagccatgctcatacaatacagatttgtaagctttcaggtggtcagaaggccagagtggtctttgctgaactcgcatgcagagaacctgacgtgctgatcttggacgagcctaccaataatctggacatcgagtctattgacgcactcggcgaagccattaacgaatataaaggagccgtgatcgtagtgagccatgatgctcgattaatcaccgagacaaattgtcagttgtgggttgtggaggaacaaagcgtctcccaaatcgatggcgactttgaggactacaaaagagaagtactggaagcgctgggggaagttatggtatcacgccccagagagtag

SEQ ID NO: 109265 - DNA, 717 bp, Artificial Sequence
  Description of Artificial Sequence: Synthetic coding sequence
atgcctaaagccccaaagcaacaacccccagagcccgagtggatcggggatggagagagcactagcccatctgacaaagtggtcaaaaagggaaagaaagacaagaaaataaagaagacattcttcgaagagctggccgtcgaagacaagcaggctggcgaggaggaaaaggttctaaaggagaaagagcagcagcagcagcagcagcagcaacagcaaaaaaagaaacgcgacaccaggaagggacggcgtaagaaagacgtcgatgatgatggtgaagagaaggaactaatggagcggttaaaaaaactgtcacgcggctttaacctgccatatcaagatgcccggaagtgcctgggcaggtttggactagagtcgcatgcccataccattcagatttgtaagttgtccggtggccagaaggcacgcgttgttttcgctgagctcgcttgtcgcgagccggatgtgttaatcctggatgagcccacaaacaatctcgatatagagtccatagatgccctgggggaggcaatcaacgaatataaaggtgcagtgattgtcgtcagtcatgacgcccggttaattactgagacaaactgccagctatgggtggtggaagaacaatctgttagccagatagatggcgatttcgaggattacaagagagaggtcttggaagctctgggggaagtgatggtgagccggccaagggagtag

SEQ ID NO: 109266 - DNA, 1023 bp, Artificial Sequence
  Description of Artificial Sequence: Synthetic coding sequence
atgccgaaagcgccaaaacagcagcccccagagcccgagtggatcggggatggcgagtccacatccccctccgacaaggttgttaagaagggtaagaaggacaagaaaatcaagaaaacgtttttcgaggaattggcggttgaggacaagcaggctggagaggaggagaaagtgctgaaagaaaaggaacagcagcagcagcagcagcagcagcagcagcagaagaaaaagcgggacacacggaagggccggagaaaaaaggacgtcgacgacgacggagaggaaaaagaactcatggagcggctgaaaaaactgagtgtccccaccagcgatgaagaagatgaggtgcctgcgcccaagcctagaggcgggaaaaaaaccaagggaggaaatgtgttcgcagccctgattcaggaccagtcagaggaggaagaggaggaagaaaaacatcccccgaagccagccaagccagagaaaaacagaataaataaagctgtgtccgaggagcagcaaccggccctaaaagggaaaaagggcaaggaagaaaaaagtaagggtaaagccaaaccacagaacaaattcgcagctctagacaatgaagaggaagataaagaagaggagatcatcaaagagaaagaacctcccaagcaggggaaagagaaggccaaaaaagcagaacagggctctgaggaagagggcgagggtgaagaagaggaagaagaggggggcgagtcaaaagctgacgacccctatgctcatcttagtaaaaaggagaagaaaaagctgaagaaacagatggaatacgagcgccaggtggcctccttaaaggctgctaatgcggcagagaatgattttagcgtgtcccaggctgagatgagctcaaggcaggccatgttagaaaatgctagcgacataaaattagaaaagttttccatttcagcccatggaaaagaactctttgtcaatgctgacctgtacatagtcgccggccggagatacggtcttgtgggtccgaacggctag

SEQ ID NO: 109267 - DNA, 2538 bp, Artificial Sequence
  Description of Artificial Sequence: Synthetic coding sequence
atgccaaaggctccaaagcagcagccaccagagccggaatggatcggggacggcgaatccacatctccatcagacaaagtagttaaaaagggtaaaaaagataagaagatcaaaaagactttttttgaagagcttgctgttgaagacaagcaggcaggtgaggaggaaaaggttcttaaagagaaagaacagcagcagcagcagcagcagcagcagcagaagaaaaagagagacacgcgcaaggggcgcagaaaaaaggacgtcgacgatgacggggaggagaaggaactgatggagaggctcaagaagctctccgtgcccaccagcgatgaagaagatgaagtgcctgcgccaaagcccagaggtgggaaaaaaaccaaaggtggcaatgtgtttgccgctctcatccaagaccagagtgaagaagaggaggaggaggagaagcatccacctaaaccggcgaagccagaaaaaaatcgtataaataaagctgtatccgaagagcagcagccagccctgaagggaaagaagggaaaagaggagaaaagcaagggcaaagccaaaccacagaataagttcgctgccttggataatgaggaagaggacaaggaagaagaaatcatcaaagagaaggagccaccaaagcaggggaaagagaaggctaagaaggccgagcagggcagtgaagaagagggagaaggcgaggaggaagaggaggaggggggagaaagcaaggctgatgatccctacgcccacctgtctaagaaagagaaaaagaaactaaagaaacagatggagtatgagcgacaagtagcctcacttaaggcggccaatgccgcagaaaacgatttttcagtgtcacaggctgagatgtcttcccgccaagctatgttggaaaatgcttccgacataaagctagagaagttctctatctctgcccacggcaaggagttatttgtcaacgctgacctgtacatcgttgccggacggcgttatggcctagttggtcccaacgggaagggcaagactacacttctgaagcacatcgctaatcgggcgctgtccatcccacccaatatcgatgtcctcctgtgcgaacaggaagtggttgccgacgagacccctgccgttcaggccgtgctgcgggcagacaccaaacggctgaagctgttggaagaggagcgaagattgcaaggccaattagagcagggggatgatacagccgcagagcgattggagaaggtgtatgaagaactgcgagccactggcgctgcagctgcagaagccaaagctcgccggattctggccggccttgggttcgaccctgagatgcaaaataggcccactcagaagttttcaggcggatggaggatgagggtatccctggccagggccctgttcatggagccaactcttctgatgctcgatgagcctactaatcacctggacctcaatgcagtcatctggctcaacaattacttgcagggctggcggaagactcttttaatcgttagccatgatcaggggtttctggacgacgtgtgtacagacatcatccacttagacgcacagcgcctacattattatcgggggaactacatgacctttaagaagatgtaccagcaaaagcagaaagagctcttgaagcagtacgaaaaacaggagaagaagttaaaagaactcaaagcgggtggtaagtcgaccaaacaagccgaaaaacagaccaaagaggctctgacccgaaagcagcagaagtgccgcaggaagaatcaggacgaagaaagccaagaagctcccgagttactgaaacggcctaaggagtatactgtgcggtttacttttccagaccccccccctttgtccccgcctgtactcgggttacatggggtcacctttggataccaaggccagaagcctctttttaagaatcttgatttcggtatcgacatggactcaagaatatgcatcgtgggtccaaatggcgttggcaagagcaccctgttgctgttgctgacgggaaagttgaccccaacacatggagagatgcgaaagaaccatagactcaaaataggattcttcaatcagcaatacgcggagcagcttcggatggaggaaacacccaccgagtacttgcagagagggtttaatctcccctaccaagatgccagaaagtgcctcgggcgatttggcctggagagccacgcccatactattcagatctgcaagctctccgggggtcagaaggcaagagtggtattcgccgaactggcctgtagggagcctgacgtcctaatcctggatgaacctaccaataatctcgacatcgagtcaatcgacgctctgggtgaagctatcaatgaatataagggggccgtcattgtagtttcccatgatgctcggctaatcacggaaaccaattgccagctctgggtggtcgaggagcagtccgtgtctcagatcgacggagactttgaggactataaaagggaggttctagaggctctgggagaggtgatggtaagccgtcctagagagtag

SEQ ID NO: 109268 - DNA, 1023 bp, Artificial Sequence
  Description of Artificial Sequence: Synthetic coding sequence
atgcccaaggccccaaagcaacagcctccggaacctgagtggatcggcgacggcgagtccaccagccctagcgacaaggtggtcaaaaagggcaaaaaggacaagaaaatcaagaagaccttctttgaggaacttgctgtcgaggacaagcaggctggagaggaagaaaaagtgcttaaggagaaggagcagcaacagcaacagcaacagcagcagcagcagaaaaagaagagagacacacgtaaaggaaggcgcaaaaaggacgtagatgatgacggcgaagaaaaggagctaatggaacgcctgaagaaactctccgtgcctacgtctgacgaggaggacgaggtccccgcccctaaaccgcgcggaggaaagaaaaccaagggtgggaatgtgtttgcagcccttatacaggatcagagcgaagaggaagaagaagaggagaagcatccccctaaaccagctaagccagagaaaaaccgcatcaataaggctgtgtccgaggaacaacagccagctctgaaaggaaagaaggggaaggaggagaagtcgaaaggaaaggccaaacctcagaataaatttgccgccctcgataacgaagaagaggataaagaggaggaaataattaaagaaaaagaaccaccaaaacaggggaaagaaaaggccaagaaggcggaacagggaagtgaagaggaaggggagggggaggaagaggaagaggagggcggtgagagcaaggcggatgatccctatgctcacctatccaaaaaggaaaagaagaagcttaagaaacagatggagtatgagagacaggtggcaagtctgaaggccgctaatgccgctgagaatgacttttctgtttcccaggccgagatgtcatcgagacaggcaatgcttgagaacgcctcagatattaagctcgagaaattctccatttccgctcatggcaaggagctgtttgtaaatgccgatctgtacatagtagcgggacggcgctacggcctcgtcggcccgaacggttag

SEQ ID NO: 109269 - DNA, 2538 bp, Artificial Sequence
  Description of Artificial Sequence: Synthetic coding sequence
atgccaaaggcacccaaacaacagcctcccgagcccgaatggataggcgacggcgaatccactagtcctagtgacaaagtggttaaaaagggaaagaaggacaagaagataaagaagacattcttcgaagaattggctgttgaagataagcaagctggagaggaggagaaagtgttgaaggaaaaggagcagcagcagcagcagcagcagcagcagcagaagaaaaaacgagatacacggaaaggacgccggaaaaaggacgtggatgatgatggcgaagagaaggaattaatggagcgtctgaagaagcttagcgtgccgactagcgacgaggaagatgaggttccggccccaaaacctagagggggaaaaaaaaccaagggaggcaatgttttcgcagccttgatccaagatcaaagcgaggaagaagaggaggaggagaagcaccctcctaagcctgccaaaccagagaagaatagaattaacaaggcggtgtcggaagagcagcagccagctctaaaggggaaaaaaggaaaggaagaaaagtctaaggggaaggcgaagccccaaaacaaattcgccgctctcgataacgaggaggaggacaaagaggaggaaattatcaaggagaaagaaccaccaaagcaaggaaaagagaaggcgaagaaagccgagcagggctccgaggaggagggagaaggtgaggaggaggaggaggagggcggtgagagcaaggccgacgacccctatgcgcacctcagtaaaaaggaaaagaaaaagctcaaaaagcaaatggagtatgagaggcaggtcgcatcactaaaggccgcaaatgccgctgaaaacgacttttcagtgtcccaggccgagatgagctcgcgacaggccatgcttgagaacgcatccgatatcaagctggagaagttttctatttctgcccatggcaaggaactcttcgttaatgctgatctgtacattgtggcagggagaaggtacggcctcgtcggacccaacggcaaaggcaagactacactactcaaacacattgcgaacagagcactgagcattccaccaaatatcgacgtcctgctttgcgagcaagaagtcgtagccgatgaaacacctgccgtgcaggcagttctgcgggcagataccaaacgcctcaaactgctggaggaggaacgacgtctgcaagggcagctggaacaaggcgacgacacagccgccgagaggcttgaaaaggtctatgaggaactacgcgccaccggcgcagcagccgccgaggccaaggcccggcgaatcctcgctggactcggtttcgatccagaaatgcagaatcgccccactcagaagttttctggcgggtggaggatgcgtgtcagcctggctcgggcactctttatggaacccaccctgcttatgctcgatgaaccaaccaaccatctcgatctcaacgccgtaatctggctgaacaactacctgcaagggtggcgtaagactttgctaatcgttagccatgaccaaggcttccttgacgacgtgtgcaccgatatcattcaccttgatgcccaacggctgcactactatcgcgggaactacatgactttcaagaaaatgtaccaacagaaacagaaggaactgcttaaacagtatgaaaagcaagagaagaaattaaaagaacttaaggctgggggcaaatccaccaaacaggcggaaaaacagactaaggaggcactcacccggaagcagcagaaatgccgcaggaagaatcaagatgaggagagtcaggaggcgccagagctgttgaaaaggccaaaggaatatacggtccggtttacctttccagatccacctcccctgtcgccccctgtcctggggctccacggggtgaccttcggctatcagggacagaagccactgttcaaaaatctcgattttggcatcgatatggatagtcggatctgtattgtaggacctaacggcgttgggaaatcgacccttctcctgctgttaaccggcaagctgaccccgacccatggcgaaatgcgcaagaaccaccgccttaagatcggattctttaatcagcagtatgccgaacagctgcgtatggaggaaactcccacagagtacttacagagggggttcaacctgccctatcaagacgctcgaaaatgcctcggcaggtttggtctcgaaagtcatgctcacactatccagatctgcaaattatctggagggcaaaaggctcgggttgtcttcgccgaactggcttgtagggaacctgatgtgcttattctggatgaacctacaaacaacttagatatcgagagtattgacgcactgggtgaggcaataaacgagtacaagggtgcagtgatcgtggtgagccacgacgcaagattgatcaccgagaccaactgccagctttgggtggtggaagagcagtcagtttctcaaatcgatggcgatttcgaggactacaagcgggaggtcctggaggcactgggcgaagttatggtctcccgtcccagggaatag

SEQ ID NO: 109270 - DNA, 1023 bp, Artificial Sequence
  Description of Artificial Sequence: Synthetic coding sequence
atgccgaaggccccaaagcagcagcctcctgagcccgagtggattggcgatggggagtccacatctccttccgacaaggttgtgaaaaagggcaagaaagataagaagattaagaagacctttttcgaagagttggcagtcgaagataagcaggccggggaggaagagaaagtacttaaggaaaaggagcagcagcagcagcaacaacagcagcaacagcaaaagaagaagagagacaccagaaaaggtcgccggaagaaggacgtggacgacgatggagaagaaaaggagctgatggaaaggctcaaaaaactgagcgtccctactagtgacgaggaggacgaggtgccagctccaaagccaaggggcggaaagaagaccaagggcggtaacgtttttgccgcgctgattcaagaccaaagcgaggaagaagaggaggaagagaaacatccccccaaacctgccaaacccgaaaagaatagaattaacaaggccgtttctgaggagcagcagccagcacttaaggggaaaaaaggtaaggaagagaagtcaaaaggcaaagctaagccacagaacaaatttgctgcgctggataatgaagaagaagataaagaggaggaaatcatcaaagaaaaagagccaccgaagcaggggaaagaaaaggcgaagaaggccgagcaaggctcggaggaggaaggcgagggggaggaagaagaggaagaaggaggcgaatcgaaagccgatgacccttacgcccatctgagtaaaaaggaaaagaagaaactcaaaaagcagatggaatacgagagacaggtcgcatctttaaaggctgcgaacgccgccgaaaacgattttagcgtgagccaggccgagatgagctccaggcaggcaatgctcgaaaacgcttccgacatcaagttagagaagttttccatctccgcccatggcaaggagctgtttgtaaacgccgatctctacattgtagctggccgcaggtatggcttagtgggacctaacggatag

SEQ ID NO: 109271 - DNA, 1023 bp, Artificial Sequence
  Description of Artificial Sequence: Synthetic coding sequence
atgccaaaggctcccaagcagcagcctcccgagcccgagtggataggcgacggcgaaagcacgtccccaagcgacaaggtcgttaagaaggggaagaaggacaaaaagatcaagaaaacctttttcgaggagctggcagtcgaagacaaacaggctggcgaagaagaaaaagtgctcaaagagaaagagcagcagcagcagcagcaacagcagcagcaacaaaaaaagaagagggatacacgcaaaggacgcaggaaaaaggacgtcgatgatgacggggaagagaaggagctcatggaaaggctcaaaaagctgagtgtcccgaccagcgacgaggaggatgaagtgcccgcccccaaaccacgcggcgggaagaaaaccaaaggcggaaacgtcttcgcggccctgatccaggatcagtcagaggaggaggaggaggaagagaagcatcctccaaaacctgcgaaacccgagaaaaacagaattaacaaggcagtctcagaggagcagcagccagcccttaaagggaagaaggggaaggaggagaagtccaaaggcaaggcaaaacctcagaataagtttgctgcactggacaacgaagaggaagataaggaagaggagattattaaggagaaggagcctcctaaacagggaaaggaaaaagccaagaaagcagagcagggctcagaggaagagggcgaaggtgaggaggaagaagaggagggtggagaatcaaaagccgacgatccatacgcacacctgagcaagaaggagaaaaagaagctcaagaaacagatggagtacgagcgccaggtggcctctctaaaggctgctaatgcggccgagaacgacttttcagtctctcaggctgaaatgtcctcccggcaggccatgttggaaaacgcgtcagacatcaaactggagaagttcagcatctcagcccatggcaaggaactttttgtgaatgcggacctgtacatcgttgccggtaggcgatacggactggttggccccaacggatag

SEQ ID NO: 109272 - DNA, 1023 bp, Artificial Sequence
  Description of Artificial Sequence: Synthetic coding sequence
atgccaaaggcacccaagcagcagccccctgaaccggagtggataggggatggcgagtccaccagcccttctgacaaggtggtgaaaaaagggaagaaggataaaaaaattaaaaaaacctttttcgaggaattggccgtcgaggacaagcaggcaggagaggaagaaaaagttctgaaggaaaaggaacagcagcagcagcagcagcagcaacagcagcaaaaaaagaagcgggacacacgcaaaggccgccggaaaaaagatgtggacgatgacggcgaagaaaaggaactgatggaacgcttgaagaagctgtcagtgcctacctccgacgaagaagacgaggtacctgctcccaaacctcgaggcggaaagaagacgaagggcggaaatgtcttcgctgccctcatccaggatcaaagtgaggaagaggaagaagaagaaaaacatcctccaaaaccagctaagcccgaaaagaaccggatcaataaggctgtgagtgaggagcagcaaccagcccttaagggcaaaaagggaaaggaagaaaagtccaagggaaaggccaaaccgcagaacaagttcgcggctttagataatgaggaggaagacaaggaggaggagatcataaaggagaaagagccacctaaacagggcaaagaaaaagctaaaaaagctgagcaaggcagtgaggaggagggggagggcgaggaagaagaagaggaaggaggcgagtctaaggccgacgatccttacgcacacctctccaaaaaggagaagaagaaactgaagaaacagatggagtacgaaaggcaggtcgccagtctaaaggcggcaaacgcggccgagaacgatttttcagtcagtcaagcagagatgtcctcccgccaggcaatgcttgagaacgcctccgacattaagctcgagaagttttccatttccgctcacggcaaggaactgttcgtcaatgcagacctgtacatcgttgctgggcggagatacggactcgtgggaccaaacggctag

SEQ ID NO: 109273 - DNA, 1023 bp, Artificial Sequence
  Description of Artificial Sequence: Synthetic coding sequence
atgccaaaagcaccaaagcagcaacctccagaacctgagtggattggcgacggggagtccaccagcccatcagacaaggtggtcaaaaagggcaaaaaagacaagaagattaagaagaccttctttgaagagttagccgttgaagacaagcaggctggagaggaagaaaaagtgctgaaggaaaaagagcagcagcagcagcagcagcaacagcagcagcagaagaagaagcgggataccagaaaggggaggcgaaaaaaggatgtggacgacgatggggaagagaaagaactgatggaaaggctaaagaagctcagcgtcccaacatcagatgaggaagacgaagtccctgcccctaagcccagaggggggaaaaaaaccaaggggggtaacgttttcgccgccctaattcaggaccagtctgaggaggaagaggaggaagagaagcacccacccaagcctgccaagcccgagaagaataggattaataaggcagtgagtgaggagcagcaaccagcactcaaggggaaaaaaggtaaagaggagaagtcgaagggaaaggcgaagccacagaataaatttgccgctcttgacaacgaggaagaagataaggaggaggagatcatcaaagaaaaagagccacccaagcagggtaaggaaaaggccaagaaggccgagcagggaagtgaggaagagggcgagggtgaggaagaggaagaggaggggggcgagagcaaagccgatgacccttacgcccatctctccaagaaggaaaagaagaaactcaagaaacaaatggaatatgagcggcaggtcgcaagtctgaaagcggccaacgccgctgaaaacgacttctcggtgagccaggccgagatgtcttcccggcaagcgatgctggaaaacgcttcggacataaagctggagaaattctctatatccgcgcacggcaaggagctgtttgtgaacgcggacctctacatcgtggccggacgacgctacggcctggtcgggcctaacggatag

SEQ ID NO: 109274 - DNA, 2424 bp, Artificial Sequence
  Description of Artificial Sequence: Synthetic coding sequence
atgcccaaggctcccaagcagcaacctccggaacctgagtggatcggcgatggagagtctacaagtcccagcgacaaggtggttaaaaaaggaaaaaaagataagaaaataaagaaaactttttttgaagaacttgcagtcgaggacaaacaggccggagaggaggaaaaagtcttgaaagagaaagagcagcagcaacagcaacagcagcagcagcagaagaagaagcgtgacactagaaaaggccgtagaaagaaggatgtcgacgacgatggggaggaaaaagagctcatggagcgactgaaaaagctgtctgtccccactagcgacgaggaggacgaagtgcccgccccaaagccaaggggggggaagaagactaagggcggtaatgtgttcgccgccttgatacaggatcagtccgaggaagaggaggaagaagagaagcaccccccaaaacctgccaagccagagaagaacagaatcaacaaagctgtgagtgaagagcagcagccagcactcaaggggaaaaaggggaaggaggagaagtcaaaggggaaggctaagcctcagaacaaattcgctgctctcgataatgaggaagaggataaagaggaggaaatcatcaaagaaaaggagcctcccaaacagggaaaagagaaagctaagaaagcagagcagatggagtacgaacggcaggtggcgtcactgaaagccgctaatgctgccgaaaacgattttagcgtctcccaggctgagatgtctagtagacaggccatgctcgaaaacgcatcggacataaagctggaaaagttctctataagcgcccacggaaaggaactgtttgttaacgcagacctgtacatcgtggccgggcgacggtatggcctggtgggacccaacggtaagggcaaaactactctgctaaagcatatagccaacagagcgctgtccattccacctaatattgatgtgctgctgtgcgagcaggaagtcgtggcagacgagactcctgccgtacaagcagtgctccgggcggacactaagaggttaaaattactggaggaagagcggcggctgcagggacagctcgagcagggagacgacacagccgccgagcgtctggaaaaagtgtacgaagaactgcgagccaccggggcggcggctgccgaagccaaagcccggcggatactggcagggttgggcttcgacccggagatgcagaatagacccacccagaagttttctggtgggtggagaatgcgcgtctcactggccagagcattgttcatggaacctactctgctgatgctggacgaacctaccaatcacctggatctcaacgccgtcatctggttgaacaattacctgcaggggtggcgcaagaccctgctgatagtgagccacgatcagggttttctcgacgatgtctgcacggacattattcacctggatgcccagcgactgcactactaccgcggaaactacatgaccttcaagaaaatgtatcagcagaaacagaaagagctcctcaagcaatacgaaaagcaggagaagaaactcaaggagttgaaggctggagggaagtccaccaaacaggcagaaaaacagaccaaggaagctctgactaggaagcagcagaagtgcagaagaaagaatcaggatgaggagtcgcaggaggccccggaattgctcaagcgccctaaagaatacacggtgcggttcacctttcctgaccctcctcctctcagtccaccagtgctgggacttcatggagttacatttggctaccaaggacaaaagcccttgttcaagaatttggatttcgggatagatatggacagtcgcatatgcattgtggggcctaatggagtggggaagtcgacgcttctgttacttttgacaggcaaactgacccccactcatggcgagatgaggaagaaccatcggctgaaaataggcttcttcaaccagcaatatgcggagcagttgcgaatggaggaaacacctaccgagtatctgcagcgtggattcaacctcccctaccaggacgcaaggaagtgcctcggaaggttcggccttgagagccacgcccacacaattcagatctgtaaactttcaggaggccaaaaggccagagtagtgttcgctgagctggcttgccgagagccggacgtcctcattttagacgagccgaccaacaacctcgacattgaatcaatcgacgcgcttggtgaggcaattaatgagtataagggggctgttattgtggtgagccatgacgctcgcctgatcacagagaccaactgccagttgtgggtagtggaggaacagtccgtttcccagatagatggagacttcgaagactacaagagggaggtccttgaggctttaggcgaagttatggttagccgcccaagagagtag

SEQ ID NO: 109275 - DNA, 2424 bp, Artificial Sequence
  Description of Artificial Sequence: Synthetic coding sequence
atgcccaaggccccgaaacaacagccccccgagcctgaatggataggcgatggcgagtcgacttccccctccgacaaagtcgtgaagaaaggcaaaaaagacaagaagatcaagaagactttcttcgaagagctggccgttgaagacaagcaggcaggcgaggaggaaaaagtcctgaaggaaaaggagcagcagcagcagcagcagcagcaacaacaaaaaaagaaacgagacacccggaagggtcggcggaagaaagacgtggatgatgacggggaagagaaggagctcatggaacgcttgaagaagctgtccgtccctacaagtgacgaagaagatgaagtgcccgcccccaaacctaggggaggcaaaaaaactaagggaggaaatgtgtttgcggcgttaatccaggaccagtcagaagaggaagaagaggaagagaagcacccaccgaaacccgccaaacctgaaaagaatcgaataaataaggccgtgtcagaggagcaacagcctgccctgaaagggaagaagggaaaggaagaaaaaagtaaggggaaggcaaaaccccagaataaatttgccgccctggataatgaggaggaagacaaggaggaggagatcatcaaagaaaaagaaccaccaaagcaggggaaggaaaaagctaaaaaagctgaacagatggaatatgagagacaggtcgcctcacttaaggccgccaacgccgcagagaacgatttcagcgtgtcgcaggcggagatgtccagccgccaggcgatgctcgagaacgcctccgatatcaaactcgaaaaattcagtatcagcgcccatggaaaggagttgttcgttaacgcagacctctatatcgttgcaggacgaaggtacggactcgttgggcctaacggcaaggggaaaaccacacttctgaaacatatcgctaacagagctcttagcatcccacccaacattgacgtactgctttgcgagcaggaggtcgtggccgatgaaacacccgctgttcaggccgtgctccgtgcagatacgaaacgccttaagttattggaggaagaaaggagactacaaggccagctggagcagggggacgacaccgccgctgagaggcttgaaaaggtttacgaagagctcagggccaccggggcagcagccgccgaggccaaggcccggcggattctggctggcctcggctttgaccccgaaatgcagaatcgcccaacccaaaagttttccgggggctggcgtatgcgcgtctctctcgcgcgtgcactctttatggaacccaccctgctcatgctggacgagcccaccaaccatctggatctgaatgcagttatttggctgaataactacctccagggttggagaaagacgctgctgatagttagtcacgatcaggggtttttggacgatgtgtgcactgatattatacacttggatgcgcagcgcctgcattattacaggggaaactacatgacttttaaaaagatgtaccagcagaaacagaaggagttgcttaaacagtacgagaagcaggaaaagaagctcaaagagctgaaggctgggggcaaaagcaccaagcaggctgagaaacagactaaggaagcattaaccaggaaacagcagaagtgtaggcgcaaaaatcaggatgaagaaagccaagaagctccagagctgctgaaacgtcctaaggaatatacagtgcgctttactttccctgaccctcccccactctcaccacccgtgcttggcctgcatggtgtgactttcgggtaccagggccagaaaccgctgttcaagaatctcgacttcggaatcgacatggatagcagaatatgtatcgtaggtccgaatggcgtgggcaaatccacccttctgcttctcctgaccggcaaactcactccaacccatggggagatgcgtaaaaaccaccgtctgaaaataggattctttaaccagcagtacgctgagcaattaaggatggaggagacccccaccgaatatctgcagagaggctttaacttgccataccaagacgctcggaaatgtttgggacgatttggactggagtcacacgcacatacaatccagatttgcaagttgagcggcggccagaaggcgcgggtcgtcttcgctgaacttgcctgcagagagcctgacgttctcatcctggacgagccaacgaacaatcttgacatcgaatcgattgatgccctcggggaggcgatcaatgaatacaagggtgccgtcatcgttgtgtctcatgatgcaaggctcattaccgaaactaattgccagctttgggtggtggaagagcaatccgtgtctcaaattgatggcgacttcgaagattataagagggaggtgttggaggctttgggggaagtgatggttagtcgtcctagggagtag

SEQ ID NO: 109276 - DNA, 717 bp, Artificial Sequence
  Description of Artificial Sequence: Synthetic coding sequence
atgcctaaggcccccaaacagcaacccccggagcctgaatggatcggcgatggggagtccacatcccctagcgataaagtggtgaaaaaaggaaaaaaggataagaagatcaagaagactttttttgaagaactggcagttgaggacaagcaggccggggaggaggagaaggtgttgaaggagaaagagcagcagcaacagcagcaacaacaacaacagaaaaaaaagagagacacccgaaaaggtcgcagaaagaaggatgtggatgatgatggggaagagaaagagctgatggaacgcctgaagaaactatctaggggttttaacctgccttatcaagatgcccgaaagtgtctgggaagattcggtctcgaatcacacgcccacacaatacagatatgcaaattgtccggcgggcagaaggctcgggttgtgttcgctgagctggcctgtcgtgaaccagacgtcctcatcctcgacgagcccacgaataacctcgatattgagagcatcgatgcactcggagaggccattaacgaatacaagggagccgtgatcgttgtctctcacgacgctaggttaatcaccgaaaccaactgccaactatgggtcgtggaggaacagtctgtaagtcagattgacggagactttgaggactataagagggaggtgctggaggcattaggagaggtgatggtctccaggccacgcgagtag

SEQ ID NO: 109277 - DNA, 1602 bp, Artificial Sequence
  Description of Artificial Sequence: Synthetic coding sequence
atgccaaaagcccccaaacagcagccaccagaaccagagtggatcggggacggggaaagcacctcccccagcgacaaagtcgtgaaaaagggaaaaaaggacaagaagatcaaaaaaaccttctttgaagagctggctgttgaggataaacaggctggggaagaagagaaggtccttaaagagaaggagcaacagcagcagcagcagcagcagcagcagcaaaagaagaaacgagacactagaaaaggcaggcgcaaaaaggacgtcgatgacgatggggaagagaaggagttgatggaaaggctgaagaaattgtccgtccccacgtccgatgaggaggacgaggtcccggccccaaaaccgaggggcgggaagaaaactaaagggggaaacgtcttcgccgctctgattcaagatcagtctgaagaagaagaggaggaggagaagcaccccccaaagcctgcgaagccagagaaaaaccgaattaacaaggcagtttccgaggaacagcagcctgcgctcaaaggaaagaaaggcaaagaagagaagagcaaaggcaaggctaagcctcagaacaaatttgccgccctggataacgaggaagaggataaggaagaagaaattattaaagagaaggagccccctaaacagggaaaagagaaggccaagaaggctgagcaggggtccgaagaggagggggagggggaagaagaagaggaggaggggggcgagtccaaggctgacgatccttatgcacatctgtcaaaaaaagaaaagaagaagctgaaaaagcagatggagtatgagagacaggtggctagcctgaaagctgcaaatgccgcagagaatgactttagtgtgagccaggcagagatgagtagtcgacaggccatgctggaaaacgcaagcgacattaagctggaaaaattttccatttcagcacacggaaaagagctcttcgttaacgccgacttatacatagtagccggcagaaggtacggattagtgggccccaacggcaaaggaaagaccactcttttgaaacacatcgctaatcgcgctctatccattcctcccaacatagatgttctactttgtgaacaggaagtcgtagcagacgagacgccagcggtgcaggctgtgctgcgcgatgacaccgcggctgaacgcctggaaaaagtgtacgaggaactccgggccacaggagccgccgccgcagaagcaaaggctcgccggatccttgcagggctgggtttcgatcccgagatgcagaaccgccccactcagaagttcagcgggggctggcggatgagggtttctttggctagggctctctttatggagccaacactgctcatgctggatgaacccacaaataatctagatattgagtccatcgatgcattgggggaggccatcaacgagtacaagggggccgttatcgtggtttcacatgacgcaagactgatcactgaaacgaactgccagctctgggtggtggaggagcagagtgtgagccagatagacggagacttcgaggattataaacgcgaggtgctggaggcactcggggaagttatggtgagccggccgcgtgaatag

SEQ ID NO: 109278 - DNA, 717 bp, Artificial Sequence
  Description of Artificial Sequence: Synthetic coding sequence
atgccaaaagcacccaagcaacaacctccagaacccgaatggatcggggatggggaaagcacctcacctagcgacaaggtggtgaagaagggcaaaaaagacaagaaaattaaaaaaacctttttcgaagagcttgccgttgaggacaaacaagccggcgaggaggaaaaggtactgaaagagaaggagcaacagcagcaacaacaacagcagcaacagaaaaagaagcgagatacacgcaaggggaggcgcaagaaggacgtggacgatgatggcgaggagaaagagttgatggaaagattgaagaaactctcgcgcgggttcaatctgccttatcaagatgcccggaaatgccttggacgcttcggcctagaaagccacgcgcatactatacaaatctgcaagttgagcgggggacaaaaggccagggtagtctttgccgagttggcctgtagagagcccgatgttttgattcttgatgaacctaccaacaacttagatatagagtcgattgatgctctaggggaggccatcaacgagtacaagggcgcggttatcgtagtgtcgcacgatgcccgattgatcacagagactaactgccagctgtgggtggtcgaagaacaaagcgtgagtcagatcgatggagatttcgaagattacaaaagggaagtgttggaggcactgggtgaggtgatggtgtctcgccctcgcgaatag

SEQ ID NO: 109279 - DNA, 2538 bp, Artificial Sequence
  Description of Artificial Sequence: Synthetic coding sequence
atgccaaaggcacctaaacaacagcccccagaaccagaatggatcggagatggcgagtctacctctccttcagataaggtggttaaaaaaggcaaaaaagataaaaaaattaagaagaccttcttcgaagagctggcagtggaagacaagcaggccggcgaggaggaaaaagtgctgaaggagaaggaacagcagcagcagcagcagcagcagcagcagaagaaaaaacgagatacgaggaaaggacgtcgcaaaaaggacgtcgacgatgacggtgaggagaaggaacttatggaaagactgaagaagctcagcgtgcccacaagcgacgaagaggatgaagtacccgcccctaaaccccgcggcggcaagaagaccaagggggggaatgtcttcgcagcactcattcaagaccaaagtgaggaggaggaggaggaagagaaacatccaccaaaaccagccaagcccgaaaaaaaccgaattaataaagcggtgagcgaggaacagcagccagcactgaagggcaagaaaggcaaggaggagaagtccaaggggaaagccaaacctcagaacaaatttgcagccctcgacaatgaagaggaagataaggaagaagaaatcataaaggagaaggagccacctaaacaggggaaggagaaagctaagaaagctgagcaaggatccgaagaagaaggagagggggaagaagaagaagaggaaggaggtgagtcaaaagctgacgacccatacgctcatctgagtaaaaaagagaagaagaagctgaaaaaacaaatggagtacgagagacaagtcgcatctctgaaagctgctaacgccgcagaaaacgatttcagcgtgtcacaggctgagatgtcttcccgacaggcaatgctggaaaacgcctcagatataaaactggaaaagttcagcataagcgcccatggcaaggagcttttcgtgaacgcggatctgtacattgtcgcagggagacgatacggactggttggcccaaacgggaagggtaaaacgacattgctgaaacatatagcgaaccgagcattaagtataccccccaatattgacgtgttgctctgcgagcaggaggtagtggctgatgagacgccagcagtgcaggccgtcttgcgcgcggacactaaaaggctgaagctgctcgaagaggagcgtcgattgcaaggacagctggaacagggcgacgataccgccgccgagaggctggagaaagtgtacgaagagctccgcgccacaggtgccgcggccgctgaggccaaggccaggcgcattctagccggcttggggttcgatcccgagatgcagaatcggccgacccaaaagttctccggaggatggcgcatgcgagttagcctcgcccgcgccctgttcatggagccgacgctgctcatgttggacgagccgacaaaccacttagacttgaatgcagtcatctggctcaataattacctgcaaggatggagaaaaaccctactgatcgtctctcatgatcagggctttcttgacgatgtgtgtacagatataatccatctcgatgcccagcggcttcactactaccgaggtaattacatgacttttaagaagatgtaccagcagaaacagaaggagcttttgaaacagtacgagaagcaggagaaaaagttgaaggaattgaaggccggaggtaaatcaacaaaacaggccgaaaagcagacaaaagaagccttgactcgcaaacaacagaagtgtcggcgcaagaatcaggacgaggagtcacaggaagcccccgagctgctgaagcggcccaaagaatacacagtgaggtttactttccccgatcccccacccttaagcccccccgttctgggtttgcacggtgtgacctttggttatcagggccagaaaccactgttcaagaatcttgattttggcattgatatggacagcaggatatgtatcgtcgggccgaacggagtgggaaaatcgacgttgctcctgctgctgaccgggaaactgaccccaacacatggtgagatgcgaaagaaccaccgactgaaaatcgggttcttcaatcagcagtatgccgaacaattgaggatggaagagacgccaactgagtatctgcagaggggctttaacctgccataccaggatgcacggaaatgcctcggaagattcggactggagagtcacgcacacactatacagatatgcaaattgtccggtggccagaaagcgcgtgtagtgtttgccgaactcgcatgtagggagccagacgtcctgattttggacgagcccactaataatttggatatcgagtcaatagatgccctgggcgaggcaatcaacgagtataaaggagccgtaatagtggtgtcccatgacgcgcgcctgatcaccgagacgaactgccagctctgggtggtagaggagcagtctgtgagccagattgatggcgacttcgaggactataaacgcgaggttctggaggcactcggtgaagtaatggtgtctcggccacgcgagtag

SEQ ID NO: 109280 - DNA, 2538 bp, Artificial Sequence
  Description of Artificial Sequence: Synthetic coding sequence
atgccaaaggcccctaagcagcaacccccggaaccagagtggattggcgacggagagtctacatcacccagcgataaggtcgtgaaaaaaggcaaaaaggataaaaagatcaagaaaacgttctttgaggaattggccgtggaggataagcaagccggagaagaggagaaagtgctgaaggaaaaagaacagcagcagcagcagcagcaacagcagcaaaagaaaaagcgagatactcggaaagggcggcgcaagaaagatgtagatgatgatggcgaagagaaagagctgatggagaggctgaaaaagctgtcagtcccgaccagcgacgaggaggacgaggtccccgcaccaaagcctcgcggggggaagaagactaaaggcggcaacgtgttcgcggccttgatccaggaccaaagtgaggaagaggaggaggaggagaaacatcccccaaaaccagcaaagcctgagaagaatcgcattaacaaggccgtgagcgaggagcagcaaccagccctcaaagggaagaaaggaaaggaggaaaagagcaaaggcaaagcaaagccgcagaataagtttgccgccctcgacaacgaagaggaggacaaggaggaggagatcattaaggagaaagagccaccaaaacaggggaaggagaaggccaaaaaggccgagcagggatccgaagaggaaggcgagggcgaggaggaggaagaggaagggggtgaaagcaaagcggatgacccatatgctcatctgtctaaaaaggagaagaaaaagctgaagaagcagatggagtatgagagacaagtggcttccctgaaggcagcaaatgccgcagagaatgatttctctgtgtctcaggccgagatgagttcccgtcaggccatgcttgagaatgcttccgatataaaactggaaaaattttcaatcagtgctcatggcaaggagctcttcgtgaatgccgacctttacattgtggccggaaggagatatggcctggtgggcccaaacggcaaaggaaagactactttgctgaaacacatcgctaaccgcgcactgagtataccacccaatattgacgttctgctctgtgagcaggaagtggtagctgatgaaactcctgccgtgcaggcagtgcttcgcgccgacaccaagagactcaagctcctcgaggaagaacgaaggttgcagggacagctcgagcagggagacgacactgcagcagagagactggaaaaagtgtacgaggaactgagggcaaccggggcggccgcagccgaggccaaagcccggagaatcctggccggtctgggattcgaccctgagatgcagaatcgacccacccaaaagtttagtggaggctggcggatgcgggtctctctggcccgggcactgtttatggagccgacattattgatgctggacgaacctacaaatcatctggatctaaacgcggttatctggttgaataactacttgcagggctggcgcaagaccctcctcattgtttcccatgaccaggggtttctggacgacgtgtgtactgacatcatccacttggatgctcagcgacttcattactataggggtaactacatgacctttaaaaagatgtatcagcagaagcagaaagagctcttaaaacagtacgaaaagcaggagaagaaactgaaggaattaaaggcaggggggaaatcaacgaaacaggccgagaagcaaactaaagaagctctgacccgcaagcagcagaagtgccggagaaagaatcaagatgaggaatctcaagaagccccggaactgcttaagaggccaaaagaatatactgtgaggttcactttcccagatccaccccccctgtcacctcccgtccttggactccacggggtcacattcgggtatcaaggtcaaaaaccacttttcaaaaacttggacttcggtatagacatggattctagaatatgtatagtagggcccaacggcgtggggaaaagcaccttactacttcttcttaccggtaagttaacccccacccacggagaaatgcgtaaaaaccaccgtctgaagattggattttttaaccagcagtacgcggaacagctccgcatggaggagacccctactgagtatctgcaacgtggtttcaacctcccataccaggatgcaaggaagtgtctagggcgttttgggctggaatcccacgcccacacaatccaaatctgtaaactttccggggggcaaaaggctagggtcgtcttcgcagagttggcctgtcgggaaccagacgtccttattttggatgagcctacgaataatttagatatcgagtcgatcgatgcactcggagaggccattaatgagtacaaaggagcggttatcgttgtatcgcatgacgcacgactaattaccgaaacaaattgtcagctgtgggtcgtcgaggaacagtccgtcagccagatcgatggcgatttcgaagattataagagggaggtgcttgaggcccttggcgaggttatggttagcaggcctcgagaatag

SEQ ID NO: 109281 - DNA, 717 bp, Artificial Sequence
  Description of Artificial Sequence: Synthetic coding sequence
atgcccaaagctcctaaacagcagcctccagagccagagtggatcggcgacggcgagtcaaccagcccttccgacaaggtagtgaagaaggggaagaaggataaaaagatcaagaagactttcttcgaagaactggcagttgaggataagcaggcgggagaggaggaaaaggtgctaaaggaaaaagagcagcaacagcagcaacagcaacagcagcaaaagaagaagcgggacacgagaaagggccgaagaaagaaggacgtggacgacgatggcgaggagaaggaactcatggagcgccttaaaaagcttagtcgggggtttaatctgccttatcaggacgccagaaaatgcttgggtagattcggactggaatctcatgcgcacaccatccagatctgcaaactctcaggcggccagaaggcccgcgtcgtgtttgcagagttagcatgccgcgagcctgacgtgctgatcctggatgagcccacaaacaaccttgatatcgagagcatagacgcactgggagaggctattaatgaatacaagggagccgttatcgtcgtatcccatgatgcccgcctcattacagagacgaattgtcagttatgggtggtggaggaacagtcagtgtctcagattgacggagactttgaggactataaacgtgaggttttagaagcactcggggaggtcatggtttctcgcccccgtgagtag

SEQ ID NO: 109282 - DNA, 1602 bp, Artificial Sequence
  Description of Artificial Sequence: Synthetic coding sequence
atgcccaaggcccccaagcagcagcctcccgagcctgaatggatcggggacggggaatctacgagtccaagcgataaagtcgtgaagaagggtaagaaggacaaaaagatcaagaaaactttctttgaggagctggctgtggaggataagcaagctggggaggaggagaaagtgctgaaggagaaggaacagcagcagcaacagcaacagcagcagcagcaaaagaagaagcgggatacccgaaagggccggaggaagaaggacgtcgacgacgacggagaagagaaagagttgatggaaagattgaaaaagttatcagttcccacctctgatgaggaagacgaggtgcctgcccccaagccccgcggagggaagaagaccaaagggggcaacgtgttcgcagccctcatccaggaccagagtgaggaggaagaggaagaggagaagcatccccccaagccagccaaacctgaaaagaacagaatcaacaaagctgtttcagaagaacagcagccagcactgaaaggtaagaaggggaaggaagaaaaatcaaaaggtaaagcaaagccacagaacaaattcgcagccctggacaacgaagaggaggacaaagaagaagagatcataaaggaaaaagaacctcccaagcagggaaaagagaaggccaagaaggctgaacaaggcagtgaagaggaaggggagggtgaagaggaagaggaggaagggggagagtcgaaagccgacgatccctatgcccatctcagcaaaaaggagaaaaaaaagctcaagaaacagatggagtatgagagacaggtagccagcctgaaggcggccaacgccgcagaaaacgatttctctgtaagtcaggctgaaatgtcatcccgtcaagccatgcttgagaatgcatctgacatcaagctagagaaattttcaatcagtgcccacggcaaggagctgtttgtgaacgccgacctgtacattgtggccgggagacggtatggcctggtcggtcccaacggaaagggaaagacaaccctgcttaagcacattgccaacagggccctctccatcccccccaatatcgacgtcctcctgtgcgagcaggaggttgttgcagacgagacacctgctgttcaggctgtgctgcgagatgatactgccgccgaaaggttggagaaagtttatgaggaacttcgggccaccggcgcggctgccgctgaggcaaaggcgcgacgaatcctagcagggcttggatttgatcccgaaatgcaaaatcgcccaactcagaaattctccgggggctggaggatgcgcgtgtccttagcgcgagcactcttcatggagccgaccctcctgatgctggatgagcccaccaataatcttgacatagaatccattgacgcgttaggcgaagctatcaacgagtacaagggcgcagttatcgtggtgagtcatgatgcaagactgattactgaaactaactgccaactatgggtcgtagaagaacagtcagtgagccagatcgacggagatttcgaagactataaacgagaagtcctggaagccttgggtgaggttatggtgagtcgacctcgagagtag

SEQ ID NO: 109283 - DNA, 1599 bp, Artificial Sequence
  Description of Artificial Sequence: Synthetic coding sequence
atgcctaaagccccaaagcagcagccacctgagccagagtggatcggcgacggcgagtccactagccccagcgacaaggttgtgaagaaggggaagaaggacaagaagattaaaaaaactttcttcgaggaactcgccgtcgaagataaacaagcgggcgaggaggagaaggtgctgaaggagaaagagcagcagcagcagcagcagcagcaacagcagaaaaaaaagcgagatacccgtaagggacggcggaaaaaggatgtcgacgacgacggggaggagaaggaactgatggagcgactgaagaagctgtctgtgcctacatctgacgaggaggacgaagtgcccgcacctaaacctcgagggggcaaaaagactaaggggggcaacgtgttcgcagctcttattcaggaccagtcagaagaggaagaggaagaagagaagcatcctccaaagcctgcaaagccagaaaaaaatcggatcaacaaggccgtttctgaagaacaacagccagccctgaaaggcaagaaggggaaggaggagaagagcaaggggaaagctaagccccaaaataagtttgcagctctagataatgaggaggaggataaggaagaagagatcatcaaggagaaagaaccgcccaagcagggcaaggagaaagccaagaaggctgagcagggttctgaggaagagggggagggtgaggaggaagaggaggaggggggagagagcaaggcagatgacccatatgcccatctgtccaagaaggagaagaagaagctgaagaagcagatggagtatgagcgccaggtcgcgagccttaaggccgctaacgctgctgagaacgacttttccgtatcacaggctgaaatgtcttcaagacaggccatgctagagaacgccagcgacattaagctagaaaagttcagtatttcggcgcacggtaaagaactgtttgtaaatgctgatctctacatcgtggccggacgccgctacggcctcgttggacccaatgggaagggtaagactactctgctcaagcacatcgcaaatcgcgctctgtctatcccgcctaatattgatgtgctcctttgtgagcaagaggtggttgccgatgagacccccgctgtgcaagctgtgttgcgagatgacactgctgccgaacggctagagaaggtgtatgaggaactgagggctactggggccgccgccgctgaagccaaggcgaggcggattttggccggcctgggattcgacccagaaatgcagaatcgtcctacacagaaattctccggcggctggagaatgagagtatcacttgcccgggccctcttcatggagcccacgctcctgatgctggatgagccgaccaataatttggacattgagagcattgacgccttgggcgaggctatcaacgaatacaaaggggccgtgattgtcgtgtctcacgacgcgaggctcatcacggagacaaactgccagctctgggtggtggaggaacaatcggtcagtcagatcgacggggatttcgaagactacaagcgggaggtcttagaggctctcggagaagtcatggtttcacgacctagggagtag

SEQ ID NO: 109284 - DNA, 1599 bp, Artificial Sequence
  Description of Artificial Sequence: Synthetic coding sequence
atgcccaaggccccaaagcagcagccccctgaacccgaatggatcggagacggcgaatctacttccccatcagacaaagtagtgaagaaagggaaaaaggataagaagattaaaaagacgttctttgaggagctagctgtggaagataagcaagccggggaggaggaaaaggtgttgaaggaaaaagagcagcagcagcagcagcagcagcagcagcaaaaaaaaaaacgagacacaagaaagggaagacgcaaaaaggacgtcgacgacgatggcgaggagaaagagctgatggaacgcctgaagaagctgtccgtccctaccagcgacgaagaagacgaggtacctgctcctaaaccccgcggcggaaaaaagaccaagggaggcaatgtgttcgccgctctgattcaagaccagtccgaggaggaagaagaggaagaaaagcaccccccaaaaccagccaaaccggagaaaaaccggatcaacaaggcagtcagcgaggaacagcagcccgccctgaaaggtaaaaaagggaaagaggagaagtctaaggggaaggctaagccccagaataaatttgccgcgttggacaatgaagaagaagacaaagaggaggagattataaaagaaaaggagccccctaagcaaggcaaggaaaaagccaaaaaggccgaacagggtagtgaagaggagggcgaaggggaagaggaggaggaggaaggcggggaatctaaggcagatgatccgtatgcacatctgagcaagaaggaaaagaagaagctcaaaaagcagatggagtacgagcgccaagtggcaagtctgaaagccgccaacgcagccgaaaatgacttctcagtgagtcaggcggaaatgtccagcaggcaggcaatgctagaaaatgcttctgacattaagttggagaaattctctatctccgcccacgggaaggagctattcgtgaacgcagacttatatattgtcgctggaagaagatacggccttgtcggcccaaacggtaaggggaagaccactctgttgaaacatattgcaaatcgggcactgagtattccccctaacatcgatgtgctgctgtgcgagcaagaggtcgttgcagacgagacccctgcagtgcaagccgtattgcgtgatgacaccgccgccgagcgcttggagaaagtgtatgaagaactgcgcgctactggtgccgccgccgccgaggccaaggctagaaggatactcgcagggctgggcttcgacccggaaatgcagaacaggcctactcagaaattcagtggcggctggcgcatgcgcgtttccctggcccgcgccctgttcatggagcctacactgcttatgctggacgaaccaaccaataaccttgacatcgaaagtatagatgccctaggggaggccataaatgagtacaagggagcagtcattgtcgtgtcacacgatgccaggctgatcactgagacaaattgccagttgtgggtagtggaggagcagtcggtttcccagattgacggcgacttcgaagattataagcgggaagtgctggaagccctcggtgaggtcatggtgagcagaccccgggaatag

SEQ ID NO: 109285 - DNA, 1599 bp, Artificial Sequence
  Description of Artificial Sequence: Synthetic coding sequence
atgcccaaggccccaaagcaacagcctcctgaacctgagtggattggcgacggagagagcacatctccctctgataaggtcgtcaagaagggcaaaaaggataagaagattaaaaagaccttcttcgaggaattggctgtagaagacaagcaggctggagaagaagagaaagtccttaaagagaaagagcagcagcagcaacagcaacaacaacagcagaagaagaagagagatactcgcaaaggacgcagaaagaaagacgttgacgacgatggagaggagaaggagttgatggagcgattgaagaaactgagtgttcctacttccgacgaagaggacgaagtgccagcccccaagccacgggggggcaagaaaacaaaaggcggaaacgtctttgcagccttaattcaagaccaaagtgaggaagaagaggaggaagagaaacaccctcctaagcctgccaagcccgaaaagaacagaattaataaggcggtgtcagaggaacagcaaccagccctaaaggggaagaaaggaaaagaagagaagtccaagggcaaggctaaacctcaaaacaaattcgccgccctggacaacgaggaagaagataaggaggaagagataattaaggaaaaagaaccacctaagcagggcaaggagaaggccaagaaagccgaacaaggctcagaagaagagggggaaggagaggaagaagaagaagagggtggagagtcaaaagccgacgacccgtacgctcatctgtctaagaaggagaaaaagaagctgaagaaacagatggagtacgagcgccaggttgcatccctgaaagctgcaaatgccgccgagaacgatttttcagtgtcccaggctgagatgtcttccaggcaggctatgctggagaatgcatccgacatcaaactagagaaattctcgatctcagcacatgggaaagagcttttcgtcaacgctgacctgtatatcgtcgcaggacggaggtacggcctcgtgggccctaacggcaaagggaagacaacacttttgaagcatatagccaaccgtgccctgtctatacctccaaacattgacgtgctcttatgcgaacaggaagtcgtggctgatgaaacacctgccgtgcaggctgttcttcgggacgatacagctgccgaacgcttggagaaggtgtacgaggagctgagggcgacaggggctgccgccgctgaggcaaaggcaagacgaatcctggccggactgggatttgatccggaaatgcaaaaccgacctacccaaaaatttagcggtggatggaggatgagggtgagtttggcgcgtgctctgtttatggagccaaccctcttaatgttagacgaacccacaaataacttggatatcgagtcaatagatgccttgggtgaagccatcaacgagtacaagggcgcggtgatcgtggtgagtcacgacgccagactgatcaccgagactaactgccaattgtgggttgttgaagagcagtccgtctcccagatcgacggcgacttcgaggactacaagagggaagtcctggaagctctcggtgaggtgatggtgtcccgcccccgggagtag

SEQ ID NO: 109286 - DNA, 1599 bp, Artificial Sequence
  Description of Artificial Sequence: Synthetic coding sequence
atgccaaaggcccctaaacaacaaccacctgaacctgagtggatcggggacggcgagtccacttctccttcggataaggtagttaaaaaagggaaaaaggataaaaaaataaagaagacgttctttgaggaacttgctgtggaagataaacaggcgggcgaagaggagaaggtgcttaaagaaaaggaacagcagcagcagcaacagcagcaacaacagaagaagaagagagatactaggaaaggaagacgtaagaaggacgtagacgatgatggagaggaaaaggaactcatggagcgcctgaagaaactatccgttcctacttccgacgaggaggacgaagttcctgctcctaagccacggggcgggaaaaagacaaaggggggcaacgttttcgctgcgctgatccaggaccagagcgaggaggaagaagaagaggagaagcacccccctaaacctgctaaacctgaaaaaaatcgtatcaataaagctgtctctgaagaacaacagccggccctgaaggggaaaaaaggaaaagaggagaaaagcaagggcaaagccaagcctcagaacaagtttgctgccctggataatgaagaggaggataaggaggaggagattatcaaagagaaggagccacctaaacaggggaaagagaaggccaagaaggcagaacaaggcagtgaggaggaaggcgagggagaagaggaggaggaggagggaggtgagtctaaggctgacgacccgtatgcacatttgtccaagaaggaaaaaaagaagctgaagaagcagatggaatatgagaggcaggttgcatccttgaaggctgctaatgctgccgaaaatgatttctctgtcagtcaggccgagatgtcatctagacaggctatgctggagaacgcatcagatataaagcttgaaaagttttctatcagtgcccacgggaaggagctgttcgtcaatgccgacctgtatatagttgctggtagacggtatggcctcgtaggaccaaacggcaaaggaaaaacaaccctcctgaagcacattgccaaccgggctttatctatccctccaaacatcgatgtgctactctgtgagcaagaggtcgttgctgatgaaacgcctgccgtgcaggctgtactgagggatgacactgccgctgagcggctagagaaggtttacgaggagctgagagctaccggtgctgccgccgctgaagcaaaggcccgcagaatacttgccgggctgggcttcgatcctgagatgcagaaccgccccactcaaaaattctcaggtggatggcggatgagagtcagcctggcacgcgccttgttcatggaaccaacgttgctgatgcttgatgagccaacgaataaccttgacatcgaaagcatagatgcattgggcgaagctataaacgaatacaaaggtgcagtgatcgtagttagccacgatgctcgattgatcacagaaactaattgtcaactgtgggttgtggaagagcagagcgtatcccagattgacggcgactttgaagattataaacgtgaggttcttgaggctctcggagaggtgatggtctcacggccccgcgaatag

SEQ ID NO: 109287 - DNA, 1602 bp, Artificial Sequence
  Description of Artificial Sequence: Synthetic coding sequence
atgcctaaagcccccaaacagcagcctccagaacctgagtggattggcgacggagaatctaccagcccgagcgacaaggtcgtaaaaaaaggcaaaaaggataagaaaataaagaaaactttcttcgaggaactagcagtcgaggataagcaagcaggcgaggaggagaaggtgcttaaagagaaggagcagcagcaacagcagcagcaacagcaacagcagaaaaagaaaagggacacccgcaagggaagacgcaagaaagacgtggacgatgacggagaagaaaaggaactcatggagcgactaaaaaaacttagcgtgccaacttctgacgaagaagacgaggttccagcccccaagccacgcggcggtaaaaagaccaaaggcggaaacgtgttcgcggcgcttatccaagatcaatcggaggaggaggaggaagaggaaaaacatcctcctaagcctgcaaaacctgagaagaacagaattaataaggctgtgtccgaggaacagcagcccgcactgaaaggaaagaaagggaaggaggaaaaatcaaagggtaaggctaagccccaaaataaattcgctgctctggataacgaggaggaggataaggaggaggaaataattaaagagaaggagccacccaagcagggtaaggaaaaagccaaaaaagcagagcaaggcagcgaagaggagggtgaaggggaggaggaagaggaggagggaggcgaatccaaggcggatgacccctacgcccatctgagcaaaaaagaaaagaagaaactgaaaaagcaaatggaatacgaacgtcaagtcgctagtctaaaagctgccaacgcggccgaaaacgactttagcgtgagtcaagccgagatgtcctcaagacaagccatgttggagaacgccagtgacataaagctggagaaattttcaatcagcgcccacggtaaggagctctttgtgaatgccgacctatatatcgtagcagggcgtcggtacggtctggtgggtcctaacggtaagggcaaaacgacgctgcttaagcacattgctaatagggccttgtccatcccacctaacatcgatgtgctgctgtgcgagcaggaggttgtggccgacgaaaccccggctgttcaggctgttctgcgcgatgacacggccgctgaacggctggagaaagtctacgaggagctgagagccaccggtgccgccgccgcagaggccaaagccagaaggatcctagccgggttgggatttgaccctgaaatgcaaaaccggcccacccagaaattctccgggggctggcggatgagggtctcacttgcccgggccctgttcatggaaccaaccctactgatgctcgatgagcccaccaataacctcgatatcgagtccatcgatgccctcggtgaggctattaacgaatacaagggggctgtcattgttgtatcgcatgatgcccgcttgatcaccgaaacgaactgccagttgtgggtagtcgaggagcagtccgtttcccagatcgacggagatttcgaagactacaaaagagaggtcctggaggcactgggagaggtgatggtcagtaggcctcgcgaatag

SEQ ID NO: 109288 - DNA, 1515 bp, Artificial Sequence
  Description of Artificial Sequence: Synthetic coding sequence
atggatctgatccctaatttcgctatggagacttgggtcttggtcgcaacaagcctcgtcttgctgtacatttacggcacacacagccacaagctatttaagaagctcggcatccccgggccaacccctcttccctttctgggaacaattctcttttacctgcggggtctttggaacttcgatagagaatgcaatgaaaagtacggagaaatgtggggattgtacgagggccaacaacccatgctcgtaatcatggaccctgatatgattaagactgttttggttaaggaatgttacagcgtgttcacgaaccagatgcccctgggcccgatgggcttccttaagtctgcgctatcattcgcagaggatgaagaatggaaacggatacgaactctgttaagtcctgcctttacctcagtgaagttcaaagagatggttcccatcatttcacagtgtggggacatgctcgtccgttctctgagacaagaggcggaaaattcaaagtcaatcaatctcaaagatttcttcggtgcatacaccatggatgtgataacaggcacactgttcggagtcaacctcgatagcttaaataacccacaggaccctttcctgaagaatatgaagaagcttttaaaactggattttttggacccctttttactgctgatatctttatttccattcctcacaccggtgtttgaggctttaaatattggcttatttccaaaagacgtgacccactttctaaagaacagcattgaaagaatgaaggaatcaagacttaaggacaaacagaaacatcgagtcgattttttccagcagatgatagattctcagaatagcaaggagaccaaatcacacaaagcactgtcagatttggagctggtggcacagtccattataatcattttcgctgcgtatgatactactagcactacactgcctttcataatgtacgaactggcaacccacccagatgtccagcagaagctccaggaagagattgatgccgttctcccaaacaaagctcctgtgacctacgatgctctcgtgcagatggagtacctggatatggtggtgaatgaaaccctgcggctcttcccggtagtgtcccgtgtgacccgcgtatgtaaaaaagatatcgagatcaacggcgtctttattcctaaagggttggctgtgatggttcccatttatgccctgcaccacgatccaaagtactggaccgaacccgagaaattttgcccggaatccaggttttccaaaaaaaacaaggattctatcgatctgtaccggtacattccatttggcgccggtcctcgtaactgtattggaatgagattcgctcttacaaatatcaaactggccgtaattcgggcactgcagaatttctcttttaagccttgcaaagaaacccagattccgctgaagctggataacttgccgatcctgcaaccagaaaaacccatcgtgctaaaagtgcatttgagggacggaataaccagcggtccctag

SEQ ID NO: 109289 - DNA, 1872 bp, Artificial Sequence
  Description of Artificial Sequence: Synthetic coding sequence
atgccgtctgatctcgctaagaagaaagctgcgaaaaaaaaggaagccgctaaagccagacagcggcccagaaaaggacatgaggagaatggcgacgttgtgacagaaccgcaagtcgccgagaaaaatgaggcaaacggacgcgaaaccactgaagtcgatcttctgacaaaagaactggaggatttcgagatgaagaaagcagccgctagagccgtcaccggagtgcttgctagtcaccccaacagtaccgatgttcacataattaatctttctctaacattccacgggcaggagctgctgtctgacacgaagctcgagctgaacagcggcaggaggtacggattaatagggctaaacgggatcggcaagtccatgttgctgagtgcaattgggaagagagaggtccctatccctgagcacattgacatataccacctaactagggaaatgccgccatccgataagacacctctgcattgcgttatggaggtcgacactgagagagccatgctggagaaggaggccgaacgcctcgcacacgaggacgctgagtgtgagaaactcatggagctgtacgaaaggttggaagagctagatgccgacaaggcggaaatgagggcctcccgtattctgcacggcctcggattcaccccagccatgcaacgcaaaaagctgaaggacttttcaggaggatggcgcatgcgcgtggccctggcacgcgctctgttcatcaggccattcatgttacttctcgacgagcctactaatcatctggacctcgacgcctgtgtgtggctggaagaggagctcaagactttcaagagaatcctagttctagtgtcccatagccaagattttctgaacggagtatgcaccaatatcatccatatgcataacaagaaactgaagtactatacagggaactacgaccaatatgtcaagacacgacttgagctggaagaaaatcagatgaagcgattccactgggagcaagatcagattgcccacatgaagaattatatcgctcgtttcggtcacgggtccgcaaagcttgcgaggcaggcacagagcaaggagaaaaccctgcagaaaatgatggcgtctggcctcaccgaaagggtcgtgagcgataagacactgagcttttatttcccaccttgtggcaagatcccccctcctgtgattatggtgcagaacgtatcgtttaaatacacaaaagacggtccttgcatctataacaacctcgaatttggtattgatctggacactcgggtggccctggtcggccccaatggggccggcaaatctacacttcttaagctgcttaccggagaactcctgcccacagacggcatgatacggaagcatagtcacgttaaaatcggccggtatcatcaacacctgcaggaacagttggacctcgacctgtcacccctcgagtatatgatgaagtgttacccagagattaaggagaaggaggagatgcgcaagatcatcggaaggtacggtttgaccgggaaacaacaggtcagcccgattcgcaacttatccgatgggcagaaatgcagagtgtgtctggcttggctggcttggcagaacccacatatgctctttctggacgagccaactaatcacctggatatcgagactattgacgcattggcagatgctatcaatgaattcgaagggggcatgatgctggtgtcccacgacttccgcctgattcagcaagtggcacaagaaatctgggtgtgcgaaaagcagacaataaccaagtggcctggcgatattctggcctataaggagcacctaaagagcaaactggtcgacgaggagccccagctgaccaagcggacacacaatgtgtag

SEQ ID NO: 109290 - DNA, 723 bp, Artificial Sequence
  Description of Artificial Sequence: Synthetic coding sequence
atgcctagtgatctcgccaaaaaaaaagccgccaagaagaaagaggccgcaaaggccaggcagcgcccaaggaaagggcacgaggagaacggcgacgtggtgacagaaccgcaagtggcggagaaaaatgaagctaacgggcgtgaaacaactgaggtggaccttcttacaaaagagctcgaagatttcgagatgaaaaaagctgccgctagagcagtgaccggggttttagcaagccatcctaattctactgatgtccatattatcaacctttcccttaccttccacggacaggaactcttgtctgacaccaaacttgagttgaatagcggcagacgttacggacttatcggtctgaacggcattgggaaaagcatgctgctgtccgcaataggtaaacgcgaggtccctattccagaacacattgatatttatcacctgacccgcgaaatgccaccatcggataagactcccctccactgtgtgatggaggtggacaccgaacgagccatgctcgaaaaggaggctgagcggctggcccacgaagatgccgagtgcgaaaaactcatggaactttatgagagactggaagagctggacgctgacaaggctgagatgagagcctcaagaattcttcacgggctggggttcactcctgctatgcagcgaaaaaagcttaaggacttctcaggtggctggcgtatgcgagtggcccttgcatag

SEQ ID NO: 109291 - DNA, 867 bp, Artificial Sequence
  Description of Artificial Sequence: Synthetic coding sequence
atgcctagcgatctcgcaaaaaagaaagccgctaaaaagaaggaggcagcaaaagcccggcagcgtcctcgcaagggacacgaagaaaacggggacgtcgtgacagaaccacaagtcgcagagaagaatgaggccaatggacgcgaaactaccgaggtggacttgctgacaaaggaactcgaagactttgaaatgaaaaaggccgctgccagggctgtgaccggtgtacttgcttcccaccctaattccacggacgtccatattattaatctcagtctgaccttccacggacaggagctactctccgatactaaactggagctgaactccggcaggcgatatgggctgatcggcctgaacggaatcggtaaatctatgttattatctgccattggtaaaagagaagtgcccataccggaacacatcgacatttatcatctcacaagggagatgcctccatcagacaaaacgcccttgcactgcgtgatggaggttgacacggaaagagcaatgctagagaaggaggccgagaggttggctcatgaggatgcagagtgcgaaaagctcatggagctgtacgagaggctggaagagctcgacgccgacaaagccgagatgagggctagccgcatactgcatggattgggatttacaccagctatgcaacgtaagaagctcaaggacttttccggcggttggcgtatgagggtggcattagcccgcgcactattcatacgtccgttcatgctgttacttgatgaacccaccaaccatttggatttggatgcctgtgtctggctggaggaagaactgaaaacgttcaagaggatcctcgtgctggttagtcattcacaagatttcctgtag

SEQ ID NO: 109292 - DNA, 2361 bp, Artificial Sequence
  Description of Artificial Sequence: Synthetic coding sequence
atggtacggagaggctggagtgtctgcactgccatcctattagcgcgactgtggtgcctggtgccaacacatacatttcttagtgagtaccctgaggcagcggagtacccccaccctggctgggtttactggctgcagatggcagttgccccaggtcatttgcgtgcctgggttatgcgtaacaacgtgactaccaatatcccctctgccttctccgggaccttaactcatgaggagaaggccgtactcacagtattcaccggaacagccacggccgtgcatgttcaggtggcggcactcgctagcgctaagctcgaaagttctgtgttcgtcacagattgtgtgtcatgcaagatcgagaacgtgtgcgattcagcgcttcagggcaagcgcgtgcccatgagtgggctgcaggggagtagcatcgtaattatgcctcccagtaacaggccactgaaagcttccgccgcaagttgcacttggtctgtgcaggttcagggaggccctcaccacttaggcgtggtcgccatctcaggaaaagtgttgagcgccgctcatggtgcaggcagggcatacggatggggattcccaggagatccaatggaggagggatacaagactctgctcaagggaatttcagggaaatttaactctggcgaactcgtcgctattatgggaccatccggtgctgggaaaagcaccctgatgaatattctggccggctaccgcgaaactggaatgaagggcgcagtgctgataaatggccttccgcgcgatttgcggtgtttccgcaaggttagttgctacataatgcaggacgatatgcttttgccccacctcacagtgcaagaagcaatgatggtgtctgctcacctgaagctgcaagagaaggacgaaggcagacgggagatggtcaaggagatcctgactgctttggggctgctgagttgcgctaacaccagaaccgggtcactctctggaggacagcggaagaggctggccatagcactggaactggtcaataaccccccagtgatgtttttcgacgagccaacgtctgggctagattctgctagttgttttcaggtggtgtctctgatgaaaggtctggcacaaggcggacgttccattatatgtactatccaccagcctagcgctaaactgtttgagctgttcgatcaactgtacgtcttgagtcaggggcagtgcgtgtaccggggcaaggtctgtaacctagttccctaccttcgggacctgggactgaattgtcctacctatcacaacccagccgatttcgtgatggaggtagctagtggcgagtacggcgaccagaactcacgtttagttagagcggtgcgcgagggtatgtgtgacagtgatcacaaacgggatttagggggcgacgccgaggtcaacccatttctttggcatcgaccctcagaagaggttaaacagaccaagagattgaaagggcttagaaaggatagcagcagcatggaggggtgccactcgttctctgcatcatgtctcactcagttctgcatactgtttaaaaggacgtttctcagcataatgcgtgacagtgttctaactcatctgagaatcaccagtcacattggcataggtttgctgattggactgttgtatctggggataggaaatgaagccaagaaagtcttgtccaatagcgggttcctgttcttcagtatgcttttcctgatgttcgccgctctgatgccaacagtgcttacattcccactggagatgggagtatttctgcgggagcatttgaactattggtactccctgaaagcctactacttagctaagacgatggcagacgttcctttccagattatgtttcctgtggcctattgtagcatcgtttactggatgacttctcaaccaagcgatgctgtgcgctttgttctgtttgccgctctgggaaccatgacctccctggtggctcagtcattagggctgctcatcggggcagcaagtacttcactgcaggtggctacctttgttgggccggtgaccgccattcctgtcttactcttcagtggtttctttgtttccttcgataccatacctacgtatcttcaatggatgtcatatattagctacgtgcgctacggctttgagggcgtgatcttgagtatttatgggcttgatcgggaagacctgcactgtgatatcgacgagacatgtcacttccagaaatcagaggcgatcctccgggaactagacgtggagaacgctaagctgtatctggacttcattgttctgggtattttttttatcagtctcagactcatcgcgtacttcgttcttagatataaaatccgagcggaaagatag

SEQ ID NO: 109293 - DNA, 2034 bp, Artificial Sequence
  Description of Artificial Sequence: Synthetic coding sequence
atgagaatcagcctgccaagagcccccgaaagagacggaggcgtgagtgcgtcctctctgttggatacggtcactaacgcttctagttactctgcagaaatgactgagcccaaaagcgtctgtgttagcgtcgatgaggtagttagttctaacatggaggcaaccgagacggatctactgaacggccatttgaagaaggtggataataatcttacagaggcccagcggttctccagtcttcccaggcgagcagccgtcaacatcgagtttcgcgacctgtcctactccgttccagaggggccttggtggcgcaagaaggggtataagacactcctgaaaggaatttctggcaagttcaattctggcgagttagtcgccattatgggaccatccggggctggaaagagcacactgatgaacatcctggctggataccgcgagacagggatgaaaggggcagttctaattaatggcctgccaagagaccttagatgtttcaggaaggtgtcctgctacattatgcaagacgacatgctgctgccgcatctgaccgtccaggaagccatgatggtttcagcgcaccttaaactccaggaaaaggatgagggtcggagagagatggtcaaggaaattctcaccgctcttgggttactgagttgcgcaaacaccagaacaggaagcctctctgggggccagcgaaaaaggctggctatcgctcttgagctggttaataacccccctgtcatgttttttgacgagccaacctcaggtctggattctgccagttgcttccaagtggtctcacttatgaagggcttggcccagggaggccgctcaatcatctgcaccattcatcagcctagcgccaagctattcgaacttttcgaccagttgtacgtgctgtcgcaaggccagtgtgtgtaccgaggaaaagtgtgcaacttggtcccatacctgcgggatttgggattgaattgccctacctaccacaatccagctgatttcgtgatggaagtggcttctggcgagtatggggaccagaactcaaggttagtcagggccgttcgagaagggatgtgcgactcggatcacaaacgagatttaggcggcgacgcagaagttaaccccttcctctggcacagaccctccgaggaggactcttcctctatggaaggatgccattcattttccgcttcctgtctgacacagttctgtattctattcaaacggacctttctttccataatgcgggactccgtcctgacccatctgcggatcacctcccatattgggattggcctcctgatcggtttgctctacctgggcatcggcaatgaggcaaagaaggtcttgtcaaatagcgggttcttgttcttttcgatgctgtttttgatgttcgccgcgctgatgcctacagtactgacttttcctctggaaatgggagtctttttgcgtgagcacctgaattactggtacagtttgaaggcatattatttggccaagacgatggcggatgtaccgtttcagatcatgtttcctgtcgcctattgttcaattgtttattggatgacaagtcaaccttctgatgcggtccggtttgttctgttcgcagcacttggcacgatgacttcactggtggcccagtcgctgggcctattaatcggcgccgcatccacttcacttcaggttgccacattcgttggccctgtgactgccatccctgtgctcctgtttagcggtttctttgtgagttttgataccattcctacatatcttcagtggatgagctacatttcgtacgtccgctacggattcgagggagttatcctgagtatatacggcctcgaccgagaagatctgcattgcgacatcgatgagacatgtcacttccagaaatccgaggccattctgcgtgagttggacgtggaaaatgccaaactctatctggatttcatagtcctgggaatttttttcatctctctgcgccttattgcctattttgtcctgaggtataaaattcgggccgaaaggtag

SEQ ID NO: 109294 - DNA, 1992 bp, Artificial Sequence
  Description of Artificial Sequence: Synthetic coding sequence
atgatcatgcggttgcctcagccacacggaacgaacgcctcctcttactccgccgaaatgacagagcccaaatccgtgtgtgtgagcgtggatgaagtggtgtcatccaatatggaggcaacggaaaccgatctgctgaatggccacctcaagaaggtagacaacaatcttaccgaggcccaaaggtttagcagcctgcctagaagggccgctgtcaatattgaattcagagatctctcctactcagttccggagggaccatggtggagaaaaaagggctacaaaactttgttgaagggcatatccggtaaattcaactctggagagttggttgcaataatggggccatctggagctggcaagagcactctgatgaacatcttagcagggtaccgtgagactggaatgaagggagcagtcttgatcaatggcctgcctcgggatctgaggtgtttccgaaaagtcagctgttatattatgcaggatgacatgctgctgccacatctcacagtgcaggaagccatgatggtttccgctcacctgaagctccaggagaaggacgaagggcgaagggaaatggtgaaagagatcctgacagccctaggtttgctgtcgtgtgccaacacgcgcacgggatccctcagcggcggacagcggaaacggctggccatcgcattggagcttgtcaacaatccacccgtgatgtttttcgacgagcccacgtccggactcgattcagcatcttgcttccaggtggtgtccctaatgaagggtttggcccagggggggcgcagtattatatgcaccatccaccagccaagtgccaaactgttcgagctattcgatcaattatacgtcctgtcccaggggcagtgcgtctaccggggcaaggtgtgcaacctggtgccctacttgcgcgatctcggactcaactgccccacatatcataacccagctgactttgtgatggaagtggcctccggggagtatggggaccaaaatagtagattggtccgggcagtccgggagggtatgtgtgacagcgatcataagcgggatctaggcggggatgccgaagtgaaccctttcttgtggcatagaccatcggaagaggattctagtagcatggagggctgccactcctttagtgcctcctgcctcactcagttctgtatactattcaagagaactttcctgagcatcatgcgtgactcagtactgacccatctcaggataactagtcacatagggatagggctcctgatcggcctgttatacctggggataggaaacgaggccaagaaggtgctatctaatagcggctttttgtttttctcaatgctattccttatgttcgccgccctgatgcctaccgtcctgacttttccactggagatgggggtgtttctcagagagcacctgaattactggtattcattaaaagcatactatctggccaaaaccatggccgacgtcccatttcaaatcatgttccctgtggcctactgcagcattgtgtactggatgacttcccagccgtcagacgccgtacgtttcgtgttgttcgccgccctcggcactatgaccagcctggtagctcagtcactagggttgctgatcggagccgcctccacatcccttcaggtagcgacatttgtgggccccgtgacagctattcctgtcttgttattctcagggttcttcgtttcttttgacaccattcctacatacttgcagtggatgtcctacatcagctatgtaagatacggtttcgagggggtgattctctctatttatggcctagatagggaagatcttcactgtgacatagatgaaacttgccacttccagaaatcggaggctatactccgtgagctcgacgtggagaatgcgaagctttaccttgatttcattgtcttaggcattttttttatatcactgagactgatcgcctattttgtcctccgctataaaatcagggctgagcgctag

SEQ ID NO: 109295 - DNA, 2037 bp, Artificial Sequence
  Description of Artificial Sequence: Synthetic coding sequence
atggcatgtttaatggccgcctttagcgtgggtactgcaatgaacgcttccagttattccgctgaaatgacagagccaaaatccgtgtgtgttagtgtggacgaggtcgtgtcgagcaacatggaggctaccgaaaccgatctgctgaatggacatcttaaaaaggtggacaacaaccttacagaggcgcaaaggttctcgagcctgcccaggagggcggcagtcaacattgaattccgcgatctgagctatagcgtgccggaagggccatggtggcgcaagaagggctacaagaccctccttaaaggcatctcaggtaaatttaatagcggcgagctcgtggcaataatggggccaagtggagccggaaaatccaccctgatgaatattttggctggttatcgcgaaacgggaatgaagggtgccgttttgattaacggcctgccacgggatctgagatgctttagaaaagtttcttgctatatcatgcaggacgatatgcttctcccgcacctgacagtccaagaagccatgatggtgagtgcgcatttgaaattgcaggagaaggacgagggcagaagggagatggtgaaggaaatcctgacagcattggggcttttgtcttgcgccaataccagaaccggttccctttcagggggccagcggaaaaggctcgctattgctctggaacttgtgaacaaccctcccgttatgttcttcgacgaaccaacgagcgggcttgactctgcctcgtgcttccaggttgtgtcactgatgaagggtctcgcccaaggtggtcgaagcatcatttgtacgatacaccagccctccgccaaactgtttgaactgtttgatcagctgtacgtactgagtcagggccagtgcgtgtaccggggaaaagtttgcaacctggtaccctatctgagagacctggggctgaactgtccgacctatcacaaccccgcggatttcgttatggaggtggcgagtggagaatacggcgatcagaactcgcggttggtgagggcagtccgggagggcatgtgtgatagtgaccataaacgagacctgggcggagatgcagaggtgaatccttttctgtggcataggcccagcgaggaggttaaacaaacgaagcgtctcaaaggactgaggaaggactctagctccatggagggatgccattctttcagtgcctcatgcttaacccagttctgcattctgttcaaacggactttcctgtctatcatgcgggacagtgtcttaacccacctgaggataaccagtcatatcggaataggcctcttgatagggctgttgtacctgggcatcggcaatgaagcaaaaaaggtcttgtctaatagtggatttctgtttttttcgatgctcttcctaatgttcgccgctttaatgcccactgttttaacctttccacttgaaatgggggtgtttttacgcgagcacctcaattactggtatagtctgaaggcatattatttggccaaaaccatggcagacgtaccatttcaaatcatgtttccggtggcctactgcagtattgtatactggatgacgagtcaacccagtgatgccgtgcgatttgtactctttgcggccctgggaacaatgacttccctcgtcgcacagtctctgggtcttttaattggagcggcaagcacttcactgcaggttgctacctttgttggccccgtgactgctattcccgtcctgctattctcaggcttttttgtgtcctttgacaccattcccacctatctccaatggatgtcatacattagctacgttaggtatggatttgagggagtcattctgtcaatctatggcctcgatcgagaagatctgcattgtgatattgacgagacatgccatttccagaaaagcgaggctatcttgagagagctggacgtagagaacgccaaactatacctagactttattgtactgggaattttttttatcagcctccgtctgatagcatactttgtcctcagatataaaatcagggcagaacgctag

SEQ ID NO: 109296 - DNA, 2475 bp, Artificial Sequence
  Description of Artificial Sequence: Synthetic coding sequence
atgttagccgtgcagcagactgagcacctccccgcatgtccacccgccagacggtggagctccaacttctgccccgaatctacggaggggggtcccagcctgctcggacttcgagacatggtgagacgcggttggtccgtttgtactgccattcttctggcaagactgtggtgtctggtccctactcacacctttctcagcgagtacccggaggccgccgagtacccgcaccctggctgggtgtactggctgcagatggccgtggcccccggtcacctgagggcatgggttatgcggaataacgtaactaccaatataccaagcgctttctcagggacactgacgcatgaagaaaaagccgttctgacagtattcacaggcactgccaccgccgtgcatgtccaggttgccgcccttgcctctgcaaaattggagtcatctgtcttcgtcactgactgcgtgtcatgtaaaattgaaaatgtctgcgatagcgctctccaaggcaagagggtgcctatgagcggcctgcagggcagcagcattgtgattatgcctccttcaaacaggcctctggctagtgccgccagttgcacatggagcgtgcaggtccagggaggcccacaccatctcggagtagtcgccatcagcggcaaagtgctatcggctgctcatggcgccggaagagcttacggatgggggttccctggagatcctatggaggagggatacaaaaccctactgaaagggatttccggcaaattcaacagcggtgagctggtcgccataatgggaccatctggggcgggcaagagcaccctgatgaacattctggcagggtaccgggaaaccggcatgaaaggcgcagtgctcatcaatggtctgcccagagatctgcgttgtttccggaaggtaagttgttacattatgcaagacgacatgcttctgccgcacctcactgttcaggaggccatgatggttagcgctcacctcaaactgcaggagaaggatgaagggaggcgggaaatggtcaaggagatcctgaccgcgctcggcctactttcctgtgcgaacaccagaacaggaagcctcagcgggggacagcgaaaacggttagctatcgcgctcgaactggtcaataacccacccgttatgttcttcgacgagcctacatcagggttagacagcgcctcatgcttccaggtggtgtcccttatgaaaggattggcacagggaggcagaagcatcatatgcactatccaccagccgtctgctaagctcttcgagctgtttgatcaactgtacgtactctctcaaggtcagtgtgtatatagaggaaaggtttgcaaccttgtgccttacctgcgagatttgggattaaactgccccacctaccacaatccagcagactttgtgatggaggtggcgagtggcgagtacggcgaccagaattctcgccttgtccgggcggtacgtgaaggcatgtgcgatagcgatcacaagagggacttaggtggagacgcagaggtcaatccttttctctggcatcgcccttctgaagaggtgaaacagaccaaaagactgaagggcctgcggaaagactctagctctatggagggttgccattcattctcagctagctgcttaacgcagttctgcattctgtttaaacgaaccttcttaagcattatgcgtgatagtgtgctcactcacctgcgtataacgtctcacattggcattggcctgctcatcggcctgctttacctcgggattggtaatgaggcaaaaaaagtcttgtctaattcgggctttcttttcttctctatgcttttcctgatgtttgccgctctgatgcctaccgtgctaacgttcccactggaaatgggcgtctttctacgcgaacatcttaactattggtactccctcaaggcttactacctggctaaaaccatggctgatgttcccttccaaatcatgtttcccgtcgcttactgttctatagtgtactggatgaccagccaaccttcagacgccgtgcgttttgtcctcttcgccgcgctggggaccatgacttccctggtggctcagtctttgggcctgctgataggggccgcctccacatccctgcaggttgcgacattcgtagggcctgtgaccgccattccagttctcctgttctccggcttcttcgtcagttttgacactattccaacctatctccagtggatgagctacatttcctacgtgcgctatggatttgagggtgtaatcctgtctatttacgggcttgatagggaggatttacactgtgacatcgatgaaacttgtcacttccagaagtccgaggcgatcctccgggagctggacgtcgagaatgcaaaattgtacctggattttattgttctgggaatctttttcatctccctgagactgattgcctatttcgtactcagatataagatcagggctgagaggtag

SEQ ID NO: 109297 - DNA, 2001 bp, Artificial Sequence
  Description of Artificial Sequence: Synthetic coding sequence
atggcttgtctaatggccgccttctctgttgggacagccatgaatgcaagtagttattctgccgagatgacagagcccaagtccgtttgtgtgtccgtggatgaagtggtttcatcgaacatggaagctaccgagacggacctgctgaacggccacttgaaaaaagttgataacaacctgacagaagcacagcgcttctcttctttgcctcgtcgggcagctgttaatatagagtttagagatctctcatattccgtgcctgaaggcccctggtggaggaaaaaagggtacaagaccctcctgaaaggaattagcgggaagttcaacagcggggaactcgtggctattatgggaccaagtggagccggcaagtccactctgatgaacatcctggctggatacagggagactggtatgaaaggagctgtgttgatcaatgggctgccacgcgacttgagatgctttcgaaaagtcagctgctacattatgcaggacgacatgctgctcccacatctcacagtgcaggaagcgatgatggtcagtgctcacctgaaactgcaggagaaagacgaggggagaagagagatggtgaaggaaattctgactgcgctaggcttactgtcctgtgctaacacacggacaggcagtcttagcggcggccaaaggaagcgtttggcgattgccctggagcttgtcaacaacccccccgtgatgttcttcgatgaaccaacatcaggcctcgactccgcttcatgctttcaggtggtatcactcatgaaggggcttgctcagggcggcagatctatcatctgcacaattcaccaaccttcagcgaagttgtttgaactatttgaccaactctacgttctatcacagggtcaatgcgtctacagaggcaaggtgtgtaacttagtcccgtaccttcgcgacctgggcctgaattgccctacctatcacaatccagccgactttgtcatggaagtcgccagcggcgagtatggtgaccagaatagcaggctggtcagggccgtgcgcgaaggcatgtgtgattccgaccacaaacgggacttgggtggcgatgcagaggtcaatccattcttgtggcaccggccaagcgaggaagactcctccagtatggagggatgtcacagctttagcgccagctgtctgacccagttttgcatcctgtttaagagaacatttctgtcaattatgcgcgattctgtactgacacacctgcgcataaccagtcacataggtattgggttacttattggattgctgtatcttggcatcggcaatgaggctaagaaagtcctctccaactctggcttcctgttcttctccatgctgtttttaatgtttgcagcgttgatgcccaccgtgcttacctttcccttggagatgggcgtgttcctgagggaacatctgaattactggtattctttgaaggcatactacctggcaaagactatggccgacgtcccctttcagatcatgtttccggtcgcctactgttctatagtgtactggatgacatcccagccttctgacgccgtgaggttcgtcctgttcgccgccctaggcacgatgacctcactcgtcgcccagtcactaggccttctgattggggccgcatctacatccctgcaggtagcaaccttcgtgggcccagtgaccgctatcccggtgctgcttttctccggatttttcgtttcattcgatactatcccaacctacctgcagtggatgtcttacatcagctatgtgaggtacggctttgagggggtcattctgagtatctacggactcgacagagaagatcttcactgcgacattgatgagacttgccacttccagaaatcagaagccatactgcgcgaacttgatgttgagaatgccaaattatatcttgacttcatcgtcttaggcatttttttcatctctcttcggctcatcgcatacttcgttttgcgctataaaattcgggccgagagatag

SEQ ID NO: 109298 - DNA, 2007 bp, Artificial Sequence
  Description of Artificial Sequence: Synthetic coding sequence
atgctaggaacacagggatggaccaagcaacgtaagccttgtcctcaaaacgcctctagctactccgccgagatgaccgagcctaagtccgtctgcgtcagcgtggacgaggttgtgtctagtaacatggaggcgactgaaacagacctgttaaacgggcatctgaaaaaggtggacaacaatctgactgaggctcagcgattctcatctctgccgcggagggctgctgtcaatatcgagttcagagatcttagttacagtgtccccgaaggcccatggtggcgtaaaaagggatataagactctattgaagggaattagcggtaaattcaattcaggcgagttggtggcaatcatgggcccttctggtgcagggaagagtacactgatgaacatcctggccggctatcgggaaaccggaatgaagggtgccgtgttgattaacggcctgccacgggacctgcggtgtttccgcaaagttagctgctacattatgcaggacgatatgttgctgcctcaccttaccgtgcaggaagctatgatggttagtgctcatctgaagctgcaagagaaagatgagggcagacgggaaatggtgaaagagatcctgacagcactcgggttgctgtcctgcgcaaatacccgaactggtagcctgagtggtggccaaaggaaacggctagccatcgccctcgaattggtgaataatccccctgtaatgttcttcgacgaacctacatctggtctggacagcgcttcttgcttccaggttgtgagccttatgaaagggctggctcaagggggccggtcgataatttgcactatccatcagccctctgccaagctgtttgagttgttcgaccagctgtacgtgctgagccagggccagtgcgtctatagagggaaggtgtgtaacctagtcccatatctgcgagatctagggctgaactgccccacgtaccacaatcctgcagatttcgtgatggaggtcgcgtccggtgaatatggcgatcaaaatagcagattggtccgagccgtgagggaggggatgtgtgatagtgaccacaagagggacctgggaggcgatgccgaggtaaaccccttcctctggcaccgtccctctgaagaggattcctcctccatggagggatgtcattcctttagcgcatcctgcctgacgcagttctgtatccttttcaagcgcaccttcctatcgatcatgcgtgacagtgttctgactcacctgagaataactagtcacatcggaattggtttacttatcggcttgctgtacttgggaattggtaatgaggcaaagaaggttctgtccaatagcggattcctttttttttccatgttattcctgatgttcgctgccctcatgcccacggttctcacattccctctggaaatgggagtctttctgcgcgaacacctcaattactggtactcattaaaggcctactatctggcaaagaccatggccgatgtgccctttcagatcatgttccccgtagcttactgttcaattgtatactggatgaccagccaaccctcagacgccgtgagatttgttctgttcgcagcgctgggtacaatgaccagcctagtggctcagtctctaggactcctaattggtgctgcctcaaccagtcttcaggttgccacatttgtgggacccgtcacagcgatccctgtcctgttgttctcaggcttttttgtctccttcgatacaattcctacctatttacagtggatgtcgtatattagctacgttcggtatggtttcgagggagtaatcctgagcatatacggcctggatcgggaggatctgcattgtgatattgatgagacctgccatttccaaaagtccgaagccatactcagagagctagacgttgaaaacgcaaagctgtatttggactttatcgttctggggattttttttatttcactacggctgatcgcatacttcgttctcagatataagatccgtgccgagcgttag

SEQ ID NO: 109299 - DNA, 1941 bp, Artificial Sequence
  Description of Artificial Sequence: Synthetic coding sequence
atggccgagaaagccctcgaagccgtaggctgtggactggggcctggagccgtcgcaatggccgttactttggaagatggcgcggaacctccagtgctgaccacacacctgaagaaggtggaaaatcatatcacagaggcccaaaggtttagtcacctccctaaaaggtccgctgtggacatcgaatttgtggagctgtcttactcggtccgcgagggtccttgttggaggaagcggggatataaaaccctgttgaaatgtctgtcaggcaagttttgtagacgcgaactgatcggcatcatggggccctccggcgccggtaaatctacattcatgaatattctcgcagggtatcgggagtcagggatgaaaggacaaattcttgtcaatggacgcccccgcgagctgcggactttcaggaagatgagctgctatatcatgcaagacgacatgctcctgccacacctcactgttctggaggccatgatggtctccgccaatctcaaactttctgaaaagcaggaagtaaaaaaggaactggtgaccgaaatcctcacagccctgggcctgatgtcctgttcccataccagaaccgctctgctttccggtggccagcgcaaacggctggctatcgcgttggagttagtgaataatccacccgtgatgttttttgacgaaccaacctccggactggatagcgcttcctgctttcaggttgtgagcctgatgaaatctctggcccaaggcggtagaactatcatctgtaccatacaccaaccctccgctaaactttttgagatgttcgataaactgtatattttatcacaagggcaatgtatcttcaaaggtgtggtcacaaatctgatcccttatctgaaagggttgggtctgcattgcccaacttatcacaaccccgctgactttatcattgaagtagcctccggagagtacggcgacctcaatcccatgctgtttagggccgtccagaacggcctctgtgctatggccgaaaaaaaaagttctcccgagaaaaacgaggtgcctgcaccctgtccaccctgcccgccagaggttgacccgattgagagtcacacctttgctacaagcacgcttacccagttctgcattctgtttaaacgtacatttctgtcaatcttaagagatacagttctgacacatttacgattcatgtcccacgtggtcatcggcgttcttatcggactcctgtaccttcacatcggggacgatgccagcaaggtgtttaacaacactggctgtctcttcttttcaatgctgttcctgatgtttgccgccttgatgcccacggtgctgacatttcctttagagatggctgtatttatgagggagcacctcaactactggtatagcctcaaagcctactatctggccaagaccatggccgatgtgccatttcaagtggtgtgcccggttgtgtattgcagcatcgtgtactggatgaccgggcagccagctgagaccagtcgcttcctcctcttctccgccctggctacagccactgcccttgtcgcccagtcactgggtctcctgatcggcgcggcctccaacagccttcaagtggccacattcgttggcccggtcacggcaatcccggtgttgctctttagtggcttttttgtctcttttaaaaccatccccacttatctgcagtggtccagctacctcagctatgtgagatacggctttgagggggtgattctgaccatatatggtatggagagaggcgatttgacgtgcctcgaggagcggtgtcccttccgggaaccccagtcaatcctccgagcactggacgtggaagatgcaaagctttatatggattttcttgtgctgggcattttcttccttgccttacgactgttggcatacttggtgctgcggtaccgagttaagagcgagcgctag

SEQ ID NO: 109300 - DNA, 1941 bp, Artificial Sequence
  Description of Artificial Sequence: Synthetic coding sequence
atggccgaaaaggccctggaggctgtgggctgcggcttggggcctggggccgtggccatggccgtaacattggaggatggcgccgagcctcctgttctaacgacgcacttgaagaaagttgagaaccatatcaccgaagctcagcgtttcagccatctccccaagcgaagcgctgtggacatagagttcgtggagctttcctatagcgtcagggaaggaccttgctggaggaagaggggatacaagacactgctcaaatgtctctctggcaagttttgtcggcgggaattgattggaatcatggggcccagcggcgccggtaaaagcaccttcatgaatatcctcgctggctaccgcgagtccggcatgaaagggcagatcttggttaacgggcgaccccgtgaacttcgtacattccgaaaaatgagttgctacatcatgcaggatgacatgcttttgccccacctgactgtcttagaagcgatgatggtttctgccaacctcaagctgtcagagaaacaagaggtcaaaaaagagctggtaacagagattctcactgccttaggcctcatgtcatgttcacacactcgaactgcactactctccggtggccagagaaaacgcctggcaatagccttggaattggtcaacaatccaccagtgatgttcttcgatgaacccacttctggattggattccgccagctgttttcaggttgtttctctcatgaaaagccttgctcagggtggccgaacaattatttgcactatacaccaaccctcagcgaagctgttcgagatgtttgacaagctgtacatcttgtcccaaggacaatgtatctttaaaggtgtcgtcactaaccttataccttacttaaagggcttggggctgcactgtcccacataccataatcctgctgattttataatagaagtggctagtggtgaatatggagaccttaatcccatgctgtttcgggctgttcagaacgggctgtgtgctatggcggagaagaagtcttcccctgaaaagaatgaagtgcccgcaccttgtcctccctgcccccccgaagtggatcccatcgagagccacacatttgccacctccactctgactcagttttgtatacttttcaaacggaccttcctatctatcctcagggacactgtacttacacacctcagatttatgtcacacgtcgtcatcggggtgctcatcggattactgtatttgcacataggtgacgacgcctcaaaagtctttaacaacaccggctgcttattcttctccatgctgtttctcatgtttgccgcactgatgccaacagttttaacattcccacttgaaatggcagtgttcatgagagagcatttgaactattggtatagtttgaaggcctactatctggccaaaactatggctgacgtcccatttcaggtggtctgtccagtggtgtactgtagcatcgtgtattggatgacaggccagccggccgagacctcacgatttctgctgttcagtgctctagctacagcaacagctctggtggcacaatcactggggctccttatcggagccgctagcaactcattacaggtagccacatttgtgggccccgtcaccgccatcccggtgttactgttctctggcttctttgtgagttttaaaactatccccacctatctgcaatggagtagctacctttcatatgtgcgatatggtttcgaaggggtcattcttaccatctatgggatggaaagaggggacttaacctgtcttgaggagcgatgccccttccgcgagccccagtccattctccgtgcactggacgtcgaggatgcgaagctgtatatggatttcctggtgctcggcatttttttcctggctctgcggctgctggcatatctggtcctccgttaccgcgttaaatccgaacgatag

SEQ ID NO: 109301 - DNA, 1941 bp, Artificial Sequence
  Description of Artificial Sequence: Synthetic coding sequence
atggcagaaaaagcactggaggcagtgggatgtggactaggtccaggcgctgtcgccatggctgtcacactcgaagatggagcggaacctcccgtgctaaccacacacctcaaaaaagtggaaaaccacattaccgaagcgcagagattcagtcacttacccaaacgatcggccgtggatattgaattcgtggagcttagttactctgttagagaggggccttgttggcgaaaaaggggatacaagactttactgaaatgtctttctggcaaattttgtcggagagaactcatcggcataatgggccctagtggtgccggcaagtccaccttcatgaatattctggcaggttatcgagagtctggaatgaaggggcagatcctcgtgaacggcaggcctcgtgaactgcgaacttttcggaagatgtcttgttatattatgcaggacgatatgttgctccctcacctgacggttttagaggcaatgatggtgtcggccaacctcaaactgtctgagaaacaggaagtaaaaaaagaactcgtgactgaaatactgacggcactgggtctgatgagttgtagccacactcggacggcgcttttgtccggaggccaacggaaaaggcttgccattgctctggaacttgtcaataacccccctgtcatgttcttcgatgaaccgacctccggccttgattcagcgagctgctttcaggtggtgtcgttaatgaaatccctggctcaaggtggcaggacaattatttgtacaattcaccagccttctgctaaattgttcgagatgtttgacaagttgtatatactgagtcagggacaatgcatcttcaaaggtgtggtgacaaacctgatcccttatcttaaggggctcggactccactgcccaacataccacaaccccgctgattttatcattgaggttgctagtggcgagtacggcgatctcaatcccatgctgtttcgcgctgtgcagaatgggctgtgtgccatggcagagaagaaatccagccccgaaaaaaacgaagtccccgccccttgccccccatgtccacctgaagtcgatcctattgaatctcacacttttgccacctccaccctgacacagttctgtattcttttcaagaggaccttcctgagcatactcagagacacagtgctcacgcatttgcgattcatgtctcacgttgtgattggcgttctgatcgggctcttgtacttgcatattggagacgatgcctctaaagtgtttaacaacaccggctgcctgttcttctccatgttgttccttatgttcgccgccttaatgcccacagtgttgacattccccttggagatggctgtcttcatgcgggagcacctgaattattggtatagcctcaaggcttattacctggctaaaacaatggccgatgtcccatttcaggtggtgtgtcctgttgtgtattgttctatagtctactggatgacgggccagcccgcggagacctctcgcttcctgctgttcagcgccctggctacagccactgcactggtcgcccaatccctcggactattgatcggtgccgctagcaacagcctccaggtcgctacattcgtcggccctgtcacggcaattcccgttctgctgttctctggattcttcgtgtcgttcaagaccattcccacttacctgcagtggtcaagctatctgtcttatgttcgttacggcttcgagggcgtcattctgacgatttatggaatggaacgcggcgatctgacatgtctagaggagaggtgtccgttcagggaacctcagtccatcctccgcgctctggatgtcgaagacgctaagctctacatggacttcctggtgctgggcatcttctttttggcattaagacttctggcatatctagtgttgagatatagggtgaaaagcgagagatag

SEQ ID NO: 109302 - DNA, 1956 bp, Artificial Sequence
  Description of Artificial Sequence: Synthetic coding sequence
atgggggatctgtcctccctgacccccggagggagtatgggactgcaggtgaatcgcgggtcccagtcgtctctggaaggagcgcccgctacagctcccgaaccccactcgcttggcatccttcacgcctcctactctgtgtcccaccgtgtgcgcccatggtgggatattactagttgcagacagcagtggacacgacagatcctcaaggatgtgagcctttacgtggagtccgggcaaatcatgtgcatcctcggctccagcgggtcagggaagactactctcctcgacgctatgagcgggaggctcgggcgcgccggaacttttcttggcgaagtttacgtaaatggccgagcactgagacgcgagcagttccaggattgtttctcttatgtcttacaatccgatacactgttgtcatctctcacagtacgtgaaacactacattacaccgccttgctggcaattcggcggggcaatccaggatcttttcagaagaaagtagaggctgttatggcggaactctccctgagtcatgtggcagataggctgataggcaattactccctcggcggaatttctacaggcgagaggcgcagagtttcaatcgccgcccagctacttcaggacccaaaagtgatgctgttcgatgagcctaccacagggctcgactgcatgaccgcgaatcagatcgtagtgcttctcgtggagcttgcacgacgcaatcgtatcgtcgtgctgaccattcatcaaccgaggtcagaactgtttcagttgttcgataaaatcgccatactgtcctttggcgagctaatattctgcggtaccccagctgaaatgctggactttttcaatgattgtgggtacccttgcccggagcactccaatccatttgacttttacatggacctcacatctgtggatacacagtccaaggagcgagaaatcgagacaagcaagagggtgcagatgatcgaaagcgcatataaaaaaagcgcaatctgccataagacccttaagaatattgagaggatgaagcacctgaagacactacccatggtgccttttaagaccaaggacagccctggtgtgttctccaagctgggcgtcttacttaggcgcgtgactcggaacttggtgaggaacaagctggccgttatcacacgcctgctccagaatttaatcatgggcctatttcttcttttcttcgtgctgagggtaagatccaatgtgctgaagggagcaattcaagaccgcgtggggctcctttaccagtttgtcggcgccacaccatacacaggcatgctcaatgccgtcaaccttttcccagtgctacgggctgttagcgaccaggaaagtcaggatggcctttatcagaagtggcagatgatgctggcctatgctctgcacgtacttcccttctccgttgtggctacaatgatattcagcagtgtatgctactggaccctgggtctgcaccctgaagtggccaggtttggttacttcagcgccgcattgctggcccctcacttaataggcgagttcttgacgctcgtgctgctggggattgttcaaaatccaaacatcgtcaattctgtggtcgctctgcttagcattgcaggagtgctggtgggtagcggttttctgaggaatattcaagagatgcctattcccttcaagatcatctcctattttacgttccagaaatactgtagcgagatcctggtagtaaacgagttttacgggctgaacttcacctgcggcagctcgaacgtaagcgtcaccaccaatccgatgtgcgcattcactcagggtatacagttcatagagaaaacatgcccaggcgcgaccagcaggtttacgatgaatttcctcattctctattcttttattcccgccctcgttatactggggatagtagtgtttaagatcagagaccatctgatctcaaggtag

SEQ ID NO: 109303 - DNA, 1443 bp, Artificial Sequence
  Description of Artificial Sequence: Synthetic coding sequence
atgtgcatcctgggttcaagtggcagtggcaagaccactctgctcgacgcaatgtccggtaggctgggacgcgcagggactttcctcggagaggtctacgtgaatgggcgggccctgcgacgcgagcagtttcaggattgttttagctatgtcctgcagagcgatacgttattatccagccttactgtcagggaaacactacactatactgccctgctcgctatccgccgaggaaatcccgggtccttccagaaaaaggttgaggccgtcatggccgagctgagtcttagccacgttgctgacaggttgattgggaactatagtctggggggaatttctacgggtgagaggcgtcgcgtctccattgccgctcaattgttacaggatccaatggatctcacctctgtggatacccagtccaaggaaagggagatcgagacttctaaaagagtgcagatgatcgagagcgcttacaaaaaaagcgcaatatgccataaaaccctgaagaatatcgagcgtatgaagcacttaaagacactgccaatggtgccctttaagactaaggatagtcccggcgtcttttctaagctaggtgtgcttctcaggagggtaacacggaacctggtgcggaataagcttgcagtaatcacgagactgttgcagaatttgataatggggctgttcctcctctttttcgtgctccgggttcgaagcaacgtgttaaaaggggccatccaggacagggtcggcttgctttaccagtttgtgggtgctacaccttatacaggcatgttaaacgccgtcaatttgtttcccgtgctgagagctgtgtctgaccaagagtctcaagacggcctctaccagaagtggcaaatgatgctcgcctacgccttgcatgtgctaccgtttagcgttgttgccaccatgatattcagttccgtgtgctactggacactcgggctccatccagaagtggccaggttcgggtatttctccgccgccctgcttgcccctcatctgattggcgagttccttactctggtattattgggaattgtgcagaatcctaacatcgtcaattctgtagtggcccttctgagtatcgcgggggtgttagtgggaagcgggtttctgagaaatatccaggagatgcccattcccttcaagataatatcttactttacgttccagaaatattgctctgaaatcttagtggtcaatgagttctatggtttgaactttacttgtggatcctccaatgtgtctgtgacaaccaaccctatgtgtgcattcactcaagggattcaattcattgaaaagacttgccccggggccacttcacgatttacaatgaacttcctcatcctctacagctttatccctgcattagtcattctgggtattgtggtattcaagattcgagatcatctgatctccagatag

SEQ ID NO: 109304 - DNA, 771 bp, Artificial Sequence
  Description of Artificial Sequence: Synthetic coding sequence
atggggctgtttctcctctttttcgttctgagggttagatctaacgtgctaaagggcgctattcaggaccgggtcggtctcttatatcagtttgtgggggcaacaccctatactggcatgctcaacgcggtcaatctcttccccgtgctgagggctgtgtctgatcaggaatctcaggacgggctgtatcagaaatggcaaatgatgctggcatacgccctgcacgtcctgccgttcagtgtggtggcaaccatgattttttcttccgtgtgctattggacccttggcctgcacccagaagtcgcaaggtttggctatttttctgccgccctcttagcacctcacctcatcggagagtttctgactctcgtcctgctgggaatcgtccaaaatcctaatattgtgaattctgtggtggctctgttgagtattgctggagtccttgtgggctctggtttcctcagaaacattcaagagatgccaataccgttcaagatcatttcctacttcacgtttcagaaatattgctctgagatactggttgtgaacgagttctacggcttgaatttcacttgtggtagctcgaatgtatcagttaccaccaatcctatgtgcgccttcacgcagggaattcagtttatcgaaaagacctgcccaggagccacctctcgcttcaccatgaactttctcatcctctacagctttattcccgccctggtcattttgggcattgtggttttcaagatcagggatcatttaatctcaagatag

SEQ ID NO: 109305 - DNA, 2022 bp, Artificial Sequence
  Description of Artificial Sequence: Synthetic coding sequence
atggctggaaaggctgccgaggagaggggccttccaaagggcgctacgccccaagacacaagtggcctacaggaccgcctcttctctagtgaatccgacaattcactatattttacttattcaggacagccaaatacgctcgaagtaagagatctcaattatcaggtcgatctggcttcacaggtgccttggttcgaacaactggctcagttcaagatgccatggaccagcccctcgtgccagaactcctgtgaactgggaatccaaaacctgagctttaaagtgcggtctgggcaaatgctggcaattattggcagctctggctgcgggagagcctcactcctggatgttattactggccggggacatgggggaaagatcaaaagtggtcagatctggatcaacggtcagccttcatcccctcaactcgtcagaaagtgtgtggcacacgtccggcagcataaccagctgctgcccaatctgaccgtgagggagacactggcctttatagcacagatgcgcctgcccagaacgttcagccaggcccagagagacaagagagtagaagatgtcatcgccgaactccggctcaggcagtgtgcggatactagggtgggcaatatgtatgtcagaggactgagcggtggcgaacgaagacgggtgtcaatcggcgtgcagctgctctggaacccagggattctcattctcgatgagccaacaagcggactcgattcttttacggcccataacttggtcaaaaccctcagccgcctcgccaagggaaataggctggtcctgatctctctgcatcagccacgctctgacatctttcgattgtttgacttagtgctgttaatgacctccggaacccctatctacctgggtgccgcacagcacatggtccaatattttactgcgattggatacccctgtcctagatactctaaccccgcagacttttacgtcgatttgaccagcatagaccggagatcaagagaacaggaactcgccacacgcgagaaggcccagtctctggccgctctctttctcgaaaaagtgcgagaccttgacgatttcctttggaaagcggaaacaaaagatttggacgaagacacctgcgtggaatcatccgtgacccccttggacacgaactgcctcccctctcctacgaagatgcccggtgcggtgcagcagtttactacactcattaggcgccaaatctctaacgatttcagggacctgccaaccctgctgatacacggtgcggaggcttgtctgatgtcaatgaccattggtttcctgtactttggacatggctctatccagctgtcattcatggataccgctgctttgctattcatgatcggcgctttgatcccatttaacgtaatcttggacgtaatttcgaagtgctatagtgaaagagcaatgctgtattacgagttggaggatggactttacaccacaggaccctactttttcgcaaagattctgggcgaactcccagaacactgtgcctacattatcatttacggcatgccaacatattggttggccaacttgcggcctgggctgcagcctttcctgctgcacttcctgttggtctggctggtggttttctgctgtaggatcatggccttggcggcagctgctctgttgcccacatttcacatggcctcattctttagtaacgccttgtacaattccttttacctggcaggcgggttcatgatcaacctgtcttcactgtggaccgtcccagcatggatttctaaagtgtcctttctacgatggtgtttcgaagggctcatgaaaatccagttttccagacgcacctacaaaatgcctctgggtaacctgaccatcgccgtcagcggcgataaaatcctctctgtgatggagctggactcttatcccctgtatgccatttaccttattgtgattggtctctcaggaggcttcatggtgttgtactacgttagccttcgcttcataaagcaaaagccgtcacaggactggtag

SEQ ID NO: 109306 - DNA, 2376 bp, Artificial Sequence
  Description of Artificial Sequence: Synthetic coding sequence
atggccggtactagtgccccgggctccaagcggcggagcgagcctcctgcacccaggcctggccccccccctggcacgggacacccgcccagcaaaagagcccggggattctccgcagctgcagctcccgatccagacgaccccttcggagctcacggcgactttactgctgacgatctagaagagctggacacgctggcatcacaggctctctcccagtgtcccgctgccgcgcgcgacgtctcttcagaccataaagttcaccgcctgctggacggaatgagtaagaatccaagcggcaagaaccgggaaaccgtcccaattaaagacaatttcgaactcgaagtgttgcaggctcagtataaagagctgaaagaaaagatgaaggttatggaagaggaggtgttaattaagaacggagagattaagattctgcgagattccctgcatcagacggagtcagttctcgaagaacagcgccgctcccattttctactagagcaggagaagacgcaggccctcagcgacaaggaaaaagagtttagcaagaagcttcagagcctccagtctgaactccagttcaaagatgcagagatgaacgagcttcggacaaagcttcagacttcggaacgtgccaataagctggccgcgccctcggttagccatgtgtctccccgaaagaacccatcagtggtgattaagccagaggcgtgttccccccaattcggtaagaccagcttccctaccaaggagagtttcagtgccaacatgtctctgccacacccttgtcagactgagagcggatacaagcctttagtgggccgtgaagactcaaagcctcattcccttagaggagattctatcaagcaagaggaggcccaaaagagcttcgtagacagttggcgacaaagatctaacacacagggttcaatcctaatcaatttactcctgaaacaaccgctcataccaggaagttcactaagcctgtgccatctgctgtcctcatcctccgaatctccagccgggaccccacttcaaccacccggattcggttccacactggcaggtatgtctggtctgcgcacaactggttcttacgacggctctttttcactctcagcactgcgggaagcacagaacctggccttcactggcttaaatttagtcgctagaaacgagtgtagccgggacggagatcctgcagagggcggccggcgcgctttccccctttgtcagcttccaggcgctgtccacttcctgcccttggtgcagttttttatcggcctgcactgtcaggccctccaagatctagcagcagcaaaaaggagtggtgcccctggagattctccgacccattcctcgtgtgtctcatctggggtggaaaccaatccagaggactccgtgtgtatccttgaaggattttcagtcacagcactcagtatccttcagcatctggtatgtcacagtggcgccgtggtgtctctcctgctaagcggtgtgggggccgatagcgccgctggggaagggaataggagcctagtgcaccgacttagcgatggcgacatgactagcgccctccgcggtgtagctgacgaccaggggcagcacccacttcttaaaatgcttttgcatctgctcgcattctcttccgccgctaccggtcacctgcaagcctctgtgctaacccaatgtctgaaggttcttgtgaagcttgctgagaacacatcttgcgattttctgcccagattccagtgtgttttccaggtgttacctaagtgcctttccccggagacccccttgccatccgtgctgcttgcagtggaactgctatccttactggctgatcacgatcaactcgcccctcagctttgttctcacagcgagggttgccttctgctgttgctgtatatgtacatcacctcacgcccagaccgggtggctttagagacacagtggctgcaactcgaacaggaggtcgtgtggttgcttgccaagttgggagtgcaaagccccctcccacctgttacaggatccaattgtcagtgtaacgtagaagtggtgagggcactgactgtcatgctccatcgccaatggctgacggtacggagagccgggggtcctccgaggaccgaccagcagcgtcgaacagtgaggtgcctgagagacaccgtgctgcttctccacggactttcgcaaaaggataagctcttcatgatgcattgcgttgaggtactgcatcagtttgatcaggtgatgcccggcgttagtatgctgattagagggctgcccgacgttacagattgcgaggaagccgcccttgatgacctatgtgccgccgagaccgatgtggaagacccagaggtagaatgcggttag

SEQ ID NO: 109307 - DNA, 2295 bp, Artificial Sequence
  Description of Artificial Sequence: Synthetic coding sequence
atggcagggacatctgccccagggagcaagaggcggagtgaacctcccgctcccagaccgggccccccccctggtactggtcacccaccatcaaagagagctcgcggtttctcagccgcggcagctcctgatcctgatgatccttttggcgcgcacggagatttcactgccgacgacttggaggagctggacactctcgcttcgcaggctctttcccagtgtcctgccgctgctcgagatgtttcctcagatcataaggtccaccgactcttagatggcatgtctaaaaatccctcgggaaaaaatcgcgagaccgttccaatcaaagacaatttcgagcttgaggtgctgcaagctcagtacaaagagttgaaagagaaaatgaaagtgatggaggaggaggttctgataaaaaatggggaaataaagattcttcgagactccctgcatcagaccgaaagtgtgctggaagaacagcgtaggagccacttcctcttggagcaggaaaagacacaagccttgagcgataaagaaaaagagttttcgaagaagctgcagtcgctgcaaagtgagctgcaattcaaggatgccgaaatgaacgagttaagaacaaaattgcagaccagcgaacgggcaaataaactggccgccccttccgtgtcacatgtttctccaaggaagaaccctagtgtagtcatcaaaccagaagcttgctcaccccagtttggaaaaacgagcttcccaacgaaagagtcgttttctgctaatatgagcttgccccacccctgccagacagagtctggatataagcctctggtaggacgggaggactccaaaccacattccctgagaggagattccatcaagcaggaagaggcgcagaagtcgttcgtggactcctggcggcagcggtccaatactcaggggtccattctgatcaaccttttattgaagcagccactcattccagggtcttcgcttagtctgtgccacctactgtccagcagcagtgagtcccctgctggcacaccgctgcagcctcccgggtttgggagcacactcgctggaatgagcggactacggaccaccggttcatatgacggctcctttagtctctcagcgcttcgcgaggctcagaacctcgccttcacaggacttaacttagtagcaagaaacgagtgttccagggacggtgatcctgcagagggaggacgcagagcatttcccctgtgccaacttcctggagcagttcatttcctgccgttggtgcagtttttcataggcctccattgtcaggctctgcaagacttagcggcagccaaacggagtggagcaccgggtgatagcccaacacactcttcctgtgtgtcctccggagttgagacaaatcccgaagatagcgtctgtatcctggaaggtttcagtgtgaccgccctgtcaatcctgcaacatcttgtttgccactcaggtgccgtggtgagcctgctcctcagcggcgtaggggctgatagcgccgccggtgaggggaaccggtctctcgtgcacaggctgtcagacggagatatgacaagcgctcttagaggggttgctgacgatcaaggccagcaccccctgttgaagatgctcctacaccttctcgcttttagctccgcggctacaggtcacttgcaggcttccgtcctcacccaatgtctcaaggtactggtgaagttggccgaaaatacgtcctgtgacttcctccctagattccaatgtgttttccaggtgctccccaagtgcctgtctccggagacccccttgccctccgtcctgctggccgtggagctgctcagcttgctggccgatcacgaccagctcgcccctcagctctgcagtcactcggagggttgtctgcttctgctgctgtatatgtatatcacatctcgcccagatagggtagccctagagacacagtggctgcaattggaacaggaggttgtgcgggccttgaccgtgatgctgcatcgccagtggctgaccgttcgccgggctggcggacccccaaggaccgatcagcaaaggcgaacggtacgttgtctcagagacactgtgctcctgctgcatggtttgtctcagaaggataagctgttcatgatgcactgtgtcgaagttcttcaccagttcgaccaggtgatgcctggggtgtctatgctcatccgcggcctgcctgacgttacagattgcgaagaggccgcactcgatgacttgtgtgcagccgaaacagacgtggaagatcctgaagtagagtgtgggtag

SEQ ID NO: 109308 - DNA, 1995 bp, Artificial Sequence
  Description of Artificial Sequence: Synthetic coding sequence
atgaaggtcatggaagaggaagtgctaattaagaatggagagatcaaaattttgcgtgacagcctgcatcagactgaatccgtacttgaagagcagcggcgcagccactttctgctcgagcaggagaaaacccaggcactaagcgataaagaaaaggagttcagcaagaagctgcagagtctgcaaagtgaactacagtttaaagatgccgagatgaacgagctccgcactaaactgcagaccagtgagagagcaaataaacttgccgcgccctccgttagccatgtctcaccaagaaaaaacccatcagtcgtgataaaacccgaagcctgtagcccccagttcggaaagacatctttcccaaccaaggaatcttttagtgctaacatgagcttaccccacccctgccaaaccgagagcgggtataaacccctcgtcgggagggaagatagtaagccacacagtcttaggggcgattccatcaagcaggaagaagcccagaagagttttgtggactcttggcgccagcgtagcaatacccagggcagtatacttatcaacttgctactcaaacagccactcattccaggatcttccctgagtctttgtcatctgttatcttctagcagcgagtcccctgccggaacgccacttcagcctcctggatttgggtcgacgctggccggtatgtccgggctacgaacaacaggctcatacgacggttccttctctctgtccgccctcagggaggcgcagaacctggctttcaccggtttgaacttggtggcacgtaacgagtgtagtcgagatggtgatccagctgagggcggtcggagagcctttccgctttgccagttgcctggggccgttcacttcttaccgctggtgcaattctttatcgggctccattgtcaggccctacaggacctagccgcggccaagcgcagtggcgccccaggcgacagcccaactcacagctcttgcgtttcttccggtgtggaaacaaaccctgaggattctgtgtgcatcctggaagggttctcggtaactgctctatctatactgcaacatctggtttgccacagcggcgccgtggtgtccctgctgctttcaggcgtcggagccgattccgctgccggcgagggaaaccgctctctcgtccatcgcctgtcagacggcgatatgacttctgctcttcggggagttgcggacgaccaggggcagcacccattgcttaaaatgctcctgcatttgctggccttctcctctgccgccactgggcacctgcaagcatccgtcttaacacagtgtttgaaggtgctcgtcaaactagcggagaatacttcttgcgatttcctgcctcggtttcagtgcgtgtttcaggttctgccgaagtgccttagtccagagacaccactcccttctgtactgctggcagtcgagctcctgagcctgctggctgatcacgatcagctcgcaccacaactgtgcagtcacagtgagggatgcctgctcctgctcctctatatgtacattacctctcggcccgatcgagtggcactggagacccagtggctccagctggagcaagaggtggtttggctattggccaaactgggtgtgcagtctccattgccccccgtgacaggctccaactgtcagtgtaatgtcgaggttgtgcgggcactcacagttatgctgcaccgccagtggctcactgtccgaagagccggaggccctcctagaacggaccaacaaaggagaaccgtacgttgcctaagggacacagtcctcttgttgcacggcttatcacagaaagataagctgtttatgatgcactgcgttgaggttctccatcagtttgaccaggtgatgcccggggtcagtatgctcattagggggcttccggacgtgacagattgcgaagaggctgcactagacgatttatgcgcagccgagaccgacgtggaggaccctgaggttgagtgcggctag

SEQ ID NO: 109309 - DNA, 2097 bp, Artificial Sequence
  Description of Artificial Sequence: Synthetic coding sequence
atgtctaaaaacccctcgggaaaaaatcgcgagaccgttccgattaaggacaactttgagctggaagtgctccaggcgcagtacaaggagctcaaggagaagatgaaggtaatggaggaggaagttctgataaagaatggagagatcaaaatcttgagggacagcctacaccagaccgagagcgtgctcgaggagcagagaaggagccacttcttactggagcaggagaaaactcaggccttgagcgacaaagagaaggagtttagtaagaagttacagagtctccaatctgagctgcagttcaaggatgccgaaatgaacgaattaagaacgaagctccagactagtgagcgagcgaataaactggcagccccaagtgtgagccacgtgtcaccgagaaaaaacccttcggtcgtcattaaacctgaggcctgctctccccagtttggaaagacgagctttcctacaaaggagagctttagcgccaacatgagtctcccgcacccatgccaaaccgaaagtgggtacaagccactggtcggaagagaagactcaaagccccactcactccggggtgactctatcaaacaggaggaagcccagaagagctttgtcgactcctggaggcagcggtctaacacccaaggttctatcctgataaacctgcttctcaagcagccccttatccctggctcctctctgagcctgtgccacctgctgagttcttcgagcgagagcccggcggggacacctctccagccccctggcttcgggtccactcttgccgggatgtccggattgcggaccacaggttcctatgatggtagtttttctctcagcgcattgcgcgaggctcagaacttggctttcacagggcttaacctggtcgccaggaatgaatgctcacgagacggggacccagctgagggggggcgacgtgcctttccactatgtcaacttcctggcgccgtccactttctgccgttggttcagtttttcattggcctccactgccaggcacttcaggatttggccgcagcaaagaggtccggcgcacccggcgactccccaacacacagttcatgcgtgtccagtggcgtggagacgaaccctgaggactccgtgtgcatcctggaggggttttcagtcaccgcattgtcaattttgcagcatctggtttgccacagcggagccgtggtgtccctgctgctgtccggcgtgggcgccgattccgcagccggtgaagggaataggtccctggttcatcgattgtcagatggagatatgacctcggctctaaggggcgtagcggacgatcagggccagcaccctctccttaagatgctgctgcatctgcttgctttctccagcgctgcaacaggccatcttcaggcatctgtccttactcagtgtctgaaggtgctggtgaagcttgccgagaataccagctgcgattttttacctcgcttccagtgcgtttttcaggttttgccaaagtgcttatccccggagaccccattgccttcagtcctcctcgctgttgagctgttgtcgctgctcgccgatcacgaccagctggctcctcaactctgtagtcactctgagggttgcttgctgctgctactttacatgtatattacaagtaggccagatagagtggcattagagactcagtggttgcagctggaacaagaggttgtgtggttgcttgcaaaattaggtgtccagtcaccactgccgcctgtgacaggaagcaactgtcagtgcaatgttgaggtcgtgagggctcttaccgtgatgctccatagacagtggctgacagttagacgcgctggcggcccccctaggacagatcagcaacgccgaacagttcgttgtcttcgagacaccgtgctgctactgcacggcctgagccaaaaggataagctcttcatgatgcattgtgttgaggtgctgcaccagttcgatcaagtcatgccaggtgtttctatgctgatccggggcctgcctgacgtaacagactgtgaggaggctgcgctggatgacctgtgcgctgctgagacagacgtggaagatccagaagtcgagtgcggatag

SEQ ID NO: 109310 - DNA, 591 bp, Artificial Sequence
  Description of Artificial Sequence: Synthetic coding sequence
atgtcaaagaatccctccggcaaaaacagagaaactgtgccaatcaaagataacttcgagctcgaagtgctccaggcccaatataaagaactcaaggaaaaaatgaaggtaatggaagaagaagtacttattaagaatggcgaaatcaagattctaagggacagtctgcaccagactgaatccgtgcttgaggagcagcgaaggtcccatttcctgttagagcaggagaaaacacaagcgttgtctgataaggagaaggaattttcaaagaagctccagtcattacaatcagagctccagtttaaagatgccgagatgaacgagctccgaaccaagctccaaactagcgagagagcgaataagctggcagcaccctccgtgtctcacgtgagtcctagaaaaaatccttctgtggttatcaaaccagaggcatgcagcccccaattcggcaaaacaagcttccctactaaggaaagcttctcagccaacatgtctctgcctcatccctgccaaaccgagagcgggtataaaccactggtcggacgcgaggattcaaaaccccatagtctgcgaggcgatagtatcaaatag

SEQ ID NO: 109311 - DNA, 141 bp, Artificial Sequence
  Description of Artificial Sequence: Synthetic coding sequence
atgtcaaagaacccctctggcaagaatagagagaccgtgcccatcaaggacaattttgagctggaggtcctccaagctcagtataaggaactgaaggagaagctatgtaagaaagctgatactagttaccaccacctgtag

SEQ ID NO: 109312 - DNA, 1305 bp, Artificial Sequence
  Description of Artificial Sequence: Synthetic coding sequence
atgagcatcgaaaaaatttgggcaagagaaatcctagactccagggggaatcccacggtggaagtggatctctatacagccaaggggctgtttagagctgcggtcccaagcggtgcaagcaccggaatatacgaggctctggaattgcgggacggggacaagcagcgatatctgggcaagggagtgcttaaggccgtggatcacattaactccaccatagcacctgctttgatctcgagcggtctgtcagtagtcgaacaagagaagttggacaatctcatgctcgagctggatgggactgaaaataagagcaaatttggagctaatgcaatactaggcgtgtctctggccgtttgtaaggctggggcagccgaacgggagctgcccctatacagacacatagcgcaactcgccggcaacagtgatttgatcctgccggtgcccgcttttaacgtcatcaacgggggctctcacgccggcaacaaactggccatgcaagagttcatgattctgcctgtgggggctgagagctttcgcgacgctatgagactgggagccgaagtgtaccataccctgaagggtgtaatcaaggataagtacgggaaggacgccactaacgttggagacgagggtgggtttgcccctaacattctggaaaactctgaggccctcgagctggtcaaggaggccatcgataaggctggctataccgagaagatcgtgataggaatggatgtggccgcttccgaattctatcgagatggcaagtatgacctggatttcaagagcccaacagatccgagtcgatacataactggtgaccagctgggggcactttaccaggatttcgttagggattacccagttgtgtccattgaggacccgttcgatcaggatgattgggccgcctggtccaaattcactgctaacgtgggaatccagatagtcggtgacgatctgacagtgaccaacccaaagagaatcgaaagagctgtggaagagaaagcatgtaactgtctgctgctcaaagtaaaccagatagggtcagtcactgaggcgattcaggcctgtaagttggctcaagaaaacgggtggggtgtgatggtatcgcataggtcaggtgagacagaggatacctttatcgccgatttagtcgttggcctctgtactggccagatcaagaccggtgcgccatgtcgcagtgaacggctcgctaagtataaccagttgatgagaatcgaagaggagcttggggatgaggctagattcgctgggcataattttcgcaatccatcagttctctag

SEQ ID NO: 109313 - DNA, 3573 bp, Artificial Sequence
  Description of Artificial Sequence: Synthetic coding sequence
atgaaaacgagacagaataaagactccatgagtatgcgctccggacgcaaaaaggaggccccgggcccccgagaagaactacgaagtcggggtcgcgcttccccgggaggggtcagtacgtcctctagtgacggcaaggcagaaaaatctcggcagaccgccaaaaaagctcgcgtcgaggaggcttcaacaccaaaagtaaacaagcaggggcggagcgaggaaatttccgaatctgagtccgaagagaccaatgcaccaaagaagaccaaaacagaacaggaactgccaagacctcagagtccctcagacctcgattctctggatggtagatcgcttaacgacgatggtagctcggacccacgggacattgaccaggataatcgctctactagcccatctatctatagtcccggatctgttgagaacgactcagacagtagttcaggcctttcccaggggcctgcacggccctaccatcctccccccctgttcccacccagtccacagccaccagacagcacacctagacagccagaagcaagcttcgagccgcaccccagtgtgacccctaccggatatcatgcccccatggagcctcctacaagcaggatgttccaagcacctccaggagcacctcccccccatcctcagctatatcccggcgggactggcggtgtgctcagcggcccacccatgggacctaagggcggcggcgccgctagttctgtgggcggccccaatggcgggaaacagcacccccctccaactactcccattagtgttagttccagcggagctagcggggcgcctcctacgaagccccctaccacccccgtggggggtggcaatctcccgtccgcacccccacccgccaacttcccgcatgtgacccccaacctgcctcccccaccggccctgcggccactcaataatgccagcgcctcaccgcctggcctgggggcacagccactacccggtcacctcccttccccgcatgccatgggtcagggtatgggtggactcccaccaggaccagagaaaggcccgacgctggctccctcacctcatagcctcccccctgcgtcctcaagcgcaccagccccacccatgcgatttccctacagctcgtctagcagctctagcgcagcagccagttccagctcctcctcttcaagtagctccgcctcgccatttcccgcgagtcaggcccttcctagttatccacacagttttccacctccaactagtctgtctgtctcaaaccagcctcctaagtacactcagccctctctgcctagccaggcagtgtggagtcaagggcctcctccgcctcccccatatgggcgcttattggctaacagtaacgctcatccaggcccgtttcccccttccaccggcgcacaatctactgcccatcctcccgtgagtactcatcaccatcatcatcagcagcagcagcagcaacaacagcagcagcaacagcaacagcagcaacagcagcaacatcacggcaatagcgggccgcccccccccggtgcttttccgcatccactcgaaggcgggtctagccatcacgcgcatccatatgcaatgagtccatcactaggtagcctgcggccctatcccccaggcccagcacacctgcctcctccacactctcaggtctcgtattcacaagccggacccaacggccccccagttagtagcagctcgaatagcagctcctccacatcccagggctcatacccctgttctcacccctctcctagtcagggtccacaaggggccccctatcctttcccaccggtgccaaccgttaccaccagctccgctaccctgtccactgtgattgcaacggtagcttcttcgcctgcagggtacaaaacggcaagcccaccaggacctcctccttacggtaaacgggcaccttcaccaggcgcgtataaaacagcgactccgcctggctacaaacccgggagtcctccgtcatttcgaaccggaacgccccctggttacaggggtacctcccctcctgcagggcccggcactttcaagccgggtagcccaacagtaggccctggcccgctccctcctgccggaccaagtggattgccatccctgcccccgccccccgcagctcccgcatctgggcctcccctctcagccactcagatcaagcaggaaccagccgaagaatatgagacccctgagtctcccgtgccacctgccagatcacccagtcccccccccaaggtggtggatgtcccaagccacgcgagccagtccgctcgttttaataagcacctggaccgggggtttaactcctgcgccaggtctgatctgtacttcgttcccttggaggggtctaagctagctaagaagcgcgctgacttagtggagaaagtgcggcgtgaggccgagcaaagggctagggaggagaaagaacgagagagggagagagaacgggagaaagaacgggaaagggagaaggagcgtgaacttgagcgaagtgtgaagctggcacaggaaggccgtgccccagtggagtgcccttctctggggcccgtaccacaccgcccccctttcgagccaggctccgctgtggccacagtcccaccgtacctcggcccagacactccagcgttacgtacactatccgagtatgcacgcccacacgtgatgagccctggcaatcggaaccacccattttatgtgcccctgggcgcagtcgatcctggcttactgggttacaacgttcctgccttgtactcttcagatcccgctgcccgcgagagagagcgcgaggcacgcgagcgtgatttgagggatcgcctaaaacccgggttcgaagtgaagccatcagagctagaacctttacatggagttcccggacccgggctggaccccttccctcggcacggcggactagcgctacagccggggccccccggactccatccgtttccctttcacccatcgctgggtccgctggaaagggagcggctcgccctggccgccggtccagccctccgccctgatatgtcttacgcggaacgcctcgcggcagagcgccagcacgccgagcgggtggccgccttgggcaacgaccccctcgctcggctacagatgctcaacgtgaccccgcatcaccatcagcattcacacattcatagccacttacacctgcaccagcaagacgcgatacacgctgcttccgcctccgtccaccctttgattgacccgctcgctagcgggagtcaccttactcggattccttaccccgccgggacgttgcccaatccactccttccgcatcccctgcacgagaacgaggtgctgaggcatcagttgttcgccgccccataccgggatctacctgcaagtttgtcggccccaatgagtgcagcgcaccagctgcaggccatgcatgcacaatctgcagagctgcagagactagctctggagcagcagcaatggctgcacgctcaccatcctttgcactctgttccacttccggcacaagaggactactactctcacctgaaaaaagaaagtgacaagcctctctag

SEQ ID NO: 109314 - DNA, 3573 bp, Artificial Sequence
  Description of Artificial Sequence: Synthetic coding sequence
atgaaaactagacaaaacaaggactccatgagtatgaggagtggcagaaaaaaagaggccccaggcccacgggaggaactcagatcaaggggtagagcctctcctgggggcgtgagtacatctagctcagatggcaaggcagaaaagagccgacagaccgcgaagaaagctagggtagaagaagcttccaccccgaaagttaacaagcagggccgatctgaagagattagcgagtctgagtcggaagaaacaaacgctccaaaaaagactaaaactgagcaagaactcccccgacctcagtcgcctagtgacctcgatagtctggatgggcgcagtctcaatgatgacgggtcgagcgacccccgcgatatcgatcaggacaataggtccacctcaccttccatttatagccctgggtccgtagaaaacgattcagacagctcttccgggctttctcagggcccagcgcggccataccatccacctcctctctttcccccatcaccgcaaccaccagattctactccccgccagcccgaagcatcattcgagcctcacccaagcgttacacccaccgggtatcatgcccccatggagcctccgactagccgaatgttccaggctcctcccggcgctccgcccccgcacccgcagctgtatcccggagggactggaggcgtcttatccgggccccctatggggcccaaaggcgggggagctgccagcagtgttggcggtcccaatggaggcaagcagcatccccccccaacgacacctattagcgtcagcagtagtggagcttctggagcaccacccaccaaaccaccaaccacccctgtgggcggcggcaacctgcctagcgcccctccacctgccaatttcccgcatgtgactcccaaccttccacccccaccagctctccgcccattaaataatgcttcggcgtccccccccggactgggggcacaaccactgcccgggcatctgccgtcccctcacgcaatgggacagggcatgggaggtttgcctcccggtcctgagaaggggccaacactcgccccgtccccacactctttgcccccggcatcaagcagcgcccctgccccaccaatgcggtttccctactcgtcctcaagtagtagctctgccgctgcaagctcaagctccagcagctcttccagtagtgcctccccatttcccgcatcccaggcattgccttcgtatcctcacagctttccaccacccacctccttatcagtatctaatcagcctcctaaatacacccagccaagcctccctagccaggctgtgtggagtcaaggaccacctcccccccccccttatggccgactgctcgccaatagtaatgcccatcctggcccttttcctccctcgactggcgctcagagtaccgcccatccccccgtgtccacccaccaccatcaccaccagcaacagcagcagcaacaacagcagcaacaacaacagcagcagcagcaacagcaacatcatggaaactcagggccacctccacccggtgccttccctcatcccttggaaggagggagctctcaccacgcccacccctacgcgatgtccccctccctgggatccctgagaccttatccccccggacccgcccacctgcctccccctcattctcaagtgtcatatagtcaggcgggcccgaacggacctcccgtgtcaagcagtagtaatagcagcagtagcacttctcagggctcatacccctgtagccatccatcgccctcacaggggccccagggagcgccttatcctttcccccctgttcccaccgtgaccacttcttctgcaacacttagtaccgtcattgctactgttgctagctctccggccgggtataagactgcctcccctccggggccacctccttacggcaagcgcgcaccctctccaggagcttacaagacagcaacaccaccgggctataagcccggttcccccccaagctttaggactggaacaccgccaggttatcggggcacttcaccacctgctggacctggcaccttcaagcccgggtcaccaacggttggacctggccccttgccacccgctggcccgtctggactaccgtccttgccacctccacctgccgcacctgcatccggacctcctctgtctgccacacagataaagcaggaacccgctgaggagtacgaaaccccagagtcccctgtcccacccgcacgctctccgagtcccccaccgaaagtggtcgatgtgcccagccatgcttcacagtctgctcgctttaataaacatttggaccgcggatttaatagttgcgccagaagtgacctctattttgtgcctctggagggctcaaagttagcgaaaaagagagctgacctcgtggaaaaggttcgaagggaagcagagcaaagagctcgtgaggaaaaggagagagagcgagaacgcgaacgggagaaagagcgggaaagagagaaggagcgggagctggaaagatccgtgaaactcgcccaggagggccgtgcgccagtcgaatgtccgtctctcgggccagtgcctcacagaccccctttcgagcccggatcagccgtggcgaccgtgcctccctatctcggccctgatactcctgctttgagaaccttgagtgagtacgctcgccctcacgtgatgagccctggcaacagaaatcatcccttctatgtacccctcggcgctgtcgatcccgggctcttaggatacaatgttcccgccctgtatagcagcgaccctgccgctcgcgagagggaaagagaggctagggagagagacttacgggaccgcctgaagcccgggttcgaggttaaaccctctgagctggagccgctacacggagttccaggacctggcttagacccatttccgcggcacggcgggctggcattgcagcccggtccccctggcttacaccccttcccctttcacccttcccttgggcccctggaaagagaacggctggcccttgcggctggaccagccttgaggcctgacatgtcctatgcagaacggttggctgccgaacgacagcacgccgagagagtcgctgcacttgggaacgaccccctcgccaggctccagatgctgaatgtgaccccgcatcaccatcagcacagtcacattcactcacacctacacctgcaccagcaggacgcaattcatgctgcctctgcaagcgtccatcccctgattgatccacttgcaagcgggagtcacctgaccaggattccgtatcctgccggtactttgccaaatccactcctgccacatcctctccatgagaacgaggttctgaggcaccaactgtttgctgcaccgtaccgcgaccttccagctagcctgagtgcacccatgagcgctgcacatcagctgcaagccatgcatgcacagtctgctgagctgcagcgcttggcattggagcaacaacagtggctccacgctcatcatcctctccattccgtgccattgccagctcaagaagactattactcccatcttaaaaaggagtctgacaagccactatag

SEQ ID NO: 109315 - DNA, 3573 bp, Artificial Sequence
  Description of Artificial Sequence: Synthetic coding sequence
atgaagactaggcagaataaggattctatgtccatgcggtccggcaggaaaaaggaagccccagggccaagggaggaactgcggtcccggggcagagctagtcccgggggggtcagtactagctcctctgacggcaaggcagagaagtcccgacagaccgcaaagaaggcccgtgtggaggaggctagcactcccaaggtcaacaagcagggccgcagcgaagagatcagtgaatccgaaagtgaggagacaaatgccccgaagaaaaccaaaaccgaacaggagctgccgcgcccccagagcccgtcagatcttgacagcctggacggcagaagtcttaatgacgatggctctagtgatccccgtgatattgaccaggacaatcggagtacatctccatccatttactcccctggaagtgtggagaacgattcagacagttctagcggattatctcagggacctgcaagaccctaccacccaccgcccttgtttccaccatcacctcagcctcccgattctactccgaggcagcccgaagctagctttgagccccacccaagtgtgactcccactgggtatcatgccccaatggagcccccgacgagccgaatgtttcaggcgcctcccggggcacctcccccgcaccctcagctctaccccggtggtacgggtggggtcctctccggtccaccgatgggacccaaaggcggcggggcagctagctccgttggcggtcctaatgggggaaaacaacatcctccccccacaacacccatctccgtgtcatcctctggagcatcaggggcccccccgaccaagccccccaccacacccgtcggcggcggaaatctgccctcagcccccccccccgccaattttccccacgtgacccccaatttaccacctcctcctgccctaagaccgctgaataatgcttcagccagcccgccggggctaggagctcagccgttacctggccacctgccgagtccacacgcaatgggccagggcatgggcggactgccgccgggtccagagaaaggcccgacccttgccccctcgccacattctctgccacccgccagcagttcagcgccagcccctcccatgagatttccatactccagctcaagctctagcagtgctgcagccagctcttcgtcatctagctctagctccagtgccagccctttccccgcgtcccaggcactcccatcttacccccactcattcccaccacccaccagtttatccgtctctaaccagccacccaagtacacccaaccatcactaccaagccaggccgtgtggtctcaagggcctccccctcctcctccatacggccgcctgcttgcaaatagtaacgcacatcctggacccttccctccctctacaggagcgcaatccacggcacatccgcccgtgagcacgcatcaccatcaccatcaacagcagcaacagcagcaacaacagcaacagcaacaacaacaacagcaacagcaacatcacggaaatagcgggccaccaccccctggggccttccctcacccgctagaaggtgggtcttctcatcacgctcacccttatgccatgtcaccatccctagggagtctccgcccctatccccccggacctgcccatctgcctccgcctcattcacaggtcagttactcacaggccggtcccaatggaccaccagtctccagtagctccaattcgtcgtctagcacctcccagggatcgtacccttgttcgcacccgtcaccatctcaaggaccccagggtgctccttacccattccctcctgtgcctaccgtgaccacttcgagtgctaccttgtctactgtgatcgcaacagtcgcgtccagccctgccggctataaaacagcgtcaccaccagggccacccccttacggaaagcgggccccatcacccggagcgtataagacggctaccccccctggatataaacccggatcccctcccagtttccggaccggtacgccaccaggctaccgtgggacttcccctcccgccgggcctggcacctttaaacctggctccccaacggtggggcctgggcctctccctcctgccgggcctagtggactaccgtctttacctcccccgcccgccgcgcccgcttccggtcccccattatcggcaacccaaataaagcaggagcctgctgaagaatacgagacgcccgagtccccagtgccgcccgcaaggagtccgtctcccccgcctaaggttgtggacgtgccgtcccacgctagccaaagtgcgcggttcaacaaacatctggataggggcttcaactcttgcgcccgcagcgacctttattttgtgcccctggagggaagcaaactggctaagaagagggccgacctggttgagaaggtacgacgggaagccgaacagcgggctagggaggaaaaggagagagagcgggagagagagagagagaaagagcgcgaacgtgagaaggagcgtgagctggaacgcagcgtaaagttagcacaggagggcagggcccctgtcgaatgccctagtctgggaccagtgccgcatcgacctcccttcgaacctggttcagccgttgccaccgtccccccttatctcggccctgacacaccagccctccgcacattgtctgagtatgcacggcctcatgttatgagtcccggcaatcgcaaccatcctttctatgtaccactgggcgccgttgacccaggactgctgggatacaacgttccggccctctattcatctgacccagcagcaagggaaagggagagagaggctagagagagggacctgagggaccggttaaagccagggtttgaggtcaaaccgagcgagcttgagccattacacggcgtgccgggccccgggctggatccatttccccggcatgggggcttggccctgcaacctggccctccaggattgcacccttttcccttccacccctcactgggccccttagaaagagaacggttggccttagccgccgggcccgctctccgaccggatatgtcttatgcggaacggctagcggctgagcggcagcacgccgagagggtagccgctctcggcaacgatcctctggctcggctccaaatgcttaacgtgaccccccaccaccaccaacattcacatatccattcccacttgcacttgcatcagcaggatgcaattcatgcggcaagcgcatccgtgcaccctcttattgatccattggcatccgggtcacacctcacaaggatcccctatcccgctggtactctgcctaaccccctgctcccacatcccctccatgagaacgaggttctaagacaccaactgtttgctgctccatacagggatctgcccgcttccctaagtgcccccatgtcagcagctcatcagctccaggctatgcacgcccagtctgccgagctgcaacggctcgccctagaacagcagcagtggctccacgcccatcatccactgcattctgttcctttgccagctcaggaagattattattcccatttgaaaaaagaatccgacaagcccttatag

SEQ ID NO: 109316 - DNA, 519 bp, Artificial Sequence
  Description of Artificial Sequence: Synthetic coding sequence
atgctagttatacaccttgaggagcacgtgattatagctttctcgcagcataatacaatcatggatctagttcagttcttcgtcacattttttagttgttttttgagcctcttgctggtggccgctgtagtttggaaaattaaacaaacctgttgggcatctcggcgacgcgaacaactgctgcgtgagcgccagcagatggcttcaagaccattcgcatcagtcgacgtggcgctggaggtaggcgccgagcagactgagtttcttcgcggccctctggagggggcacccaagccaatcgccattgaaccatgcgctggtaatcgtgccgctgttctgacagtctttttgtgcctccctcgggggagctcgggcgcccctcccccaggtcagagcggcctggcaatcgcatctgccctgatagatatctcccaacagaaggcctctgattccaaagacaagacctcaggggttcgtaatagaaaacacctgagtactcgccagggtacatgtgtgtag

SEQ ID NO: 109317 - DNA, 4140 bp, Artificial Sequence
  Description of Artificial Sequence: Synthetic coding sequence
atggagaccggaggccgggccaggactggcaccccacagcctgcggcccccggtgtctggcgggctagacctgctggcggcggcgggggtggcgcctctagttggctgctcgacggtaactcctggctattgtgctacggattcctttaccttgccctgtatgctcaggtttcccagtctaagccgtgtgagcggacggggagttgtttctccgggcgatgtgtgaacagcacctgcctgtgtgacccaggttgggtcggagaccagtgccagcattgccaaggtaggttcaagctgaccgaaccatccggttatctgacagatggtcctattaactacaaatacaagactaaatgcacatggctgattgaaggctatccgaatgctgtgttacgcctgcgatttaaccactttgcgacagagtgctcttgggaccatatgtatgtgtatgacggtgacagcatctacgcgccacttatcgccgtgctctcaggactgattgtgccagaaatccggggcaacgaaacagtgcctgaggtggtgacaacgtcaggttatgcccttcttcactttttttcggacgccgcctacaatctgacaggttttaacattttttactccatcaactcctgtccaaacaattgcagcggtcacggcaagtgcaccacatcagtgagtgttccaagtcaagtatattgtgaatgcgacaaatattggaagggagaggcatgtgacataccctactgtaaggcgaactgcggttcacctgaccatggctattgcgacctcaccggagagaaactgtgcgtgtgcaacgacagttggcagggacccgactgtagtttaaacgtgccttctactgaaagctactggatcctgccaaatgtcaagccttttagcccctcagttggacgggcatcccataaggctgtgttgcacgggaaattcatgtgggtcatcgggggttacacgtttaactatagtagcttccagatggtgcttaattataacctcgagagcagcatctggaacgttggaacaccgtccaggggccctctccagaggtatgggcactccctggccctgtaccaagaaaacattttcatgtacgggggcagaatcgagacaaacgatggcaacgtaacagatgaactgtgggttttcaacattcacagtcagtcttggagtacaaaaacgcctaccgttctcgggcatggccaacagtacgctgtcgaggggcatagtgcccatattatggagctggactcgagggatgttgtcatgattatcatttttggatacagtgctatttacggttatacaagctctatccaggaatatcatatatctagcaatacctggctcgtccctgagaccaaaggggcgatcgtacaggggggatacggtcatacctccgtgtatgacgaaatcaccaaatcaatttatgtgcacggcggctacaaggcgctacccgggaacaagtacggtttagttgacgacctgtacaagtacgaagtcaacacgaagacttggacaatcctgaaggaatctggattcgcccgctatctgcacagcgcagtgctcattaatggtgcaatgttaatttttggcgggaacacccacaatgacactagtctgtccaatggagccaagtgcttcagcgctgactttttggcatacgatatcgcctgcgacgaatggaagatcttgccaaagcctaatttgcacagggacgtgaaccgattcgggcattcagcagtcgtaattaacggatctatgtacatctttggtggattcagctcggtcctactgaacgatatcctcgtgtataaaccacccaattgcaaggccttccgcgatgaggaactttgcaagaatgcgggtcccggtatcaagtgcgtttggaataaaaaccactgtgagagctgggaatcgggaaacacaaataatatcctgagggccaagtgcccccccaaaaccgctgcctccgatgacaggtgctaccgctacgccgactgcgccagttgtaccgctaataccaatgggtgtcagtggtgcgacgataaaaaatgtattagcgctaattccaattgcagcatgtctgttaaaaattacactaagtgtcatgtaagaaatgaacagatctgtaacaagttgactagctgcaagagctgttcgttgaatctcaactgccagtgggatcagaggcagcaagaatgtcaggcactaccagcccatctgtgcggggagggttggtctcatatcggggacgcctgcctccgggtcaattcctctcgggagaactatgataacgccaaattgtactgttataatctctcaggtaacttggcctcactaaccacatcgaaagaagtcgagtttgtccttgatgaaattcagaaatacacgcagcagaaagtcagtccatgggtcggcctgcgcaagattaatataagctactggggctgggaagacatgtctcccttcacaaacaccaccctgcaatggctccccggtgagcccaacgactcagggttctgcgcttacctggaaagagccgccgtcgccggacttaaagccaacccgtgcaccagtatggcaaatggtttagtctgcgagaaaccggtggtgtcaccgaaccagaatgcacgcccttgtaaaaaaccctgtagcttgagaactagctgttcaaattgtacatccaatggaatggagtgcatgtggtgctcatctacgaaaaggtgcgttgattccaacgcgtacatcatcagcttcccttacggacagtgcctcgagtggcagaccgctacctgctctccccagaattgctccggcctgcgcacatgcggacagtgcctggaacagcccggttgtgggtggtgcaatgatccctcaaataccgggcgcggacactgcattgaagggagtagccggggcccaatgaaactgattgggatgcaccactctgaaatggtgttagacactaacttgtgtcctaaagaaaagaattacgagtggtcattcatccaatgcccagcctgccaatgtaatggccactctacgtgtataaataacaacgtttgtgaacagtgcaagaaccttacaacaggcaagcagtgtcaggattgcatgcctggttactatggagacccaaccaatggtgggcaatgtactgcatgtacttgcagtggacacgccaacatttgtcacttacatacgggtaagtgcttttgtaccaccaagggaattaagggcgaccagtgccagttgtgcgactcagagaaccggtacgtggggaatcctttacgcggaacctgttattattcattgcttattgattaccagtttactttctctctgcttcaggaggatgataggcaccacacagccattaattttatcgcaaatccagaacaaagcaataaaaatcttgacataagcatcaacgcgagtaataactttaatttgaatatcacttggtccgtcggaagcactgccgggacaatttctggagaagaaaccagtatcgtgtccaagaacaacatcaaagagtaccgagatagtttttcctatgaaaagtttaactttagatcgaatccaaatattacgttttatgtatacgtctctaacttctcatggccaatcaagattcagatcgcttttagtcagcacaacactataatggatctggtccaattctttgtgacgtttttctcatgcttcctcagcctcctgttggtggctgccgtggtgtggaagatcaaacagacatgctgggcttcacgccgccgagagcagctgctgagggaaaggcagcagatggccagtcgaccttttgcctcggtggatgtggccctggaggtcggggcagagcagacagaattcttgcgcggccccctagagggtgcaccaaagcctatcgccatcgaaccttgcgcaggcaatagagccgcggtgctgacggtgtttctgtgcctaccaagaggctcatctggtgcccctcccccggggcagagcggcctggcaattgctagcgcgctcattgacatcagtcaacaaaaagcctcagactccaaagataagacatctggagtccgaaatcgaaaacacctaagtacgaggcagggtacctgcgtgtag

SEQ ID NO: 109318 - DNA, 1293 bp, Artificial Sequence
  Description of Artificial Sequence: Synthetic coding sequence
atggagtgcatgtggtgctcatctacaaagcggtgcgtggattctaacgcatatattatcagctttccgtacgggcagtgtctcgaatggcagacagcaacctgttccccacagaattgttcagggctgcgaacctgcggccaatgcctggaacagcctggctgcggctggtgcaacgacccttcaaacacgggccggggccactgcatcgagggcagcagcaggggtccaatgaaattaatagggatgcaccacagcgagatggtgttagacaccaacctgtgcccaaaggagaaaaactatgagtggtctttcatccagtgcccagcatgtacttgttccggccatgccaatatatgtcacctgcacacaggcaaatgcttttgcacgaccaaaggaattaagggggatcagtgccaattatgtgactctgaaaacaggtatgtgggcaaccccttgcggggtacctgctactactccctcctgattgactaccagtttaccttttccctgctgcaggaagacgatagacatcatacagctataaatttcatagctaaccccgagcagtcaaacaagaatttggacatttccattaatgcctccaataatttcaaccttaacatcacatggtctgttggttcaactgcgggcacaatcagtggcgaagaaactagcatcgtcagcaaaaacaatatcaaggaatatcgagattctttctcttatgagaagtttaatttccggtcaaatcccaacattacattctacgtgtacgtatctaatttcagctggcctatcaagatccagattgccttctcacagcacaatacaattatggacctcgtacagttcttcgtaacattcttctcctgcttcctaagcctgctgcttgtggccgccgtcgtgtggaagatcaaacagacctgctgggcctctcgccgccgagagcagctcttgcgggaaaggcaacagatggcaagccggccatttgcctccgtcgacgtagcgctggaggttggcgctgagcaaaccgaatttttaagagggcctcttgagggcgccccaaagcctatcgctatcgagccatgtgccgggaatcgtgccgccgtgctcaccgtgtttctttgtctcccacgcgggtcaagcggggcgccccctccagggcagtccggtctagctatagcatcagctttgattgacattagtcaacagaaggcatctgattccaaggataaaactagcggcgtccggaaccgaaagcacctgtcgactcgtcagggaacatgcgtatag

SEQ ID NO: 109319 - DNA, 207 bp, Artificial Sequence
  Description of Artificial Sequence: Synthetic coding sequence
atgcccaagcacgaattctcagtcgatatgacctgtggtggttgcgccgaagccgtgtccagggtgctgaacaagctgggaggtgtaaagtatgatattgacttgcctaataaaaaggtgtgcatcgaatctgagcactctatggacactctgttggctaccctgaagaagaccgggaagaccgtttcctatctgggcctggaatag

SEQ ID NO: 109320 - DNA, 207 bp, Artificial Sequence
  Description of Artificial Sequence: Synthetic coding sequence
atgcctaagcacgagttctctgttgacatgacatgtggaggctgtgccgaggcggtctcccgtgtcttaaataaacttggaggtgtgaagtatgacatagacctgccaaacaagaaagtttgtatcgagtctgagcattccatggacacgctgctcgctacactcaaaaagactggcaaaacggtgagttacctggggctggagtag

SEQ ID NO: 109321 - DNA, 207 bp, Artificial Sequence
  Description of Artificial Sequence: Synthetic coding sequence
atgccaaaacacgagtttagtgttgatatgacttgcggtgggtgcgcggaggcggtgtcccgggtcctgaacaagctcgggggcgtaaaatatgatatagaccttccaaacaagaaggtttgcatcgaaagtgagcacagcatggacacgcttttggcgaccctgaagaaaacaggtaagaccgtgtcctacttggggctcgagtag

SEQ ID NO: 109322 - DNA, 933 bp, Artificial Sequence
  Description of Artificial Sequence: Synthetic coding sequence
atggcagctgctgtggctgcggctcccggggccctcggctctctgcatgctggtggcgcacgcctggtcgcagcctgctccgcctggctctgcccagggctccgactgccaggctctctggccggtagacgagccggaccagcgatttgggcacaggggtgggtgcccgcggctggtggacctgcaccaaagcgcgggtattcctccgagatgaaaactgaggacgaattacgggtacgacatctggaggaggagaaccgcgggattgtggtgctcggtattaatcgggcctatggaaaaaactccttatctaaaaatttaattaagatgctctccaaggctgttgatgccctgaaatccgacaagaaagtgaggacgattatcatcagatcagaggtgccaggtattttttgtgccgctaatctgccagtgcccaccattgcagctattgatggactggcattgggcggcggactcgaactggcactcgcctgtgacatccgagttgcagcctctagtgcgaagatggggttggtcgagactaaactggccattattcctggcgggggcgggacacagaggctgccccgtgccatcggaatgagtcttgccaaggaacttatcttttcagccagggtgctggacggaaaagaagcgaaggccgtgggcctcatcagccacgtgctcgagcagaatcaggagggcgatgcggcttataggaaagcgttggatctagcccgagaatttctgccccaaggtccagttgccatgcgggtggccaagttggctattaaccaaggtatggaggtagacctggtaacaggcctggccatagaggaggcgtgctatgcccaaacaatacccaccaaggataggctggaaggcctccttgcctttaaggaaaagcgcccacctaggtacaagggtgagtag

SEQ ID NO: 109323 - DNA, 1020 bp, Artificial Sequence
  Description of Artificial Sequence: Synthetic coding sequence
atggccgccgctgttgctgctgccccgggcgccttagggtcgctccatgctggaggagctagactcgttgcagcatgcagcgcatggctgtgccctggcctccgcctacctggatcgctggccggtcgaagagccgggccagcaatctgggcacagggatgggtccccgccgccggcggccctgccccaaagagagggtattcttccgagatgaagacagaagacgagctccgagtcagacacttggaggaagaaaacaggggcatagtggtgctgggcatcaatcgggcgtacggcaaaaactcccttagcaaaaatctgataaagatgctgagtaaggctgtagacgcattgaaatcagataaaaaggtccgtaccatcattattagaagtgaagttccggggatcttctgtgctggcgccgatctgaaggaaagggccaagatgagttcaagtgaggtgggcccttttgtgtctaagattcgcgctgttatcaacgatattgcaaacctcccggtccctacaatagcagccatcgacggcctggcgcttggaggcggactcgagttggctttggcctgtgatatcagagtggcagcctcgagcgcaaagatggggctggtagagaccaaactggctatcattcctggtgggggaggtacacagagactgccccgcgccattggaatgagcctggctaaagagttaatcttttcggctcgtgttcttgacggtaaggaagcaaaagcagtcggattgatttctcacgtgctcgaacagaaccaggagggagacgccgcctataggaaggctctggatctggctagagaatttttacctcagggccccgtcgctatgcgtgtagctaagctggctatcaaccaaggaatggaagttgacctggtgaccgggctagcaattgaagaggcttgctatgcccagacgattcccacaaaggacaggctcgagggcctgctggcctttaaggaaaagcgccctccacgctataaaggcgaatag

SEQ ID NO: 109324 - DNA, 768 bp, Artificial Sequence
  Description of Artificial Sequence: Synthetic coding sequence
atggccgccgcagtagcagccgccccaggcgctcttggcagcctgcacgctggaggcgctaggctagtagcagcctgctccgcttggctgtgtccagggctgaggttaccaggatctctggccgggaggcgagcgggtccggctatctgggcacagggatgggttcccgccgcaggaggccctgctcccaaacgaggatatagttctgagatgaagacagaagatgaactgagggtgagacatcttgaggaagaaaatagggggatcgtggtcctgggtatcaacagggcctatgggaaaaattctttgtctaaaaacctcatcaaaatgctgtcaaaagctgtagatgctttaaaaagtgataaaaaggtgaggactattataattaggtccgaggtcccgggaattttttgcgccggagcagatctgaaggaacgcgcaaagatgagcagctcggaagtcggacccttcgttagcaaaatacgggccgttataaatgacattgctaatctcccagtgcctacaatagctgccattgatggactggcgctggggggaggcctcgaactcgccctggcatgtgacattcgagtggccgcctcttccgccaaaatgggcctggtggaaacaaaattagccatcattcccggtggcgtcacatcttctaccgaagtgctgaatccttcaaagtcctctatgaaaattggcatcattattttccagaccccggtgaacattgacattctcgctagctcacatgaaagctag

SEQ ID NO: 109325 - DNA, 1932 bp, Artificial Sequence
  Description of Artificial Sequence: Synthetic coding sequence
atgccacttctcttcttggagcgtttcccctggccctccctccggacatacaccgggctttccggcctggcactgctggggaccataatcagcgcctaccgagccttgtcccaacctgaggctggaccaggcgaacccgatcagctgaccgcttctttacagccggagccaccagccccggcccggccttccgccggagggccaagggcgcgcgatgtcgcccaatatctgctgtctgatagcttgtttgtgtgggttcttgtaaacactgcctgttgcgtgttaatgctagtcgctaagctcatccagtgcatagtctttggtccattgagggtgagcgaaaggcagcacctgaaagacaaattctggaacttcattttttacaaattcatattcattttcggagtgctgaacgtccagaccgtggaggaggtagtgatgtggtgcctgtggtttgcaggtcttgtattcctccatttaatggtccagctgtgcaaggacagattcgagtacctttctttttcccccaccacccccatgagtagccacggccgggttttgtctctgctggtcgccatgctcttatcttgctgcggcctcgctgccgtctgttccatcactggttacacccatggtatgcacaccctggctttcatggctgctgagtccttgctggtcaccgttcgcacagctcatgtcatattgcgctatgtgatccatctgtgggatttaaaccacgagggaacatgggaaggcaaaggaacttacgtctactacaccgactttgtgatggagttgaccctgctctcccttgaccttatgcaccacatccatatgcttttattcgggaacatctggctctctatggccagcctggtgatattcatgcagcttaggtatttgtttcatgaggtccagagaagaatccgcaggcacaagaactacctaagggtggtgggaaacatggaggcgaggttcgccgtggcgactccggaagaacttgctgtgaataatgatgattgtgcaatctgttgggacagtatgcaggctgcgcgtaagttgccttgcggacacttatttcataattcctgccttagaagttggcttgaacaggatacttcatgtcctacgtgtcgcatgtcattgaacattgccgataacaatagagtacgagaagagcatcaaggggaaaacctggatgagaacctggtcccagtggcagcagccgaggggcggccacggcttaatcagcacaatcacttttttcattttgacggtagtcggattgcatcctggctcccatctttcagcgtggaggtcatgcacacaaccaacatcctggggattacgcaggcctcaaactcacagctgaatgcgatggcccatcagatccaggagatgttccctcaggtaccataccaccttgttctacaggatctccagttgaccaggtcggtcgagatcacaaccgataatatactggaagggcggatccaagttccctttccgacccagcgatctgactccattaggccagccctcaatagtcccgttgaacggcccagtagtgatcaggaggaaggggagacttctgcccagactgaacgagtgcctctggatctttcaccccgtttagaggagacactggatttcggagaggtggaagtggagccatccgaagtggaggatttcgaagccagaggaagtaggtttagtaagtccgcagacgagcggcagcgaatgctggtgcaaagaaaggacgagctactgcaacaggcacggaagcgctttttgaacaagtcttccgaagatgatgccgcatcggagagctttctgccaagcgagggagcgtcctctgacccagtgacgctaaggcggcgtatgcttgccgcggcagcagaaagacgactgcagaagcagcagacatcatag

SEQ ID NO: 109326 - DNA, 954 bp, Artificial Sequence
  Description of Artificial Sequence: Synthetic coding sequence
atgagagattcagcatgttggcagcgaaaggacgaattacttcaacaggcgcggaagagattcttgaataaatcctctgaggacgatgcagcgagtgagtctttcctccccagtgagggcgccagtagcgatccagtcacactgcggagacgaatgctggccgctcgaaacggaggattccgcagctcccgccctccatctgcccctctaccctcctctgccgcgagctgcgctctgtgtcccacagactggcgtcggccggtgcccattccactgcatggaaaagcaggactgaccgccctgccactgtacaaggcttgtggccttatagtcttcggacagctgataaacctcatcttgctgtgtaataccttttatgtgacattcctgtttccactggaaactctgcaaatactgaccgtgggcatgatttcttctggggtcgactggactgcctggggcggcggcagatcaggaggctctgaggtggcgtgcttgcagcaagccgcaagcacacctgcaagttgcgttaggcccaccaatgcgggtgtgttaagcaccacacctagtggcaagtctgtcggcgaagctcactcagtgtcacctcccccaagaagaggcgttacttctgtgattaagctactcagcctgctctggaaacacgttgattgtgctaggcgcccaacgggatcctgtacaccgcagcagggcatcctcgagaaggagctgttagtgagatatctggaacagaggcgggggaaaagcagagctatcggatgcgatgaggtcactcctttttgtcctaccacttctggaactgatttcccttctcttcaatctaaagccggtcttatttcagtcaattcaggtgccccagccagccatgagtgcgcgccgtgggtgccctcccccctcagtattagcttgtcccgactggatctgggctcagggtag

SEQ ID NO: 109327 - DNA, 1638 bp, Artificial Sequence
  Description of Artificial Sequence: Synthetic coding sequence
atggccactgatgcagctctgaggcgcttactacggctgcaccggaccgagatcgctgtggctgtggatagtgcatttcctctgttgcacgccttggccgaccacgacgtagtccccgaggacaagtttcaagagacgctgcatctgaaagagaaggaggggtgtccccaagcttttcatgccctgttgtcatggctgctgacccaggactcaaccgcaatcttggacttttggcgggtcttatttaaagactacaacttggagcgctacggaaggttgcagccaatcctggacagtttccctaaggatgtggatctgtcacagccgcgaaaaggacgcaagccacccgcagtgcccaaagcactcgtgccaccaccccgcttacccaccaagcggaaggcatcagaggaggctcgcgcagctgcccccgccgccttaaccccacgggggaccgcctcgcccggcagccaactgaaggcgaagccgccaaagaaacccgagtcatccgcagaacagcagagactgccactcggcaacggcatccagacaatgtctgcgagcgtgcagcgtgcggtggccatgagttcaggggatgtccccggcgcccgaggcgctgtagagggaattcttatccaacaagtgtttgaatctggtgggtctaagaaatgtatccaagtgggaggcgaattttatactcccagcaagtttgaagactccggatctggcaagaataaggcgagatctagctccggacctaaaccactggtaagggctaaaggtgcccagggagccgctcctggtgggggtgaggcacggctagggcagcaggggagtgtcccagcccccctagcactacccagcgatccacagctgcatcaaaagaacgaggacgaatgcgcagtgtgtagagatggcggagagctcatctgttgtgacggttgtccccgcgcatttcatctcgcctgcctttcacccccactgcgtgaaatcccttctggcacatggcgatgcagtagctgtttacaggcaacagttcaggaggtgcagcccagagcagaggaaccccggccccaggaacctccagttgaaacaccactcccacctggtctgcgatccgctggagaggaggttcgcgggccccccggagaaccattggctggcatggacactaccttggtatataagcatcttcctgcaccaccgtctgccgcccccctccccggattagatagctctgccctgcaccccttgctatgtgtcggcccagaaggccagcagaatcttgcccccggggcgagatgcggtgtgtgtggagacggcaccgacgttctgcggtgtacccactgtgctgcagcgtttcattggaggtgtcacttccccgccggtacatcacgaccaggaacgggactgaggtgtaggagttgcagtggggacgtaacacccgctcctgtggagggagtcttggctccaagcccagctcggctggctccagggcctgccaaagatgatacagccagccacgagcctgctctccatagggatgatctggagagtcttctctccgagcacaccttcgatggaatactccagtgggccatccagagcatggctcgcccagccgccccgttcccaagttag

SEQ ID NO: 109328 - DNA, 735 bp, Artificial Sequence
  Description of Artificial Sequence: Synthetic coding sequence
atgtggcttgtatattcctcgggcgccccaggcacccagcagcctgctcgtaacagggtgttcttcccgataggaatggcacctggaggcgtctgttggcgacccgatggctggggaactggtggccagggcagaatttccggaccaggaagtatgggtgcaggtcagcgtctgggcagttcaggaacccaaaggtgctgttggggatcgtgttttggcaaggaggtggcgctgcgacgggtccttcacccttctcctaagaacgaggacgaatgcgctgtgtgcagagacggaggcgagttaatctgctgtgatggatgtccacgtgcctttcatttggcttgcttgtctcctccactacgagaaatcccttccggaacctggcgctgtagctcatgtctgcaagccacagtgcaagaagttcagcctcgagcagaagagcctaggcctcaggagcccccagtggagactccactgcctccggggctgagatcagccggagaggaacctcggtgtcaaggctggacacctcgaccatgtacaccctattgtgtctgggtccttcgcgtctctcgaacgtggctcctggtgagagtcgccggctgcgctgagatggttaggacttgctgcggagttttgaccgctcccctccctagcaccggtgctgcaacgtctcagccagcaccacccggccccggaagagcctgtgcagcagatccagcacaagaaacatag

SEQ ID NO: 109329 - DNA, 1047 bp, Artificial Sequence
  Description of Artificial Sequence: Synthetic coding sequence
atgtggctcgtgtattcttctggggcacccggcacccagcaacctgcaaggaaccgggtgttcttccccatcggaatggccccaggaggggtctgttggagacctgacggctggggcacaggaggccagggccgcattagcgggccaggaagcatgggcgcaggccaacgcctcgggtcaagtggaacacaacgctgctgttgggggtcatgcttcggaaaggaagtggccctgaggagagttttgcacccgtctccagtttgtatgggagttagttgtctttgtcagaagaacgaggacgaatgcgccgtgtgcagagatggcggtgaactcatttgttgcgacggctgcccccgtgcattccacctcgcttgcctatctccgcccttaagggagatcccgtctggcacatggcgctgctcaagctgcttacaggccaccgtccaagaagtccagccccgggcggaagagccacgtccacaggagcccccagtggaaaccccacttccccctgggcttcgttctgctggagaggaagtaaggggcccaccaggagagccactcgccggaatggataccacactggtgtacaagcacctgccggccccgccgtcagcagcccctctcccgggattagattcctcggctttgcatcccctcctatgtgtaggaccagaagggcagcagaatcttgcgccgggagctagatgtggcgtgtgcggggatgggacagacgtgctgaggtgtacgcattgcgcagccgctttccactggaggtgtcacttccctgcaggcactagccgtccgggtactggactgagatgtcgatcctgtagcggcgatgtgacccccgctccggtggaaggcgtactggccccatctcctgctaggcttgcaccagggcctgctaaagatgacaccgccagccatgagcctgccctccaccgagacgacctggagagcttgctttctgagcacaccttcgacggcatactccagtgggcaatccagagcatggccaggccagccgctccctttccaagctag

SEQ ID NO: 109330 - DNA, 1017 bp, Artificial Sequence
  Description of Artificial Sequence: Synthetic coding sequence
atgtggttggtgtacagcagcggcgcacctggcacacaacagcctgccaggaaccgcgtgttctttcccataggcatggcccccggaggggtctgctggaggcccgatggctggggcacgggcggacagggacggatcagtgggccggggtcgatgggtgccggacaacgtctgggtagctctggcacccagagatgctgttggggatcatgtttcggcaaggaggtggcccttaggagggtgctccacccttcacccaagaatgaggacgaatgcgccgtttgcagagatggcggcgagctgatatgctgtgatggctgcccgagggctttccacttggcctgtttatcacccccgctaagagaaattcctagcggcacctggcgttgctcaagctgcttacaggcaacagtgcaagaagttcagccgagggccgaggaaccacgaccacaggagcctcctgtcgagacacccctgccccccggattgcgttctgcaggcgaggaagtgcgcggtcctccaggtgagcctttggcggggatggacacaactctcgtgtacaagcacctgcctgccccgccctctgcagctcctctccctgggctggatagtagcgcattgcaccccttgctctgcgtcggaccagagggccaacagaatttggctcccggggctaggtgtggggtgtgcggcgatggtactgacgttctcaggtgcacccattgtgcagccgccttccactggagatgccactttcccgcaggaacgtctcggcctggtacaggtctgcgctgccgttcctgcagcggcgacgttaccccagccccagtagaaggtgttctggcacccagtccagccaggctggcacctggccccgcaaaagatgatacagcgtcccacgagcccgctctccaccgcgatgacctggagtctcttttgtcagagcacaccttcgacggtattctccagtgggcgattcagagcatggctaggcccgccgcgccgttcccatcttag

SEQ ID NO: 109331 - DNA, 1047 bp, Artificial Sequence
  Description of Artificial Sequence: Synthetic coding sequence
atgtggctggtttattctagtggcgcacctgggactcagcagcctgccaggaacagagtgttctttccaatcgggatggcccctgggggcgtgtgctggcgtcctgacggctggggcactggaggacagggtcgaatctctggcccggggagtatgggcgccggtcaaaggctcggtagctctgggactcagaggtgctgttgggggtcttgctttggaaaggaggtggccctgcggcgcgtgctgcatccttcgccagtttgtatgggagtctcatgcctttgccaaaaaaacgaggatgagtgtgccgtttgtagggacgggggggagctgatttgctgtgatggctgccctcgggcttttcatcttgcgtgtttgtcccctccattgcgggagattccttcgggaacctggagatgtagctcatgccttcaggccacggtgcaggaagttcagccaagagcagaagaaccaaggccccaggagcctcccgtggagacacccctcccacctggacttcgaagcgcgggtgaggaggtccgaggcccccctggcgagcccctagctggaatggacactactttggtctacaagcatcttcccgctccaccttctgccgctccgttgccgggattggactccagcgcgctgcatcccctgttgtgcgtgggaccagaagggcaacagaacctggcgcctggggcaaggtgcggtgtgtgcggggacggtaccgacgtgttaagatgtacacattgtgccgcagcctttcattggcggtgtcacttccctgcaggcacttcaagacccgggacgggtctccgatgtagaagctgcagcggcgacgttacgcctgcccccgtggagggggttcttgcccccagtccagccagattagcaccaggccccgccaaggacgataccgcgagtcacgagccagcactgcatcgcgatgacctggagtctctcctcagcgagcatacgttcgatggaatcctgcagtgggccattcagagcatggcgagacccgccgctccctttcctagctag

SEQ ID NO: 109332 - DNA, 3717 bp, Artificial Sequence
  Description of Artificial Sequence: Synthetic coding sequence
atgaaagtcgtcccggaaaagaacgccgtacgtattctgtggggccgtgaacggggggcacgtgctatgggcgcccagcggctgctccaggaattggtagaggacaaaacacgatggatgaaatgggaagggaaacgcgtcgagctgcccgactccccacgcagcacgttcttgcttgcatttagcccagataggactctgctcgcttcaactcacgttaaccataacatctatattacagaggttaagactggtaagtgtgtgcatagcctgatcgggcaccgccggacaccttggtgcgttacattccaccccacaatctccgggctgatcgcctccggctgtctcgatggggaagtgcgcatctgggatctgcacgggggcagtgaatcttggttcaccgactcgaacaacgctatagctagcttagcatttcaccctaccgcacagttattgctgatcgctaccgcaaacgagattcatttctgggactggagcagaagggaaccattcgcagtggtgaagactgcttccgagatggagagggtgcggctggtgaggttcgatcccttaggccattacctgctcacagccatcgtcaacccatccaaccagcagggagatgacgagccagagattcccatcgacggtaccgagttgagtcattataggcaaagggcgctgttacaatcccagccagtgcggcggactcccctcctgcacaattttctgcacatgctgtcctctaggagttccggcatacaggtgggggagcagagcactgtacaggactcggcaactccatctcctcctccccctccacctcagccttctacagagcgcccaaggacatctgcatacatccgccttcgccagagagtctcttaccccactgccgaatgctgccagcacctgggcatcctctgcctgtgctcacggtgctccggaacacgcgtgcccagcctgctgccccatcaggactccgtgcccccagcttctgccagggccaccacaccaagcttttccttcgtgcagaccgagccctttcacccgcccgagcaggccagcagcactcagcaagatcagggccttttgaatagaccttctgcgttttctacggtgcagagctcaaccgccggcaacaccctccggaatcttagcctcggccccacccgacgcagcctcggtggcccactttcttctcacccatctaggtatcatagagagatcgctcccgggctgacaggcagcgaatggacacgaaccgtgctttccctaaactcccgctcagaggcagaaagtatgccgccccctcgcacctctgcctcttcagtgtcacttttaagcgttcttcgacagcaggagggcgggagccaagcatcagtttataccagcgccaccgagggaagaggatttcccgcatccgggctggcaactgagagcgacgggggaaacggctcttctcagaacaatagtggatccatcaggcacgagcttcagtgcgatttgagacggttctttctggagtacgatcgccttcaggaacttgaccaatccttgagcggggaagccccacaaacccagcaggcacaggaaatgcttaacaacaatattgagtccgagcgtcccggcccaagccaccaacctaccccacattcatcagagaacaacagtaatctgtctcgaggacatctgaatcgctgccgggcttgccataacctcctgacctttaataacgatacactaaggtgggagagaaccaccccaaattactcgtccggggaggcttcgtcctcatggcaggtgccaagctcctttgagtccgtccctagctccggctcccagctgccccctctcgagagaaccgaaggacagacaccctcttctagccgcttggaactgagttcaagcgcttcaccccaagaggaacggactgtgggggtagctttcaatcaggaaacaggacattgggaaagaatctacactcagtccagtcgctctggcactgtttcccaggaggccttacatcaggacatgcctgaggaaagttcagaagaggactcgcttcggcgcaggctgctggagagcagcttaatctccctgtcaagatatgatggagctgggagtagggaacaccccatataccccgaccctgcaagagacaacggagacagatctcggcacagagccccgcggaacgcaaggatgtccgcacccagtctcggacgtttcgtgcctagaagatttttattgcccgagtacttaccctacgctgggatcttccatgaacgcggtcagcccggcctcgccacccatagttcggtgaatcgcgttctcgccggcgcagtgattggcgacggccaatcggctgtggcaagcaatattgcgaacacaacctaccgcctgcagtggtgggatttcacaaagttcgatctacctgaaatctctaacgcaagcgtgaacgtgctagtgcaaaactgcaagatctataatgacgcctcttgcgatatatccgccgacggtcaactgttagccgcttttataccgagcagccagcgcggatttccagacgagggcattttggctgtctattctttagccccccacaatctgggcgagatgttatatacaaaaagatttggacctaatgctatttccgtaagcctcagccctatgggcaggtatgtgatggttgggctggcctcacggcgaattctcctgcacccttctacagagcacatggtggcacaggtatttcgccttcagcaagcccatggaggcgagacatcaatgcgacgggtgtttaacgtcttatacccaatgccggctgatcaaagacggcatgtgagcatcaacagcgccagatggctgccggaaccgggactaggactggcatatgggactaataagggcgatctggtaatatgccggccagaagccctcaattccggtgtcgaatattactgggaccagctgaatgaaaccgtatttactgttcactccaattctaggtcatctgagcgccccggaacctcgcgagcaacatggcgcactgatcgcgatatgggcttgatgaacgctattgggctgcagccaagaaaccccgcgacctccgttacctctcaggggacacagaccttagcactgcagttgcagaacgccgaaacacagacggagcgggaggtgcccgaacctggaacggccgcttctggccctggcgagggggagggttccgaatacggagcttcaggggaagatgcactgtctcggatccagaggctgatggcagaaggggggatgacggccgtagtgcagcgcgaacagtctaccactatggcgtccatgggcggctttgggaacaatatcatcgttagtcaccgtatacatcgaagttctcagaccggcaccgaaccgggtgctgctcacacgtcctcgccccaaccctccacctcaaggggtctgttgcccgaggcaggccagctagccgagagaggcttgtccccacgcaccgctagctgggaccagccaggcacaccagggagggaacctactcaacccaccctcccgtcaagtagcccagttcctatccctgtgtcactcccatcagctgaaggcccgactctgcattgcgaacttacaaacaataaccatctgcttgacgggggatcctctaggggtgacgccgctggcccccgcggagaaccccgcaacagatag

SEQ ID NO: 109333 - DNA, 2169 bp, Artificial Sequence
  Description of Artificial Sequence: Synthetic coding sequence
atgaaggtggtccctgagaaaaacgctgtcaggatcctgtggggacgcgagagaggcgcaagggctatgggcgcacaacggttgctgcaagagctggttgaggataaaacccggtggatgaagtgggaaggcaagcgcgttgagttacccgactctccccgctccaccttcctgctcgcatttagccccgatcggaccctcctggcctccacccacgtgaaccacaatatctatattacggaagtaaagactgggaagtgtgtgcatagcttgatcggccacagacggaccccctggtgcgtcacttttcatccaacaatctccgggctcatcgcttcaggatgtcttgacggcgaagtgagaatttgggatctgcacggagggtccgagtcctggttcactgatagtaacaatgcaattgccagtctggcttttcatccaacagcacagctgctgcttatagccactgcgaatgagattcatttctgggattggtcccgtagggaaccttttgccgtggtcaaaactgccagtgaaatggagagggttcgcctggtgcgcttcgaccctcttggacactacctgttgactgcaattgttaatccaagtaaccagcaaggcgatgacgagccagaaataccaattgacgggaccgagctatcccattatcgccagagagctcttctccagagccaaccagtgaggcggacccctttactgcacaatttcctccacatgcttagcagtaggagttccgggattcaaactgaacccttccacccacccgagcaggcatcctctacccagcaggaccagggcctcctgaacaggcccagtgctttcagcacggtgcagtcaagcactgccggaaacacgctgcgcaacctttctctcggcccgactaggagaagcctaggaggcccattgagcagtcatccgtcacgctatcacagagagatcgcacccggtctgacagggtccgagtggaccaggacagtcctcagcctaaattctcggtcagaagcagagagtatgccccctcctaggacatctgcttccagcgtctctttgctgagcgtgctccgccagcaggaggggggcagccaagcttctgtctacacttcagctaccgaagggcgcggcttccccgctagcggactggccactgagagtgatggaggcaacggctcctcacaaaataactctgggtcaatcagacacgaattacagtgcgacctccggcgcttttttctcgaatatgaccgcctccaggagctagatcagtctctgtctggcgaggcgccacaaactcagcaggcccaggaaatgctaaataacaatatagaaagcgaaaggccggggccaagccaccagccaacccctcactcctccgagaataatagcaatctaagccgcggccacctcaaccggtgtcgcgcatgccacaatctcctcaccttcaacaacgataccctcagatgggagcgtaccactcctaactatagttctggagaagcatcaagttcttggcaggtcccctcatcatttgaatcagtgccaagcagcggctcccaactcccccccctcgaaaggaccgaaggccagacgccttcctcttcccgtttagaactgtcttcttccgcatcaccccaagaggaacgcacggtaggtgtggcctttaatcaagaaactggccactgggagagaatctacactcagtcatcccgatcggggacggtgtctcaggaggctcttcatcaggacatgcccgaggaatcttccgaagaagactccctccggaggagatccctggcacttagtccccgtctagaatactcgggcgcaattctggctcactgcaagctacggctgcccggatcttgtcactcacccgccagcgcctcgcaggtagcaggaacaaccggcgcacatcaccacgccagactgatcttcgcgtttctagttgagatggaatttcaccacgttagccaggcggggcttgagctgctgacatccggcgacttacccaccagcgctagtcaaagtgcgggcatcacaggagtatcacaccgggcgtggcccaggttactcgaaagttccctgatcagcctctccaggtacgatggtgcgggatcacgcgagcacccgatttacccagaccccgcctag

SEQ ID NO: 109334 - DNA, 3627 bp, Artificial Sequence
  Description of Artificial Sequence: Synthetic coding sequence
atgaaagtcgttcctgagaaaaacgcagtacggatcctgtgggggcgcgaaagaggggcgagagccatgggggctcagagactgctgcaggaattggtggaggacaagactcgctggatgaaatgggaagggaaaagagtggaactgccagattcccctcggtcaacgttcctgctggcctttagccccgataggactctgctcgctagtacccacgttaaccataatatatacatcacagaggtcaaaactgggaagtgcgtccatagcctcattggccataggaggaccccctggtgtgtgacatttcacccgaccataagcgggctgatagcttccggatgcctagatggcgaggtcaggatctgggatctccacgggggatccgagagttggttcaccgactcaaacaatgcgattgcgtcactcgcattccaccctacggcccagctgctcctcattgccacagcgaatgagattcacttttgggactggagtcggagggagccattcgccgtcgttaagacagcctccgaaatggagcgcgtgcgcctggtccgatttgacccactcggacattacttactcacagcaattgtcaacccctcaaatcagcaaggcgatgacgagcccgagattcccatagatggcaccgagctgtcccactataggcagagggctcttctccagtctcagcctgtaaggcggactccacttctccataactttctgcacatgttatcaagccgctcaagcgggatccaaaccgaaccgttccatccacctgagcaagcctcttccacacagcaggatcagggcttacttaacagaccttccgccttttccactgttcagtctagtaccgccgggaataccttaaggaaccttagtctcgggccaacccgcagatcactcggaggcccgctgtccagtcacccctcacgataccaccgggaaattgcccccggcctcaccgggtccgagtggacccgcacagttctgtctctcaacagccgctcagaggctgagtccatgccgccccctcgcaccagtgcgtccagcgtgagtctgctctccgttttacgtcagcaggaggggggatcacaagctagcgtgtatactagtgcgaccgaggggagggggtttccggcctcggggctggctaccgaatccgatggcggtaacggtagctcccaaaataactccggcagcattcggcacgagctgcaatgtgacctgcgcagattttttctggagtacgaccgcctccaggaactagatcagtctctatcaggcgaggcacctcagacgcagcaagcccaagaaatgctgaataataatattgagagcgaacgccccggacccagccaccagcctacgcctcacagctctgagaataactcaaatctgtccaggggtcacctaaatcgctgccgggcttgtcataacttgcttaccttcaataacgataccttaaggtgggagagaacgacaccaaactatagcagtggggaagcttcttcgtcatggcaagtgccgagttccttcgagagtgtcccatcctccggaagccagctgccacccttggaacggaccgaagggcagaccccgtcgtcctcgcggctcgagctttcctccagcgcttccccacaggaagaacgcaccgtcggtgtagcattcaaccaagagaccggtcactgggaacggatctatactcagagtagcaggtcgggaaccgtctctcaggaggcgttgcaccaagacatgcccgaagagtcaagcgaagaggacagcttgagaaggcgactgctggagagttctcttatcagcctcagccgctacgacggggccggcagccgcgagcaccctatctaccctgaccccgcgcggttatctccagctgcttactacgcccagcgcatgatccagtatctcagcaggagggacagcatcagacagaggtccatgcggtatcagcagaaccgattgcgaagctctacaagtagctcttccagcgacaatcaagggccaagcgtggaaggaaccgacttagagttcgaggacttcgaggataacggagataggtcccgtcatagggcccccagaaatgctcggatgtcggctccttcacttggtcgttttgtgccaagaagattccttctgcccgagtacctgccttacgccggcatattccatgagagaggtcagcctggcctggccactcatagctcagtgaatagagtgctggccggcgctgtgatcggggacggacaatccgccgtggcctctaatattgccaacactacatatcggttgcaatggtgggacttcacgaaatttgacctgcccgagataagcaacgcttcagtgaacgtgcttgttcagaactgcaagatttataatgacgcttcttgtgatatcagcgctgatgggcagttgttggccgccttcatcccgtcctctcagcgcggatttccagatgagggcatcctggccgtttactcccttgcgccacacaacctgggagagatgttgtataccaagcgcttcggccctaatgccatatcagtgtctctgtcgcctatgggtcggtacgtaatggttggacttgcctcaaggagaatcctgctgcacccctccacagaacatatggtagcccaggtttttcgacttcagcaagcccatggcggcgaaacttccatgcgtcgggtgtttaacgtactgtatcccatgccagccgaccagaggcgacacgtcagcattaactcggctcgctggctgcccgaaccaggcctgggacttgcttacggtacaaacaagggggacctggtgatctgtcgaccagaagccctcaactctggggtagaatactattgggaccaattgaacgagaccgtgttcacggtacactccaattcaagaagctcagagcgcccgggcaccagcagggccacctggcgcacagatcgggacatgggactcatgaacgccatcggactgcaaccgcgcaatcccgccactagcgttactagccaggggactcagaccctggcactacagcttcagaacgccgaaactcagaccgaacgcgaagtgccagagcccggtaccgctgcatctggacctggcgagggcgaaggatctgaatatggagcgagcggagaggatgccctttcacgcatccaaagactaatggcggaaggaggcatgacagcagtcgtccagagggaacagtccacgacgatggctagtatgggaggattcggcaacaatatcatcgtttcccaccgcattcatcggtccagccaaactggcactgaaccaggagccgcgcacacctcatccccacagccatctacttcccgtggactcctgccagaagccggacagctcgctgaaaggggactaagtccacgaaccgcctcttgggaccaacctggaacccccgggcgggaacccacacagcccactttgccttcttcatctcccgtgcccattcccgtttctctgccttctgctgaaggtcccacgcttcactgcgaactgacaaacaacaatcatctgctagacggtggaagcagccggggtgatgctgccggcccgcggggagaacccagaaaccgttag

SEQ ID NO: 109335 - DNA, 3810 bp, Artificial Sequence
  Description of Artificial Sequence: Synthetic coding sequence
atgaaggtcgtgccagagaaaaatgccgtcagaattctctggggccgggagcgaggggccagggctatgggcgcacaacgcctactgcaggagctggttgaagataaaactcgctggatgaaatgggaaggcaagagagtcgagttgcctgattccccgagaagtacttttctccttgccttctccccggatcgcactctgctagcatccacgcacgttaaccataatatctatataactgaagtgaaaaccggcaagtgtgttcactccctcatcggccacaggcggacaccttggtgcgtgaccttccaccccaccatttcaggcctgattgcttccgggtgtctggacggcgaggtacggatttgggatttgcatgggggatccgaatcttggtttacagattccaacaacgctatcgccagccttgcctttcatcctactgcccagttgctgctgatagcgactgctaatgaaattcacttctgggactggagtaggcgggaaccattcgccgtggtcaagaccgcttccgaaatggagagagtaaggctggttagatttgaccctctcggccattacctgctcaccgccatcgtgaacccaagtaatcagcagggggacgacgagccagagatcccaatagacggtaccgaactgagccactaccgacagcgggccttgctgcagagccaacccgtgagacgcacacccctgcttcacaactttctccatatgctgtcctctagaagttccggcatccaggtcggcgagcagtccacagtgcaggattctgccaccccctctccgccacctcccccgccgcagccatcgacagagcgcccccgcacaagtgcctacatacggttacggcagagagtaagctatcccactgccgaatgctgccaacacttgggcatcctgtgcctgtgcagcaggtgtagcggcacgcgcgtgccttcactgctgccccatcaggacagtgtgccccccgcatccgcccgcgccacaacccccagcttttcttttgtccagaccgaaccgttccatccacccgagcaagcatctagcacccagcaggatcagggactactgaaccgtccttcagcattctcgactgtgcagtcttcgacagcaggtaataccttacgcaaccttagtctgggacctacgaggcggtcgctgggaggccctctgagttctcatccatccagatatcaccgtgaaatcgcgccgggcctcacaggctcagagtggacgagaacagtcctcagcttaaacagtaggagcgaagccgagagcatgccaccgccaagaaccagcgcaagttcagtgagcctgctgtccgtgttgcgtcaacaggagggcggcagccaggcttcagtctacaccagcgctacagagggcaggggattccctgcgagtggtctggccaccgagtctgacgggggcaacggctcttctcagaacaactcagggtcgatacgacacgaactccaatgcgacctacgccgcttcttccttgagtatgacaggctgcaggaattagatcagagcctatccggagaagccccacaaacgcaacaggcgcaggagatgttgaacaacaacatcgagagcgaacggcctggaccctcccatcagcctaccccgcactcctcagagaataacagcaatctgagccggggacaccttaacaggtgcagggcctgtcataacctgttgacttttaataatgacactcttcgttgggagcgcacaacccccaattacagctcaggcgaggcctcctccagttggcaagtaccatcaagctttgagtccgtgcctagctccggcagccagctccctcccctggaaaggaccgaaggacagacacctagctcaagccgtctggagctgtcatcctcagcttccccccaggaggagaggactgtgggcgtagccttcaaccaggaaacaggccactgggagagaatttacacacagtcatcacggtctgggacagtctctcaggaagctctccaccaggatatgcccgaagagtcctctgaagaagattcattacgccgactttccccagccgcgtactacgctcagcgcatgatccagtatctctctagaagagacagtattagacagcgctctatgcggtatcagcaaaacaggctgaggagctccacatccagtagtagctccgataatcagggtccaagtgtggaggggacagacctcgaattcgaagactttgaagataatggtgacagatctaggcacagggcaccgcgtaacgcacggatgagcgcgccctcactgggcaggttcgttcctcgcagattcttgttgcctgagtatctcccttatgccggcatctttcacgaacggggccaaccagggcttgctactcacagttcagtcaaccgggtgctcgccggcgcggtgatcggcgatgggcaaagcgccgttgcttccaatatcgccaacacaacgtacagactccagtggtgggattttaccaagttcgatctcccagaaatttccaacgcatctgtcaacgtgttggtgcaaaattgcaaaatttacaatgatgcctcttgcgatatctctgccgacggacagctgctcgccgcattcattcccagctctcagagagggtttccagacgagggaattctcgccgtttatagcctggcccctcacaatctgggtgagatgttatacacgaaacggttcgggcccaacgctatctcggtcagcctgtctcctatgggccggtatgttatggtcgggttagccagccggaggatcctgcttcacccctcaactgagcacatggtggcacaggttttccgattgcagcaggcacatggaggcgagaccagcatgaggcgagtgtttaatgtactctatcccatgcccgcagatcaacggagacatgtgtcaatcaacagtgcccggtggttgccagagccgggcctcggattagcttatggaactaacaaaggcgacctggtcatttgtaggcccgaggctctgaattccggcgttgagtactactgggatcaactgaacgaaacggtgtttaccgtccactccaatagcaggagctcagagaggcccgggactagccgcgcaacttggcgaaccgaccgagatatggggctcatgaacgccatcggccttcagcccagaaatcccgccacatcagtgacctcacagggaacgcagacgctagcgctccagcttcaaaatgccgaaactcagacagagcgggaagttccagagcccggaaccgctgcgagcggaccaggcgagggagagggctctgagtatggcgcatccggagaggacgcattaagcagaatccagcgtctgatggccgaaggcggcatgactgctgttgtgcagcgcgagcagtctaccacaatggcttccatgggcgggtttggaaataatatcattgtatcccacagaatccatcgatcatcacaaaccggcacagagcctggggctgcacatacaagctctccgcagccctcaacttcgaggggcctgttaccagaggcgggccagctcgccgaaagaggtctgagcccccgaacggcgagctgggaccagcctggcactcctggtcgcgaacctacccaaccaacactgccaagctcaagtcccgttcccatccccgtgtcccttccctccgctgaggggccgactttgcattgtgaactcacaaacaataatcatttattagacggggggtcctctcggggggacgctgcagggcccagaggggagcccagaaaccggtag

SEQ ID NO: 109336 - DNA, 3897 bp, Artificial Sequence
  Description of Artificial Sequence: Synthetic coding sequence
atgaaagtggtccctgagaaaaacgccgttcgcattctgtggggccgcgagagaggagctcgggccatgggagctcagcgcctgctgcaggaattggtggaagacaaaacaagatggatgaagtgggaggggaagcgggttgagctgcccgattctccgcgctccaccttcttgctggcttttagcccagataggaccctcctggcctcgacgcacgtgaatcataatatatacatcactgaagtcaagaccggcaagtgtgtacactcattgattggccaccggcgcactccatggtgcgtcacattccatcccacaattagcggcctgattgcctccggctgcctggacggcgaggtacggatttgggacctgcacgggggctccgaatcttggtttacagactcaaataacgctatcgccagcctggccttccaccctaccgcccaactcctgctcatagcaaccgccaacgaaatacatttctgggactggagccgacgtgagcctttcgcggtggtaaagacagcctctgaaatggaaagggtcaggctggtcaggtttgacccactggggcactatttgcttacagcaattgtgaacccctcgaatcaacagggggacgatgaaccagaaattccaatcgatgggaccgaactgtctcattatagacaaagagcattacttcagtcccagccagtccgacggaccccgttgctgcacaacttcctgcacatgctaagctctagatcatcggggattcaggtgggggagcagagcaccgtgcaggacagtgctaccccatcccctcccccccctcctccccagcccagtactgaaagacctcgcacgtctgcttacatccggctgcgccagagagtgtcttaccctacggcagaatgctgccagcatctcgggatactctgcctgtgttctcggtgctcgggtacacgtgttccatcactgcttccacaccaggattcagttccaccagctagcgcccgcgccaccacacctagtttcagtttcgtccagaccgagccattccatccccctgaacaggccagctccacacagcaagaccaggggctgctcaaccgtccgtcagcattctctaccgtgcagtcaagcaccgcaggtaatacactgagaaacctatctttggggcccacgcggcggtctctgggcggtcccctgtcaagccatccgtcgcgctaccaccgtgaaatcgcacccgggcttacgggcagcgaatggacccgaacagtactgagcctgaatagccggagcgaagccgaatccatgcctcctcctaggacttccgccagttctgtctcactgctgagtgtgttacgccagcaagaggggggaagtcaagctagcgtgtacaccagtgccaccgagggccgcggttttcctgcgtctgggctggccacagagtcagatggcggaaatggcagcagccagaataactctggctcaattagacacgagctccagtgcgatcttagacggtttttcttagagtatgatcgactgcaggagctggaccagagcctgagtggcgaagcaccccaaacgcagcaggcccaggaaatgcttaataataatatagagagcgagcgcccgggcccatcccatcagccaacacctcacagcagcgagaataacagcaacctgtctaggggacacctcaatcgctgtcgagcatgccataatctgctgaccttcaacaatgacaccttacggtgggaacgtaccactcctaactactcatctggagaagcttcatcaagctggcaagtgccgagctcattcgaatccgttcctagctccggttcccagcttcctcctcttgaacgaacagaaggtcagacgccatcatctagcagacttgaactgtctagctctgcttcaccccaagaagaacggactgtcggggttgcctttaaccaagaaacaggccactgggagcgcatctacacacagtcttctagaagtgggaccgttagccaggaggcactgcaccaggacatgccggaggagagttccgaagaggacagcctgagaaggaggcttctggagagctcgttaatttcacttagcaggtatgacggggccggcagccgggaacatccaatatatcctgacccagcacgactctcaccagccgcgtactacgcgcagaggatgattcagtacttatcccggcgcgacagtataaggcagaggtcgatgagatatcagcaaaatcgcttgagatcaagcacaagctcctcatccagtgacaaccagggaccgagtgtggagggtacagatttagaatttgaggacttcgaagataatggagacaggtcccgccatcgtgcgccaagaaatgctagaatgagtgccccttcactgggaagattcgtccccaggaggtttcttttgcccgaatatctgccgtatgcgggtattttccacgaacgcggtcagcctggactggctacacactccagcgttaacagggtgctggcaggagccgttataggggatggacagagtgctgtggctagcaatatagccaacaccacctacagactgcagtggtgggattttacaaaatttgacctcccagagatctcgaatgcctccgttaatgtcctggtacagaattgtaaaatctataacgatgcgtcatgcgatatcagcgctgatggccagctgctcgccgcctttataccatcatcccagcgcggattcccggacgaaggcatcctagcagtgtatagcctggcccctcacaatctgggcgagatgctgtatactaaaaggtttgggccaaacgcaatttccgtgagcctttccccaatgggtagatacgtgatggtgggattggcaagccggcggattctactgcatcccagcacagaacacatggttgcccaggtgtttaggctgcagcaggcgcatggtggtgaaacctcgatgagacgtgtattcaacgtgttgtacccgatgccagccgatcagagacgccatgtatccatcaactcagcccgttggctgcctgagccaggactggggctggcttacggcaccaacaagggcgacctagtgatttgccggccagaagctctgaattccggggtcgagtactactgggaccagctgaacgaaacagtattcaccgttcactcaaatagcagatcttcggagcggccgggcacctccagagctacgtggcgcacggatcgagacatgggactgatgaacgccatcgggctccagccaaggaatcccgcaacctctgtgacatcccaggggactcagactctagccctgcagttgcagaacgccgaaacgcaaaccgaaagggaagtcccagaacctggcaccgccgccagtgggcccggggaaggggaggggtcagaatacggggcctcgggcgaagacgcactttcccggatccagcggctgatggccgaggggggcatgacagcggttgttcagcgagagcagagcacgactatggcttcaatgggcgggttcgggaacaacatcatcgtctcacatcggatccataggagcagtcagaccggcacagagcccggcgcggctcatacctcttcgccgcagccgtctacctcgcgaggtctcctccccgaggccgggcagctggcagaaagggggctctcccctcgcaccgctagctgggatcagcctgggaccccagggcgggaacccacgcagcctactctgccctcatcatctcctgtgcctatccctgtgagcttgccctccgcagaggggcccactcttcattgtgaactgaccaataataaccatctgcttgacggtggcagttccaggggcgacgcggctgggcctcgcggcgaaccacgcaacaggtag

SEQ ID NO: 109337 - DNA, 75 bp, Artificial Sequence
  Description of Artificial Sequence: Synthetic coding sequence
atgaaggtggtgcccgagaagaacgctgtcagaattctgtgggggagagaaagaggggcccgggcaatgggttag

SEQ ID NO: 109338 - DNA, 3810 bp, Artificial Sequence
  Description of Artificial Sequence: Synthetic coding sequence
atgaaggtcgtgcctgagaagaatgccgtgcgcatcctctgggggcgcgagagaggggccagagccatgggtgcgcagcgactactgcaggaactcgtggaggacaaaactaggtggatgaagtgggaaggaaaacgagtggagctgcctgacagtccgcgaagcaccttcctgcttgctttcagcccagatcgcacgctcctcgctagcacgcacgtaaaccataatatctacatcacggaggtcaagaccggtaaatgtgtacacagtctcattggccaccggagaactccatggtgtgtcaccttccaccccaccatttctggtctcatcgctagtggatgccttgacggggaggtgagaatctgggatcttcatgggggctcagagtcctggtttacagatagtaataatgctattgcatcgctggcattccacccaactgcgcagttattgttgattgcaacagctaacgagatacatttctgggactggtcccggcgggagccttttgctgttgtgaagacagcatccgaaatggagagggtgcgattggttcgatttgaccctctgggccattaccttctaactgccattgtcaacccctctaatcagcagggagacgatgagcctgagatccctatcgacggcaccgagttgtctcactatcgacaacgagccctccttcagtcccagcccgtgcgccgaacaccgttacttcataacttccttcatatgctgtcaagccgttcctctggtattcaggtgggcgagcagagcactgtacaggattctgcaaccccaagccctccgcctcctcccccgcagccatccactgaacgtccgaggacctccgcatatatcagactgcgtcagcgagtgtcctacccaaccgctgagtgttgtcagcatctcggaattctgtgtctctgttctcgctgcagcggtactcgagtccccagcctgcttcctcatcaggattcagtcccccctgcaagcgctcgtgctaccacacctagcttttccttcgttcaaacagagccattccacccacccgaacaggcctcctccacgcagcaggaccagggcctgctgaataggccgagcgctttttctaccgtgcagagctccactgctggcaatactctgcggaatttatcattaggccccacccgccggagtttaggaggacccctgagcagccatccgagtaggtatcacagagaaattgccccaggcttaactggaagtgagtggaccaggaccgtcctttccctgaacagccggagcgaggccgagtcgatgcctccaccgaggacgtccgcgtcttcggtgtccctactcagcgttttgaggcagcaagaggggggctctcaagcgagtgtgtacactagcgcgacagagggcaggggttttcctgccagtgggttggcaacggagagcgacggaggcaatggttccagccaaaacaatagtggctctattcgacacgaactgcagtgtgacttaagaagattctttctggaatatgaccggctccaggagctggatcagagtctcagtggtgaagcccctcagacgcagcaagctcaggagatgctgaacaacaacatagaatccgagcgaccaggaccatcccaccaacctacaccccactcatctgagaacaattctaatctgagcaggggccacctgaacagatgtagggcatgccataatctgctgaccttcaacaacgacactctgagatgggagcgcactaccccgaattactcaagcggagaggctagctcatcatggcaggtgcctagctcatttgagagtgtaccgagctcaggaagtcagctcccacccctggaacggaccgagggccagacccccagttctagcagactcgaattaagttcctctgccagcccacaggaggagagaacagtcggagtggccttcaaccaggagacagggcactgggagcgaatatacacccagagctcaaggagcggaacagtgtcccaagaagctctccaccaagacatgcctgaggaatctagcgaggaggactccctgcgccggctctcacctgccgcctattacgcccagcgaatgatacagtacctctctagacgcgattcaatacgtcagcgctccatgcggtatcaacagaataggctgcgaagctctaccagctcctcttcgtctgacaaccagggccccagtgtggaaggcacagatcttgagtttgaagattttgaggataatggggaccgcagccggcacagagcaccaagaaacgcccggatgtcagccccaagtctaggtcgtttcgtgcctcgcagatttctgctcccagagtaccttccatacgctggaatcttccatgaaagaggacaaccagggctagctacccactctagcgtgaacagggttctggccggcgcagtgatcggggacggtcaaagcgcggtcgcctccaatattgccaataccacctacaggctgcagtggtgggacttcactaagttcgatctgcccgaaatttcaaatgcaagcgtcaacgtactcgtacagaattgtaaaatttacaatgatgcctcatgtgacatatctgctgatggccagctgctggccgcatttatcccatcctctcaacgcggatttcccgacgaagggatcctagctgtgtatagcctcgccccacacaacctgggcgaaatgttgtacacaaaacggttcggaccaaatgcgattagtgtctctttgtctcccatgggcaggtatgtgatggtagggctggcctcacggaggattctgctgcacccttcaacagagcacatggtcgcccaagtgtttcgactgcagcaggcccacggtggcgagacttctatgcggcgagttttcaatgtgctttacccgatgcccgccgaccagagacgccacgtatcaatcaattcagcgcgttggctgccagaacctggactgggtctcgcctacggcaccaataaaggagatctggtcatatgccgaccagaagcgcttaattccggagtggagtattactgggaccagttgaatgaaacagtttttactgtgcacagcaatagccgatcttctgagaggccaggaacttcaagggcaacttggaggactgacagagacatgggcttaatgaatgctatcggcttacagccgcgcaacccagccaccagtgttacaagccagggaacacaaacacttgccctgcagctgcagaacgcagagacacagacagagagggaagtccctgagccagggacggcagcctcgggaccaggtgagggagaagggtcggagtacggcgcctcaggagaagacgctctttctcggatccaacgactcatggcggaaggagggatgaccgctgtggtgcagagagaacaatcaaccacaatggcttccatggggggttttggcaataatattatcgtgtcacatcggattcacagatcttcacagactggcaccgagccaggagcagcacacaccagcagtccacaaccctctaccagccgcgggctgcttcctgaggccgggcaattagctgagcgcggcctgtctccgcgtaccgccagttgggaccagcctggaactccaggtcgagagcccactcagcctactctccctagtagttcacccgtgcccattcccgtatccctgccctctgccgaaggacccacgcttcattgtgagctgacgaacaataaccatctgctggacggcgggagcagccgcggcgacgcggccgggccccggggagagccgcgcaatcgatag

SEQ ID NO: 109339 - DNA, 3717 bp, Artificial Sequence
  Description of Artificial Sequence: Synthetic coding sequence
atgaaggtcgtgcctgagaaaaacgccgtgaggattttatgggggcgtgaacggggggcccgcgccatgggagcccagcgcctcctgcaggagttggtggaagacaagactcgctggatgaagtgggagggcaagagggtggagttgccggacagccccaggtccacctttctgctcgccttttctcctgacagaacgctgttagcctctacgcacgtgaaccacaacatatacatcactgaagttaaaactggcaagtgtgtgcactctctaatcggacaccggcggactccttggtgcgtgacgttccacccaactataagcggcctcatagctagtggctgcctcgatggcgaggtgcggatttgggacctgcatggcggcagtgaatcgtggttcacagactcaaataatgccatagctagcctggccttccatcctactgcacagcttttactaatcgccactgctaatgaaatacacttttgggactggagcagacgtgaaccgttcgcggttgtaaaaaccgcgtctgagatggagagagtgcggctcgtgaggtttgatccactgggacactacctgttaaccgcgatcgttaatccctcgaatcagcagggcgacgatgagcctgaaatccctatcgatggaacagagctgtcacactatcgacagagagccctactgcagtcccaaccagtgaggcgaaccccacttctgcataattttcttcatatgctctcatccaggtctagcggaatacaagttggggaacagagcacagtgcaggattctgctactcccagccctcctcctcccccaccccaaccaagtacagagaggccaagaaccagcgcatacatccggctccgccaaagggtgtcgtacccgaccgcagagtgctgtcaacatctgggcatactctgcctttgcagcaggtgttctggtacacgggttccctccctactcccacatcaggacagtgtcccgccagcatctgcacgggccaccactccatctttttcttttgttcagacagaaccctttcacccaccggagcaggcaagcagtacacagcaagatcagggcctgctgaatagacccagcgcctttagcactgttcaatcctcaactgcaggcaacaccttgaggaatttgtctctcgggccaacacggcgcagtctgggcggacccctgtcgagccatcctagtcgctaccaccgcgagattgcaccaggattaaccggtagcgaatggacaagaaccgtcctcagtctcaatagtcggagtgaagcagagtccatgccgcctccccgaacttctgcatcaagtgtttctctattgtccgtcttgaggcagcaagaggggggcagccaggcctccgtttacacctctgcaaccgagggacgtggatttcccgcttccgggttggctactgagtctgacggcggaaacggatcctcccaaaacaacagtggatctattcgacatgagcttcagtgcgatcttcgccggttttttctggaatatgaccgcctacaggaactggaccaatcattgagcggggaagccccccagacccagcaggctcaggagatgttaaacaataacatagaatccgaacgtcccgggccctctcatcagcccacccctcattcctcagagaataattcaaatctcagccgaggtcatctgaataggtgcagagcctgccataacctgttgacattcaataacgacacactacgctgggagcggacaacacccaattatagcagcggcgaggcaagctctagctggcaagtgcccagctctttcgaaagcgtcccgtcctccgggagccagctcccgccccttgagcggaccgagggccagacccctagcagttcccggctagagctgtcttctagtgccagcccccaggaggagagaactgtgggcgtggcttttaaccaagaaacagggcattgggagagaatctatacacagtcctctaggtcaggtactgtgtcccaagaagccctgcatcaagacatgcctgaagaatcttccgaggaagattccttgcgccgccgcctcctggaatcatccctgatcagcctgagtagatacgacggggcaggctcgcgggagcaccctatttaccctgatcctgcaagagataatggcgacaggtcccgacaccgggcaccacgaaacgccagaatgagtgcaccgtccctggggaggttcgtgccacgaaggtttttactacccgaatacctgccttatgctggaatcttccacgaaagagggcagccggggctagccactcattcctccgtgaaccgagtgctcgctggagccgtgatcggtgatggccaatctgcagtcgcctcaaatattgccaataccacatacaggctgcagtggtgggatttcacaaaattcgacctccctgaaatctccaacgccagcgttaacgtgttggtgcagaactgtaagatatataacgacgctagctgcgacatctctgccgacggccaactattggctgccttcatccccagctctcagcggggattccctgacgaggggattctggctgtgtatagcctggctccccacaaccttggcgagatgctgtacactaagcggtttggccctaatgccattagcgtgtctctaagtcccatggggcgctacgttatggtaggtctagcatctagaagaattctcctgcatccaagcactgagcacatggtggcccaagtcttccgactacaacaggcacatgggggagagacatcaatgagacgcgtgttcaacgttctgtatccaatgcccgcagaccaacgaaggcatgtgtctataaattcagcacgctggctgcccgagcccggactggggttagcttacggtaccaataagggagatctggtcatctgtcgaccagaggctctcaactcaggagttgaatactattgggaccaactaaacgaaacagtgtttaccgtgcattcaaacagccgctcttccgagaggccgggtacgtctcgcgccacatggcggactgaccgtgacatgggcctaatgaacgcaatcggacttcagcctcgaaacccagctacctctgtgaccagccaaggaacccagaccctcgctctgcaattgcagaacgccgagacacagaccgagagggaggtccctgaacctggcacggcggcaagcggcccgggcgagggagagggtagcgaatatggcgcctccggggaagatgctctgtctagaatacagaggcttatggcagaaggtgggatgaccgcagtggtgcaacgcgagcaatccacaacaatggcgtccatgggcggattcggcaataacattatcgtatcccacaggatccaccgttccagccaaaccgggactgaacctggcgccgctcatacctcctcaccacagccaagcacgtcacgtggactgctgcctgaggcaggacagttggcagagcggggactgtcccctaggaccgcgagttgggaccagcctggcaccccaggtcgggaacccacgcaacctaccctaccaagctcgagcccagtaccgatacccgtttcgctgccctcagccgaggggccaacccttcattgtgagctcaccaataataaccatctgctggacggcggctccagtaggggggatgcagcaggaccacgcggagagcctcgtaacagatag

SEQ ID NO: 109340 - DNA, 3540 bp, Artificial Sequence
  Description of Artificial Sequence: Synthetic coding sequence
atgaaggttgttcccgagaaaaacgccgtgcggattctgtgggggcgcgagcgcggggcacgcgctatgggcgcacagcgcctgttacaggagcttgtcgaggataaaacgagatggatgaaatgggagggtaagagggtggaattgcctgacagccccagatccacattcctcctcgccttttcacctgatagaactttgctggccagcactcacgtgaaccacaacatttacattactgaagtcaaaactggtaagtgcgtgcactctctgatcggtcacaggaggacaccttggtgcgtgactttccatcctaccatcagtggattgattgccagtggctgtctggacggggaagtcagaatttgggatcttcacggagggtcagaatcatggttcacagattccaataacgcaatcgcctccctcgccttccatcctacagcacagctgctgctaatcgccaccgccaatgagatacatttctgggattggagtagacgagagcctttcgccgtagttaagacagcttctgagatggagcgcgtgcgcctggttcggtttgaccctctgggacactacctactaacagccatagtaaacccaagtaatcaacagggagacgatgaacctgagatcccaattgacggcaccgaactgtcccattatcgacaaagggctcttctgcagagtcaacccgtgcggaggacccctctcctccacaactttctccatatgctcagctccagaagcagtgggattcagactgagccctttcatcccccggaacaagcgagttccactcagcaagatcagggactcctcaaccggccttcagctttttcaaccgtgcaatcttccacagccggcaataccctgaggaatctgtctctcgggccaacccgtagatcactgggaggcccgttgtccagtcatccctctcggtaccacagagaaatcgcccctggacttactggctccgagtggactcgcaccgtgctgtccctgaactcccggagtgaagcagaatccatgccaccaccacgcacttccgcctctagcgtgagcctacttagcgtcctccgacagcaagaaggaggctcgcaggctagtgtgtacactagcgctaccgaggggcggggtttcccagcatctggcttggctacagaatcagacggggggaacggttcatcacagaataactcaggctcaattcgacacgagttacagtgtgacctgcgtcgcttctttctcgagtatgataggctccaggaactggaccagtccttgtcaggggaagccccccagacccagcaagctcaggaaatgctgaataacaacatcgagtctgagaggcctggacccagtcaccaacccactccacactcctctgaaaataactctaacctctcacgggggcatctgaaccgatgccgtgcctgccataacctcttgaccttcaataacgataccctacgttgggagagaactacacctaactacagcagcggcgaggcttcgagctcatggcaggtcccctcctctttcgagagtgtcccatcttcaggtagccagctgccaccactagagcggaccgagggccagaccccttcatcctctaggctggagctgagctcttctgcgtcaccgcaggaagagaggacagtgggcgtagcttttaaccaggagacagggcactgggagcgcatttatactcagagttcccgatccgggaccgtttcgcaagaggccctgcaccaagacatgccagaagaatccagtgaagaggactctctgaggaggctgtcccctgcggcttactatgcccagcgtatgattcagtatctgagccgcagggattccattagacaacgctccatgaggtatcaacaaaaccgtctgcgatcatcaacatcctccagtagcagtgacaaccagggcccatccgtggaggggacagacctagaatttgaagactttgaggataatggagaccgcagcagacatcgcgctccgagaaacgcccgaatgagtgcgccgtctctcggccgctttgtccctcgtagattcttgctacctgaatacctaccctatgccggaatctttcacgaacgcggccaaccaggcctcgcgacacatagctcggtgaaccgcgttctggcaggggccgttattggggacggacagagtgccgtggctagcaacatcgccaataccacctacaggctacaatggtgggatttcacgaagtttgacctgccagagatttccaacgcctcggtaaatgtactggtccaaaattgtaagatttataatgatgcgagttgtgacatcagtgcagatggacagctgctggccgctttcattccttcatcgcagcgaggtttcccagacgaaggaattttggcagtgtacagcctggctccccacaaccttggcgagatgttgtatacgaagaggtttggacctaacgccatcagcgtgtcactgtctccaatgggacgttacgtcatggtaggccttgccagcaggagaatactgctgcaccccagcaccgagcacatggtcgcgcaggtgtttagactacagcaggctcacggcggcgagaccagcatgaggagagtgtttaacgtgctataccctatgcctgctgaccagaggcggcatgttagcatcaactctgcacgctggctccccgaacccggcctgggacttgcgtatgggaccaataagggagaccttgtaatttgtcgccccgaggcgttgaactccggggtcgagtactattgggatcagttgaacgaaaccgtcttcactgtgcactcaaactctcgttcgtctgaaagacccggcacaagtagagccacatggcgaactgacagagacatgggcctgatgaatgccatcggcctacagcctcgcaaccctgccactagcgtaacctcccagggaacccagactttggccttacagctgcagaatgccgaaacccaaaccgagcgcgaggtaccagagccgggcacagctgcatctggacccggagagggtgaggggtcagagtatggcgcatcaggagaggatgcacttagcagaattcagaggctgatggctgaaggggggatgaccgctgttgtgcagcgagagcagtcaactactatggcctcaatgggggggtttggcaacaacattatcgtttctcatagaatccaccgctcttctcagaccggaacagagcctggggccgcccacacaagctcaccacagccttcaacatctagaggcctgctcccggaggccggccagttggccgaacgaggtttaagccctagaaccgcatcctgggatcagcctggaaccccggggagagagcctactcagcctactctgcccagtagctcccctgtgcctatccccgtgagcctgccctcagccgaaggccccactctgcactgcgaactgacaaacaataatcacctgctcgatggtggctcttcccgaggcgatgctgctggtcccaggggagagcctcggaatagatag

SEQ ID NO: 109341 - DNA, 1947 bp, Artificial Sequence
  Description of Artificial Sequence: Synthetic coding sequence
atggagaaggccaggcgcgggggagacggcgtccctcgcggacctgtgctccacatcgtggtggtaggcttccatcacaaaaaaggctgccaggtggagtttagttacccccccctcattcccggagacggccatgatagtcacaccctgcctgaggaatggaagtatctgcctttcctggccttgcctgatggcgcccacaactaccaggaagacacagtgtttttccatttacctccgcgtaatggcaatggcgctactgtttttggaatttcttgttatcggcagatcgaagcgaaagccctgaaggttcgccaggcagatattaccagggaaaccgtgcagaagagcgtgtgcgtcctctctaagctaccactgtatggtctgctgcaggccaagttgcaactgatcacccatgcctactttgaggagaaagatttcagccaaattagtattctaaaggaattatacgagcatatgaactctagcttgggcggcgcctctcttgaagggtcacaggtttacctgggcttgagtcccagggatttggtgctgcatttccggcataaggtgctgattctgttcaagctcatattgttggagaaaaaagtgttgttctacatttcccctgtcaataagctcgtgggcgccctgatgactgttctgagcctcttcccaggaatgatcgaacatggcctgtcagattgctcgcagtatagacctcgaaaatccatgagtgaggacggcgggctacaggaatccaatccttgcgcagatgactttgtctctgcctccactgcggacgtgagccacactaaccttggaaccattcggaaagttatggccggtaaccacggagaggatgccgctatgaagacggaagagccgctgttccaagtggaggatagctcaaagggacaggagccgaatgatacaaatcaatacttgaagccccctagcaggccatcgcctgactcaagtgagagcgactgggaaaccctggacccaagtgtcctggaggacccgaatttaaaggaacgggagcaacttgggagtgatcaaactaatttatttccaaaggactcggtcccgagtgagtccctgcctataacggtgcagcctcaggccaacactggccaggtggtcctcataccaggtttaatttctggcctggaagaggaccaatacgggatgccgttggctatttttaccaagggttatttatgtcttccatatatggcgctgcagcagcatcatctccttagcgatgtcaccgtcaggggtttcgtcgccggcgctaccaatatcctgtttaggcagcaaaagcacttgagcgatgccattgtggaggtggaagaggccctcattcagattcatgacccagaactgcggaagctgctgaaccccacaacagcagatcttagatttgccgattacctcgtgagacacgtgactgagaatagggatgacgtttttcttgatggcaccgggtgggaaggcggagacgagtggattcgggcacagttcgctgtgtacattcatgctctgttggccgctacgctccaactcgataacgagaaaatactgtctgactatggaaccacattcgtgacagcctggaagaacacccataattacagggtctggaactccaacaagcacccagctctcgcagaaatcaatcccaatcacccgtttcaagggcaatactcagtatcagatatgaagctgcgattctctcatagcgtccagaatagcgaacgggggaaaaaaattgggaacgtgatggtaactacatcccgtaacgttgtgcagaccgggaaagctgtcggacaaagtgtgggcggtgccttttcgtctgccaagactgccatgagttcctggctttctacatttacaacctcaacaagccaatcactaaccgagcctcccgacgagaagccctag

SEQ ID NO: 109342 - DNA, 1773 bp, Artificial Sequence
  Description of Artificial Sequence: Synthetic coding sequence
atggaaaaagctcgacgcggaggagacggcgtgccccgcggcccggtgctgcatattgtggtggtaggcttccatcacaagaaagggtgccaagtggaattcagctatccacctctcatcccgggcgatgggcacgactcacacactctgcctgaagaatggaagtatctgccgtttctggccctccccgacggtgcccataactaccaggaggacacagtgtttttccacctgcctccacgcaatggcaatggcgctaccgtgttcggcataagctgttaccggcaaattgaagccaaggcgttgaaggtgcgacaagccgacattacgagggagacagttcagaagtcggtttgcgtgctcagcaaactccccctgtatggcctcctgcaggcaaaacttcagctcattacccatgcatacttcgaagagaaggatttctcgcagatttctatccttaaagagttatatgaacatatgaactctagcctggggggagcatccctggaggggtcccaagtgtatctcggactgagcccgcgagacctagtcctccattttcggcataaagtattgattttgttcaaactgattttactagaaaagaaagtgcttttctacatctccccagtcaataagttggtcggcgccctgatgactgttctgtccttgttccctgggatgatcgaacacgggttaagtgactgctcacagtaccggccacgcaagtcgatgagcgaggatgggggcctgcaggaatctaatccctgcgcagacgacttcgtgagtgcttccaccgcggacgtcagccatacgaacctgggaacaatccgcaaagtgatggcagggaatcacggagaagacgcggctatgaaaactgaggaaccccttttccaggttgaagacagtagcaaaggtcaggaacccaacgacacgaatcaatacttaaagcctccctccagaccctccccggactcttccgagtccgattgggaaacccttgatccatctgtgctagaggatcctaacctaaaagagcgcgaacagctgggcagcgatcagacaaatctttttcctaaggactctgtgccctctgagtcactgccgataactgtccaaccccaggctaacacagggcaggtggtacttattcctggcttgatttctggcctggaggaggaccagtatggaatgcctctggctatattcactaagggttacctctgcctcccatacatggctctgcagcagcaccatctgctgtccgacgtcaccgtccgtggattcgtagccggtgccaccaacatcctgttcaggcagcagaagcacctgtcagatgcaatcgtcgaagtggaggaggcgctgattcagattcacgatcccgagttgcgaaagcttttaaaccccacaacagccgacttgcggtttgcagattacctcgtacgacatgtgaccgagaatagggacgacgtgttcttggacggaactggatgggaaggaggcgacgaatggatccgtgcccaatttgccgtgtacatccatgcgcttctggctgctacgctgcagcttgtgctgttccggatagtgaatgtgaaaaagattggcaacgtgatggtcacaacatcccggaatgtggtgcagactggaaaagctgtgggtcagtcggtggggggcgcattcagcagcgcaaagacggccatgtccagctggctttctacttttacaacatcgacctctcagtctcttaccgagccgccggatgaaaagccatag

SEQ ID NO: 109343 - DNA, 1392 bp, Artificial Sequence
  Description of Artificial Sequence: Synthetic coding sequence
atggagaaggcacggagggggggagacggcgtcccacgcgggccggttttgcacatagtcgtggtgggtttccatcacaagaaggggtgccaagttgagttttcctatccgcctctgataccaggcgacggacacgactcacacacccttccagaggagtggaaatacctccccttcttggccctgcctgatggagcacataactaccaggaggatactgttttttttcacctcccaccccggaacgggaatggggccacagtctttggtatctcatgttacaggcaaattgaggcaaaggctctaaaagttaggcaggccgacattacacgggagactgtgcagaagagcgtctgcgtgctctctaaactgcctctttacgggctattgcaggcaaagcttcagctcatcactcatgcttactttgaggaaaaggacttctcacaaatcagcatactgaaagagttatacgagcatatgaatagctcgctcggaggagcttctctggaggggagccaggtttacctcggtttaagtcctcgagacctcgttctgcacttccggcacaaagtcctgatcctgtttaagttgattctgctcgaaaagaaggtgcttttttacatttcccctgtcaataaattagtgggtgctctgatgaccgtactctccctgttccccggcatgatcgagcatggattgagcgactgttctcagtatagacctagaaaaagcatgtccgaggatggggggctccaagagtcaaatccttgcgcagacgacttcgtgtccgctagcacggctgacgtttcccacacaaatctcggaaccatacgcaaggtgatggctggtaatcacggggaggacgctgctatgaaaaccgaagagccacttttccaggtggaggatagctccaagggacaggaaccgaacgatacaaatcaatatcttaaacccccctcccgccctagccctgatagtagcgagtcggactgggagacactggatccaagtgtcttagaggaccccaatctgaaagagcgggagcaactcggttcggaccagaccaacctgtttcctaaggactctgtcccgtcagaatccctgcctattacggtacaaccacaggctaacaccggacaggtcgtgctgatccctggcctgattagcgggctcgaagaggaccagtatggtatgcccctcgccatcttcacaaagtgcacacaggacgtgttgcctcaggcaaaccactccttcaaattcctgatcaccgatcgtaggattactcccagacccttgcggcgaaggctggtgagtgcgacgctcacaaacatgctccaggagaagagctgttggaaaaaacacattaagtgccgcaggagggtccagaagtag

SEQ ID NO: 109344 - DNA, 2532 bp, Artificial Sequence
  Description of Artificial Sequence: Synthetic coding sequence
atgtcctcagctatgctcgtgacatgtcttccagacccttcgtcttcctttagagaagatgccccaaggcctccggttcccggcgaggaaggcgaaacacccccctgccaaccaggggtcggaaaaggtcaagtgaccaagccaatgcctgtatctagcaatacccggcggaatgaggacggactgggtgagccagaaggacgggccagtcccgacagcccccttactcgctggaccaaatctctccactcactgctgggagatcaggacggcgcttacctgttccggacattcctggagcgcgagaagtgcgtcgatacattggatttctggtttgcctgtaatggatttcgtcagatgaacctcaaagatacgaagacccttagggtcgcgaaggcaatatacaagagatatattgaaaacaatagtattgttagtaaacaactaaaacccgctacaaaaacctacatccgtgatggcattaaaaagcagcagatcgactcaatcatgtttgaccaggcccagacagaaatccagagcgttatggaggaaaatgcataccagatgttcctaacgtccgacatttatttggagtacgtgcgctcaggaggtgaaaataccgcatacatgagcaatggaggcttgggaagcctgaaagttgtgtgtggatacctgcctactctcaatgaggaagaggagtggacttgtgctgactttaagtgcaaactgtccccaaccgtcgtcggtctgtcttctaaaactctccgcgctaccgcttcggtgcggtcgacagaaactgtcgactccggttacaggagctttaagcggtccgacccggtaaacccctaccacattgggtccggatatgtgtttgcccccgccacaagtgctaacgactccgaaatctcttctgatgctcttactgatgactcaatgtccatgaccgacagtagcgtcgatggtatccctccttatcgggtcggatccaagaaacagcttcagcgggagatgcatcggtcagtgaaagcgaatgggcaggtatcactgcctcacttccccagaactcacaggcttcccaaggagatgaccccagtcgagccagccacatttgcagcagaactcattagcagactggagaaactcaaactggaactcgagagccggcactctctcgaggagcgcctccagcagattcgcgaggatgaagaacgggagggcagtgagctcaccctcaacagccgggagggtgctcctacgcagcaccccctctccctcctcccatccggctcctacgaagaggacccccagacgatactggatgatcatctctcaagagtactcaaaaccccaggatgtcaatctccaggcgtcggcagatattcaccacgctcccgatcaccagatcaccaccaccaccaccatagtcagtaccactccctcctgcccccaggagggaagctcccgccggctgccgcatcacctggagcctgtcctctcttgggtggcaaaggttttgtcaccaaacaaactaccaaacatgttcatcatcattacatccatcaccatgctgtgccaaaaacaaaagaggagatcgaagccgaagccacgcagcgggtgcactgcttttgtcccgggggctccgagtattattgctactccaagtgcaagtcgcattcaaaggcacctgaaactatgcccagcgaacagtttggtggttctagagggtcaaccctgcccaaaaggaatggcaaggggaccgagcccgggctcgctctgcctgcccgcgaagggggcgcaccgggcggagccggagccctgcaactgccccgcgaagagggcgatcgctctcaagacgtgtggcaatggatgctggaaagtgaacggcagagtaagcccaagccccacagcgcccagagtaccaaaaaagcatacccccttgagtccgcccgcagcagtcctggggagagagcatcccgccatcatctctggggtggaaattctggccatccgcggaccaccccaagagcgcatctattcactcaagatccagccatgccacccctcacgccgccaaacacactagcacagttggaagaggcctgtcgccggctagccgaggtgagtaaacccccgaagcagcgctgttgcgtggccagtcagcagagagatcggaatcactccgccaccgttcagacaggggcaaccccatttagtaacccttctctggctcccgaggatcacaaagagcctaaaaaactcgctggtgtgcacgcactgcaggcatcagagctggttgttacctattttttttgcggcgaggagataccctataggcgcatgctgaaagctcagtccttgaccctagggcattttaaggaacagctgtccaaaaaaggtaactaccgctactatttcaagaaggcaagcgatgaattcgcctgcggagccgtctttgaagagatttgggaagacgagacggtgctgccaatgtatgagggccgcatactgggcaaggtcgaaagaatcgactag

SEQ ID NO: 109345 - DNA, 2337 bp, Artificial Sequence
  Description of Artificial Sequence: Synthetic coding sequence
atgagctctgccatgctggtcacgtgcctgccagatccttccagtagcttcagggaagacgcccctcggccccccgtccctggagaggaaggtgaaacccctccctgtcagcctggagtgggtaaaggccaggtaacaaagcccatgcccgtgagcagtaataccagacgcaacgaggacgggttgggcgaacctgagggacgggcctcacctgacagccctctgactagatggacaaagagcctacatagcctactcggcgaccaggatggcgcgtacttgtttcggacattcctggagcgggaaaagtgtgtagacacgcttgatttctggtttgcctgcaacggctttagacagatgaacctgaaggatacaaagaccctgagagtggctaaggctatctataagagatacatagaaaataatagcatagttagtaaacaactgaaacctgctactaaaacttatatccgcgatggtatcaagaagcagcagatcgattcaataatgttcgaccaggcccagaccgaaatacagagcgtgatggaggaaaatgcataccagatgtttctgaccagcgacatttatctggagtacgtgcgatcaggcggcgaaaataccgcttatatgagtaatggcggattagggagcctgaaagtagtgtgcggttaccttcccaccctcaacgaggaggaagagtggacatgtgcagacttcaagtgtaaactctcacctaccgtagtcgggttgagcagtaaaacgttacgggccacagcaagtgtcagatcaactgaaactgttgactccggctaccggtcgttcaagcggtcagacccagtaaatccataccacattggatcagggtatgtgttcgctcccgcgacttccgctaatgatagcgaaatttcctctgatgctctgaccgatgactccatgagtatgaccgacagctctgtcgacggaattcctccatatcgggtgggcagtaagaaacaactccaacgcgagatgcacaggtctgtaaaggctaacggtcaggtttctctgccccattttccgcggacacatagactgcccaaagaaatgactccagtggaacctgccaccttcgccgctgagttaatttcacgtcttgaaaagttaaagctggaactcgagtctcgacacagtttggaggaaaggttacaacaaattcgggaggacgaagaaagagagggatccgaactcactttgaactcacgcgagggcgccccaacacagcatcccctgtcgctactgccaagcggctcatacgaggaagatccccagacgatactggatgaccatctatctcgggttctgaagactccaggttgtcagtctcccggggtcgggcgctatagcccaagatcaagatctcccgatcaccatcaccaccatcacagccaataccattctttactacccccagggggtaaattgcccccagcagccgcttctccaggcgcatgtcccttactggggggcaagggctttgttaccaagcagaccactaagcatgtccaccaccactatatacaccaccacgccgtgccaaagacaaaggaagagattgaggcggaggcaactcagcgagtgcactgcttctgcccgggcgggtccgagtattattgttattcaaagtgcaagtctcacagcaaagcccccgagaccatgccctccgaacaatttggtgcccagtcaacaaagaaggcctaccccctcgaaagcgccaggagtagtccaggagagcgcgcctcgcggcatcacctttggggcggcaacagcggacacccccggacaaccccccgggcccatctctttacccaggatcccgccatgcccccactgaccccccctaacacccttgcgcagctcgaggaagcatgtagacgactggccgaggtgagtaaaccgccaaagcagagatgctgcgttgcctcgcagcagcgggacaggaatcattcagccacagtgcagacaggagctacccccttttcaaatcccagcctcgcacctgaggatcacaaagagcccaaaaaactcgcaggcgtacacgcacttcaggctagcgaactcgtcgttacctactttttctgcggagaggagattccatatcggcgcatgcttaaagcacagagtctaaccttggggcactttaaggagcagctgagtaagaagggaaattaccggtattatttcaagaaagcgagcgatgagttcgcctgcggagccgtgtttgaagagatctgggaagatgagaccgtgctgcctatgtacgagggccgaatcttgggcaaagtcgagcgtatcgactag

SEQ ID NO: 109346 - DNA, 483 bp, Artificial Sequence
  Description of Artificial Sequence: Synthetic coding sequence
atgtcctccgcgatgctggtcacttgcctcccagacccctcttccagttttcgtgaagacgctcctcgccctcctgtgccaggcgaggagggagagacccccccgtgccaaccaggcgttggaaagggtcaggtcaccaaacccatgcctgtgtcgtctaacaccaggcgaaatgaggacggcctgggggaaccggaggggcgcgcatctcccgatagcccactcacacgttggacgaaatctctccacagccttcttggagatcaggatggagcttacctgtttcgtacttttcttgaacgtgagaaatgtgtcgacactctggacttctggttcgcttgtaacggattccggcagatgaatttaaaagataccaaaacgttgcgcgtggtcaacgatttctgccatgatattttgttctatctctattgtaagctgtgcatcatcaagagctccttcaaggaaaactacctggtgcagtag

SEQ ID NO: 109347 - DNA, 921 bp, Artificial Sequence
  Description of Artificial Sequence: Synthetic coding sequence
atgtccgaggttaccaggtcgctcctgcagcgctggggcgccagttttcgtagaggcgctgattttgactcctggggacagctggtggaggcaatagacgagtatcagatcctcgctaggcatttgcagaaagaagctcaggctcaacacaataactcagaattcaccgaggaacagaaaaagaccatcggtaagatcgcgacttgtctagagcttagatccgccgctttgcaaagcacgcagtcacaggaggaattcaaactggaggacttgaaaaagctcgagcctatcctgaaaaacatcttaacgtacaacaaagagtttccctttgatgtgcagcctgtccctctgagacgtatcctggcccctggcgaggaggagaacttggagttcgaagaagacgaggaggagggcggcgcgggtgctggttctcctgattccttcccggctagagtgcctggtacgctgctccctaggttaccctctgaaccaggcatgactctcctgaccataaggatagaaaagatcggcctcaaggatgctggtcaatgtattgatccttacattaccgtgtccgtcaaagatttgaatgggattgaccttacccctgtgcaagacaccccagtggctagccgaaaagaggatacttacgtgcacttcaacgtcgacattgaattacaaaagcacgtggaaaagctcacaaagggcgcagcaatttttttcgagttcaaacactacaaacctaagaaacgattcaccagcacaaaatgttttgctttcatggagatggacgaaatcaagccaggtcctatagtgattgagctctataaaaagccaactgatttcaaacggaagaagctgcagctcctcaccaaaaagccgctctacctgcacctgcaccagaccttgcataaggagtag

SEQ ID NO: 109348 - DNA, 675 bp, Artificial Sequence
  Description of Artificial Sequence: Synthetic coding sequence
atgtccgaagttacccgctccctccttcagcggtggggtgctagtttccgtcggggcgccgactttgattcatggggtcaactggtggaggccatagacgagtaccaaatcctggcacgacatctccagaaggaagcccaggcacaacataataacagtgagttcacggaagagcaaaaaaaaaccatcgggaagatagcaacttgtctcgagctgaggtccgccgcccttcagagcacccagtctcaggaagagtttaagctggaggatctgaagaagctcgaacccattttaaagaatatattaacctataataaagaattcccctttgacgttcagccggtgcccctgcgcagaatattggcgcctggagaggaagaaaatctcgagtttgaggaagatgaggaagagggtggcgccggggctgggtcacctgactcattccccgctcgggtgccgggagcagctatcttttttgagttcaagcattataagcctaaaaaacgattcactagtactaaatgctttgcgtttatggaaatggacgagatcaaaccaggacccatagtaattgagctgtacaaaaaacctaccgattttaagaggaagaagctgcagttgctgaccaaaaagcctctgtacctgcacctccaccagacactccataaagaatag

SEQ ID NO: 109349 - DNA, 849 bp, Artificial Sequence
  Description of Artificial Sequence: Synthetic coding sequence
atgatcgctaccgaagccgtcgtccgcgctgcccagggactggctcgtcaccttcaaaaagaggcacaggcccagcacaacaacagtgagtttaccgaagagcagaagaagacgataggaaaaatcgccacttgtctggagctacgctcagctgccttacaaagcacccaatcgcaggaagagttcaagctggaggatctcaagaagttagaacccattctgaagaatattctgacatataataaagagttccctttcgacgtgcagcccgtgccccttcgacgcatcctggctcctggtgaagaggagaatctcgagttcgaagaggacgaggaggaaggaggggccggcgccggttccccagacagctttccagcaagggtgcccggaactctgctaccccgcctcccctccgagcccggcatgacactcctgacaatccgcattgagaaaataggactgaaggacgcaggccagtgcattgacccttacataaccgtatcagtaaaggacttaaacggaattgacctgactcccgtccaggacacccctgtggcgtcacgcaaagaggacacatatgtgcacttcaatgttgacattgagcttcaaaagcacgtcgagaagctcactaagggcgccgccattttctttgaatttaaacattacaagccaaaaaaaaggtttactagcactaaatgtttcgctttcatggagatggatgaaatcaagcccggtccaattgttatcgagctgtacaaaaaacctaccgattttaagcgaaagaagcttcagcttctcaccaaaaagccactgtatttacatctgcatcagactttacacaaggagtag

SEQ ID NO: 109350 - DNA, 2685 bp, Artificial Sequence
  Description of Artificial Sequence: Synthetic coding sequence
atggcgtggcgctgccctcgtatgggtagggttccactcgcctggtgtttggcattgtgcggatgggcctgcatggccccccgcggaacccaggctgaagagagcccttttgtgggaaacccgggcaacatcacaggagctaggggtctgacaggtacattgaggtgccagctgcaggtccagggcgaaccgccggaggtgcattggttaagggatgggcagattttggaactggctgactcaacacagacacaagttcctctcggcgaggatgaacaagatgactggatcgtagtgtcccagctgaggatcacatcccttcagttgtccgatacagggcaataccagtgcctggtgtttctcggacaccagacgtttgttagccagcccggatacgttggtctcgagggcctcccgtatttcctggaagaaccagaagacagaaccgtagcggccaacacacccttcaatctgtcatgtcaggcccagggacctccagagccagtggacctgctatggctccaggatgcagttcccctggcgaccgctcctggacatggcccccagcgctccctgcacgtccctggactgaacaagacctcaagtttcagttgtgaagcccacaatgctaaaggcgtcactacctctcgtaccgccactatcaccgtcttacctcagcagccacgcaatctgcacctggtgagtaggcagccgaccgaactagaggtagcctggacacctggcctgagcggcatctacccactgacccactgtacactgcaggctgtgttgtccaacgacgggatgggcatccaggcaggtgagcccgacccacctgaggaacctctaacttcacaggcgagcgtccctccacatcagctacgcctgggatcactccacccacatacaccctatcatattagagttgcttgcaccagctcccagggccctagctcttggactcactggttgccagttgaaactcccgaaggggtgccacttggcccaccagagaatatcagcgccacacgcaatggttctcaggccttcgtccactggcaggagccgagagctccattacagggaaccctcctagggtatagactggcttaccagggtcaagacacccctgaggtactcatggacattggcctccggcaagaagtgacactcgagctccaaggggatggcagcgtgtccaacctgaccgtctgtgttgcagcatacactgccgctggcgatgggccctggtctttacctgttccactggaggcctggcggcccggtcaggcccagccagtgcaccagctcgtgaaggaaccttccacccccgctttctcctggccgtggtggtacgtgttgctaggcgccgtggttgcggcagcatgcgtgctcatcctcgctctcttcttggtccataggcgcaaaaaggaaactaggtacggggaggtgtttgaacctaccgtcgagcggggcgagctcgtcgtccgctacagagtcaggaagtcctatagcagacgaactaccgaggctactctgaacagtctaggaatttctgaagagctaaaagagaaattacgtgacgtcatggtggaccgccataaggtagctctggggaaaacactcggtgaaggcgaatttggagctgtcatggaggggcaattgaaccaagatgacagtattctcaaagtagccgtcaaaaccatgaagatcgctatttgcacgcggtcagagttggaagacttcctgagcgaagcagtgtgtatgaaagagttcgaccatccaaatgtgatgaggctgatcggggtgtgttttcagggatcggaaagagaaagcttccctgcgccagtggtaatcttgcctttcatgaaacacggcgatttgcatagcttcctgctgtacagcaggcttggggaccagccagtgtaccttccaacacagatgctggtgaagtttatggctgatatagcctcaggtatggaatacttgagcactaaaaggtttatacaccgggatttggctgccagaaactgtatgttaaatgaaaatatgagcgtgtgtgtggccgacttcggcctgagtaagaagatatacaacggcgattattatcgccagggacggattgccaaaatgcccgtgaaatggattgctattgagagtcttgctgacagagtgtatacatcaaaatccgatgtgtggagcttcggcgtgacgatgtgggaaattgctacccggggacagacaccctaccccggcgttgagaacagcgaaatttatgattacttgaggcaaggcaataggctcaagcagcccgctgactgtctcgacggcctgtatgcactgatgtctcggtgctgggaacttaatccacaagacaggcccagcttcaccgaactgcgggaagatctggagaacaccttaaaagctctgccgcccgcccaagaaccagatgaaatcctttacgttaatatggacgagggggggggctaccctgagcccccaggggcggccggcggcgccgaccccccgactcagcccgatccaaaggactcttgcagctgcctgacggcagcagaggtccaccccgcgggcagatacgtgctctgccctagcaccactcctagcccagcccagcccgctgaccggggcagcccggctgcacccggccaggaagatggcgcttag

SEQ ID NO: 109351 - DNA, 2658 bp, Artificial Sequence
  Description of Artificial Sequence: Synthetic coding sequence
atggcgtggagatgtccccgaatggggagggtccctctcgcttggtgcctggcgctgtgtggatgggcttgcatggcccctcgtggtactcaagccgaggagagcccatttgtcggaaatccaggtaatattaccggagcgcgaggcctcacaggtacacttagatgccagttacaagtgcagggggaaccacctgaggtgcactggctgagggacgggcagattctggaattagccgactccacgcagacgcaggtgccactgggcgaagacgagcaggacgactggatagtagtgagccagctcaggatcactagtctgcagctgagtgatactgggcagtatcagtgccttgtctttctgggacatcagacttttgtctctcagcctggctatgtagggcttgaaggcctcccatatttcctggaggaaccagaagaccggacagtagcggcaaatactcctttcaacctgagctgccaagcgcaggggccccctgaacctgtcgatcttctgtggctccaggatgcagtgcctcttgctacagcccctggacatggtcctcagaggagtcttcatgtccccgggctcaacaaaacgagttcctttagctgcgaggcacacaatgccaaaggtgtgactacgtcccgaacagctacaatcacggtcctcccgcaacagcctcggaatctgcatctcgtctctagacagcccactgaacttgaggtcgcgtggacacccgggttgtccggcatctatccactcacgcactgcactctgcaggctgtgttgtctaacgatggcatgggcattcaggcaggagaaccagaccccccagaagagcccctgacaagccaagcatccgttccacctcaccagttgaggttgggctctcttcacccccacacaccgtatcatatccgcgttgcctgcacgtcgtctcaaggcccctcaagttggacacactggcttcctgtggaaactcccgagggcgtgcccctcggtccaccagaaaatatctccgcaactcggaacggatctcaagcttttgtgcattggcaggaaccgcgcgccccactgcagggcactctgctgggatatcggctcgcttatcaggggcaggataccccagaagttctgatggacattggccttaggcaggaagtgaccctcgaacttcagggagatggtagcgtaagtaacctcactgtatgtgtagcagcgtatacagcagcgggtgacggcccgtggtctctgccggttccattagaagcttggaggcctgtcaaagaaccatccacccccgccttttcttggccctggtggtacgtcctgcttggggctgtcgtggcagctgcgtgtgtgttgatactagccctctttctggttcacaggcgcaagaaggagacaagatacggcgaggttttcgaacctaccgtcgagcggggagagctggtcgttcgatatcgagtgcgaaagagctactcaagacgtactacagaggcgaccttaaatagtttgggaatttcagaagaactgaaggagaaactgcgggatgtcatggtggatcgacacaaagtggccctggggaaaactctgggagagggggaatttggcgccgtgatggaaggacagttaaaccaggatgacagcatactgaaagtggccgtaaaaactatgaagattgcaatctgtacacggtcagagctcgaggactttctgtcagaggccgtgtgtatgaaggagttcgatcaccccaacgttatgcgtctcatcggagtgtgctttcaaggctctgagcgagagtctttcccggcccctgttgttatactgcctttcatgaaacacggcgatcttcatagtttcctgctgtacagcagactgggtgaccaacctgtctacctgccaactcagatgcttgttaaattcatggccgacattgcttctggcatggaatatttaagtacaaagagattcattcaccgcgacctggcagctcgcaattgcatgttaaacgagaatatgtccgtgtgcgtcgcagatttcggactgtctaaaaagatctataacggcgactattataggcaaggcagaatcgccaaaatgcccgttaagtggattgcgatagagagtctggccgacagagtatatacgagtaagtccgacgtatggtctttcggggtgacaatgtgggaaattgctacccgcgggcaaaccccctatccgggcgtggaaaattccgagatctacgactatctacggcaggggaacaggctgaagcaaccggccgactgtctggacggcctttatgctctgatgagccgttgctgggaactgaaccctcaggacagacccagcttcaccgagctcagagaggacttagagaataccctgaaggcactgccccccgctcaggaacccgatgagatactatacgtcaatatggacgagggagggggctatccagaacctcccggagctgcaggtggtgcggacccccccacccagcccgatccaaaggactcttgcagttgcctgactgccgccgaagttcaccccgcaggccgctacgtcctttgcccctccactacaccctccccagcacaaccagcagacagaggcagcccagctgcccccgggcaggaggatggagcttag

SEQ ID NO: 109352 - DNA, 2439 bp, Artificial Sequence
  Description of Artificial Sequence: Synthetic coding sequence
atggagccactcggaaactggcgctcattgagggccccattaccccctatgctgctccttttactgctccaggtagcgggccccgtcggagcccttgccgaaaccctgctaaacgccccaagggccatgggtacgagtagctctccccccagtcctgcatccgttgtcgcccccgggacaaccctgttcgaggagagccggttaccagtgttcactttggactacccccacgtgcagatcccttttgagataaccctatggatcctactggctagcctcgccaagatcggatttcatctttaccacaagcttcccacaattgtgccggagtcatgtctccttattatggtaggtctgctcctaggcggtatcatctttggtgtggatgaaaaatccccacccgccatgaagactgacgtgttctttttgtatctgcttcctccaattgtactcgatgcaggatactttatgccaacaagaccttttttcgaaaacatcgggaccattttctggtacgccgtcgtaggtactctctggaacagcattggaattggggtgtcgctgtttggcatttgccagatcgaggcgtttggcctctccgatatcacgttactgcagaacctgctattcggtagcctcatatccgccgtggaccctgtagccgtgcttgccgtgtttgaaaatattcacgtcaatgaacagctttatattctcgtattcggagagagtttgctcaatgatgccgtgacagtggtactgtataatctctttaagtccttctgccagatgaaaaccatagaaacgatcgacgttttcgctggaatcgcaaactttttcgtagtcggcatcgggggcgttctgataggtatctttcttggcttcattgccgctttcaccacccggttcacacataacattcgtgtgatcgaacccctcttcgttttcctctattcttacctgtcgtacattaccgcggaaatgttccatctatccggcattatggccatcactgcctgtgctatgacaatgaataagtacgtggaggaaaatgtcagtcagaagtcttacactaccataaagtattttatgaagatgttaagcagtgtatcagaaacccttatttttatcttcatgggggtttccaccgtgggcaaaaaccacgagtggaattgggcgtttgtgtgcttcactctggccttctgtctcatgtggcgagccctgggagtgtttgttcttacccaggtgattaaccggttcagaactattccgctgactttcaaggatcagtttatcatcgcatacggtggtctgagaggagctatatgctttgccttagtgttcctgcttccagcagccgtgtttccacgcaaaaagctgttcatcacggccgccattgtggtcatattttttacggtttttatattgggcatcaccattcgcccactggtcgagtttctagacgtgaagcgttccaataaaaagcagcaggccgtgtcagaggagatttactgtcgcctgttcgaccacgtgaaaacaggaatagaggacgtgtgtgggcattggggccacaacttctggagagataagtttaaaaagtttgacgataagtacctgcgtaaactactcatcagggagaatcagcctaagtcaagcatcgtaagcctctacaaaaagctggaaattaagcatgccattgagatggccgagactggcatgatcagcaccgtgcccactttcgcatctctgaacgactgcagggaggagaagatcaggaaagtgacatcgtctgaaacagacgagatccgcgagctgctctcccggaacctgtatcaaattaggcagcgaaccttgagctataatcgtcactccctcaccgcagacacatcagaaaggcaagccaaggagatcctcatccgaaggcgtcactcactccgggagtcaatacgcaaggattcttcattgaatagggagcatcgcgcttccacaagcacttcaagatacctctccttgccgaaaaacacgaagctgcccgagaagcttcagaaaaggcgcactatcagcatagccgatggcaattcttccgatagcgatgcggatgcggggactacagtgctgaacctgcagcctagggccagaagatttctcccggagcagttctctaagaagtcaccccaatcttacaagatggagtggaaaaacgaagtggacgtggattccggcagagatatgccgtccacccctccaactccccattccagagagaagggcacccaaacctcaggcctcctccagcagccactgctgtccaaggaccaaagtggttctgagcgcgaagacagtttgactgaggggattccccctaaacccccacctcgtctggtgtggcgcgcatctgagccaggaagccggaaggcacgctttgggtctgagaaaccttag

SEQ ID NO: 109353 - DNA, 681 bp, Artificial Sequence
  Description of Artificial Sequence: Synthetic coding sequence
gccgaaggcaaatggggcctggctcatggaagggctgaggcgcacgtctggcctggccagggcggatggcgtctcggaccaccacaggggcgatggacagggtcctcacccttgttggacatcgtggggggaagaaaagcacgacctagacagttcccttttctggctagtatacagaaccagggtagacacttctgtggaggggccctaatccacgcaagatttgttatgacagcagccagctgcttccagtcccagaatccaggtgtgtctacggtcgtgttaggagcctatgacttgagaaggagggagaggcagagccgtcagactttttctatctcatcgatgagtgagaacgggtatgacccacaacagaacttgaacgatctgatgctcctgcagttggatcgtgaagcaaacctgacatcctccgtgactattctaccactccctctacaaaatgccacagttgaagccggaaccagatgccaggtggccgggtgggggtcacaaaggtcagggggcaggctgtctcgctttcctcgcttcgttaacgttacagtcactccagaagaccagtgccggcccaataacgtgtgcactggggttttgacacggagaggcggaatctgcaacgttagcgccccttgcggcggaaggcggggccccgaaagatattag

SEQ ID NO: 109354 - DNA, 7875 bp, Artificial Sequence
  Description of Artificial Sequence: Synthetic coding sequence
atgttcagacgcgcccgcttgtcagttaaacccaatgtcaggcccggcgtcggcgcccgaggcagtacagctagcaacccccagcggggccgggagtcacctcgccctcccgaccctgccacagattccgccagcaaacccgcagagccgactgacgtgccgaccgtggatttcggtggtgcggaaccccaggaaaaggcaccccgctcatcgaccgagaaaacaggcggcgataatgacgtggaagaatcttctcgttcaagtagcactgtatctcagcgcaggaaacgcattagcagtacttcaagcctcgttaagtcttcagtctccgtgccttctgagtcacacccactctccaccataaaccaggaggccccccagccgaccgcaacaagtaccaaagagaagcagccttgctcagataggtaccgcatttataaagcccagaagctgcgtgagatgctgaaagaggagctgcgcaaggagaagaaacagtggaagaataagtatgcaattaatgaaagccagcgtccaccggacagaagcaaaatgaccatgcgagatttcatttattacttgccagacaacaatcctatgaccagctcgctggagcaggagaagaagactgaaaaaccttcaacgccggtccagactcgggagcaagaaggcaagagtactcccaacgccgaagataacgaaatggaagaggagacggacgacggaccactgctggtgcctagagtcaaggttgccgaagacggctcgatcatcctggatgaagagtcccttacagttgaggtgctaaggacaaaagggccatgtgtggtggaggaaaacgaccccatcttcgagcgaggttctactactacctatagttcttttcggaaaaactactatagtaagccctggtctaacaaggaaacagatatgtttttcctggctattagcatggtcgggaccgacttctcaatgatcggccaactgttcccgcaccgcgcgcgaattgagatcaaaaataaatttaagagggaagaaaagaccaatggctggcggattgataaagccttccaggagaaacgcccattcgatttcgacttctttgcccatcttctgcagaaggtcctcgccgaggaagagaaacgaaaacagaaaagcgtgaagaatcatagcttgaaagaaaagaaatccactaagcctaggaagaatgttaaagtcaaaaaggtggcctgtgagggcgttaataacgacccagacgagagcatgagctcgcgcataagtgacactgaacgtagccagaaagatgctcagacagttgaggaagagtcactgaccctgtcaagggaggacgccgaacaagtggcactggaagtggatctgaaccagaagaaaaggcggcgtaagaagcaagacggagcgaacgagctgggagtgaacaatttactggagaacgcgaccgtgcaggccgggcccagcaagggcgagaagcataagaacaaatgccaagcaatcaggccggaactgaaggagggagagtgcagcaaagaacagatgctgtcttgtactcagaatatcgacggcatcgtcggcttcgcctctactgagaaggttgagaaacggaccgaccctatcctgtctctctcaaaccagcaggatgcaacttcagtggccacagagtcttctgagtcatccacgtccgatctgcccagcttcgaagttgggatacgggcactgtgtgaagtaaataatgcggaaggctcttgtatcgaagagagaaatgtggacctgaaaaacaacagtcttgaaattgatcagacggagaatgtgaagccgatgctccgggggcgcttccaacgccctaagccaaacctgtcaagggctgggaaaaagagcgtcctcagccaaggtaagaccgaaagcgagagtaaaaattcacatagtaagacctccgtggaaaagaaccacgtggagaaggataagatgaatacactggatattctgagaatggagacaaccgagagggaaaacccagaggctgaaaccgtgtcagttctgggagaaaaaaattgtcttcaggaaggaagtcagctcaaagctttgcgcccagttcaggttcggggtcggttacaaaagcccaaacctaatgctggaaaggccgctgaacggaaggagatccttatcagccaggaggaaattggggccaacgtagaaaaaaatgagaatgaaagctgtgcagatcgcgacaccccacagcacatggaagatcaatctaggaaggattttgaagaagaggatgtgatactccagccagaaaaaaatgacagtttccagaatgtgcagccggacgagcccaaagtgctgaacgagtgcctctctgtgcaggagaacaataaggctaataagttgaaccaggttccaattttgcgtaccaggttccagaagccgaagccaaacataggtagagggaccggcagacgcgaaatatcatctaaagaggaggtcctggagaagatcctggtcagcggcgaaatggccgctgccttgcgggaaacagttcgtttagacacgtctcctaaagaaatggtgcctgcggaaattaatacaaaagaaatgcagagtgacctgaaagagacagggcgtcgcgctattagccctcgcgagaagatactagacgtcattgacgatacaatcgaaatggaaaccgggcttaaagccatggggcgggagatctgcttaagggaaaaaacccccgaagtcattgacgctacagaggaaatagacaaggatctggaagaggctggaagacgagaaatctctccacagaagaacggccctgaagaagtaaagcctttgggagaagttgaaaccgacctgaaagctactgggaatgagtctagtcctagggaaaagactcccgaggtgaccgacgccaccgaggagattgacaaaaacctagaagaaacaggaagaagaaagatcagccctagagagaacggccctgaagaggtgaagcctgttgacgagatggagacagacctgaacgcaaccggacgagaaagctctccccgggagaagacccctgaagtcattgacgctaccgaagagattgatctcgaggagaccgaacgcgaagtgagccctcaagagaacggcttagaggaggtaaagcctttaggcgaaatggaaaccgacctgaaagcgacgggtagagacagttttcctaggggtaagacccccgaagtgatcgatgccattgaggaaatagagattgacctagaggaaaccgaacgagagatcagtccccaggaaaacggactggaggaggttaagccactaggcgagatgcagactgacttgaaggctacaggccgcgaaatatctccacgcgagaagacaccggaagtgattgatgcaacagaggaaattgataaagacttagaagagactggccgccgcgaaatcagccccgaagagaacggcccggaggaggtaaaaccggtcgatgagatggagacagatctgaagactactgggcgtgagggctcttccagggagaagacacgggaagtcattgatgcggctgaggtgatcgagaccgatctggaggagactgaaagggagatttctccgcaggaaaatggcccagaggaagtcaaacccgtaggaaagatggagaccgatttgaaagaaattcgagaggaaatctctcagagagagaaagtcctggccgagtttagtgctataagagaaaaagagatagacctaaaagagacaggcaaacgggatatcccaattatggaaaaagtaagcggtaagatggctgtcgtggaagagatggaagcggacctgaaagagacaggcaaagaaaatttcagagaacggggcagcgaagagatttgcgtcaccgaggaaaaagtggcagagttaaaacagaccgggaaaaccgacattagcccgagagaaaatgagttagaggagaccagcacatcacggcaaacggatacccatctaatgcagtcaggatccaatgatttcagtgcagttccctcactggacattcagaacatctcaagtgaggtcctcagtatgatgcacactccagtggaagaaaagagaaattcagagaaggaagtgtccagccatttttcacatttcaagatcagttctcagacacatgagtcagacaagaccgaggtgcaagggattcagtcccccgatgtgcctgagcagttctccgacatcaaccttagcaaaagtctcccccaggagcaaaaacccctggaaattaaaccagcgccctttgtgcgcagtcggttcaaacgacccaagcctaatttggcccgcgcagcgctgaagcgggagaccacagaatcagaaaagtacatttacgagaagaagtcagagaccaagaagatggagactatcgtgatgcaggaaaacaacgaacaaaccgatacactgccctcacagcatgacgaagcatccctgatgatcagcagagaaaaggatacgctgggtcatcggaatgaggaagctgtaatccttccgtgtacccagacagagcgtaatctctctcccagcaacagctgcgaacctaaggaggagtctcagagcgcacctgtccagaagaatgatagtgtggtgtccgttggcacaaataatgtcaacacttttcagcaggagatgaaagagtcggtgatacagacggcaagacaggtgcggggcaggctacagcggcccagacccaatattaggaagacaggacagcgtcaaatcgtggacaagggggaagctaaaggcatcatcaaggaagggcgaaccatactgccgaaagatgagaccgaaaagaaggtgctgacagtgagcaacagccagatcgagactgaaattgaagttccctcgtcagcagtacccgaacatcgcatgtacgaaaatcagtctcaggttgtgttggtggaaaatctccacgttaataagactaacgagaccattcggcacgagaataagccgtatgtccccagctccgcccaaatgaccagacgcaagtttcaaaaagcgaagcccaacctcggccgggcccactcaaagaaagaggagcctgttctcgaaaaagtgactactgatcagtcaaaggagggcaaacccgaggatcacctgctgcagaaaggcgcgagcaacacccagctactactcaaagaaaaagcagagctgttgactagtttagaggtctcagcacggaaagactgcgtgggctctaaagagagcgcgctcgcgaagattgacgctgagctggaggaggtcggtccgtctagacgagtgggtgaggagactgtcggagacaactctccttcgagcgtggtggaggaacagtatttgaacaagctgaccagttgtccacaaccccttaacgaaacctcttactctaagattgccctggacggaaagactaccatctcctctaccagcgaatacgagcggaatcgcggggaacggaggtcccataaaaaatttaaacccaacgtcacgcggggtagagggagcaagagggtgcgtggcaagacatccaagaaagaaccacgtgcttccaaggcaatgttagttaccctgagggccagccaggaagaagacgatgacgctgacgacttcgaatccgactatgaagaggaaagttatcacctggcaccggaggaggtcaataaggctcccgtctttgtgccggtaggcctgagatctccagagcccgtctccgctcagatcgaagagaccatggaagagctcgaaatcactgttaacgttccggacgttggttgtatcgctgttgtcgagcacgagttgcctaacaccgatgttaccacggaagagatgaagcaagaagagaatctctctgtcccgttcgagatgacgactagtgagcacatccaggacgagcccgggacgaatgacgggagcactgaggcagctataaccctcctcaccatgggagatctcgtgctccaaagtgagatctcctccgaacaaggcgatgtgggggtgtgcatcatccctcatgtgcactccaaagacaagagccatatacccagtagcttggacaatgtcaaccacaagatcgtgcacgagtgccaagagctgtcttcacctgtgatcacgacatcccctgcatctttcgaggagaataaaattgtcctagaagagcagagttccagagaggagatcagcctcatggaaaaagtgaaagagaatgcaactccaacaaggaacaccatctccaaagtgactagcaatttaaggattcggtcaaggttagcaaaacctaagcctaatctggagaagactctgggtacgaatagacttgatgattatcaggaagtatcttcactgtgtgtcaccaagggggccgaaatggaaacacagagggagaccgagaaaaacgcatccaaggccacagagctcgaaaataagaaccttgggcctgtgacaaccgccgaaaacaaggatcagagcaagctggcttgtgtccacgggattaaagggacctctatctctagcgaggtaaacctgactgaaaggaatgaaaaccaggaggagagcagccaggaagtgcatatgctgagcgtggccccagtggcctcctccgagacgggcccatgcacactcggattagatagaggactgggagaaaacagcgttgaggagccccagattaaagattccaagggtgacagcgtattgacgctgccggtccccgagtacacccccacctccataccagaagttcagcaggagaatatcattaatcctcaagacctaacggtgaacctggtagcaaacgtgcctcaggacggcgaagatgagcaggcgtttatcttgacacttgtagagatccctgctaatgccgttgaggaatttacggatgccactgctcagttcatgccaaatcccctcctccctgcacccatacttgtcaagagcgtgaataccgaagaaagaggcgacatgtcaatttgcctgccagccactagtgtgggccaggacgccatgggattaagtatctctggcagggacaactcgaaaaagcctcctgacaatctggatctggtgagcagaaagcgcttccagtgtcgcttggacaagaacgatcacatcccgccagctaagaaaagatcacttaccttgcgcgatgactgccaggaatatactacggaggttcactcaaaggagctgaccaatgtcttcgaggagacaggggagtcccacaaagggcaggatatttttctcacctccggttctacactcaccactcctgagccccagaggcaacaggtggaagccgccttccaaagcaggggctcaaggagccctgacgcgtgtatggacaaaaatgtcccgcagctccctcaggacgagatgattgtatctgacaaggaagaaaggaccgacgccgctcccaaaagccagcagatggatagcaggacctcctcttccaaagcttcattgagtcggcctgggcgccgaccgctggggtttctttccctgatctgtagcaagaattccctggagtccgacgagcctatgcaggttcacagcaaaaagcgattgaagcctctgattccaggactacggaagaagcttaagcgctctaacccttttaacgagtcacaggagaagaacagggagtctagcgacttattgccttcccccagtgtcatcacgacgcaatctgagaatatctcctcatctgccacccaggttagctgcgaccaaccactgctgaaggagggatacaagtcggcccagaagagagctccccagggtgaggccaccaccgtaagtgagtattttttcaatgatatcttcatcgaggtagatgaaaccgagtag

SEQ ID NO: 109355 - DNA, 1392 bp, Artificial Sequence
  Description of Artificial Sequence: Synthetic coding sequence
atgctggtcactctcagggcctcccaagaggaggacgacgacgccgatgattttgagagcgactacgaggaggagtcttaccatctcgctccggaggaggtcaataaagcacctgttttcgtgccggttggcctacgcagcccggaacctgtcagtgcccagatagaggagacaatggaggagcttgagattaccgtgaacgtcccggacgtgggctgcattgcagttgtagagcacgagctgcccaacaccgatgtaacaaccgaggaaatgaagcaggaggagaacctaagcgttccttttgagatgaccacctccgaacatatccaggatgaaccaggcacaaacgacggatcaacagaggccgcgataacccttctgaccatgggcgatctagttctccagagtgaaatcagctctgaacagggcgacggcgtgtgtataatcccacatgtacattctaaagacaaatcgcacatcccgtcaagtctcgataacgtcaaccataagattgtgcacgagtgccaggagctcagcagcccagtgatcactacaagcccggcgagcttcgaggaaaacaaaatcgttttggaagaacagtcatcccgcgaagaaatctctctgatggagaaggtgaaagaaaacgccacaccgacacgcaacacaatttctaaggtgacctctaaccttaggatacggtctaggctcgccaaaccgaagccaaatctagagaagaccttgggtaccaaccgcttagacgactaccaggaggtgagcagcctgtgcgtaacaaagggcgccgagatggagacccagcgcgaaaccgagaagaacgcttccaaagccactgagcttgagaataaaaaccttggaccagtcacaactgccgaaaacaaggaccagtccaagttagcgtgcgtccacggaattaagggtacctcgatttcctctgaagtgaatttgaccgagcgaaacgagaatcaggaggagtcgtcacaggaggttcacatgctaagtgtagcaccagtggcatctagcgagacaggcccttgcacacttggtcttgaccgaggcctgggcgaaaattccgtggaggagcctcagataaaggactcaaagggtgactctgttctcaccctgcctgtgccagaatacacccccacttctattccagaagtgcagcaggagaacatcatcaacccccaagacctgactgtgttcgtgtatcagcaactgcagctcgtgaaaatgccctgggtgtacctgtttctggaagagataattctgaagagcagactgattatctggatcctctacctaggaagagatttcaacgctggcttgattaagatgactacattcttactgcccaaaaacgtgcatagcttgtag

SEQ ID NO: 109356 - DNA, 2445 bp, Artificial Sequence
  Description of Artificial Sequence: Synthetic coding sequence
atgtttcgccgggctaggctctctgtgaagcccaacgttcggccaggggtgggggcccggggcagcacggcaagcaatccgcaacgcggtagagaaagccccagacctcccgatccagccactgattctgcttccaagcccgccgagccgactgacgtgccaacggttgatttcggaggagccgaaccacaggagaaggcacctcgatcaagcaccgaaaaaactgggggcgataacgacgtggaggagagctcgagaagcagctctaccgtgtcacagcggaggaagaggatctcgtctaccagtagtctggtaaagtccagtgtctccgtgcccagcgaaagtcaccccttgtccaccattaaccaagaagctccgcagcctactgccacctccactaaggagaagcagccttgttccgatcgataccgaatatacaaagctcagaagctgagggagatgctgaaggaagaacttcgtaaggagaagaagcagtggaaaaacaaatatgcaatcaatgaatcccagaggccccctgatcgctcaaaaatgaccatgagggacttcatttattatctgccggacaataacccaatgacctcttcgctcgaacaggagaagaagaccgagaagccgtccaccccagtccagacacgggaacaagaaggtaagtccaccccgaatgctgaagacaatgaaatggaagaagagaccgatgacggtcccctgctggtgccccgcgttaaagtcgctgaggatggctctatcattcttgatgaagagtccctgacagtggaagtgctcaggaccaaaggtccatgtgtggtggaggagaatgatcccattttcgaacgcggatccacgactacttattcttctttcaggaagaattactacagcaaaccctggtcaaacaaagagacagacatgttcttcctggccataagcatggtcggaacagactttagcatgattggacaattattccctcacagagctaggattgaaatcaagaataaatttaaacgcgaagagaagactaacggatggcgcatagataaggctttccaggagaagaggccatttgatttcgattttttcgcacatttgctgcagaaggtgctggccgaggaggaaaaacgtaagcagaaatctgttaagaaccactctcttaaggaaaagaaatctacaaaaccgcgaaaaaacgtcaaagtgaagaaagtggcttgtgagggggtgaataatgaccctgacgagagcatgtcaagccgtatatccgatacagagaggagtcaaaaggatgcacaaaccgttgaagaagaatccttgactctttctagggaagacgccgagcaggtggctttggaggtggatctcaatcagaaaaaacggcggcggaagaaacaagacggagccaatgagcttggcgttaataacctgctggagaacgcgacagtgcaagccggcccaagcaagggcgaaaaacataagaacaagtgccaggccatccggccggaactcaaggagggtgaatgttccaaggagcagatgctgtcttgtacacagaatatcgatggcatagttggttttgcctcaaccgagaaggtggaaaagagaaccgatcccatactaagcttgagtaatcagcaggatgccacttcggtcgcaaccgagtcaagcgagtcttcaaccagcgaccttccaagttttgaggttggcattcgtgccttgtgtgaggttaataatgccgagggaagctgcatcgaagaacgcaacgtcgacttaaagaataactcccttgagatcgaccagactgagaatgtgaagccgatgctgcgcggtagatttcaacggccaaagcccaacctctccagggccggtaaaaaaagcgtcttgtcccaagggaaaaccgagtccgaaagtaagaattcccactccaagacttctgttgagaaaaatcatgtcgaaaaggacaaaatgaacacattggatattcttcggatggaaactaccgagcgcgagaatccagaagccgaaaccgtgagcgtactgggagaaaagaactgtctgcaagagggatcccagctgaaggcactgcgccccgtgcaggtcaggggtcgtctgcaaaaaccaaaaccaaacgccggcaaggccgctgagcgcaaggagatcctgatctcacaggaagaaatcggagccaacgtggaaaagaacgagaacgagtcctgtgcagatcgagatactccacagcacatggaggatcagtctaggaaagatttcgaggaggaagatgtaatcttgcagcccgagaaaaacgactccttccagaacgtgcagcccgacgaaccaaaggttcttaacgagtgcctgtcagtgcaggaaaacaacaaagccaataagctgaatcaagtgcccattctgagaaccaggtttcaaaaaccctag

SEQ ID NO: 109357 - DNA, 2541 bp, Artificial Sequence
  Description of Artificial Sequence: Synthetic coding sequence
atgttccgacgggctcgtctctccgttaaaccgaatgtaagaccaggcgttggagctcgcggaagcaccgcgagcaacccacagagagggcgggagagtccccggccccctgaccctgcaacagacagcgcatctaaacctgcggagcccacggatgtccccacggtcgattttggcggcgccgagccccaggagaaagccccacgatcctccaccgagaaaacagggggtgataacgatgtggaagagagttcgcgaagctcatcaacggtctcgcagaggcgcaagcgcataagctcgacttcctctctcgtgaagtcctccgtttctgtcccttcggagtcccatccactcagcacaattaatcaggaggcaccacagccaaccgcaacatccacaaaagaaaaacagccctgctccgaccgctatcgaatctataaggcccagaagctgcgggagatgcttaaggaagaattgagaaaggaaaagaaacagtggaagaataagtatgccatcaacgagtcccagcgccctcctgaccgatctaagatgactatgcgtgatttcatttactacctgcctgataacaatcccatgacgagtagtttggaacaggaaaaaaaaaccgaaaagcccagtacaccagtccagaccagagaacaggagggcaaatcgacaccgaacgccgaagataacgagatggaggaggagacagatgacggaccactgctggtgcctcgcgttaaggttgctgaggacggttctattatccttgatgaagaatccctgacagtggaggtactccgaactaaggggccctgcgtggtggaagaaaatgatcctatatttgaaaggggttctacaacgacgtattcctcttttcgcaaaaattattacagcaaaccttggtcgaacaaggagacagacatgtttttcctggccatttctatggtggggactgacttttctatgatcggccagctttttccacaccgagcccggatcgagatcaagaacaagtttaagcgggaggaaaaaaccaatggatggcggatcgacaaggcattccaggagaaacgcccctttgacttcgacttctttgctcacctcctgcagaaggtgctcgccgaagaagaaaaacgcaagcagaaatccgtgaagaaccacagtttaaaggagaagaaaagtacaaaaccccggaagaacgtgaaggtgaaaaaagtcgcctgtgaaggagtgaacaacgatccagacgaatcgatgagtagtcgcattagtgatacggaaaggtcgcagaaggatgctcagactgtcgaagaggagagtctgactctgtctagagaggatgctgaacaagtggccctggaggtggatttgaaccagaaaaagagacgacggaaaaagcaagatggcgccaacgaactgggggtcaacaatctgctggagaacgcgaccgtccaggccgggccttcgaagggcgagaagcataaaaataagtgccaggcgatccgacccgagctgaaggaaggggaatgttccaaggagcagatgttatcctgcacccagaatattgacgggattgtcggcttcgccagcacagagaaggttgaaaagcgcaccgatcccattctgagcctgtcaaaccaacaagacgccacctcagtggctacagagtcttctgagtccagcacctccgacctgccttccttcgaggtggggatcagggctttgtgcgaggtgaataatgccgaaggatcctgcattgaggaaagaaatgtagatctcaagaacaatagtcttgagatcgaccaaacagagaatgtgaaacctatgttgcgtggacggtttcaacgccccaagcccaacctcagtcgcgccgggaagaaatctgtcctctctcaaggcaaaaccgaaagcgaatctaaaaatagtcacagtaagaccagcgttgaaaagaatcatgtcgaaaaggataagatgaatacactggatatcctcagaatggaaacaactgaaagagaaaatccagaagcagagactgtctcagtgctgggggaaaaaaattgtcttcaggagggctctcaattgaaggccctccgtccggttcaggtgaggggcaggctgcagaaacctaaacccaatgccggtaaggccgccgagcggaaagagattctgatttcccaggaagagattggagccaacgtggaaaaaaatgagaatgaatcatgcgccgaccgcgatacgccacagcacatggaggatcagagcagaaaggacttcgaggaggaagacgtgattctgcagcccgaaaaaaatgactcgtttcaaaacgtgcaaccagacgagcccaaggttctcaacgagtgcctaagcgtgcaggagaataataaagctaataaattgaaccaggtgccaattctgcggactcgtttccagaagcctaagcctaacattgggcgggggaccggcagaagagagattagttccaaagaggaagtgctggaaaaaatcctgagcctgggtaaatggcgccagcactag

SEQ ID NO: 109358 - DNA, 6399 bp, Artificial Sequence
  Description of Artificial Sequence: Synthetic coding sequence
atgtcgagtagaatcagcgacaccgagagatctcaaaaagatgcccagacagttgaggaggaatcacttactctgtccagagaggatgccgagcaagtcgcactggaagtagacctgaatcagaagaaaagacggcgaaaaaagcaggatggggcaaacgagttgggcgttaacaacctccttgagaatgccacagtccaagcagggccttcgaagggagagaagcacaaaaacaagtgccaggcaatacgccctgaattaaaagagggtgaatgtagcaaagaacagatgctgtcttgcacacaaaacatcgatggtatcgtgggattcgcttctacggagaaagtcgagaagcgaacagaccctatcctgagcctgtctaatcagcaggatgcaacaagcgtggcaactgagagctccgagagttccacctccgacctcccatcatttgaggttgggattagggcattgtgtgaagtgaataacgctgagggctcttgcatcgaggaacggaacgtggatttaaaaaacaattccttagaaattgaccagaccgaaaatgtgaaacctatgctgcgcggacggtttcaacggcccaagcccaacctgtcccgggcgggtaagaagtccgtgctctcccagggtaagacagaatcagagtctaagaactcacattcaaaaaccagcgtggaaaagaaccatgtggagaaggataaaatgaataccctggatattctcagaatggagactactgaacgggaaaacccagaggccgagaccgtctcggtactgggagagaagaattgcctccaggagggaagccaactcaaggctcttcgcccagtgcaggttcgcggacggctccagaaacccaagcccaatgccggcaaagcagcagaaagaaaggagatcctaatctcacaggaagaaattggggctaacgtggaaaagaatgagaatgagagctgcgccgatcgggacaccccacagcatatggaagatcagtctcgaaaagacttcgaagaggaggatgtgattttacaaccagagaagaacgacagcttccagaatgtgcagcctgacgagccaaaagttctgaacgagtgcctgtctgtccaagaaaataacaaggcaaacaagcttaaccaagttcccattttaagaacgagattccagaagcccaaaccaaacatcggtagaggtacgggccggcgtgagatttccagtaaagaggaggtgctggaaaagattctagtgtctggtgaaatggctgcggccctgagagaaacagtgagacttgatacatctccgaaggaaatggtgcccgctgaaattaataccaaggagatgcagtccgatctcaaggagaccggcaggagagcgatttctccaagagagaagatcttggatgttattgacgacactatcgagatggagacagggctaaaggctatggggagggaaatatgccttagggagaagactccagaggtaatcgacgcaacagaggaaattgacaaggatttggaggaggcaggccgccgggaaataagcccacagaagaatggtcctgaagaggtcaagcctcttggagaggtggagacggatctgaaggccacagggaacgaaagctcgccccgagagaaaactccagaagtgacggatgcaactgaagagatagacaaaaacctagaagagacaggccgccgaaagatctctcctcgcgaaaacggccccgaggaggtgaaacctgtggatgagatggagactgatcttaatgcaacgggtcgcgagagtagtccacgagagaagactccggaagtcatagatgccactgaggagattgatctcgaggagacggagagggaggtgagcccacaggagaatgggttagaagaggtgaaaccactgggcgaaatggaaacggacctgaaggccactgggcgagattccttcccccggggcaagacacctgaggtgatagacgccatcgaggagatagagattgatttagaggagacggagagagagatctctcctcaggaaaatggcttagaagaagttaagccactgggcgagatgcagacagacctgaaggccaccgggcgcgagatttctcctcgcgagaaaacgcccgaggtgattgatgcaacagaagagattgataaagacctggaagagaccggtcggagggaaatcagccccgaggaaaatgggccggaggaggtcaagccagtggacgagatggagaccgacctcaagacaacaggaagggaagggagctcgcgagagaagaccagggaggtgatcgatgcggctgaggtgattgagacggatctcgaagaaaccgagcgcgagataagtcctcaagagaatggacctgaggaggttaaacctgtgggcaaaatggagactgatcttaaggagatacgagaggaaattagccaaagggagaaggtgctcgctgaattcagtgcaattagagagaaggaaatcgatctaaaggagactgggaagcgcgacattccaatcatggagaaagtgagtgggaagatggccgtcgtagaagagatggaagctgacctgaaggaaacgggcaaggaaaattttagagaacgcggtagtgaggaaatctgcgtcactgaggagaaggtggctgaactgaaacagactggtaagacggatatttctccacgcgagaacgagcttgaggagacttctacttctagacagacggatactcatctgatgcagagcggcagcaacgatttcagcgccgtgccgtcattggatatacagaatattagtagtgaagtgctgagcatgatgcatacacccgtggaagaaaagagaaactccgaaaaagaagtcagcagccatttctctcactttaagatctcttctcagacccacgaatccgataaaaccgaggttcagggaatacagtcacctgatgttcctgagcagttctcggacattaacctgtctaaaagtctcccacaggagcaaaaaccgctcgagatcaaaccagcgccttttgtgcggagccgctttaagcgccctaagcccaatttggcccgagctgccctgaagcgggagaccacggagagtgaaaagtacatttacgaaaagaaaagtgagacaaagaagatggagaccatcgtcatgcaggagaacaacgagcaaaccgacacattgccttcccaacatgacgaggccagcttaatgatatctagggaaaaagacaccttaggccataggaatgaggaagctgtgattctaccatgcacccagacagagcgcaatctatctccttctaactcctgtgagcctaaagaagagagtcaatcagcgcccgtgcagaaaaatgatagcgtggtgtctgttggcacaaacaacgtaaataccttccagcaagagatgaaggaaagtgtcatccagaccgctcgccaggtacgtggtagactgcaaaggccgcggcccaatataaggaagactggccaacgccagattgtggataaaggcgaggccaagggcattatcaaagaggggcgtaccatcctgccaaaagatgagacagaaaagaaggtcctcacagtatccaacagtcagattgagactgaaattgaagtgccctctagtgcagtaccagagcatcggatgtatgaaaatcaatcacaggtggtgctggtggagaatctccatgtcaataaaactaatgagacaattcggcacgaaaacaaaccatatgtgccatcttctgcgcagatgacccgaagaaagtttcaaaaggccaaaccaaatttagggcgtgctcactcaaaaaaggaagaaccggtgctcgagaaagttaccactgatcagtccaaggaggggaaacccgaagatcatctcctccagaaaggcgcctccaatacacaactgctgctcaaggaaaaagccgagctcctcaccagcctcgaagtgagtgcaagaaaagactgtgtggggagcaaggaaagcgcactggccaaaattgacgctgaactagaggaagtgggcccctcacgccgggtgggcgaagagacagtcggcgataacagcccaagcagcgtggtcgaagagcagtacttgaacaaacttacttcttgccctcagcccctgaatgagacgtcctattccaaaatcgccctcgatggtaagactactatctcttctacctcagagtacgaaaggaatagaggcgaaagaagatctcacaagaagttcaagcccaacgtgactcggggacggggctcgaaacgcgtcaggggaaaaacttctaagaaggaacctagggctagtaaggccatgcttgtcactctccgggcatctcaagaggaagacgatgatgctgacgattttgagtctgattatgaggaagagagctaccacctcgccccagaagaggttaataaagcgccagtgtttgtccccgtaggcttacggagccccgaaccagtgtctgctcagattgaggaaaccatggaagagctagaaattaccgtcaacgtccccgatgttggttgtattgctgtcgtggaacacgagctgcctaatacagatgttacaactgaagagatgaaacaagaggagaacctgtcagtgccttttgaaatgaccacatctgagcatatccaggatgaacccggcgtgtgcattattccacatgtacactcaaaagacaaatcacacataccatcctccctcgataacgtgaatcacaaaattgtccacgaatgccaggagctgagttcgcccgttatcactaccagcccagcatccttcgaggaaaataaaatcgtactcgaggaacagagctcccgtgaggaaatctccctgatggagaaagtgaaagaaaatgccaccccaacccgtaacaccatcagcaaagtcacctccaacttaaggattaggtcccggctcgccaagcctaaacctaacctggaaaagacattgggcaccaaccgactggatgactatcaggaggtctcatcgctttgtgttactaagggcgctgagatggaaactcagagagaaactgaaaagaacgcatccaaggcaaccgagttggaaaacaagaatcttggacccgtcacaacagcagagaacaaggaccagagtaagttggcctgcgtccatggtattaagggaacgagtatcagcagtgaggtgaatctgacagaaagaaatgaaaatcaggaggagtcctctcaggaggtgcacatgctctcggtggcaccagtcgctagtagtgagaccggaccttgcaccctcggtttggaccgcgggctgggggaaaactcagtggaggagcctcagatcaaggactctaagggcgacagcgtgctgactctgcctgtacccgaatatacgcccacttcaattcccgaagtgcaacaagagaatataattaatccgcaagacttgacagtgaatcttgtggctaacgtaccgcaagacggtgaggatgagcaggccttcattcttacactcgtagagatccccgctaacgccgtggaagaattcacagacgctacagcccagttcatgcccaatcctctcctgccggccccgattctggtgaaatcggtgaatacagaggaacgcggcgacatgagtatctgcctaccagccacctcagtaggccaagacgccatgggactctctattagcggtcgggataatagtaagaaaccccccgataacctcgatctagtaagcagaaagcgctttcagtgcagactcgataagaacgaccatataccacccgcgaagaagcggtccctcactctgcgagacgattgccaggaatataccacagaggtccactccaaagagctgactaatgttttcgaggaaacaggcgagtcgcataaaggtcaagatatttttctgaccagcggatccacactgacaacgcctgagcctcagcgtcagcaggttgaagcggccttccagtcccgaggttctaggtcccccgacgcatgcatggataaaaacgtaccacaactgccgcaggatgaaatgatagtgtcagataaagaagagagaacggatgccgccccaaaatcccagcaaatggacagtagaacaagctcaagcaaggccagtctctcccgcccaggcagaagacctctgggattcctgtcactgatctgtagtaaaaatagcctggagtccgacgaacctatgcaagtccactctaagaagagactcaaaccgctcatccccggcttgcgtaagaaactcaagcgctctaacccctttaacgaatcccaggaaaagaatagagagtcctccgacttactccccagccccagtgtgattaccacccagtctgagaacatctcttcctccgccactcagtcgcccttttag
